United States Patent 7,468,248 (METHODS AND SYSTEMS FOR INFERRING BOVINE TRAITS) - sequence listing, part 5

SEQ ID NO: 28265 - DNA, 1466 bp, Bovine  19866880825870
acctcatgtgaagagttgactcattggaaaagaccataaggctgggaaagattgagggcaggaggtgaaggggacaacagaggatgagctggttggatggcatcacagactcaatagacatgggtttgggtggactctgggatttggtgatggacagggaggtctggtgtgctgcagttcctgaggttgcaaagagtcagacatgactcagcgactgaactgagctgaactgaactgattaaagttcagtgttaaagttaagaaaaagtagacttaagtagacattactaactgagcaggaaaaaaattaggcctccaaagaatatgtaataaaatgctgttcctagactgggaagaagtttagataagtaagaaatctattttactcaatatatttaggaaatttatgaatatgagactcagcattttaccccaggcatgattttcagaaataaatttaatgacagaattgtaggattttcaatttacctatcaaactactaggaaattttattttatatgattcataaaatcttcacatcactttctcaaagtttatttacttttcacttgaatttcaatacaaacaagtgattttcatttgtggtcatttcttttatcactctaccactttagttttatactagtaccttttctgacagcaaagccacagattgttaagagatactactaaactaattttccatattagagctataacaaaagagaaagtactccagtaagttctgcctttaaaagcatgtatgccctcgaatacctgcaatagggcttacaaatgagaagtccttgttcaaattaagctgcatgcatcatgtgtcaaagttaaaataagcaatcgcaaattacaaagacagaataaagatattctgtcattttggtacaggtagtggggaaagtatgaaagcaaaagagatcatatatcaacagtctcactgttgtatagttattgaaccttcgtaagcaggaattcccaagtgattactcagtgctgaaggtccagacttattacataaagtatctatcaaagccaagatgatgattgataagcaacttctgtgtgattaatgggtacaggagtacaaagcaaaggagatttaaaaagccaatgggttttattgatagagtcaacctcaactctcaacaaggcaaaatactcatttaatcagcaacccagtaagctgcttagaaaaatacttctctgcccaggtgaaaaactagcatgagcttgtagatgatagcacatttaacaaattcattcatgacattcaataagaaaattatttctcgaaagcaactaaatcaaaattgtcctttaatggaagaacagggttttatctcatctagaaaacctcttgagttcagttgaaaaaatacactgaagctgctatagattaaattaagaatgcaaaaccaatacaatattgtaaagtaattagcctccaatt

SEQ ID NO: 28266 - DNA, 1272 bp, Bovine  19866880894161
taactagagaatccccgtggacagaggaacctggtggactacaggtccatggggtcacaaagagccagacacgattgagcacactccccacctcgcacaccacattaggtgtgcaatgacacaccacttgttcaattggtgattttaactcagatgatgagactgagagctgacttcattaatctccttacttatatgaagaagtattaaatgaaagattctaggcagctgctggtcattttgaataagaagaaatgccttaaagggaagcaagaaagaaatggactagacatgagaaagaacttcaaattgattagatattgagaatattccaagtaatggtcataaaatggtcctatcagataccttcaaagcagagaaaaacttttttaaacttttacaaaatcctccaaggagactatcttcaatgggtccataaggttcctgcctgttcactgagacttcattaagtcctgattccctctgcttccttaggagtgcattccctgtctcagaatttgaaatcaaaatatcaagcaatttagatgttgattaattaaattctgcctttcaaattttcaggtattaaagaaattatccaataagaggaattattttctctgcactaagaatggagtgaggtgccatcaccatgtacacactgcaaagcaatatgccctcactctgaggcacaaaactggtattactcatcttttcataaattattttaattcagttctggaaaaacttttaatatagatactttccctttctccatccacatactcatttgcattttcagtttctaggtttgtaatatatatattaaaaaatactatttaaatgtatagtcctttgagattaactgctttcttcagtttacatatttacagagaaatggtacaggcccaaagtcactgtaaataattggtgggaaaaaagatcaaattagatcaatgtgtttttgccaaagcccatgtggcccagaggctttttttagatgtacatggcattgtgttcatctattgctctgtatttctcattctatgctcatctctgggtgatatcattcatgcccaggaattgtcaagtgttatcaagaagacctacagcctttactctgaatgctggactcatctagcaactgcaacctgatatttccttttggacatttcaaatgcctctcaaaatctaccaatttaaactttaactcatgaacttttcctatgtcctcctctgctaaaacgcatggcctcctccaagggatgtctg

SEQ ID NO: 28267 - DNA, 1431 bp, Bovine  19866880964356
aaactctgcattcaaatgggtatgtatttccttttttcctttgtcttttgcttgtcttcttttcacagctatttgtaaggcctccccagacagccattttgcttttttgcatttctttttcttggggatggtcttgatcactgcctcctgtacaatgtcatgaacctccacccatagttcttcaggcactctgtctatcagatctagtcccctgaatctatttgtcacttccactgtttaattataagggattttatttaggtcatatctgaatgacctcttcactttcacccttcaccttcaccttgtcctgttctcttcattcacagttatgttgctctttagttagttcttcaaaaatgtcaaggtttctgtagcttgaaagccttccacaaagttttccttccacctgaactgctctcagcacaaggcaccactaccataacttgtatttatagtatctcttcttcagacttgtggttgccaaggggcaaaaggttgggagagggaagaagtaggagtctggggttagcaggtgtatgcttttatatagagaatggataaacaacaaggtcctactgtgtagtagaggatctgtacatacagaacctctatattcaataccctatcaaaaagcacagtggaaaagagcattaaaaaggaatgtatatgtatgtataactgaatcactttgctgtaacagaaattaacacaacattataaatcaactttgcttcaattacaaaataaaataaattctcttttcttcagtgaaaccttccaaacccactcacacaagccatacgaggttaggtttccctattatatgctctggctaatggaattcataaatctgtcaggatctgctgtgttttattatattaatgtaatagaaggttatcttcctgctaaagacccaaaaataacctgaaatctgttatcctcataaatgaatatgctttaaaataatacaaatcatgtcaaactacaaggagagttccagaggacagagaataaattcttctgcctcagcagtttgtttggagactaaaatttcctcataggtttgctactcaaggggttcagccttcttttgaatactaaactgtggttcagtagaagtgcccccaacctgcatgaagaatggggcaaatcaatattcgcattattgtctggggtgtgggggaggagtgggagatgaacgcccaggtgaggtagagatctttccacttgaatattccagatcctgagttattcttgattctgctgtagatcagcatcttagagcacctgcctctccacagagcccagactatctccagtcctccggtgatgttatattgtctctgctgtgaatggtgtgcaactagattttggtagacaattgcattgctagagcttttatcatccactgacacctctttctaggag

SEQ ID NO: 28268 - DNA, 1063 bp, Bovine  19866881035589
taacacagaaggagctgaaagttttagataatgaaatgcttagcctggtttggacagactgcactgtaaaccaattcctatcactccatgtgggtggatggaattttggccaggtcagtggcatttgagaggattaagataggagaaagtgttgaattccagagatgggacatggcagtattagaaaaatatttctgttgcatcttttgatgtgttggggacagaatagtaaaggggcttaacagctagaatccctaatctcatgcctcacttaaaaaaaaatactgtcccaaagagccttgggaaggcgcttaaatgttcccagtggtggagcttagccatgccaacagcagcaacagcaagcacagcgaaacatgatgctgcctcctctcagtttatggggaagtggtaatgtttctacacttcagccacgcccttcactttgcccacctgtcatcttacttttagctctttgtcagtaagaaattctgccctggttcttccttttgagttctggctattctctcttatttccctgtctgaaaactactgttgctgtaatgcactggggaatgaaaacttcaaagccctgatcttaaagaatctcttcctgcagatctaggtatgacacgcatggtgctagagtgagttggaaaggcacacttagtcactttctgtgatatctttgtagaatatattaatacccagagagtataattacagcatattttagatgtagaattaacttaggcattatagtgtgtttttgaatacacctcaaacaaagcagaagtatataaagaaatctgaaagtccatattcagcaatatggcagagaagatttgatatcctgataactttttaccaaacacctagaggaactggatgagatggaaatgtacagctagatgtctgagaaagttaggaaaatctccacatgccccctcaaaaaaactgcagtaggagtcaggtaagaaactggctcttatgcttcagcaagtctgaagacagcttctaattttggtaaccaagaggcttactgtttctagccttctgtttccca

SEQ ID NO: 28269 - DNA, 1224 bp, Bovine  19866881070182
tctaaaaagagaattctaaaggagtttaggttaaaaatatactccccaagtagcaaacatcatattattttctaatgagcagaaattctctctaaaatagcctcatgaaaccactttataccctgaccaaaagtaactccctgaagttaaatcagtgccggcttcctctgtccaccctgccagatgtggtttgggacgatgacagcccacagtggccctcttaccgagcagaaaaaaaacacggcccagaaacgtcttggcagagcaagcgaacccacttgcagtaaacctaaagttccagtcttcattcatttgtgatgctgctctgtaaacacagcaggattgctttatttagtgtcacgcccattaataatgcagagatctttacacgggcaggtggaggaaattagtcctgagtgatttcgttactacagggtatacgtgaagtcagagggactcagagtctcattacagctgaggcagaagctgatggcagtacagacagaggtcacggagctgcccaccacaccacaaagcgatataagcaaggcacccacctcacagcctttcagtattaaaatgagttaatgtttctccaccttatagatatgggagagatcgaaggacaacttgaagaccattccttctactctttcaccttcttttatctccaaagtttaagttaaaaaaaaaaaaaaaaacaaatttggcaaatatttgcttctgatggtaactttacaaggattggccagtttgtcagaggattcaataacgtaccactagacactgcaaaatgttgcaaataaccctatgagaccgtgagctttgtccttaaggaatttttcacaaaaaatatttttcaagaacatagtaaactttgcaaatccaaagttatttaaaattcctttttataacattcaatgtaaacaatgttgtggggaaataatgtgtggggaagcagagaatgaaaactctgaagatctttctaaaggattggggagcagtacctttccatttacaatacaaactcccttctacttaacaatctgtctgctggacatttatcatatgtgcattctctaattagcagattaaaataagcatgtatgttttattatggcttataatagcaaaagcctagaaaacgccaaaggcctgtcagtaaggcacagtgtatccatacaatggggtaataaacagcggaaaaaggctagacaggcctcc

SEQ ID NO: 28270 - DNA, 694 bp, Bovine  19866881101585
ttttttaaaatcccttttaatcactttttaatacccaccagaagcttgaaattgaaatgttatgactagactgccctcattttccttgtgctacagccacacaatgaatggtgtccagatctgcactgtaagtgtacagatcattttcctcatatttcttttccttactggaagcagcattattaaaccaacatcagagatgaaagaacatgcccagaaagaaaggcttgggaatgttttaaaaatacatcgaagacaaatacatctgcctcagcaaatgatgtctctcctgatctccacgtctgatcacagagtgtctagtggggagggcagcaggcctccgccagcccggctctgatcctcagccacagggaggcctcccgctggttggaggagagtcgagtttccccatttcacaccccctgctttatgtctggcagcgctttatggatgatgcctcgacatgacggcccgcctgcccccgtgccaggcgggcatgaggccttccagagaacacacgtgtgtcctcccgccatggttacggccccccacttctcctccatggtcacagccccccacttctcctccacagttactgccccctgcttctcctccacggttacggcccgctgcttctcctccacagttacggccccctgcttctcctccacggttacggccccctgcttctcct

SEQ ID NO: 28271 - DNA, 699 bp, Bovine  19866881125385
tacttaggaatatatctatgtaaagaaactaaagacctatatatagaaagctataaaacactgatgaaagaaatcaaagaggacactaacagatggagaaatataccatgttcatgaattggaagaatcaatatagtgaaaatgagtatactacccaaaccaatctatagattcagtgcaatccctatcgagcctattgatttttaaaggtcaagtttcatttcaagaattatccattcttttttagggctcaaaatctccttcaccaaaaccaaacatgcctattcgatatttcataatgaagagtagcaatctgagaaaccttgaaatttctcaacagaagggtatctggtctacaactcctagtaatgagcggaagctaaatcgagccttttgggaaagcagcatggtgtacttggtattttctgttcaaggatctggacatttccaggtgagccatcctgaaacagtaaaagggcattattctggctatagattagatcagttaaatcatagaggttaaaaacaagctgggtttttattgcattggaatgtaagcatgcactgtgcttgactgaggatgaggaataaattgcaccttttcaaaggaatgatatatagggatccttatttttgccttgttttcctagagtctctccagataaacaacttttccttctgaggacaacttaagacggt

SEQ ID NO: 28272 - DNA, 779 bp, Bovine  19866881142431
tatgtctctgcttttgaattgcttctaggttggtctaactttccttccaggagtacacgtcttttaatttcatggctgcagtcaccatctgcagtgattttggagccccccaaaataaagttctaactgttgcttcctgacctgaatatagatttctcaagaggcaggtcaggtggtctggtattcccatctcttgaagacttttccacagtttattgtgattcacacagtcaaaggcttaggcatagtcaataaagcagaaatagatgtttttctggaactctcttgtttttttgatgatccagatcgaaggtgatagcaaccaccttatccatggttttgctttccttgatttcagttacctatggtcaatttcagtctgaaaatattaaatggaaaacttcagaaataaattgttaaattttaaattgcacaccatggtgaagtctcccaccatcctgcatgtcctgcctgggacccccaaccatggacatcatctgctcaggacatccagtcatcaatatcatcatggctccatgatccagggccacccagagcagatgatcctccttccgacatattatcagaagatcagtagtagcctaatattatgacacaacgcctacctcattcacctcacttcatctcattacacaggaatttttatcatttcatctcatcacaaggaaaagggtgcatggtgtaaaataagatattttgagaaagagagaccacatgactgcaattttcattacagtatttcattaaaattggcctat

SEQ ID NO: 28273 - DNA, 1339 bp, Bovine  19866881143453
attattattcttttaatatatgcctggattagataaattgacatattatataaatattcccaacattttttataaatgaaatcatctttagttcttagagatctctgtaaggtttggtttagagtttttctgctttcttaaaatgaattaggaagcttccattttttactttaattatttaagtaattacaggcattacatttgaaaaatgttcagtcagaattcagctatgaaattatctcagtctaaggctccaaaaagtttagatttctaattatcttttgaaatctcctatggccattgctggtttggtgtttacagttgatgattcaaaggctttcacacctgggacattaagtgacgatttcagaaagcttcctcaagaaaagtggtaaaatgcttggttgggaagagcaaagtcctaccagaaaaccactggggagttgctttattagcttacactgcaaagaatcacctctcctacttggatctgagtaacctctggaagcagtagaataatcgaacccaaacaagaagctttatttgctcctttgttgagtgttccttcaaccaatagggaaaaaaaaacaaaaaaaaaaaaaacaaaaaaaaaccaaggttctagcccattttctttgtccccaaacctgctttgccccagttagattttaaagcattttaaaacaaagtcaggaaataaaatggtcattttcattgcagaactaattgtttaagctcctaaagatatttctctaaatatttcaataagcctttcctctctggcctctcttcctcatactagttaactttcccctcttccttctcatagttttcagtgtctttttatcaggcagcttaagtatgttccctaatgccaggcgtttcctacatcattctgtttataattttatctttgcttccctgagtgaactatcttcccaaccctcctgccagctacacccccacatcaggcatgggcttctttccaccatgctcttattgttgctttgagtcaccagaatcaacttccacagaacacactaactcagcagtggtcccttcctgaaatgatttaattgcttctgactcaatacctggacttctcctgatcactagcaatgtccaagttaaatctattgttttagaaagtgaatcatattgagcatgctgtaccactgggagatgagatgcagaatgagctgttaaaggagatatcgacaagctcaaaaataaaattaagtcacatgaagatagtcagaaagaccgtttgtactttgtgttctccttcatctcagagcaacataaaaaaaaaaaaaaaaaaaaacaggcacacatttta

SEQ ID NO: 28274 - DNA, 1278 bp, Bovine  19866881171306
acacacagtaaaaggctgaacacatattacccacgtgcctcatccgtgtggtttatgatcgcagcataccacactagatcatgacacagtgctaacacagaaacgcaactaggtcagttgatggggtcaggaaaagcttgccacagaaggaaacctgagccaggtccaaaggcaggtggacaaaagtagtacatgccaggccaaaggtgcagcacataacacacagaggcacaagaagctgaaagaagagcacagttttggctctccaaatagcctgggatagttccaacgatgtgtgtgtgtagcgggggaggcactgttaatgaacgcggctgaaggagtgggaaagatcagatcacaaagaaacttacaggccacgaggaggatcctggctttccttgcacagtattcactattggcattgaaggtgattctcatggttgataccagttatatacaacaagatgaatatgcacttgtacatttcaaattggaaacaatacaagaaaaaaattaacgttttaatttttaactttggtttaacttctgttcaatgttgcagagaaagggagagaggattttgttaaagggtgggaaagaaagaggcaaagaaaaaggaagaggacggacagaaatgaaaaaagccaacacgggcacgcaggctggaggggaagaccaaaggcccgaccagcgattacgtcttcagaccctgacttctgcagcagcaaatggtgcaacatgtctgcacaccatgaatgttatgaggtagagcattccaccacactaaatgcactccacatttatgaagatcagcttcctaagacagtgaaagtggcctccagaatccgtctcaaagctgtgctacatggacaaccaaccaacaggagttgatggtgagaggaaacctattggccacaggcaactagaatgcacgtctccttcccaagaaatgtttcccaagatgtcacttgttttggctgaacacaaggctacgctcaggaaatatgtcaaagacctgaattagggggttaagatgggaatcccagagtggagcatggatatagcacagactcacatatagcatccagattttattacagtcatcagtgttccttcccatcctctccttcactttcatggctaattgaacactggcttctatcccaacactgtggctctttctgaacaacccctagagacagatgaaaaagactaaatatgacatattttatagaatgattagttatggataaagattgctcttccacagtctccttg

SEQ ID NO: 28275 - DNA, 1204 bp, Bovine  19866881172816
taatagctttgctatttctattctaaatgtttagacctttttcttagagggcaaaagaggagtctgtagagcattctgagcctttcaatatggaaactgtccaaataaggtgtaaattcagcacagctatttgggcaaaagagatcttgaacaaacattgatatttctgcagttcagtctcctttggaagaccagaaagttcctgcattaacaggagtgaaagagtaaaggctgcacaactccagcatactccaggggccccacgattatctacattttgtctggtcataaaaacgaaacagcagctgagctaaaaagagaacaaagatggatgtgaggcaaagtttagaatctcaaaatgctaacaagccagtctttgatgttgacaaatatttttccagaaaaagaaatacctaaaaacagctgaatttctatactctaatctctaaagcaaaaaaaaaaaaaaaaaaaaggagtatggaaacacagaatatcttaaatatcagtatatatgggtagagttcattgaaaaatatatgagaaaagttttttaatagcccaaacctagaatcataagattcacagctaaaggggctagaaaaatattttacagataggagtgaagttgctcactcatgtccaactctttgtgacaccatcgtggactgtagcctgccaggctcctctgtccacagaattttccaagcaaggatactggagtgggttgccattaccttctccaggggatcttcctgacccagggattgaacccaggtctcctgcactgcaggcagactctttaccatatgggccagatattttacaaataaggaggtagttaataggtatttaacttagacatttcttatgatgctcacaagagtgttgttcacaaataaatttctttcaatagtaggtgctagcttaaaattccctggagaccaaaggattttcaaccaaatataaaccttggccaccatccacaagacttgctggccatcctgtgaaatccaaatctgggttaaatgcactcaccaattccttcacaagaaatgccagtacaagcagttgaggtgtctgctattggcatttcaaattagtggagaaaatagctgcctattaaataaatggtactagaacaattggctaaatttggggagaaaagttaaacctcttcttcataacagttataaaaaacaaaata

SEQ ID NO: 28276 - DNA, 936 bp, Bovine  19866881334924
taatctctcatgaattttaaaggctgtggtatacgagagagagagaaggaaagggaggatctttaaggtagactattaaaaatgaaaacttccacaaggagacaaataagttatagttaaaatagtggcaaaaatctctatggtttatacagttaaaatagagaggaaaatatcaagaagaacatttgaaagtataaatagatcaggggccagaagtggactttgcttgttctaaattagttgagaaccagcctttgtgggtttttaaagaaaagtattgggggcaatgacactggcccatgtcctcagcccctctccatgcagctctagtcctgtgctctagtccagcaaacttcctttgaagtattctcgaagtgggagactggttctatgtaagatgaaattgactcagaagttttttcaactgcccaaagaaattaataccttcagaaggagcttgaggacactgtcagaattaaaaagaacttggtgacaatttgacaatgaagtcacttttgaaacttcagaagagccagactctatgaagatttaaagtgatccattggaggttgtttaaaatgcaaaattcactttaattttgaaaatgaattgaagttcttcaactgtgttccttgtaaaagtcactggtttgcatcctactgaaccccaagatacaacaaggccaatttatttcttctctgccttccttcctgtctctgttatatctaaacccttagcacagtatctagtacatagtcaattggtatgaaatatacattaaataagtactgtaacaatgctcagtttaattgccaaatacagattggagatttgaaaaagtagtatatattacatagtcatgtacttcagagatataaaaattctaaatagctgtgattactcatgagtttcttaaagatgtcattgagggacttg

SEQ ID NO: 28277 - DNA, 1234 bp, Bovine  19866881531673
actgttatgttagtaatacttactaaaatactaagggctacttgcattttaatagggccatgttttaattgtataaaagatttgttattatacattttttttttaaagggtttctccaaagacacttctgacattttgcaccaatggggtactgcttcgtacactgatggcaggagatagtacattgtcaactgtgacacatgttattgtggtaagatatttaaatttaaatagctaattaagattttagaataggatatatgtgagaaccaatttttttttaaaacaggctcttctaatcaagttactttttattttccataattattagaaataaatatttgtattaaagatattcttgccatcagttttcatgagtgaaaatagatagctttgtaaaaaagtgctttttatgtataaaaatgatacatgtatttcaagagtctccagaatagtgaaagttttctttttttctctgtgcttagtcatctattttctcttccatatcttaggagaatacttaaagtcagttaacttcccggttatcctgttattttaactagctgctgatgaaataagtagatgaattagcaccttattaaagaattctaagcttttatccagtttgtgtcagaaaacttagattaagatttataagcttgtgataagcaggtttggaaagtttttagttctctgcattcaaaccacaatatgcacctggtcctgatgctaacagaagcatatttaaatagattttagatttattaaaattatattaaattagactgtactaattcagaatttgttttagtttctgcagttttacattctgtgggaaaaagggcaatacgttacccacagaggattgttaatatctgagtatttctaaattgtccataaaacaaatttcactaattgactgtttccacatttaacttgatttagtgtgaaactcagcagctccatagttttaaagacttcacttattttatgttttaactgttccatggtttgtttttgtttactgcaggatgaagttcatgaaagagatcgatttagtgattttttacttacaaagttaagagatttactgcagaagcacccaactttgaaactaattctttctagtgctgccttagatgtaaatctttttataagatattttgggagctgtccagtgatatatagtaagtaaaattatcagatttcttcaggattttagaaagaattattt

SEQ ID NO: 28278 - DNA, 861 bp, Bovine  19866881543857
ttatcttaagtttgttgcaactgtttcccaatagtaagaggggatattcccttacatctttgtacgtcatggagttggcctctcggtatcacagtagcactaagaattttgcctgatttgtttttcctagaagaatagatacatttgctgtgaagtttttctggagttagactatttgtagccatgctttcataccttatctctattcatcaatcacaaagcattactttaaactgtttttcccataattaagaatccgaatttatttcaatgagatttataatgccaaacaaaatattcaactttatttctgatttttaaggaaattttcatggagccaagcaaatttggaaccagaagtaaccttagctgtcatagtctgcttggaatatttcttgtttgtttttgagtttccatttggggattcatcttgccccaactctcaacccttgtgatttgagtgaagttgactttcattctcccttgctctggggagattagggggtggagggaatgacttgggcctggctgattaacatgttctatttctctgatctcattgattggcccaaggataggttcaataatcatgctttcactgttttagtagagaaagttctttttggcttttgacttgaacctgggaggatgggatagggttgaagctgctagcagtcatcctgccccaagttggaaactgacaatgaagcccctgtgagtagaagtgagccaaggaatgggaagagaccaggtcctggtaattaatacagggtaagctgagcctagacatgtgtgctcctggacattttagttacacaggacaagaaactacccttctccctccccaacacacactcatat

SEQ ID NO: 28279 - DNA, 909 bp, Bovine  19866881626891
ggaacacggtggtacacctgtggcagattcatgttgatgtatggcaaaaccaaatacaatattgtgaagtaaaaaaaatgaaataaataaataaataaaaatcaataggctcaattaaataacatcttataaatatataaaccaaaatattttaccaaatattcaacaaatataagtagctctatcatggctgaaaacttacacaaggctcaatcaaagtgaggtcaaagaaccaaaaccaagtaccaattttcagagcattcagaatagtcaactctgatttatactccaaatgtactttcagaaaatatattaataaacttgcaaagactgaaaacaaaacaaaaactgctcccagcttactgcctggatacaatttccaggtgacaatacaggaagggaaacacaaacggaatccaatggtctcactgaacttacagtttagaggccacattaactaggttttgcatggcagtgtaccagatagacagagaaggcaatggcaacccactccagtactcttgcctggaaaatcccatggatggaggagcctggtaggctccagtccatggggtcgctaagagttggacacgactgggtgacttcacttttacttttcactttcatacattggaggaggaaatggcaacccactccagtgttcttgcctggagaatcccggggacggtggggcctggtaggctgccgtctatggagtcgcacagagtcggacacgactgaagcgacttagcagcggcagcggcagcaccagatagaagggagctgcatgggaagagaacaggggactacagaaggggtcctcacaaggttctggctaagtaaagacctgaacatagtaagaaacaatacctaagcaaggaaaaattcaaagtaaaagttcttagagct

SEQ ID NO: 28280 - DNA, 716 bp, Bovine  19866881672937
cctttgaaattaacggttctgctcttataaataaccaggatttcacctctatcaacaggaatcttcaagtgattgaatggtcatctgcacagagtgttgtcagagtgatttctgcaagatgttgttattttctcttcatgccattaacccaaacagcaggacccagactaccaaccttaagttgctaaagtggcatcaaacaaggaagctggttaagatgcaaccactcataatttgaactagaatctatgaatcaggattaggacaaagaataaatgtccttttgtcagtaaaaactttttttttttcaatagcaaaaagagcaagagggacacttggtggtcagtacaaggcatcgcaaaggaccgtaccataagaaatattctcagggaacttggcctggagttttgaaggcaggagagaactctgctgttcatagtgaaacaagactcgtgtacaaaatagcatcactcttgccctggttagatgccaactatcagaagtgacagcacactgctgctattgtgaataaacagaagtcagtgtgtccaaagaacattccaggggggaaaaaaaatttagacaactgttaaaagtctgggcaaaaccccatgtgataaataacaactgtaaataaagaattatctgccactgcacagaacttggtcactcattcttacgctcttaacttatcattcttcctgggcttaaattga

SEQ ID NO: 28281 - DNA, 1462 bp, Bovine  19866880371354
ttgggcccaggacaatgtggtctgagggcactgtacctagaaaggaaaaggtgatccagtggacaggagagttgtgtttcattcattttgatatttggcaaaactaatacaatattgtaaagtttaaaaataaaataaaattaaaaagccctcaacattcagaaaactaaaaaaaaaaattaaataaaatatgaagatagaggttccgtatcagtgctttgatgagatttttgtggcacttgtgatttatttcattaaatactttcttgattgtgtactcagcaaggactggaaatcagggatgtaaagagcttgtggagatagatccttctggaaaatttcagtcttacagagaaataaaatatagaaatccaggctatgttttaacgcccatatcaatcaccgtgaaatcctcccctaatgaaaatagaatcctatgaaattattaatttgcaattgaaaactaaattttctatcatcttgtagtattcactgattgcttcctatgtgagtatgagttttattttcccctccagattaaatatttgaggtcagggaccatgacttactaatggaatgataaataagacaggttaatagaataatgttataatccctgaaatctgtatctgacaaatgcatatgatataaacagtgaaatcttgggattacttgtcccgatactgaagaagtataccttaatactggtattgttgttgtttagttgctaagttgtgatgactcttttgtgactgaccccatgcgctgtaaccttccaggctcctctgttcatgtgatttcccaggcaagaatactggagtgggtttccgttcccttctccagggcatcttcctgacccagggctcaaacccatgtctcttgcattggcagacagattctttactactgagccacctgggaagcccttaatactgtccagtttagaaaacaagtatatatttcattaatttcattagaatcgggagtatacacattaattatatattttgaaaacaaaagtttgtccattttttagagaaaatatttttccaatgtgtcaatctagttcagcaagtgttttatggtcttccgttacatttcttccttatgtgtttagtattgtttctaaatgaagttctattggtcaataataccaagtgatgctcttttctactggattactcagattatgccaccctggaagacgtcgaaatttaatgtcttttgttgttgttgtttgtttctggctctgtgtttgttttggactttgaagaaatgtttgtggattttttttttttttaagcagaagagatgtttgagaatttagttctaagcgtctggatgttcattcattctgcttgtaatggagttgtctgttttactaatgtctactgacagcttctcattgatctttgtagttcttttctaggaaggtgaaattctgcaggctcaaggtgatggg

SEQ ID NO: 28282 - DNA, 1689 bp, Bovine  19866880506358
tacctattggtctccccagtgatagctttacaaggccgaacgaaaccccacctgtttataaacttgttctagcacctgatacttaaaaattattcctcaaagcttaaagaggtgacatggtctacccactgaagataatagctaaaatctttatttctctgcaggctccaagtcagttgtagctactctgcaagtagcagtgctctcccagttaatgtccaggttcttactctcccaccaccccttcctgagacccagcctggaaacctcactctggaacttaagattgccaaaggtaagaccctcttgggtagactatctggcctctagtctgactaaagtcatcttctgggccggaagaccctaacttggtaacaagatattattcctttcaaaggcatttatgtgggtgatggtttatcccaagccacctagaggttccaagctctttactgcttcagcttgttttggcctgttgcagataaacgctatcgctcctactacacggctagtgactacccagtggtgaagttacttcgggatcccatctacgtggaagtctccatccatcagagaacagaccccagtctcgagctgcgcctggaccagtgttgggcgacacctggtgcagatgccctgctccagccccagtggcccttgcttgtgaatgggtgcgtgtctttctttcacctgtgttaccatccctccaagaagcccatcttgactgctggatatccttgcttaggtgcccctacacaggagacaactatcagacaaaactgatccctgtctgggaagcctcagacctgccgtttccttctcactaccagcgcttcagcatttccaccttcagctttgtggactcagtggcaaagcgggccctcaagggaccggtacgatgctgccccctgtgctcttcagctgggctctaaacccaactcaaatgtttccacacggtaccacttttcatctaaggttgccctgtaacattggcttttggtattgcctcagagcaatcaaaggatgcctgtggcatgtgtgacatgggtcaactagagtctggtatcttagtgcttctgtgatgtcagtttggtttatcaattttctgataattctttgacttcttcctgggggagataaagcaggtttgaagacttaggatgtgctagacccatgatcccaattctttcggttcccaggtgtatctgcactgcagtgcatcggtctgccagcctgccgggacaccatcctgtgtgacactctgtcctgccagacgtaaatatccaacctatctatgccagaagccagattaaagtgttatttggagtccagtgctaacctttagtctgtggcacatgaatcaaactgaagattcatctaattaacgagccttctttaagtactttcatgatgtaatagaacagaaatacaactagtgtcctagaattccaggcctaaatatttcaggattaatagcttatatttataattttcagccttagtttttctccatataaatttttagtagggagtcaagtgagttcacagcctacaatctaataaaacacttctgtggtatcagatataaatgtaggcttttatttatcagatataaatgttggcaggtctggcaacatggcctcaagacttatagatggcatgggattgcagacttagtgtgtgttaatt

SEQ ID NO: 28283 - DNA, 641 bp, Bovine  19866880528576
tctcccctcccccacccccagctactcccttggtagctttgtcccaatttaaggattctttccgtagcactttgctcatctgtgtgcatgcatgctcagtcatatctgtctctttgcagccccatggactgtagcccaccagactcctctttctgtggaattttccaggcaagaatactggagtggattgccatttcctcctccagggaatcttcctgtcccagaaatcaaacccatttcccttacatttatcctgcattgggaagaggattctctactacatttgcactagctcttattttattcccattaaactattcatgagaagaagagagcattttatacacttagttaagtttactttttttttttttttctttgcggactctttctttgctctatgcagactgctcaaggtggtggccaccgaacgctcctctacggtcacgcaatactgctgcggcattcctacagtggcatggtgagtacatgtggagacttcatctcccctatggtcatgcggagctatttgtgcatacagggcaaagaaatatttggtaatcccattccattgatggctttaataagcttgaattgtatgtgttttttaatatatttgaacactgtttattttctcattt

SEQ ID NO: 28284 - DNA, 1761 bp, Bovine  19866880569427
gctctgtagcacaatttggcttttctttctcacattccccgtgcaaagagtcacctgcacctcggaaactcggggattgtggggtggggactttgctcactgagatccctggaggacttgggggatgcttagccattatctcattttacagaagaagtttaaggtgaaagaaggcacttacccagagcccacatttactgaaatacaatgcaaagggcaaatactggtcttctgatcctcacattgaagaccctgtatgcgagacagcaaaagagacacagatgtaaagaacagacttttggactctgtgggagaaggtgaggctgggatgatttgagagaatagcattgaaacatgtattttatcgtatgtgaactagatcaccagcccaggttcgatgcatgagacagggcgctcaggactggttcactgggatgacccttgagggatgggatggggagggaggtgggaggagagtcaggatagggaacacatgtacacccatggccgattcatgtgaaatgtatggcaaaaccccaccacaatattataaagtaattagcctccaattaaaaggaaaaaaaaaagacttagtgtctgtggcttgttgtttttgccttggggtgacagctctcataaaggtaagagttctggagtgatacttttggtaattccacactgaaaggattttatatgaatgatcctaaaatttttgatgtgtatttttttcttcccaggattcatacctgtgtgtagcctgggagtggctcaagtgggcaggctgaactttggaaaggatgtcagcaccttgaaatatttcaccatctgtggcttacaagagggctatgaaccatttgccgttaacacaaatagggatattaccatgtggctgagcaagaggcttcctcaatttctccaagttccatcaaaccatgaacatattgaggtttgctttttctttaaaacttggaccatcagccaaaaccaggagtgggagttcctacttagacaattactgtcatttacttaaaataatggttctaatgttccattataggcgaatctaaggatagaattaccctctgattttaggtactgtgtgagaggctgattagactgattaactgtggttgagcctggaataactttgtggttaatttgcatttgatttatagttggtcctctgcttctgcggattcaaccaaccgtggattatgtagtacccttggtagtgtttccccttgaaaatatccacatcttagtggatccaagcagttcaaaccttcattgttcagggtcaactgtatgcaattctttttttaatatatatacatgtatcggcaatggcaggctcaatctgagtatatacagttgtaacgtgaatttcccagattgtcttctgagttagcagaactgtgagcatatccttacacagccatccctatgtttaatgatctcatttataaaattatgccatgagtaggccatgtctggagttttaaaggtgtgatgcacttttaaaggggttttggaatcaggaagtcaacagtgctgagcatctgaatgattgcttcttcatttgctaggtgaccagaatagatggcaccatagacagttccccgtgtttaaaagtcactcagaagtcctttggctctcagaacagcagcacggatatcatgttttatcgtctgagcatgcccatcgagtgtgccagaggtcttctccaagactgcagctgggagggatccctggcaccgggct

SEQ ID NO: 28285 - DNA, 3811 bp, Bovine  19866880586969
agctttgagagatttttccatctgtaggaacacccacagtcaagatgcagagtgtttccattgcttctcagatcctgtgctttttgcagtctatccctccctacaagcccaggtcttgatcacctgtgttctgccactacagactagtctgcgtgttccaggacactgatacatgcagtcacacactgtggtctttctgagtctggcttctttcactcagaataatgactttgagattcattcatgttagaatacatgtcggcaatccattcctttttagagcctaatcatggcattttgctacttatggaaataccccaggttctgtgtggttttttttttttgttttttaccagctgatggacatttgagttgtctccagttttgggctcaggtaagtaaaaccattatcaatattcatgtacacatctttgtagagacatacatttatatttatattgagtaaatacctggtactggaaaggctacacatatatttatgataagtgaatatttaacttattaaaaataatgccaaactactttccaactgactaaccatttttcatcccaacagcaatagatgagtattccagttgctccaaagcctactcagcattcagcattgtctacttaaaaaaaaaaaaaaaactagctattttatctgtgtgtagattaaaatatttcggattatataagggaaaaaattttccagaggttattcagagatgcaaagctgcatgatgcttgactagcacatcagaaggatttgaggaagaatcttactttttaatgccttcaacagctatgcacctgactggaaaaaagcagagagtgacagagaaaaaaaaagccctgtgctcattggctttacattatacaaagaagtagattttgaaaaatacatatagattttaaatataattttaaaccataaatatttaaactatagcacagatatggaagagtagaaaggtgactttggagcaatgactggaaggatgtctggaaaagagccatgaggacatctggcgaaagaatactacagatggagcgaacagcaagtgccaaggccctagagcaggcgcagacctggcaagttccagtcacagcaaggggaccagtgtggctggagcaacaagaactggagagtggcaagaaacgaagtaagacaatacgtgatagatagggtaggaactattcaaatgccttttaccgtcactcaaagtgagaaagaaagtctagaaggttctgggcagaagattaacatgaaactttgaagagatactctggctgcaggggaggctcagatagactatttagaatggaactgcaattaaaatatgggggaaatttatccgtattttggtaaacatacatatggcttactatgattagagggcacagcctttagtatactagtaataccttgcagtgtgatatgcaaacttgtgtgatataaattatatacatgagatgttaaaacaacctttaaagaaagtaaaaatgcataaagtaaaagtgacggcaaattattgtaaaaggacataaacatccaagaatataaagttgattctctttccaaagaaaaatgcatgtgattggagaaaatatcttaaatttcttgctctttataacttaaaattatattacatataatagtatgtattatatataataacatatattgtattagtcactcaattgtgtctgactctttgcaactccatggactctagccaaccaggttactctgtccatgggaattctccaggcaagaatactggagtggggagctattcccttctctagggaatcttcccccaacccaggaattgaacccacgtctcctgcagcacagacagattccctggtgtctgagccaccaggtaagtctattacatataataagtgtaacatatttataatacatagtatattatagttataacaacatataattataactatttatagctaaatatcttgagaaacaactataaacaactgtaactcacacaagcacagcagtaagagactgtgcctaccttttccagatctggctcccgcaaagctaaagctagttcattattatccatcaccgaggctgctgccacatccaagtggtgttgaacctctcatagctggtgaggctgttaattaaagcaaagatggaacaaaacctgaattgtgctgtaactctgagtcccatataaaaacatactttcacatagaatttcatttctaaatataatgcatactgtaccaatccaaaataatttaaagtttagttttaaaacccagtttgtatatcccttttatcttaaagattcaatgaaagtcatacatttacttaccaagaccaacactgctgttttccagtaaataactcagatgatcaaacatagctttctgattctgcctgcttatacgacagaagtaacagagaaaacggcaacagttggccaccatcttcggaaaagtgatttcctacataaagagcatttagttagctgggaaagtaaaggatctttgttaatagtgagttctgaagttgaggtctcaatcagattgtgcaatcatgtgtgcccatgtctaccaagcctcgggtactgaagacctctgaatgtccagatgaaggctcacctagtcctagagctaccaaaaatcaagcctgacactaataggaaacctaactattgtcaatggtctgatatggaattaatctacagccctatacttaaaggtagcatgagcctactttaggattcagacaggctcaactgtgattcttgatgcccactattagctgcgcttccttggaaaattaaaccatctcacagattttgttctgcaaaattggaataagatggataataatatttactttaggcaaaggaaggacagttcaatgaggcattttgtgaaaaatacccagtttaatatttggaaccacataataggatgctcttatcatcagcgttgttgttgtattattattaagattccaggaaattcagatcttccctgactggcacatgacttgtctcctgtgatgaacacccttcctggaaggtctgcctgctaggccccagcaaacatatctcccttgacatctagatcttaatccccaaagactccaagttcttattaaacagaatattttataaatatctttataagtttgcctaaccaagagtctgaacatgagaaaaatggactcaggaattcagtggaaccaactgttgtctgaatcaaggaaacaggtctggatagcatgtttttgttacagactttgaatgtgatggaaatgtatttaattttataaaaattagcatactattaactgttatagtttctagatatcttctaaatgagaattatacagaaaatagcaagttacatggcattagataaattattaggcttccctggtgactcagatggtgaagaatctgcctgcaatgcagaagacctgggttcagtccctgggtctgatccctgagtcaggagatcccctgggaaagggaatggcaaccactccagtattcttgcctggagaattccatggacagagaagcctggtgggctatagtccatgggatcacaaagagtcagatacaactaagtgactaacatgttcactttttcaagcaaattatcaatatcaaagaaaaaaacttcagtcagacctctttatctgcaggttacacatctgcagattcaaccaaaaagcaaaaattacagaatgttttaaaaagcaaaaccgaatttgctatgtgccaatacatttagatagcatttatatcag

SEQ ID NO: 28286 - DNA, 821 bp, Bovine  19866880758647
taatagagaactggtgagagcctactgtagaggaccggggaactccacctcaatatttgtgaccaaaatattcaccaagctaagtgaatacagctatatccatatagcagtatgcacttagctgtatcatagagactaaccacaacactgtaaagtaacgatactccaatgaaaattaataaagacaaaaaataaaaacacaaatgcacaatattaatatgacagaaggaaaagaaatgctttggagaaaactcaagtgaggtaagaaatggtgctagtgaggttatgggggaagtaaggataagtagcatttgataaaaaatagtttaaaaggatatattctgtcaaattagactgcaattttttaagaaaataaagtttactttaagagaataaaaattagaagttgtttagttcaacaggtcatgaatatctttaaattactggtaaattcagaatctatcacaaatatttgatagcaagtgaattaagcaagtatttacacatgaaaatttttttactttaaatacaaaaaatctgaagaagatgttcaaattgaatgacagtaatgtaataaaataatctatacattaaagagtcataatctaaagcagtgcataactctggcatggtgattcaattacatgctggtgattcaattacataccgacctccttattgagttcggtgctggtatctctggaaaccacatcattcaaacacatagaaatatgtagtatactttgcttcagagtaggaagttgtctttttagagacaaaaagacactaaaacaaggcgtctacaagtagagggcatatat

SEQ ID NO: 28287 - DNA, 2104 bp, Bovine  19866880809458
aaattagcctaggcacttacgtaacacagtcagctatatagtattgtaataggtttagaatacttttcacatgaataatacataaaaataaacacaaaaaataaaagactgtcacccttacgttacagaagtttggaaagtacagtagtgcagtacaacagctggatacaggggttggcatcaagtgaacaggcaagaagagttactgctggaggagggcgaggaagtagaaatgctggagctgaaggagcgtcagtgataggagacggagggcaagctgccgcgtcacgcatgcctgacgtgactggacatgtgaacccacatgcacaactttgaaagtttgcaacttggggattcatatgcagaggacttactgtcctcccatcaacaaccacaaccagctcttctgaaagagagctggtgaggtgagtgggattgaggggcaatataagaatcacagaatgaactgtgtcctcagactctttgagaaggtaacgtcatttcttcccctctgcagaatcactgaggtcctgagtcacaggacaaaagttccctaaactcctggcctgagtcacatgcttcaaataaaagactcttatctcatactcccttttattcatgcatctggctttaaagaatttacagtgtgattttgcaacgagaggagaagaaagtgaaatggaaataccatgatcttgatcaggtgcctccaggttgtagccatatcccagcagtgtgcgtacagcctcacggaggctatccttattggatttcttagttcggtcatctagaagggcataaggaacaagccgagggtttcttctgttctttacatcctacaggaaggaaaaaaaaaaatgtatgtgatcatcaaaggacaaccaacagcatttggaaatgacacagccaccaaatacatcaaaatataaagtgtctgaaggtagatattgtaccttccctttgtctttccaggttgtaggagttagtgaaatactcccagtatgaagaatctatcaagtgagtcactgatcaatgtaaatcaggctctctccatgaaaagaaaatgtaaaaataacagcaataacaaaagccaactttaatgatctcaataaccatcatccatctgtcaagatcacaaggcaatggactaacttaagagaacctaccatttccttgccaagttgactgacaggtctttgttacaaaaagagcctaattagtaaccatcatctctctgacttttgagtcaatgtaccacacaaggcagctgtcccttcctcagagaaaagtcagtatgtggatggccacctcacgacctcaaatggcttaaaaaaataataaactgactccatcaactggtaaacctggtaatagtgggagtattaaaagaactacaaacctcacaatttgtcttttataaaagaggctcccagtttaaagcatgattaaaatggcagtgaccaagcaagaaggcaggctatcttatcatcttaacaaaaggataatttaagagtaaatacaaaatctgggccgtggagatgccccaagactgcgagtctttctaacacttaagaaattacttctttgcattcattcactgctgcagattttatcaaactttccatattccaggaggcatgctgctactgctaagtcgcttcagtcgtgtcccactctgtgggaccccagagacagcagcccaccaggctcccccgtccctgggattctccaggcaagaacactggagtgggttgccatttccttctctgatgcataaaagtgaaaagtgaagtgaagtcgctcagtcgtgtctgactcttagcaaccccatggactgcagcccaccaggcttcactatccatgggattttccaggcaagagtactggagtggggtgtcattgccatccaccaggaggcatattcaatctcaatttatcttagcatgaagaacaatttgaaggctgtatatattcccaaacattctccaaaacatataagctatttggtggacagcatttgttctggttggggaggaacaaagaaaagtgtttcccaatttcttcttccccttctctagcaaatctgtagtaataccttatactg

SEQ ID NO: 28288 - DNA, 2054 bp, Bovine  19866880833073
aatcgtgaaacatggctgaatacatcgactacaattgtttctgtagctctcagctcatcccctcattcttgcttcttaatttttttgccatcttctcacatccactcagaaaggaacgtaagaacatcccctaaggccttctgctgttctctcttctgtgctttcttccttggacatctcatgtagtctcaaaaaatctcactccaattttagcactgacttttatagtgatccttacttccattctcctaaagacctgtgacacccctctcccgcatactcttaacctctgtctccacccctgcctcatccagtcatggcccagaatcctgggtatcttaaagaaccctccaaagagcttagacttgtcttgaaatatcttttgtcagctgctagtaaggtgtctttcagctaacttctcatctaacagtggaagcagcttccctgaataaaaaggtcacctcaactcagccacacgtggcaacatataaagatattttgggttgtcatgactgggaaaagagaatgctagtggcagctggtgagtagagaccaggaatgctgcttacaaaccatcctataatgcacacgatggcacccgtgtcaaagaattaaccggcccaaactatcagtagcgctgaggctgatataagctgctgttgaatagtaagtcaattcatttttctctgtgggagaataaataaaaacaaccactctggtgtaaaggagagaatggatggcattgaactctgcagaatgagctaaattaaaatacacgaactcatataactaattggaattatatgaatatataattaaaagataaagtcaatggagcagttagaatgagatcagagtagcttttgacaataatatatattccattttctgacattcttttctctcatttcatcttaatagtccttcctctaccttgcctggtatatgaccatgtccattcttggacactacaacaactttttttttgctgctcatcttctggacattgctatgggattcaagacgttaagaaccatcttgtcatcagtaactcacaatggcaaacaggtaaaaatttatcttttctttcccctgcaaaaactgaaaaactaacaaatattccaacagaagtaaaaccaaacctcaaataacagtgtacagttttaaagcttttgtggatagaggagctgtactttttctcctggaaaccataaggatttgtagtttgagagtcccttagacctacgttcaagtcttggtttgattgatttagctttgtgaccctggataaattatttaccattcctaaatctcaactccctcattttgaatgaaaacagcaaaagtacctaccttaccagggttttgtgagaatttaaaataaaaacataaacgtggaggtcttagcacaggccctggcacagtaaattctcaggaaaacagttactgttttgttcctaatatgatatctgctgtatttgatactgtgaggaaaccaaagtatgctgcaatatcctcacacactagttgcattagtaataaaacagatgctgcatctgtaatttaatacagtattttaaaccagatcttcttgggctcttttctccacttttatattgggcaaaatgaataataatgtttcacacttgacaaggtcatgcttacttagaggaaagttggcttaatttcagataatcagcttatgttctaatgcaacacacttgtcttgttaaaactttcattattaataaacttatcaattcattctgtatttatcaagtgtccactgagaggtaacacattctatgttatttacttggaataaaagagtccttctttttccagaattttataatccagcatattttaaaattggtgcccttcctaaaaccttgaactatgtccacagttaaattcacattatcatgaccttcagttttctaaatttcagcatactgttcttatatatgtcactctagtttctgaatatgagtatggtatgtatggcatggcataaatccagtgacaaaaactatactaagcttattcgaaaa

SEQ ID NO: 28289 - DNA, 2480 bp, Bovine  19866880836119
atagggcttggtatgtgcacatttgggcttctctggtggctcagtggtagagaatccacctgctaatgcaggagacatgggtccaatccctgggtcaggaagatcccctgaagaaggaagtggcaacctgctccagaattcttgcctgggaaattccatggacagaggagcctggcgggctagtccatgaggtagcaaaagagttggaaatgacttagcgactaaacaacagcagcgacagatgtgcccatttaaataggtggctaacttacctcctggggtagaatggcctccaacagccagaaagcctgcatacttcttcaccatgtgtcttcatggagtgagagtggagcttatatctccgagctgtctggcttctagcttacctctgaaccaagtcctgtggctggggaggccgtgactggtccagatcagctgtgctgcatccctgagggtggagtcagctctgcccaaagagcatgactgcccaccattggtgagaagagagtactgtgtactacaaaatgcttttcatgcagtaggtagcgacttgctacccctaacgagtgatagggatagaaaagaactaatcataagaataaatttttaaatcacgaaactaccatgggaaattcagacatcctgataaaacccttattttatttaggattgctttcatggaatataattatgctctcgtgcaaactttccagtttgtttatctttttaagaaaaagtattgttatattgaaacctattgtaaatattcatgaaactttaaaaatgattatttaaaatcacaaaactacaactcaaagacagttttatttccttaaaagtcagagagtctaggctaaagtaaattaaaccttaactccaaggggaaaaacctcctatgaaatcaactttagatgataaactatgtatcactgcacttataacttaagattggcctaattaaagaaatgattaaaaaagtaattaaagactaaaacagtatctctagaggagcccttttgaaaatagcactaaaaattacatcgtattattatatcaattcctagaatgttgggaaggctaataaaattataatttctagccctataaaccagtgcaagttctgaaaaaagaaagctaaaaaagtatattttaatacatgtctattttattctgcaaagatcaaaaatatttatgttgcaattcattcattcaacattattcaatattatatgatacactgactgtatcatataatgtgcttggtgatgggtattttagagactagtgagagaggtgtaaatacatgtacatacatacacacctacagctacaaaactgtgggatatgattataaagggagatgactacaaagtgctgtgggaagcaaggggaagggttaaattcctttttggatagagaaggatatgagaaggggcatttttgaaatcaaaaggaaacaaaaatagaaccaataagccctttcactggcaaaatcattacagttataaagtaaatgtggctatttatgcaggttttttattagttgaactaaaaataattctgttggtatgcagttacaaatgtatagcgaaagttagggaggaaagtcttgatatacctatgttggttaatttgtacaatttttaggaataagtgttaaagtgtttatcttatatttaatgtagagaaaagaaaaggtcaaaaaaagctatttttaaataatagaagatatactgaagctttgttttgttttctaagattcctctaaaaaaaatcacaaaactctggaatacattgtccaacggagctctcaagctcttccccgggcacctgaactagaactcatcttctgagatggttgccagccctaccccatcccatggggagtgaatgccagcaggctcttgcaagcctgtgagcctttgcttcatgtacatatctacaaattcttttgtttttccagactgaactctattgatgtgaagtatcagatgtggaaactaggagtcgttttcactgacaacgtaagctaccttcaataccacaaagtaaaacgcactctgattagatgagtttactgggcttcagcaggtggaaattttcgacggctacttaagaaagttattcaaatatcggttcatttaatactgaccatatctgagaaaaacccatagaaatacatgattcatcagcccatctcccattccatttctttcaatagctgaaagattaaaatgaaaatatatttacacaagaaaatgaaacatgaaaattcacgtgtattttcattcaggttttagttgaacaatggcattcttcaaaatttttacagatgttagaaacttctaaatacgttttttaaagtttttcttaacattgattgcaatccatttgcttctgccaagttaagtccattattgtgttctttttcttgatggatcttccttttatcaaacagcctagagttaaaccataggacc

SEQ ID NO: 28290 - DNA, 841 bp, Bovine  19866880876713
aacacacatacattagaaaagattatagtgttatctaggaaatgaatcttaaggcatttttttctcagccagcaatagtcatgggtgattctcaaactagcctgttctagcatttttttttgcacaatgacttcagggacgcaatgccacagggatgctctcttccagttgttccagaaaggagtcctattcaatatctactcctcacctacacgttttctgtgggtccactttaattaaagacttacagctggctactaatatatttccaaactttcagctcaaaacagacacgtaaattaaaagcaggaaaaaaaacaaaaaaagggtctactctatttcatttaatttttttgaaaattaaaaaaaataaataaataaggagagtggtagttagcaacagctagtctttcttagatatatatattaaaaaaaaaagtgcagcctaagccaaggggggaaataatatttgctttctttttggctaaagaatattgagcaatatttcaaagtataggaaatttaaaagctgagaaggtttgagggaaaatcatgtaatagaacataattctaggaatagatgcaatcctgcctcatgcaagcagactgcgtgccaccatttacatatgtgcagggaatgagtgacctcattgggcagaagtcgaaagaggccaaatctttcggacttcattgattcagaaaaaaattcacaccaaggctttaattagaaacttgatgttgggttgctcttccataaatatttttctcccatggctgctggaaatttcagaccccatccttcaccgagatagaacaatgtaagcaacctcatctccaaggg

SEQ ID NO: 28291 - DNA, 1507 bp, Bovine  19866880893087
tgggagaggaaaataggaatcccttgcaatgtggatattaattatagatatagaaatacagatagataaattgaattttctctgaattagttattatggtgtttaattttgtgtgtcaacttgtgtgggtcaccaagtacccaaatatttgataaaactatttgatcaaattattctgggtgtttctagtttctctgcagaagggaggggtctcttttcagccttgaatcttttattaacaatgtgttttatgattctgtgctgaagcccactaattggaattgtgtatcctgtaaaattttggtataaatacattctgataaatgccaaactatcaggctgtgaagtctttgtaaggacttatgcttttatctgtatgctaatgctagatttttctggggctcagactctgaagttgagctatcccgactgtcaaagtgcctgctttctgctgagaaataagtggtttgacatctgagataaggcttaaagagtattctatagctgaaaatacaaaaatagctcactgctttcattcagtgaacaatattataacacttatgagaagtggaattgatgacaggaataatttgtccttattaaaagaataactttaaaggacttctttgagcagttttatgtgatcagcctgaaatatgagttcattaatgaagtttgttatattggaggataatgttttatgtaggccaaaatttacagcctgaatcctggaattttttaaaatgttattgaacaaggcacatattgttggttaacaggtgtgcatattttaaaaattcctattcagtgaaatttcagtgacttctgatttatgaagtagaagactctttaaaaattttgttacaaataatatcattgtccagtagttttaacactttcttttttctctttatctgtaacattgttttggttcattagttcaatagagttagtgaacagaaagctgcacacatgcttttccttctctaatctcttcagacagttctttggtttgttggatttcattatttcttcaataattaaggattgtaggctacaatctctaaaagtttacccttgcatcataaatgtgttatgaagttttcttttattaattatattctagttagggtataatttctatttcctctctgaccttaagtaatttaggagagtttcttattttcctgaattgttcttttcttcatcattttagtatttattcccaaattttatttgttatgatcagaaaatatgtgagtaaatagctacacttaaaaaaaatcttataaaattttcttatggccaagtatgagatctttattaaaagtctggggagaatccaaatggctgagccttgggtcatagcccatgatcaagggaagtgaagtttaaccttttttgttcctttttttcccttaagtttaactttttaaacttccatagaaggaataaaactctgctttcatcaaaaatcacatagggaggacagcccaaacttagaaag

SEQ ID NO: 28292 - DNA, 1556 bp, Bovine  19866880905269
caagaagaatataaagcaaatcaatgtaaaaaaatgtatattattcatgggacttgaagattttacctataattatcatgttgtattgctatatagtatatttacatatatacacatatatgtacacacacacatactgcgtggacaaagaatgaagcctgccatttaattaaacaaaggatgctgtcaccatcagcccagcaaccactgcagccacccaaacggtgtacctgaggggattcaggatggagaaaagcaggatccaggccctgagagttaaggtgcgtatcaaaggaatgatttcagggagcccagactcttgcatcttcccatatatagaaatgcacaaaattcactaacttcagatgtctggttttctttcattgtaatcttttgatgttctgactacttatttatttattgcaaaaacctgcatatcctggctcctcccttaccttttagaacagttgcccagagctgagaggctgctcctgggattaagtcctaagtaagtccaccaaataaaacacaacttccaacttttagatggtgcaatattttttttttcagttgacaacacacacacacattacagtgaagtttttaaatgcttttttcctttttgtaaggcttctaaaaaactccctcctcattttcacaagaatactataaaaagtggtttaaagttctgccctttctccttcacttctctctcctccttcatcaatatttattgagtgcttaatatacacactaggtattggagatacgacacattcaacctcatggttcatgcccttggtatctcacgatatctcaatcctaaaagtggtaaggcagttcattccatataacttcacatctgattttaaatgacccattggctaagattctacagaaggggtcattagaaaatgtggatgacagcaggaaaataggcatgctgcatttttttccaaggaatttaatgttaaccagttgactcttttttctcattctttttcaaataacagaaatgtttaaaagtttacctgaatatactctgtaagagtgttaaagacttgttttgccacttgaatagctttggagaaattcctttgtccttgttcatcaatgacatcttttccagagtaataccaatagaaatcactaattgattcctgaaaaaaaagagatgataggatttaggattaaggaatattccgaagctatcaaagacctgtccagttttggactctttaaaggaaatcattttaaataacagattggaagcaaacaaaaatatctgtgaaataaacactattttcaatgattttcctaaacataaaatatggcaaatcctccctagatataaataacatctggagagaaaataagcagaaaacttagctttaaaaatgactttttgtctctgatgaccttgaaattcacaaacataaggattcataacactaatgcatatttatccacagagtatttacatattactatgtgaacatagaaattagacaaatcatagaatataaacatctagtctactttttctccagtaaagc

SEQ ID NO: 28293 - DNA, 2258 bp, Bovine  19866880918255
tccatatatatgtgttagtatactgtattggtgtttttctttctggcttacttcagtctgtataataggttccagttttatccatctcattagaactgattcaaatgtaatctttttaatggctgagtaatactccattgtgtatatgtaccacagctttcttatccggttgtctttttttgataaataaaaatgctctaggacttgattgtgcggatttgggaaggacagttcttagattcactttgctttgatttttaaaatgcactaaaataacaatttcgagatctgaatttggctgagtcatgccaaatctcactgttttcctctttttctccttttgcaggatgatgaagtggtcctgcagtgtaccgcgaccatccacaaagaacaacagaaactatgcttggcggcagaaggatttggcaacagactttgcttcttggagtccacttcgaattccaaggtgaggtaaagccttttcagtccattcaaacattgaggttttaatagtggcgctgaagttatttgtgggcactcttcggttttctgcggaacacatcaactaaaggaaattgaacagtcttttcactatccagtaagcacttttcaattgagcccctaatccatgtaaataactcagatgcagttgttaacaggaagagacagagtctttttgctcccatgctatttatatcccaggggataagtaaacatggtaataatttcagaaccaataagggctctgaagaaaagcagagtgacagggtggagagtgctgaggtaaggacttttgcaaagagtatggagggaaggccattctgagacagtgacgtttgagctgagtgaagtgagaaagggagaagtggtaagttcctgaccattctggaaagagagaccaggcaatgcaagggcccctcattaagaatgtgctgacagtctcttgaaggaaggaccaataggcactgcagctctggtaccatgaatggggccactagtgaggggaggtgaagggcctaccagcccttggttagtattaaattgaccaaaatgtttgggtttttatgttacatcttatgggaaaacccagacaaacttattggccaaccccatagttgatattctttcctagtaagaaaggaggccattggatcaggtgagcaatgcagttctatgtaatatttaaaagattgatttgacttttttgtggattcgagcaggggtcaccaacacctggtctgcagaccagtctgtggcctctcaggaaactgggcctcaccacaagaggtgagtggtgggtgagcaagctaagcttcatctacccctccccattgcctgcattaccacccgaaccatccctgccccttcgttggtggaaaaattgtcttccgtgagactggtcctgggtgtcagaaaggttggggaccactggattagagaatgtggaaagattaagattaaaagtggggagagcagtggaaggtgcctgcagaagtttgcagggcaactgctgggtctgctgatgagaagcagtgatggtgaggaaacttagtgaggggttgggaatatgcttggaggatttagagggtgtgctgaaagatcagagtgtatagaataaaggaaagagaggaaaggcagatacctctgcaggtagacagtcaaccagaaaacagtcagtttattaatcttttgggtagcactttttagtttacagagtcatttgacatgcatgatcacatctgattgtcacaataagagtatgctatgcatagttattgctgttctgttcactgtacacttgagggcatggatggctgagagacgacaggtattagaccagaggcttcctgtgacttgatgccacagcattgataatggcaaattttcacacttaacacctcagtcttttgatttgaatccctgattattattattattatttttattagcacaggcccatgattctttatttcctgggtctgcgacccacatctaatcaggtcgagtaaccataaacactgccaaaatgcccagagtactactcctacggaagcaggcagtcactgagtgcgagaggagctgggtagcgtcacctgcagggagttataggctgacggctttgggtgtttgcacaaactccttgagaggcctgcgggatgctgagccacgtagattgagccttcaacagctactgcaggaccgtggtggaaaacgcaaatctgacctgttttctgctggaatcattggcggggacgagg

SEQ ID NO: 28294 - DNA, 1358 bp, Bovine  19866880930895
atataccgcttgctttccgtgatctgcaagggcaggtaaagaattcctgtcactcttgcaagccagatgctgcttcactcaattttgctttcatccagcactcagaaaggatgcccactgactagtagggaaattatcacttcaccttactttcagggcaaaggaacaggaaggggctttgagtaatgaagccagaaataccacttatctcagctgatttccctggttctttcccagggctgtgtggtgggaggaacctgttatttgttcttctacaccttggtaatgggggctagcccctcactagtgggcaggtgggatgacttagccaagtacccagcagaggtttctgctttctcagtaatgaaggtccctctgtcctagagaccatcctacatgacaagcagtaagtcaggtatattcttcacagctaagccagtccagttctcccccaatcactagggcattcctgaccaacttaaacagagtccagggtcagctcttctcacctgttttgtagtaccacaagtagtaaatggaaaccggaacagaacaaaagtgtgtgttgccatcacaggtttacattcgctgtcattcctgaaggccaagtgtacagaattcaagagcagtgggggcgaggtcacgttccgggacacagcaatagagaaatggccatcttgggtacagtgtgaggtcactgaaacaccagagcaactatgctgaaggcaggtcacgtcaagtgattgatccagccagacaagagtctaaaaattatagtttcattattttaaattccccaccctcctcttctcccactagaaaagctggcattccaggtaatgaccttgaagcaggttcagccatccagaatttaactggggctttggatgggcacttgggtttgaatcttgcctccactacttactgtgtatttaacctccttgtatcagcttcacctgtagaatgaagatagccatacctgctgtttcactcatcagctaggattaagagcttagaattatgtagcatcttgtttcatgaaggtcatttttacgtgagaaagacttggaacatgatttgggacagtgttcgtttgaaataaggctcatcttctgaaataaagttctttatacacaatcagccaccagattgtctatttcttgaaactggttaagtttctatcaattaacatcctgcacatagacttagcttcctgagttcattgaatgttatttgctttctgttgggttctagaagaatatgcaatggaagactatagaaagctgggtcactgaaggtcaagtgttctaaggaggtactaacttatacattaacctttggtcatctttcagtatttg

SEQ ID NO: 28295 - DNA, 1209 bp, Bovine  19866881007813
caagtttgtacaaaaaatcatactccaggttttccaacatttttaatatttcttcaccctgcgattcctctctattcccaaccaaaagattacatccagaagcaagaatgttttaacttatgggtgtgagagaaaaaagacagaaacaaacaaagcctgcctgaaaccaaacatttgaagggtagggagaaaggtgatttaacaagcactctggcttcatgctcagagcagtttagaagtgtatctgccttcctccatagcactggtccatctgctacaacctctggttgcttcccacccatcaacagatcatgaagctgatttcatggaccttggctagcatttttaaaattaatacaatggggaaaaaacagaaaaaagtataaaatatcagaatgtatcacagagaatcattccacaaacttcaattacattttggtcagaaagtttacgaaaacactaagcaatacctctttcctttcccatagcagctccttcaaaaggactaaatactatatagcaaggaaataattcttgagcggagtggtgctttatacatacagtaaaacaggaaaggacattatataggaaaaaatatgctctttccctcttagagtgtgggaagtcttatatgagttttagagatacattagaactgactattctattaatgaatcatactgaaatctcattactaatttttataaccaaggtatttccaactaaacaaacacttgttcagcaattatgctacagctattatttttaatggagcatgaagattacctggttttggatgttttgtgctcttcgtcagcactggatctcttaacagagagagataagccaggatttttgctcctggactccaagacacttacatgcatttcaggagcacatcgtcctaacaggtcaattaaagctgaataaaaggtcatgatggcatttcccatgtggatggtatcatcctcttcctcttctgtatcactttcatggatttttcaaaagaaacaaaaaaagcaaacaggataataaagtaacatttcaatttattacatatttctcaaacgaaagggatcagcatggtaataaattctgcctcctctgacacttttcacatatatgtttaataaatagcttatcatttctaaaagaaaaaaatgggttaaagatatgatttgagattctatcgccaagaacacatgtgtg

SEQ ID NO: 28296 - DNA, 1353 bp, Bovine  19866881086451
cacccccaaaaattaatttaacctttttgggtatttttttttcaccaaatttacatttatatattttgaagaattaagtcattggtgaagaaattagcattaacagcccttgtaatggattggggctcagatcaagtgtcatttgtgacaattatagtgaattacttctatacaatttgtacacctgagtactttacatttctgttctaagaaagtgatctccatttgaaacgaataaacctttctacaaggttcctttgagatcctttttagtactatgtagctctcagacagtgatcacaggttctaattttatgtttaattgctgcaaatgagctacattctctctgttgacaaggcagccttgctttgaaagtataaatacacatggacccatttagctttgcaatttcacatgaaaatttctgataatggatttatttctaatttctgttttaaactgtaagaaaatatatattctattttgttctctctgatgactattgccccaaaatatcaccattcttattcaggttttaaatactgtatttttctttttgtgtaatcttgtatatttctcttgttctgtaaaccaagaaacatttttgactttaaatctccagaagaatgtaatgatctccatgggttagatgcattgctgcagaattatgcttttagcgtctgaaatcttcctaaactggccataatctacctgttccatctcctactggctttgtacctcaggcacatcagctctgcccagcattcaagacttcagtcaacccatgtttcccgtctggaaaatggtcgtgcatgagttctctgtggccccacttaaatgttacattcctttcatttctctataggcagggttacctgcttacttagctgaacacgtgtatatttgcgttgttctcacttgttatcatatttggttaccaaccctgcctcccagacaccagctgtccctaatcacagatattcggagacaaacgcattgagctcataattgtactatgttcagtcaacacctcaataaacacatagagaggagcaaagtcactgatcattgtagactaattaatcatattgccccctttctttattttctgtttaggtattcttgaagttttacactgtgtgttagtagaaagtccagaagctctaaatattattaaagaaggccatataaaatccattatctcacttttagacaagcatggaagaaatcacaaggtaagtgaaccattttattgcctgaaatgaattctggaataatttcaaacatactctttaaaaaagataatttttaaaaggtgtgtcacatttttcatgttttttactttttaattt

SEQ ID NO: 28297 - DNA, 1522 bp, Bovine  19866881103100
catggaagggaaaattgaaggaagaagcattaaaataaataaggattgaaaggaaatatttagttggtatcagaggattgattgtttcttcctagcatagggagctctgtagtccaaaacccatattgaaactgaattatacccttgattagtgtttgaaagaaatcatcattattcctaacaccctcattaaaacaaaattaatcattaccattataaataacagattcatggtcaaaatcctgaaagtttattaaagtgtttattttatcgcagattctgtgctgaaagggttgcattcattatctcatttttttctgatactgtgggggaggttctcttgttagctttatttacagatgagaaaacagaggcttaaaaggtttaattaagttatcctaagacttcagaggtactaagtggcagagattaggctcaaaattgaattttctatccccccccaacctttactcttagtcatcaatcataaaaataataatctagaaagaatatgaaacctaaattactgattttaaggtctccagtttggagtttgccatgaagcaatataaaattttgtgttatggccgaaataattttctccccgtatgaataattcaggagtatgttatttatccttgcaatctcctactcagtttccattagagatttaactgctacaatagaacatttgaccattatcatttcagagggctacatttttcaagggacatgatttacaacaaggcaaagttcttttgatattaaacccatattttttaaaagcctttgcttatctttttttttttcctctctcaggaaaaattggatgtaggagtgagaaaagaagttgatggcatgggaacctctgaaataaaatatggagactcagtatgttatatacagcatatcaatacaggcttgtggctgacttaccagtctgtggatgtgaaatcggtgagaatgggatccatacaacgtaaggtaagaatgtacaaaaacactgtctatggcagtcattcttaatgactgaaaaatacaaatgcaagaccaaaacaagtagctaacactctcagccacttgctatgttatttacatgctagaggtccagtcccaccctgataagctctctggtttttgtatggtgagcagttttagatgttgctttgttgttgtcgtttagttgctcagtcctgtttgacttttttcgaccccatgaactgtatggcctgccaggctcctctggatagaataccgaagcaggttgcctttcctcctccagtagaccgtgttttatcagcactctccactttgatccatcgcttttgggtgtccctgcgtggggcgtggctcatagcttcattgagttacatagccccttcgccacacaaggctgtgaaccatgaaagggttgaaattttagttttttgtgtgtttttcgttatcgcacccaagtcacgcttatctcagcttgctgtcatttcatctattctggttgttcatctcagtatgacttctgatt

SEQ ID NO: 28298 - DNA, 1598 bp, Bovine  19866881130857
ttttcaaagatattgactatgttatccctgctcatccccacacactccttcccaactcactcagagtaagagccaacccatggttattgcactaaggagccttcaaaagctgatccaactcctccctcctatctagcttctatcttccttccatcctgcccctcatcactccacaataattactatttccaggacacacttctgttcatatttttgtttggaattaatccctcaaaacaacagctttttgaagcccctctcattttcatacaaagccttatcaacaccatcaacatcttcttcctagcctgctttaagcagcactttttagtttgtggaattttttcaggctctgcatttcacacttcaccataactagctctgtctggcaagagaggttaagactagtatccaggtctcagactgatttttcccaaagttaaacagctagttaaatgattgctattaattttctaaatgttttcatttctaaatatgcatatattattagaaatctccaccagaagacttaaagccatgtaataaatcacccagatcatgccttctctcacagtaatctcttacacatcctaccatatccattcattaatttgtgaggcaaatgaaacattcaaatcatcctaaatatttttatgctttttaattacttgtgcattttttcctgtgatccagactacttctatcttggcccagtgcaaaataatattaacacaagagcagtattaaaatcacataaaatattaggggaaatgattaatttttttacttatgtcaggtggcactggtggtaaagagcccacctgccaatgtaggagacataagggacgcaggtttgatccctaggtcaggaagatcccctggaagagggcatggcaacccactccagtattcttacctagagaatctcatgcacaaagcagcctagtgggctacagtccataagatcgcaaagagctggacatgactgaagcaacttagcacacacatcagtcaatgggaggtaacagaaaaaggtcctaaacttctgggcactttgagaactctgactttgaaactgaatttgagactaaacattccagaaagagaattcatcaaaaaaaaaaaaagaacatttaatgaagccctaagtaattaaatgtgttcactcttcccactcagtttcttgtattcaatgcttctaaccatggtttcattatacaaaaattttcagcaactctactgataggcagtgaaaacctaatatgagaaaaaaatttcagaggaaatcaacaaatggatcgcttcagtggacagacaaaccatagtggcccactttctattacatgaatggcctgaacagacctatccttaatttataaaaattgtatcaaaacatgaaaatgaaaggcttaaagctctgggcccaggtaccaacctccgctgctcttcaccgtgttctcctgaagggacagtgaggcattcatccatgtgtccatgaagcaacctgaggacgtcaccaccaatcagataccctagaaggatcgaaacgcagtcacatttgaattgtcatcattggatatcgaaagctaaacagatca

SEQ ID NO: 28299 - DNA, 2635 bp, Bovine  19866881223509
ctatataacaaaactgctgttttctatagtttgtttcttttcagcttctttttggagaggagggatgaagaagttataaacccaaagtatcatactgacaaatatttaaaatatgtcccagaacaacaaaagtcatgccctaaaaatctgcaaaatttccacttattttctgatgagtatctattgctacctcagtcatcaaaagataacaccgagaataagtggtaaagaataaaacagaataaaccaaaaataaagaggcacagtgattctgcactgctaggattcaaatcctaactctaccacacatgagctctgtgactctgggcaaattacttaacctctctggtttccttatcgttgaaagaaatattatagtaacaggcctatttcatagggttactaaccagataaaggcgttatcagttgcaaaacacttaatacaggtatagagcaagtgctagagaaatagttattacaggacttccctggaagaagtcccttcttccctagaggttcagaatccacttgcgcacgcagggcatgagtttgagccctactccaggaagattccacatgctgcagggcagctgagcccatgtgccacaacctctgagccagcacgctagagccctctagccacgaccaagaccatttgcctagagcctgagctctgcagcaagagaagctaccacgatgagaaacgcatgcaccacagctagacagtggcccctccacaccacaattaaagaaagccctcaagttccaacgaagacaccatacagccccccagaagaaaacatttcatttcatttaaaaagactttaagaaatatttatgacagtcaccaaaaatcaggtcattaacaaaagtttccggagtaaattcaaattagcataattttaaatttaattattgatgtagccattgatatattactgaatttttactagaaaatgattttatgttgcatttttccctgaatcagagatgactgcagccatgaaattatttttcatgatccacagagttgagcgaaccctagaactgttgcgaccctgtgctgttctctattgttatttctcaagccaaaaacttctcgcctcagttatggaagcaaaatgtccccaaaggcaaagaccacatcagactttcttttcataaactctgcagaactttgcaacctactaggcaggaagtctgcattggagaaggaaatggcaacccactccagtgttcttgcctgaagaatcccagggacgggggagcccggtgggctgccatctatggggtcacacagagtcagacacgactgaagcgacttagcagcagcagcagcagcagcagcagcagcagcaggcatgaagtctgcactcatcaagttaattggattaatctgacaatttttaaccttacgaacctggcattttttttattaattcagtttattaaattcttagtgtaaatatagaaaacttggtcaatcttgtttggttagactataatccttcaatttgttgaaaactttcttagggcatacatgaactaccatttcttcagaaagaaagaaaaaagcaaaaatacttccagaaataacttctacagtaattttctgaatccttttcccagttttccaagacctaaatattgtggattacaacataaattctggacattggcccattccaaaacaacaggaacaaatcagtcctccaagctgaaaacctactcttccccatttttcaatacttctcagagtgggagcctatttgagaaaacagaagatttagtccttatttataaatgctaaagagatagaaactagcacagaaaaaagaattgtaagaaaaagattctaccctcagaaaaatgttaatgttatattcaaacatatttaacccatatcattaaaaatctaattcccagaagcttcctggtggcccagtggttaggaccctgtgcttccactgcagggggtacgggttagatccctggttctggaactaagatcctgcaagctgtactgcatggctaaaaaaaaaagtatttaaaaaaaatctgattcccttaaaatgcaaggattaagcacaccacatttcatgaaaaggcaatgctgttcagatgctaatacattcatataatgacagaaaatgctaacacttttgtagactcaaaacatatagtcctatagtaataaaaaatatatttattacagataggaacaagtgaatcatttcattcgcaggcaatttgatgagcaatgactcatctgcagtactttctggaaactattctatcaaaaactctgaaatgtatggccataacctagacttaatatatgacctaataaaagtcattacctcaatacaattctcctgtgaaatcatatactctaatttccccactggacaatcttccttctctttcccactgcctctttgccaaaaatttgtccaggagtatcagacagtgttcctgacttcttttccttctttaagcagcaaccccactcacgcatgattgatcaaatcaactataactatactttaaacccagttccctcagtaattctctacttcccttgtccttctgctgcaaccaccttgcatctcacatcctcagatcaatacagcta

SEQ ID NO: 28300 - DNA, 1271 bp, Bovine  19866881317390
atcccctggagaagggaaaggcaacccactccagttttcttgtctggaaaatcccaaggaccgaggagcttgtcgggctacagtccatggggtcgcaaagagttggacatcactgagcgaccaacacatccacatgtctcccaaatgtggccagaaacaggaaatactgctataacttaacatctttttttacttaacctccaaatctctccctatttgttctaaaaaagaaactagcatcccaacctgggcaagatggttctttgggaaagaagtgcaccatcttctcagcctgcgaactttctgaatacagtcactattcctcattccaacacctcaactcccaatttactggaatgtcatataggaagaagatgaactggggctgtgtaacactggcaggacaaaaacccatctcctgtgctcctttcagacagacacatacatgcacacacacacacacaaatatacacacatgcattcagagaaatagtgacatgccacatcacatatgtgtatgacaggccgacccgtacttgaccaagaaaattttgctctgataaaaatttgaaatgtatcttttactaactatggtcaattgacctgattagaaaattaatggatttcattccaaatgccagaaaatgagatgggcatgttcccaagtacaacaagaagctggttaaatttatgaagaaatataaaattatgcaggaacacaagtacacacacacacacagaccaaggtcaatgttaataggttgtgaattcactgcaatcttttttctctgtttacctgcaattttactggctctggcagtttcatttggagcaggccctccttgggcctcttagcccctttgttttcttcctcagcggctccttccagcttggagtcttccacaaagggttccttctccgccacctcgctctcctcctccgggctggcggcttccttgaacacactaggctcaatcaactgcaagacgtgtttcaagtcctcgttgtggaagacacccatgatgagcagggtatagaacagcttgatgagagggacgaagaggaactcagtggtgcccccaacggggtctcgggcatgaaggctgccctctttcacggcttctgtcagcatctgtatggtcttggccttcaggatgtccagcgggaactctgggctgtactggtaaccctcggtattaatgctgacaaaactcggggaggaaaactgcatccgcggcctgagggaggtgctgaggccgatgcccgggagc

SEQ ID NO: 28301 - DNA, 1568 bp, Bovine  19866881369250
tttatataaacttcaagacctttttttttgatagtttttttcttctgatgcacactgcatcataggatggtgggaagaagacagatagttaagaccgtcagctctgattttgagagtcaaggattatctatgctcttcctaccacacattatttaatgtagatcactttttaaagaaaatataacaaggcatacacagtacttgtacattgtaaaatacagtaaacattattttgcagctccttcttattccttgaaccctccagttgccaagctgaatcaattcatgccatgtaccataatgagctgtagctccagggtatatatatggtctgaggtagaagggccacaaatatccgctgaatggagtgatcttttccccctttgattccaccagtttagtgggactcagagggtggttggtgattagcagctgcaaattttttgttaccagtctgaggggagaaagagagtttgccaagaatttaaattaagtacatcatttaaaatgaagcacattaaagaaaacagaacaacacaaaaacccctcaagactttctagttggaaggagcagaatgtttgctgattttcattttggtgcaagttttttgtctccttgtgaccgcaaagtagtagcattgcactaatgcagatgagtcatccaaattaggccagagctttgaaagaatcatttttaagtaacttaaaatagatgatttgccatacatcaacatgaacccaccacaggttaaattaaaaaaaaagatttgaatattttattcatatttgatttgaatattttattcatattaattatttaataatataaagaagcaaaagttatctccaaaggaaatgatatatctagagtcaaataagtagacaaattgtaattgtggctaagactcttcatggcgttcctgctcttgggtccagtttgtcctcctgggtgagaatataacccctaaagaactcccactcagatcagcccagccccttttcagtactgtgagaataatgcaaaacaaattgttttaatgaacctaaatagtatacattcataggactttaaactactattgctctttaatgtttatttcactttacctgtttgtacacattccaaaaatgcttattttaatttctgctaatcctttctttctgtttatgtatttttccattacctactctaatcttttaacatcccccctcctttccctctggttcccagtgcctttgcttctcctagatcccttttccttgctttctttccctcttttgctgccagttctctctccttctggatttctttcattattttgctgttgcctcattttcactgatgtgcaggatcctcctggtacataaaccctaggccaagagttgctatataagagacagaggtactgagctcacaggtgatctgtgagcccacgtccaagcattgattaaaaacccagtacttgtgcaaagccaggcaaatgtgacaggacagaggggcaaggaaatcaaggtgggttgctaagaagtgattctagtgatggataaagcatctatactagaattaa

SEQ ID NO: 28302 - DNA, 1647 bp, Bovine  19866881597295
tagctgtacatggtcctgtcccttaggaggattagccaaggggctgtaaatttcataatcattttctggttgctaaagattaaatcctgtctttatttaacactaggtttaatcatcgatgcttttggggaactaagagaccaacaggaacaggtcaaagaagacatggaggtaagtctgtttctcactctacatttttgttgtggacactctgtcttcactgcctttatcaaagaattatggcagtgggaggaaggaggaggaacatgaaaaatgtgtaacttcattggcctgtttttggttcaggcaatacatgtagttgagcaaggtggtgggctccagatacatacagacagtaatatggcagcatccacccctccaggagtgggaagaccatccattctaaatgacggattcatggacagattagtaaacaggcaatcacagagcagtgtgatgagcacttataggaggaaaccctgagtactggggtccttgaggcttgtgtctcatttcatcttggataatcagggaagttcttaaaagaagagatgcacaaacggaggcctgatgattgcagagatgtggatgtgagagagcacgcaggatagtttagggaaccttctcacccccactatgtgccccactaggccccctggattctgtgagatgtcactgcctgaggttctatataccaagacactggttttcgggaatttgatatgcagatttttcccttggaagcataattggtgcaggatgaagtattacattctaataatgggactagcaaggaaggccaactaattaagagcctaaaaacgcatttgagaaatttacagtataacttacaagctaggaaacaagaaaagggttttaagcagggcagtgacgtgatcagatttacaataaaaaaaatatcaattaaaaagggaatgaaggcatgaccaggaacagggaagcagctgtcagcattttctaggtaggagatgatgaagctcttgctaaagaagtgccactgaggaggtgggaaccagatggactcaaggagcactttggagctggcatgaaaagaacttggtgattggccatatgcagaggatgaagtttggagcaagcagaaatgatactgaggttctgacatgagcctctagaaagaagcatggtggctcagttaaacacagagtgaccaagggaggtaacagaggaagggcaggttcctggggaaagctgataagtgagaacctatttatagaagagacactgaatggtgtccaagactggacctctgaatggagcctttctgtcatcagcagttgttgatcagtaaagcaaagagaattataaaatatcttaataatcttgattctagcatctagggcatcataaacatgcctctagtggtacaaaatagcatctaatttgcagggatgaggagcatctggagctgcatgaggacaatcgttattgaattcatttgagttgatacataggcagtgctaatggtaaaatggaaagcctgcttctccctgggttttgggcctgcagatggcagacctagcaagtgaagagagagatggatgggatgggagaagcggggagagaaggcatcctatttctagagcagattgtcatcccagtacaggc

SEQ ID NO: 28303 - DNA, 1720 bp, Bovine  19866881619514
tgctgcaatagaaagagtccatactttgaggtatcaacaggttgtggattaaagttcccttcagaatccattgatgactgtttttccatcatactgacataatttgactccatgtagtctggaggcaaagctcccgcaactgcactcaggcaaggcagtgccagtttgaaaagttcttgttcatatttctgggaagaaatggaggaccaaaaaaataaatatcccattacaacttggcaaaagttgtcaacatgagcactgcgactgacatgatgttgtaggagaaaatctgaattaccttcagctaactcaattcccccaaagattctttttctagaaaacggaaagtgaaagtgaagtgtgaagttgctcagtcatgtctgactctttgcgaccccgtggactatagtccaccaggctcctctgtccatgggattctccaggcaataatactggagtgggttgccatttcctgccccaggggatcttcccaacccagggatcaaaccaaagtctcctacattgcagcagatgctttaacctctgagccaccaggaaagccccagaaaacggaaaatatggccttaaatcccaccaaacacaagagaaactgaagctttttactgaagttgtagcataaaaagaataaaatctttgcttctctaaaagtttgttttccaatatgtgaagtgaggtgaacttgaatattcaaagtgtacaatatgcttttacaacataaacatgatttcagtcgaggagtacattagttatagtttatcacagctagttacagattattgctgtaccacagtataaagactatatatgaaaaatacctaaaggataacacccagagagtaaaaaattttaattttataccttgcatttcaaggtataaaaaaaattctgaacagagaaacaacttttacaggaaaaatgtataaccaaaacttccagggaaaagtatattagttatatagttaaactgtatttacagattttttaaaaaatcaaaaataataattattttaaagttatctcactttaagtgcttttaaagtgcaaattcttctaaaaatacgttctacatattgttttaaaaggactctcagtttcccaaacacaattcagcaagaaaaagcattcagatgtagctaccacatgttgtcacagataaacttcctttactatgtagcaaacttctgttatactattccagtcatctgataatgtctatctgggaattcaaactgattttgattaatgatttaagcataagcatagcaagcatgttctgattttcactgaaatactatgcttcagtttcctgaaaagtgtacaaaaccattcactgcaaatatggcaaatattagaggatgtcatgtacttaaagcaagagtgaatgcagacacttaagtcaccatagcagcaaagtgtgaaaagtcaataaggctactggaatattataattttatgagctttaatacttaacatttttacatttgacaagatttcttcaggctttataagattggggaggtgactgatgaggaagggtttgagtccaaataagtccaaatataccagaaactgatcaatccatgtgaataatttgctaaaatgcttagccattttcaagtcaaaaagtgttgtaattacaagaaacatgttaccatcatgactatgaaaagtcaatataaattgcattctcaacatttgt

SEQ ID NO: 28304 - DNA, 875 bp, Bovine  19866881913577
acatcctcaagttcctgcagatcaatggctatgctgtatccaggtaaaagcacacctactccaggttataagtaggtgttataagacttgttataagactgttataagacttgttataagactgaatattcaattagccctgtcagatttaatgctgaaaatgagctccgtggcctctttaaatgtcagagctctatttagcgtgttcaaaatatacatgttgaaaacattaatgcccttagctgccatataattgagttccctacactttttatgtcaagtctccgttcatcatttaggcaaaatctctaggcagaaatgacactctgtattttgaaatgcaagatcttattgtgtagtaatatttattaactacagcttcttatcatatgcaaagtattttttataatttatttttagctataaaatattagctaaccttgcaaatgtatcaatatctgtgtataaatgtatatattgctatatgtaaaatgttaagatacctctctgtatgtagatatttaacaaaatatattttgtttttaccttgccttctaataatctttcttagatgttggtttccattttttgtttttgccatcctagagggttcaaagacctggaactggacacaccttctattgagaaacggtttgcctatagtttccttcagcaactcattcgctatgtagatgaggcccatcagtatatcctggagtttggtaggtaccatggtcctgttactaacagcccagtttttgttatgtttgttatttacaacatcaggatctagaacagcatagaccactgggatgcttatggtctgttccctgatggtgtaaacatttttatatcaatcctaatattaacttgag

SEQ ID NO: 28305 - DNA, 2248 bp, Bovine  19866880165999
acaaggatgcccactttcaccattactattcaacatagttttggaagttttggccacagcaatcagagcagaaaaagaaataaaaggaatccaaattggaaaagaagaagtaaaactctcactgtttgcagatgacatgatcctttacatagaaaaccctaaagactccaccagaaaattactagaactaatcaatgattatagtaaagttgcaggatataaaatcaacacacagaaatcccttgcattcctatacactaataatgagaaaacagaaagagaaattaaggaaacaattccattcaccattgcaatgggaagaataaaatacttaggaatatgtctacctaaagaaaccaaagacctatatatagaaaacctttctgatttttttgtgattgggtaagataaacgactagttctggataatgaattgggagtggaagggatgagtgttatttctagactgaaacatttaattaccagtgcaagaatcttcagacatctcttttcttctagtgtggtgactggcaatgttagagatagtaactactccatcaacccagactcctgacccacaatacacatataacatgaggaagaacctttgctaatttggggcagcaagatgttggagatgtacgttcctgcagcgtcacctagctaattcttcatgatacaatatgtgtcatccccatggggcagtgaactcctcaacagtcttcagccagttcagtctggcatccctattatcttgcaaatgcatggtagctgggtgttcaatgtaacatttgttgaatgaatgcaaacagaagtaaagcatttaaatcccagggatatcaatagaaaaccattaataaaaatacagtgtttttatgccccttggaaaaaaaaaaggccacttgagaaatgtacttaaaaccaattcacagctgttttcgttaagttttcagtgcagttttgtattctggctctggaccttgtattgcaatgaggggaatgtttgttaaagaaatggtgcaggcatacgtgtttaatttgtacatctctgtgtagttggatgattggtcctaacagaccgtcagagctttttagaaaacagcactcagcaatgtgcacattgccttgattaggtgagctcctgttgttgttcagtcgccaaatcatgtccgactctccttgaccccatggatgcagaattccaggcttccgggtccctcaccatctcccagagtttgcctgagttcatgtacattgaatgtaggggattgcataactcagtgaagctatgagtcatgccatgcaaggccacccaagactgacaggtcagagtggagagttctgacaaaacgtgatccacttgaggagagaatggcaaaccactcccagtatacttgctgtaagaaccccatgaactgcattaaaaaaaggcaaaaaagctcctaggtgcagagacctagcaagggtctgcctagttatccccacagatgttaagggactagctgtttgagagcaattagttactgagacttaacttttttcagtgatggaaaatgatgagaagctgcccttgaaccagctgtgtgtttgcctttgtaagtgaccagaacactgtgtcaaagctccatacatgaactaataacttgcatttggaactgcttcccccgtcttcctggaagaggctcaacattaggaaatattgactaatggtgaagagaaagaaccctgggaggcctgtctagtcagggagggcttcagggaatctttacaggagccagagataagtaagatatggcttgattaaccacaaaaagataacaatgagcaaagtggacagtgtttggagggggacaagctcagacatcagggattctgagaaggagtcattcttattattttatcacattggagcatgatcaacttgtgcttctccaaacctgtaatctgggtgagggattcccaagcctttgccagccctgaaacttctctcaatgtgacctctttccataaactaagaagggatagagaaaggtagtgcactgattaaaagagggctctgcctgagaaccagacctgtctgactggaggtcagatcccaaagccgccacctactactgtatgcttttcacctcattgaacctcaattttgtcatctataaaatggtgtgcttatcacactggagtgttctgaagattcaacaacatcatgcatgtaaaactctcactattctcataagcacatactaag

SEQ ID NO: 28306 - DNA, 1648 bp, Bovine  19866880364613
aatggctgagctgggtgattctggcttcaggtctcttgtgaggaggcagtcagtttacagctgggctgtagttatctgaaggttggactggggctggaggatggctcactcacatggcagacacgtaagcgctgcttgtcagcaggatgcctccgttcctcaacacctggacctcctcattgagctgatgtcccccaacagacttggtgactggcttttcccaaatcttccttgcttgttgatgtcaaattttgttcagtgcagcagtgtgcccacctttataaacatgaattcccaagctcactgggcctatggtggccctgtgataccattctagccaataagatgtaagagaaagctcttattttcctggttaagggagagtctcacttggcacacgcttttacctttacctgtttttcctgcctgaaactcacatgcgatgtctggatatgcaagcaccatgatgaacatcacatatgaggaatggcagggggcaatgatgaaaggcgcttagaccctgacagcttcatggagcttctattcctgactagagtgcttaactcttcacttcttatacttaagaaaaatgacccagtttggttacatccctgttgtcagtttcttgtttcatgcacctggacacaatcctaacacattcctttgtcttcttctaaacttctaggactactattactataaacatcacactgaattttccttactgacatgggcttctcctcaacttttcactgaacttaataaaggaaaacatcagattatacctaactttgtgtggtacatttttattaaaccactgggcttatatttaaaagaaacctttaatgaattctttgagcttttgacctcaaagaataagttcaatcattctattggtgatcagtaagtctggtctcatcctgactttctttctcactagagccaagatctgggtcagagaagacagacatcaaaggcagctggggtggagaggggaagacctgtttgatgtgaaaaaagagggagaggtctttgctaagttgactacaaagaagcacttctgtggaaatggctgctggcttgccaggtcattatttttgccattcaccttgcatgggtcagaggactcgaagacagattcctgcagccagagagtctaagctcatcgtgaacgtgactccaacctgtcactgggtgccctccccactcctttaagtgcatcttcctcaaaggataatgagggaagagtcaaagttgattccagggtgatgaggtgactagggggatggtgtgtcattaagagaaatgggtggtcaggggctggcgtgcagagcacacagcagacgggctttcaacatccaagtggaggtgtgcaacgggccagcaggaatttaacttggagagttgtaagaatgcttgaagtggtccctgaagatgtgaggatggaaatgactccctaaaggggagaatagagcaagaagagaaacagatcaggattggaactgcagggaatctcccaacttgggtcaagaaaagagaaaaaacaggggcatttaggacagcaaaattattctgtttgattctgtaatagtggatgcagttttctttttctttttttttttttttagtaagtactagtaattttatt

SEQ ID NO: 28307 - DNA, 1182 bp, Bovine  19866880565006
atagacagaaaggccaagggacaggaatgattatggcatctcatgagatagcactgttcttacctgtcaagtcacagacctataatgaaaagtggcagaaattgtcacggggatgttgtgagcttgagagcagagagctagcttgtcccttttctcctgtttttgaatggagggagtacttcttgtcctgctgttttcagttggccagaacctatagaagatgttccctaccactgataattcccatcctcactggtgtgatactcttactgtttagttgctaagttgtgttcgactcttttgtggcctcatggactctagcccccctggcccctctttccttgggatttcccggccaagagtactgggagtgggttgccatttccttctccaggggtcttcctgaccctgggatcaaacccacatctcctgctgggcaagtggattctttttaccactgagccaccagggaagccctttggtactcttgggagagcccccttttagaacttgagggtattaactggatcagtccttcaagccctcctaaccttggggaatatcttagtcatttggctagacagtagttctattacattttagagagaaaagagtctcgtgtattaaaagtgcacatttatgtgctggtccactttgtgaaatcaatcagatttagttctgaaacattactcaaagacagttaactttgacaagaagaacatactgaatatgatattccaggatcaagaaagaatgcttattttttcctcaaatgaattatatattaacatgattatgcaaatgtttgtatgcagcatcttttttgctttatcatttttgtcttccagaaaaccatatatcactgttacttacaaaatcaatatgtcctgatattgtaacacaaattcataaataattttaaaatttacacatttgtcaaagataaagagattcttactaaattccttagagactcttgatttaaagtactgtcttgtaaagtactcttacaagagactagtttaaggtgctatactttaagagagtactctacgtattgtaaggtgatagtgcacaagccataattcaaatttttgattcagaaaattatataaaaatgccagtcagctcactctcagcagctatgggacccgtgagttaccaaaaaggcaaaatgctaag

SEQ ID NO: 28308 - DNA, 732 bp, Bovine  19866880584560
cactctagagagcctgccctgctcttctgtctgtggaattctccaggcgagaatactggagcgggtagccattcccatctccagaggatcttcccaaaccagggattgaatccaggtctcctgcatggcaggcagattcttgaacctgttaacctaggcaccagagaatcatacaatgcatatgtggccttatctgtgaataaaattcctataaacgtgagatacaataacacatctttactgagctgacctactgaatgcctgcacatgtttcaaatttacatggaattattctctcaggagattccattctcccttgaaaaacacacatgtacaaaaacaaaacttgatttaaatgaaacagacaccttaagaatcttaacaagtagagctgaccttggaaagtaattcgacaagacttattggacttggagatattggacagatcaatgcatgacaactcccctcctgaacttccataacatccagaggaggacagattccatgagactcatgggcaagggtgacttggccaaaatcaggtggtgctatttttcctaccaagcctggctataatcaagagcccttctttctccctggaagctagcatcatgtgtttcccttcatttgatagtagcaaagccttttagtacagagaccatgggaggttgcctttctgtctaagcagaatatacatgtgcagtaacatacatgtacatacacagggacata

SEQ ID NO: 28309 - DNA, 1852 bp, Bovine  19866880587310
ttcctggaggatcttttccaagtaggaatattacctagctttagtccatatttatatatagtcacggaatactggtactgtcgggacactgcttttttaccaatgaagaagtaagaacgtgggtaaatattggcatcacatgggtatcttcagcctctgattgtgttactgtctcagaagtggtagagaaggtttctcccctgcttaccaagtattcttttgaactttatatgttaattgaatataccccaatacaaaataaaaaaacacttaaaaaacaaaataagaaccctattaaattgtacatacaatttgttttaaaaaagtatatgaagctggatgcagtacatagggaaaatgagatgttacaaaaaatggaaaagcttttagaccattatcactgatgctccacctcaccaccctccaacagagtgctccagtctatatcctctccctcctagggaggcactccatgcaggcattcatgattattcagggattttagtccaccaaccagcctggctttccaggtggctcagccctaaagcattctcatgcagtgcaggagatgccggagacctgggttcgatccctgagtcgggaaaatcccctggaggaggaaatggcaacctactccagtattcttccaggagaatcccatggacagaggagtctggcaggctacagtccatgaggtctcaaatagtcgagcgcaactgagcaccacgcaacgagtcttcttatttcacagtgaacatggcagtgatggattgaacgcgttgaagagaaaagtgattgattttctgacaagaagccattctatgtcctcttatcagccagccccgccccctaaactgaaagggtaagaagctaaatgctgaaacaattaaggttacttgacattctaactcctggccactagaggggggtagcgaccaggcttcttctctccccagctggatgagaggcctctgcccaaactgaaatgttatcccttgaagagtgacaattcagcatacggttctgttcattagcttttccctctgtggagtcagtgtttcctactcaagtaaaggtagctcgtctttcctaagaggagtatttccaaccttgttagtgggtatagagtctttggccgctttaaagtcatagcgcctggatgtggggcaaatagaatggtgcacacaccttccccacccctaagacatagtttccacatatgatctgatatatggccttatcaagggagaaaatattttaggttccagaacatgcgtgattattgtttggtctctgttcaaacaagagtaaagggaaattagcatctaaggaaaatcataagcattgctactctttcaaggagatctctgtgtccacagatgcctctaattccactaaaaccatctctggcttgtgaagggtgcccaaggctgatgcttatttctgggatgcctgcgtaaggctggcttctgctatgtaggtcctggcattcgtctcctggaaagtgttacgaggattaaagcaatcaatattgttcagtaaatggagaatctaaaatagttgcaaatgtagcacccctaagttttaaatcagaaatatacataagtaggcagagtatgcacgacaggaacagaatccaggcaatcaaaggggttccttgtgaataattatcaaattgatttggtaggttatttctgtgttatcttagtatttggatttttattcttgtcaaagcaggaagagagtagttacagagggaaggacactgaaggcaggaagaggaaaacacgtgggactgggaaggcggagcttgggaagatcgcagaagagtcagcgtgggctccagcacact

SEQ ID NO: 28310 - DNA, 1619 bp, Bovine  19866880669526
catctgcctgctaaggcagaagttgcaagagattcaatggatcagaatccctggatcaggaagatcccctagaaaaggaaatggcaacctgatcctgtgttcttgcctggaaaaccccagggacagaggagcctggtggcttacagtccacagggtcaaaaagagtcggacctgactgaacacaaggtggggggcccttaactttaaaggtaaaggcagatccatatgctttttcttgcatacttgtttctttttttttttttgaccccagaatatctcgtgtttgtgtagacagaggccactggcagctgacagactgtcagttgaagggatggtggcagcagcagtggaggactgataagccctttggggagaaggatgctcttctagaagtagagcccacttatccagaaggcatcagggaaatcactggtggcagctgataaacaaacaggaagaagggacaggcttctgtacatctttcccattggtaaacttccaggcagatgaaaatgctttccaggtggtttttgcatttgaacctataggggaagttccagtataccccaaagcacctagtttgagaaatgccacagattccaccataaagacttttgttctgcaaacccttgaggatgtcagggaaggcactcttcaaaagttctgcaatcctctaaggtgaatttatccaggtctactgctgaaatctagggcaatgaaaggtctctcagcctacccattattccttcattaagttatgcttaacaagtttatataaaagccccgtgcaaagagaatctttatagggtagagtttcaactgactgtacttatctgtagtcataaaagtttttcttttattttttgattggtcactatagatcaaaaagtatataggagatcagactaggtttagagatttcttttttcttttcttttttttttgcacgttctctttatcgttagtaaatacactaaacgctgattttcaaggagctgcctggccatggtggttatttttggggaaaaaagcaaccacacgtcatctttcttctcttttaatttgagttttacactaaaaatctgttttgagagggaaatggagcgtgttaggctaatgacagctttaccctctcttattttttccgtttaacagcaacgctcctataggctccccggcgtgcctggatgtgggcactgcagccttaagtgaagcctccaacgactcgaaaaaataaaaacaaataaacagccccattccccccactccaaagggggtagagcttaagaggaaactgtacaaaatgtgtcggcaaacagacgaatatatttgcaaaggtatagtttctgtgactacagacaatccccacgttgcccagaaattgttagatgcgtcctgctgagaaacgtgcttggctagtgcgtgattgcctttcggatcggccccggccgacccaccaggaggacccgcgtgaggggcccccatttccattcttagggagaggaagccggggacccacgtgagcgcggaagacagctgatcatcaggtcccaatacttgccaagcgtcccctaattcccatttggttacaaaaactctctcctccgttgcatatcctc

SEQ ID NO: 28311 - DNA, 854 bp, Bovine  19866880725535
accttaccctaccccacttcagctctgtccaaatgaccgcaaacatttcccacccattatttatctgcttccaaaaacggcaacaggaagcaggtatcacagccctccactcatctcccacctcagctgctgcgttgtcccggtctctcagctaatgaatctcaaagagagacagggccaaacagggaggaagaaggtggctgctcagagaaacttctggacagttgtggaagcatataagtggggaggaagccagaaaaggaggcaaagcagaaacaaggaacagacctaaatagcccacagagcaaagggcgcctcatttgtagaactgtttagaatctgctatgagctttcctatgcttgctccatttaaccttcaggaagactctttaggtaggcatttttagaacactttctggaaaggaaactgagcctgactcatttatctgaactcacacagcctgcaagacataaaaccaagggctccggatcaatgccttattcccattatacctgtgccaaagtaggaaggagtccacgggaccatattgaggggtcagctggtatcacccagccgtgaaatacacagagaaggcatacataccaaggcttagtcttcctcatcgagcatggaagtcattttaggtcatgccttgtagataccaggcatcttttcctcatttgtgtcccctcgtatttgagttttggacaaagcatttcaataaatagaccaaggatatcagtagcatctgggatcagccctacagtggggcattaggccagggctgagtggaaaatgttttccatcacagtttatttaaatatttccaagttaagttgaccaaccttgaaat

SEQ ID NO: 28312 - DNA, 818 bp, Bovine  19866880785960
cctagaggggtcctagagctgatgccatgtgtatcacgaggacctctggacaacatccctgggattgcccagggagcctgtgacagcaggaaggtgcaggaggccagcttgcctggattcctgtggccagagctccacccacacatgtttacacgacgtacatttttccctaacaagtgagccgagtgtcattatgagttcagttcaagagggaaccagtttatttctaaagtaaatcaagttgtattttttatttgggaaatgagaaagttgggccttagtaacctcacgtagactttttttaaaaaatagctttcttacaaaacattcatgttaggcttgaatttggaagtaacacgttaaaggtttttaaatttctctcgtacagcaggactgaaatggtttcctctggcatatactcttttgtcttgaaaaataccagtaatgaatgctatgaatttctgcatcggaaaatctgaatcaccctgggatccacatgagttccttgatgaaatgtgaaattaattttatactaaataaaacttgaaaatggtttcaattatggggggtggggaaaacatgaaatgaagacagtaattctactgtatcatattcttgtttcattattttgaatttttaaaatatcatcatttttagacactgttctatttcataaagatgctgagattgtgaatgttggaagttgtggtgatacctaatacaacctgtcaccttctaaagagagtctaggactgctttggagtaggaggaaatggagggaagaaacaaatatttatgaagcattcactgtttgccaa

SEQ ID NO: 28313 - DNA, 1308 bp, Bovine  19866880801568
atggccccagaatcccatcacccatttccctgaagatcctgtgcagtgtattacaatgtaccccatggaacttaatcttcccaccataccctggccaggcaagcctggttgccaggctgttccattttcccaaagccccttcaggtataagaaaatatttttccactgggagtctactaaatgtcatgtctaatttaatcttaaatacatttccacagaaaaaagagtcaaatgaggaaacctctcctaacattcctgatttcttgtttctctagcccttcacccacatctccgttccatctttttttttgcaagggaagtagaagtgaacagggcatttgaggaggggggactctgccacttactaatttgttttccatcctcagccctaaatttctttttctctgacttgcactgagacaggacaggtggaatggtgacaaagggagactaacttacttatcttaaaagcacaaattgcccccagtcatctgaatgctacttacacccgagcaagcacctctgcttctccttaaacattttggttttcttgggtactcatttaagttttaatgggataacaggaggtgagaaagtcagggagaaatttaactttgctgtcaatctaaattccttctgacctctacctctgttttcttccctggtcttccttatggaggaaactgaaatgattccagtcagagtcagatagtgggaagaaccctggttcttcccagaaacccaggctccccatcagttcaccaccacattcccttgtggagctgaacacctgacactcacgttcctaatctgtagggtaaggaaattgaaaggattctcaccaagatcccttcccattttcactgcaatggtttcacggttccaactcaaattcaccttttatttctcaatcatactcagtttgatttcaaattacttaatgcaacctcctgtgttgtatgtgctagcatgatgctactcaaagtgtggttgtggacccaggccaatctgcagacatttactgatctggggtgagataagcaggcgagttgagaataggtattagaaattttctggcacttgccatggccacaccatccaaacatgtgaccagtggccttatttggttgtgcttgcctacagctggatgagtcgtgaactgtgtcctaagctgtgtgcaatagaaccaggtgtaaaatggaatggaaagaagaaagaaatgaatgctccaatggtgatcaagaccagcatcacccttcataaatcatattgatggtttgcatcctgaatatgatgtgatgaaaagtg

SEQ ID NO: 28314 - DNA, 1491 bp, Bovine  19866880828517
ctctatctggatattcacatgggattgattccaggattccagtgggtaccagaatcggcaattgctcaagttccccatatgaaatggcagagtatttgtatataacaaacagacctgtctatactttaaatcattcctagattacttataatatcatacaatgtaaatgctatgtacatagctgcaggcatgcagaaaattcaagctttgcttttaagggactttctggaattttttcaccccaaatttttgatctatgattggttgaaactgcgggtgtggaacctgtggattcgactctacttcattctcacaatagcttttctttgtgttttgggttctgcttttcttcatgacctcagattgcttattggaatatcacagcatgcttaggtggcaggcacgtcacattcctggctaatgatggttgctagtgcggcttgagctgagtcacggcgctgtgtgtggggaatgtccagtccaatcctttgcagatgaagcagctggtgacaggcttgggagaactcactagtgactgtggggcttcctttcaggtttgctgtcatgaggtcgaaggtgcaccaatgccaagtttacacaatttgctcaagtacggccattgttccacagatgcagctgagaaatgacacatccctggcctaaattgtgctagaaactgctcttatttaatgtcttatgaattctctggcttaatccctacagcagatgtttcaagcttagtgtatctaaccccaaattctaactacttttctgtcccctcctccatagaaggagacctcaatcctagtttgctacaaacaaaacaaaacaaaaacatgaggtcatttgatacaagttgtgtccttcatgcctccaagagcactgcatttttcattccccctctttgtttcattttgattatgaggaatctagttgtttcttggctccagcactggaatcgtcctatggcccttggcccatttctcacacccctccagagcttgcgtgtctgtcaagccgtctctcccctacattttcagttccttcatctcactcagcaagtgcctcttacctgtgtagtaacagtcatggctactctggtccagatcaagctcgctctgttctgccgctcgtgtaggtgtctccttttctcctccgcccttttctagcaggttggctgcatcctctgctggaggtcccacctcctggtctcttgttggggctcttcacatgcactctctccctctctggattcagtactcactctcctcccttagaaggagtaagtgctcaagggaaaagaatggaaatctgaagattaacaaatatttgctctgattaggaaattaatggtgctttttaaaaaggaatctgtttattcttctatgtactttacaatttttttttttacattaagcatagttttaattaggaaggcagcttaaatttggatgaatgtctatctacttaagaaacgttctacttatctac

SEQ ID NO: 28315 - DNA, 2499 bp, Bovine  19866880850339
cctggtcttgtttttgctgactgtatagagcttctccatctttggctgcaaagaatataatcgatctgatttcggtgttgaccatctggtgatgttcatgtatagagtcttctcttgtgttgttgaaagagggtgtttgtcatgaccagtgtattttcttggcaaaactctattagtctttgccctacttcattgcgtattccaaggccaaatttgtctgttactccacgtgtttcttgacttcctactttggcattccagtcccctataatgaaaaggacaagactagatagcatagcccagaacactgcacatatagaaccaggaagatgaaaggtgaagggaatcctttttttcttaagtcgttggagttcttctttttttgaaccaactacttataagtgtgtattcctgcagttgacaacaaaggacatggcttgttttagattgaggctgggaaattggtggcatgcatatttatcaaatgaattccattactatagataagttttatttatctctccaccagcaaacacaggtaattaagatcttaagccagacagtcccactactctttaaaaaaaaaatttatgttctattggagtataactgattaacaaagttgtgatagtttcaggtgtatagcaaagggattcagccatgcatatatacaagttcttggagttctaatgaaaatgccactgaacaagaaagtcaatttgttttctttctcatactaaagaatgttgtcaaactaatactaatgtggactcaagcagaggacatcatcctggggtccgggaagccctctctggacttccatccattgagtgcttgaatttgaatgcaaaggtagcttgagaagacatttgaagatagcattttggaatacagttaacttggggctgccagaagtttggtcacatgctgagccagttcagagatagtaacccacatgaagttaacttttccccttttggcaccgttttttgttgataaggagttaactcaagtttgctcgttgcctccagcttgcgagagaattttgtttcacaaaagcaaatttagagaaatagagttgcattaaaaaaaaaataacagtccctttagacttgggtcatattgaagattcaatttcaagagtgttttagtgtaaacacatttctaaggttttcagatgccagcagatacagtcctttggggagagaccaaatgtgtccaaatgaaacaggggtcaagtgccagagaaattctcataaaagtaaactggtgcaaaaaaagatatatatacacacttattactttgtatattacatatttaatacacattaaattattatttatatttaatacatattaaatatgtaaatactatgtaaataaaacaatatgtaataatacatattaaatacatatacataaattacatatcagctttggccagagattcagcaaagatagctcaagataaaggaagacaaagattaaatcttaatacattcaattaaaataaattcaaaattatttaaaataatctttccgtcttcacaaaggagtcagctgtggtttgtgtctctgatgtcacatatgcatgtcccagcaaggggctggtgtgaacaaccagcaccagtcccagggtgagcggcattctcagggcagctccagaccctttttctgattgttccctttgtgctgtcttcagaaacagtgaggaaaggccatccttctctagttagtatggacagtcaggtgttcagagatccttgatggtccatgtttatccaatcataattcagcaaacacttactgaactcctttcatttagcaaatgtttaccatactctgtgttgtgaccataggaattaatcatggtctctttcctcaaggatttcacagtctcttgaaggagacacatcagtaatccagcaataaccatgctgaagtaacacagggtgctggggagaccaggggagagaagataattcatcttgatagtgaagcacagagggaggtttccaagaaaagtatccagagaagaccacactggaactgactctgatactctgaaatgtgaaggaattacatagaataagccccaaaacatacttcccagtgagaaacatttgtctgtctttctaagtaatggattgtgactgagacttaataatgggtctgaatattaatttactggtttcccattcccagtcctagttcaaggtgttagatacaaactaaatcaagttagttgcctcctgagaaatctgtatgcagatcaagaggcaacaattaaaactggacatggaacaacagattggttccaaatcgggaaaggagtacatcaaggctgtatattgtcaccctgcttatttaacttatatgctgagtgcatcacgcaaaacactgggctggatgaagcacaagctggaatcaagattgctgggagaaataccaataacctcagatattcagatgacaccactctcacggcagaaaatgaag

SEQ ID NO: 28316 - DNA, 789 bp, Bovine  19866880859254
actgatttttattacatactggggacctcttccttttttctcttttgaaaatgtacacatctaacagcatattccacaggaaaaagttttctacatcatctttatagaaacacatgttaaaatgagttctaagaaccattccaaaattctttcctcaccaatgacaggttatgtatgtattaaacctgaaatcaatatacaacattgttatattctcttccttttttgccttttatagatttttatttagatgttcatcctcatctgtttgtaaacaatcatgcataggactgaaagcttggtatttgatctcactctttggcattcactggactttatggtctaacttcacgcctctgatcctttatatttcttcctgtctatttaccaatggacaaccagagtaagttaactgtcacataaagtgtaatgatttttctattagtcaaattccccattttatggtctagttgtaacagatatatagaatattatttctttcaaaaataattttcaagatcacataggtgatagcaacctagttttccaagctaattcaactggaaaccacaccactcggaggaagatgcaaaaaattcaaatgattcaaaatagcggtaggcttcagttatatcttaacaactttcacaacaaaccccagtgtctgttttggcaaaggatatctcataactttattgagaaaaataagtttcagatgccaaaacatgttttagcaaacatgtttgcttagacttgtggtttattgctttgcgatttaaaataatagca

SEQ ID NO: 28317 - DNA, 1579 bp, Bovine  19866880883681
attttttttggtgggagaggtttaaagttcaggcaccaaatggaatagtgctcagccataaaaaaagaatgaaattttgccattttcagcagcaacatggatagacttgcaagatattatccggagtgaaataaaccagcaaagagaaacactgcatgataacacttacatatgaaatctaaaaatgcagcaaactaatgatcataacaaaaaaagcagactcatagagaacaaactagtagttacccatggggaaagggaaggtagacggggcaatataggtggttaagagatacaaagtattagaaatacaatgaactacaaggatatattatacaacacagggaatatagccaatattttataatcactataaatggagtataacctttaaaactgtgaattactgtgctgcatacctgtaacttagataacactgtacatcaactatacttcaattttaaaaaatggaaaaaaaaatacaagcaccaaactaaaccttttactatcttgttttataaataaaaaggccctggtgttactgcttccttatttgaaaggccaagcccagcagaagtgctgaacttttggctgggccatttgttaattaaaatacagaattctcctggccactgaaataacatttcacagagcacccagtcctgggaaccaccttggtcactttgggatgaatgacccagtgcccagcaagtgccctccctggagagaaagctggacacagtgcagctctgttgctgaaccgggttggagccagtgttccctggcagagacagagcagaccaaatcctcccttccccagcacaaagcacagacaggcctgcaactgggagccaggctggtgagcccagggatggccgacaggatatatctgtaaaaatctgcttcctttttcctggcttcaggcttgtaaagaacctggtcagtgggcacagagtgtagagaaataaatactttacaaggaaagggggaaatctggtgacgatactggaattaataattcttttaacatgaaagagcttttctctgtgatctttactgtcttacctagggtttggagtttaaacagagcaagagggtgagctggtttcttcattgtatcccaagcaactggcccatgtgtgagcacaaaggtaggaggcatctgagttgctcaaagaatatgggccagaagacctttcaaaacccctgaaaacttttccatacaaataagcaaccaggaaattggagtcttcattttgtctttgtgatcaaagccagagaggaaagatattaagcagatactgacccgaagttttgtggccaccgttaggatttattgactgaatagcaaataaggactgtgggaaagccgaggttggtgtttacttgaagggaagaaaagatttggattcagaggctgactggaaacagaagcctgccctactacggacatgagtccatgggctttggtaataggaggtaacaacacatttacagcattgattgacatgcattacatgcctggaactccaggacacctaataatatatgacagtgttaataataatggcaatgccat

SEQ ID NO: 28318 - DNA, 3668 bp, Bovine  19866880924385
gtaaggggctcaggggagacttgtagaagtgtacctgcagtgctctatgttttgtttcaagggatgtaggggtgaggtcactttaaatattcatgggatatatacttaggttttctgtactttataggattgtactatgcttctgtttttttctttaatttttaataggaaaataaaaaagtgtctccttaaggaattctaatgtgcctcaggttagagaacaacaagctctgggacccttgacagtgggctggtgtttgtgcttcttcagccaactgtatgtgaggctccgactcccagctggacggactgcagccttgttgactcatggcgctttggttaatctaagtaccactgggcatagccatactgctggagacccctcacctgaacatagacctgccctgtaccccaacccatggaatttttcagcttctgctctactcctaaaatccttcctctagataatagcagagcataccaaatgtaagtcctattgtatcaattccccttaaataagcttcagctgttctcttccacaaacgttgaaaacttagaattctaagacccctatgtgtaaaacttcttacgaagtttaccttgcccaaagcttagcaattaaaaatatcacttccttttctcctctccactttgactccttttcttgctcctgatcacagatcccaattcttaatcactcacaggactttgggaatggacagacagcctgattttaacacaaagtgatggtaagaatctcttcttctgaccacagatattataggattcatctgggaagcaaaggattttggttattatgtatagaaatccagggaaatgcctccttgagaacagcttaacagtcattatgcttattttgcaaatgcggaaagctttgcaaaacctgaaatggcttggattggtgcagcgattagatagatctgcccagtcttgaaagatgtgcattctctttcaatcttaagcaagaaattccagcagagctgggccagtttcttacagtgatgattaatgcacttattgatgtatatgtttgttgaaggtgccactggattttctctgtctggtttgagaacagggtaatttcctagagaaaaacgtgctttgtgtttctgctcagttttatttatttattcgttttacattatgataaattgcactgtgttttgagaaattgacatggtacatgttaaaataaaaagaacagagaggaagaacacaatgtggaaagcagctggagcatcttaagataaaagagggaagtagaaatgacaaagagttttgaaaagaattaatttcctcttcatcatctaaacaaacaaaaattttatcttctgggattgttgggagagatgaatgtttgataacactcccattcaaagcagtttgctgtgatggataggtatccagcctctaccacaaaggagcatcgtggtcctgagtaaattagtttgtctttctgtgcctcagcttccaaatttgcaaaaacagagcgataagcatagaaataattcatgaagagggcttctatgtgccagtgttctaagcactttacatatattagttcattagatcatcatgaagcagtgaatgcaattattatcatctctactttacagttggggaaactgaggctcaggggtattaacaggcatgatcacatagctagtgagtgacagagattgaatcaaacctaggcagttggctgggtgtccattctactgcttctgtaggtttgaacatgtcacttttcttaaagtgctcctcccagaatcaccatcagcatgaagtccaaactccacaacgtggagtagattgcctttcacgatgaagcctaatcctgcctctacagtcttccttcccctgaactctggccactacagcacctcccccaccagccacacaggggactctcatctcgtgttccctgaatatcacctgcaccctttcatgccctggctctgctcttattcttccctctgcctgcagcgctctccttccactgaccacttctgatcttctttatggactcctgtccttctttcaggtaagccccttaaaacctatgtgccctctaggaatgaccttgatttctctgggcacagatgagtcactcactttctatgcttcagtacagcttaatgtgtgcattggttgtagtgcttgtcactcagtatcacattattttatgtatgaatctgtctgtgctgccagagcatggttcagataatgggtttcttctgtaccagtctaagaaatcagtagtactagatcactgggttgagaaggatttttgaaggcatatttgaattcagtaggagaatgttaaatgcagacttcataaaggcagagacctcacctgacttttacatcttagtatctgtagtgccagggcttcccaaatggcactagtggtaaagaatctgcctgccaatacaggagatgtaagagacacaggtttgatctctggattgggaagatcccctggaggaaggcgcggcagcccactccactattcttgcctggagaaacccatggacagaggagcctggtggattgtagtccacagggtggcaaagagtcagacaggaatgaagcaacttagcacacacgtctatagtgcctgtttcagcctgagtacacagtagacactcatttgtatgaaagagtagtgaattcacgaggtctcctatagcaagagcggtgaaggtggttacattcatgctggatattttacgttcctctaatagtcactgaactcttcaaggggaaggacaacatcttatttatcttagtgtctttgtcacctcatttagtctattgaacaagatattattgctatataaatacattgttgaaagaagtgttgtaaagttcagagagtctgtgctgatgtgaggcatgaaggaggaagaccaagtcatgttacacattctatcttttgttctgttatgaatcaaatggacccctgcagaaagtaatgctttctgtgactgaagatgtgttcactgatgtgtgactctccttgccccaccaccctcactcccaccatgttgggaaataacagcaggtccacctgagggttagaatgaagagggagatggcagatgccagaggggctgggagattgtgagacaggctttgcatttattgttttctcctccagtcctcaggaataccttcatctccctcactttttactcttgctcctcctctcctagctctgtgttagccagcctggtgcgtccagtgtttgtcccagaaaaaagtaaatcaaagtacctctccattgtccaagtcgttaaatgacaaggagagggattttagtcctataaatgactagtctattttaaaatgagccaaggccaggtgggacatttccactcaagatgccaaccagacaagcctgtgactccttcataaggatattctatatactcatcagttaaccttggatcctactctttggaaggcaccagaaactctcagtgaaaaagacagaagacccaaagagaggaatgacaaagaggtccgatcaatgaaacacttcagcagcaccaaggggcccaatgccctttgctgcctccaaaaggtgctggtaatgtaattggtaaacaaacaagtactctctgaacagattctgtttccag

SEQ ID NO: 28319 - DNA, 1088 bp, Bovine  19866880952038
tgtgagagttgatggccttgtttctcatttgtcagttgtaaagggagtccccaaggctcaatttcaggcccggtattgtttacatagcccagcaataatacatcacatgtggcaaaatattacaaattcatttttatgctgatgatatggctcatgcataaaagcagctaatgtgcttctctttttcgttgaaattgcagctaagtttctaaaggcacaaagggccttttgtgttttgaaccataaagaagagaaagtatatgacagtttttagaaggactaatgaagggtttgatctgcctcggctgccatctgtgagtcccattatagcagttacggtcattataataccataccctctgaaggcatctgtcaggatttttaacactactattattattattatcatcatgattattatcattattattattattattttggaagctatggaaaatggctttccattttgctgtttgcatttaggtgatgggaaaaaaattgtatgaacgatgatttccatctggtactttattcaaatggcctgtaccaaccatatggagatgacacattagcatgtatactacgtaacaagggatacactgcatttaaaacagtctccatgtaaatcaactcattacgagtcacagtaagttgcctgcactttgtctctgaagaatcttcagcaggaaaaacatgagcatattttaaggaacacacagatgtgccccaaagagccaaaagctgtatttagtttttggacttagagtctgagaatgcaaaccctgggtatctttctcaagaaaagaacagtgccttgtaaacaagatttcatgctatgtaatactaacaaatcagaaaagcaaacaaataaaatggcaacctcctcaggaatttggcatgttttaaatgaatatttacagaaaggaaaaggagaaagccgtttcatacctcttctttagatacattctagctctaaagcctgactttttctgacaccaaaagacagcaagtagctgcttggccatgggtaatttggatttaattgtgtttgcttaaaccatgcattccactcccaaaccataaaa

SEQ ID NO: 28320 - DNA, 1992 bp, Bovine  19866880969948
cagccagagtgaattctcaaaccaggaaatgagtccaaattctactggggattttctcttttgcagcaattgcttctgaatagtgaaaagctctcaacattttccttgagcatatttatcaacaaggaaatggccctgaaaatgtttctcttgcaatcttgcattctaagacaatgtgatactagcatttaataattaccactggaaaacaagaaaatgcaaacctacctcttatcacacgattggaaatgatgtctgaaattgtgtctatctggggccaactgttttagcagacatctacccaggagcaaatccttgtgtgctactggacatgtaattaacctggtttgcacatgtatagagtgttgctagtattaataacagctatctcacaagcttgtcatgaggattgaacaaaataccctctaggaaaacattctacccagaatagatgcctgataaatgttcattcctcacatccttgctctctttttccctcccccacttctttctttctcctctcccttcccttttcaccatcccctcccctttcctcccttctttctgtggtagagctgatatttacaggaaaggaccatggagatctagacagaaaggagattgactctgggcactatgagggaaggagagaaaagtcagagaacaggcaaagcgcaggtagcaagtgagagggatgggcctggacagctgataagagaaaaggttttgcagttaggaagtgcattggcactgacagtatctgaggcttgaagaggtcaaagaggtatagatcacatgcctcctatagtcagcccctatggctgaactctggagaaggaaatggcaacccagtccagtgttcttgcctggagaatccccatggacaaaggagcttggtgggctagagtcaacagggttgcagaatgtcggacatgactgaacgactaatacatgactgaatccaggcactctcctggctgagttgacctcatgtatttttgtgcctaatgaggaatagcagggctgagtaaccccaaagcccactcccatctcctgctcccaccttcttccatatcccttctttgtaaacatttcttatttgggaagttctttatcctccacctcaaatttgcctgccactcttctgcttatcttttgatactctgcttaaaatcccttagtcagtgcgattgattcttgcaagtgttccccaaagcatcttgactgcacttcacatgtgcatttattaattcagttcaggacagaaagcactggtggggtcgcccatgttctgtgcaggaggccagggcctgagtgagagaacatgactgagacagagtctcactcccaaggccttcccagtaggcacagtggttccccaaacccagttctcaccagacaattaatttcagaatgcacggggaccaggtgttcaaaattatatttctaggccctactcccaggtacccaggtaaagataaggcttgagaatctgtaacttaagaaactctctcaggtaattctgatgtgtagtcaggtttggtaacttctgaaaagataaaggaaaagtaagcaatttagaatattctctctgacaaggtttggattgatggtgtactatattgccagctatgctgctgctactgctaagtcgtttcagtggtgtccgactctgtgtgaccccatagacggcagcccatcaggtcccgccgtccctgggattctccaggcaagaacgctggaatgggttgccatttcctccctccaatgcatgaaagtggaaagtgaaaagagaaagtgaagtcactcagtcgtgtccgactcttagcgaccccatggactgcagcctaccaggctcctctgtctatgggattttccaggtaagagtactggagtggggtgccattgccttctccattgccaactatagctgggcccaaaaacttcagagagcaattaggtgagcttatatttttactgtgggacttccca

SEQ ID NO: 28321 - DNA, 1690 bp, Bovine  19866880982714
tgatgtccatgtgtagagtcttcttttgtgttagtggaagagagtgtttgttatgaccagtgcattctcttggcaaaactctattagcctttgccctgcttcattccgtactccaagtccaaatttgcctgttactccaggtgtttcttgacttcctacttttgcattccagtcccctataatgaaaaggacatcttttttgggtgttatttctaaaggtcttataggtcttcatagaaccattcaacttcagcttcttcagcattactcgttggggcatagacttggattactgtgatattgaattgttttccttggaaacaaacagagatcattctgtcatttttgagattgcattcaagttctgcattttggactcttgttgaccatgatggctactccatttcttctgagggattcctgcccacagtagtagatataatggtcatctgagttaaatccacccattgcagtccattttagttcgctgattcctagaatgtcgacattccatcttgccatctcctgtttgccacctccaatttgccttgattcatggacctgacagactgatagtctttgttaaatcctattttaacaaagacttactttaacaaagtaaggaaaattagaattatgtttcattgtgagaaaagaatcattgaagatttgcctcagagatgccatgattatttctcttgttccttcagttattttcttaaataatagtgcagaactactgaaaatttaatcacaacatccagtttacattcagtgtattaacatataagaagtagaattctcccttctgcctgtggagagagtcagctcaggaaagcgtttaaaaatttttttccttgcaaggaagggaaaagggtgtgccatttcccaaacacaaggagcaagaacagccaatataatcttgaaatcaaacaaagctgaatcacagttcaggcaatccctaattttgtgatcttggacgagttacttagcattgttgaacatcaatattctcattcagagattggggatcaataaaaaaaaaaactacatcatagtgttgttttagggtcagttgttaatagtacataaattaaaggcattactgttattattgaaactatttcttaatggaacatttggccatatccaggaagacggctgtgatatcattttttcaaacaaacaaacaataacaacctcttgctattgtatagaaaataatttaaaagggatcaagagttgggtaaccagaaaaatgatggcagctttccaaataggagactatagtggccagtacctagatcacagcagtgtagatgtttcaagcgtctagagttaagatgactctagaatgcagaatccatataatctggtattagactggttgtgagaggttgtgccggagcaaggaatcagcactctaggtctctggcttaaacatctgggtggatggatgtaccgttagctgagttggggaagactgaagggacaaggtcaggttgaaggtggcagggaaatacaaaatttgatgatagaacaaaagtccacttttagaaattaatagtggaggcttccctggtagctcagcagtaaataatctccctgcagtgcaggagccatgggagacctggatttgatccctaggttgggaagatcccctggaggaggacatgctaacccactccag

SEQ ID NO: 28322 - DNA, 1493 bp, Bovine  19866880995525
ccttcccttctccgtggacctgttttgtcgaactcccccatgacctgtctctcttgggtggccttacacagcttagctcatagtttcattgagttagacaaggctgtggtccatgtgatcagttttactttatcagtttgttaacatcagatatataactttgatatatattaaatgatctgtttcttctctcctttgtaaaattgctgtaatgataaaagtgataattctatcctgacaggccagttcagtagttattgtgacttttgtcattacttaatacataccagaagaattatatggttagtagtaggaaaatttgaaagagaaagaaagaggcaatgatttttttgtacctaccacacacatatttacatatctgcatccctttcctgtagctagctcattaaaagtccaatgcatttatgccaatgccttccaacaaaaaatgtcatcacatatcagacctgatggaagagttaatagttcagagtgagagccccagcactttagtcctacttttctgagatgtcaatctattcatcagtttatggaaagaaaagaaataaatgataaaatagagaaaaactggaaggaaaaaatatgttatgaaatatgtgcataaataataaaagtgtagtttgtaggagaaggggaaaataatgtgcaagtataaaatgttgttacctaccaaaagtaattgcttttctctttattaaaccctggttgctatggaaacctttttgcattgagttaaaactttaaaaatacttatgaattatcttgttccagaatttgcatttagttttaatatttttaaaaaataaattgattttaaatgctgttgttttgaaaccaagactgtggtttgacaactttgatattcacatttctccatgaattgccccagccaagctgcatcttctgcaaaggcagtcactttctgaaggggtcctatgcatgcttcactgctgttcagccactcagtagtgcctgactctttgtgaccctatggactctgatcttctaggctcctctgtccatggtattctccaggcaagaatactggaatgggttgccatgccctcccccagggatcttcctgacccagggatcaaaccctcctcagtctcctgcactggcaaattggttctttaccactagcaccacctgggaagcccaactggcctttaaacttggagggaaaagacaataacaaataatctgaataattttcaagagattagagttctatgaataaaataaaacagtgtaattggataaaaaaagagaggcaagacaagtaaactttttgagagggtagtcaggcaattttaagagaaagcaatattcgagtagaaacttgagtgagaaaaaatattgcagagagaagcctttcagggagaactccctgaaaatataaaaacccaaagcagaaatgaacctgaactgttccaggaaaattaaaacagtcatgatggcttgggagcaca

SEQ ID NO: 28323 - DNA, 1334 bp, Bovine  19866881084015
cctctgcacacgctgctccttctgtctatgactttcttcccctaactcatcctgtcttttctcagatgcctcatagaggacttccgcgttccccacttagcgtattctgaacctcagttcttgatttgcttccttctttgggtttggggagctatgagccaggaaccaggatgattcacgttaaaaatcacattacttgatcatacacatttgcacaacagaatttatgttccatgaagagagggaccaggagagtctgatttgttcttatatcccctgggctgagcaccatgagggatccatagaaacttctggataaatttgtgttgactgagaaaggaagaccccagcccaacactatcgacattggcagacacgaggtcaactttggtattgaccttataggacactcagatcttgctccatctaaagcactccactcctacatcatagacagggtgagagtttagtcacagcagactgagtgtccatcagatacagaggggctggcccgcctggaccaggttagtctgtggacttccttgacttcttaagcacaggtcttatgtcagatcatatggatgaaagtcccacttccattttatgtagactgattgacacctatgctgtaacatgtatgtctgtcatgtctggctatctgtcacgtctgatcatcagtgttatgcctgttagcctcttcatgaccagttcaggaatccagctcttccctgatctgattttgtggctcagcctttaaccgttacgataatcagtgtcatctgagtctgctctgaaatagttcgctgtgccatatggccaattaaaagattataaagactgatgcttttaagatccaccctggccttgactctgtgtggccaatgaaatcatcttttttcaaggaaaaatacctgtgcaggcatggaggaatgtgcttcagatatgattcttcattgggttatatctatgccatgtacatgcctatacattttcaaacttctgtagtgtgcctgatttggagaagtatgagagataataatatctctcccattaacaaaattaatttagaatcatggtacttccacacaagggaattttctcagcagtacaaagaagcaatctactcacatgcaataatgtgggtgaatctcatttgcatcactccaagcaaaaggagccagatttgaaagactacatatgtgtggttccatttatgtgattttctggaaaagacaacaatacagggaaaaaacaggttaggagttcagggggctgggagtaggttgtgcaggtgggaaggatgatcacgaagaggcataagcaaattctctggg

SEQ ID NO: 28324 - DNA, 1509 bp, Bovine  19866881098439
ttataaattataattaaatttctaaggtctaaatcctcatctacttacttggaggaatatttgattgggtaatatagtagaataattaaacaatctctgtctctttagagtttaaacaggatttgatctttagtgtaaataatttcttctttaatttgcctaccaccatcctggattccttgtttcttactggtccaaaccgtgtgtttaagtaacattttaaatgtgaatttcttaagaagtcttttgtgcttttattttttcttaaaacaatttttgcttgcctggcctgggacactggctttggggcttttggggagataagacacttcagtgttttcttgacagctgaactaaagaaaacctcttacacacacgtcatctgatttacttcatgccattttgattgctcctactgacagttctgatttaatttttccttcaaaaaagagtatcaatttcaaggtttagagttcttgggatttagaatctttgattaaaaaagtgaaatttaatcttgaatcaaggggagggaaatgtgagcaagattagcaggcttctttttgatagaagactcttgtagccagtatttattatggtaatgctttgttattataaacctcctacgaataatattttggggagctaccacacaacaaggcatacattataacacccgggttaggaggcgggtgacagcaacgaactgagaagcacaattatctcacggatatgcatgcctatgaagtgtgttattacttttgttttttacaacttgtagaatattttcattgtaggtgaagcatcagacacatttttattcaaaggaagagaaacaaaaagaaggttgtgtctgctgtgtgttctgaatggtaccctggtggccctggtcctctagttggggggctaatttataactgagtgtctcccaggcgccagaacattcagctttattgtctgtgtcatggtcttctgatatccatggcacaaaaggagtcattatttggaaatggtgattagtcagttcgaacaggagggtctgctggtgtgcctacaggaggtgttgttttaggttgacttagtgaaaaaaaaaatcagtaaagcttggtgtgtgttagttttgatgtttcagaaatcaagtaaccatgcaactggcattttatttgttgctaaagattttaagaccatattgacagagtcctaggataaaaattagtcagttctggggaagaaagtgagttagtgactgttaagtactttgccaggtggtttacttcaggtagattttaattctcacaacaacctataaggttgatagtacgtccatctttgcagaggtgaggaaactcaggctctgagaattcaaatgagtttcccacattgctaggagatagtttgttgttctgacactcagtcatgtcttactctttgtgaccacatgaagcatgtggtcagcatggtcaggcttccctgcccttcatatctccggaagattgctcaaacacatgt

SEQ ID NO: 28325 - DNA, 760 bp, Bovine  19866881102474
caggccagctgttgttctcatcactacatcctttcctgaaccctccagaggctttgcaatctggcactaacccccagcgctacactaatcacaaggaacaggaagcaaatgctaacctgtgcatccactttccttctctctgcagctccacacccctcacccccagtaaatacagacattgagagagtagggaaggaaggtgaggaaggagtggactgcagggaaatcgttggaacaaactagcctgggattcacaatttgaagtagtaagatcttggtactcataaagccagatgtcctctgcccacgagaagaccaaagatgataaaaatgcaaactacaaagcggggccagtggatacacagccagcaaaggccaccgcatatgagagccagtggaaaccttgatacatggttcaaactcaggttgctcctttaaaaatctcatcagaagaattatttcatttgaaaggcttgtggggcagcgagggttttccttgcatggcattttccctctccctgtacagcaactgtcagcatagccctaaaaacccagaaggataaaaagcagcttcttcattttgcaaagatgaaaaagaagcttagagcaagtggaaaggaaccaacccactggaactggtgaaactcacttgagaaagtcaagttttcaaagaaatcttctaagtgctgacacactccaggctcaagtcgattaaggaaaatgaatttctaaaactaggttggcagcaggtatcttggca

SEQ ID NO: 28326 - DNA, 1111 bp, Bovine  19866881105917
catgaaagtgaaagtgaaagtgaaagtgaaagtgaagtctctcagtcacggccgactcttagcgaccccatggactgtagcctaccaggctcctccgtccatgggattttccaggcaagagtactggagtggggtgccattgccttctccgagaggcttctcacactattcattcaaactagtgatgcctgtgggtattggtcttgtcaaccagttctaagtttgtgttttaagacaatcaggatgtaatccaatcttggcaagctcttgggatgatcataatctaggcccaacatgatcaaaggaagagatgtgtatagactgttggaaatagttgtgatgaggggctcctagcttgagccaaagctctcattctgacaagtctgggcaactccagtgaaaaagagaagtcccctgtttgtcttcttgtgagagcaaactccatcctaagacaggcagagatgcagcacgacagaaccccctagttactgagtctagttacagaaggagggaattattgtgaatataacttggcatctgtcactccagctatcccaagtccagggcctgccatggatgcccatgttggttctgaggaagaaagatgctgaaaataaagctgaaaagaactgtgaaatattcaagtacaggcccactgatttgggatttctataattgagtaaaacacatggaaaggaaaatccagatgacactgctggtgatcagaggtctccatgatactagtggcaacgtgcagtcaaagaggatggatgcagtagccatgccaggctgagagccagagtgactgggaaaacggggcgaacaggggggacaatggcagacagacatgagagacgatggactcctgtccagcgcagaaaagagatatttcctctatcataaactctttttaggaagactaggcatccgcctaggaagatgatcaccattggcaatacctattataaaatagtacctgtggacaaagcatacatatattctctggcaaatggactagtaagcagaaagaaaaagtgcttggcttcttgcagaaacaatgagttgtgttaaactgagcttctccggaataatatcagacgaggtccagaag

SEQ ID NO: 28327 - DNA, 937 bp, Bovine  19866881128894
ttctccaaatttagagatagattcagagtcgagaggggagttgctttcagtaacctgcaggtctcaaaccagtaatttgacttcttgggagcttaaaagaggattgtctaggccagcaattctcaaattatttggttgcaggacctctctacattcttaaaaattattgaggacaccaagagctttagtgtgtaataaaattatgtctctgggttggtctacactggagagaagttcttaccttcctcaaatattcttctgtattttttgactatctctgtctaccagaatgtaacctccacaaaggcaggaatttttgtctgttttgttcaccattcagtctctgaatttgatgtcctaaagctagaacattgtctataacaatgcttggtgcgtagcaggcactcaagaaatgtttcttgaatgaatgattaaatgaatcgagaaagataggatattcactttttactcgaacattgtggagtgtttcatatttctcactcctccaccctccaacccttaggtcccagcatgctaggcaggctccaaaattatattttgatccttcaggacttcctgactcaagccctcgacacagctttggtgtttggtatcctggagatgaaacagcagtagcagtagcctttgtgtttccagggctctgtcactcagagacatcacacaactgcccacaaaaatgccatcttgcgaaactgttaaggagaatggggaaaatattattttcatcactatacaaatgaaaatgatcagacataaacagagagatgctgctctgggaaatagccgtcaaccatcaagagaaagtgacgttgtttacttaatattccccatatactccatctttagcaggatttgctaattttttcttataaataacttctgaacaaacattttaggatataactcttttatattt

SEQ ID NO: 28328 - DNA, 3589 bp, Bovine  19866881155967
tagagctttgcaagagacagtcgggttgtaacttgacaggggaaaaaagatgaggaggctccccctgtaggtaaattgtgataagtcctatttcagtgggggaagggaccacaggtaggtgctgacacgtgtactctgctggctgctatgaggaaaggtgttcaaagggtcttactgccgcgtggcacacggctcatgcacataaagtggatagacaagggaggcagctggtgtgtgacattacaggacggcacggcgccggttgcttggggccctgtgatagcccttggcatccctttccttatctctgcaccgcgcagctgtgcaaaccccatgggaacgagagtcctgcctgcacttctctgctgtcaggaaagatgccaagggcagggaggataaattagaaaagcatttctaagtacattaattaaaagctcccatgacggaaagtatgctttacagggattgctcgggccaggctggtgctctttacctgcagggctttcctggaaaagctcatttgaagtggatcctgtggtttcccgttggagcaatgggcgacggtgtttcctgaccaagaactcagcatcaaacagaacattattgacagaataatgccattaaagcagaaaaaccaaagccataaatctcagtaactactgaaagtgataacattctgctactgattctgtaaaatgaatataaatgtagagtattggtgaatactgactaaggcaaggtccatgatcttctattaacatataaaaattcagctcaactgtgtcataaattagatttcactcatgctgaagtattaagtgtgataacatgaattgaatacttgaataacaatagttctgcccctccctgaaacttgacaggtctatgaagatgcttttattttcctcttaataaattcctttgttatcagcagaagcatgcataattattctgttatccattccatccacctggatgtcaagctcacagcatcattagatcaacgaggtggaaatctgaggaccatgcaaagtggatcaaatcacagcctatgtcagaaggcctctgatgtacagattagaaagatcttagctggagaaatacttaatagctaaaatctacaaatgaaagctttatttttctcccattctttattttctcactcactctagttcctaaatttgaatttaaatattaatatgtcttatgacattccttttgttgtttaaaaaatacactgtgattttatctttttagaaaagtggtgcatgttcattgtagaaaatatgtaggaaaataagagaaagagccagcactcagggtattgaccgtggtgaatatttgggcatatagttttctgtgtgtaatcactccagtattcttgcctggagaatcccgaggacagaggagcctggcgggatatagtccatagggtcacaaggagtcagacacgactaagtgacttagcacataagcacgcgtgtgactacacaagactggaacagttttgctctttttccattaatccttcctgaatgtttccttgagtttaaaaatgtacattgtaaacaccatcgtaatgtctgtagaatatttcattgtagaagtctcctaaaatgtaggtaactaggcccttattgtaggcaatttaggttatttctttttttttccattttaatagtattgtgatgacaccccctgtatataaaccatatgagttactatttccttaggtgtgaaatttccttatcaggataaaaatgtttcttagggctatttgtaagtattgccaagttactctgtagaaagatcttctaatgttattaagaacatgagagttgagattagaaaggcctgagttacagtcctggttctgaagttctgaatctgtcatcagccacgtgaccttggggatatagttaacatctccaggcttcagtttccctatctgttaagtgggctggtagtatcacctgcctcatatctggttctgtatggagtaaatgtgataattcatgtaaaggctgagtagagcaaagtgctcaacataagagctacacttttacacttttgccagcagagtatggactgtctatttcttcattctcttacaaaatctaggtacaattttgtgtaaaagtcaacttgacaagtgaaaaaagacatcttatagttttaacttctgtgaaaagacacatctttcaagcctttaaaaatatgtgacacatttcaagtcaagaactgactttgacaaacatttttccctcaaatgttgtttctcatgagtgccaagtaatagaagaagctcaaatcttccttagttttaaagggtagatgtattattgattgtgtctgagagtccagagtagtctgtgggtagggtagattatgtgtacatagcaattattaaatatgtgctttgaacgtttctctaagcagtctcagtgaattggattgagctgttcataatttattttaaattgtataaatagcttcatacaacaaccggtagaaatatagagaaaagaaggaaaacactggccagcagtcctttcacacaaacaaattaaattttgtttgctgactgtccaaacagttttatagaattacattagacattctttcaaatcagagggtgcatttcctctggttgaggtttttcccaaaaaagtgccaccattttaccaggttcatgaggtcccatccccttcatgtcatgccagtgggagttgaatacgacagcaagggtacccacacccttgggccaggaaagtcggtgagaaacatgtgaagcagaagtggacttggagggtaggacggcagcagccaaaagtggtgctgtgaagtctgagtgcagatgtggtgggcgtgggtcagtctgaaatgaaaattgaaacaatagaggaaataatgttgaggagggttcctccccagacattcagtggctgttgtaaggacaggctttatttgtcttttcttggaaacctggaggctccacattactttaaagacacaacatgcgtgtctaatattagaaagggttgaatatgatttcacaggttttctgtaatacaagtggagaaggtattaagaattacagctttgattattacagaaagcagagagagcagtttttctgtcctgattattgtgtcttaagtatcaggcatcaaacaatctctctttgcatgaaatgaaagcactcttgaggtttcagacttgtttctcttttgttccagcttagttcccatttcccaaggctgtggccttgagtgttgaaatgtaataactttgaaagtacacggtgagtctattgatcttttaacatggtttctgccatttaattcttgttcagagcaggcaattctacccagagcaagctggtcactctctgtaatcaggtgtgtacacatctcacaccaagagggaatgcttgtgtaagaacactggatgaccatgtcctgatcacttttcaagatcatcagtgctatttataatcttgaatagtattttttctgcttccagccttgaattagattctgtaaagaagtggtttcactgaacagagtatgaaaaaaataagtctaat

SEQ ID NO: 28329 - DNA, 1136 bp, Bovine  19866881206009
tgtgtgtactgtaagaaacctggaagatcaaagagtaaaacaataattaatgcttaaagaaataaaaagacattttctctgattccctcacattaaagatgtcaccttcttggcttcagattctagaattcaagcagcataagaaaaaacaggagttaaaagctatgtcctcaattgcctgaggagtttagaaagaagtggtcctagaaggctctaccatgaactctggtctctgccagtcatgttctttgtaagcttaagagcaaagaataagactttaaattctggattatgttatagtttctgattaattgttccaaggggctggataccagctgtaatgtcactaggaagcctatctctgaagttatctattatgtggtatattgtgatcatcagatatagactgcccaaccacaaggaaacatgtgatcttgatatgagggactaatctggatcagtctggaaagttggagtctgtgactttatacatatcctcttaaaaaacaaatttattattaattttataaactttatatcaaaactaaaaaaatatcttcctagctactgctctcataagagtttacaaatgattctagaatatttgactgattgcttagaaataagcaaagtgcttgtgatgaaaatgtcatcaccatgattcactcagctctgcccagtgacatgtctccatatctattggtgtcatcgggattacatccagatctgagttaaagtagaatctcactatggtatttttccttttgaaaactgtaagatatggcatagtatcgttttcttccagaagagagagatgaagttgttaatcatcactgtcttcattgctcatctcttacactcaagtgaaacaggctgcctttgatggacaggggaaacaggagtcagcaaagacattgcaatttcaggctatcacgctctagctgttatcaatagctatacatgcaaaaattatattaaaacatgtatgtctcatctcacacaccatagtacccatgttcattatgttaaatgctctgaattctgactttaataaattaatttaaccattctacatctctttaaagactaggttaaaattccatactacatatttaagatatatgcagttattttcg

SEQ ID NO: 28330 - DNA, 759 bp, Bovine  19866881209502
aggttcaaagggagcaagtgatgggatcagatttggatttccacaacatgtaagcaatcctctctaatgatggtggatgtttccctttcgggcttgctaaactggaaaaggaatatgaaagagcctttaagatggctcctgatcttggggtgagcacaattgcactcttgtttaccttaatgtaataggatcattatctgggtgccccatttggatgaagccttgaaagcatattaacctgtcaactttgttcgcaataattagggaaaatctctcaggctccaagcccaggtttttaaagccaatggtgaagtggtctttccttgttttctatgttgactttcattaaagatttgcataaacataaccgaatggtgactcttgctttttggtgccagccaattatatgaattgatttttgcaggccgaaggtgtttttgatctgcagtttgtaaaaggtgaaggcgggggtgttggctgaccttgacctgaacaaggagaggacttacctttatatctcagggtctaataacagagacctcagtggtaaatccatgggagccagtggctttctaaccccactgtgacagagggtctcctggggagtggggccacaactgctcaaaggaggcttgtgcttctcttctccctgacccactgcctgcctccatttacccaattaaagtagtgcagggcatgacctgcctgctgctttcctggtttcacttagccgacccaccctctgactttggagtgcat

SEQ ID NO: 28331 - DNA, 1754 bp, Bovine  19866881501409
cttgctgcagggccttctgtgtgactaatgataaagactttgtctgccaatgcagtacaccccttgggttcattgtcctgggttgggaatatcccctggagaaggaaatggcaacccactccagtattcttgcctgggaaatcctatggacagaggagacagtccatggtgttgcaaaggagtcagaaacaacttcgcaactaaaacaacaacaacaaaacttgctgggaaaagagcactagtctcaggagatgtaacttagttcacttttttgtcacttactaatgtgactttgggcctgtttatagaatgactttttttttaattaataaaacagggactgtgctatgtcctctttagcactcataacagaatgagaaaggcctttgtaaactgtaacgtcatagtccaatgtgaggttattatgtctccaaggtcaatgtgtttgaaaatatattagtttgtgtttgaaacacactgcagttctctttacatcctggccaatcatttccatatttaaacttaagccccttaggcacttcccaggtggcactagtggtaaagaatcaacctacttagatacaagagatgtaggtttgatccctaggtcgggaagattgcccagaataggaaatggcaacccactccagtattcttgcctgtaaaattccatggacagaagaacctggcaagctgcagtccatggggttgcaaagagatacaactgagcgactcggtaaaaagcaaacaaggaccttggctcaatctcctatatctttcagtctaattagtggcctgaaagttttgctttatttggaatttgtcaccccacgttctaaagaaccaggttcagtgattctcaaaagactaagattctaagatctggaaaagtgaatcctaattgaatgtcttcagaaagccaagagatttgatgctgtcatcaaattggtctctatttcagttatattgtaatagagcttattattcatatatcagagctactcacaaaatggcagcaccttgaataggggtgtattctaagagctgtgttcccaacatgataacaaatagacatttgtaactgtttacatctaaattaattaaaattcaatcaaataaaaaatttggtttttcattcacactggatacatttcaagtgctaattgaccagatatgatgagtggctataactttggacagtggagactatagagtatttctatcattaagaaagttctattgactagtcctgctctagaagaaaaggaaactgatgtcacattattcagaggtatccactaaggtttcatgaagtattttttatatcatttttaggtttccaatttaaaatagaagcctttaatgtctggacaaggtttgacatttactcacctactgcttttcttcaagttgtatttagaaaacttggtatctgatatttttgaatgttcacttctttctgttggtcccttaggtcctgcgtgacagacatgtgtgaatgtccagtccataaaaactgttactgcgaatcattcctggcatatacccgggcctgccagagagagggcatccgtgtccactgggagccacagcagaactgtgcaggtgagaaatttctggcagatccaaccatcagaaactcaactccagtgcccaagctagtaacatgcttgtcgctaagtcgtgtctgactctgcaaccccatggactgtcacccgcgaggccctctgtccaggaattctccaggcaagaat

SEQ ID NO: 28332 - DNA, 2066 bp, Bovine  19866881738551
tcccttttgttttcccgtggcccaatgaacaggcttccggaggagcctagcaaagcatggctcttgttgctggctgaccgcacaacggctctgtttttccaaactgatggcacggcttgccaagagtgaattaaatgtttccacagaatcatttgcttcgctcctatttggctctgtaaattattttccttccactagtttaagaggggcacactggctcccttggtcaggcacctcaggctagggtttttgggaaaggaaaaatggaaagtcatgagaggcccttctagaaatctaagggggagaatggaaaagtctgggctgagtgcaggcgtggccttggagcagtaggtaggacagaaaacacgtggatgcttgtccagagctcggggtgatggagaggctgggaagcaaggatttctgggtcattgacctccgggacacaaacaaaatcactaacgagagtcacggaagctaatgccgtgactcgcttgtgctggaagattctgtccgactagccccacttccctggctcagatgggagacttctaggatgtctcactcactgtgtcttcctccaggtggtcctccagccttgccacagtgaccatctgcaaataccttgtaacagaacccccaccttgtctctctgcccatcgccccagctgtcctagggttagcagttggggctctgtgctaaatttcttcagttcagcttagggctccttctcagggccaagtcagtctcccactctccccaggcttaagcatgactccttctttccagtatcagttgctcccctctgcctgcatttggaatatgatgaaaatgttgcttctccagtttttcctttactttattgtccctgaaaacaaattcatttaccatattcatctcaacaggttgttgctatttactccaggggatgagaatagcagtcttgggcaagtgatgaagctttaaaataaccagggcccttgtcctgtagtttctaatgttttcgttctgggatggtagctgtgctctcccttagatctttactcttgagaggtggacttaattatataacctggtaacaccttataatttatcatttaatggggataatttggggaatgaaagggatgttattagcaacatgccagaataataggaataaaaaaggaatattatgggcaacagttatattcttaccctgacattgcctttagcagcccacatggagcaaaagtcccttggtcaagagttgtatctggggtcatttctctttggaagtggtacatggatgtgacagcccgctatatggcttgaaattcaggaagatcctggtgcaactcttggactcatactaaatgcatagacctggacaagtagtttctttggtgactctcaattaccctgtctgtacaatggttataatggtaactgtctcaaagatgacttcaaagaataaataacatgtaaagcatttgatttggaatgcctcaatgagttctagtttctatttcttcatcttttccctaatgaaacccacaaagcatgccaactctgtttccacttcctctcctttcgagggaagatggtctgtaatctgctactcagtattctatcttaaaatggattcccaacattgccttcctaacatcttttaatgtaccaaataagagggctgaaattcaatatattaagtgaagtgattttaatgtatgagacagaaagagagatttagtttatgttccaaatatgcatgaacatgagatgcattcagaacaagatattgccagatgatgaaaatgaaaaaagatgaatcttgtgctgggcgtaattaaatgactgagaagacagctaatggttttaggatgaaaactttagctccagaccactggttttagtgcaacactgaaagctattatgcccgttgccagcagctaggaaaagcgactgactagaaccaaatgtaattgctctggagagtatggtcttggacaggagtcctatgcccttgaagttcctcacactctcttggcttcagtttcttgacctgtaaaatgggcataaaattatg

SEQ ID NO: 28333 - DNA, 1056 bp, Bovine  19866882076848
tttggagtgtaatagcgggacctagaatatgttcgtgtactcctagtacccaaaaggaaatctttggagagagagctgaaaggatatttctggctatttagtaggtttctgtgtttgtttggaagctggagtacagtttattagttagcgtgtccagctccagtgagtttgagagagcagggaatgcccattacctggaggtttcaggagaaatgctggagagtgcttggaatgtcaggaataattccagattccctcctttgggttcagcattagaacatgacctccttccaggtctagactagtaagaaaggcggttgtgtaccagtacctccaaggagttgggaaggtagagggcttaagactgcttgacatcctactttctttggctctgattggtgtggcaagtgcaatggctttgggttggtaggtagatgtggagtggtggtggggaaacaggaccaggcagagtcaaaggttgactttattagataatcaaacatttcagcttctctcattatcatgaaccacagtttctccattggattatttcttatttgtgtgtcaacttaatgcaagggtttctttgatattgaaatgagaggtatatggaaacttctcattcagttttccttaggtaaaaactccaagctaaaagtgccatgttgttaaaaattcagctgtaggttctggttttccaagacactgaccactgtgaggacgccctgcctgaagcatatcggagaagttagctggcatttcttggccatcagattgattaccaagaattcagagtcactaaaatgaaaatggccactgtgtttatttataaaagtactttgttggttttctaagttgaagttgatgacagatgtgtttttagagaaaaagtacaaactctagaaacataagcatctgctctttctcaggcttgcctcctaggttgatatttcattttttttagccacacaaagggctttcttttttctactgaatacctgaaaatatgggtgtaaatgactaatatggattcttgacagttttactggaacaaaa

SEQ ID NO: 28334 - DNA, 568 bp, Bovine  19866882140298
tgattggacatgtgttgtacattgtattgtaagtataaatgttgtacatgtgaataagcctgtgacttctgtcactgagagaggcaagttggcaagggagaagtcaccctgctggagggatgccaaggagatgactgactctgtgcacctgcatccagcaggtcaatatgggacgagtccaggcatgtggttctcggtccaaattgaggtgatatcatcagatggcgatgtctcaatttcctttggtgttctttccatctgtttactctttcttgctctccagcagttcttccatcaatgctgtaaaacacattctacttggagaggtttatttgttcagattgagttatgagttcagagaaggcaatggcaccccactccagtactcttacctggaaaatcccatggacagaggagcctggtagactgcagtccatggggtcgctaggagttggacacgactgtataactttcaagtagacaacctgagcgacttcgctttcacttttcactttcatgcattggagaaggaaatggcaagccactccagtgttcttgcctggagaat

SEQ ID NO: 28335 - DNA, 790 bp, Bovine  19866882190935
taattaatggcttaaagtgtaataacaattatagatcatatagtacatgttgaaaacctaaaaacagttgtgaatgaacagctaagactctgtcagctactgacagacagcaaggaaatcttaaatactagatttaaagaaagaaaggaagaaatcagagtcaaagagaaagaactagaacagggaagagaaccggtgacaagatttgcgctttgcaatggacaagctggagccatcagacctcgtttgtgccacggacctatggacctgatgcctatccccctttgcacttttcgtgttcaaattcttctcctatctctttggctactttccagaagtgagtaaatctccgtgggaatactggggctgacgttgattgtggcattctatttttcaggaaggcgttgtcacagagtctgaggtgcggtgtgtcgttcattgtaaaaacccctccaagcatctgggaacatgctgccccacgtgtccaggtaacctctcaggaaggggaaggcagtgcagctccctggtacagtacagcactgttgaaatccttcggggttctctcaagcatgcatgattttcccactcccgactggaatttttctccctttatgtctgtgtacctaatgggtgaggagagcaaacttctttgcatagaaatgtccggttggactctggtgggcccaggatgactgcaatgtgctgtaggtcttggcaaggatgctccaggctccggaggcctgctttccactccacggggccacaggtaacgcttattttggaaggaaag

SEQ ID NO: 28336 - DNA, 1727 bp, Bovine  19866880365573
taggaatgcaggtatttctgtgtgttgattttatatcctgcaactttactataatcattgattagttctagtaattttctggtggagtctttagggttttctatgtaaaggatcatgtcatctgcaagcagtgagagttttacctcttcttttccaatttggattccttttatttctttttctgctctgattgctgtggccaaaacttctaaaactatgttgaatagtaatggtgaaagtgggcactcttgtcttgttcctgactttagcggaaatgctttcaatttttcaccattgaggataatgtttgctgtgggtttgtcatatatagcttttattatgttgaggtatgttccttctattcctgctttctgcagagttcttatcataaatggatgttgaattttgtcaaaggctttctctgcatcttttaaatgaccttgaacaaagtgcttgatttccctaagcctctttccctcatttatgtaaagaatataatccttatcacataagggtgttttgacattgagattttgaggtagagcactaagtgataccataattgggagagaataatcactcactcagtaggagcttcccaggtggcactagtggtaaagaatctgcctgccaatgcaggagatagaagagatgtgggttccatccctgggtcagaaacagagcatgacaacccactccagtattcttgcctggagaatcccatggacagaggagcctggctggctatagtccatacggtcacacagaattagacacaactgaaatgacttagcatgcactcaatcactcaataatctacttcttgtgttaattattgttattagaacattcaggaaaagaaattttcaactgggaataatttggttacaagggacaaaatcctacttaaataaattcaagggaaaatatggttgattcaaaacatatagagaattttcaatgaacctaatgataagtactgctggtcttcccaagcagtaggtgagctttaagaaatttactctttaaatatctttctcattgccttctctcttatcctgctgaagattggcttcctttacaaagctcttttttctgcttctctacgaattcagctttcctagcatcaactccgctcctaaatatttattatattaaaattccagtggccagtacaagcttactgactcagtctcacatcctgctttgaaacctctgtaagacagaattcaaaatcaacatgaatggacatctgttcagtgtccacctgactctccaggtgtcaggatttaatgtggttaaatgtccattattcctgctgtggctaggggcagacttacaaaaaaaaaggtgagttgatgagaaggaaaataatgtaaatttttagctaaaggaattaattcaggataaagaaagatgacatgtccatttttgaccaactcaagggtctttcaacacattgagaaatcaatttcagaacagcatataaacgtagtgtttggaaagaattcccttgtggctcaactggtaaagaatctgcctgcgacgcgggagacctgggttcaatgtgagaccaaaaaagccatatcaaaacaaaaaaaaaaaatgcaacaataaaaaacacaccaaatcctgtctcttcttataatagtaaaaacaaaactacaaaatagacttgtcaaaggcaagatattcctctctcttaaagaattaggttagaccatcca

SEQ ID NO: 28337 - DNA, 2221 bp, Bovine  19866880440888
ttgtcacctagagagcttggcttttgtcttattggcagtgaggagtcaacatgggatgtaaaagagggggaagatatgatcaagtgtgtttggacagaaggaagccttggcagcagtgttgaggatggctgctttctctcctggaatgaccccttgtcttctccatctggctggaccattcatatttaaaggttcagctcaagtgtcacctccttcagagccttctctggtctcctccatctggaacaccatggaaccctataaaatgtgtttcatagcacccctaacacccagtggcacatttctttcctggttaacctgagggttgtgaggattggcctcctatccttgcatccctgtgtggtcagcacctggcaccatctgcggcacttcctaattgctcactaaaaactttattgttgaatgaatgagcataagcatccactgtctttatatttgctgaagctggttatacataaaaagtactatcgactgaatgcttactctttgtgagataattgtgatctcactttattctcacacaaaactatttgcaatagtgagaataatgtttctttttcttctactgctactactactattattactactactactgaaatttcttacacgactcttactatgtgccagacactgtagtgatttacatatattaactcaattctcatggcaacctgctggtataggtgctagtccccataccccccctctttttttttttttttttacaaataaggaagctgagacagagtgtgatgaggtaacctgctagtcagtggtgaattaggatttgggcccaagcagcctggctctaagaatctgtgtgctttccgttgtttagattatgtccaggacttccctggcagtccagtagttaagactctacgcttacactgcagggggcgtggatccgatccctggttggggaactcagatcccatgtgccacatccatatgataggtctaaagcagttaggagggtttaggctcctagggtataggttcagttataaaagtcaggacaaagaactaactccatgactatctggctccaaagtcctaagactttagattcctgctctgttttatattaaacataatatgagtgttcaccagggttatcactaggacattcagttttgaatttctgcagagttaaacaaagcatgatagggagaagtctgattcctagagggtttagaagtaggggaggctagagaaactcagggtgggtggattgagtgtctataagaaattggaagtcagaattgcttcagtctatggacggaggagcctggtgggctgcagtccatggggtcgctaagagttgggcacgactgagcgacttcatttcactgttcactttcatgcattggagaaggaaatggcagcccactccagtgttcttgcctggagaatcccagggaggggggagcctggtgggctgacgtctatggggttgcacagagtcggacacgactgaagtaacttagcagcagcagcagcagcagcagcagcagcagcagaagaagaaattagctaatttgctggatagtctccccttaaattttcttacatttctcttgagttttatttaggataaaaatattctcaaaaataaggactacttcatataaacttgatccatttaaattgagataaaagaatacgttcactccaaagtaatacaactttaagagcctaaggttgaattccgaatagagatgataattccaggctatgattaagtaagttgttaaggagttaaaagtacttgtcattagatgaattagtttcatatgattcagtgatgtgctgtgggcatccagatggatcgtgaaaatatttaatttatttatgtggccaacattatgcatcatatacttggtttgttatataaagtgtcaaccctcctaactgggacgttatttttcctgatggtattttcctccacatctgtacacaacaatcaccatcattcttagcctcagtttccaattcagtccatgcttgagtagagagtacgtgtggcttcagttacaaaaatcactgtgtgtttgtgggtaggtaagtttgggagactaattattaaatttctctgcctgttggaatcaaaaggagcttatgttcgtattagcttgattaaagacatttcttcttgttctacagctgaactaaggatattctgtttcctctaaat

SEQ ID NO: 28338 - DNA, 1790 bp, Bovine  19866880446050
ttctaagactaaatggaacactcataatggtccctgaggaaatgtaatgatggaaaaatgccatttccttgctagccaggaaattgcattatggaaattgtgccatcagaataagttaatagatgtcttaaaaaaaattcggtgcccagcaaacaaatgaatatattatctggagtaagattaatgttaaaggaacctttgctcagtttatagaagagggcctttgtatacaggcaaaggggtggatgaaaaggaagctttgaaattggacagcaggagagcatgcacgtgcctgagggaactgaaatccatcgaactgcctgggtattcatctttgcccaccagccactttagcaatcctgagtcagtcttatctttggtgctaaactcctgtctgtaaaggtggcagacacgctggtgatcattgatgaaatgacgacaggctgaactgggctgtctgctggggaagcttcatctttgccattaaatggagttccccgtcccttcttttcacagtacatttcacagccacttctgatagagcccagctgtgctgagatgaccgctggggaggctgcagtgcggttgcttgcagctcagggatgtctgagagcagctgagcgagccccacagccttcagacactcatcgaattgctttccacaagcacatcccttcacccttctctgacatggaagggagcagagggaatgggcatgatcagaaatgacagacatgctggaaggggatgagctaatttacagggggaaatacagcttgcaagttaagaacaaagagaataagagccctgcagagtgtcatgaggcttttagtgtatcctagagagaggatcgttagcagtgagtagatgggtcttggaaggatatttggggtgccaatgtcttcccccatcgtggttcccagggagttgcatttatctcgctggtccacaggagctgaacttttaaatctgataacctcagctctcttaagtctgttgataaccttcacataaccttcctgtttcccaggaaagtaattgccttactcttttcttggctacacaaagagaaactctccttagaaaacctgcgggatatatattgtaaggcaaatagtcttgtcggcttggatcatctacctcaaagataacaactcaactcaaagtttcctacaaaatacttattctgagctagatttggtggaagaataggaatgtatttggacaagattgcatcaaggcaaacatttggtagaggggctgtggagaggaaactattgtagagctgggaggctgaaaatgaagatgtgctattaataggcaggctcttcatacatgtgtagagtgattaatctgtatctcccccctcccctcccatttcccaaaacactctgattattgtgtttcttgattgaagattatattctttctattttgaaatttgttcacaaaaatacacaagcaaaatacaatttaaaagctataccccattctttctgaaggtatcttacgggcttgtgcctgcctgtccaaattcaatattgatccttctcacctcctcttctgatggagaattgcactgtgttctggttactttcctgctattgtgtttgctgatatatctgcttagaattttctactaggttgtaagtattgaggaaattttctttcctctttaaagcatcaactcaagccttaccttctcactgaagatattcccaattcccttagcattcaaacattcttctactgtgttcccactgtaagcaattcttacagacataccaaca

SEQ ID NO: 28339 - DNA, 1568 bp, Bovine  19866880484329
atgaagtagagtgacttctaggtctgcctgggtatttagagatttgggtgctaaaactgagactcccaggcaaaccaggacagttgatcaccctcagtgatgcaaaagtagagaaaatacttatactaggaaagggctgggtctattacctgctggacagaaaagcctaaatcgttcttatttttattagccatgaaaaagacccttggaaacctagaatatatttgtcatcatattatctttgccaaaagaaatggaaaatccatttgaaaggatattccttttgcttatcctgtagcaatgtatattatacacagcagtattctttttggcttttttttttttttttgtcacatagttgctttacaatattgggttattttctgctgtatagtgaactggcccttttatttcaatgactgactgattttgcattttaaaattactaattgtttctcccacactttcttcttcctgcatccctcctcatttctctttctactagtaatctcaggcacacacatgtgtgttacacagatcattagatgaaggtcaatggtgttgacctgaacaaaaatggaaataagaacggacagatctttgatccccatcagcacaaaacctcaaggcacttcatatttttttctaaaaaaaataaaaaggtcatgagggtcagcccacatactggcttaaaatgttttcttaccaaatgaatcaagatgggaatgctaatttgtttgaatagttataattccagtctggattaaaaagaaaggcggaatatactgtacaaataccaactgtaacccaaagaagagtgagtgtatgcatttacctataaatacatatcgatgtatatatcccaggaccttctcataataagaaccaaaaggtcttgcactgaactgtcatatggactagcgtcatccctcagtagttggaaggtaattctgggacctccttttccccctacccatcagggatacaaaaatttgcagaaatgccataatacagtatgatttctgtatacacaggctcagcatgcatggaatcaaccaactgcgggtcaaaattgtttgattctgaagatgtggaaatggcagatagcaggcggattttatttatttcctggacatttgtcaataaaggaagcatttgctaggcacttagttttctttagaaaacagaattgtataaagcataaaacaacaaacaaaaagaaggtgatcggccttatctctctcagaaaaatcatctttgaggatttctaaagatgaaagcataccttaaaacatagcaacttctcccccaaaaaggtgaaataagggataaaaagatagaaattctattatttttcttcatttaacttcaaatgtatctatacttaactggaaaaaagaaactctggctgagcctgtaccagcagacctcctttgatctcattttttaagactatgctttatttcataccattgaccatggcagtatttctcaaaatgccaacttcttaagaatcacattgagtatttaacattcagattcctggctcaatgtcagattctgtttca

SEQ ID NO: 28340 - DNA, 606 bp, Bovine  19866880521529
ctgtctgagtactatttaaatgctcttagtgtttatcagcttactgatctgtaagatatcaggtggtatcattcaatcattcagtgtgtgtttattgagaacccctatatgccaagcagtgttctaagcactgagtgtataatactgaataaaaatagttcctgctctctcggatctttttattaaggctagaatgagataagactaggatgaggctatctgacatgttgtaatacctaagtatttatgttacttccttgactcccttccttcagagtaagagattagattagtgaaagtatgtttaatttttttattgcttaatttctgttggtttgttttggaatatgaaaggggaattcatggtgaagtcacactttttgaacttgagagtccctaacaagtaagtacaatgatatcacatgatcaagggagatttctagaaagcacattaagtcagatgtcctagattctgactgcttgtgagatttggaaacttctaaatttgcagacttaatattttctgaatgtcttgcattctaaagtagtgttctttctccctggcctagactgggatcaagcactctgtctcgaatgggagggagt

SEQ ID NO: 28341 - DNA, 1235 bp, Bovine  19866880549400
ctaacttaaccaatggattttaggtgatagcgatgtgtcagtgtaggttcatcagttgtaacacatatgtaagatcttttttttaaattttacttattttttaatcgaaggataattgctttatggaattttgttctgtcaaacctcaaacatgaatcagccataggtataggaaatctttgcataggaaatcttcacatcggaaatctgtgtatctgccattcagtttttctgaacacttttataacctaaaagtgttataaaatatcaagtctatttttaagtgtatcacacagatacattggatgtgcctaatgaattatccaactccaagctatattttctactctataacatgtcacatctccttgtaaccagtactctcgctttctcgctgcagtaaaatgtctatcaaaaatagaatacaaaggagaaaactgtgacctaagcaagaattttgggtctagaattctaccaaaagaatccaattcaaagcaagaggaaaaccgcatgtttttacataaattaaactaaatctccatttaaagatcatggcactaagatgctgatatctgtcaggcactctgtgaaggccatgttcccaccagctattctaggccattcttgggagattttccttggcaatgagacctcactgaggagcttctcttttaaacacagcgctctcccagcagccatgtatggcggatggcactccgtgactatgattcctgggcacggcatcgggcttgaactgcatgtcaagaatgtgttcggacacgcatgtgtgccgtggactttgaggaagtgaagattacctccacctctagtgacgatgtttacagtgccatcgtggcaatccattgaaaccacacggccttgaagagcagctttgaaactgaccacagcctgccaccatctcacaaatcccaacacagtgtgtttcgcaggatctctgtgccaatgtcgtccagtttgagagtcagccacgggtggaaaccagacacaagaacatagacatcttagttgttcgggacaacacagagggtgaatacagcaacctggaggatgagagcatgaacagagtggtagaaagcctaaggaccgttactaaggccaagtgtttgcgccttgctgaatatgctttccagctggctcatcggatggggtgcaagaaagtgacagccacgtacaaggccaacatcatgagactgggagattgtctcttcatccag

SEQ ID NO: 28342 - DNA, 1871 bp, Bovine  19866880576117
tgaaaaaagcataaatattcttgtgtgggtagcctattttgatgcagctgtatctcactgaccactgactatcacctgaatcagaatcaattggatagcattttttgaatcagttctaatgaggtggatgaaactggaacctattatacagagtgaagtaagccagaaagaaaaacaccaatacggtatactaacacatatatatggaatttagaaagatggtaataataaccctgtgtatgagacagcaaaagagacactgatgtatagatcagtcttatggactctgtgggagagggagagggtggggagatttgggagaatggcattgaaacatgtataatatcatgtatgaaacgagttgccagtcgaggttcgatgcacggtactggatgcttggggctggtgcactgggacaacccagagggagggtatgtggagggaggagggaggagggttcaggatggggagcacaggtatacctgtggcagattcattttgatgtttggcaaaactaatacaatattgtaaagtttaaaaataaaataaaataaaataaaaactattaatgcaagtctgataaattagaggttgggagttgaggtgtggggaggctgtagaaattttgtgtaagtttccacatttcaaaaagctcctccagacattctagcaatccaggtttggaggctactgacgtgtaagaccagagcagtgattctttaccatgactgctcactagaatcccttgtagtgtttcaaagaatgcaagagccactgatttaattagtctacagtggagtttacacataaatgaatatttttgtgatagcctcattgagataataattggttgtggctgtccagttgctcagttgtgtctgactctctgtgaccccatggactgcagcatgccaggcttccctccccttcactaagtcccagaggttgctcaaactcatgcagctctgttgcccccttcaatacctgttcctcaatctttcccagcgtcagagtcttttccaatgagttggttctttgcatcagatggccaaagtattggagcttcagcttcagcatcagtcctttcagtgactgttcagggttgatttcctttagaattgacaggtttgatctccttgaagtcctagggactctcaagagtcttcttcagcaccacagttcgaaagcatcaatcctttggcactcagctttctttatggtccaattctcacatccatagatgactactggaaaaaccatagctttgactatatagacctttatcagcaaagtgatgtctctgttttttaatatgctgtttatgttccttatagcttttcttccaaggagcaagtgccttttaatttcatggctgcagatataatttacataccacaaagttcatccatacatgagtgtttttcagaagctttctagataattccaacgtgcagccaagctttgaaagtccctggaagaaaacttgcaggaggtaataacacttcccagatggaagacataagagattttgaatttgggcagtgtcagtaagtgaaggtaagtgtagactgtatgaggcagtgatgtagggaggaattcagagaattctctgaggtttaattaacaggatttcatgattagttttcatgtggtagaagaataattcaggagtctaggattaggtcagtttccttcgatggacttggtggatagtgacatctgtgaattttcctatctccttcctatatggggctcctttacatacagaaattaggcaatgtgatgtatgaaacatttagacctagtatgaccagattcaacaagttacattatttactggatgggagaccccttccagggcccgagcgtgg

SEQ ID NO: 28343 - DNA, 4661 bp, Bovine  19866880588864
tgcctcccaggaagcaaagtgaagggcaccaatcattttaataaattgacattccccatcaaatatatgaaagctattagggattacctgtctagttagtaatgcagaaaataattcctgactatttagatgacaagcagtttttcctcccctccaggcaagctcatacgtattaaactgtgaaagtcaggagttgagttcgtaggctcatttttaatcctctgccctgggaaattcaaaagcccctgtaacttgaagcacaatggctaaacagaaaggacatccaggcttctgtgaaaatatgaccaactggaacccagaaattgcaaatttttcttggtaactagtatccaggaattgtttgtatccaagtatacttaatgcactgtagatcatgtggaaaaaaccagattgaagccactagcctgaccaaaaaagaatataaactcatgcaatttgcatcactttctcctaacaggatgcactgattagaaaaggtagttgcctgaaaatgttgccttgggtccaaaatgtgttgaatcaaagagcagtatctatgcattcattttggtggtgtttgaaaagataataagtttcaagcttggcagactaatgtggttttaaagcattctccatttttatagagaccttaaagttatctatgtgtggcagcaattttagccaagaagattgagtccatgaggggagattctagaagattactttattaatcttgctaagaaaacctttcagtacctcctcagtgcttaagataaagtccatcttccacagcatgatatctaaagacctccatgattgaacttctgcctgcctctccagctttatctcctcctcctcctcctcagacatttcaaatcccagctcattctaaactactctggtcactgaaatgcaccttattgatggcttctgccttaatcttatctctgcctacaacacacatatagacttacgtgttgattaccaatcagtccagttcagttcagtcactcagtcatgtccgactctttgagaccccagggactgcaacacgccaggcttccctgtccatcaccaactcctggagcctactcaaatttatgatgtccattgagtcggtgatgccatccaaccatctcatcctctgtcatccccttctcctgccaccttcaatctttctcagcatcaaggtcttctcaaatgcagtcagttcgtctcatcagaaggccaaagtattgaaatttcagcttcagcatcagtccttccaatgaatattaccaatgattaccaatatctgatattaactaaagtacaggtgtacctcaaagatactggcaggttcaaattccaggccactgcaatgaagggactatcaaaattaagcaagtcacataagtctttttggtttccccgtgcatatagaagttatttgacactatacagtagtctactgactgtgcagggcttccccagtggctcagtggtaaagaatccacctgcaaaagagaagacgcaggagacccaggttcagtctctgggtggggaagatcccctggagaagggcatggcaacccgctcctgtattcttgcctggagaatcccagggacagaggagcctggcaggctatagtccatagggtcacagagttggacacagctaaagcgactgagcacacattcactaagtgtgcaatagcattatatctcaaaaaacactgcatgtatcttagttaaaaatactctgttactcaaaaattctatcatcttcagtgagttgtagcagtaacataaaaaatagctgtattaacaaaacattgtagatcaaccatacttcagtaaaacaattttcaaagggaacaaaaatcactgatcacagatcactgtaacaaatttaacagtaatgaaacagtctgaaatattttgagattcgccagaatgtgacacagagacatagagcaagcaaaggcagtttaaaaaaatgatgccaataggcttgctggacacagagttgcctcacaccttcaatttgtaaagaagacaatgtctgcaaagcataataaaacaaagtacatataacaaggtgtgcttgtaatggaaaagattgatttttgagggtagctaattatttgaatgctcctgatctgttccctctcaaaatatcccttccatagttttcctcattccagttggtgatgaaatctaccctttcccattctctgggtcaagatcttgaaattgtccttgacttttttcttttgcagtgcacatctaaatctttgctctgccttcaagatatattgggatccaagcatcatatgatcactaccaccacttctccacatgacatcattatctttaatatagattatggccaaaacctccaaactcttctcctgtcccctgctgtacagctgtctcctctttgtaatcataacatggtagtccagcggataatgctgaaacatagattagatccagtcatttctctactccaaaccttccacggctccccatttcctcagtaaaagtaaaaatctttatagtgatcaacatgactcgacgtgctctcagctcttctccttgttatttctctgtcctcaccattcagggggtggatttcaagcatccttacctgaatcccttgttttcctgttatattttccttatagtttggttgtttgaaatgttcttctcctaaatattttcatgatctgctccctcacatcattcagatttgtgttcaagtgttacttcctcaggaagaccctcagccctgactaaaatagctcttcctttctgtctgttgtattgtcatcagtaatgcttttcttgactggtccaactacctggccagaatataaactccatggggcaagagttttttttgtcttattgccactgtgtttccagggactagggcaacacttggcacacaacagttgctcaaaacatcttttgaataaagatacttgaatctcttttagttttatattagtctacaaaaccaaaatactgtcatcaagataatatcttagaaagaatgagaaaattattgttgtcaatcacacaccttcatccctggtatttttagatcatatgtaatcagaattatccttgaggttttcttctcctcgtattcccattcaatcaatcatcacaatctatttgttttttctctattcttttgcctagtcgaaaccatcatcatttagattttgtttggaatgatagcagagggcaagtcttcaggtcccacatcctgttctttcttcatgaaagagtgttctttctgtttcatagtataatccctataaaaggcaaatataatcaaatccttttctcgatgaaaaacgtgaaatggtttcctgcgcctcttggtgtaaactccaacctggactcccccgtgagtccctttcctatttcaagttataatcaatatcttgaatttttcccacactgatttttttttttttttttttttttttagatttttctcaaagctgtgatcctactgcaggtctctgcccagagagacctgggcagtatttggaactctttgcttctctttctccacctttctttctcctcctaccatttccagcccccatcttcccttgttcacttcagtttcaactgcagcttttcttcataaatattttctcaaacatcttgtaaccttggctatctgtgcatttttatgaatgatgtgttagaagttggttgaaaactcagtttacctatgtgtaatattgataaatgattttaagtttattcttttgagcaattgagattttttgagaagatccttccagtctaatggaagagatcagtgacatttctgaaagaattatacttggatgctagcattgtgagagccaggtgggatagataaggcaaagggtttcagaactcagtatatgtatttccacggaatccccttgtttgtcgtgcaatgtctctgctctcagctgccttccagtttctgtggtaccttctgctgagaaggaaactgcagtctttgctggggcaggaggaaggccaggagtctggctgaggtgagggagcgtctctgaggaatcttaattgattacttatctttccaattagttttcttctcttagcctcactattccctgcagtttcagagacagctgatgcaaccacttccggtgttctgtggtgtaaatcacgttgctttctggcttcttctggcttctccactgaagggttatgaatcatttttcttaggccttctgagggagttagttaactctcatccatctcttttttagcttccagaattctattgctcgtgactcttctccaatgtcctttgcttttgagggtttatgtccttcataacgtgcctttaatattattttattactgtttcatggagaaaggagtgggagatgtgagtatttaatctatcaactttagttggaactaagctcctcaattctaaaattgtttctgactcatagatgaaaaatcaaaataaaccatggatgaaatgtatatgtaataatagtagaacgaaagaatgaggcattggaggatataaaatatatttctctttcagaatagagaagattgggggaagggatgtaatttaatttatatatcgtgacaattattctctctaaaaaaatattagaaga

SEQ ID NO: 28344 - DNA, 4035 bp, Bovine  19866880600227
ctgcctgcaatgcggggaccctgggttcaatccctgggtcgggaagatcccctgaagaaggaaatggcaacccactctagtaccttgcctggaaaattccaaggactgaggagcctggtaggctacagtccatggagtcacaaagagtcacacacgactgagcaacttcacttatggtatgtgggatcttagctccccaaccagggatggaacctgtgccccctacagtgggatcatggagtcttaaccactggactgtcaaagaagtcccaggacctagtctttactccacatgtgccccaacatgggaagaacagtcatgctgccacaagttgcctcctgtgtcattccctatgagggtcacttgtcaccagtcccctgattcagaagtatggttgtgaagatccaattgccattgtaggttttactgcgtttaagcagagatcttgtatataaaaatcatatgagcatcttccactttaaaggtaaagggaaatcagggaagattaagaatctaattctttctgtgtcccctcaattttcttcagagaatgttggccttattacatgaattctgaatcaaaggtcaatttcatcccctttcttttccctcattttcttttgcaaatgactaattaatgcaggggagtacaggcatggaggctgaatgacttttgaaggggaaatgaatgcccacagagacctccatttatgaaaccagctactccactaattagtagggagacggtgtcaccccaaggtgagaggcagtaaatcatcttatctgaggtggcactcattttaatacatcaccctgctatcagtaccatttttaagctgtcttttcttgacttatttccaagtgtgaacaaggtaggtcaaccacactcaatttgtgggcagaaaaacagacaatcatctttgtcctcagtggaacattagtatgcacttggagacaccttgcatagacttttattttctctctgaaaaaagatatttgcttcctagagtgatgtaacagcaggcctccagaagaccaaaacactgcatagctcagttattgcaagaggcatcatttttttgcagacacacagcggcagaagttggcttaccaaaagccttccctccatctttcccaacccctccgggggttgaagaagacactcaatgtcaagaactgcagaaacaccagtttctagtaaactgaacctaattagtgacaaccacaacgtcacttggtatgggtctcggagtcccagacacatggctcctacttctgtttctaaaccttggtgccagagaatggagaaactccatccctctcctattgtttaatctggttttagtaatacaaacagaaggcaaacatttggcaaaagtgtgagttgctcagttgtgaccaactctttgcaagcccatgaagtgcagcccaccaggctcctctgtctgtggaattctccaggcaaaaatattggagtaggttgccattctcttcttcatgggatcttcccaactcagggactgaactgggattcccaccttgcaagcagattctttaccttctgagccaccatgaaatcccaacattaggcaaagtaagtgattaaaagccccagcctggatactcagttgttatcagaaggagggacatcatggtgacaaagttactactttggacctctcttgtaaaaatggaaaagatggggagaaatgaaaagaagaacaaacaaacagattaatgagtccagcttcatcattacatttttaatcaggatgtgcacagattcagcaagagaaacttgtccatcagactgctgaaaaatgagagtctgctgttatcaacctcatactgagaagttcaacccttttaagtttgggaaagaggcaattatcccaactctgcttaaatcattcgtttctcagggtaactgacttcaaggtggccatagacagtgaacacggcaggcaagccaaggcacatttatttacccaggtgtctctggccttcccatccgtaaagctgctgagaggaagggcaaaggaaggtgggggaaatgatactccacgtgtgcgttcaaccacaagttcaggtcccttggtcaaagctccaatataacagccaagagagagtgaattcaggaggtgcactgagtgattcaggaggaactttggggattattttggccctctagtttttttttttttttttaattcctagagatgcccattgtggcagggtcagggacatgcctcattcagaagttgaacaaagggaaggaggagatggaagttgccctgggcagcatggttttcattagaagctggggggtggggatggggatgggaaggagtcttgcactgagatggactgaaactattccagaattatctgtggggtcctttgcccaaagttacgcttagaaggaacttgaaaaccaaaggctcattttcaaattgccccatttccgatccataaaatgtcctttaaaatccaaaagatgcaatgaaaaactaataatacataggaagaaaacagtaatatatttacaaaagacctggagatttcttattaaaaaaaaaaaagagcttaggagaagagaaaggcttattggacataatagaaacaaaatcacaccaaggtttttcttttgctacatcagcagttcttaggttgggatccatggatgcctaagagtcaatggctagacattagcagtcactaaaacactttgctcattttcaaacatatattcaaggcatatatgcaaatatttctggagagattattcagagcttccattaattcccaaagtggagtgtgtacgtgtcgtgtgtgtgtgtgtgtgtgtgtgtgaagcaaagaggtaaacaaacaaacgttctgcctactttattcctaccagctctcccttccttgacacaccctcttccccaccgcctcctttataaaaatattcaaattaacttgatttccagagaccctttatcagaccccgtggcaaagaactcacacatcttccacctgcttcaagctcattaaacacataattagtctctctggacgataatcgctgttgctcaagtttatgaatttctttccccctaatctctaattctgggtaggtttgtgacataaggcttcagaaaagaccagtctgtcattaaatggaggactgtaaagattttactaccatcatgagccacggaagccttgatcatacttttactgcctctacaggaggaatataaaccaaaatgctgcttacatgcccccactgaggccctctgcctcgtgacagctgatgaaatatgtcctgcattttacctctgaagggacggatgccaatcgtgacgggtcatgggaagaaataaatgttgatatctggccctagcctcaaaaaatattttcccacatcagaaggaattgctttgctattgcacagggatgacaaacaagtaagacttgagaaggatgggtgatgagacagcagagatgccctggaaaaggtatgcagacaaatacaggccaaaacagagactcggaagccagatgtcagaagactcaagttcctgttttaggcttaggcaagacatctaacctttctgggactcaggtttcataaacactgaggaaataggatttgatgaaagattcatttatgctcactcttctgtgcagtcaaatttctccacatctaaccttatataagagcctaatacatagaaccaaccatacagttgaagcttcaaaggtttacatggggatagatgttgaaagcccatttcctatatcttagccccacccccagtcactctagtgtcccagtttccatcatacagtttcaaaaccattataataggtgtttcatttagatttgacatgctgggttacggctgatctctcatcccacctcggagaattccagatgacacagcagtcctcaacagctgtcacttattgatactgatacttgtaacagcaacagcaagccactgcaagggactgaggggccctctaaatggcagtcaagagtt

SEQ ID NO: 28345 - DNA, 1627 bp, Bovine  19866880611000
aacaatgacagactttattttcttgggctccaaaatcactgcagatggtgattgcagccatgaaattaaatgacacttgctccttggacgaaaagctatgaccaacctagacaacatattaaaaatcagagacattactttgctgacaaaggtccatccagtcaaagctatggtttttccaggagtcacgtatggatgtgagagctggaccataaagaaaggtgagtgccaaagaattgatgcttttgagctgtggtgttgggagaagactctttcgagtccgttggactgcaaggaaatcaaatcagtcaaccctaaaggaaatcagtcttgaattttcattgaaggactgatgctgaagctgaagctccaatactttgaccacctgatgtgaagatccaactcattagaaaagactctcatgctgggaaagattgaaaacaggaggagaaggggacagcagaggatgagatggttggatggcatctacgactcgatggtcatgagtctgagcaagctccaggagtcagtgatagacaggggaagcctggtgtgctgctgtccatggggtcgtaaagagttggacacgactgagtgactgaactaactgaacagtacacttggggaccatgacaatatgacaacatcagttctgtgcatttgaaacacatagtctttacctttcttctagctacaagaacaaaaccaactgactgcaaagccccaaagaccatgcccccgactaaaaaatacaaaatactgacctttcaaaaccctgtgcctgtttagggaccaatcatgtaatatatttgtcttcagctttaaaaagtcagggctgcaacattcttttctgaattgtttatcaacaacaggggacatgaaataccacagatgtaaaaataaagaaaaaaagcaaggctctttcagctccctggttgcttagagatattttctggcccagactctagagttgtcacatttatcctgtggaattaaatgtggagaccttgttaacagtaagcagacatgagaactgaattccctgcatgctgtgttcaaatgccccttcatgaactctattcctctaaaggagtattgtcctagtaatggctagggccattaaagctttggcttctacttaaagaaaaaacacagtcagtcactccccttttatccagtggcccaaattctatcatctttaagtcttgagaagagagtcgtgactcagaggttatggaagaattctctgcagcatataatggccatgacacccatgtacttgattccaccataaaatactagagacactcagagggtagagaagagccaatgggagttaactgatataacatgcctgcttatctcatcctgagtcgtggaggagatgactgttctgctcatccattgtttccacagagtggaaccttgtttattccagggatcactgaggcttactcccctcactgctctcatgtctttgattatttgcccctcatctatgagccctttccagaccaccccacataaaactgcaccactgcccaaccttgcacattcatctccttccttcactttatttctccccatagtcccaccatctgacattctatatagccctgccctgtca

SEQ ID NO: 28346 - DNA, 675 bp, Bovine  19866880612612
gtggtgttggagaagactcttgagagtcccttggactgcaaggagatccaaccagtccattctaaaggagatccgccctgggatttctttggaaggaatgatgctaaagctgaaactcctgtactttggccacctcatgcgaagagttgacttcttggaaaagactctgatgctgggagggattgggggcaggaggagaaggggacgacagaggatgagatgactggatagcattactgacttgatagacgtgagtctgagtgaactctgggatttggtgatggacagggaggcctggtgtgctgcgattcatggggtcacagagttggacatgattgagtaactgaactgaactgagactgcttgattctagagcacacagtctgaaccaccagcaatgtgctttcacagaaatgtaccattttcttgctaacagcgacctgaactcttgtagcttaatacttcatctgtattgccactggggaccttgaaaattacagctgaattctttacaatgttgatcatttgtttctctggcactcaacgtcagggggagtcttgttttaggcagctgaattaggacaagcttattggggcttcattctgaactacagagctccattctggtgagctcaccattttatgaaggctgttgtggactcagtaaggcaggca

SEQ ID NO: 28347 - DNA, 1262 bp, Bovine  19866880633972
ctcaatgacctaacattaccctgaatttctcctccatttatttttggtagcattccaggcagcctgattagctctaaggaggtgatttacagaagacagaaaatctggcttactcttctttgatgcctcacactgcccatcatgaaccaaggcagcacataaatatgtgctaattgacttattgattgacacaaagtaatggaaggcaaagaaagctggatgaagggataacaaagggaagaaaggagataaatggaggcactcggctctgctgggatgtggaaagtgaaactatttatggaagcccatttttttttcttttgctccctctgactctcaagctattcagtttccaaaactactaattattaatcacaggaaaagcatatgccaagctaattcctccggacgaatcacacacaccgcaacctaacatgatcaattttctttgcaacaattaagagtaaaaaaaataataataacatgaagtctgtgggagactggcctcctttgtggaacttgcagttctaaaataaaataacgttatgtaagtgaggagaaagacgaagaaaaattttccagcaggctatcgctcctgttgtgattttaagattcggaggaaagcgtggtgcgaatatggaaatggataaaatccatatctaacgtagttgttaaaataagatctgattgttgcaaggttgaatttgttagaaacaataattatttatgacactttattacaacaccctccaaagcatatggttaccttattagaaattaaaattcattttcatataaatctcagcaggatatcacaccaaaataactagagtaactccaggggacaaggaataattctagtttagctcttctaaggcctggcatttgtaatacaaaatttaaactaattcacttgtaaatataatggcaggttttgaaaatgtggacaatctacaagtatgaccataattttttttttaaccactttgaggacatgtataatttacactttcctcataagtttcttttgcttggttttacgttttcaatataatacaaactttgttcattatgaaagccattgctgttctctcatttttaatttgtgaatgtttacaaatcagagcgttcagctgactggctttctgttctttcaaccacagtgaacaatacataggatcataaaaatagtcatgctcctgagagcccgtgcagccatcgaggagtatagatatttctgttagatttcacctcggtttcat

SEQ ID NO: 28348 - DNA, 906 bp, Bovine  19866880682540
tatcatcagtaaaaaaaaattggttacaacaaaataattatgacacaattactatttgaataaatgaaggaaaagagtgaaaggagaaaggtaaaatcattttcttttttataccataatactatgccattcaatgtatttgattattcaaaaaatgcatgtatatgtgtgctcacaattttaaaaatacgtaagagaaaaagcagtccaaagaaataattgaaaggagatttccaaagacaggagtaaggaagtcataaggacagctatatttgttttaagcgtctgtgtattatttaactttccaaatagtctgcaagtattacttcaagaagaataaaagtttatttaaaatggaaaaataagtctatgaaatgtgtcttgcaaacttgatttattaatagatattcatgaaataaacctactagctatagagtgaaacaatataaatttctccctgcagttatatattggtatgcaattggtacaatttggtgatgaaaaacaaataggcatgagataaaaattggagccttgggctttaaggtaggagtgaaaatacatacacatataaataaaaatataaggaaaaaattgaactgaaaaactaggcatccacaaaataaagatagaagattggaagcaaaaccttgggtacttatattttctgggcaggaggaaaaaattgaagaactttacattctttaaatatagcatagtgaatttacatatgtaaagattatatatatatagtagacagcaaacttattagacttatgtatattttaagagatttctgtaaggtaagaaactgctactgttgctgggaacaaaacaaaaattcctgccctcatgtacattatcgtctgcacaagtattgttcgagtacatataaaacatttacaa

SEQ ID NO: 28349 - DNA, 1900 bp, Bovine  19866880700629
atgaaaaatagagaacatgtttaaacagaaaacaggctctgaatgaagaggacttttatgctttattccttcaggtctgtttttatttagatctgacttgggaacatcgtaagtagctttcctaaagtaacttcagctctgtctcctgcttgacagctggtataggggctccagaccatctgccaagtgaggagccaagtcatggtcagacatctccaaacagagagaaccaatattctcatgtcctgatttttaaacagtttgcattttttcccactgaaaaacgttggttgttcttatgtttatcctaaattgcttccaacatatatattatattttattatttaggaaaatttcatggaaacatttattatgacagtaagaaaaaatacagatttatagagctttattctaacttagctaacttttggttaatgggtatgaaagaaattatgtatctcataattggaagatgatttaaaaagaaaataattttatgtttatcaatattataccaaatacatatataagtgctaatttagttgatatgttttatacattctttcaaaataaattcagaaggttgctacattatatataaatgattcattttaaggtatttatttgcattcatcttgttactttatttatttatttttttttttactgtctcatcttaaaagactctgatgctgggcaagattgaaagtgctaggagaagggggatgatagacgatgagatggttggatagcatcactgactcaatggacatgagtttgagtaaactctgggagttgccgatggacagggaggcctggagtgctgcagtccatggggtcacaaagagtcggacacgactgagcgactgaactgaactaaatggaaagacttgccagaattggaatctacattccagaaaaggagaagaaaagatgatctttcaggaaacagtcttcaaagatcctagcctattttcatggcagggggtacaaaaaaggggaccacaaatcctagggaagttaggatttgtgaagttaaaaattgtgagctatttaatgcacagtttcttttatataaaactacctattgcacattttttttaatcagacagttcaactcaatgtatgttattatagcttttctataatagaaaagaacccttacaactctgttaaatataaacaccaaaaaatggctcttttcatccaattgttattaaactgtttttaaaagtgttaatgtagccagccaccaattacattttattgatttacatttttaattacacattgcatgactaaaagttaatctgatgatgattatccattgagtaaatattggggagtaattaaagattagactttctcctctgtagtggcaggcacggaaggaatattatataccattataaatgtgtaatcgccatacaagactatgaagattgagcagcatttgttagcaagcatacagatcaggccaggtctgtgttttcatcaggaatcctgaacttaaagctggagcttgacatgctgaagaatatagaagaaaacatctgattgataggaattgagaactagtgtaggtaaacctaaaaaaacaggacttgtatttgcctttaagtcaggaaatcctttttgattaaaggcatcgtcttccttaccctttttatctggtaatcatgaagtcagctgaacttgttatttggctcatatttttaagcttattatgcacatgttcacaggaaaaaatggtgcaaatggctctcaacctgcttcaaggggatatttttcctcttgattaaattcagctacctttgcctgagaagaggctgagagacccatttttcttattctctcagctgtgacacaacatttttttttaaatccaagaatgtaatca

SEQ ID NO: 28350 - DNA, 2268 bp, Bovine  19866880703961
tgctagcctggggctgctctctgatgtaactgctgcaactcttgtttggatctttttgcttgcatattttatacccccaccagccttccttgctggctttctcttccctgtctctttcctgagttctctgttttgttagaagccaggcagccagcttccatcctcttggtgtctccgtgccgggtttgcgtgggagggatgtatgctcattcacgctcatttgcaactgcaggtgctatgcaattatgatttaacaatgagtaattctatcacatccttcagtcttcaaattaaagagcaatgatcataaggtctagatgtccagtgtaaaacaagcaattttcaacattaaggtgtggtctgctatctaagatgatttttgtaacttcacaaatatagttaagacttcgtatatttagttacattgtaaattttttaaattttattttttattggagtgtagttgctgtaccatgttgaactagtttctgctgtgcagttatgtaaatctgctatatgtatacacatatctcctcccttttgagccttcctccaaccccccacagcctatctttctaggtcatcacagagatcaagctgcgctctgtgctatatagcagcttcccattagttacttatttcacacgtggtggtatatatatatcaatcctcatctcccagtttgtcccatcgtctacttccacccttgggtccaagtatctcttctccacatctgcatgtctattcctgccctgaaaataggttcatctgcacgatttctccagattccaagttgtgttagtcgctcagtcgtgtttgactctttgcaaccacatggactgtagcccaccaggctcctctgcccgtggaattctccaggcaagaatactggagtgggtagccattcccttctccaggatgtcttccaacccaggaatcaaacccgggtctcctgcattgtaggtagattctttaccatctgagccatcagggaatccttcatctgtaccatttttatagattccatatacatgcattaatatatgatattgctctttctgactgactgcagcagatgtaaatgtaaacagcaatatccttgttggtttatctatcagtttggccaaaagatttacattatggaaaaacccaaatgaactttttggtcaacccagtgcagaggctcagatgaagttcatgccctaaaatgaaaccttagatgacttgtgcaagagacataccaaggaattcagaactgaaagtgactttattaaatcactgaagacagccaaccgtcttcttttatggtaggggtgagagatgccataggaatgaaaaaacatacctcaggctccagtggaggaggtcaaattcaccagctctcactaaactagtcccacttgccttctcctgactgctacagtaattataccatgagtctccaaatagtcagaaattggctcacgcattttgaaacttcttacattgcttgctcattgtttcatatatgctgacctgtctaacctacttcactgaaaatgtgttgaagataagaactacatcttaaagtttttctatggtgaagattggattcatgctaatcatttagtgggaaaattcaataaatattccttgattgatttaaatatcaaaggattttgtctacatgattctttgtaaaagaatactaggaaattaaaaatgacatctgaatgttttacatttccttctggtatatggcatctagactgtgagtgtcttggggaaaaagttgcagtatagaaatatttacaaagcctggtatgtagtaggtgctgaagagagtgttgctgaataaatgagtgagtgagtaaattaatgaaaaatgtgggcaacacgttaatcaggaaaaatgataacaactgtggacagaagttggggaagatgagtaggtttataggaacaagtgcttgttaggatacccaagatcaccctcacgtgtatcagtcagcgggttcgtaccagggcctgggcctattgaactttctgttgtcttgtagggtcagctcttctgctaactcactgaccttgggcacccgagagggcaagtggtgaataatgtggaggggaagatgaattcttaaaatactgctgctctcaaggtcccatcaacggaggcaattcaaaatatggagtaaaatgcaaatgagataatttggttggtgggaggtgaaagtttatgaacactttgatgtcctaagccttgcgtttatttcatatgttccaaac

SEQ ID NO: 28351 - DNA, 1424 bp, Bovine  19866880710501
tttttttttcagggagatgctctggttagatgttagctgtttcctgtgtaattaaaagcaccgttgcctttttcatgtctctcttctttgtaattgccttgatcatgatcaagaatccctctgcctaaatgcatctctacctgcactgcattaggacgtgatatgataccattttcaggcatatagacttgttgctcaaggcttcctttcttagctataatcattggtgctggggagggtgtgctagagacagagtctagtttttatttctcactagtaaacaaaatccaagtaaagcaatctctaattcagaggcagagacttttccacttctgactaggtgaacagatacagaaaacttcaaagatcagctggaattaaaaaacaaccaaccaaccaacaaaacaaagaccttcattttgccaggtcaggtctcacacaaagtaactgccagatataaacttgtggaaagcaaagagaaacattaatgagccagcctgcagcccacatgctgttgattgggcttttccttgtggtatctagcttaattgcacacatctggcttgataccggatcccacaggcctctgcaaattaaataaagataatgatttcgtttaatcataaataactaaatatgcaaataattgaggaaggatccttgatggtgatggaggttaaatcaccggaaaatcaggaaagactgagcagtaagtgaatgatttacaagaattgaacatttatctagtgaaatttaaaatgtggcttaagacacaattgactttcttcactagagaggaaatatccacagacaaaggggaagaaataatcatttcaaatgtgaaggcaaagtgaaggctattttatgtgtggggatatttcgttgaaattaagcatttgacttggggtaagcattggagaaggcaatggcaccccactacagtactcttgcctggaaatcccatggacggaggagcctggtaggatgcagtccatggggtcattaagagtcggacacgactgatcgacttcactttcactcttcactttcatgtgttggaaaaggaaatggcaacccactccagtgttcttgcctggagaatcccagggatggggaagcctggtttgggctgctgtctctggggtcacacagagtcagacaggagtgaagcgacttagcagcagcagcagcagttgtaactattatagagaaagcccgccagcagccttgaagaccaaatgagcaggtctagtctgttccctcagagggggtcagtggcttagactgagggctttggaatccactgcacttgaatctgaatcccactttagtaatcataagtgaccaaaggcaaatgtacccctcattggtaaattgtggatgatagtgcctacttcccagagttgtaaggagtacatgaggga

SEQ ID NO: 28352 - DNA, 1682 bp, Bovine  19866880716631
ccttgtttagagaatcaggcccctttttaattcctgccagaagtctttaggatttctatattctgatttgattctacattcaatgtataattgcagaacaagattgaaaatgctgtttacaatgtaattctaaagtagtttatactcacataattgaaatggcttgcttgaaacagctcaccgcacccaaatatgcctacttagctaagcaggcagacttccaaatccattctttacaaaatgctacagcaactaggtgaactataccctgttgctggctaagattttctaaactagtgtacgtttattaaggttttcagtctaaagtgatcagtccatcctgttcattaatatagtactgtagggagctacatctattattttattatcgaaagccagtccttgattgaagacatctgtgaaaatacatcaaatattttaaagttttccaaatgcaaattttagttttcattcctcaagacaacaccaacagctgatattgcctatttaatgtttatgatctttgttgtaatgaattctccaaattttttcagggtacactttgtaggaataaatgatatgaacattctgtagtcttctctagtttcctttctctttaaaattaatttctatgaagcttcagcctctaagcttcagtcagaaaatattttttggtcacctaagatttacaaaccaggctgagcactgggtaaaatatggaagaagtgaaaaacatggtccctgcacacaaatcactgctgctgctgctgataagtcacttcagtcatgtccgactctgtgcaaccccatagacatcagcccaccaggctcccctgtccctgggattctccaggcaagaacactggagtgggttgccatttccttctctaaagcaggaaagtgaaaagtgaaagggaaatcactcagtcatgtccgactcttagcgaccccatggactgcagcctaccaggctcttccatccatgggattttccaggcaagactactggagtggggtgccattgccttctctgccactaatcactagtatatgttatttgggaagatgacatgacatacatgagagacatacaaaagttcaaagtctagcactaatatgtactagtgataggaatttcaataagatatttgacatttctaggcctcagtttcgtcaataaaatgagccttactgacatttattttgaaagtttttatgaagttgaaatcagaaaatttatgtaaaagtgagcaccatatttgacacagagtagagcttctatttgctggtaatgatagtgattatatataggtatatacacacatatatgcagtactcaccttcatatatgtatttatacatataaaaagaaaaaataagtaatatacattttcaatgtcaaattaaaaattaattattagctaatttcaagttatgattatttatatattgttttttcagtcactaagtcgtgtccaactctttgcaaccccatggactaaaacacatctggcctccctgtccctcaccatctcctggagtttgcccaaattcatgtccattgcatcggtgatgccatccagccatctcatcctctgatgtcctctactccttctgccctaaatctttcccagcattgggatcatttccaatgagttggctgttcacatcagatgaccaaa

SEQ ID NO: 28353 - DNA, 799 bp, Bovine  19866880827992
tggaatggggagctcttccaggaggccttgaagtatggataagacatggtgatatgatagggccataatggccttgtttcaaataaattacaaagggaggaacttcagaaaaatgggtaagtccctggaaatcatttcccagaaagataagagctattctctgtccttcaaattcacaacttctggggattgttgaccgtggctgccatcctatagcattgcctccctgaccccaaacagcagatggtgactactggattaagaacatggatttcacattgccctatctctgtgggccaatgtcagtttgacttgatttatgtttcccttaactttataagaaactctgtatagtacaagagaaagaacatgctgtgctatagaatctagtcaaggtcagagaaacaaatgaatatccttatagtctatagagaggagcaggaactttgaagttttaaattgttcacaattggtacatacaccgatgatcttccagaattattagttatcttctagaaataacaacttccattggaatgcctttacctcctacccattaaaaataaatatttttagaacttaagcaacatatagaatttttgctttgcagtatggggaatttttattttatttaacttgcacagctagagaatgctgctgctaagtcgcttcagtcgtgtccaattctgtgccaccccagagacggcagcccaccaggctccctcgtccctgggattcttcaggcaagaacacggagtgggttgccatttccttctccaagcagaaagggaaaggaaag

SEQ ID NO: 28354 - DNA, 1664 bp, Bovine  19866880830841
ggggcaggaggagaaggggacgacagaggatgagatggctggatggcatcactgacttgatggacgtgagtctgagtgaactctgggagttggtgatggacagggaggcctggtgtgctgcgattcatggggtctcgaagagtcggacatgactgagcgactgatctgatctgatctgatctgaaggatgtgagcagctctatttctgatgccctgatgtgccttgtcacagttctgtattttctagcaaaggcagttcgtacattttgtttgctccaaagcatccattgtccagcaatggtagcattggtgtgattgagagaatttattcttttaatctatttgctgatcccaaatctccccttatcaaccctcatctctgcctattgttcccagggtagccatttgacaggtggtatgtttttgcttgacattgattaaagttcccactccattgctcaaaatgaagtgtatgctaaatgttgaaccagcaaagatgcctgcaattttggctgaaagacagcatttcagatacgtttatgaaaaactcagtctgtatttgttttcttgtcagaaaggtcctaggcaggttggagcttggaggaaggaaaggacaaaagtagaatttgtaataacattgaccttgatcagtcattaaaatactggactcttagacatcaagttattagcattttcatcttatgaattctcaaacttttgtatctgtaattgacaattgtgaagatggtccttaaaatgagaattccctcaaatgagtttctttgtaattaaacaaaagtatgcaaacaagaaattatagagctttttcccttgcagggatgagcatgagaatgaaatatttcaggcacagggtattttatatctttgtgttctttttaaaaactattcctgtgggctttacctaattatgtcttgggtgatttccctgatttgggatttctgtatttacgtaagactttctccatggaaaagtctgatcctgattcagatttgttttctgtaagtttcatttctgtcaccccttggaacctcaagtaagacctttctaaattattcttgtgaaattcatgagatgtctccttcctgttgctgcagatggcgcataaacaatgtggactttttatgttccctgtaaccttcttggagaagatggatgttagtccaggcatttaaaatacaattgtatgtttatcaggtattttacagatcatgaaattgctagcgtgttaaatagacgttttttgatttaaccagatgaaccattcattaaacccatctgaggtcgacagactagctcgcaaaaatgagtagcttggtttgggactttgggtctgagttaatggtgtgcggtgtgtgcgtgcgtgtgtgtatgtgtgtgattgagtgagagagagaatcaatgtgtcgatgtagctgggaataacctaagatttgtttcagtggaagtgggtagaatagacttgtaagaaaattcatttcattaaatggtattgagcgtttgttgtgtaccagggagtctgctaggtactggggagacagcctggcgtgctgcgattcatggggtcgcaaagagtcagacacgactgagcaactgaactgaactggagagacaacagtaccaaaacaggcacactcttcattct

SEQ ID NO: 28355 - DNA, 1595 bp, Bovine  19866880837456
ctgcatggtggaaacataactcttgtatgcactgggaaaaccaaagcatctgtgtgacttgcctcatggaaagttttgctttattgtggtggtttggaagcagacttctgatatttctgaggtatgcctagagtgtgatgagtgtggtcatagagatatatgcaaggtgctatgagagcacataagaagggaaatcagacagttccctctaggggaaattgtgtttccagaaggggagagaagagagagagcaaaaagaagaaaggcaaagtaggagacagaaggggagggccctatgagagctaccatcacaagccacttacctgcccattacctgatactcacagcttttactcaactctcatttcttattttgcctgtaattattgttgaactcattttacctatacaaccttgccctgatgatgtttatctataaggagggattttcaagatttaaggacagcacctgatttttctatgaagtggtttttttgggggaacaaactctttacattgattaatgagcctgattagacacctcatcgtagttgactctgtgattgccgagattttttatttttgttaagctacttttcagcccaattgctgctcttcaaagccttcctgttctgtgttcccctccgccagtctctctgagagcacggttcatcattgtgtcctttccagcacccttcttgttcccttcatctctctcccatgcctccgtgatagtgaacaggatctctggaaacacatcattttttcttccttggtgatcagcaccagagtgaactccctgctctaataccatcttgattcctccttctggaaataaccttggaattcatttgacattaatgtgtcatgctcctccatcttctttgattctattgccaatggcatcatctcctcccctcttggccctgaagctgcccataggcttgtctctgcctgagatcagtcgtaacgtacctcttctgtctcacggtagcagaggcatgctcatggcttgaaaagtcaccacactcctctggttcaggtaaataaacaaatcgccaccacagcattccgaatgagaattaccttatcacccttccacctgatactttcatcttctttttctgagaaatcacttttctacaaaagagactgtcaaactcttgatcttctccagtgagtctattccctgaccatttagagcactccagaaacgggcaactgaggctctagtgttacttgaccatggttattgtttttatccagattgacagatcctttttatagactccggctgaatttcattggaaaagagcttaaaatgcacaggaggaggaaagtacttctctcccaggatccccactgagctgataccagtctatgggaagtcatctatttaaacagaaataaacatgccttgggatgccagcagcctattttcagctttattaagctattttcagctttattaagaaatctgtgtttaatttttccaaacatcttcagttttgttcatttagcttttctctatgtgtggatcaattagaacccttgatgagaatgcagacttggcattctgctccttatagaacata

SEQ ID NO: 28356 - DNA, 855 bp, Bovine  19866880860745
atagtttacaaagtttctactgtaaatgaaaacaattcaacaaagtattataatcatttacatagcttccctttactatggagaaaacagtaacatctgctacttgcgttctttttgaagacagccaatctgacaggtgtgaggtagtatctcattgtatggttttggtttgcatttccctgatgattagcaatgttgagtatcttcatgttacattgatcaatttcattcaagtgaaataaaaatatacatcatgttctcaattttgcttcttgatctacaaaaactaaaatttactaaccagccctttacaagaaaagtttgccagctcctcttctagattatcatgggttccaaattttgcagagaaaattgaagtactcagttttctaattacaattctattcacagtttgaaagaaatagacttataaatcttctacaggaccgggggtgtttagaaggtggattaaaccactgtctgcttgtaatcacccacaattaaatatcttctgcctcacaaatgcccattttacataataatgttttgaggacagagctcaatgcggctgctagataatgtacagctaaaaagacaaaaatgatattctgtgaaaaaaaagaatgagaacaaaaagggcaccatcaactccaggatatgaagaaccacagtcacctgaagctgagtggcatgtttcttggtccaaaaatttggtagcaagctaaaatatatttaacagtatttgagatcaagctgctccagacaatatgaaataatagcttctacatgccacaagctgggaaagcaaataattgcctgcgtttcacatttccactatacttctgatgtgaaaag

SEQ ID NO: 28357 - DNA, 1186 bp, Bovine  19866880917814
aatgtggttttgtttttcctagtcttctaagtccaagaagcccaccttggtctcagtctgggtgagcacccctcttctgtgctccaaagaaaccctttaaacactactgcagtctttataatctcctgctgcagttgcctgttgactcatctcttgatgtggaggtcattgctgtgcatctctgtttaatcagcatttagcacagagctaagcatgttatacggctcaagagcttcttgatgaataaacacatgaagatgccttcctattggaacatgcacttgtttgtctagaagattttacaaggaagtgaaagtccgacctaggacacagcttctagagccttaccccaagcttgaggaaatcattgctcccacaggtagatgtgcaaactgactttaatgttgagtctgattgctaatggatgactgactttcaaagaaaatctttgcagtaaaattcatttcactgtagaagttcctgcagcataggtgaattcttaaggcacttcagaatgtcacggtactccaaactcatttattatgagcatgcttgcattgaggtgcatgtgcagaggagctgcttctagaaatttctgtttgaggggatgctggatcgattgtataagaaagatacagttgggagcagaaggccagtgaagttttgatatagacagaaaggttagtatgacccttcatattaaagatctaaatgaagtcctgaattaataaataatagacatatctcacatgcacaaagatgctttcagagactcgaaggcaacatgagagggaaggagagggagaataaaagagttgttttaataacatatcactgaagataataaaaattagtcaactgctaggctgtgaatcagagaagtgatattcaaagattttgaaggaaaatagcaaggggactaggaaagcctttggcaaaagtacttagagtactctagacagagttttgaaatgtggttaacagaatgaggaggaattcaggaagatctcagtcttagaagtctgccttcagatgtgcagacaaaatgctggcaagaatggtgcgaggcaagattgaatgattttgtgggatggtttgacccatttagacccaaggctatttgtaaaaacacattcatattgataaattgataagggttgtgagtatatttctgagttatttgaag

SEQ ID NO: 28358 - DNA, 1817 bp, Bovine  19866881016828
tagtcttttttgtatgaattgttttgttcagcatagtttctttgagatttatccatattatgcatgtatcaatagttctttcttttttacaactaagtagtattccatcacgaagctaaactatgatttatccattcaccagttgattggaaatgtttccactttggggctattgcagataaaactactatggatgttttcatacagctttgatttctcttgggtaaattcctagaagcagactggctgggtcatatggtaagtgtgttgaactttttaagacgctgccaaaccattttccacagaggttaaaccattttacattctcaccatcagtgtatgagaattctggttgcttaccgtgttcatcaacacctggcaaattcagtcttttttcactttaactattctagaagtgtgtatcagtgtctacttgcggggcttattttgtattttcctaatgactaaagaccggagaaggcaatggcaccccactccaatactcttgcctggagaatcccatggacggaggagcctggtgggctgcagcccatggggtcgctgggagtcggactcgactgagggacttcactttcacttttcactttcatgcattggagaaggaaatggcaacccactccagtgttcttgcctggagaatcccagggatgggggagcctgttgggctgccgtttatggggtcgcacagagtcggacacgacttagcagcgacttaggagcagcagcagcagcagggtgggaaaattcctcatgaaaagtgtgctggatgggaaaatgcaggcagctttactggaaagtgagcaggatataagagaaatccagaagattaatagtgagaagagatgtctagagtgactgactgctttagcatctccgtatctgccctatctttgaaactaatcagaattccttgagcttctggtaaatgagattttgaggtaagaagaattctgtttgaaataaaagtgaggtggtttgaattgaaacttaatcacattcaggaaagtcaagtatcccttctgggagagatcaagcagattatgaaatgattttagagaattggtaacaagaatgttctttctaactttcaaatctatatttggccaagtaaaacacatggaaggaaaaattgttttggtcccttgggtaaaagacctaaggaatatttctttttcactcctactgaaatcactcattcagtttttagagctcacttcacccactaaaatggtatcggtgattgtggagaaatttcttcatgacagagtggaatctcttctattattctagtcatagtaattccaccattatttaacactgtatgagaaatatcacaggtcatgttacaacataaaactttgaaaggcataaaatattaagagcataaatctagtttttgacatgggtagaaattacactggcctctctgaaaacaacacctgaatcaaagtctcaaagatgagaacctgaaaaaataataataaaaaaagaaacagcaatcctcaaaatcaaccaactatgagaatatattgattagaggagtaaagataacactagctgagatgacttctagtctagagagaccaggtcaattctcacagaccttaagtatcttttcagcaccctcttcaattctaggagaatattgttgcaagttttggcagaagcagttttcactcgcatgtacctgatgatgaaaatgtcttcagcaggtaaatgaagttttgccccagtgcttgtcatcaaagcatcagtaattaacaagccataccctttgaccttgcttttcacctgta

SEQ ID NO: 28359 - DNA, 2262 bp, Bovine  19866881108254
actgagacgactgaactgaactgaatggagaagaaaatggcaacccattccagtattttgcctggagaatcccatgaacagaggagcctggcacaggctacatgtagtccatggggtcacaaagaatcaagcatgacttagtgactaaacaatacttaaataaaagggttaaggttattgttgaaataaattgtattacacaggactcatggatccctgaaggcatccgtgttgttctaatatccatggaccctttttcagggcactgggtcatactgcttctgaatccgcagggaagacagtttctgggaggaaataaaaaggggctgtgaatattcacagatattattgagccttgaaatactgtggtgcagtattcattaagagactcaacaatgttgctcttcccaatggtctgtactggcaaggcttagcctcaacacagaggactcagcagtctcagcaccaggggcctgaaatggaaacccactctggggacagcagtttcctcactgtagctgcctgtctttccctctcttcctggtgagagccagtcctttcccaggttggcctggggacttgcaggtgataatgcttgagaacatctgacgagaggtgaatgggtggtcaggggaattgttgctgacacaaatccccagcccttgtgttcttagcaccactggaaactgaattttactacatttggttttttctctgttgccatagctgaatacacagatcatgctttggtgaggttttatttcattgtaatgcctacttttccatttttggtacataaatcttttggtaaatcaaggacccagaataattagtaattatggagcagtgcattgaagtagcatttggaattgttacaagcacactgagaattgcttatggtgctactaacaatgcccaaagatgaaaataggaaacggctatgacaaaattatcttttcagagtaggtaaagatgagtgaaagaaaatatggtagctgtatttggggtaaaaggggcatgtgggcaaggagagtacttctgttcattcagtaacttcaaaaatacttaccgtgaatctacaatggccaagcacctatactcattgcaagcaatacagcaattaagaggttgctgctgctgctgctgctaagccgcttcagtcatgtctgactctgtgcgaccccatagacggcagcccaccaggctcccccgtccctgggattctccaggcaagtgcactgtagtgggttgccatttccttctccaatgcatgaaagtgaaaagtgaaagtgaagtcgctcagtcatgtccgactcttagcgaccccatggactatagcccaccaggctcctccatccatgggatttcccagacaagagtactgtagtggggtgtcattgccttctccaattaagaggttgacagggtctaattctgaagtaatgaaagttatattctggatactaaagagatattaaatgagaaaatggaatggccaaaagttttaataaattctagaaattgagaccttaagtttgggaaaatatagtgtgttctagcaaatgtggtttttgcttagagaaatagtgagaaagaggcacaccatgacgtttatgaggctggcagagttcacaagttgaagagcctgagggctgtattaaggaattttaagttttttctaagtgtaagcattcattactaaagatactaagcaaggacagaatgtgtgatatagattttcatatgctccaatgactgattgatgaagaatgtgatggacaaggtcacatggaaaccaggtctccagagaggccttctcaggggaacaaggatggtaaatagatgaagaagaagatgaagtgaagatggaggaaagtggatggacttgacatggaattactgaaatatatttaaatggacaatactcaagaatagattgaatagagtgaagtgaaagagaaggggtcagggagaaccagaaagttcctgaatttaataattgtgtggatggtgatgtcactttgtgagagggaaattcaagaattccatttgggacatgttctatttgagatcaattcagtcactcagtcatgttcatctctatgtgaccccatttgactgcagcatgccaggcttccctgtccatcaccaactcctggagcttgctcaaactcatgtccatcgagttggtaatgccatccaaccatttcatcctctatcatccccttctcctcctgccttcaatctttcccagcatcaggg

SEQ ID NO: 28360 - DNA, 2163 bp, Bovine  19866881174367
taagtaatagtcactgtggttaaattgaagagagctgcccagagccaagaaaaaaatggctggatggtaccaaagttcttaagatctctgatttggagagccacaaagtttacaaaatcatatgttgttctctttgaaggcagttgcatgtgttggtgtgggaaattaagggaaagttgaactaattgcaggttatagtctactagggagattcaatgaaagaagaggatttgaggatgttgacaataggttagggtgaatgtggaatctaagcttaatagtgaatacaagatttttagaagaaggtgaacaaagaggttacaagagaagggtggtaggagggaatgcagtatttgaagggggccagggagaccgagaaaagggcagaagtggaaggttgatgcaatttgttggcatcaagaaggctgaggacttcgaagttttatggttaagtggttagaagagttgcccaaaattatgtgaaaaaagtgaatccttacatcatctctgtgatggtagaaatcagcagtggagaaagagagggaggcatgttctgaagtgcttagcagatgaaatggaatgaccagaagatgctggaaatgtgggatagagcagaggtgggaaagtggaatgatatgaggctcagaggatgaaaggaatgtgctgagggtcagtgaaataaagacgcagagtcaacagagaatgctatgagagtgaccctggcctttacagcattggggtacagggagaggggttttcttggagagaaagctatagtcatacttaggacattggctgatgcacaaggaatgctgaatgtcaactcattctcactttgttgacagaagactgaatgtaaaatgtatgggtttatatcaggaggtggagggattctgggaagggctgaggatgtcatggaatgggggctaattaccacagaaaagggctttccaggaccacattggaaagcatttgtaaagaagaccacaagtgaatgaagggacatgatgggagaagtacaagctaatgtgtgcacatgagtcatataggggttttttcattgaagaggctggtgttctagctcaggctgaggccggcaggcatggagtggctgccattgactgtgctgaggtctctaagactgggacgatggaagcctgggtagactgaggagctaacagtgataaaaaccagtagtctttgctccatactcgaatagcaagatgtggccaagctttcatattttttaaagataattctgttttggctgttggaaatgatttgcttctctttaaactgctctattcctagaggaatcattcattggtttgaggtagctatggaatattttatttatttatttttttcctcaaagaattaggtattatggagcagcttggatgaaactacccttaatagagctctttttacatggctggggataaacttggctattttctccagggcgtgatatagaggtagaccttggttgctaaaagcctaccgcctcaagttctgctactagcccgagttctgtttttctgctcacaccatttggtgagagcctctcttctatagcttacgtgtctgcaggatgcatataaaaagatgatatatgtgttagtcttgaggcaaatggatgaactagatgaatcatttggggagggtaacacccacagccccctcacattgtcactgaagtaatataattttctaaaggaagaattatcgacatctagtgagatgtgaaatcaatatgtgtattatttactgaacacatgctgggcattttttaccagactcattggtaaacatgctcagacataaattttccaaattcttggatggatttgtgctttaattaacattcttagctggaaactagaggcagatgggaagcgttaataattccataattgataacaatcacttctgaaacatagaaacagctcacagctcactaattatttcggagaacaaaatacttcaaattgttggggagaagtgctcagtggcgtgggaagtgggaatagtccggtgaatgaagactagatcagaagcagaaggtctggctttgaattcagtgccgcatcccatctatcttttcttaagctgtattttcctcatctgtcaagtcagaataattcttgtcttcacatgtag

SEQ ID NO: 28361 - DNA, 906 bp, Bovine  19866881186388
ttctctgaacttaattgtgttccctgcacaaattactcatatgttcatataccaacctccactgtgacagcatttggagatggagcccttgcagagaaagtatgtttagatgaggtcatgaaagtggtgccctcctgatgagattagtatccctttaagaaaagatatgaaaaagcagggatggcatcaccaactcaacggacatgaacttgggtaaactccaggagatggtgagggacagggaagcctggcatgcagcagtccatggggtcacagagagttgtacacgacttggcgactgaacaacaacatgaaaaagcatgcccttctgctccagcagatgatgccacagggagaaagcagccatccgcaagtcagaaagagccctcggcagaacccaaccctgatctcagacttccagcctccggaactgtgaataaatttccattgtttaagccatccagtcaatgacattttgttatgacagcccccatggactgataatttaataaccctttaaatatctctgttgcctggtgagatgaatttttacatcatcttctaagatatgtgtcaaacaaacatgcttcctgccagatcaaatatttgcatgttaaaaattcaaatacccttttggtcatcccatgcacggtaatgaactcttctcatacaaggttaaatacatcataagctagaagttagatcattgcattttctgacattttaaaggtgttttccatatatacctatgtcagatatttgcaaattcatgctaagatgttttttttcccctgctgggttcaatttcagaattaaatactgtcataaagtaacacatctctttgtgccacggggaatcacagcataccaatttttagctgacatcagaaaaacactgtaagatac

SEQ ID NO: 28362 - DNA, 1207 bp, Bovine  19866881264895
tagaattaatgagcctcttaagtagcaaaaatagagacatttgctgattcccagatgagagttcttcctgctattcaatgctattccaaacgttaaaaacagatactaaggttttcagagtaaaaccaactacaaagtagaaaaccaacacaattttctagataactcccttccttgcttcattaaaacaaattatccctgaacatcttttatgcctcaattttctagataaatcagttgcctctgactcactggtcctaatgaggatgtggattcccaaatgtgcttacatggggagaccacacttccaagggcctgaaattcctgcctaataaactcccacacttccaaatgcagctgctgccagcttggcaagatggctcactccagagtgacagttgtgctaaatacactgctgtcaaacctgccatctgctccttggcccaggctaggacataaagacaagacctcccttctaattttgcaccttgccaccctcacgatgctatgatcacacctgctgacctgtctgaagacacccacctgatttctcttgtcctctaattgacactcaccccagagcttcgatctgaacacaggagtgtcttacagttcacattcaaaccacacacaggaacacattcacccctcagacctacagatctagtgtaaacactaagtgtccactgaacttcgtgtcttcacgtacacatgtgtgtgcctgctaagtcatgtatgactctttgccactccacggactgtagcctgccaggctccaaagtccgtgggattttccaggcaagaatactggagtgggttgccatttccttttccaggggatcttcctgacccagggatcaagcccaagtctcctgcctggcaggcatttctttaccattgagccaccatcctcacatatagaggctgcaaaagccatcaacacgatggctggtgtgcctcagccattcacaaccttggcaccgaaacaagatgtgtacctgattatgacatcaaaaagtacctatagaattatcttaggacagttcagcatcaccactgaggccatgagaatttcccctgctttctcatctttgcccacttctctgacagtcaccctccttcccctgctgtatccctaacaccagtcctcactatccaacctcttgacctaccgccaaaaggcttattttttatgtctgaggaaatt

SEQ ID NO: 28363 - DNA, 2405 bp, Bovine  19866881279457
tcaatggattgtatgtaaaagtgaaataggtattattatatttatttgttttttgtatactgaaaccttttacatgtgtcaccaaatgatatgtattccctgtgtaacaaagaattgtttcaataaccctgctgtttactatcagagaaggcaatggcaactcactccaatactcttgcctggcaaatcccatggatggaggagcctggtaggctgcagtctatggagtcgctaggagtcggacacgactgagtgacttcactttcactttcatgcactggagaaggaaatggcatcccactccattgttcttgcctggagaatcccagggacgggggagcctggtgggctatcgtctctggggtcgcacagagtcggacatgattgaagcgacttgggcagcagcagcagctatttactatgaatttccttattgctgttttatctaagagaaatctctctctctctctctctctcttttttttttgtgtgacagcattctgcgaagaaggctgcagatacggtggaacatgcatggctcccaacaaatgtatctgtccttctgggttcacaggaagccactgcgagaaaggtaaggaagctctttctctaggactgtagtactgtggattgacctgatacattgcattgtgttggtggatgtggctctcccaaagctgagtaccttttgattactgtgtcatagacatcctccctctgaaaacagaacttaatctgccctctctccactgtgtctaatttagcaaagtcgaatcttttccctgctaccatttgcagtgtgcattttagcactaattagatataaagcctggagaaggaaatggcaacccactttcagtgttctcacctggagaatcccagggacaggggaacctggtgggctgccatctctgggggctgcacagagtcagacacgactgaaatgacttagcagcagcagcagcagcaaagcctttatagaaggtggttttgttgttgtttagttgctaagtcatgtctgactcttttgcgacctcatggcctgccaggatcctctgtccatgggatttcccaagcatgaatactagagtgggttgccatttccgtctccagggtatcctcctgacccagggatcagacccacgtctcctgcattgcaggcaagctctttaccactaacctgccagggaagcccatagaaggtggtggtggttgttgctcaatctctaagtcgtgtccaaccctccctctgtcctttggtatctcctggagtttgctcaaactcatgtccagaaaggtggttggggagttctatgtgcaaaggcttcctggtgaatctgagaccgggggccccacgggggccaccccagaggccaagagaagaactgcaggctactaaacaaaattcaaccaggaataaacttgtaacagctaaagaatgattacttcagtgcattgccttgctacaaaccaattttccttgtcaccatttcaaaagatctcctcaactttaaatctcagcaggaacccaggaattgctgcttttttgaagtctgcagaagatttgacatcctggcctggcaaaggtttatggaatatctcatctcctgtaataaaaattcccctgtatgttgacccgaaattctacctgtactaaccctggtgtaaacaataagattcttcacctggagtagaatctcctcatggggctgccctacagctgcaaacagatcctggagggcatttgtctggcagaatgattgtgtctgtacaaaccaattgctcaatgcctgttctccagcagagctcaggaaaagaatcaataaaaaaaaattcccatccagtacattcccaatctgattaattcaaatcaattcaacttgaaaaatgggaatggcgacacaattaataaaccgtgactgggtgagggacagctttgatcctggcctctctgaaagtctccaggcaaatcaatgaccttcctggggtcctggttcccttactgtgatgtggggccagggtatccaggaatgaaatctgaatgcaatctgacagcagaacatttaagaagacagactttctgataagaagctaataacagaagcagaaatttttcctgcttcggaaaaattttttaaaagatacaaaaatttcagaacaaagcaggcagacagtgaccaggtgacacactactgctctcatcacctggcctttcaggagccaactggacatattaacaaagacatattaacatattaaacaaaggaggggaagggtttgtgggctctggagtcaagaaccatctgggtttaaaacccagctatcccatttcctggcttccctgatggcataatggtaaagaatatgtctgccagtttaggagacgtggggttcgatccctgggt

SEQ ID NO: 28364 - DNA, 1739 bp, Bovine  19866881320682
tttcctgcagaggtgggttgtggggatgaggaatagagtaccaatggttattgactgctttctctgttgtagaccttgtctggccatacctgtatgacctcagttagttacatttcaccttcagagaatgctaattaaatagtaatgtaatcatccctctgtagcctgtttctaagaccctctgtggatataccaaactccacggatgctcaactcccttatataaaatgacagagtgtagttggcccttcatatatcccatggatcaggcatctgcaggtacaaagggttgactgtgttacccctagtgtataaatgaggcaaggatactcagaaagaccaagcaacatgtgtgtcacatagtttacaagtgagtgaaatgagatcaaaacttagaacttttttttgtttcctcaagattttcgctcattcatgcaacagatgtttttaggggcttgcttactatgtcactgtgttagatggtggagtatttcacttaagtataccatgtcccatggagaagacaaacttatcctcttccttagctccaacccagaataggcggtcccagtgataagcaccaaaaggaggtggcagttccacacacctcatcttcctagggagcattgtgattctccttattccctagaatgagtagctccatccagtagctctttagaaggaaacctttgaaaactcatctcccccgtagtgtcctgtacaccagagtgtgttaagcccaccctttggtgaggtgagatggctaggacaggggatataagccaatgtctcattacagaaattatcctgatagtttcagtgtcaaaaaatcttcctataaaagaggcattcatttctcaggtgacttctcaggcttttaatatatatcgtgtagaaactgcctcctggatccaagaatcacacctgtgttttggttccagaactaaaattcttatggtgttttcaggctaaaactgtggtgttctttattttaaatatgaatggtcacttcataggcaaagtaaaaggtaaaactgtcaagcttttttctggttcctggtgcatccttaggaatagtgcaataaactgttgctgatgaaacagcagaggatggaatcatttgcttggtgttttgcacataaacctctagtgttagtcactgcctgtcagagacacagaacacaagctgcagaattcttcacttcaaaacagcatccatttgagaaagcagttggccagtagtgataggcttatctgaatctactgattgtcgtagattttcattatcaaggtggttgcctaccgctcaatttccctttgatgcgtactaagctgattatgctgtcactatttcagagggtaaagaaaaaaacaagcttaggtgaatcacagtgcttcagaggtttggttgttctgacagtttcgaaatagctgaactctcagggagaattctgatcccaaagccattcacagttagaactattctctcagactgtgtctctgtgtctggtgaatttaggtctgaaacctttcccttacctggacttcactgtctccttaacagctgagctgtcacggggaagtgaaattgattattatttttttttctgccacagctgttgttttctacctcagctggttcccataattccacagatggtaagcatatgtttataggcacatagaaaaagaagctatactgaattcctcccatctctaattcttattttttcctttca

SEQ ID NO: 28365 - DNA, 1409 bp, Bovine  19866881382047
caaacaggcgcagacaccacataagctcagggatgcgcctcggagggcttgctgtttcttttctcttttcaaagtatggatgattaaaaatgtgtgaaaggacagatcagggaagcagctcacatgtagtttcaggtaacaggagccagggtgcagaagaggcctcttaaagaatcccagtgtgtgttagtcgctcagttgtgtctgactcttcgcaaccccgtggactgtagcccaccaggctccactgtccatgggattctctaggcaagaattctggagtgggttgccattgccttctccaggggaagaatccctacagtctggcaaagccatacctttacaaggggggaaaggtgcaacaaagtaccttccctaacacctcctctgacacctcccctaagtgatccactagagaccactaatccgctaacttactctagaaattgtcccaggtagtcttgacactgggagaaccacacacctgctgagctaggtacacagtgattgggtcaggctgtgtcctgatcttgcctcctacttgtgctgtaatcccagtctcccttcaagctcaagaagaaaagatgctgaagatgggtaatttcttgattacttctgtctaaatctttgacaaatctacttatggaaatcaagcagcacttggggtggcatttcagcttgtaacatatctaattttgagattttcattggttccaggagctcaatagtgatttttcaattacgtttaaaggtttaatacaatagatctctttttttacctttcatatagcaaatgccaaataaataatatttcaaaggaaaggaaaaaaagcaatctattgcatgactaatgtacctagtttcattcattgacctcttactgtgaaaaaggcctctgctgcctgtctttgaatgtgtagaattaagaataaatgattcgctccatgtttgcttagataaatgcttgaacaaaggtaaaacagaaagagatgcagatttgataccgtatctattttggatctgcaggcattccttgagaaaatggcaggtagtgtagaaatagcttttgaaaatgaatttgtagaaattcagcacgctaatgccagtgacagaaaatgtaattcatttttttttttattcagagttattttttcttttattgttgcttcaggatttagcaggggggaaaaggaaggcaagattacatattaagtgcctttgaaaaattagctttttgctttactgtgttcctttgtttttgaaagtctatctgatgcattcttattattacagagattagggcttttcattgttttcagagaaggctaagtatattaaaaatgaaaaaaagctcagaagggaaacaaaaccggccttcggaatagcttccattgtattagaggctcttc

SEQ ID NO: 28366 - DNA, 1287 bp, Bovine  19866881384478
ttaaggcaagaattacaaaggcaccctgcaagtttcttcaattatgcacaaaaattggagtcagatggtaaaagatgctgtgtaagtagaagaaagtaaacaggccttgtgatcaaaagacataagttccaattcctgcccccatttactcatctttctgagcttctgcctctacagccaagaatatgaaataagaatccctgcatggcgctgatatgaggattgaatgagataatggatgtgagtgcacctgtaaactacaaagcccttgacaaatacgaggtattattatgacggtattatcacaataaaagttaaatgcgcttgggagaaggcaccctagcttccaattattctgtcaaaatatttattggatacctacatgccagcctgctgctctgagccctggagaacaaatgagtgctctgctctcacaaagatttcatggagccagcattctcatgaaagagagatagtaacaagttattcgtggattcaggatgcttttcacaagagaaaaatcctcattgaggatgcagctaagtaggtcctggatccagcactaggcagggaaacaattcaccctacccagtgatgtcacaatatttattacgtcaaagttgcatgcatgcatgctcagttgctaagtcacgttaggctctttgtaaccccatggactgtagcctaccaagctcctctgttcatggaattttgctggcaagaatactgaagtgggttgccatttccagaggatctttctctggaaagatccattctccagaggatcttcctgacccagggctcaacctgcatctcctgcattgcaggtggattctttaccactgagccacctgggaagtccatatcaaagttggaatcaaggaaaaaatggaggtgaagagggctggaggatcaattactgggtatcaaaaaacagaaagagaagccagtgtcacagtcatgaaacagaattcaaaattaaggactaaattgggcaggtaaagtactagtatatgaggactcagaggaactgaggcaaagtctgagacattatttgcagggtctaactgaggatgaggttccctggtggctctgccgtaaagaatccaattgcaatgtaggagacatgggttcaacccctgggttgggaagatcccctggagaagaaaatggcaacttgctccagtattcttgcctgggaaatcccatgggcagaggagcctggtgggctatagttcatggagcacaagagttggagacgatatagggacggacaacaacaacaac

SEQ ID NO: 28367 - DNA, 1959 bp, Bovine  19866881408542
tgaaagtgaagtcgctcagttgtatctgaccctcagcgaccccatggactgcagcccaccaggctcctccatccatgggattttccatgcaggagtactggagtggggtgccattgccttctgcctgccttccctattagcctgttaaactcacctttccaaaggcaatctctctagtgcattgatatagcattgtactggcttgtgtttcctacttttctgagcttcttgggaacagataagctgaagacatgtgctttgtatgattacacagggggaaagtgtgttcttctgcgttgtgagtgaagtcctgatgaatggaatgtatgtgagttccttttcacccagtcattcattttatggctggagtagctgaatcaaagctactgcttttgtactccatggtgataacagccacttcttccttgttttaacactgacctcagcaattcattctgtagtcttttagcaactgcaacaaggaaatagttatataatcttggtgtgaaggactcatggcaaacataatcaagatgacagtctgataggggattcagcagttattcccatactatttccatgtcttactctagacatgcacagagactttgtgttgcttagagtatttatgttctatggaatctactggagttggacagtgccttggaggtcattttgttacatagtatgactatctgacctgcttttctgttttattacagcaaaatgtatctatggaggaaaagtccttgcagaaggccagcggattttaagcaagagttgtcaggaatgcagagtaagtttcaatcttacggttcccattacttgttgggaaggagatgtgggctttaggtagggttctgaagtggagcatattggcccaaggtggggaaagactctcattgggctgaagtccaggatggggagttctcagccacggtcactgtgtgattagcttgtggtcagctgtggatcacgtagtcttgggaaagacggtcagggaaggaagtgagaaggggaagggagctagcagctaccgtgagtcagggagcttgtcagctgaccctggggaaaggttttgattaggtattggggcaattagtctgtgatttgagctgtggatagtgccacctctagttctcaatgtctgagacagtgttagaaaatgcctgtctcctgcctgccccgtctcatgtattcctccaggttagatttgtgggaccatagatctcattcagtaaatcattcagcaaacatgcattgagcaagtgctacttattggcatgctgttagattctgggtgaacaacagtgaacagaacaaagccctgtctttagagaatttgcagtctggtggggagataggcagtaaggtacaaacaaatagatatacaagacagctgagccttgaacaacacatgtttgagctgtgcaggtccacttacacgtggattttttttccaatagtaactactgtgatgctgcactctctgtgcttgattgaattcctggatgcagaaccatcgatacacagatacagagagctgactataaattatgtgccaattttagatggtgtgaagggccggtgtccctaacccctgcattgctcaagggtcaactctgatgtcattctataaagatacagagcaggttaaagggagagagagctttgaggtgggcgtgagtgatctgggaagacctctctgaggaggtcctgattgagcacagtgctggatgagggtgggagctagccaggcagttacgtgggtgagatgttgtcctggatcgtgggagtgagagacagagggaaagatgggagagaggggagcagatacaaggtggtgccttctagagcagccacagccccacagcgaggcatggctggttctgtgggcatcttcagggaggctggctggaactacatgtctcagaacagacccgctttccaagcatttca

SEQ ID NO: 28368 - DNA, 1354 bp, Bovine  19866881463319
tgctttctaagaatcctgaatggtgatgtgtaatggtatcctcatctgtaaatgggaaaactgagaggagagaggcagataacttgctccagtgaaacttaattgggaagcagggatgaagaattccaggttctgtgattccaacacagcatcaggtacctgagaagtgatgtccatgtcactcagtgggagaaaactagtttggggatttaaaagtcgaggcgaggagagaaggtagaaatacaagaagaaggaaggatgaaagaataaaaagaatacaggaatgaaaaagaattaccttagcagtcagaccctgctgaaaacactgctctccccatccccactcttcgatacctaacccagacagacacctagattatcagatgagaggcttttggaaatgggcccacagatacccatttcacacctgccagtttctagctgtataattttgggctagtcatgaaatatctatcaaatttatcttcctcatgacaaaatggaaagaaaaatagcaacctctttacatggttgttacgaggaataaaagtcaaatacttagtttcaggtactcaaaatattttaattattgacattattattattagttacatacttaaaaagacagtggggaaatccatttgaggacatatacatttgatgtggggaaccaaggggtaaatgacaccccctgactcacagggctatctggccacaattgtgtttcattaaaaatgtactatttttcattccaggcttgaaggtctcaaccaatgaatccagagttagagttattaataatcatgttgcaaaatgcaaaggaattctaaagagtgctgcttattggaggatttaaaacatatatttgacctttccttggctgccttcaaagtcaaaacccaaggttctcttaagtgagcttgtctgattaatagctgctttcatgttcatacatgcctgccgggtctccagcctccaccaccgcctggttatctgtctttctagatgtttagctatatctcatctacaacatgagctgccctcattcttgagccaatgttatttttgaaatatttaggctcaaatccctcagaatgtatttctaatttataggcagaatggtacaggggaaaagaacacagtccctagaccagagaaacctggattaaatcactagctgtgtgaccttcagccaaattactcaccttgtctgagcctctgtgtgcccacttgtgaaatgaagacataaatacctcttcttcaggtctgtgtcagataactgacaggatatacaccaaagtaagggcacagagcctgatacattgccttcctctccagatttgtcccttgccac

SEQ ID NO: 28369 - DNA, 1235 bp, Bovine  19866881479059
tatttcctcattatattttaaatttatggagagaaagatcttatcagtcttattccatgctgcatccttagcttgtagaaaaatgtctaagaacataattggtgtttaataagtgtttataaagtaataagtgaatgagctcctaaagccataaaaatctctggactggaaggaaattaaaaagttatttctgacaaaagaccatccaatctctgccttaacaaccctggtgccatggaatttactaactcctcaggtatttcattccaactttggatgtctctgggcttccgtggtggctcagacagtaaagaatcctcctgcactttgggagacctgggttcgatccctgggtcaggaagatcccttggagaagagcatgaccacccactccagtgttcttgcctggagaatcgcatggacagaggagtctggtgggctacagttcatggggtcacaaagagtcagacgtgactgagtgactaacacacacagttgaatgtctctgacccattacaatgctccttctttagatgctgacttaacatgtatcatctgagctaggtatgctgaggctagttctattcctttgagttaggtggtatatgataaattcttgcaaggtgttgaatatagctgccacctcctcctctctcccctgtcttattttctttagatttccctaatgttttcatctaggtctcatctaacaggatttctttaccatcctggtgacccctccattagcatgctctagtttttctcctttcacctctgcccattggtacccacagtatttttcattgtccatcgagaggaacatttccctgccttgttttagatgctgtaactctcttaagtcgacctaaggtctccgagctactgattccagttaaacctgtgggcaattcaagctcctaagtgtttttcaagtgctgctgtcaaacctgcggccatgaacttgtaaaatcaggcatgtttttcaatgattcaatgacttccttttttttttatttgaaacagaagattgttttctgaggaacatttttctgggtcaggtgactgttcaggcctttgcattggcttaactcttaagtccaaaaaaaaaaaaaaaaacaacaacaacaaccaaaaaacctcttaagtcgtgctgaaagacttcattggtgccttcttcctatatacttgtcaaaacctatgagttaattctgtattggtgatgcagtatatctgct

SEQ ID NO: 28370 - DNA, 678 bp, Bovine  19866881753373
ccctgcgtaatcttaagggaaatagtcctgaatattcttggaaggactgatgctgaagctgaagctccagtactttggccacctgatgcaaagaactgactcattgtaaaagaccctgatgctggaaaagaatgaaggcaggagaaggggacgacagggggtgagatggttggatggcatcactgctcgatggatgtgagtttgagcaagctctgggagttggtgatagacaggaaagccaggcatgctgcagtccatggggtcacaaagagtcagacatgactgagcgactgaactgattcaagcaagggtgcctagacaatattaaaagtgaaatgccactgtgagttaatgagatatcggaaagcttttaacctcaggactgcaaaactgcaccattaatgctgacgctcataaacaccgtctttatcgagaagagaggagattggaaatacacgctactcattcataaagacaagggccaagaggcagcaaaatgccagcgatcaggcagcggtaccccagcgcaatgacgtgggctcgaaataccaccagtgtgatgatccatccatactccttcccgagcaactctttgcaagagttcagttcagtgggaatgtgacctgggacaaaaccacactaaccctggtgcagcagacttcctgctcccaatatcag

SEQ ID NO: 28371 - DNA, 833 bp, Bovine  19866881802777
catatctgccgtgtaaagacacccagtcctctaagagctcaccttgcttccggccctcctttcaggtttgccttggaatatcagcatagttaagaggttaagaacatggctttgaaattagtgtcttggtattaaatcctgcccactcattcactgtgtactcagcaaatttttagcctcagttttatcattcacaaaatgtaaataatattccctacacagtaattttattgtgaagatgaagtaaataaattaatcaagatatatgtgttctataggaaggagattgaatttggtttgaacattgctataaacctgatacccatagcagatactgagcacacacatacatcttaaatgtctgtgtagggtttcttctctgtctgatggctcagtgtatctcacaatgatcaggtactcatcatgctgcccaattggtagaagttcatgagaagcaaaggaaatggggagccatgctcctctcattatcaggggaatagggatatcttctcatatatgcagaagagaatgaatttaaactagccatgaaggtatcctttatgaaggcttagtctattaagttgtttgtcttggtattattaatagaagccatcagtgtctctaatgtagcaggtgaacttctagagagctgatgcagctaatagccagatgtcatacaacagtcaagtcaataaatgtgaaaattattaaacgcaagtgtaatggcctggaatagaaacactgagtgcttgtaaattactccattgttatttgaaggaaagaacaatacaagttgaaatattgaaacttcgtatgtcaccgtgtctcactat

SEQ ID NO: 28372 - DNA, 969 bp, Bovine  19866880126061
agaaactccccaggtcagtaggtgcccaatatgctactggagatcagtggagaaattactccagaaagaatgaagggatggagccaaagcaaaaagaatatccagctgtggatgtgactggtgatagaagcaaggtccgatgctgtaaagagcaatattgcataggaacctggaatgtcaggtccatgaatcaaggcatattggaagtggtcaaacaagagatggcaagagtgaatgtggacattctagtaatcagctaactgaaatggactggaatgggtgaatttaactcagatgaccattatatctactattgcgggcaggaatccctcagaagaaatggagtggccatcatggtcaacaaaagagtccgaaatgcagtacttggatgcaatctcacaaatgacagaatgatcgctgttcattcagggcaaagactaatagagttttgccaagaaaatgcactggtcataacaaacaccctcttccaacaacataagagaagactctatacatggacatcacccgatggtcaacaacgaaaatcagactgattatattctttgcagccaaagatggagaagctctatacagtcagcaaaaacaagaccaggagctgactgcggctcagatcattaactacttattgccaaattcagacttaaattgaagaaagtagggaaaaccactagaccattcaggtcatatcaggcctataaagaaaaactgcctatggaaactaggaagaaatttcttaaaaggcatctaatgtaaggatttttattttccttttctttttactctctggaatgcagttgtgatatcaagagctcagctagccacctgatcatgaggtagaagccgtgtattgaacttgatagagaacttgataaaagaagcctgtgtctctgataaagaaatagccaaaacatctctagaatacgactttatttagaaataaataaatat

SEQ ID NO: 28373 - DNA, 1384 bp, Bovine  19866880392759
acataaaaggaagttacctttaattatgaattatatgctaccaaccacagtattccatctcttcaaaagaaagaaaaacctttctataatactggaaaacctttcttttgtttctagaatgtctgtaatcatatgtctatcctatcgctgtagaaatgacacattactgcctttccattgtgggcacccaaatgctacttgtcctataataaattgaaacatttccattccagggaacataggcttacccaataagaaagcttcccatggtatcatcaactcactggactcaacacttgacatgtgatacgtgtttctttttttaaaatataaatttatttattttaattggaggctaattactttacagtattgtattggttttgccatacatcaacatgagatatgtgtttcttaaacatgattcacaatcttattgtgatgaacatggcatcagtccttccaataatatttagggttgatttcctttaggactgactggttcgatctccttgcagtccaagggattctcaggtggttagatagcatcactgactcaatggacatgaatttgagcaatagcggaggtgatagcggaggacagaggagcctggtgtgctgcagtccatgggctcacagagtgggacactacttagcgaaagaacaacaacttagcattcactaagtccctcattcaggtttgtacgtgtggcctatgtactttgcccagtcattctcaaaacctcagtataacttcagcaacaagatgacagatttgcttgctttagcaattttatgccagatggtgatgactaatgctgaatatggagagaaatattatttcctgagctatccatatttgttttttgtaaataattctttcatccaatcactgcaaatccctttgtggctattaagcacttttgcaatcttccagggactgcttaaggtagaatagagccacagaggcgcggcatagaaatcactcaacaccttagacttgatatgatctggtgcggctacttaacttgcagtctgcattttgagcatcttcactatttacgcgccatgcacacctttggaatttttataaaatacatgggttccttttctgaatagagttctaaaatgcataaaataaatatataggattaaaacaaaaacattaataccaaagttcagttaaaagtgtattagaaactaaaatcctggtatgctttgttaacaacaaattagctaagataatatctaggattgggttctcttgagtacctagatcacaaagtagaaatgagtttaaatgctatatgagtgcaactaccataatgctatataatataacacagaagggtagcaatactaccgtgtatgctgtttaaattta

SEQ ID NO: 28374 - DNA, 953 bp, Bovine  19866880399972
ctgatgtttatagtattttataaaatgttacatatgctaagaaagtagtcaaatcctctctattcacattatccaatttatcagaactttgctgtagttagagaaaatatgctaatttcaaggcttctcagacattcagaaggggatacatcacttgtgaaataggatataagaataaatgtcaagaggaaattacttccatttcaggaaattcttaattatggaaattaagtgaatattatttccaacccttcatagataactttgcaacttcttacatgttttaaatgaaagacaattgttttgaaaaacttaatgaatttacagtgtatacatgttgaatttttttttaatatagcaattatgctttaggctttaaaaattacatgaatttgatatcaaataccagaaataccagaagatatcactgtaaatatgctaataataaaagaatgtaatttagaaaattactataaacttttatttatgaaaatagggtactttattaaggattgacatagtcctagagtaaagtgcctattgatttctcaaagaattttattatttttgtgtaaagagtccaaataccttcaaaatcacctaaatgaaaagtaagattattttatttcaaaacagttgaaaggaggtgattttttaaatcaggtagcaaattttggcactatatactgaagcattttaagccaaactttgcataaattaataaatcactttatagactattctttttttaattctgtctccttgttatttcccacattattcagtgcccagtttcaggatctatatccattgttttaaatattactaaaaatatgtctgaatgcaaaatgctcatatacgtttcagaaacacaaacatatgctatgctatgctaagtcacttcagtcgtgtccgactctgtgcgaccccatagatggcagcccaccaggctc

SEQ ID NO: 28375 - DNA, 1296 bp, Bovine  19866880429602
tgaggccaagttcctcttcctactctcaggtcatctggtgcttccaggcttgtcaccaggagcaactggaaaggccagacccaggactatggcctatcctggtggctgccaactgatgggccttatgtgcttacagcatgcaagcctcacgcgtgagctcagaaaatcctcctccagactgagaattctgaaatttgaacttggaagctctccagtttttctctgtttcatgaggttctgtggtagctgttttttgtgtgcgtagatgatgcactttatactcctatctaaatgggaagtgctcccacttcctccatcatctgaataaatgcattcaatgaggatatctctcgtttataaagctttcccagtggtagctctaatcattagccagattggggaacaacagatctattctaaaacagaggtactcaaaggagctagggttctccgcttcctccaacgttaagttgatataaggacagaaattgagagtacagatttagaaatttaacagcaatttgatgagtacttgtataacttttgaatctaataataggtagcactttatggttctttatttttccattaatctttttaactgcatttgaaaaatgtattgggcaaaagtaaaaatagagcataggctggggtggagaaaggatacacgagcgatattgtcctgagttctaccatattgaatgaatttttataaaaataataaaataatttcaagtgattttgaaactatcaagtcagtatgttaactattttgcacataaaatatgttttagctatatagagagatactagccaattcagtcactgaccaatgaaagctgttatcatttctgtatttagtgaagcagagtcaatcccattcaagaaagtcagtcaaaaaagtcaacatattattttgatgaatttgattatattttgatcaacttatctactatagtggtcaaaagttgcctgtgtagacacagatatcctcccaggaagcagctttcttgggtacaaatactcttgtagttggcctgctaacaaagtgtataaaatttgagcattactccatatatgaatatttatctaagactttggcatcatccaaatgtctgaggctctaattaagaaaaaaatgtaatgtcactcccaaattttgacatgttttaaaaacacagtcaaaactaatatatatcaacaaggtgtgacaaaacagttgctataaatggtgcttctcacaccagctggagaatatttaaataactatattaggacatgaagcttaaagcctat

SEQ ID NO: 28376 - DNA, 1260 bp, Bovine  19866880512516
caaaagcaaaattaatgtttttgttcatcaaaacctggtataaatataattagagagtatttacaatacatgtcggagaaggcaatggcaccccactccagtactcttgcctggaaaatcccatggatggaggagcctggtgggctgtagtccatggggttgctaagagtcagacacaactatgtgacttccctttcacttttcactttcatgcattggagaaggaaatggcaacccactccagtgttcttgcctgaagaatcccagggacagaggagcctggtgggcttccatctatggggtcgcacagagtcggacacgactgaagcgacttagcagcagcagcagcaaactatcttgactttaagtcttttttctggtttctaataaatggcctataattatttgaagaagacaagtgagatattagctcccttcccacttacagtaaggatttcagattcttaggtgtggggtaaggaaatttgaattcagcctgccttaatcctatttctctggttagtgaggaaggctttctcaaaagtacccttagagtggtggttatactgagggtgtatgtgcttccttttgaccttcttaatttaacaatcctgccatccggttatattgactcatattcaaagaaaaaaatttgataagtacaataaatgtaaaggtgaatttttcactttttaaacaaaattgaaggcaactttttcattatcacaatatcaagtggctaatattgaaacattcaattacactgatctaatgactaacattcctgaaatatgattgaaataatctttaagtcccctcacaatattgctatattcatgtacaatattttttgaagaagggtgagcaaagaaggcttggagaagatgctaacagtctccaaaacagtatttgcaaaggccatctaaagacgtgaagactaaagaagttgagatgatagcacatctcaacttggatatattttgtgtcaaagttatgtaaaatcccaatcttcattattactaagcttttcaatttctttactttataatacattttactagagaactaaaaatgctcatatctgcaaagagaatagtatatccagtctatgtaagtggtccatgagtgttgtattttgtactgagaattccagatgttatctttttattcagttctgttaaaataaaaattttttcaaagaagaaaaatttattgtagaaatataattgaggccattatatatttcatgttttctgtaac

SEQ ID NO: 28377 - DNA, 995 bp, Bovine  19866880549668
tatgcatggaaatgaaatggaagatgtatagcttgttccattattaatgtaaggactttcagggaccaaagcgaaagtgaaattcgctcagtcgtgtccgactctttgtgacccatggactactatagtccatggaattccccaggtcaaaatactatagtgggtagctttccccttttccacgggatcttcccaatgcagggatcgaacccaggtctcctgcattgcaggcagattctttaccagctgaaccaaaagggaagggactaaaagcatttgtcttaagtgttttcttgtgaaaagaaacattaccaaaatttaaaaaaatacattgttgtaatattgactatagaaagcatagcaataattaattaaactccaaccacattttctatcagttctgtttttcctttcaatagtaattacaagacatggatggcaaagacagggaaaattcctgaagctgtagcagctgggtctttgttgaatacctgttggcttctaaattgcttctaggtctgtccctgctggtggagtgcctaagtttagttgttcttcagaaaactctgctcaagatgtctacagggaattttttgtaaatttaaagaacagtgtccttctttggaaacatgcaataattttagaatcttgtgatattatattgtaagacataagccaacagtttacacatccctgtccaggaagctgaataataagtaatcctgggaatttaaacttctattttaagcctctgtaaaggtactctcatttcttttgtataaattcaaaaaaatcagagtctgatctttgactcatttcaaaagtatccctatactaggatagaaaaatgaacaagtgcaagtggaaagagccctattcagattgagtgaacttatttccagttttttttgtaattacttttgtggaaggttatggataacatgggacattatttattttccaaatacatttttttgtgtgtgctacttgtcaag

SEQ ID NO: 28378 - DNA, 984 bp, Bovine  19866880572009
ttccccttcagcaggctctgctaaaatgactgaattctgacagtatacttccccaagggaaagctacaagagccccattccttcatttctttttaattcattcattcaacaaatatttaatgagcatatactgctaaggtactgatgtggaaccttgctttcccactaagagctttgtggaggcaagacttcccttgtttgatctcaaagaaataagtctctctggggaaggtgtgctgggtaggaatataaaggcaggctggaaggggggccattctggaggatgctgggctttcagattctcctaactcaccccacatagaaactgatcacaccattttaaactgaggaagactcctgctcacctccctagtagcagtgcctctaattagttcatccagtcaggaataagtttctaccttctccttccataccttcccctccacctaacactgtgatttgggacagtttcattctgacacaaaatttcacactatgaaaaagtcacaagtaaagtagacttccacagaagagaaagcttgattattctgaatgggtctccagactcctcctctggttcctgaactagggggcaattacccaggtaaacacatgctctattggaaatcctaccggtcatttctctcagcagtttctcggaagcacccaggtgctgactagaggaggcatcttttctttatagcaccgaggaagcatttttaaggtcataacattggaacagctgcttcaatacagaaatgtggaaactgagtccccaagaatttaggcctcttggtcactgtcacacttatttgtgacagaatctgaggccagagctctgtttgaaatactgctgcctccttccatccttgaaaaggctgtatctaaaaatccgtaggacgcataaaggtgaacaaagctgactgcctcacattcttaatgtattactcaagtctcaagtcagtattcacgtttcgtcaatca

SEQ ID NO: 28379 - DNA, 2319 bp, Bovine  19866880589559
attttgcaggaagctacctaaggataatttctgtcaaaacaaggaaatgaacaaagatagaactgtgaccaaggaaataggagatctcatatagcagacagatgaaaaaaattcccaagactatggcaaaaaaggaagtatccatatgatagttgtataagaggcctagagaacacaaagactctgttttagtagaaggtcagatgtctcagcaagtcaggtgttcagaagataaaatatgcttgaaaatgagataaaaaaaatcatgatcatatgaaaaaattattgaggcattttatagagcttttctggggtgatattcataggttgaaagtaaaccaaatcaaaagagggcaatttttaactccagtttaaatacaagaaaagcagaggaaggaaatgtaatcagataatcttctagactcagcaatgaacactatttaaaaagttatgatggaaaacctaaatgtttttaaataaaaattgaggcataattatattgataggaaaatagagggtaaaattgagtcaaaatgataaaaccttacaaaagaagctgacagttaaggtttaaactgatacaacagtatattcatattctgttgacctgtggagataattaccaaataaaatagctaaatattaaatgtgtttgctcttgaggtataggacaagtcttaaattgtcaagaaataattttttaaaagaatagtaatttcagggataggtcttttaaccagttttatctaataacacatttatttcaaataaatattaattttaaaagcaatctggctcatatttctgattattaaaaatgtgttccatagttatacacactaacaagtcacttgaggttttctaatatgtttctgttgaaaatataataattgcttttagtatgacaatttttgctatattaactctaatttttttttttttagcttcatgttagtatagttcatttgccttcagctcacatggtaaattaattggaattgtcttaagaatcattttaatactatcattaagattacccttttgagatcaaattatgttaaaaataaaatggtttctgagttctaatttatctctggtttatggccactgggaaacttattcatctaatgatggccatcttgaactgctaggccatgggtggtaaagggcatctaatcaatttttagaatattgttatttctaaagattctagttatgagatgtaaaaaataagttgatgattcattaaaaaactatagcaaaattaagttaaaaatctactctaatgaaaagtcttttaaatgtttgataattcactttgagtccaagtgatataaaaatgtaatgaaagattatcattagaattgagtttgtatttctacattaagaaactaaatattacccagattggaccctgggatttacattcaatttagtacacaaatcctttcttttttggctattcaaactaatccttatattaaatatgtttttacttattaaaaaatctttatatttgtgacaacacatatattgctgtttggttctaaagttatggtcatatgaagatatacataaaggtgcttttagtattgcacttaaatccaacataaatctgtagtttggcaccatggttaaggaatgagggggtttatgtatagcagcgcccatagagataaatgttgaggagaatataaatcatgcaaacttcagagagcgtgggccacctaagagtataataaaaagaggaaaaggtgagcagttcaacatgtagagcaaggggcataaaataggagtggcacacctgaggccactccaaggtaaagaacatttcaaaaatgtatccctgaacatctcattttatgtacacactttatgtacacatatctttctcttttaaaaatgcttcttttaattcagataaattcaaaacattttataaattagaaaaactaacagtttagtagtggacactgagatttgagccatcgaatgattatcattgattttgaaattaatatttgctaagataaatggattgagtttcattttaagactgtccaattagacaattagaagagctaagtgaatatcttaatatttaagatatttatttcaggctcattttacccttgaaaaaagatgagcatctaaaaaataatttggagcagtacagtagctggcagacaaaagaaacttacagaaaatttttaaaaaattttcacatagatgcatcaataatccatacaaataaaggcataaatatatttatctgatagaattaaaatatgattctggttaaatattaaaagaaacatg

SEQ ID NO: 28380 - DNA, 1756 bp, Bovine  19866880609338
tagaacacactctttatttaacagaggcccaacgcttccagatcccaccttgatgaatgcaagtttatacatacatgcataattgtcatttatcaacactaacgctaacagtgaacttcataagtggccattaaaaactctcagtaaggcctgatttttcattacaaaaatactacagaagtaccttcatggatttatgttccagatggtagtaccatctgggagctaagtttcattgtctaatggttttttgctacatttacatatattaggcatcaacacccacttctggttacaatcgttccctttccagagtcagtgcttagtagaaggtgttctgtgtagcttattatgaaaatgatctcaggtgacaagaggaagtaaacagattgaaaatttcatattgctaatgatagaaggcacagccataatgcaacctccattgaccatctcagatcagtagcatttgggccctaacacatttgcatggaatgtgtatcctaagcaggttgggtctgccacccagcttccttgggaatgtagacttgcagatggttctgatgaaacttcattttcttgagaggctgcatttaaaaaatacctgatggcctccaaatgcaccagaagctaaactgctaaattttctagtagattgataaaaatgagaatgaaatggagtgaacattagctaccaccatgggatttattaccccttcctttagggcatgggttctattctggaacaatctttgggagtcaagcaacagatggataggctgatctcttttatttcacatatcatgaccaaggtttgatttactttcagagaaaatataattcttcctcctccattccctgtatctaacctacagtaattcttatcatagcttcacagtctttctttcactaaagagtaggaccacccaaatatgtccacatcttaacacttggcaactcttagtatgttaccttacatggcaaaaaggaatttggagatgtgataaagttaaagaccttgagatgagaagattatcctagattatctacttggacccagtgtaatcacaaagatccttctaagacagaggaacaaaagtcaaagtcataagagatgggatgatggaagcagaggttgaagtgatgcactttaaagacagacaagggatcatgagccaagagatgtaggcctactctggaagctggaaaagacaagggaacaaattgtgccctagagccttcagaagagcacagcacattgattttaaccgcatattgctcatttcagactttaggccttgaaaactgtaagaaagtaaatttgcattgttttaaacactaaattcagagaaggcaatggcagcccactccagtacttttgcctggaaaatcccttggacggaggagcctggtaggctgtagtccatggggtcgctaagagtcggacatgactgagcggcttcactttcacttttcactttcatgcattggagaaggaaatggcaacccactccagtgttcttgccttgagaatccgagggacgtggaagcctggtgggctgccatctatggggtcgcacagaatcggacacaactgaagcgacttagcagtagcagcaaacactaaatttggggtaatttgttacagcagcaataagaaagtaatgcacattaccttttgtgtctgtgagttcaagagcttttttcacagaatcttgaattatttttattacagaaataatccatagagagggacaat

SEQ ID NO: 28381 - DNA, 2288 bp, Bovine  19866880628236
cagtttaccttccctactactagttatttgacaaatgtcaataatttccacaccaacgtgcttagtgtacatgttctggattaatatcaattttatcaattaattatcaattaaaaattaatatcaattttttctaagtcacattttgtatatctgtgaaataaaagtaaggcctatgttgtagaatcacatgtaatgagaaacaatgtatgtaaaacagaactgattgcagcgcctgacctggggtaatgactcattaaatgagagcttctgtcatggtgataatgatgatggtctccattttttatccctcggaatgaatctgatcaaataaggaaagctgcatgtgtctgacccttctcctctttctatctcagttgacttaataggctcattattgatgatcttcctaggaagtaaagggaaaaatcaccagaaatctgaatgaacctcagctgctggtcaaacagaaccagaatagcccgtgggtgctggaacaattcaattaggatttttaatatactctctgcttctcttctcccagccctaccggattctaagtatctatctgcactagatggatgccttcaggtacaatgatatggataaacacttccagggaggcggactcctttatagcttttccagaagaacactgtctattgtgtgttctgtttcatttttataatataattaaacagacacatggagaagtttgagccatgtagctaggtaacactcaaacaatgcatttttattagctcacagaatgaaatttagcaaggattctaaaaatctggtagaatttatgctcaagtagtaaatagtataaggaaagagaagaaagaaaggttttatagcatttcaagtaaaaataaaagacctgttattttaccacaagatcgatacaagtcattgcattaaggccctcttcagagatacacagtattagtgtcactgcaggtcatgatctcaatgtgctttcttccagtcagatcagctttagaggatttgagatcaaggcaatgagagggtccagaaatcacataacatgacaaagtttgaatgacttaagaaagttcaccccagcagagaaaagcctatggaggaactgatatcactcttcagtgatatcaagcatagccctggaaagaatgtgaaaaagaaacatattctggggacttccctgatggtacagtggataagaatgtgactgccaatgcaggagacacagggttcgtaaccctggtccagaaagattccaagcactgcagagcaactaagcctctacgccgtaactactgagcccgcccctagagcctgtgtccacaagaggagccactgactgcagccagaacctcgtgcaccacaaccagagaggagcccccactcctgcaactagggaaaaccacatgcagcaaggaagaccaagggcaaccaaaaatatataaattataaggggaaaaaaaagaaaacatactctgttcaatctctaaaacctaatttgactaaatggatgatacagaaaggtgtcccatgtcagctcagtttttaaaacttgataaaacatgagctgtgctgcaaagaatgcgggtggtcttaaacttccaaatacacagaatattccaaaaatttcatagaagtccatataaatagaatatattaagaagaggggctttcgactggtagaagttagagccagatgacctacaaggaagtttttagcttcaagattctataagaacataaataagtactattcgacaactctcacttaactcgaaccaagggagtaaaagcactaagaaaatcaagaagtaatatttaaatgaattgccctcttatcaaagaaatgggtccttcaaaatacaactagaacatttaaagacatttaatatatttcagcatacttatctcttaagcaacatacttagagagcaaatattataacattctcaatggtgatactgaattatttatcaatttgtgtttagcattgtgatacagaattaagtggcttcccagttggcgctagcagtaaagaacccgcctgccaatgcaggagactgaacagactcaggttcaatctctgggttgggaagatctcctggaggagggcacaacaatccactcttgtaatcttgcctggagaatcccatggaaaggggacactggcaggctgtggttcatagggttgcacagagtctgatatgactgagcgacttagcaagcacacactgaattatttatcaatttatggtttgcattatttaaaactaccagggaca

SEQ ID NO: 28382 - DNA, 1432 bp, Bovine  19866880696812
aatttgattacacattttctaaagaaatgttctaagaggtcagtaataactatatcactgagccattacttagctcctgaatgaaagcttttacatccttgagatctctccatgatttaatatttggcttctatattgtaatgactggttcttaaacaactctttgggcttaaaaatctaaaaaaaattgaaagtgtaacaatttatataaaataatcctataaacagtatatatgcttttacatttgttttcatttatcaattcctaatagctaaattcaaattctttttgctaaggataatttcaagtacctattcatttttggtcatcatacttctgtggatacaacattacacataaaataagtaacaaaatcttcttgagtatctcctcaatgagaatttatgtctccttataataattttattctcagaaggaaggagagaagtaaaaattagagaagatgtaagaaaaataaatgtattgcagaataggtgggaaggaggaagaacaaagtaaatgagggagaaagtacagtgacttggattctttttttgctttgttttataatttctgtaaagtcaaggcagtattagacataggatagcttattaataaacatatttgcattaactttaaaagtgcaaaagtatccaaatgctcatcttgatgagtaaaaacttagagcaaaattttgtccatataaaaagtcatgattgaagataattttgagtgggcaaagactgttatagacacatgagttgggtgtgagtacacttttgtgtgtgtgtgtgtgtctgtgtgtgtgtgtgtagagagagagattgtgtccatgcatatttaattctcaagaaatggcatttaaagaaagggcatgaaaaattttgagtactgctagcaggtataattcaataaacataggttaaaggttaaagtatgattcatttgtatctctttcatttctttggtaaaggctatttctggttaattgattttcacagctcattgattcatgctcaccagctaaatgtcaccttatttttttcagtgatggtttgcacttgaatggtttatgtcaccatattaagcttagtttgtatcagtgctaattgtaattcctattgaaggtgtaactattccagatttactatgtttacctttccttgaaacattaacacatctctatctttgctgggtcaaccaagctttcctggtcatgattacttggtatcaaattgagtacagaaaaccctctggaggtatacagcttcatcaaatctgaaatatacaagaacttttaaaagaaaactagctaaaaaattctaagatgttttgcatcacctaatgttatgcttaaagtaccatgatttgcatcaatcttggtaacaaggcaaaatttcatctcttggatggtgtaacgactaatataaa

SEQ ID NO: 28383 - DNA, 2602 bp, Bovine  19866880698450
tgtttaaatgtagtaaaactctatgggaccatagtttgctgttagtagtaataataacttgaataaatcaatctaaaattagatgttatgataaaactcttcattataatattataataaatgtgaaagcgtgtacatgcaaatatttgagaacaaaaattaactcttacatatatagatggaattcaaaggtacacttctcttttgtgtataatattgaataaaggtgaatatgcccacacgaatcatagactagggattctgtgttataacatatcacatggcagtttatcactcaaagataacgttataaaaattaaggttgagtttgactcagttattttcagtatacatttatcccatatttatgatcaaagaaatccgtgtcacagatggtcaaacacagcatgatccccaccctggaggattctatgtgataataaatataacaaaaagaataaaagctagaacagaaggtataagtaatacaaaaaaagagcaaagaaagagaaataaattctgtcctaggtgggaaaatgaagacaagcataatgatgtattagcatgtgagtgaccctaacaagatgagtcatttttagataatgaggtggaaaactttgatgagaaaaaaaaaaaagcatttcttcctgaggtaagaatgtagcttttggctgtatgagaaaatttaattgaatagggaaagtaagaatctgaactgaagtacttatagtgtctctgtatcgaatcaataaaaagtttactagctactttggtaagtaaagtaaagtgcttataacaaagtataaaattactctcaagtccttgcatgcattctatttcattgctattctttctataaactcttcttttccgtgtggcccaaggccgtggtctcctaactggcctaaagaacccttgccccctgtaatggaggcatggagttttaaccactgaatcgccagggagattctaacaaattttccctccacccaaagtctacagtggcttcctaggttgcgcagtggtaaagaatcctcctgccaacacagaggatgcaagagatgcaggtttgatccctgagttgggaatatccctggagcaggaaatgacaacctactccagtattcttgcctggaaaattccacggacagaggagcatggagagctatagtccacggggccacaaagagtgggacatgactgaacatgcatacacaaggtctgcagtgcacagtgatctgctggaaattagaaaaatgaaacaagacatttacttcccttgtctgctgaactttgaagagatcattatccaggtcatacagttaccatagtccaggcaatggttccatttcatttcctgacatctgtgcgtgcccctccccataaccctgaacgaccaccaacacagacatatgttgtcagaatgtttgccatttccagatttcctttgtattcctttgttgttgtttctggatcctctgctgtaagtgccattcctctccttttctatctggtaatttcttactcaggtatgtcatcaaaaccattagctgcaagcttcctcctctttattccaatagaaccttatatctctatgatagtatttaccctgttttaaattcttcaaggatggaataggattcaatttatttaatatctttgcctctcacttgatagacccacagtaggtgctgtcttctgcccataaagagagctttttttaatgctctccactccttatcactccttgagaaaagaaaaccatgagaaccattaagtgactaaacataatttaacacaagctaagttacaaaaaggtagtaaaatgtcgtcttaaaagaactttgactttatcaatcattttaaagacatgtttataggcatagatattaatgaaagatttcagaattgattgaggaaactaaatggcactataaaaatagttcaccagcttaatttttaaacattccttgtatatgaatttctgctgtataattagctatattacctggaattggaattagggatggtgatgctatacttttccaaattcatcagattgttatgtacttctctttcctcactactctggtggcattattcttatatacatgaatattgttagtggattgacgcttgtgatcaagaaatatattttatggaaggaaagggatttgactttcaagtaacaagctacaaagtatctagactctacatagatctattatttcatcaatttcaatttataaaacatgctcattattgaatttttatatccgggcaaagttttatagtctttagagggattacattaagctgttgagcctattcatatatatagccaatagggatatctctagctacatacaattttatacttatttgaataaaataaaaattctgcaatttataatacccaaaatgacaatgttggagtttgaataattaaacaaatggatgttatactaagtcataaatgtaaatgtttaaaatatataacaagaaaatcatgattaatgtttaatttaccaaagatttttaattggatgtgtaaacaaatacagaagattgtaagccataaagtccaacaaggtcactttaa

SEQ ID NO: 28384 - DNA, 1830 bp, Bovine  19866880704118
agactttactttcactttcatgcattggagaaggaaatggcaacccactccagtgttcttgcctggagaatcccagggacgggggagcctggttggctgccgtctatgaggtcacacagagtcgaacacgactgaagcgacttagcagcagcagcagcaacagcagccatcccaaagagtaaatcatttggaattgttccaggctaagtcagcagagtgtcacggacatttaacataaaaaacacttcttgaccctgaggatataaatcaggaaactattagctgaggcataccaatcgactctgtgaagccctaaacagagcttcacataatatcctcaacaataaggaggaaaaccaattgatcttataattaatttgaccaatacagaatgtacatttaggtcaaagagtaaatattgggtttgacactgaccaacttagctatgtacatggatcaaattaaacaagtaattgcttgcatgtggccagatcagactatggacttgaacctattaatctgactatatttggaagttcagctattaaatctgggtaaactatttacctcaatgtatggctgaacttctggaacttgctctgttggaagttgtaagtgaacataaaaagtacacccaagtaaaataggcaacttacatacatagagtacaaattctgtgcaactgtggttagggaggaaaaaaaaatacaatttctatgtcactggaaaatctaattatttaataatccaagccaatgttaagtttctaccttaaatattaaatgagaagtcaaagaactggagccattttactagttaacatttacttatattgagtaaccttgagtttgaaattaaatattagaacagttactgaaaactgtctcaaatatgtttgccctgtacaatgtaaaactgtaactaaagaatgcggaataatttttttgagttcaccatacattaaagatttttaaaaaatacaaacaaagccaaattcttgcagaaataatgtgaccttgcagtaatatatgaaactagaaatctttaggataaaatcccacatagctaagcaccaaagtttgaggacttagaagtaagagagtttcattaatggagaatataaacagcatccttaatttgaatgacataagacagcatatttctgacaatcaagtagccaaagaagaatctatctgcttccaataaagctaaaagaaactactttccttctcattcagtcaaaggcaggtcaaagcaacattaatcgtaagacatatatgaacatttcatttgatttagatggtttaagtggtgagttgacagcaggaagatctaacagatagtcactagagtctctttcattcctggttatttttcctcctacaaattcattatagcatatacttagaatgattatttatgtcctaaaacagaatatattatctgcctatattaatttatcatatttgtttcccttatgaaatcatacatttttacaagtaacgtgaaaagttgcttcccttccagaaatttcaccattttgaagtttatggtgattggagaattttggaaatttttggtataatctgtggattactaaacacagtggagttgtaagaaattctaagaataaattgcatgcattaaaaatagaaaagaatacaccttaatcaccctgtgatttaatggctttatctggagatatttcaatgaggtgctgacaaaatcatcacatgaaaaaaaaatttaagtaacttaagtaccaaaacaaagtaattgggtctgaaatatcaaaatcttatattctcacaaatttccataatcaaatct

SEQ ID NO: 28385 - DNA, 998 bp, Bovine  19866880717567
tagattataattgagcataaggaaagttttatgtaaaaattcagagaatgactgatttgatgttgagctttttaattggcttttcatggctgctggcctgtccaaaataactttatgttctttcctggtaaatataggaaagtatgtaataaaccttttcacatgaggtgtggatgcaaagagaacatacttatgaaagattgattgagaattcctatgacaaggaactgaaattttcttcctgccttggagggtgcttggctatgaatacaggatttcttgttattaactttagttaaaagaggaaacttttggtcaaaccttatgattcagtgataaaagtcttgataattgtaaactcatggaaacttgaaagtcactttgtcaggattaagagactggcttgacatttcaaaatcttaattggaagtgagattagttagatggtgcaggtttattccaagtcaggtaaataggaaagacagtcttataaaccctccataatgacacttttcctatacagaatagatgtgggaagagagagaaagggaaggagagagagggagaatatgaatgaatgaatgagtgagtgtgtaaggagataatttgattcctgtaatggggcaagggaaagtctagatttattgacaggaatgataagtgaaaataagtaattatttaattaagtgtgagagaggaaaccaaaataaggcctctcctttaaaaacatgtttaattcaaatggctataactagtatctaaaaaaaaattaagcaaattattttagttaaaataggaaactggaaccgaaaacaatagaatatatttgagaaataggtctgaattttgatatgaagttcttttaggagaatatcagaatatattcaacagaaattcatgttccgaatcaggtatcccagtaaaaggatctttggcttctaggaagatttgagccagacataaatatcaaccaaatatcacacatgtcatccttcaaa

SEQ ID NO: 28386 - DNA, 1220 bp, Bovine  19866880776189
taggtaaacactgcagccctgtgttgtacatttaacttctttacatttctattatatatactgtatctatgtacatagatatgtaaacatgcagacatatatataaaacatatttgaaaggcatctatgtttatttatcttatgctttctcttctgtattaataacttttagaggtcaggacttgtatctaacttaatttgatctaatatgttcttttgctgatttttatgttggttttgattaaaatatgcagtatattatttataaagggaaattatctcagtttggagataatgattttcaatatgtagcactaagaattcatattgacgccaaggaagcaaactcaataaaatatcagtttagttcagtgttggctgcaagaatattaaaatgttctgtttcagtaactattagaaaatatcaagattctattctttcctttattcagcaagcattttaatgcctactctggacatgctcttactaagtgttaaggatacaaagatgaatgaggcataggttctgccttgaagacatatgctatagtgtaatttgtctctctcacaatacacacacacacacacacacacacacgtgcttatattacagtgtgaatggaataaagggaataacaataaagttatgccagggaattgtaggagacttggagagggacagctgatctagctgggagtctcagagacagctgcttatagtgagttttgaataaaatatataagaaggaatatgaactcttaaatgaggatggagaatgggaagatcattatagatgatggggataacaaaagcaaaagtctagagcattttagcagtaatacaaatattagatatcataagttcagtaggagaaggcaatggcaccccactccagtacccttgcctgggaaatcccgtagacggaggagcctggtgggctgcagtccatggggtcgcgaagagtcggacacgactgagcgacttcactttcacttttcactttcatgcattggaaaaggaaatggcaacccactccagtgttcttgcctggagaatcccagggacggggggggagcctggtgggctcccgtctatggggtcacacagagtcgggcacaactcaagcaacttagcagcagcagcagcagcagttactgtgctaatggttttacatggattctctagtttttgtcttaccataactctatagagatttgca

SEQ ID NO: 28387 - DNA, 2690 bp, Bovine  19866880805054
agaatgatttccacacctaaatgtgaatacaaataaaatgactggagataattctcaacttcttttttaaaatatgcaacccactatgccaaatatgacaccagcatttcacaactcaaaaagtgcattagacctttcaggacaagatgatgtacttccaaactcataggcagcaatcttttcaaacatcagctctgcggctacctcatgaaggcttacatcatcctgatttcctgcagtctgaacactgtcattgcaggactgttctgaaagtagcctgaggtgccaaagcgaagaaagacatgctaggcctttgctatgtttggagagaatgaggttaatgttttccctcagcaatgaagatctgcaggctcgtgacattgatacagagactgccagggagaggaaagcagtgctgggaattacttctccccttttccctctgtgaacagtgaaaggaatctgtctgaaggggtaagacgatttagcttggaaataggatataagattaaatttcttactcttttactcccctttgcagattaaaacccatctactacctctaaggcaacagcttgtctttgagattcaattctttattttctctggggaaacgcaaacactaacttgatctttatttagcagtaatctctaaaatgcagcacagctacacgattacaatgactttgtaacagctttctaaggttccctcagcacctacagacaatactataaatgctgatatcaaactggtcaggttactctcatatccctttatttgttcacacagtagctcattcagttcagtccgtctttagaattttcgttcagcaagaatcaactacctgtcagaaatgtaggtatctgggaaaagtgtataggtaatgtatggtccataacttttcagagtttagtgcagggaaaaggtaaccatgtgaacaaaaaatggtaacatgactcacaagtagaatgtttagagtatgaaaaaatagagcctaaggcacagatttctaaatccttaaattccatccttcatagttcacttatgttacataaatgtatgcatacaatttttatattttatatgtgtgtgtgtatatatatatatatatatgacaaagtgaaaaaaatgcaaatagtttctacttgcactttactgactagtatgttttttgagtaaaatcttaagataggttcaggtggtgaacattggaaactatagagaccatctctcgtgtggggttagtgtttccattaggccaaagaaacaaagtaagctttggtttattgtaaaaaaaattacacttggactttagccctttgtatttcaacacacgataaaaaaacatctgtgcagaaagaacataccatgtagaaataaaatgcaaagctaagagagccgagaagctttgctctttcctcgcacagtgctggcttccagtcactgccctggactacaggacagaaggatggagaaccagccccagtcttgtgtacttaggcttcatagaaggaagggtttaggtgacacagagtcaggagagcaagaggccaggagtggggataggggttgcttgaatggctatgcccatttcaccagccttctaggaacaagaaaacacaagtcatttaagataccatttggaaggccaagcatggcacttgcacagttcacactcctacatactctggagtagaatgagatagggagagaggcgagagagagagaaagagagagagataacagaaaaagataagttcccctaaaagcccacaggttataacagagagatttgcaaatcactgtgatgatagagcagaaaggaattataaattaactttgtgcatggggatcaagaagatttcaacaaggaaggggtatttcataatcaaccttcctaatacttctaaagatctcctgaaacagctctcattatctcaacaattggattctgttaactagaaacatccctatgaacctacttagtagttggtttatcagttcatttcagttcagtagttagttgtgtctgactgtttgcgacccccatggactgcagtatgccaggcttccctgtccatcagcaactcctagagcttactcaaactcatacccattgagttggtgatgccatccaatcatctcatccttttcatccccttttcttaccaccttcaatctttcccagtatcagggtcttttacaatgagtcagttcttcgcatactgtagtgtataataactttgattctaaatgtgattttgcccctcctaccatcttgctgaggcttctcctttgctcttggacttgggtatcttttttggtgggatccaacattctcctgtcaacggttgttcagcagccagttgtaattttggagttcttgcagaagttaagcacacgtttctactcccccatcttgtgtctctgaagggcttttcccccagtctctataataacttttgtactactttaagatacgctaattttgcaaacagctttactattaataaataactaaagccacagcaatttgaactggaaagtagtgaataatgtcacatagctgaaatgtgctctttccttgaatcaatattttatttatttgcatcttaattaatctccacactattgcttaagaataggtatgtatactgctacatagagtcctaatagttacacaaaactg

SEQ ID NO: 28388 - DNA, 1668 bp, Bovine  19866880815633
tcggggcggcggccgagaagagctaccccaggtccgaggtcaaacaaagatatatgatattgtctgcacaaatgttttaaacaaatcttacctgttgcttacacagattaggctcaaaaataacacaaagtggaaaaagaaaaagcaaaatgaacacattgttttaagtcttcgatgaagtaaaatggataaaaagcgatttccattttttgaaaattgtgaatttacttaaatgccccattcattgtttccttgtatccaaaatgtaagtcttgttaaattgaaatatatgcaatgacagcatcaatatttagtgtaagcaccaaatcacatttcctttaatgaagaaaggacatggggaaaaaagagttaatgagacagggaaaagaaattaagcttcaggctgtcccaaattatctaaatcagattcttaattaaaaatttatttagagccactcagtctactttcaaagtgaatgtcaaataaagctaaataatattagtacaaaggcatcatcttttaacagagcttgggtatactctgttaaatttctgtaacatttaagttgatagccttccaaagcttccatatcagagattaaagtatgatatgatgtgacaagagtgtagaacatatagtaaaataaagggtgggtggagaagactttgataaactttatctctactagaatgtctttggaaatcttttttccgaaaaattattagactaaagacaaccttatatagtttcttgaaatcaagacaggtacccctttgtcctctccctgcaagacctatcagagatctaatacataataaaggtcagtaaaatatattgtattgaactgacacagggaaatgagctagctggtgtgagaaatcattaccatcttcctcagtagcctaaaccagaattctgcatggggagttatactgcccccaaaggaaaaggccatattaacataatttccacacttacattctctggttaaaatcttttctgagcagaacttgttcccaaattaagcactttcattatcaaaggagaagttcttaaagtctgcttcccttatttatcagttcagtaagtcgctcagtcatgtctgactctttgtgatcccatggactggagcacaccagccttcctagtccataaccgactcccagagcttgctcagcctcgtgtccatcaagtcagtgatgccatccaaacatctcatcctctgtcattcccttcttctatctttaatctttcctagcatcagtctcttccaatgagtccattctttgcatcaggtggccaaagtattggagtttcagcttcaacatcagtccttccaatgaatattcaggactgatttcctttaggatggactggttggatctctttggagtccaatggactcttgagagtcttctccagcaccacagttcaaaaacattaattttttggtgctcagctttctttataagtccaactctcacatccacacatgactactggaaaaaaccacagttttgactagacggatgtttgttgacaaagtaatgtctctgctttaatatgctgtctaggttggttccttatttatactggccattatttttaggaaaagacaagggaaacaatgagaagaaaatttaccttgccatttatacaaaatagat

SEQ ID NO: 28389 - DNA, 1134 bp, Bovine  19866880820801
aaccctttccaatggatcaaataaagctctcctgtccacatgcacttatatatccttcttcatgatcaatttcttggcatgggtattagtaaaggtctcagtcaaaacagacatggagacatagttttaaacttgaaataacagaattgtcccttagaacaaagagaacagaaagctaatctattagccagtaggttgtccatgattactccacatttcatgaaatcttttatgctctacattctttttggtaattattttgaatctttttatttttattcatttacacttattttacatgttttatatattgtactgagccaggtaaaattatggaagtatggaaatacctttgtagtatacatctgtattttccaatatgagatttttattccaaccaattcagcatgtatattagcagctcagtgtgtatcagaaaatattgttggagattggaatacagcaaatgacaaaatggatgaagacctgcttccaaaacaataaatataaaaagagttatgcattgtgtcagaaactgaattgaaaagagaaacatgtatttgctccttttcactctggagtttttaatatctgtagaaaacttatggatattatgaattcatagagtaaaatgcaaatccatatggcaactgtgacctgcgtgctgggattgcagactaccaggctgtattgggaattaaggcctggcagatgatggatggcgacggtgctgtttcacttaatgaagccgctattgaagcttaaaaggggaaagatgacaagagggaactgagtgctttagtctttgtaaaaagtaaaagctttgcaagattataccaagaagaactcaactcactactttttgaacttcattaatcttttctataaaaatctatctcactgtcaagtggctcaatagctactttgggaaaatgctttgcttctttgtaatggaaccagtgccttaattgtcctgaggccccaaggatgttccacctcacagaaacactaaagaggtgtgcaatgctctggagaagccagtgtgaagatgccaaaatggtccagtcagcccagtcaaaacttatgacccatggggcaacttttctgtattaatttgtttctagaacaataaca

SEQ ID NO: 28390 - DNA, 741 bp, Bovine  19866880844549
tttgtgagtaagactgagtgaatgactctaataccatcaatgattattaccctgtgtaaagcatcacagtcatatgtattatactatattctatttcacaataatgagggtctatattttccctaattattctgccacatttttaagccgcagtaaaaggaaaatattatatcagtaaatggggcttattttcacacagaagaaaacatgattcttaaaagcaatttataggcaatgctctcagtatatctaaccaatgttttgatttacaaaagtacaaggcgctttcaggtttacactattttacatatctcaagtgtttctgatgaacaatgattctaccagtgtctatgtaatatccttttaaacatatgttaggggtataatattgtgcaaaatagtgtttttagaattactattaataatcatactaattacaatgatttataatacagttacataagactgcaattgaagacaatttaactgtgagaaattcatattttaaagttaacttgctttattttctatgtcaataaaatatggacctttgaaaaatgtgaattaatttatatacttatttatttctgtataatttgtgtttaaaataccttactcatttaattcttttttttttttttttttttttagaaagcaaattaaatacaggctggcaattttgtgcactgttttgttctaatgtgaattcaaaccattgagtcataaactcctgaaaaactg

SEQ ID NO: 28391 - DNA, 1578 bp, Bovine  19866880850958
gacttgtggtcattgaaactatttatctatgatatagaatttccattacagtgtattaagattttatatttataaagaaagagcttactatttgctcttatccttaaagcagctactctcagcagtgtaattatagtttgtatgatattaatggcatacctctgggagcacacattatttcatggctttataaaaaaatgttataattatataatcaccagggatggcattctatctgctcagggagcatataacatctcagtagttttccattagagtatcactgatttggagttggcatatagaattaggcgccctccctcagttcaaggttaacacataggaattacagaattcatactcccattgagacgaatttgtcctttcttataacttttcctcatctaaatgagttatttgatatatagcagctcttacctctaaaatgtaacattttaaaagctccttactataataatttaaaaaacaaaaacaagttctccaagtacctaagtacaaattaattatgcagattttctcaagcaataagaaatattttcatttattataagaaaattttcatggaggatttagaaatattatcaagtatgtttctcaaaattataaataactatataaattgataaagctatggcttctgctgtatgaatttcttattagaagacacatgtgagcttccatacacaatgaagcaaagaagatgttgtttagatggataaggtttaagaagaatgattaaatttatcaggatactgacttgaagaattctttatttctttcaaaaatatggctcaatattattcatttgaatatattttagatacatgctgctgctaagtcgcatcagtcatgtccgactctgtgtgaccccatagacggcagcccaccaggctcccccatccctgggattctccaggcaagaacactggagtggggtgccattgccttctcctttggatacatatataagctaaagagtattgcagtttacaaaatttatatctaatatataaaatgttatgagttctgtctacaatatatttaaagttaccaaagcaaaataaaaattcccttaaagtatatgtgcctatatcaaataagcatctccttagtcacatgatttttatgtgtatggacacatttctgcaatggaagtcatatgcaaagggacacaagattatctaaaagaaacctcagggaatggcgagtggctgagctatatcttttctgttagaactgagagtgaaaccacttctaaatcaaccaatacactctaactttttaatttaaactttttattactttaaaaaagcaataataaactcattatctgctcacataaataacatctttatcattaaaaataactatactttctcaaataaattaaaagagtggctcttggtttttcattctggcaaatctctttactgactagattaacagaagagagctggattttcctgtctgcttttgtttccaatctgttaatatgttctcttggttgaaatatatgaagacaattctgcctaaaaaaaggtatttatttgggaaaag

SEQ ID NO: 28392 - DNA, 1622 bp, Bovine  19866880856770
cttattttgcttctttacaaggaaaaaaattacaaagctgagaagtattgacagggctgaagaggagtaattatattactaaagatagtaatatcttatgtctgtgttgtggggacaagtctggtgttataaatctcaagagcctgcagcagttttactccttactattatcattctaaggaacgataaggaacggccctcatttgggacatgtctgtgttataaataatggcaaagagaatatgccaggccataggctgcctcttaagtctgttaggtaacagacacacatggcctctgcccacctttcattggccattgcaagtcacatcaccactcctgagctcaacagagctgtgctatatacacatcccacaggaacaggtcccatagaatgtgacaagaaatagtgaggagattgtaatctaccacagtggcactgacttatttgaatcatgcttacatactttgtagctgctaacctgctggcattttctaaggctggaccaacctatatataaagtagtacacagcacaactaatggattccttgggttaggagatctcttagtctatttaaatcagtgcctaggcagaaaaccattgtgaagaagagcggaagttttcctgatcagggctcagtggaggaaaggatgggagacgtgttcttctggatttttctcagcaagtggattgtaagattccatgaaatcagtttcttctaaggaaaataaaaatagcatactctaaaaggttgggagacaggtaatctgagttgcatccagctgtatatatctcatgaagggagagaattagttggacctaaaataaacttttattcactatcttatcttctgctttcattagaagatacatatagtatcataatgtatcaatttgcacatttcttccatgaaatgtttgctcctaaaaacaaagccttggtagtcagtcagaattcatgaaatgaagaagtgaatgaatgaatgaaatgactaacttgaagccaggtgactttatttgatcaaggttgtcctaaaagcaagtgatatgccaatggttctaataatttaatttttgcttttgatgcttcacttcatagaatctttctaagattttttttatagaatgcaagattctttaacttctgtggtactttacaattttcaaaaatttcatacatggatttcatataattttataatacacctttttaccctatccctgtgctgcccctcctgccttccttctcttcacttgtaaccactagtttgctctctgtatctgtgagtctgcttctgtctttggtttattcactagtttgtagtattttttagatttcacatgtaagtgattatggtatttgtctttctctgtctctacacttagtataatgcctttcaagtctatccacattgctgcaaatggaaaaatgcatatatatctatatatatatagatatgccacatgttctttattcactcatgtgttgatggacacttaggttgtctctgtatcttggcaattgccgatagtgctgttatgtatgtcgggctgcatgtatcttttagaattcatgtttttggtatttttggatgtataccaaggtgtaaaattgctgg

SEQ ID NO: 28393 - DNA, 901 bp, Bovine  19866880906737
aatctgcctgcaatgcgggagtcctggatttgaacctgagttgggaagatcccctggagaagggaaaggctacccactccagattctggcctggagaattctacggactgtatagcctatggggtcacaaagagtcggacacaactgagcaactttcacctcatgttttaataagatatctataatgctaagaaattttatgtaacagtagaaattttattataaatctttggccttttaaatcacatctaatcaaaattttaaatctatagtgctatgtaaaatagctgttgcaatttcatgctctcaagcaggaaactgtcttcattataccttacagaagttgcttgcagacatcggtattttcttgaccacattatttcatggccatcaatcaaataagcaattcacttctctagatcttggaacatttcagttccccactatacttatgagactctactaaaaagtaagatatacacgcagatagaaaattatatattatacatagtaactaaattatgacataatgtgcgatttagaaagaaagtcttaaggtaggtgaatttcttgaagtacgttatagataagccacatcaaaatttgctagcatctctctactaaaacattgttataaatacacacatatatatgcatatacacatatgtatataaatgtgcttagaaagaagcctgttcccttcccacagctttcctatcccatcatgctataagcatcctatagagtaattagtatttttcgtaatgatttaagaagaaattttagcaaaagaaacatgtcctctgcaaaagaaagcaaatatatatttgaaccacaatgagatcattggggatttaacagtaaagaaggagtaatccttcttttcaaggaatttaaagt

SEQ ID NO: 28394 - DNA, 1306 bp, Bovine  19866880923746
caagagtattggagtggggtgccattgccttctccatctttaccactgagccgcctggtattgaaatttaattgagcatgagtgaatatgaatcttgaaaatgagaactcatccccactgcaagcatctacaaacatcactctgtgtgaacaggcatgttcaataatatattaagtacgattaaaaataagaacaaagttgggcacattttgtagagaggattctaaaggataaactgattaaaacctgtatcaaaatcatctgaggttctcattaaaatgcaaattcctcagccctgaactacagtactgaatcagaatttctagcagtaggagtattaattatatattttattataaatcttagtttaggtaataattagacactgaaaattgagaatcagatgttttaggccttacacaactacaaaaggactactagagataagcttgacatttctcatgctttatcaaaaatacatttgttcctttgatttttacatgttttcctaaatgcatgtaaaacttcctgagttaaaattttcaaccacaagcaattctatagagaaaaccccaaagagttaaattaattctgatgagtttgaggttaaatctaattctattatactctattaagaactgtatggcagaagtatatgcatttatatccttgttgaataacatctttattaatcaaacagctctaatttattgatgcaaactcttagtaaccagttattaatccatgggctactgttgtggttttctccaaggaatcctttgatggatgggctgtcaaaatgtggatgggagagcccagatctgcaaatggagaagaatatagagtgctgtctcaaggcgatcatagaagcagctgtatccatggcatcagtttcacagaggaccagtaacaagaacaacaacaacaaaatgcaataatatagcacacattagatatctgccttattattattaatgagttctcgcttaagtatcccttttgatcttttcagtgatcctgtgcttttatggataagcaaaacagaggcttacagagagaaagttacttgttcacatattttcatattacacaaaaatgagggttttagaaaattttcatttactcacttttttcctggtaatatatatctaaaagtatagaagaaatgctgtctatccttaagttagctacaagtagaaacataaatatataaacaggcaattttaatgtggttttacaaatgttctaaggggctaattatgggctgcatggagagtatataagagatacttaattcacctttggg

SEQ ID NO: 28395 - DNA, 699 bp, Bovine  19866881005793
attataaagtagtagctatgcttatatttatattctgtaaaaacatataagaatttgtcatgttaaaagaaaaaatgccagcataataaattatcttgtggttcttcagaagtaagtgaaagaacccacagaacccaagagccatgctgatatttgcctgcatttaagtaccacattctgagattttagaatacctagattttataccattctttctagccacaggcatttctttgcttttttttttttttttttcttcttttaaaatgtcttttgtatcccattctcctgctttattttagtaactttactccattataagcaatacctgctgcagtgttattaggaaagtataaagtagtaaacaagttaataccagaggcaattatcttccaccaaattaaaacaagaataaaataatgataaaatagtaaaacaataataaaaaaataatgaaataataatttaaagtatcagagaaaggcaaatatccacttgtggaatcatgttaaaatgttcctaactttaagccaattattacagcttatcaaaactgatttttcagcacttcctaatgtgagacataaggcagtttgccaaatatattttattcatgcttaaaaatcaatgatacatttacaaagcaagtttgaggggactgattatgtggagtaagaaaaagtagatgtggctgacatt

SEQ ID NO: 28396 - DNA, 2527 bp, Bovine  19866881058283
ctttagagaccttgggaaatcccaggattattagaggcgattatctgttaagatagtagaaaggacggagaagaggaagcaaacatgcttgtctagactatgagtattagaataacacagtaaacacgattatgctataatgaggttattaacatgggaaagctgaaaacatttctaaaggagaaatcagacaggatcatgtgcacagaaatgaatataagaagtctcagtttggctttgctgaggtagtatgggtcaatagggcacttatgataggttttcattttttcacttttcattttttcactcattaatttacaattatgataggttttcattttttcactcattaatttacaaaatgattactgaatggataaatggctttacacaaggcccatggtgtttacttgcattcgtgagtaaagactgtataatgttaatgttgcaagattaatataaagggtgtagagagatttgtgagtcaattcaaatgttgcaaaatcttaaactctccaagtgtgcgtgcccccctgggaaaaagactaggatttcctgccagatacttaattgtgccctcagaattggaagcaggaattttgaagttatttaacttacaccagcttctattatgctgatttaagactaaacagtcatagcattcaaatacaagctagtgccctaaaaataaaataaaaaaacattcccagaaagtaaggtaagaattcagaaactaattaaaattctggggactcaaagtgggtaagtctcatgcctgggtacattttatgacttaggtttggaatctaaaaatctcagtttccattctggatgtctaaactttaaaacttattccccaaatcatagtttatagatataattttaaggttttcttcaagtgatagcttgaatttgtacagaagagcagataaacatttagggaaatatttaggaagtatcccaaattctgggaatttatcctataaaactaatgctaataccaatggtaagtaacaaaagataaatgccctttagcctaaaacatagttcaagataaattataagtatacctcattaagttagaatgaccaaagaagagttcagaaataaatgaagtgttaggtattttttaaaaaatgcaagttctaagtcatactagactggtgaggtcctcaaagacaggttatagtatgtaacagctttgctatcctaatgttgaatacactcccaagaaaatactattatttatctcttagcataatttgcggagaaggcaatggcaacccactccagtactcttgcctggaaaatcccatggatggaggagcctggtaggctgcagtccatggggtccctaagagtcggacatgactgaagtgacttagctgcagcagcagcataatttgaaatcctaggctagctaaaccgaagcaatttgttggcaagaaagcatctcttatattttaagaatactcatcaggatattggctggtcccagtaatattagagggctttccaggtggcacagtgcaaagaatccacctgccaatgcaggagacacaggagatgtgggtttgacccttgggtcagaaatatcccctggattaggaaatggcaacccacttcaatattcttgcctggagaaaccacggacagacgagtctggtggctatatatagtccatggggttgcagagttggacacgactgagcacacacgcatatgcacagtattatcagaataattaagagctatactaaacttgtcaagctaaatgaataaagtacatcctcagatgaagtacccatgacttttattatatttgttcatatacttagtaatttgcaaaaattcagcaattgtctccctgtcattagtttgaattaacaaagccctactggaatagcagttaggatggtaattatggaaaatgaagttacatttctaaataaatggaggttatattcatatttagtaaagcctgaagactaagcttcaaagtaaaagcattttagaaaatattttaaaagctagtatggtactgaaacaaaaactgaaaaagcaatgtaatttttacatgttttattatttactatcaggctcaactcctgtttctcagctcctactgtcttattgttttagtacattttgttagttccctctgagtttgcccttctggacattagctgacactttaatttttataatttcaaaaatattgattttcaacaatttttaaattaaatttctatattttttctatttcagggctcttgatacaacaatatctttttcttttttgggggcttaccaagaatatcagtgtctgcttcctgttgatatgtctcagaatgttgaattggtataatctggcatatgataatttttatgtaaaaataatgtcagcttaaaaaaatctctatatatcttaagctgtttgtccatgtaaagatacataaacatacatatacagattactacctaccaagagaaagtcattagtattttaaatatttattactcaaca

SEQ ID NO: 28397 - DNA, 1581 bp, Bovine  19866881190628
aaagctaactttaaaaaatcgattgcaatatatttctgttctctgggtatatgagatttccaatcagaaatgagtatttaacattatctgaaactctaaacaagaactctattttttttaataacatcccaaaatgaagtgatagattttgaagagttcccactcaaaggaagttgccagaaagatggtttcaaggaaggtagcagtagatataattcttgcattcattcagccctctggctgccatatactacatattcacagtaaggcagaaagaaagaatgtagtgtttaaaaaattaaattctatgtttcaaatgattactctagcagtcttttcctagtggtctttcagaaatgttctaaaaggaagccatggtggtggatgttatctaaactcactgtggtgatcattttacaatgtatacaaatattgactcattatgctatacacctcaaatatgttacatgtcaattaaacctcaataaaaaataaattaaaaaataaaaggaagctgaagtaaaaataaatatgaaaaaacacagatgcctcaagttccacaactgcctattttatctgttttgtcaattgctttaaaaattgttcccaatggtctataaaatcagtgatccaaactatagaaagcttgtgtgccacaggaattgtatatgtgttatgccaactttgtggcatccagcaatactaacaccaaacctaactagatgaatccagttttatcctcttccaaatacatactttcaggttgtaagttaccgtctatgatttatttttttcttccagtagtctcttccaagctcaaactgtttttgcccttctgtttccagagaatggcagtaattaactattaggtgaaatataggatattgataaaatactaaacattgataaaatattagaaataagacgtatatatgatttgcatgtgatgaagtgggaaaacatgaaagagatgtttctgtcaagaagttttcaaatcagcccaagtatgtattaattaacttttcattttacttgtcattatatttataatgtaaaaatattataatcactgtcagcaccaagatgaatcccaagaaaaatggctactaaatgtaatgtggtaacctaaatgggatcctggaacggaaaagagcattaggtaaaaacgaaggaaaactgaataaattatgagctttagttaataacaatgtatgaatagctattttattaattttaacaaatatacaacactaatgaaagatactaataataagggaaattgtggaatatatgtgggaactctctatatgctgcttttcttatgtcaatgtaaagtggttctaaaataaaaagtgcattttaaacatatattaaaatattatgttatctagagataggcattcaaaaagaatctcttgtttagggttggattctcaattcaatttaaaagtgtcacaaatattgaacattttagttcttttggcaacctggagaggttgtatagcttgttgatgttcaaatggcaccttaattttatgtcgtttactgaacgacaggcaggttggcaggttcacccaacat

SEQ ID NO: 28398 - DNA, 4317 bp, Bovine  19866881255085
aaaaagtagggcaaaccactagacaattcaggtgtgatctaaatcaaatcccttatgattatacagtgggaagtgacaaatagattcaagggtttagatctgatagagagagtacctgaataactatggacagaggttcctgacattgtacaggaggcagggatcaaaatcatccttaagaaaaagaaatgtaaaaaggtaaaatggttgtctgaggaggccttacaaatagctgagaaaagggagaagctaaaggcaaaggagaaaaggaaagatatacccatttgaatgcacagtttcaaagaattgcaaggagagataagaaagccttccttagtgatcaatgcaaagaaatagtggaaaataatagaatgagagaaactgtatacatgcagcaaaaacaagacctggaaatgaccgtggcccagaacaccagctccttattgcaaaattcttgcttaaattgaagaaagcagggaaaaccactaggctattcagatatcccttatacttatacattggaggtgatgaatagattcatggtgttagatctggtacacagaatgtctgaagaaccatggacagaggtttgtaacactgtaaccaaaaccatcccaaagaaaaagaaatgcaatatgtcaaggtagttttctgaggaggctttacaagtagctgaggaaagaaaagaagcaaaaagcaatggagaaagaaaaagatatacccaaattaatgcaaagttccagaagtagcaggaaagatgagaaagccttcttaaataaacaaggcagagaagtatagggaaacaacagaaagggaaagactagagatcttatcaagaaaattggagatatcaagtgaacatttcatgcaagaatgtgcaggatagaggacagaaatgaaaagacctaagagaagcagaagagattaagaagaggtaagaatacacagaagaactatacaaaaaagtcttaatgaactggataaccacaatgccatggtcactcacctagagcaggacgtcctggagtgtgatgtcaagttggctttaggaatcattactacaaataaagctgacagaattctagctgagctatgagctatttcaaatcctaagacatgatgctgttaagtgatgaactcaatataacagcaaatttggaaaattcagcagtggtcacaggactggaaaaggtcagttttccttccaatcccaaagaagggttcaagtgccaaagaatattcaaattgaggctaaaataagtactcatttcctatgatagtaaggttatgctcaaaattcttcaagctaggcttcatcagtatatgaaccaagaaattcttgaggtacaatctggatttagaaaaggcagaggaagaagaggtcaaattgccaacattcgttggaccatggagtgaaaagtgaagtcgctcagtcgtgtccgactctttgtgaccacatggactgtacaggctcttccgtccgggattttccaggcaagaatactggagtgggttgccatttccttctccaagggatcttcctgacccagggattgaacctgggtctcccacattcaaggcagatgctttaccatctgagccacccaggaagccaggaatcatggagtaagcaagggaattacagaaaaacatctacttctgcttcattgactacgctaattgctatgactgagtggatcacaacaaactgtggaaaatacttaaaatgttaggcatcccagaccaccttacatgtcccctgagaaacctgtatgtgggtcaagaagcaacagtgaaaacaaatatggaacaatggtcttgttcaaaattgggaaaggctgtatattgttaccatgcttatttcacttagatacagagtacatcatgcaaaatgctagacttgattaatcacaatctggaatcaaaattgaggacagaaatatcaacagtctcagatatgcagatcatataactctaatgacaaagagtgaagaggaagggtctattgatgagggtgaaagagaggagtgaaaaagatgtcttgaaactcaacattaaaaaaactaagatcatggcatccagtcccatcacttcatggtaaatagaagggggaaaagtggaagctatgacagatcttattttcttggactcccttgagctccaaaaatcactgcagactgtgactgcagccaggaaattaaaagatgcttactgttggaaggaaagctatgagaaacctagactgtgtattaaaaagcagagacatcactttgccaacaaagatctgtacagtcaaagctctggtttttccagtagtcatgtaaggatgtgagagttggtgcatgaagaaggctgagcgcaaagaattgatgcttttcaaactgtggtgcttaagaaggctcttgggaggccttggacagcaaggagatcaaagcagtcaaacataaaggaaatcaaccctggatattcgttggaagctgaagctccaatactttggccacctgatgcaaagagctgactcattggaaaagtctgtgatgctgggaaaaacggcagcaggagaagaggatgacacaggatgagatggttggatagaatcagcaactcaatggacatgagtttgagcaaactccaggagacagtgaaagacagaggagcctggaattctgcagtccatgggtttgcacagagtctgctgtgattagtgactgaacaacaacgacatatcatgcacttaaaggaaacaaaaggatttctataatactcgagatgagcattatataagtgtgacaaaggtccctagtaaaattttagaattttgttctgttcattattcaacacaattaagtccctctgatatgacactctttggacaaggaagaaaatggtgaaaaaacagcctacctggtctcatacaaaagagtataaaggatatataaaaagagaatgaatggaatgcaatatgacaagtgccacacacaaaaaatcaacaaaatgctgcgttatcataaatgggccatcccttttctgatattcatctgacatcacttaaaggttttatgggtcagaggactttaactgctcatattcaaatatggacaagatatcaactggccactccaaaagtgaaaaatcaattggacataaataaacgccttgccagtccttgtgctcaatggcaaactctatgctatgttggaagaaagccaacttgaagttttaaaataacagcatgtagtgtggtaggggatttgccctcttgttaaagcagcattgtataatttgatattgtaattcattatttaaaaataattacattgagaatagatttatttcagtataaagtagaaattgctttatttaatatgaaagatattccatattttttttctttttaagcaataggttgaattttcattagaaataaatctgctgttatataaaaaaaatcacagaaatgtttccagaaaattaaggctacagactttcaacttctttaattcataggccagatgtcattcttattgacagaattggaaaagtttaatggactacaccttgccaattagaaaaactactgagttccagtgctctgatttctgttctctagtgcttttccagaacatagcaatgaagtttatgatatatatgaggtgagatctaaaacaaatggtgacacatccctctgagctgatcatgactgctttcttatcccaattagtattatggcaattaggagacttacaaggagatcagttcagttcggttcagttcagtcactcagttgtgtctgattctttgtgaccccatgaatcgcagcacgccaggcctccctgtccatcaccaactcccggagtttactcaaactcatgtccatcaagtcagtgatgccatccagccatctcatcctctgtcatccccttctcctccagcccccaatccctcccagcatcagggtcttttccaatgagtcaactctttgcatgaggtggccaaagtactggagtttcagctttagcatcagtccttccaatgaacacccaggattgatctcctttagaatggacaggagatcagcgatgctcaaaatggaccacagatttcaagtctggcatggctacacctttcttggatgttactaaacttgtatattgctttcctaccttcctttactcagcaacagtatacacacacacacacacacacacacacatacatcagtgtgactatctcctatttggacatagggactattaagagatactcaagtttatgtgatgtcctaaggggaggcctttatccagtagggccagtgtc

SEQ ID NO: 28399 - DNA, 693 bp, Bovine  19866881293474
ggaagcccaaaaatactggcgagggtaacctatcccttctccaggggatattcctgacccaggaattgaactggagtctcctgcattgcaggtggattcttaaccaactgagctatgaaggaagccactttttagactgtaaggttagctaaataatatgagatctatttcctccataatttcttgtcaatatttacaggctacaaggcaaaatgtctgatttcctgaaagataacatcagctactcttaaaaagtcatgtcaatattaatttaagaggttttttgcacaaatgttagcattgataaattgattttgctcttctcattcatttagtttacagactatataacatacttccatttaaattatgtatgtgaacacttgtgttcccaatagttatcaatcacttacaagatgaatgtaaatgacagtttcacaatgcatgctatagatctccagaacaaagagatagaataaaatataatctaggtgactaaaaggtttctgaaccaaaaataccattaaatatttatatgcttttgagcagaatgtacttatttcccagagcaactattgatctgtgtactgcttttcccaataaatgatttcacattaaactcaacttggttcatgattttctcacacagaacagttattcccttcatctaaacgactggaattcatattctta

SEQ ID NO: 28400 - DNA, 1023 bp, Bovine  19866881301717
gggctgtggtaactgttatatggactttgggttttactctgcttcaatgggaagctacagtacatctctgaaacaaaactcaggttttgacaagagaactctggccactgaaaatggggcaagggttgagcagagattctggttaagtggctggtgtgatgatggagataaatgatgacaatggctctgaccagtgtggtagcaatgtgaagtggttgttttctggatacatttagaacaaaaagtcgtagataaccggtgggatgtgagaaagcttggaatcaaggatgcctccaagatgtttcacctggaaattggaaggatgtgatatctatcacctgagatagctaagatgcaactaaaggagattttgtgtagaatatcagaagtttcagtttgggcatatgcagttaaagaaatttactaggcactcaaggatttataccagagtcaccctaaaagacaactctcttccctcctttcacccctccccctctatgtcccaattaataatttattgggaaaatattccactcggatgtttcctgattctgtacaccattggtccaacttatggaagtactcaatcaaaaggcagaaaatatagtgtgtagttttcaaagataagatatatttccttgttgaactggtcctgataggaagccataatatatatagcctatgtcagagaattaaagacctttaggaaacttacgcagaatctacagcaacctcttattttatacttgaggaagctgaagcccagggaggataaatgactttcaaaaggtcagccatctagttattacggagttagagctagaacccagagatcctgtaagctattagagcacacagcttcttccgttgttttcctgcttttgccattattcatatgctgcaacattcacagtcgatttacatatttttatttggaaatacaattaaataccagaccattagcatagggtcaccactttgctggccttgaaaacaaaactttttcttttccttccttttcta

SEQ ID NO: 28401 - DNA, 715 bp, Bovine  19866881895525
tcatttctccttttccaattattatgtttaaataataatttaaaattgctgttcaaaatgttttctatcttaattaactgctaaaataaaccattgactggaagagtggatagacagcatccttgactctgttcagaattcactgggaactttctcagttgctgtaagatatttgcagaatccatgaattgctgcttcacaagtacttctcctctgcatggaaagcaaatatatcagtgcttttctttggttattttaaatagtgagcagtattctctacctttcatggaagttgcctgatacatcagctaaatatatattgttcaaagtaaaataacttgcctgttgctggactttgttagtaaaaaacagctaccagccctgagctgtcacaaaattctgagggttaaaatacctgtgatgtcatgattaatgtcagagagaaattctaattatgctggaatggcacagcaatacacagtgataaaatgaaaatgatgtatatagaatcttgctgttctagcaaccaagaatggaaactatgaaggtgtttattttatttatggaaagtgttacagctcacagttttctttagtactaatgactgaaactatagtaaagctaaaaagcactggattatgtaatccttagtatttgagaaatatgtgagagcatttaaagacatagaaccaaaaattctttaatagttaagaaa

SEQ ID NO: 28402 - DNA, 1747 bp, Bovine  19866880081373
catctctagggagaaggcaatggcaacccactccagtactcttgcctggaaaatcccatggacggaagagcctggtaggctgcagtccgtggggtcgctaagagtcggacatgactgagcgacttcactttcacttttcactttcatgcattggagaaggaaatggcaacccactccagtgttcttgcctggagaatcccagggacgggggagcctggtgggctgccctctatggggtcgcacagagttggacacgactgaagcgacttagcagcagcagcagcgtctctagaccaggaatttagagaacaggcctgtatctacacagtgacctgccttctgaaaccctttagcttcagctactggaagacacagtttttacatgttaactttaatatctgggccagtcttgggcatttttacttttaggtccggacctcaatttacaggattgtttaccttatatcataggaaggctgccttataacataggtgggctgatctctggagggtgcctttttctgttagtgggatttggcagggttcagccagtgggaggatggagggcagttgaagggagaagccgaggtgggggctctggcagctcttacatgctcccataggtctgcggtggtccaccccagcacccagactcccataagaacacttcctccttccctctgtcgctagtcaccaggctacttcaccatcccctgaggattctgagctgttgctgtgtaaccagtctcttgtatttcattctctctgttttaagtccccaggatggtctgtgttcctggttggacttgacggatacagtgccgctgaaacaccttctccagctctagggacataaagatgacaaatcacatgattcctctgatcgtatagattgaagagaatagtattcttcactctgttgccaaagactggcttccatccatatggaaaagttggcctcaattgcaagtgacaagcagacagtgttaatactgctctgtgaccttaagcacatagtctctgggtctgcatgtcttcatctgtaaaataaatggtataataatattgacctcatagaattatgaggattaaatgaatgaatacatataaagtgcttacaacactgcttggcacatagagagctctatataagtgttaactattattatttaactaaaaagagctcattatcttttcttgccagttattttaattctgaaaatggtgaagtacaaagctaatttgttgtaggattttcatgactttattagatctgtaacttgtcttcctgaatcagccaaagacaaatggaagccattaactttgcagagtttaatatttggcctgagctttatcatcattggaaatgctatcagaattagccacataaatttgttactgaatttggaaaacagtttggaagcattatatcttctatgaaattctcccttttgaatgattccttttagcattcagtccaaaaaagccttgttttccttatgaacctgtcaaagccttctcttttttcatcatggtaattatgtaaatggccataaatcctttttggttttggttgctggagagcgcagaactaaatttaaagtttagttgtataatttgtgcttggttgcccctgccccatatttgtttctacttaatttggccttggttttatcattcaattgattttttgattgattccattatatttcaccatttctgttagtgttatgggttacagcaaatt

SEQ ID NO: 28403 - DNA, 1983 bp, Bovine  19866880475420
ttctaagatacatctcaatttcagaggtgttaaaattaattttaagttgataaaatgtcatatgtgtatactttacttctatttcagcacataatagttatattccatttatcatagtaatataaagtttctcctttgaatgaatgtaattgaacaacatttgatttagcgtaaaatattgtataagttggagtagaggtggtatgtgagcatgctgtcttgttttattctttgcgactccatggactgtagcccgccaggctcctctgtccatgggatttttcaggcaagaatactggagcaggttgccattccccttttcaggggattttcccaacccaggattgaacctttccatctttgcatctcctgcgttgcaggagaattctttacctgctgactcattgggaagccagaggtggtacatagtacgacaaaatcctggaggtggtagccaagtgactgtgccttagacaggagtctagtcccagattctgtcccttgttcacccctgccagctcagaccaacccggccaccctctagccctgtgcccagatccacatgagggagagcctgactcttccactgagagtgggagaggagtctgagcccatgctcaggagtctgagatgcccatgctcaggttgaggaatgtgactatcattcattgaagttatttgatgagagtgaaaagaaatttccaggaaatagactcattataggcattggaataacctggtgtgtgtgtgtgtgtgtgagtttctcagtcgtgtctgaatctttgcaaccacatggactgtagcctaccaggctcctctgtctatggaattctccaggcaagaatacgggagtgagtagccattcccttctccaagggatcttcccgacccagggattaaacctgggtctcctgcattgcaggcagattctttaccatctgggaatcccagggattcccaggagcaatctggacttgcctctatttaaataacagcatactcagaggtttctcttttgttttcttttgaacacaagaaataagtgaggagaggaaaagagcatttgagtctctgctgatgagcaatttattcactgaaaatggctgaaaagtgaaagtgactcagttgttgtcgactctttgtgaccccatggactgtacatgggattctccagtcagaatactggagtgggtagcctttcccttctccagggatctttccaacccagggatcgaaccaggtctcccacattgtgggcagattctttaccagctgagccacaagggaagtccaagaatattggagtggatagcctatcccttcttcaggggatcttcctgacccaggaatcgaaccagggtctcctgcattgcaggcagattctttaccaactgagttaatggctacctgagcactaaacactcagtttcagtgattatcaaaccaaagaatggtcgactttgttcttcataatagatttgtcagttgagagtaactatgaataacctgaagcaaaatgtatttcattgagaaagtagagaagcagctgatttccttcttccagaataagaaaagtaaaatcactttagaggaaagagtgaaaaagttacgttactattggtgaaactctgtgcttttgtataccatctccctggatgttgcaggggatttgtgttcctcatgcttccagctctcaccttgctctggatccagcctttggactgcagtgcacacttccctgggagccacacacagaaccctccgattaattcagtgcttattcttgaaggttattgtcatcattaaccagatgcaatagtgcaggagatcacaagccatataggctctgttgctttgtctgtttttgcaaacttgatttgggaaggttttaatggtaggtgtaattggagaagataaattgaatacatatgcatattctaataaaggtattcttccaagtcagccaataatcacatcatatta

SEQ ID NO: 28404 - DNA, 1729 bp, Bovine  19866880480380
cccatctcccccagggtgggtgcacactccccatctcatccatcagcaatcagcatctgtcttccacatgctctcaccaccacccttcattccctcactgtgcttgctgtgccctctgtcagatggtctgtctgcaggccacactgtcaggtggtcttgtgaccctggtcacttgcatccctggcatatagctcatggaaggcctggcacaaaagaggcagtgaggcgactttcactggataaatacattctattttgcgctgggttgggtgccatgctcttggtaatcctccacttctcatggatgagaaagctgaggctacaaaggctaagtcattgcccaggttcaagcacaagtctgtggacctgagcctacttcctttgcactgtgccacgtggtggcacctggcacctcctcttccaggttagcaccttggcagctcacttgtgtttgatctctccccacagcactcacatgaaagttaccttacctcagcaagaaagaatgctaccaggagcatatggaatgtttgctgttactcaggagtgtgagtgttgctttgaacaccagagcaaaggaatgtaggtcaaatgattgccctgcccagtatctccgtctattacccaacttttctcatcccatgtgtgaggccacaagtggaagatagctaaatggaaaattctagaagctttgcaactatcatgaaaacaaaaactcattaaatcaagggagggattttaaaatcactttctgtttcagcttatgattattctaatgcagaggttcagatttattcatttgttaagagtcaagcaggtatacaaaatcacagcagacccctaaaaacataagtcctatttagctattatgaaaataaagtaaatatgatgataaagaaaaatacataacgataattatgggtcaggtatacacatcacaagttaatcctctaacagccctgaagttatacactatcaatgtctgcatctgtaaaatctgcaaagcacagagaggtcaagtaatttgctcaaggtcacacagctagatgggacagaaaggaatagatctagcccagctgcctccaaaacctgtgctaggcaatagcaactttctagtttgcataatatgaatataaattacagtctctaatacctagttttatatttttaagaaaaatgtagtacagaattagtctaacaacatttcaatactaattgtatcttacaaatgtgttgtctataataagaaacttcataaagttgatgtttaatttcttttaagggaaggaagagaaaatcctttggaggaaaaatttcaaagaaagtcttaagaaataagcagttgtaggagtttcgcattttaacctaagagaaatgtaaagacatctaataaaaccaaattttacaatgacttgctggttagtgttaccagtggggcaaaataaatatccagggtcaaaagcacgtgatgaccttactactctatcaattctatgttgcagacatgggagcaaccattccctcccatcaatttagacaaattaaaataatagattttcaagtcaatagtttttaagagtgtggggttgaactagcagctgtgaatctcctgagcagcagaaatccaaacaccaaacaaaagagaagacagtcatggaaaaatgggtaattcagtcactgatcatataagtccttgttctaactgaatgacatcatcgaaagcaaaaca

SEQ ID NO: 28405 - DNA, 1099 bp, Bovine  19866880491650
caactttacttacacctcaagactcaattaagcatcactccttctggaagacttccctgggcggtccacattgagttaaatgccctgttccaatactttttttcactggactctttgtctacacccaccctaatattttgaaacccaactgtaatcactgctgttcatttcctttctacgctgtgaactgtttgacctctttcaactctttctttccagaacccagcacagtgcctggcacatggtagatatttcaattaatgaacagagaaatggaaaaatgaatgctgttgtcttctgaaggtagcacctccctactccagggccttctccagaagtctaggtcctggacagttcctgcaggacttttgcctcctgattgccttcttcgccccacctgacccacctggttctagctgtaacccaactgtccccatttccgctgagtactttctacttggtgttccatcaagatgagtgttgcccaaagtgtgatacacagtaatttttaggtgatactcagacaaatgtcttttgacagtcttgtttttacattcatatatattttgcagaagggaatgcacgcataaaacctgtaatttcacagagaatattgcttaggatgagacaaatgtagtactgtcctgggaatcaagcttacttagacctcataaatcaggggtgcggtgctcaggcataatcataagtgttccaagccctcaataatggaaccctcagcagtgcccattagaagcatagacaaccaagagggaaggactcccacatactgaattttacaagtacctctgtgttttattaagtgatatgttgaaatatcacttcctaaagttgctgagtatatatatgtacacttaaatatagcagattaaatagttgaatatttttgagctgtcttaaccacatccttggtcttcctaggtggtgctcgaggtaaagaatccacctgccaatgcagaagacataagagacgcaggttcaatccctgggtcaggaagatcccctggagaagagcatggcaaccactccagtatttttgccggagaatcccaggatagagaaaccggcaggctacagtcca

SEQ ID NO: 28406 - DNA, 1683 bp, Bovine  19866880498126
tgagcaaaatagttccattttggaaaagttaaatgtaaatgtaaattagtagcagaaacacaggtacaacttttctcttttcccagatcttttttctactagaagacttctactaggcaactatccttccaaatacctgagttcttctctaacccagatactatcatgaattatccatgttgtcattgttcatattaattagcaatgttatgttcaatttattgcccaagaaatattttagggaagtaaagttagatctttattagtcatacatttacatatctatgtgtaatttttctaatttattctgttttttctctttaggaacaaacaaaaaatgcccagttcataataatttctcttcgaaataatatgtttgagatttcagatagacttattggaatttacaagacatacaatataacaaaaagcgttgcagtaaacccaaaagaaattgcatctaaaggactttgctaaacttgcttaatctgaagatttttcatatcttaccatagactcaacatgttgtatttctctatgtaaagggttataaattatataaaatacctattcttaaattgtatcatatagtttctattttatgctgttaattaagagatgttacaagtttaataaaatattctctatgcctgtttctaagagattgtaagaatctgacagttttgtaagtggcaactatggagaaaataagatgcctggactatcagataacttccccttatgcagagttaaaagtatattactttgatgaaccagtacagttgtaaactaaaccatgttaaaccagtgattctgaattgcaagaatgagaattttaatattatacattcttaaactcagtgtacttgactgtttaaaacatttgtgaaagggccagcaaatgtctgaataacttgagtgggtatatataccactatagttgcttcagaaaaagaatgatttaagtgtataagggttaatttctttagtataaatggaaattaggatgcagtactgtttgtccattaagttgtcaaaggctttcttgttactgtgttacactgcattaactcagaaatatactactggaaataagctggcaaccacttcattttcagaaaaatcctggtattgaatcagaagtctggtctaagctatttggtttctagatagagagcctgaggaattaaaatttaaaattaccttgttattcatagtgcattgtttaggtactaaaacccaacaaagacagtctgtatcataatcagtaagatgtaaatacatgagcatgaacttaaataaagtaagatctaaaattcaagtatggtcatttgttttaagattatacaaaggaaaggtaactagaaaaaagtatcagtataatccaagtcttttcattggtgagaacagagatggatttattattttttatgttttcataaccaatagaaaagtgtagtgcttttaaaaagttaaagtagataatgcccatagcccatatgaaaattccacatcaaccactcctgagtttcagcaccttattaaccactcaatgcaaagatccaaatgagtttattacaatgtaaacttttgttatacataaaaacttagaaatgaagattcaagattatatacttcaaattttacaatctcaccctcaaaaatacaaaagggaagagcagt

SEQ ID NO: 28407 - DNA, 2734 bp, Bovine  19866880548623
ttgtctttctgacttatttacttacctgataatctctaggtccctaataagcttttaactataaaataaacaaagaggaggaaagtagaagtgagaaatattcagttataactgtatttctcaaagtttgatcttgcatctgaattatcaaggatgcttgttaaaattcatatttctgagccccatctcaaacctattgattcaggatttctggaagtaggaattaagattttgaatttaaaaaagctacctaggtattcacatgaacattgaagttcagagcctcacagctcatacttaggttactacaactgtctgttagctgatgtcctgcccttgtgttttccttcaatcatttttggaatactcctaaagatctacatttgataaatgtggcatggttcctttgaatcacctcattatatttaaattttcccttgatgacaaaaggctttcttcctgccttttcaatgccttctcactggccttgtccccagctcctccccagaccaattgtctatctgggctaaaataagctgccttcagactactcagagaagctctctcgtggttccattgagaactcaaggggctgtcactggggaaaacagattggctctagagctctccatcttcattccaaccagatcttcacttgtactacctcataaaatttatctggggaaaaaactcttgtggatacaataaattaaaagcaacaacatcaatagcaacaacactgtcctagattaaacttcctgcatcactttcctatctgcaaacacttccattttctttgtgtgaaacccctgcccatctctcccacttcgaggcttccatatcaacaatccatagtctgtgcatcaaatttaaaaaccttccttgagatgcagctggatctcatctaaccctccatcctcagggttgtttgtgtcattcagagctcagatcagctcatggcaagtgggtttaacaatttctcattgttaaattataactatctcagttatatccttcatacaacacacatttatcaagccactgctccagaccagggtctgcactcagccctggaaatagagtaatgaacagacaaaagttcctgccccttgtggagcttacatttttatgtacatgtcccctgcctcaaagaaattctacgttctacaataggaacctgatcttctccttgttttatatcctttcaaatttcatggtagaaataattaattaactccattataggaaacatgacccaaaattcatgacaaagctatttcatgtcttaatgtaaaaactttgggtttttattttctggttgctgctgctaagtcgcttcagtcgtgtctgactctgtgcaaccacatagacggcagcccaccaggctctgccatccctgggattctgcaggcaagaatactggagtgggttgccatttccttccccaattttgcggttacttgaaaattaattttgaacaataatttgtctgcttcatacttatgtttcagattgtgtttagaatcagagacccaaaatttaaggggaaaaagtaaatgacggttatttgcaattttttaattctgtaatcagcacgtcaccattcaatttttctcacactttttccttaagtggctctactatccttacaaaaagaacttgtttaaattcccaaacttacccaaacaatttgctttatttgccaaaactatgaaaagcttttaagaaggggaagttctcccagttcttcttatgcattccagagtcgagaacagtttttttcttacctgatcatagatttagtgagcatgaacttcacacccatataactcaagcttgacttctgatgtccagcaatgctgagctaatttattcaggccaattctcctattgaaaatcactaaaagtactgaataaaatatgctttcatcttcactaaaaagcatcagtaagccaaaacattagcaaggcattaccaggctcagaatagatgacaacaaagaaaagtaggccaagcacttgaggctgcttttgttccaagggcatttgcctttttggactatgaaactgagctgtggcctcaatggaatcctggggtgagaggaatggaaatcagatcccagggcccgttgatgtggagagtataataggagaaccccatattacagtgaaacacaatgggctcccccagaggtcagttcatcccctcccagccctatcagagagctatgaaaatggttgttttagcccagcacagatcagagcacaaagaaaaggaatcccacccagaccccaaaagactataaccacaggaatatttgaagcctcaaatgtgcagcccaaatttgtatcactgcccaaagtctagtttagaatgataccagaccgtctacccaagcccccaaaagaagcaagtgcaaacctcctctagaggaagttagcatcatgttatcgagcctttgagagtcctcaacatatacttgctcaagtggtatgaacagcagagaatcaaaggtaaataacacacacaaaaaaaaacaaggcagcaggaagaacaactagtagaaagaacatgggacttccctggtggcgcaatggataagaatccgcctgcccatgcaggggacatggatttgatccctgatccaggaagatcccacatgctgtggagcaactaagcccgtgtgtcacagctactgagcctgcactctagagcccatagccacaagcccca

SEQ ID NO: 28408 - DNA, 667 bp, Bovine  19866880588572
ttgaagatgtgtaggtaggaacataacattggcccttttccccaatgctgggtgatggatattcctaaatttccacataaggaatccattacagggctacctcttccttcactcacttctgtgggttattgttttaggaaggagaaaccagaaaccaactctatttcctttttctccaacatttatctgagcaaatgattagatcattttagttaatcttcctaaccttttcttccttttgcaacctgaagcaattttctctcataatacaaggaattatttgttattcttcttctgcatctttttcatatttgtggatagaatagctgccctttgaacaagacaattattccctaaaagacagaaatgcgcttacttcccctatggttctgaagtaattatataaacaaaattttagaatgcaagtgagaatagcaaaatagaaagagcggttggcagagttaattggctgatcttcttatgtagatctaatttgggatgtcaattgaatttttggaaatcattgcttatttcctttgagaattatttattgctctgtgtaatctgaatgtataatacatagtttgttcacttctgcattatagcttgattgagaaaatctatttctatcagggagagataaaaaatattttgaatcactttttta

SEQ ID NO: 28409 - DNA, 1183 bp, Bovine  19866880589602
aactgtgtttatacaacttgattttcttggttactggtctccattttgtaaattagttcaaaccaataaatcaaactccatttcgtgccaggagagagctgcaacctaggctagcaagccctgtgtggagatctttgtacaagaataagatagtaaaggttgcaatcttaatgcccattttatatgcatgacttgagttgagcccttatgcataattcatgcggtcatttacaggcttttacacgactccccctttaaaagttaactaacaaagggcaatatcagccatggcaacaaggatattatgtaaatctatctcggtaccaacataagagggggtgggttgattaattaaaaagacagaggaggacaggaggcaaggtgcacatgcctcttgatgttactcatcatttattaatgtatttaattgaaaagaattttgaagcgtaaatatgtgtttgtatattgccactggctgggagagcactgcttaaccctgtgagcaaccatttgaatcagtggaaaacacccgatttcattcatttcatttcctctcctttcaaggaacagcatcatgagaaggtgaactaagtcttgggtttgatatcagctttagcccattatactaaccgaggtacttaactcctttgaggctcagtttcttgcatatagaatatacactaaaatacccatttatttacctggtacagagtgggaggggactatccaagggtatggataggaggaggcaggaaatattgggggtcatctggaaggcaagcaaccagatgtcagaagcagagaccaaggtgattctcctaaaatcactgggacgatacagagccaagtcaactgtacaggttgttcaactgctgttcattgaattgctggagggaaccaaagtagaaccctctatcttaccaaatggaattttgaaattttcatttccaaaagctgatctgaaagcagtgatgggggacttccctggtggtccagtggtaagaatctgccttccagtgcaggggacacaagttcaatccctggtcagggaactaagattgtgtgtgctgcagggcagctaagcctgcataccacaatgaagacccagcacagccaaaaataaataaatgtttgaaaaattaaagcactggtaatgtctgacccatgagtatttaaaatattt

SEQ ID NO: 28410 - DNA, 5576 bp, Bovine  19866880592179
ctggcaggctacattccatagggttgcaaagagttggacatgactgaggcccagcacagcacaaaaatttccacctaattgcagcttacccctttacacactcctgtcctatttgagtgtgatatacacaactttcggagaaggcaatggcaccccactgcagtactcttgcctggaaaatcccatggatggaggagcctggtagcctgcagtccatggggtcgctaagagtcggatatgactgactgacttcactttcacttttcactttcatgcattggagaaggaaatggcaacccactctggtattcttgcctggagaatcccagggacctcgggagcccggtgggctgccgtctatggggtcgcacagagtcggacacaactgaagtgacttagcagatacacaactttgcaaaccctcttttggtgctgaccactgcatgatttgcttgaatttaggatgtttgctgagacttcagtcaacttcaggtgctgaaggtctcatcatcagatgaatgtgacagggttgcatgtttattttattttttaaaaatatcatgaggatttattacataactatttaaaaaatatttatttctttatttattggctgcgctgtgtcttattactatgtgtagggtactctctagtcgtggagagtgggggctactctttacttgtggtgcacaggcttctcattgtggtggcttctcttgttgaggtgcacgggctctggggctcacaggctttagtagttgtggtgcaatggggccaggtgccccacgacacgtggaatcctcctggaccagggatcgaacctgtgtgctctgcattggctgatggattcttaaccattagaccaccagggaagtcctgcatgtttatttttaaattcaaagtttccggaaggtggcatactggggtgtatgcacataaaaaggaaaaccaaaacaagtgagagtctggagagagtctggaagtctgtccgcctgagaccgttcaaaagtcaaggcttagaggctgtgactggcagaaatcctgcccacagtaaaaaggcagtgacgaaagtacaatgaggaatttaaccagaaggtgacagggtacactcaattcctcctctgttgtcataaaaaaagctttccttgaaaagatgttttaatccactcagttgctcaccctagggtcacaggagttaaatctgatctaatcagtagtaagaaggtgttttttttttttttttatagtaatccatgaggaaaacgagctgaattgtaggcactttttaaaaagtcagccacagaagtacagatatgggctaacaccaaaacggacgcacaaaagtggaaaaattactttaaacgtggcaaagtgcttcttagtgtgactttctttccctggaaacaagatgcagttcagtgtccacgttgctttgtgtgaccctttaaggtattagactctgctactcttactggtcaaacccattgcttgattttctctctaaacctcaccagccaggcacgacaatctttcttaatccacaaagaaatttttttttttttaacttgagtatgggttgtattttccatgttcatgggctgctgtcagcttagttttatccatcatagatatttaattccttcacttggggcacacataatctactgaatgcttcagataaagcagtcatattgacagcggcaaggaatagagatgaaataatacagaacctccttctcaaagtgcagacaggtacacaaacagacaagtatactatacatcacagatttattctatttatacataatttatgtcataggttagggtacctatccaagtctagagaaaggaggggtcagggaaggttttctgtagttggtgatggctgagctaagtttcagcaatgagtgggaattaactgggcaagtaaaggacagagtaaacaggatggagaaaacatttcagggagaggtacagcagaagcaaaggcctggaagctagaaacagtgtgaaccaggcaggtcagagagattgctttctcagagcacaagggagtcgcataaaatgaggccagagacgagaaggactcatatgggaggtctttatgccacatttagattaggctttgggctgccctggtggctcagacagtaaagaaactgcctacaatgcaggagaggtgagttggatccctagattgggaagatcccttagaagaagggcatggcaacccattccagtattctttgcctgcggagttctgtggacagaggagcctgatgggctatagtccatggggtcccaaagagctggacatgactgacagattaacactttcactttttcactttttcctgaggaagtcattaaaggatctaagaaggagacccacctgaacaggtaagacaggtagactaggggagggacttaaagagtgcaaggctggaggcagggagaccaggtgggagaagctatagcagctagattgagaattagtagcatttgcaagattgggtcagtagctgcaatggggaggggaatgatttgagacacatttagaagggaaaactggcaagacttggtgactgatttagtctaggaaacgaagagcggggaggaatcacgtgtatgttggtggtggccactgccattatctgagatgaaaagtactggcatagacacaagttagaggagaagatgatgacgagttagtctgaacatgttacatttaagatagtttgtatactttatttattctccccctgtcttcaaaaagtaaaggagtgttgaacatctctagaggttcagtgattaagactctgtgcttccaatgcagggggtgcaggttcaatccctgggcagggaactaagactccataggctatgcgatgcaataataaaaaaatttttttaaaaatttaagtattgcaaaaaaagtaaaagagtgtataagctaaacttaactttgatctaaaataaaggtaacaaatgctgtgttaatggacaacatcactgatccatcagagcaccctgttcacacagcccaggcacagctccagcatccttctcagcacactgcgctgtccccacagggcagccaccatgcttcatacaacatggcggccactaacagtccaatggagagtgcgtgcattggaagcccatgatgcctcctaatctaaaggcttgagagaatatcattctttaaagttacataccatcatttggaggtacccttgccaaatttaaatatgcaagactacactgatctgcagtagcagggtcatagaagaagtcataacatattcctggggccttccctggtggctcagatggtaaagaatctgcctgcaatgcaggagacccaggttcgatccctaaattgagaagatcccctggagaaaggaatggcaacccactcccagtattcttgcctggaaaattccacagacagaggagcctgtacagtccatggggttgaaaagagtcagacacaactgagtgactctctttttcacacacacacacacacacacacacaacatattactgagagattcctaacttagtttaagccaaggcagtgcagactatggtgatcaatagaatttagtttaatgtttgttaaccgccttctctgtgatgggccagtgcttcttgatatgatttcagtaggtcacaagcctggaaggtgtcaggaatgggcaaagatcttgctgttcaggtgagatgatttgaatttcatccccctctttgagatcgcaaggcacagcagcgtattagagacagagaaatcctacagtaaagaaatccactgaactaattttagcctggtatcatccagagttattctggccagggaagcctcctgtcacatactgcaagtgaaatcaggaatatttcaatcctcatagcatatccattttccaaatgaggagcaaaagctctaaagtcctgaaggaggaaacagaacaggctctatcttgaaagcaggactccatcttgggccggactgtggactttgagctacatgtccagtatctatggaaacgacacaccatctggaaaaccaggcccccagaaggaagagccccagggctctccatcgcctaaaagaataccctaattatctgtgtaaccgaatagaatcatacattctgttatgcttattgcggtatgaccacaagcctattgataattgtccactgttaactacctaggcttaaggcttatgaatcatgggttaactttgattgtatctttctttttcctttgttcagactagattcagggaattttggggaggtgggtttggatacgtccacttagggtatataaggttttcacaaaaagctggttggggtcattggctaagaggaggctctgctttgggccctccagtgtaacaaactgcactccgctatctgcattatccttttgagtgagtttgtttcccggaacgtgtggctacaacattttcagcaaggtcttcggtgattctaaagcagaccggtcattcctggaccgcacgctgagaaacactgcttacaggactaaaggctgtcgttattcttgagatgagggtgaggaaaaaattgtgagtgatttgaggttatgttaagtgtttgtgtcctcactgtatataaagttctgtgcaggaccctgagtgggagacaggaaatagaaactcaggtctgcatcagccatcttttatctttttttttattggcatatagttaatttacaatgttgggccagtctctgctctacagtcaagtgactgttatacacatatgtacattcttttcaaaatattcttttccattatggtctctcccaggagattgggtatagctccctgtactatactgtagggccttatagtctatctctctaaatgtaatagcttgtgtctactaaccccagactctagtacacccctctcccttccctctttctcctgggcaaccacaagtctgatcactgcatccaagtcctccttctgtctttaattgctcctctaaggtttgaaccgggggtaatttatcccacatcacagtatgatcaggtatcctcttttcctatattcgcttccttaggtcttatactagaagtttactgtataaatacacaaacaagccaagaaaataataaatactgtagcagtagtagcagtagtggcacctgaatgagggtccagggctacgcacaatcaagggttttctgtggtctacatggaagtgctgtgatcacactgcgtagggagacctttcttctaaagaagggcggataaggcgtccgtcttcagaacagcatttgtctgcagcctcattgcttccaatggggccagagtctcaggggcccccaccagagttttaggtgaaaaacccagggtactggcaaagctcccattgagagggtcaccttcatgtgctttaaacctctcaaccccttgcatatgtcctcctcccttaattacagtctcatggttgtggatgggtgggatcattcttgatcccttctccgggcaagatattttcctgccctttacttcacctgccaactgaacaactagt

SEQ ID NO: 28411 - DNA, 2203 bp, Bovine  19866880691355
gatgaaaatggactaaaactggatcgtggtgacagtcacgcaacttgctaacctggatggagccacttcagagaaaacgatgtgcatggcctcatttttgtgacattaaatgatttcctgagacttgccacagaagagaccccaaagcaagcccaaataacaaaactctaaatttgtttctcatttagcaaagtggactatcatcttcttacatactttccctctgcttacgaaaggttaccttggtttgtttactttttatgggaagcttgcaattgtctaaatactagagtttcacttgaagttggctgcagaataatttactttggggtggtcagacacaatatccaaatgttaatccacatagggtcaaacttacttaagccatgacgttcaatcctgtttttctcatttggctaaaaaggaatttgaagggtttccccccccacccccccagtcttacaacacttaggaataaacctttctttccattttacacgtatttgtatttcataaaaattgagagtctcatttcatcctttcctttcatttcatatttcctgcatgaaatatcatgcagatggatgtaggtataaggatttcagccttgtggaaaatattcttttagggaagagaattgggtagctgggagtttaccctgttgttttagtcactaagtggcatctaactcttcttgaaccccgtggaccagaggagcccaccatgctcctctgtcctgggatttcccaggcatgaatattggagtgggttgccatttccttctccaggggaatctctccaacccagggattgaacctacatctcctacttggctggtaaattccttaccactgagccacctgggaagcccttgttctgttagggatggtaacttttcagtatatattctttagcaccattagaatgtttaccatgcatattatcatccattgaaaaaaatttcatgttttacagctttacacttaaatttggtaaaccttaactaagttaataagttttttaaaaatggaattaaaatattctaatcacttttgtccaaatataataacagtgaaatactgtaagaactctgaccaagttttaatgcatagttaaataagaaagttatttgaagtcttcagtctctccatctctaatacaaagctattatgaagattgatggaataacttttgtaagatgcagaatcattgagatggagttttgcagaggtaactcacccttggacagaagtaaaatgaagttcagctgcaaaagcaatagatctctttgtcctggacatttgttacttactcatcattggatcatttaggttgaattggacttgacttatggtgatcaattatgtcattttgtattatgggaccaaattcattcttggatccttggggaccaagtttagcattaaatatgtttgcaacagcaacttcataatccacctgtcaatttattccactgcctagtcattctcttgcctgtacaattactttagctgaagaaatggtaatcaacataccttaaaattgtgatggcacattacagttcacttaccatttctatcaatacatatctcatcacattcgaccctcttagcaaccctgtaggggaggcaagagagacattacaatgtctgcttcaaacagtcatagttaaatcgcccaaccaggaatcagggaactgagattagaatctaggttcccccattctccttccacccagttatacatattttaccatatgtatgtaaaatttcagaaaagggtgtatttgtgtgtaaaatctgttttgttatattagaacacaaagacaatgtgtgtactttatcataatttctcagttgttttttcttttttctgaacggaattcacatgggcattgtttcatctgctttttgaacttactttgacaattatattacctaaattcacatgggtagccaaagagggttcttgtgcaatgcggaccattcattttcatagtctcatttatgactcacggatttgtgtgggcgttgaagagaaacatctaaagaaagaggaatgggaaaagatttctttctatatttaaatataagtaatagaaagaggctgagctaagttataaataacagtaaagtgaaatgttctctggaaaatccatggcaatatcattacggctgcctgggaaatgtgaccacttaaaact

SEQ ID NO: 28412 - DNA, 2114 bp, Bovine  19866880693071
aagttacctaaaataaaaatcacttttcctaattagaaccttccttttctaagtttttttccctctaacgtatttttttttctttctttctttttttttttttgctgtttggtttactaagtagaaaacttagatacttagatgccataaagcagtggtctgcaggcttttttgatctcatatttatcagtaaaatgtttttgaacctaagccattaacatacacgtatcccactcataattacacatgcatgctaggtcacttcagttgtgtccaactctttgagaccctatgaacatagccctccagactcctctgtcaatgggattctccaagctctaagaatactggagtgggttgccacgccctcctctaggggatcttcctgacccagggattgaacttgagtctcttctgtcttctgcattggcaggcagagtctttaccactagcgccacctgggaagccccataactacacatataccgctgtaaaaatccatcttgtgtgtatgaaatttatacactagtcctttggtatccacaggggattggtttcaggatccccacagattctaaaatccccacaaattctaaaatcccaggatggtcaagcacgacatggtatttgcatataacacacacatcctcctatatactttaaataatcttcagattacttatagcacctctctctaacctctgaatgctcagtcatgtctgattctgtgaccccatggactgtagcacaccagacggctctatccatgggatttcccaggcaggaatactagagcaagttggcatttcctccttcaagggatcttcctgacccagagattgaacccacgtctcctgtgtcttctgctttgcaggcagattctttacctactgagccatcaaggaagcctgcttactactacttaatacagtgtaaatgctatgtaaataattgtaaatacaatgtaaaagttatacaaatagctgctggatgcatggcaaattcacattttgctttttggaactttctggaagtatttttccaaatatttttgatctgtggttggttgaatccacagatgcagaatctgtagatgtggaggactgactgtacacaaataggtattttcaaaactaagatgtttaaaatataaccaaaagcaaaagttttagtaatttcttctttcacctccttatattctgaggtcagttgtccaaaacaatttgaaaattggtatatccctgcctgggtacaatagaatttcctataccacttgcactaataaataccgccctgtgtatagggattattttacaagtttgttttaaagtcaggcaaacagccttcaggggaaaggtcattttacagtgactgaaattagtttccacccaggcagaggaaggaaaagagtacgcatctgtttcgtttccttggggaaggtcctgttggtaagaaagatgtttcatttaggacctctggttttttcaggaacagtagtaagactgtactcaatggaaaacgtagctgaatatctagaaaggaaagcgtgcaccttggcagaatccgagggtggaacgttcagtgcattatggccccgccttgctctgagcagcctctggccctttggtcacacagcccattgtcttcaagcacaaaggcacacagggtcagtgtcctgattccttcagctatcactcaccaagagccctcctgggtccctggctttgtgctcggggtcaggatcacaaaagggaggttgggctttccctcagggagcttacagtccacatggggaggtacacacacacataggctgccctgaaattgatgccacctgagagggatgttcagatggccgatgtggacctagaaaaggcacagcccatgccatctcagggcgagggatggatccaaactgtaccagtggaggggaggggtggggaaatcaagaaaatttaacatgaaatacagcagaggactggctcccacttcgtgccagagcagagcaaacacagggaagccggcctggctttctgtccccaggctactcctggcagaaggagccgcagccgcagccgtgtgtggttggaggatgggcaagccggctcgccagg

SEQ ID NO: 28413 - DNA, 1421 bp, Bovine  19866880723085
tggtgttggagaagactcttgagagtcccttgaactgcaaggagatcaaaccagcccatcctaaaggaaatcagtcctgaacattcattggaaggactgatgctgaagctgaagctccaatagtttggccacctgatgcaaaaactgactcattggaaaagaccctaatgctgggaaagattgaaggcaggaggagaaggagatgacagaggatgagatggtttgatagcatcaccgacacagtggacatgagtttgagcaagatccgagagttggtgatgaacagggaagcctggtgtgctgcagtccatggggtcacaaagagtcagatacaactgagcaactgaactgaattgatagtgaacagaactataatgtgtatcctctttagtatccaacttgttttgctcaacatactgtctctgagttttatccttattgttacatgtaccagtggtttttttccttttccttgctgagtagtactccactgtatgaacctactacaatttgtgtgtccattcaccttgatggccatttgagttgatttccatttgggggcaattatgacgaaaactgctaaacacattcatataatgcgttttttgtaagcacatggcactcagttctcttgagtaaatacccaagagtgaagtcagtgggtcctgcagtgggcttcccaggtgatgctagtggtaaagaacccacctaccagtgcaagagacctaagagacacaggttccatccctggctcaggaggaccccctggagaaggaaatggcaacccactccagtatctttgcctggagaatcccatggacagaggagcctgacaagctacggtccatggggtcgctaagagttgaacgtgactgacttatcatgccccgcagtaggtgtgtgtttagctttagcagatacagggacatttaatgaatgctattcattcccatacataaatgaatggaagaatgacactttcgtgccacagccagctttcatacactaacagaggaatctatgaatttggggttaaaaggagattgtcccaaataaaaccttttagaccggggctgtcagtggtttcagggcagagcatgaggctttcaggggcaggaagggaaagaagctccattgaaagacccccagggagaggcagctcagagccaagcgagataggggctgggaggtgtttcacatagaactgagagcagggatctggcacagacgtgcgacctacacacatctgtgcccacaaagagagcagtagaatatgcttccagggattctctgtcatgtttcctaattggttgccttcaccttgggagtctttagtcataaaacatttagctgcccaaacattatcaattcagccctatggataatggatcagccatataacccacaatgagtgcagctgt

SEQ ID NO: 28414 - DNA, 1356 bp, Bovine  19866880738621
tatgtgtgtgtgtgtgtgtgtgtgtgtgtgtgtatatggcttcccaggtggtgcagtggtaaagaatctgcctcccaatgcaggagacacaagagactcaggtttgatccctgagtcaggaagacccccccttggagtagaaaatggcaatccactccagcattcttgcctgcacaattccatggacagaggtgtctggtgggctagagtccatggggtcacaaatggttggacaccactgagcatgcatatgcacatatatatatccacacattcacccatatatttcctttatttgctttattcccttgcaaacaattcttatatttctgattattgacccaaaggacaggaacatttacatagaagtcaatattttagagcattcaacttgtgaggattaatgaaattacgaagatatttaagatcccagggtaaagagaattctcactgtgctataaaactaatccatttctctgtgaaacaaagccgtgttcagcttccaggaaaatcaccagaaacaaatagcatttcctttcagctgaagcagttttcctctgcctacagaagctattgtttacataattacgttagtttgggattggctgagccctttaacctggagtggggctattccaggctgacagatgtgctgctgctgtgggtttggattcatgcccgagggccccattagtgtttggtcagcgggttccacgccggcgctcgggtggcacactgcctgctaagctagcaagcccgttagctcgctgggcccaggcctgaagcaaagtgggagtctgggaaggctgacagaaaacagggctgctttggggtcatctcccaaaaacctctggaacagttcacttctcacttctgtgataaaatgggatgctgctgagatagggggaagggtcagaggctgtgctggcggccttgcagctgggagacagatgtccttattaaaatacatgcctgcaccccccttctgtttcagctgcctttttcaaaagaagcaaatatagctgttaccttattagaaaatgaaaggattggcagcctcactgggggaacacaatggtttcactccaagctggctttaccccaggttccagaggtaccaatgaataatgtgtgagacagagttggagactatttacattcactggaatgtggaaagagtaagaaccctagatgcctgtgaataagttttctgctcctcagaaaccctgagcccttttagccaagtactcaggaaaggtagtcctgcatttttgtttgaagttctcgaatcatctcccattatagcctctactataattgggattgacacagttgttgcttctctgcagcacgtgt

SEQ ID NO: 28415 - DNA, 1853 bp, Bovine  19866880766114
tattggaaaaaattaaaaggaggatgttggaatatagggctgagtctgttgaaaaaaaattgtgtgggtgacttgacatgatatgggaaacatcctacttcatttggtagaggaaatccagtgcttccacccaggatagtgagagagaattgtaaggaatttaagttattaaaaaaaaagggaggacttccctggcagtccattggttaggactccttgcttccaatacagggggcatgggtttagtccttagtcagggaactatgatcccacatgccctatggcacagccaaaatattaaaagaaaaagaaaggaagggaaggtgaaagtagaaagaaagcaactaaggtgttgtaaccctaaacatatgcacccctgggtcacaagttcctctatcactgggcatctaaccactcctccctagtacacatgtttatctttgttcacccttggctttctaatgatttccagtggattccggttagaatcctaacaggtcttatccagtggtcttcagtcaggatcacagtgaaaaacaagccaaaaaccccatttgctctcactctgtttgaagtaccttcacatcagcccaactttccacttatgctactgactagatttctggatgatggacataagaaagaaagtgattctgttatcaagcatcctacatagctttgatatcatccccaagatctgaaactatgtgctgtcccatttgtgagctcattaatctctgttctccagtgggagctgtaaaattacaaagaactgctcagtggaggtctgtaatagctgtccaatggcagcatcaccaaccacaggcatacttgcctgagcagaatgggattgcctattagggggcagggaggtcaggtagcagggggtttgagctcatcgaagtacaggcttgtttagaatttattgacgtgttgttaaatgtgttgcagctttgcctagtatgatggctgtttatttattgatttttcaaaaaagctttcaatattgtggtttgtttatcagggagctttgagctgttaaaagttgacctcaaaattgatgtaattaactgattttagttttctcagtttaattgatgttgaattacagacaaaaaaaatgtgtgggggtgggtgtaattttctagttagttggatgtcgtttttgggttttatagccttctggttactcaacaataactttccaaatgttagctctgctttgattattagctttatgatgattactttgccattatgcctaatcaacagctgtgcagaaactcattttaatcatattttcctgcttagaaattagcagatgaaggataattactgttgaatagctccagagttctgattggctgcttcctgtgtaacactgtcaaaagatggaaacttaaatataaaactctcgttttaactttctaaataaacaataaggtcttggcctctttttgaagccaaaaggctgagaaggagttgctcatttctctaccctgagaccaatcatcttccaaatcagggtaacttaattaactagattaattaaactagattaaaggtgctctttacaagacatgacttaagcagccacagagtcatgaaggatggcaacgttttttaatctccagaatttaagcagtagacttctttccacatatttcacagatgcatcagaagtttcaatgagaccagggctgggatggcttggagagaccatctaatcctgggtttgcctgtggacctggaggtatacatatacatggacatatttctgagaaacagagtccaatcttctagagattccccaagggaccagactgctaagaagtttaaaatcagggacaaac

SEQ ID NO: 28416 - DNA, 1972 bp, Bovine  19866880779435
tcagggattgaaaccagttgtcccacttgcaggtggattctttaccaacggagccaccagggaagccccaggatacaagagtgggttcccttctccaggagtctcttgtgttgcaagctgattctttaccagctgagctaccaaggaagccctgttaccaacatatacaagtgtaagtttcatcttccatataatgggaatattaatatttattatataggattgctatgaagagtaaatgagatagagcagatgcctaggccaatgcccagcccatggtaaacgcccaaagaatgggagcactggtgttagtgttatcatgtccccatgggcatcatatgtctctagccctttagttttcaccagccatggagacatagtcagtacatcaaaaaatggcatttaatagagaacagatataataaaataatgaggcaaagtcaaatttaataaagtctacatagtttaaagtaataaaatgttcctcagggtataataaaataataaaattatagagatagaagggggtcttaaaataaccaaattcaatccctcactttatgtatgagaccatgagacccagaaaggctgaacagccttctctgagcccctctgctgactgaacagtgcgctgcaatgcgcatccatgcctgcctttcgctgtgatggtttcctctgctatgtatgtactggataatggtgcacttgagatttgtcttctgggcttggtctaatgactgggattatgatacagaaatagaaaataaaaatccctcagttgtgcctcctaggctttccaatgaaatggaagaatccacaggaacaaaaagagacatgcttacaaagtattggggacctagtctttcagtcatggagcccatatctgttccccttaccagcagacagggtttgattccagagtatgtgttcctacatttaaatgttatgttcagtaaaagaacaaaaagactcaaagagttccttgcaaaaataattagaaaattactatgatgatacaaaaaaggagttttgctgtatccttgcattccagaactgtgaggttagaaagtaggaaatggaaaaacaagacaccatgacaggccactgctgaaagtaggcttgggtggtgccaagcgtcaggtttaaaggttgctcgttgttgtttctctttaactattccttcaatctcattgtctcttgctaattattatgcatagacaaatatgattatcaaattttaattgcaccatcacaggcaccttataaatgatgataataaaatagcaattgcaatctgctttggtaatttttggacggtaactgtgccttaatttgtacaaatgaaatacattttgtttgtcttcagagtagttattattatatccaaatctttttttagattacccattccagtactatttttctaaaaactttgtttgtgcatattaataccataataatttttatttttcaatatttatattcaagcagttttgccaattaaacttggttgtattgcacactgtttatttacttattcactcactcactcattcattcattcattcaataaaatgatcagagtacctactctctttcaggcacagtattaaccccctggtgatacagaagtaaataatagcaccatattcattcttttggctttaattgatcacaatccatatgctagtgactttcagatctccatttcaaaacttgtcttcatcttctcctctgagttttaggtccatgcatattcaaatatctactggacaattttacttgtttattttcctcaaaatctatgtgtcccaaactgagattattttctttctcttaaaactgctctttacatgcaaacattcccaattattggaatgatacctatgatcctaatctagaaatttgggattatctctgactgcctctcccacatgtcttggtttctaataagtcaatgaatcctgtcaat

SEQ ID NO: 28417 - DNA, 1028 bp, Bovine  19866880783426
cgtcccataaagtaatgattcaggagcatagtgttctgggtctgcctgggctccatcctcagaagaccctcagaaagaaatgaggtcttagtgttcaaaagttcccatcagtcttttcccttgaaaggccattgtgaaaagactgatgaaaatttgacatgtaaatataaccatgtgttgattgaacatcctttttcaagcaagaaactagcagttatttttagagacgtatgtgaaataaatattgccccctggaagcacattttctcacctctaacaccacatctcaagtggggtttggagtccacccaggccctggactttgacaggagagtgcctcttgatgcagatggacttgcatggaccagttctggggaagtccggattctaaataagtttggaaaccaagagactctttggtgatcaatgaaaatgataaatgggctggaaaagtgatcattgtgtgggaaggctacagaaattgaggtcgtttttttgtctgaataaatagactgaagaagaaaagcctggggaagctggtggggctttgcggagcagggcacttgataacagtcatcagatatactaaaagttatgtggaagatgtgagtaaggtcttttcagatccacaggggaaaaatgagaaaatacacgtaactagccactcagtcctgtaatccttccccaactgttatcctctgctcccaaagctatgcagagaatctgggagagtgtgtttcaaggccacacatacttttcactgatcctatgactttatctttttagctattatttttcaaaggagctcccaaacaactattgatccctgttgaacagaatatgagatcattagtaaagcacaagatttcatatgagcagccacattctctcagctatcacttctgtccttaaaagtcccctccttccccttggccaaggtcataggtgccttataaaaatgatgataaacaggcctcaacaatttcaagaactgttggcttttctcacattggattcaagccctccca

SEQ ID NO: 28418 - DNA, 1304 bp, Bovine  19866880790706
gtcccagaatttttttccccagcgtaagatttgaagttctggtttacaatatgagttatcataagacgaggagctccaggttcattggtcattgcaggaggtgggggaggagggatgctattcaaaatctcttctaaacttctattatcaatttcctcacttggagtttctaagtcagtcaaaggaaaggaaaaaaagggggagaggggaagcctgcatcagtgcaatttgttagcctgctaatctttggagacgtcatttatgaaacctaggaatctctatttttcactcaaatacagtattatcttacattcacaaaggataacagtctttaggctttgtcttatgacaaaagaaaatttttgaaagagatgccatcagtcacaaaattctatagaaatataccttttaggagtcaatacactacatcgtaatgcaaatctggaaaatccacaatcacttgagtccttgcctaaacaggtggtcaaatcctacagctctagattcaactctcagtatctgttaagcatctggaaccctaactttggacactggcgagctcccgtgacagttacaggggtttcatgtcactcaattcctggactcacaaaacccacggcgagtgcgggcgtaggtgcaaattatcttctctttgcaatttaagatcaccgaggtgaagttgtacgatcaagcaacttttcatcatattaacaaatagtcacgctgacactgaaaaaagtccactctggctgaccgtgtcgatttccgcggaaacataagacaatgaacagaagttcagaattttagctatttactagcccccatccctccagcaccgttaaccgaaatttcacagtcgaatctgtgaaaatcgctttcttgaccttcgggtgtcaaccccgcagcccttttcgtccgcgccctggaataccaaccgtcccgggttgggtgccaggtctccacgcgcttgccctcggcgtcgcgaagggctactcacctgcggtggccagcgcctggctcctcgcgcggccgggcggcggatccggctccgcgtcgctgctggtgccgtccggggaccgcggcggcccttcctctctgcgatgggcagtggagggctgggtgcctttacggggcatggtcgctggagccgagggaaagccgggagcaagtcagcccgcgggcggccggccgcgccgtcaagttccccgccggcccgccacccgtcccactcgggtaaaactttgtccacccgttttctaaggctccgttgaaaaaccccgcgcaacgccagcgagttctcggga

SEQ ID NO: 28419 - DNA, 1295 bp, Bovine  19866880824048
atttttctaactgggagaaagatacccctagaggagtggccagattccacactcagtggccattgccataatatattcaggaaagctcaatgcacagaatcgaacgcattaagttgggagagtacttccttctgcttttttcagcttgtattcattaatgtattgtagcagtaactagaatgcacatgttgttctcctgaagttgaagaaaacttctcttgtgcttttagtttctagttaggctttttatgaaaggaataaatttttaaattattgacatgttgacagttcacctgcaagaaataaccactagcatgtttaatccatctttctaagtttgaccttttttttcagtttgatctttttaaacaacgaaaactatgaagttttactaagagaagtatgggggtttaaaaaaaaactggtacagtatctgctaattctttgcttgcattttcttttgcaagtcagtaaatatatttttagtatgttttatatgataatcatttcataataacaaccccaagtaaaaatagctttagttatatgggtgaggtcatgaaattaaactaccagtgtatacttgtctgtccacagaaggctaaacactatgtccttcccccttattatttcctgtaagtcaagtgtaggtcacgacacagcacagtatgaaaaatcaggacctggaaagaaagacctctttccctcagaagcagatgacctaaaacagtagaacttgctcctaaatttttaatttgatcaaatgtgtcactttttttccccctagattgagatagaagatctgtcttaatagatctttatatataataatgtaaaatatggcagtttagatcttatatgcataattgtgtatgagtatgggggctgtttaagtatatcctttatttcttagggcagttcaaatagtttcttttctttctcagaaactgaaacttaaatttgtaaaagaggtttaaatgacatacagtgttgctctgtgtgggttttgtcctttgtgatccccaaaaggaaatgagcgcccgaggggataaatgctcagagtcctgaaaccctgacacttctctgatgtcccctcctgccagaagtgggtgtgcaaaagatacttgggatgctcagaagtcagagtcacttacccaacccggtagaacaagtgctcaggtctcacgttgcctctacattcagtgccaaaggactggtcacattttctttgtcacagcgtttctcaaaaaggaaagtgtagggtcagttttcacttaggagaaatgaaagacgta

SEQ ID NO: 28420 - DNA, 767 bp, Bovine  19866880956819
tgaggatgtaaagaaattttgagaccgggaagttttagaactactgatctaagagcttattatcgtactttttgttttcttttaaaataaatagaagaacagattgatttcagtgtaccagtgatttcagaacataccatcctataaatggcatgctttaaagagtactttcggagaaggcaatggcaccccactccagtactcttgcctggaacaccccatggacggaggagcctggtatgcagtccacagggttgctgagagtcggacacgactgagcgacttcactttcccttttcactttcatgcattggagaaggaaatggcaacccactccagtgttcttgcctggagaaccccagggacgggggagcctggtgggcttccatctatggggtcgggcagagtcagacacgactgaagcgacttagcagcagcagcagcagcaaagaatactttactgcaatttaaaatattttaatcccaaattcaatagtgaaacatgataaataaattacctttctgcttgcagaattaaactaacagttccttccttgagatcaaatataagtggtgtattccagttctttgtactgaaagacaaataaaatggatacttatttacacttaaaatactttttaataagtagatgggtattcattttaaacaaagcatctttagtttcacagtaactctgtatatgattctattatagcacttggtggagttgttctgaaataattcacttacacatctgtatacctga

SEQ ID NO: 28421 - DNA, 1074 bp, Bovine  19866881123570
ttaaacaacaggtaaacctgaaaatcatataagaaaaaattatatccatttaagaaacatataaataaatagtattacatcaatacaacactttcaacttcattctgtcacttaaatctcattaaattagctttagctgaataatttattaattaactaagtaacataaaaagattattttgtaggaatgaaattagaagcaagaatacaacactctgttggttttattgatgacaataaacaatcccacacagtaaaacgttaccttgcatccctttcatataatgttttaggcaaaatgtctctgtccacataaactgtattggggtaataccacactgtaaatcgagtatcttgaagtccacaaaggatattgcacgtatcactccacgccaaagtatgcaccattgttccttattttaaaaagaatgttaatgtattatttccattatataagtattaaaaacatatctttaaaattagctgatgcataagaccccaactaactgctggtaggtatgagtattttatgatagtgaaaacatgtgcaaaaattcacataaaaatttatggaaatatttgagcattttacccagaaccattatattttcaatctacatgtctttttttcaatgccactttagttgcagcagctaaagacttgctatcaaaatggaattaaatagctaagaaatgttaggagaccaaagcattattcacagattcattcaaacaagctatttagtataatataaagagtagatctaagaatactgaaaataataaacaatttaaatgtattacaattattttaccaagtttgataatctgttcttccttcccaaatcgtttcactgaagtgatatagagatctctatttttatcaatgaaagcaatttttctatcattggtgagtcccttttgatccagggcaatttccaaaacttcattctaaaatttttaaagaatgaaaattctggattagttttagtatttacatcagattattttaattgtttacttacaagaacatatgtttatttaaagatcaattaaatatcatttacctactta

SEQ ID NO: 28422 - DNA, 1138 bp, Bovine  19866881128063
tgctgaagaagactcttgagagtacttggacagcaaggagatcaaaccaattgatcctaaagaaaatcaaccctgaatattcattggaaagactgatgctgaagttgaagttccaatactttggccacctgatgtgaagagccaattcattggaaaagaccctgatgctgggaaaaattaaaggcaaaatgagaaaggcagcagaggatgagacggttagatagcatcacagactaatggacatgaatttgagcaaactccggagatagcaaaggacagaggagcctggagtgctgcagtccatggggttgcaaagagttggacataccttagcaactgaacaacacccagggaggttagagaaacccctcccctcccccaaccatccagcttgagatgattggatctggagccttggttaggagctataggtaattaccatgtctgagcaggaccagtgaatagtatgagctgaggtaaagcttaatcctctctctacccaccaatgaaaagctgttgaactgtcaaatagggtttgcaactttgaagtaaaaatgtttcctgccacatatgatcaagatgaacaagtccacacctgttcatctggtccttggttagtagaaggaatgaaaaagaagaactgtgtgcctttgagctaaggcattttaaatacttattactgtgattcattttccagcattcaccttcattgcagttttcctttcatcttgacactgtaagtaatgcatgaaccttccccatggaacactgcagatctcatttaaatggtaaaaacgtctctagctcaggcccatttgctacgcaagaaataggaggtgtttttgtcaggttacagccaaaggattccttgtaacatggggacctctcattggcttccatcactgtattcctttaaccaatggtttctgttctttcagttatcctaaaaacagatggaaaaataaatggcttcatagcattgtgctgggactgagaaaattgtttatacatctccatccaaaacaaaacttcaaggacttccctggtggtccagtgggtaagactctgccttccaatgcagcggtacaggttcaggtccctattagggggctaagatctcacggcctctcggccaaaa

SEQ ID NO: 28423 - DNA, 1570 bp, Bovine  19866881135413
aaataacttaatggaatttttcactctgatcagatgtcttcagaaccagcttggaatgactgatcacattccaccgccactcgctcatctgccctccactagagcttgttggattatctggtggcaggatttgaatgatgttgtcctatggttggcgtctctatttaactgggatgaatatcttgggacttaaataaattgtttaacataaagagtaaaagtgtctctgtgccttttctctatgttgagagaacagtaagatagaataatggacttcattttagagaaaatcagataaattgatcttttcatttgtgtggatacttggagttttcatactctgaaatagaaagatgagctcaaactcataaccaactaaatgcgttatgccccagaaaaatctctgtggaaaagtgatcttacaggaaatctcagctccactctctccctcctgtgaagagtgtaatctttgttcacaattaaaatgatatgtttatatacagcagttaatagaaagactctctatgaatcctctgtttgtaaaaacagaatatttctttagtacagactctggtgtccaactctctgtgttgggatttgactctgccatttaccctctatgtgactgtagtcaaattacttaacctcgctttgcctcagtttccttctctgtgaaatgggagatacctcataaggtggttgagaatattaaactagtaaattcatataaagtgttaggggacctagcacatgataaatactcagcaaattaactttatcattattgttacagtataatttcctccttctggattattttagtggtctcttcactcttctttttgtttagtctcccttttccagttccttgatttagaaacccattctatatctgattactaagacagtcttcccaatgagcacactatattattttcctatccaaaaattcacattgagaagatcctgctacaaaataaagtggaaagcactttcacatattgtgtttttcacatgtaacaggtaactatatgcttatgaatcaatatacttatgaatcaatatacttatgaatgaataaactatctagatcactattggggcaggggtaggggaggggggcagaaaaaagcacatgaaaattattaattaggaaaattattaatatattttcagaatgagatgggagattaaaagggcaacagactcccacttcataaaataattcattaaattcttgatttggctttctgcccaaaacctgttagtcattccgacctggtcttagaagtctcaaaatattatgatatgtagtcatttgaatacaagtagataaacataaagttaagtagaaaaatttttaagatcatgatatctaataaaaggttttatagaagcacataaccataacaggaggggttgttaaaagcaaactaatgctgtcttacacactatatatttattgacctgaatttatataattaaagtggcaaaataaaaccctcaatacagttatgatttgggatactttgaaataagaatttctgccaaaaactaaataagcttatag

SEQ ID NO: 28424 - DNA, 769 bp, Bovine  19866881149306
cccatctttcattcactcaggaaaaattttaggataatatgcttgtcttcactctctcatgccagcatctttaccatggccaagtctttacatgatctggctgctacttatctaactttgtgtcttctcctatctcactctgcttagttcatgttgacctagtcctaaagccttgttccttttaaatatcaatcattcccaccattgcatttcttttcctatagtcattgccctgccccagctctagaattctctatgccctcaccctgcattaattttcttcacagcatgtatcattagttgactgtatttgcttgattatttggtttttttaatgcacttttgtatcctcaacttctagaagactacttggcacataggaagcactcaatattatttgttggatacgtgttatgatacagcattgccttaaaaaaagttttactcatactgtggcattccaaaacacctgacatacttaaatttatttataaacagtaatgtggcctaaatttttatatgaaaatcaaaaattatttgtaactttctccttctttagtttaaaaatatgtaagtataaaaaatacatgaatatacataagcaaaataaatagtacaatgaagcacaacatttactatgttactaaataaagaaaaaggaaatactttcaataaacttaaaaattaacatacatttttaggactcacagtcttgaattaaaactataccaacagctacgaatatatagatttacttcttacaactaag

SEQ ID NO: 28425 - DNA, 1327 bp, Bovine  19866881201469
tttggcatgtgtgtagtgctgcaagagtgcactatccggaccctgcataagcacagagcccacaggtcatggcccatgtgaactgcagcatggatgtcacactgccctgaacgcacaatgcaggcagtggccctgggccccagtggtggttaacttcatgtatatatttgtcttttttacatgactgaaactgccttgagggcctgctttctgtctttacggagagtaaatacccattaccctcctcctcacccctgaaattcagtgcccaaaatattatttttgcaacctcaagtcttgtagctattttatgactatatatttttatcatataaacttgaatttctttaaacctgggggcactaaaggccttcatattttactttagaagaaaagaaagagaaaaggggccatgatgagaaatatgctgttaattatttccaacaaaaaattttttttaccaaaaatttttttcttagtattttatctatggaaagtgaggcttctgtgatcttttcctttttgtaaataacttggagatgagtaagtacagtaactcagaagatgacagtgaattttgggatttattttggaaattttggacatttagggcaaattggcattttaaaaaatcaagttactgcttatgttacagtgaaatcacatttttttggtattgattctcaaaataatattattattatgtttttataagtgaagaaagtgaggctaagcagttataatgatttgtctgggtcatgcatataataattggatacttctgaccacaaattctctcctctttataccataccccaaagctttctttaattgcttctctccttttattttaaaggggcaagcatggctttttaataggctttaaatccattttttaaaaacattcacttcttcatcttatcttaaggttaaaaattaaactacaagccttgaaatgaactgtctctgctaacttggtaatgttttgtttcattagatgttgcttcttgagttctaacataggtgaacaatgttagcattacagagtttggtttcttaaatggaagtcatctattaaataaattaaaaacaaatgcttcttcaagttaaacaaacagaaatgtatcattatcttggcttagacgtagattttctactaacgttttacttgggtctttggaaaatctaatctgaaatcaacctggacatgatttaatgagaatggattgttttatcattactaatgcatttttgtttgattttcttatggatctggaagaaggtggtactagatattattggagagatatagaaaaatgcttaaagt

SEQ ID NO: 28426 - DNA, 4488 bp, Bovine  19866881297859
cttatctgcaggagacagagtctttcctagttattttaaatggaagaaatggtgatgcttttaattggcaagtgaaaacttgagttacagtgtgtgaaaaaattttccattgcacagagagaaggaaatataagcctgtaggaggcccatcactcaaatgtttggtcaaactttacagcagaacaaaaactataaaaagaataatgagatggctgttgcttttccttgtgttaatgtctcagtctgctggggctgcaatagactgggtagttgaaacagcagaagttacttttcccaccattctggaagctggaagactaagatccgggtacaagcatgttagagttctggggagagctctcttcctgacttgcagacagcaaccttctcttcctgtgttcacttggcctttctcagcatgaattcatggtttttgctgttcagtggctaagtcatctctgagtctttgtgaccccatggactgcagcattccaggcctccctgtccttcactatctcccagagtttgctcaaactcatgtccatcgagtcggtgacgacatccaaccatctcatcttctgtcatccccttctcctcctgccttcaatctttcccagcattatggtcttttccaatgagtcagctctatgcatcaggtggccaaagtattggagtttcagcttcagcatcagtccttccaatgaatattcagggttgatttcctttaggattgactggcttgatctccttgcagtccacagttcaaaaacatcagttcttcagcactcaaccttctttatagtccaactctcacatctatacatgactactggaaaaaccgtagctttgactacatggatctttgtcagcaaagatgtctcagctttttaatatgctgtctaggtttgtcatagcttttctttcaaggagcaagcatcttttaattttgtgactacagtcaccatccacagtgattttggaacccaagaaaataaagtctgtcactgtttccattttatccccatctgtttgctgtaaagtgatggggctggatgccatgatcttagttttttgaatgttgagtgtgttcatggggagagagagaaagaaagtaagaaagttagatagatagatagatagatctttgctatcttataaggccactaatgttattagattaggaccaaatccctatgacctcatttaaccctaactacttcctaaaagccctattgaaactatacatctcagattgggacttttaatggagatcacacacctggtctcaggacttaatgaagctcaggttcttgatatctcatcacaaattcattgaaagacaaagtgataagcaagaagtggatttagttagaaacacacttcacagagtgcgagccatctcagaaggcaaaagcagcaccagggtatggggttgtcatttgtataggggtgggtaatttcataggctaatgagtaagaagagtactccatctatttgggggaaggagtgggaatttccagaaatggggccattgcctactttttgacctttatggtcagccttacaactgtcatggcacttaggtatgtgccatttaacatatgctaatgtattacatatttcctgaagctcaagttctagtggaagtcaactcgtccatccaccatcttggacctatttcgtcctaaccagtttatgtcatgtcctcagttgtatcattcttttaaaggttgtgccctgccccccttcccttctgtttcactatctccaaatatagtcacattgggagttaaagtgtcaacatatgaatctgtggggcaaggaaacaattatctctttgcagctttcttgaggcaatttcagatatgttatttagataacaacagacccagcctcacagtcctactgcacaaggaaaatttattgtttatttcaaaaactcttccctgagattatttggctgatataccagggacttcttggaaaagaataaatttggattttcccaactttcctcacccacatttccatatttctgaggtttctattacccacaaaaaatgctcattagttagcaagaatttgcttttccagggcagctgggttccaaaatgttcccttatttataaactggagccaagactttatcaaactctgccactctttcaaagccagctcaaatccagtctcttttcttaaactgttcttgactgtcttcccttgaactggcctctccatctccaaagttctgaagcagatatagtgtaaacctcggaatttaacacgtaaccacataatacagatcggaactgcccttactcagtaataactcccactcactcttctttggtcaattctatccccatgggatcctaagagggtcaagaattataggaatacacttctactctcatcccctgaacctccaaatttatctttaattgtcctctctgcttctgtctcctgcctcaaaagaagctattgtcatgattcctttgtaggtaaataactccgctagctttcttgatctccttccttctgcctctttcagaatttcagggcatcagttgtgttccttctcatgtttttagtcccttcttctccactgcatctccactcttttagattacaaacctgcttaaaaactctttgtcctaggaaggaaagaaagaaggaaggaaggggagagggagtaatggaagtgggggaaagggatagaaaagaaaaggagtcacatcctgttttgtgcccttcaactcaggtttatgcctcatcctgttcttccacttcactatcactcctcttaaaaaataatttgccacttagtaacacctttcacccatcgtgcatgcatgaagcgtgtccaactctttgtgaccctacaggccatagcccaccaggctcctctttccatgggattgtccaggcaagaatacaggagcacacatccatacatgactactagaaaaatcatagctttgactagatggacctttgtcagcaatgtgagctttctgtgttttaatatgctatctagaatgtcatagctttttttcccaaggagcaagtgtctttgaatttcatggctgcagtcaccatctgcagtgattttggagtccaagaaaataaaaatttgtcactgttctattgtttcccaatctatttgccatgaaataatgggaccagatgccatgatctttgtcttttgaatgttgcattttaagccagctctttagttcctcttcactttctgccataagggtggtatcatgtgcttaactgaggttattgatatttctccctgcagtcttgattctggcttgtgcttcatgcaccccagcattcagcatgatgtactgtgcatataaggaaaataggcacggtgacaatatacagccttgatacactcctttcgctttttggaaccagtccattgttcatgtcccattctaactgctgcttcttgacatgcatggaagtttcacaggaggcaggtaaggtggtattcccatatctatgagagttttacacagttttttttttttttgtgatccacgcaatcaaagtctttggcgtagttggagaagactcttgagagtcccttggactgcaaggagatccaaccagtccatcctaaaggagatcagtcctgggtgttcattggaaggactgatgctgaagctgaaattccaatactttatccccctgatggggagaactgactcattagtaaagaccctgttgatcagaaagattgaaggcgggaggagaaggggacgacagaggatgagatggttgtatggcagcaccgactccaatgggcatgagtttgagtaaacctcgggagttggtgatggactagaaggcctcacgtgctgcagtccatgggctcgcaaagagtttgacatgactgagtgactgagctgaactaaacttgctttcttatctaacaaatcttccagagttccctgctgcagccctggaatcaaccatttttctaaagaatggtggtttcttttactggagaatatttgtatcgtagaccaaggtctcagtgctaggtattctcatttccctagggatttctgattccaggctctggtggtgtatgaagtcaggaaatacatgcatatatataggcatacccacaaaattttacatctagttatttctatatcattaacttccctcctatacttcaaagttcaatataatactttaggattcattctagcattcatatttgaatatatttttttccaagtgtgaaacttggctccaatgctcttcattgtgttcatttatatattcatttaatccaccatacataagcaatctctgaatctttctgggatgctgacccacctgtttatgtataatgagtttttgactaattttgaagaataaaaggatggaaagagagaaggaaagaagtagggaagacaggattttaatcagtttgacatatctatttgtgtaacttcctc

SEQ ID NO: 28427 - DNA, 792 bp, Bovine  19866881351236
cacttgcagtcagtgaggcttttgttctcgtagcagcgagtgctgacgtaaagtctcaaagaatccggtcctcatataagctgtgtgtgtccaggcacacgggagggaccactgtctgtagggagtgcaaacggcaataataaagtcatgataacttgtcaaagatgatgcgccaatgaaaaatcatttctacaagttcttttaattaaacatttggctgtccactggaaccatttttaaatataaaatgccagccctgtggcctttttctccccatctcccacccttctgcagtagctctgacaattgaattctcactggtgataataataaaattcataagacagagtacagctagttatgcctctagcaagatgtcaaatttcacttgcacaaaattaattgcacctaattaaactggggtcattggcattaccgtaaagtgaggctatttattagacaaagaaaatttcacaaatatcaatttgctgtcctttcaggtttgtaaaagagaagaattgcttacataattaaatttgttttgccattttaatagtgttagtcctcaaaagatcctcttcaaaatttcctttacttttaaaattgtgtaatattttagaatactggaggtaattcttggaggagggcataaaaaatagtaagagttttctgcagagtacccgatgacttttcaaatagtatattaaaaaaaagaatttgtaaactatcatttgcaatggcatgtaccttggaattactcatatgaaggatattctatgcaaattaatagtg

SEQ ID NO: 28428 - DNA, 1179 bp, Bovine  19866881662207
aagagggggtgaaggggcggagggggtgggagaggagtctgagaggaatcaggggtgaggtgatgtaagaccctgggggcccctggtgggatgtgggcttttatgccgaggaggagaattatgagatgggtggcaggctctgatttaggtcttaagagagcatttgggttctgcgttgaacacagaccacagaacaggggcaagggcaggagtagtctggagactgctactgctcgaagatgatgatgatgatgacaaaggtaatagcaacacacacccagacacgcgcaccgaattatccaaatgagtctgaggggaatggcctccgaagccccatgcagggtttctccattcagagaccgtggtatacaggacttcctgacagtccagtggttaagactctgcttccactgaagagggtgtgggttccatccctggtcaggaaatgaccatatgccaaaaaaaaaaaaagaaaagaaaagggaggggaaatatatatacctatggctgattcatgttgatgtttggcagaaaacaacaaaatactgtaaagcaattatccttcaattaaaaaaaaaacaaataaaatcagataaaaaaaaaagaaactatggtatacattatggatgaaaggaatcagtcctacaaataaattccttctactcactaagatgctaatctagggactttgttttaactactctattatcatccttaagaatagataaatcaataagcaagccttcatcagaaaaggggacatttctaaaaaacatcattgttgatattaccagtgaccatgataacatctagaacttagagaaactgccctttcagaatctgtgatgttaggtgggttctaaaactaaggtttccaagtaggattgagacatggcttcatggctaatatttctttatttgctgagttatgaacagagggagagcatttcaaaaggacagacacataaagttctataaaaccccatggagatgtagaatctattgcctattatcacctgcctattggacataattttattctaaaaataagcaataagtacttcaaaaactattgaacacacaatcagtgttatatgttgtagttcatataaaagaaaatcaatttgttttcctctggaagcagaaggctaaacaacccctcccctcctgatggcactg

SEQ ID NO: 28429 - DNA, 1224 bp, Bovine  19866881694815
tatttaaatgtatggaagaaacttccagaatgagaaaatgacagaagcagtaattaaatctgaatggaaagttactgttcttttactttgctttcccttcaaatttgcatggaatgtgctacttataaactcagaaaatcacaaattacaaaaaacatgcaatttagacaagaatatctgtctagcagtcctatttcctttgttgtttggaagagaaatcattaaagagctaagaggggaaatcccagtttgaaagctggaaaccatcagaaaagatagtttcaaccaatggtgaacaattgctggaaaagctgtgtcttcctgttacttgtttgctttcagcttcccccacatctggggaaagcggaaccagttttgttgtctatagtcctcctcctgtgtaggcttatttcatggatcagggcttccaagcagaggggacccaaccttgcattgttgaattctagaccatcttgcataaacatctaggacctggtgttgggggctgtgagctctcctagctaaggggaaaattgtaagagagtaatgccgagatgtctgtgacttttatgcagtgggggctctaggccttccaccccagggaagctctggcttcagtgattggtcatcaggtattcaaccttccctggtggctcagatggtgaaagatccacctgcaatgcaggagaactgggttcgatccctgggttgggaagatttcatgaggaagggcatggcaatcctctccagtattcttgcctagagaatccacatggatagaggagcctggtggactacagtccccggggttgcaaagagttggatatgacttagtgactaaggacagcatcaggtattcaggtctcaagatggggcctcagtgcaactcaccaccagaaaaagagctggaatcattgactctgtcaaagtcgtgtaagaaaaaaagagtcccttactgcatggactggtccacagttttcttttaaggagaattagtgagatgtttaattttctcatggctatcaatgaaaccagcataatcacctaagtactcccttgcagcatgccagtgagcctttgccttaaggcttgttgcccctgagaggaagcagagacactgatatgaatatttttaaaaatatttgcttatttggctgtgccaggtctcggcggtggcacatgggatcttcacttgttgcgtgtgggaaacagttccctgcctgg

SEQ ID NO: 28430 - DNA, 996 bp, Bovine  19866881782609
aaaacgtattggttatttaattaacccaattttacactgatgatatgattagtaattctgtttgtaaattgactgaatgtgctttattatcttatgattgctctgattaaagtttttagttcaatataaagtgtaacttaaatactctctctggccagcaatatgaaatatgaaaaaaagaaaattacagtttgaggatttcaccacaaatcctgctaatcgtataaatctgtgtctgttatgctttatcttgcagaattcagaaatgaatgaaaaatgagattcccccccctcagtttgtaaagtaaatcaatattttgttatttatcaaagtgacaacatgtttttatgattttaactatgttatttatatgattagttgtctaggtcttaacattttgtgtccccagatttttttgtttgggtctatttctgacttactttcatgatctcttaatttatactgacttagaagtatgttttttaaaaaaattaaataatttaatacttaactggttaatcaaagagtcatattactttacaaacaaagagatttatttatattccaacatcttcatggctaaggacataatttgtggcctttcagatatcccatgtcactggaagagtttttggtgtcaactgttttgactcaatattttgaccccaaggacatttttaacataaacatttcagttagaatcacaccaacattaaaaaatttggttcaagaaagcactttctggagtgaaaatcattaagacaatttaattccctgattaattttctatagagtgcatttaatggttttccatatttttccactttcttttttattttactaaaactattttcaccagaatcaattctttcatttaaattttatgtcaagtgttcattttttgtcattaagaagttatttcttaagtgattataactttggccataatgagttttctcttttggtcattatttctacaaagttcaattttcttg

SEQ ID NO: 28431 - DNA, 804 bp, Bovine  19866881800080
ttataatgcaggagacctgggtttgatccctggatcgggaagatctcttgaagaagggaatggctacccattccaggattcttgcttggagaattctgtggacagaggagcctggtctttttttagtttgagggaacaggttgatgtcaaaatgcaggaaaacatacaaatgggcagagttaaaatcagatctgaccatagaattttttttgtttgttttgagttaggtgagccttcattatttttgtacatttattctttttttttaaatcagggccacaaagatgtgagacccagactgggtggtggcacttcttgaattttcccagacttacagctgactcactgtcttaagtactagagcaagtcatataactctataatgtagcagatttctcttcagaggtggtaaactgtaatgaatgttttataaccattcatatttagagatgaaagacaatagtgcattagggaattaaggcttttaaaaaatagtttacacaggagaatgatatttttggtatgcccagttctccatcatctgctgtcagtgctgaccatacataataagctggttagacactgtggagactccatagaacatcaacttgctggagaaagactgcatgaaaactttagaagttcaataatgtgtttgtttttacacttaagcacaagaaatctgagaaataatttataagtagatgatttagcttcaggtttatttctgaaaagatttcttttttatattcatatttacttggtgacttttaaaagggaagcaggaaatcttaactaagttat

SEQ ID NO: 28432 - DNA, 1182 bp, Bovine  19866881833228
tttaaaaataaaataaaatttaaaaaaaaaagaaaactttaaaaagttttctttttttttttttttttggtaattacaactaaagatcctaaacccaatatacagctacgtatgttccaaatatcagctttcagaattttggacttttaactcacatgtctaattgatctgaaagaaaagggcagaacactgtgtacattaagaaatggccactgatccctcagggtcccctgatctacaggtgctgtgttaacaatattgtcacacaaggtctgggttactctcttccttgcagcaagtgagagttgcacagctgagtgagaattttcttctttatttcctttttatcattggtgggagaaacaagcataacagcatttccccaaacttcttataattctgcagaaggtttgggttcccagagaatgaggagaaaaaaaaaattctaatgcaaaaaaagggggaaattgattctcaggtgatgtttctttaccttactttttattgtaaaactaagatcattacaagtaatagaatattcttaagcctttggtgagtctatgtccctaataaagattgattttattatttcatattttcttccagttcctaattacaagcacatgtaatttttcatacagttgcaatcatagcataagtaaaattttatatttgtagggttttttcctgcttaatggtaatctataaaaattacccacattatccttggcatcccccaaattatcataattttggtgcctgaagaatatttcattaagtcactgatgtaccacagtttacttgttcagtggacgtttctcttctttctgggttacttttctccactcttctttttgctggttgtgttatcagttggactttgaaaaactcttccagttgagtcacttgacttgtcataactcgatgttacccaaactagccatgttccacagaacttctgatgtgctcctaataggggctctgtgttggggcagggaaaggaggcagggggactgggagaaggggaacctgtccacaaatggacttaatagacagatcttggagttttagtatcacatttatgtattaaaggctccaagaggtctttcagaggaggaacttacttgactttaatctagcttttccaaactttgaccgtcaagaactcttcctgtgatttcc

SEQ ID NO: 28433 - DNA, 759 bp, Bovine  19866881908475
tgcttaggttctttttatttttttaatgtccccctcctccgcccacagtgtaaatgtgtgagaagactgtaacgtcatttctaaacgaagttatatcccgcacgccgacatttacggacattcccacactctcggggctggggatcaaagcgcacagattcttgtctccgagtccgtactagctttaggtttgaggggttctcaactcttggcagagcagtcgggaacgaagaggcggttcgccgcccacattcctctccccgccatagcccttggctcggctggcggctcgggggctttgaggtctccttctactcgccggccggggaccggcggctggggtcgaccgctcgcgattttcaaatcggaagccggcagcgccaactccgcttccatcaccttggggtggcaggggtttgtccctgaggtccgcggcgaatcccgctggacaataaactacgaaaggccaccagtaagggctcagagctagtggttagtccctcgggagaagagaaacgggcagcgggccgggacagggggcgacgcccgtagtccgaccaagatttctaagaaaaaggtccgcgagggctgagagggcccccagccccgcggccccaatcccaccatcgacgcttaagtagctcagagaagtggcgcccgggagaagcgcgcgggagcttcgaccgccggggagcgactgaggggggaggggtgacagcgagcgaaatctccccgaggcagcctcagcctagacttcgg

SEQ ID NO: 28434 - DNA, 752 bp, Bovine  19866882028417
ctgtagcctcccaggctcctctgttcatgggattctccaggcaagcatactggagtgggttgccatgctctcctccaggggaatttcctgacccattaaatgctaatggtaagtaaataatcattcaataaaagttatttgtgattggtacagatcaaatcaagagttgagttgtgttgatggagcggactcttggccgctctgagagagggctcagggaaggctatagtccatctccaaaggtggtacccagcacacaaagctcaggtgctgctttttttcccttcgcagagcaaacagagctcttcctattcagatagagacactactgaagaagaatccgaatccctggatgacatggatttcctcacaaggcaaaagaaattgcaagccgaagccaaaatggcccttgccatggccaaaccaatggccaaaatgcaagtagaagtggaaaaacagaacaggaaaaagtctcccgtcgctgatctcgtaagcagcaagcgctgaaacgcaactgactgagggcttgcatgccgtggttggctggcgagtgttggctgcaaaaggttgaggctgtctcagtcctttcccagagttatgcaaacttgggtttctagaaggcactgtgtaaaacgtcattgagaaatatttaagtctgtttctttttccttcctactgtatcacagaaggatgcataagctacagatttcacaaacgtaaactttgctccccattcatatctactctgtttt

SEQ ID NO: 28435 - DNA, 1604 bp, Bovine  19866880347346
tggtaccccgctggcctgatgatgatggagttggtgatgataaaaggtgactttattgatccttaaaacgttccagggtcccacaaacatgtgtcatttcaatgaatctcaccatcctgtggagaagcaactattattacccacatttcacaaatgacaccactgaggctctgagggaaataactgcctgaggtcatacagctagtaagtgatggagctggggtcagaccccagagcttgtgccctaaccactgtacctcctgccctcacaggggcttgtccttcacatgagctggggagcagatggcccctggcttccaagatctgggacaagcgatgcacggagcagtttaaggtgggagtctgaggcatggtgtggggggtccctgcactgggctggggccctagtcacagacctgctgaagctcaaccctaaaggaagggagaggctggaacactgggtgcagagctggcctggcactcagggtgccctgatcccttgcacacctcttccaacctctcccagagggtgcgagtcctgggggagggaaagtcatggactgagttcccgaaaggcatgtctgagaggaagatggccccctccccaccccacccggggctgggagatgctcatctgagggtggggacggcaatctcaagtcctcagggaaggaccggcagcactgggcagactcactgagctcaaaaagaacctttatgtcagtctcggaattcagactttattcctggtgacagtgggcagccagggcgggcaggggcgaactgggaagagctcagtaactgagaccaaggaagacagtaagatctgagagctagcagagggttaggggtgctgaggggggacccgaatctggaggtggctcagagaatttaatcgaccacaggggtgaagaagagggaggtaccaaggatgacccaggcatctcccccagccctctgggggcttcgatgcccagctttgctgaagcagcggctgcctgagtcaatacgaattgaccaggaccccaaggagccctgggcccctccccccaggaagccctgacttgggggagggtgctgctagccggcaggccgacaccagccccactctgtcccactgctgacctttctcctttgtcagcactgctctccatcaatgcaccggaagggccagtgcaatctctcccgactgcctggggccagggctgggggcgggggcccactgcgtcttccctcttttaaggaagaggtttctgaagcctctctggaaggccgggtgcagaggagccaaagccctcagtgcagatggggagcctgaggcctgagagaggtggctcaggacccagcaaccagctgcaggcacagccctgggcacagagagcccctcgggggtgacccacagcccccgagctggcagaggggagggtgaagaggaggggaagctggatggggaggctgggtcaggccatggagggatgggcaaggatatctggtgagaagagggaccaatgaggtgtgggaagggggcaggggcagagcagggctgtgccccaaagtcaggaaggggtccggaggcggtgatgggaacagttgtggagtggaga

SEQ ID NO: 28436 - DNA, 1444 bp, Bovine  19866880348535
ggtctcctgagtgaggggtctgtcttccctgcaacggagcctctgccctgcccccaaccctgccggctggggggaggtgcaccagcactgcaagaggggccttgcccccatccccagctcaaaccccagcccctccaccgccttgtgctgtgaccttgacacagccctcccaactccaggccacattcttgtctaaaacaaaggcttgaattagactccgggagaagcagtaggcaatccagctcacagccccatccaggatagttttaggggtaactttgagggttttctgcctgcaatgtaggagacctgggtttgatccctaggttgagaagatcccctggagaaggaaaaggctacccactccagtagtctggtcgcaaagagtcagtcacgactcctaggggttggtgaggggtttcagggaggcatgcactccagtgtaccccagatcctctgcgcccaactcaggctcctgtggcggctgaacctccctctccagggactgcccgtcaagcaggatgcccagctcagaggtgggaagaatcattcgtgtccacccaagccctggcagccctcctaaactcaaacaaagtcagtgatctgaaggggcagtctgaccctgacactggaggttggggaggatttcacaaagggaagtttctagctccctggtggggacagctccctcacctccgagtgagtgagtgagtgagtgctcagtcactcagtcatgtcggactcattgcaacgccatggactgtagcccgccaggctcctctgtccatgggattttccaggcaagaatgctggagtaggttgccatttccttctccccctcacctctgaaccacccctttaaaacacagcagttccatggaggtctggaaacctgagctccgcctgagccggtatctgctgccactcaggactgtgctctgaacttgtaagggaagacagagatcacaccgcacggcctctctgctctgtaagttgcgctcctgccttcggccaaaatcaatacagttctccactatgattgcttcaccatcatgaggggccaggccccttgtgatgacatccccaccccggcactggcggaggatactgagggtcccgctttatcacccagcctcagccccacgtgaagaagtgtggggtgggggtcgggtggcgatggggggcagtgcgggcgaggagtaggggggctgccccaagagctgctctaagtgcctctccaaagacaagcccggtgctattcatcaactggttttcagggctgtgagaaatcaatggcatttgtgctgcaaactcatcattaggacaggaaaaactctgcaatggaattgatttgtttaaatataataacacgatttaacagagaaccaagggggtggggaaaggacccaggcaaacaaaacacagggaggcacagaggaaccag

SEQ ID NO: 28437 - DNA, 693 bp, Bovine  19866880356895
attgtgctgctccttctccaagagccagcttcctcttctggaaggtaagggtgctggtaatgctaccgtcttggattccctgctagaaggcagaaaggaggaaccatgtcagtgttcaacaaactcctgactcaaaataacctttttttttttttaaaggaaatgttgtggtaagttctataggactgatggactcaacctgagcttctccaagtgtggtccctggaccaacagcaacagcatcacctggaaatttgttaaaatgcaaatttgcaagcatcagcccaaattctgagggtgggacccaacaatttgtattttaacaagaactccaggcaattctcacatctcttaagtttgagaccctctgggctaaacttttcgatttctgtggacccacaggagggggagatcattgtggatggtagatccacaaggaggattgatccacattgaggatggagatcatgtgtgcttatgggccatctccaaagaaggccttagaaatggacattggagggtgaggagttgctgggtgccgggaggcactgaggtgccagaacggtgatcaggagcaggaatgttgaagacaaatctgccaaagcctgacctgctcccaccaatgcccacaagactgggagagtgagcgctgaaatcatgaccaggattcagatttgaccctgactgaatgat

SEQ ID NO: 28438 - DNA, 814 bp, Bovine  19866880365022
acaggccctgtgtgtggggtggcgtggggggctcagtcagggaaggcatggggggctgctcactgggtgggcccaggcacatctgtgagcaccaacccagatcctcagccacctgctggcctctcgtcccatacctagaaccctgggggctaggggcctaactctgccagggcaccctcatgccaagggtcccttgctcactgcacacatctgcccagggagtgtggatctggagggcagccagcagtgggttcagggtgggtgggcctctcttggccaggggcggggggaggctgagatcaccagctgaatcaccaaggttcatagttctgggttgggtttgaggttctgcatttctaacaagctctggggtgacactgatgtggagatggctggctgtacttgaaggagcagggacccaaagcatggcgtggccattcctgagaagagtggtgactggcatctcagaccccccactggtcttggagggacccagccctgcctggccacaccctcagctgccaacatctggagggcaagactacacggattttctgagtttccaggattccatttccattacacgtataaaataaaagtagtaccatgctataaaaacagtggaaagtacaaaaaaataataggaaaaaaaatcgctgataatctcatactgtatgtaacacaactgttaacctctctccccaggattccaaaaccacatctgtcagagtcaggggtcatccagtgagtggggtctgcccccagagcctcaccttgttgcagcgaaacactaggggagagatgggagctgttc

SEQ ID NO: 28439 - DNA, 1914 bp, Bovine  19866880425218
cgtgctcaccggtgtacacactcatacccaggacagcacacaagctgcgctcggggcatctggggggcccgagcaggggcatggacagctctgacgcacgggcagggcccctgcagctctggggcccaggagagcgggtgcggggagcaggtgggcaggtggccatctgcagaaccatgcgggaactcgtggcggccgctgtgctcatggggttgggcctgtccagagcaggcccataaatcaggaagcagcctgccgccagcgctaaatcactacctctaggacatggtgcttagaacagagaagcagctggcatcaggcccaggcccaccgttggggtgggggctggaggggacatggtatgtggcaccccctccaccctgtgccgctgccccctcctgccctgtgtctgcccgccttgtcctaagggcaggggctaattcctcccgcagtcagaccttctctcccactcgattcctgcctccccctggcctttcctcccattctacctttcttcctctgctcctggccccagactcctgagttcaccccctaggttgagtgctgccctcccactccgagcactgaaggcttctcccagtgtctaatgccttaggacctcagagggctggggttgggggctgtggagagtccacttctgggcaggaacacgggggtgccatcaccagacctgggctgtgagcccagaggcactcccagctgtactccccagagttacctccttcttcctggcctcgagcactccactttccaatctgtaaagtgaggactgactggggagagacctcctggggctgcctgccctgaggatctgaagccagggaaaagagcctccgtggatgctgattaattatgattattaataatacaaccatctgtatctagtggtggagtgaggatgattaaaactgggctccaggctccagccgcagaatacatgggtttccaggtgggctagggtgtcaccccctaggcctgcaagcagatccctggtggctatatgtcggggaggggctgtttatactgcactgcacggacggatacaaagaggagcgacatacaggaaggcagacagacagacggtggggagctggctcatcagctgatgaacagtagacaattaccttgtgccaaggctctgggcaggactctctctgcctaccactaggacagaccacttggtcttcccatctctcctcaaccttcgccttagcctgcagcagagccaagaggactcgacgattcctcagtgctcagcacagcggggggagcccgtgcactgcccaaaggggtgagcatggccagctcaccctcgagaaactcaccctgagccaggcactgctaacccattaattgtcacaacagccccatgtgatatttacgcccatttcctagatgagaaaactgaggcacaaagaaaatgagtgttagtcactcagttgtgtccgactctgtgacccatgaactggagcccgccaggctactctgtccatggaattctccaggcaagaatactgaagtgagttgccacttccttctccaggatatctttctgacccagggatcaaacccaggtctcccacattgcaggcagattctttaccacctgagccactgtggaagccaaagagatagaggaatttgccaaaggccatatggccaggaagtggctgaaatgcaaagcagaccatttggcttcagaggtctcatctacccgggtacaaagattccaaatgaatgaatgaatggataacatttaaacagcaggatacataaagatttttttgctagttcatctgatagttcatctgctttaaactatctctgtgagtggaaggcaaaatggccagaaaatacatgtcatgggttcaggctaggtctccgaattatagg

SEQ ID NO: 28440 - DNA, 680 bp, Bovine  19866880460126
gtttaagcatcaagctgacctgggctcagctcagctccatcacttccgtgctacatgtgaccccagctgtatctcccagtctctcacaaagcgataagtacaaagtacttaactcaagctggcatctcagaagggcttcgtacataaccattttgattattacatcctgcattacagtacagtctctaaaacctacttgctgcatgagttcatgcaaatcacttcacttttctaagcttggggtccaaaagatctagaatccgggtctcctggctggagcggcagcaattctgtttccttggcaacccagctgcctctcaagggaccatctggatcacgtcgccctggcaaggtgctgcccaggcaaccaggtgtttgtgttctgcagtggaagctctgcaaggtggtaattcctctcactggggacagggtggtggccaggcaggtggctggaaggaatcctcgctgcctcagtcactgcctgcccttgctattcctggtgcacagagaaaccgactccagagcttgggaactctagccaatgactttccttgaggagctattaacagatgcttcattatattcctccgcacattttctggcttgtcgaggctggccaggtggaaaacgctgcctggggctggactcctgtagggaattccaaaagacccagtcctcac

SEQ ID NO: 28441 - DNA, 1620 bp, Bovine  19866880483932
gcagggactggagacagctagggctccgggggcatccctcactttctctgtggtccctccttgtggtctttccagactgtggcttcagagagatggacttcttcatggtgactgaggacccccagattctctaacagatatccatgtttctccatcttatataacttgacttttttcctgacagtaaccttaatgttcttgaatgtttggagagttcccactccgtcctgctatgaactgcatagcaacacgtcttctgttaacttgacaatgacaatgaagggcatctggtccaaatcacttcactttaattcctgggtttcctcctggatcacagaactgatgggggagacatctccgtttgaagacagacatacacacacacctctttgtcatgtcaggcctcccacagtttttccccttcttaacaacactctcacgtcccttggagggaatctttttccctctacatcttctgagtttataaatcaatgtatccaggtgcctgagccctacagtgtaaaccagaagtccgcaaactttttcctaaagggacagataatatattctttatgttttgtgggccaagaggcaaaattgagactatgatataggtacttatatatgacttgaattatggtaaagcatcaggatgcagagaagacatcagattaaatagctatttagggggcttccctggcggtccagtggttgggaatctgcctgctggggcagaggacatggcttcgaggcctggtcagggaacagggatctcacttgccacggttacttacactctgtgattacctgcatgctgctactactgaagcccgagtgccctagaggccatgctcggcaacaggagaaactgttgtggtgagaagtcctgcatggcaactggagagcagtccccacttgtgccgctagggaaagcccacacgcagcaacaaagacagtgcagccaaaatgttagagacagagatttaggaagtcaagtcatcaaaacttggttgttaagatcgtgagagggatggggaaattgcagacgaggccaaagggcacaagagcaacatccagagaactgaggcgtgctgcgttaggtggggttctccagaggcagacctgagactgagatccgtgtgacagtgatttgttgagggactgctattcagaacaacctgtacgactgggaggggtggagcagggagaggccagcgttggcctgatcacagagcaagggcttcggagcataaactgtactacatgacatcttccttaaggcagagggccagaattttagactctgttctagccattgcttgtgggctgcccctttggggtataagtccccagataagacagttcttgacacctcagggccattctctagagaaaaggcagctgtgggctaagagcccacactcacggtaggtctgggctttggccctgcagagggatgtgggcagaaaagagcagtgtttcctatagtccttgcactgctcagacccacctgcttctcacattaagctgatcttgtctgcctattgacagaccagagtcattattggtttgggttgtaaccaaaggatagtatccaccctcacagggtgtcatctccaa

SEQ ID NO: 28442 - DNA, 1341 bp, Bovine  19866880523577
gtaattgggaggtgccttgtcctgtccaccctccaggaggtgcagctcacagcctccccccacatgcactgtgtcccttctgaggactaggtaggacagggattaatgcacccattttatagctggggaaacagaggcccaacaagggcagtgagtcgtctgaccacccaggcagagtctagtccctgctccctgccccaggcctgggttatccccagacctcctctacatagctgggtgagtgaaggcagcttcagccttccctgaaggtctgatcttcagaccttgatcttcctctgtaaactccctttgtggtttttatggtgcatccaagctcaaagatgccagaaccagggctcgtatccagcctttccctgcatgtgcctgtgtatgttctggtgacctgtgccggtcaggggctgacagtcactcagtgagaagcactatgatgggctgctacactccacattgtaagggaagggcaatcagatatcaggtcgtgatgggcaggaaaggacttacaaaaatcataacttgcatccctgagcgcttacattgctacagacatgaggcatggttctaaatacatgcgaggtactacacacttgaaaagtaagtacaagaatcatagccattttacagagaggaagccaggcatgcctggatggtcagggtctcacaataaggagcagaaccgggactagacccaggcggctctgctctcagccatatcactccaagtggtgttaaatcagtatgttgccgccacctattacattagaggtggggaaactgagaccccgtgtgtgaaccatttccattggatcatatggaagttgcaggtccccgtgacccacaccttgtgttggtaggaggttccagggacaaggttccctaggatacgggtctttgcctgcctgtttgtgataagcccttgacaacgtaaatagccatggcttggggaaacaggaagggcagacagagggccctagcacacaggccatggcaagatgagctaatggctggaaggagaggctcacgtgcctgggttgtgcttcccacccacgggagctggtgaccaggaaggggattgtgctgggactcttccagggatagagaggcctggcctccatctcctccaccaactaagcaactgtgtgacccggggctaggcctggtcctccactgggctacaccagctttgtctctaaaatcagggctgggttagagtcagagctgccattctacaagtaaatatagttagccctccatatccgtgggttccacacccacagattctatatccacagatggacagcattggggaaaaatttttcagaa

SEQ ID NO: 28443 - DNA, 581 bp, Bovine  19866880523945
gggactcttgacccgacgaatttaggatcgctagaaaatttctaggtctagactcctttttgccacaggatgacacaaaccttttttgtttaagtctttggatttttcaagagaagtcaaaaatttggattttttgaaatatcaaatttcttggtttaaaagcacagttcaggccaaacaaagcaattcttccaagttaaatctcaggcccactagtttgcaaccccagctgaaattccaagcccagaattttcacatggggaactgagacccagggtggtagtggcagtggtttagttgctaggtcacgtctgactctcgtgacctcatggactgtagctcaccaagctcctttgtcggtgggatttcctagacaagaatactggagtgggttgccattccttctgcaggggatcttcccaacccagggatcaaaccctgtctcctgcactagaggcagaatctttactgactgagccacccaaacagggaaagtaaatctctaaaggatatagagcaagtaaagcatgtaggggctcagaccctggaggtcaagtttcaagattagagcttcgggcgtc

SEQ ID NO: 28444 - DNA, 1093 bp, Bovine  19866880589915
gtggcagcatggctccgggcctagcgttcaagtgataacatctaggatctggtgccaaattagtgtgacctttggcaagtcacttcccctctgggggcctgtgttctcatctctgtactgagaatattgccctgtgtctcagctctaaatggtagactccaatccaagagttaaactactggagtcttgagctagaatggacaggagggtgatgaaggcttggtcctgcctgtgggtgctacctacccccagcatctgatggtacagcaggtgatagtaagagatgccgggatgaggaaaactgaatgaatagagtcttgtgttccacgctccaggagctggagaaggaggaagggaaagtggtggcttcgggactgggatagcctgaaacttcccaggcggtccttgaatttggaaatgggtagaatttggtgtcttgggtgagaaagggaatgaatatcagctgggacacctagggaggtggttcctccaggtgaagcaacagagacgagtacaggaagtggagtcattgctgaaacagatcttatcccaggagcacaggtctgatccccaggggaggggagagccagggaggagccagggagacctgtggggctcccaagggcttccgggaacagggatgttgctggcttgaggcagaaatctgtgcagggaagtgggagagccctgcgaggtcggagctctgctgcgggaatgtccctgcctctgctgacgcaatggaaagcctgtcgtgttgcagggttcctgttctgcggtcgcccatggtagggggccagggcagccagctcttctgaggagctctgggaacttggtggaacttgtccaggcctcccctctgctctttcgtggaaaaaaaaagagaaccttgtttgtggaatctgcccctagtccctcgggggttgcagccacgccctgggagggtttaaatctctgtgggcggttccctggggctgggactggaggggacaggtgacaggggacaacctctaaactggattttggcctcacaccctctcagtgcccgctaccgggcagagcctgaggcagctggtatttataggcacccggtcca

SEQ ID NO: 28445 - DNA, 3056 bp, Bovine  19866880598796
cttagagtgaaagcttggtgcttagtgttttcagaaacctcaagtgaatctacatggccagaggagggcgggataaaaattatacatcacagccaccaccacccccacacatacacacaagagaccaagcaccctgagacacaccctggagccctgatcctcaactgattccctgactttatcttcctcctcttgaagagccttagtttccccatgtgcataatggagatgctgcacccagtgggtgctacgggacaggagtgctaggaagtcctcggtgtccacctcctctgcctcccccaagccaggccacccttggactcatgccccacagagtcccaggctggagcaaggacatgacagaaaacccaggacccatgagcaatgcctgccactcctcagaaggtttgggattggggacaaagcaagtgaggcactgaagcctgacagagcaccctggttaatgcatgccccatactggcacccagggcacgatccaggtgaatgccacccgcaccagcaaggcaagccaatgggacagctgtagtcaggatgcaggagacttctaggtcgagctctgccactgacttgctgagttactaatcaggcctctattttctcttctgtaaaatggggccatgaagaaaagatgcctagaataaagcaccacctcccaaagtaagggacgcttctccgcagagtctttctcttggtgctgaccgcgcctgactttctgtcactgctaattccctattactaatgctgcctgctttcctcccttccacctgactcagaaggtccatgaggtgtggtctccctccgagtctaggcccgccctgtcaactgaatctgacggagggagggtcacgccatctcggccaacaggccctcgaacgacggtctcccttgtctgagtcagagctcagctttccagggctggccagagggagccgggcagcttcccaagctcccagctgggctggaacggctgttcctcccaggccctggggctgccccccaccacttcacacagaccacaaaggctgctgggaacaaacctcagctcctgaagcccattcaacccgttaggcaaactcccaccttcaacaaataggtggctttgttctacacatccatgccagtcgggcagcccctcggctcagatgcacgaacggacagcaaaagtgatatatccaaaccttcagaagactgtcaatacctgctgctgctgctaagtcgcttcagttctgtccgactctgtgcgaccccatagacggaagcccaccaggctcccccgtccatgggattctccaggcaagtacactggagtgggttgccatgtcctgctccaatgcatgaaagtgaaaggtgaaagtgaagtcgctcagtcgtgtccgactcttagcaaccccatggactgcagcctactaggctcctccatccatgggattttccaggcaagagtatcgggagtgggtgtcaatacctaggaccttttaaatcaggacactgaggttaccccctcaaaggtttctaacagcctcatgtgtgtaggagcctgaagccctgtctggtaagcctcatgagacccttactgctgttctcaaatctccagtgagaccagagaggcaaagaggagggtgtcctcggtgctacgaagatagcactaggacccaggagggcatctgggttaacagctgcaggaagagcctcccacgggttgaaaatatccaacaaggaagaggtctgctttgatggagcacgccctgaacttggaggtattcagaagaatgtcgggttgaggaaaggttagcaggctctgtcctgcaggacttctcagagcctttactgtgttagtgggcagtatgtgtctccaagggaaggatactaggctgtgttccccaaatgtatttgactccaaagcccgtcccctcaacctccacagagcatcacttgacagctgagccacatcttcaagccacatctggccctggaggaagaggaaaagaaaacagctgccctaaacatctgacctggaatgggacagctctgtctccctaagagggtgcaggagctacccaggaggggctcttggcatcactcggaggtgcttaagcactaattctcaacatgagggtaactctacttttctgcaggtggagtcccacagcctccacactgctgtgaatttaaattccaaacaaaacctggcagggaagaccccccaccctcatgccaccaaccccagctgcctataagacctgccttcctcgggtacccggagaaagagaggaagggcatagccaagggcctcacaaatttctctccaaagacatacattaatagttgttgccacagatcagggttgaaacaggggttcattcacagggtctagtttctatacccagaggcctttttaagaactgcaccaagtacctgtgtgtgctttggcctggcaggcttaccacactaagaagccgagaaaacccccacaagcaaccacccccctggtgccagtttctgaacttgcccatgaactccaccatctccctctctgctcccggagccagtgctccactcagaacccttggcttatcttcagcttccagagctgaggttctaggggcacaatgggcttctgtgcccccatgtcctcagcccccacccccgcccaaaccccagctgcattcatggtgttctgctattgtggtgggagcagcctgggggtggtgcaggagggggtgggctcttggcacggggactggcgcagacaggccatggtcagtggtcagcatgcaagtcacatccgcaggcactgccactgggcctgccaggctctgcatggaatggtgacgctcctggggccctggggcccttcgcagagttcctgcaggcccacacacaacttgcttcctgtcggacaagccccttggtggcattcaggtggggggtattttttcttgccttctcaaccagttgctattttggagccatattaggtcaccagctaagaccctggatgcaggaaaggcctgtccctagaagcacagctgggg

SEQ ID NO: 28446 - DNA, 1654 bp, Bovine  19866880612214
gcctagggagaacggacctgaccacatcactaagaacagtaggtcccctgggacaccaggcctggctcggagtggggcggctggggtggccccagggggtggcctcttgtgccagctgcccttgccgctgaaaccattttgtctcattctccgtgaacactgggattcaacgttgacagaaagagctaggattagggtgaagggtggaagttcccgcccactcccttttctagggaggctgagcaggactggtttagggcttacctgctgtgggtcaggaggccagtttcagccctgctggctgcactgcctgtttatcctgccccggttaatgtctcctcttcctgggctgagaggcctgacaacattacctagagagaagtgcgcggtgtcttctgaatgctgggccgggatcagtcagttgtgagctgttagctggggtgtcatgctgctgtcggggatgggagcgggggcagcctggggccttggggagagccgtgggccccagctggctttccccccgccggcaggcccgctctgggacggcggatgtgtcactttccctccctggctcacacccctcctgcccttaattttgtgggactctggggagtgggcattgtggctggcagggggcaagtcagggggctcctgggcacttagcccctctgcctggtttgcttagcacccccgcaactccaccccaagctcttggacccccttttgcttccaatccttgaaaaagagaggaaacctcaagtgtgatttcttgcctggtgtttggtgatggggcctggctgtgaaaggaacttccctgaagctgtgagctcagcattgatttatttcctgcaaaaggatcgcattgtgattcctcccaccccagtccaggttgacactttcatttctgtgtgtgctttgggtacagggctgatttctataggcacaggagtggagctgctttggggcttggaatccacatggggcccaggattctcagagttttctgccttgtggatggctgccctcctagctagctccctagaggtgtggttgtccagccaggggagatggtcctccagacctgccgctctgggggctccaaacactactattctgggtgttcatgggacctttgattctcaagactgcaagggagcttggcagccacctcatctgatgtcttgttacacagatgacttccggtccttctgccacatccccacagagcatgttataggcttgcatgcctccagggacagctccctgcctcctatctgcttcctcctgggaagttccactttgtgtggcgcctggaagaatgcctctcactatctctcagaactgtgccgatagggtaaagtcagttcttgggaactccctttcgcatcatgggtgtttccccagagacttctcctctctagctgagttcaggctggagtgggcagaatgggcttcctggatgaggtagcctttctcagttctcctgctgctgctgctaagttgcttcagtcgtgtctgactctgtgcgaccccatagacggcagcccaccaggctcccccgtccctgggattctccaggcaagaacactggagtgggttgccatttccttctccaatgcatgaaagtgaaagttaaagtgaagtcgctcagtcg

SEQ ID NO: 28447 - DNA, 2190 bp, Bovine  19866880612445
aggcctgggcagatgagaaatcttgtactctccctaaagagtttctgttttcctcccctcaaacatccagtgcaaccaacctattattacctttcaagaaatatgctgctgggttggggctcactgccatatccttcctagctgcataggatctgagggtcaagacagaaagtgtcctccttagattcatctggcccttcccaactcaaagatggaacatcactcatttctgagcaccaaagggtggctagccggaccgcaccaggccaacaataggtgctcaataaatgtttaatgaactaatgagctggagagacagggttccaggcttgggtctgccattaattcgctgttgtctttggatacagacaattgtttctttccatagttgggtttcctgggccagaaaaaaaggacagaccaagtaatccttacagcccctcaattctataacacatacttaggggtgcaacacataggcagggagattgcagagtaggaagaggtttcaaacacctctccccactgctccagatagaagagaacaggatgtaactgctgggtgggaccctcctgggcaggggttctgaaagcatcgctgccacccaccaccccctcttctgcaagtgccaacctctgtgggtgaatgactagagctgtcgggcaaggaaaatgggggcagggtaggagaaaggacagaaagtaggtgcagagtccgtttaagccagatatcaaaataattccaaaataattttagaagagccattgaaagtacaaagagactatattttaaataaccccccctccctgacattcagattaactctgccactctctggcaaagctataatctgcactgaggtggaccctccaagagatcaagaatctggaacagactgatgggagaagaaggagaaaggccctgtggtctgggagcctgggaaagacaggcctgagtcctcagcagaaaccctggccagcggaggcaatgaccccgagtctgtgtatagagaatgccaactagggagtcagctttgagacaaaaaagtgccgaataaagtagacttctccagagggtttactggcccttggacaattccagacctgtcctgatgtctacaggtacaaagattacacagaacaaaagtccctgccaccctgacactaccagccatccaggcactgggccagtccctacccctctgaaggcctcagtttccctacttggcatagtgaagacttttagcgagatggtatctcaggccacagctgctctgacagtccacgatgctaagattctatggaaaagcacatcacctacaccattcagacccccaccccggagacctgggaggggagtccccagtccccagccggctggctgaggctggggctaagtggagtccccacaccgtctgtcctcaacagcctgccacggctgaaatcttcgagtggttacaattacagccgggctaacaggattaggggagcattgaaatctaagaaatctaattagctcagacaccccggcctcccccagcacgatccacagtaaccccagcagctgggcctgataggcggggcctggggccttcctgggccacagtcattacctgtgcaggtgtgccaggctgggccaggcttcctggggagccgccagctcagctgcccgactgctccctgctctggacccccgccacctgcagcctggtcctgggatgccactgagatgggctccagaaaactcagtgcaggggcctggtcagcagagggggcagtgctaaggggcagaaggaatccaagggcccccacagggcggctaccccacacggcttggggactgactcagccagaggaggggcaggctgagtcaacgtctgtatctatagaaaccatcacagcccagggaagagccttggtctgcatggggatctggggcctagaaacatctctgcttcctgctccagggccagggatgggggtaaagccccatgcacagacatgtgtgccctgggcagtcatggcaggatctggggttcagagcaagctctggctgtaagacactgtgccctaagaaaagggcacagttgctcagggcgtgagccatgtgctgccaaagtggggggcaagtgagcctcccaacccctcctgggcacacctcctgctacttaacctcagtccccagttccc

SEQ ID NO: 28448 - DNA, 1206 bp, Bovine  19866880615120
acgactgagcgacttcactttcacttggcttcattcacttctcttttagatttgtctttcaggcaaagagctctctgacaacacttgaggaagacaaattgtgagaccagagcaacacttggctctcagaaccttgccctggcctctcaagagatcagatttccttgctttgggccaaactctttaaagcattttggcattgggtgaagggtttggggggccagagggctggcggggagcagctgggatggcacccagggtcactccagcgctttgccctgctcttgctcttactccccatcctgatggctcttctgaagcaagaaaatgggccagaggtgccccagctgggcaccaagggtgggatgaagacctgggcttcccccttccaagagcatctgttgctacagatgcaggtcggtggccccatggcagctgatggctcctttcttgagacttctgcaaagcccagtctggggttgtagtcttcagagttgtccatgcattagagcacctggagccgggcctcaccccagagcttatgaggcagcgtgttacagctggggcctgggaactggaattttctaacaggttccagcagtgctgaagctgttggccctgggaccatgctttgaaaacccatgctttggttgagtgaaggaagccgaaggcatagaaaaagatgaagaaaccaaaaagaggaggtgggctggagtcatgccacgcaggaccttccaccgtgggttggggatttacagttacatgggtgaaggtgggggtctggagcagcaagaaaagactcggggagtcagaggcgcccctggcagtgctgggcctgagtcctctctatcctgactctgcggcttcagccagctccccccaggggccccaagtcccctccctgggtgaaggcacacatccccctgcccgcccacctcctcaaggggcaggtgttgcctggttggggcgatggccttggagaggggattgcaaactggaaggccctcagcagatgtgagagtgattattataatccccctcccccagatggcaccggtctgggttgcccccacctccgcctgccaggcccgctctctgtggtccctgggggactgaagggcccgccgctccatggccacctccagggccccaacccaggctcagcatgagccagccttccagcttcgcagggtctttcttcaggtg

SEQ ID NO: 28449 - DNA, 2662 bp, Bovine  19866880618383
aatggaatttagcctgtatagagaccaaattctgaggacatgtccagctccttttattaaacatgaaattgtggtgcagccagcattgtctaaagcgggtatccttgatggagattgggactctgaagaaggcaacacagcccttttgaggataagcacagcctggcaggaacattttgctatagataactgtcgtggttgtgggcttattgggattggattcagccatcaattcccctaatgggattccctttgctgagttgccctctctaggctgcagtgagctccttctatataagatgaggggttagcctagatgatttcaaaaccctttccagcaataacatcctggaggtaaatcatcagcctgatgtttagttccaggctgtcgtatgtgcgtgtgcatatgtgtgcacgtatgtgtggagtttgcatgcatgaatgtgcgcatgtctgcatgcttacacagacatgctcagggtgcgtgtgtgcatgtttccagtgtcctttaacttgatcattaacgcctcacatcagacgccaacaataaacagaccatagagacttcatttctagctgctgctactttcgaaacagataagggtcctgggaaaagcatgacacctctaacacgcataaatacacctggcaagcttttgagcccctaaggtgtttttcatcctggcaggtatgctaaatgtgtccacataattgtgtgacaaaaattgtatccagctttccttaacaaaaatctagtgcctcatttacctaggaaggctgatgtaccacttgatgaacaaggctgagactaaccatttctctcaataattatattctgatggctgcagggacagaccatgagaaaatcagattatttttatacagcaaagagaaagtcgagttaaagactcacgagtattaccactcgaattataggtgagcccttccgagaagatagcctcttcgattctaggtagacagaataattggaaaacctattgttctcaccatcatgttgtctttttagtttagcttgtcccttttcactatttggagctacattaaatacatatattttaaagaagctgtcacaagagtcttccaaatattctaaatattctgtttctcaattattccccctttgagtacacgttctatccacactcatagtaagtgacttaaaaataaataaactaccatcattccctttctcaaaaaccatccctggggactttcctggcagtccagtggttaagactgcttccattgcaagcagcagggattcagttcctgggcagggaactaagatcccacatgctgcatggtgtggccaaaaaaaaatcactactgacctctatcaggttcaagtccgaaccgtcagtgtctgtcaaggctgctcggattcttcaacttgccctcctttaccgtcagtcttaccagcagctctgctcctcagtgagttcttctcgcctataaccacatggatcctcctcccaggcccccgagacccaagttcttcctctgacaccccgaaacctctgacataccatctcctcaaactttcatccttcagggagcctttcccaaatgccctcacttactcattcacaaatatttgctgtgggtccttgggcccaggtgtcaatgatacagaaatcaatagtgagagcgacacagaggcacactgaggtcatttggaaaccagaaaatgttaccagggcagtggagtacaagccccaacgtagcttccagcacgtggcgggcgttcctaagggcaggtagcatgaagagggctctagggacagatgagcaattcacccgggacagggaaagctgggaggccctcctgccgggagctagtgaatgcagctgcagctgatcccatgtggtgccatgagaaatgtcaccccaacctgggcaactggtctggctgctggtgctgccaaagcccaggggaggatggagccttgccccgaagctgagccaagtcaggagctggccaaggaggtggagacagggaaagccagggttcctgggggtcgctgaaggaggcaggctgggtctcaccctggggagacaggagggactccagcagagctgcaggcagggcagcctggaggccagtccaccgcatcctaaggagccagccaatggacaggggacatggagctcccggagaacccagcctcggctcggcccgcattgctcacccggagctctggaggctcctggcattcggcgagtgctcagtgcagacctgccaaaccactgagtgagtccacgagcaagggaacaagtgaaccaagcacagctgtgcaacacctccccacgtgtccaaggaacagcacttttctttggggcctccctcggtttccctttaaaagagaaacctcccagggcttgtttctgaaaacagtgagacagaggaaatagagccccctgaagaaacaaagcaagtgcttttttctctcaggcctctcagggtacttcaaagaccctcagggacatccaagcctggcacccagggaggcacttggtaaagaagggtcgaatgccctcagtagagccttcagctctgcaagtgaagtctaagagcatgacctccctccaccccactctgggccccaggtcacactgccctcctgggacccccactagcaag

SEQ ID NO: 28450 - DNA, 1162 bp, Bovine  19866880636012
tgggaccccacgggaggggatgcgcttcgttaatcacagggagacagctttccgggcagcctcgaagacagaccgaggagaccggagctgggagggagctcccccacaagttcccaggggaggccagggctcctgctccgacccagcactgagtcccatcagctagtggcttgcccttccagtgccctggaatctctgagaactgccggtcctgcttgcggcccagacatcaggagacaaaggtgggtgtgtctgtcctctgccatcaggccttccttcttccgtccagtgaggcatcagagaaaccctctgaggccagagggttggaatcttggttctttgcttggcaatcggctggtcgtgtgaccctaggtctcaggctgtgcaaaataaggcaagagctctgacactacctgtgtgcccagcctagaatcagtcatcatgctgtggggagggcacgtacagaggcccacgccctccatccctagacccacagaagagcaagtcagctgtggtcgttggcctgatctgagtcactgggcaggcttggcagtgggaggtgacctacgcagccccaggcagcagggccttggagaaagccatggtagagagaagacagcctggagcacaggcaggaataaagacacacatttgccaggagctgggcttccagtcaccctgctcagaccaagcccagtctcccctcatcctcactttgccttttggtgttgagggctgtggactcctcttggaacacttgagcccctcacagcccacagggatgcacctcactgtgatagaagctcatagacatcaaagctggagatgcgctggctgacccctgacctcatcatgtgaccctaggcaaatccctgttcctctctgagacctgtcagggcacccagtgaaaagagagcctggagattccctgtgcctttcctctaaggtcactagcattcctgggtcagccagcagagaggtggctgggctgagttgaccatctgggagacccagcgataggcaacaggagggagacagcctgggcagccaggcagggctagtgggcagagcatggggcacccaggggggtcagagcaggactcaggcccctccacaggcaaggggaaggggaaagaacaagtgatattcaagcaaatctcta

SEQ ID NO: 28451 - DNA, 1032 bp, Bovine  19866880644563
caactgaataacaacacacgcagaggcaaggttcagaaaagtgacgtgacttgagatgggatcctaacgggagtagtctgattccagagcctgttcagagaaccactccaccgtgttgacttaaatcctcaaactcctttgcggtccccaggctgtgtccctggcacacaaatgctcaatgcgctttccccagaggggacaatggaaggggggctccagggtccaggcttgggtctggctgggatcactctactggtattaaaccccatcccagttcccacagctgtaaactatgagatgtttccagcttctttatgcccagaactagcggtgccacactcttgagtctggctcacagtgacccttctaaaccaggccctgggggctgccgtgaggacagagcagtaaagggatgcatgcctttttcccaaacctggcttggcaacaccctccccagcagcaggcacagtgggcgaccgtagcacaccccatagggtacccagcccttgggccctctgtgatctcccagccaattctcttgatgccccacccccacaggtgggaggatgggcaagggcagggcaaagaggctgccaagcaggtggcagttgagggccagggataggccaaatcttggttctgccctaacctgctgtgtgacctaggccagcgtgtagctctttctgagttttgtcttttctagctgggaaatgagtcaggcatgcctgtgtgatggttgggtggattacattaaatgagcatgagtgagggcctgacccttctgagaggtgtcatccacgcacacacgtgcacacgcagagctgggaggacgtcgggttacaggaatccccatcccggcctgcggagcacgccaggctgccctacccaagaagtgtctctggggcctggcaccagggtgagagtctccgctcctcctcctccagctcagactccttcagccccaaacctataatccccagctgggaaaatgacagccttgcccagcagccgccctcggccgccgggcgggga

SEQ ID NO: 28452 - DNA, 2254 bp, Bovine  19866880704874
aaatgaggggtgtggctgagagttctcaaatgaaagccagtacgggtcagtctccctggctaagctaagcccttcttcatacatgatcttactgaatactcatgaccttacaagataggtaacgttgtcaccccactttacagacagcaatctgaaggtcacactgttaataaggggcagatcagaacctgtacccagagagtccacatttagcatccacactcttagccagctcccaccgtaccagggctgggcccccagcaccaggtgaggtccttcctctccagtgatcctcacaaggcctctgagtccaagccctgggctcaccagggatgcacagccagccagcccccctctcatcctccgtccgtcccaggcacacacggaagccacccctacacacagcttctgtgagcgtttacagggtagaagaagaagaggatggaggggtgagggaggagaaaagttggggaaggggagacaggggatgcagagcaggaggggggtggctagagttggggttgggaaagggtggaggaagacacagaagaaatgcagagggaagaagagccagcgagcgagtgagaaagaatgacagagaaatggaaagagaaggaagatgcgagaaacaacgatggagaaatggaaagagaaggaagacgccggaggtggcaaggacaggagggaggaggggacgtggagggagggagacacagccagaaagagcagagaggaacagggaaggaaggaggagcagttacaagaggaagaagggaaggaggagaagtggtggagtgagtcacagggaaagggcaggggatgaagggagagggaacaaaggaggaaagacagacgggggtcagggagggagcgggccttggaaaaccgagagacagagggaaagcgaacccgcccacccgaacattaaatacctaacaggagatgacaaatcaaatgggaattactgtggtaaaaacataattagaaacttgattgaagttaaacagaatttacataacactgcaaattaactttacacggaaactattcactgggaaggcaatgaaaaggcatttcattagtaatctatatttaaacaataggcacaatggagccttctgatgaggaacttggtgccttcaacccgagggaatgccagaggctgctggagaacaggaaggcagtggatgctccaagaggaagcgggcagggtccggggtggggtcccccggcctgcggatggcggggtggagccgggtggacacagtgggccagatcagattctggtaccggttctgccctgggcttgctgtggagtcctaggtgagtgtctcacctcctctggcctttgtttcctcactgacaaaatgagaatgttggaaaggtggtttacctggaggtgcttacaagtctggatattctaggagagcctgggggatggtagaaggcagggctgagcatggacttggggttcaggtggacgggttgcttcaaagctccatcctgccagctgcaagctgtggcatcatgcaagcctcttcctctcgggccctggtttacccatgtgttcaatggagataagtgcactgccactcgatgtcacccaggcagtggaaggatttatcgagagattgggtgggggcaggcttaaagagaagtgagtctaaaggcacaggattacttggcccgtccgcctggcacactaattagattacccacagcctcctgccaccggcctgccactgagccacgcagcatcaaagcggcttcccacggatccctggtccccattccggagtcagaggcacacctccctagggaactggtgggtcaccaagtccccacctggctccatcgtgtactctggtatggagaagtctcctgggcctttgcacatcagttgtgtccaactctttgcgaccccagggactataaagtccatggaattcttcaggccagaatactggagtgagttgccattctcttctccaggggatcttcccaagccagggactgaacccaggtctcccacattgcaggcagattctttaccagctgagccaccagggaagcccaagaatgctagagtgggtagcctatcccttctccagcaggtcttcccaggcacagcaggctgtgtttgctgagccagaggagctggcctgctctgctgccccaccacttgccctccctgcacctcccatcccacctcacaccctgtggaatccttgccagccttcctctctgcaacctt

SEQ ID NO: 28453 - DNA, 943 bp, Bovine  19866880767017
ctgacgtaccgtaggcgctcaggaagcgccgggcggttgtactgagggctgggctgggctctgtcctggacagattgtgtgtcctgaacacagatgtggcacttagtcaaggccccaccacatacacacgtaccattacaggcaaatgtggaagacgcagagcaggtcccgccacactggtgtgcagaagccaacacgagacacgcgggtgaccctgagggcaggcccaacagagagcacgcatgactcccctacagccacctggagtttctgcgggcaccacagccggcaccccaaccagccttggcctccttgactgcaccggggcagcaaacaccctggggctggaccagtggaggaatctgccagacacaaggccttggccagaccaggcctgatatggttttcatccacgttgtcttgtccctctttatttccagcaacccatctttttaaagaacgctgactttctgagaatgatggtggagataaaaacctggatgctgacgtgggtggcagggtctcatctaaaaagcacacgggctctggagtcgggaaggcctgagtttcaattccagctttgctgttcattagccatatgaccttaggcgagccacccaacttctgtgggccttggttttatcatctggcaattggcctgatggagtttttgagataattaaaggaactgggacatattacacactaagctcagagggaaacccaatgcttagagaatactattattgctgttcatattattattattacccttgaatagaaacctggcacgctatacacagatagctacagggacagattttttaaagatgataaacattcttgaatcctagttttcttggggcaatgctgacgttggctggagagaagtcctggccaggcacagcctcaccccacaaagaggggttgcctctcaccaaca

SEQ ID NO: 28454 - DNA, 2591 bp, Bovine  19866880791831
ctgagtgtctgatttctctgcagctccaaggatacttgagttgctggtctttggacccactttgagtagcaagtgtgcagcctgacaagagcgtgacaggactcccccctggttcactgctggaacccaagcaccactaacggcactgggacaaaatagacgaatgaataactgtcagaggcagaaaggcatgaacagctcttgaatgcaggtgtttcgtggttgccatttgtgcacaagaaagttgctgctgctgctgctaagtcgcttcagtcgtgtccgactctgtgtgaccccagagatggcagcccaccaggctccccgatccctgggattctccaggcaagaacactggactgagttgccatttccttctccaatgcatgaaagtgcaaagtgaaagtgaagtcgctcagtcgtgtccgactcctagcgaccccatggactgcagcccaccaggctcctctgtccatgggattttccaggcaagagtactggagtggggtgccattgccttctccgacaagaaagttgaggtcgacgcaaagccataaggaaaacaggcttggggaggggctggcctgcatgtgaggttggcagctgagtgaccatgggttccagagttcaaggataagagtggggaaggaagggcccgggttctgagagttgacagcccaattccaaatcctgcctccagcacccactgggcaagtggacccaagagatgaggctgcaaaccaggcaacaatacatgagtggatgattgtctcactcactccttttttcatctgatgggtgagagcaaccgtattcataatccgtaagggttattttgaggattaaatgagatgattcacagactggacatcagatgtattgaaaatggtggttcacttttttaggtataataatgtttttgctttcttttttaaaattttgtatcctgtatcaatacatactgaggtatttatgagtgaaatgatacaatgtctaggatttgcttattttagcagagagggagaagacagaaaaggagaaggaaaaggtaacagaagggatggataaaaaaagaatgacaaatgtcaatcattactgaagctgggtgatgggccccaagggtgttcatgactgtcctgtctgtctttgtccacccttgaatatttccacaatcaaaggtccacaataataaattagaaagtgaagaagtaggtgacttacttggcttggctcctgattcatagcaagtgcacaggaaacgtcagctccttttccttcaaggtgggccaggctctggccatgaaggaggtgctcaggggccaccaggcatgtcccccaaccctgagtgatgtgtccaggctcccactattgacaggagcaagcttgagatttgataccgcgcctccgcgtgttcagcccacaggaccacacagctggaaaagcagggttagcttgccttctggaacaatgggcagtagagacagtgctaaaaataatactcacttctggggactgactttgccaggcctttaacatatgttacgttatttaattcccccaaaatcctatgaggcagaggtcatccttcctgcttcccataagcaaatgagtaaatgaagactcaggttggtggagtgcctgggctgcagctgcactctctgttgctggacataccctgtccatagggggaagctgctctgttcacccaccccttcctctgcattgtttaatgtgtggcctggtttggtcagggctcaaatgctggtctcagctcctgggagtgtgttctgcctgcccagctctgggccaccccaggtacctgcaaactccaggtagacatgcagtccagggctcttgcctgctctccaggccccagcaaggttgcttaggcattccaacgggacaaaccattgccccctgccctccctgtctgaacccagtagggtgggatttgcgtcccaggcctggctgttacagggacacggccgcccgctcccctgggcagcacaccaagtcctgctgtgaaccccaccatgaatggcagccattctttaccccaactccaggtcaccaccaccccgcagcctgggaagggagacctcagccttccccaggcctgtaaacaccaagccacacacacagcagggccccagcagccaataaatcttggccccaggttctcttaaagagacagagctgggacagacagcaaccagaccccaggtagctgtagccagctccaccctgcctctccaccgcctaccccaaatcaagagagacaaagtggcacactaacagcactctccctgtaagctttttgctcttgcttctgacatctaacttttctctctctctcttttatttttcccctctgctgcttaccctggggataggataacaggagacctgctggtgggaatgcgtatgtgattcatcttttggaagctaagcccctgggctcatggcgggagccgggtggagaggcagaggtctctggactttgcacccagggaagcctcagggaagccagagagacagtcggggtcaggtgggaagccagcccagcccggaagcatgcgctatagaaggagcgt

SEQ ID NO: 28455 - DNA, 1294 bp, Bovine  19866880818701
atatatgtcctgtcgtaaagcatttaatattttatctcctaattgcattaccagagacagacagctgtttatcctcatcactctcccattgctgtctttggcaggacccactgggccactccaggtgtttccttgcctccttttctgaaagtcctggatggccaaacaggcacctccaggcagttccatgtggtcaggcagtgagtggtgccagcagggtggggggcacctgtgcttggcatcatggggtttcaaggcaactcatggaccctgtctgcctcctcctctctgcccacagccttcccgtgtattcggcaccatggctgccatcagctcatctgattctcacagccctgtaagacaagaaccaccttactgatcccacgatacagaggagggaaaagatgcaaggagaggctgtgaatctcactcactcactcactcgttcattcactctttcagctgtccttccgttttgtaggagcagccttgtggaggccaccaagaacagtgacataaataagatgcggtccctaccttcggggcttgtgcagggaaagtgaccatggcacgaccccctcggggtgtctctgtccccctggtagtgctggccactgacagagtgctagttctaaaacatgaaccaaactcaggttcagaactcttgcatggcctgaactcagcgtaaagccccagactctataaactttctgttcatattctcgtacaaccaacctcctctctcacccccttcaccatggaacttcacacttaccaacatatgaccgccctgcttgctgcccgccaaacagcccctcctcccttccaaccacctgcgttccctgtcagcagggctctgatgctgtgggagtggtgcgcagagattctcgtacccggctcctcagcaaccccagtgtaaacagagcatggttatccaaatcccttttgccaagcatttccccagtcttcctcacggatggtggtgaccagccaagtgacaaagtcaatgagaacagggcactgctatggaccaagtgttttgtccacctccatttcacatgttgaaaccctagcttaatacacctgttgatatttggaagtgggggtctttgctttgggaggtgattaagtcatgagagtagagcctccttagtggtccttataaaagggaccccagagaactctctctccctctttcctccttgtgaggatataatgagaagttggccatctgaaactgaaagagggctcttaccagagcctgacagtgcggcctccagatcctgactttcac

SEQ ID NO: 28456 - DNA, 1786 bp, Bovine  19866880840145
gcacacctcctgctacttaacctcagtcccccagttccccattctgggggtccacatggatttctgcacccttgtccctgcctggctggtacaatgggaaggcaccaacacactcgccatctataaggcctgacattgagaatggctgcagcaggggatatttcacctccctaaacctcagttttcttctctgctaaatggggctgattctaaacagcagctagcttccgccactgctcttggagttaggcaaagttggacagcacttcttaatccaccaagtgctgtacaaaggcgaggggctgtggttattactgtcatcatgcgcccatggcaggcagccagccggtggtggttaattatttatttggactgatcttcctgcccttgctggactggaagctcctaaggaacaggaactgtcttacacatttcagggtctctcacaggccacggtcctcacactggggactctcaggaagtatcttcagcagcagtgctagggccctgacccaaccccactccccgctacgtatctcctttcttcttctaactgatcccaaggcaagtgccaggaagcagagctggcacgcagacgcagacaagtgacagtgagcccctaagacagaccccgctctgctccccacaggtcactcccaataagggctgaggcagccaattgaaaggtgtcctctcgccccagggaagtgtggcctgcctgggcactggtattgaatctgggatcatcaaagtgctagtctgtggtctggagaacccctagttccttaagcccagcaaaggtcagcaggggttgatttccagaaggtatgcagccgagcatgccaacagtcagagctatccactaaaggcagaagctgcccagaggtggtgaacaccctgtcatggggagcatgcaagccaaagctggacaataagcttccaggaggtgtgtggatgggagagcagtatctggcaaatgcttctaacacctccaatttaaccccttggtgctccattcattctgcacccacagcctgccaggccttcaggggacacacatccagggatttcacacccatatctgcctcatcctcacagcaaccatgtggcatcagagttgggggtggggtggtcctgcctttggacccattttacagatgcggaaactgaggcccagctgagtaaagctatgagccggaggcagccagccaactacagcctcctgacacctttcccctatctcctcaggtgataggaaatgtttgcataatcctgacaggtttctggactctttcctcagagcctgtgcttagcactggttttctcagcctctcatcttccctgagggccacagggtccaacctcaggatcacccctggagcttctagcctaggcaggctttgcctccccttgtcatcagggtagagctctacggataaagagccacccccccacctccgcccagagggcgtggacagaggccactgtgtcctgctgagaggtcaaagcagtcaccaggcaaggctgcagcagggttcagagtaattacagcagcccagcctttgttgtccacacaaaacctaaggagcctcataaagatgaggtggtgataggagccagactagggccctggggagcaaagttatgaatgaaaacgtatgggactcagtcagaacctggcaggccctgcttcctggttctgtgacagagtgcccagagaagcttccggaaattaacttgttggtgcctgaatctcttatagcaacatctcacgtgagacgagagt

SEQ ID NO: 28457 - DNA, 1867 bp, Bovine  19866880843623
ggagcattgatttcaaacccccgaagagcagggactgtgtggggtgcatttatatgtgtgtgtagcccccgtgcttggcacggagtgggcctggcacaggacggcttatcgttccttgccctgaacatttctgttgagtattttttattttgagaggcattcccacgcccttgacctcatcattgttcctgtagccgtgaaggtagagaaatggtctggatgcatgagactgtggaagaaatggatgctgaaggtgggggagcatggcctgcccaggggaggtggagatggaaggtggcccccagacccccatggccttgttcaggggctgtcttctttgtctggagcaccctgaagtgtggactggggaggcagcccccgagatggcttaaggtggtcacgggaccagacgagaaaaccactgctacatcagctctcttcccattttggggatgttgctagttcagggaggagagtatcagtttcctgaatcccaggctccatttttaactggcagagagctggcccagactctcccatggggcaggcgcctggagctatacctggacgcagggtccactctctactgtctttacctggacagttaacatctaaatatggtcagggaggctggtttgccagataaggtggtaacagagagaagaaagttttcttttcaaatttccctcttgaagtcaaaataagtaagcaaccacatgaagcatacaatcagagtatgagtgggactggaatacggcagggtgaggtgaggatgagacgcaggtgatggaaagggggccgtgacttgttgctggggtttgtgggtgcctcactgcgcacccccgggggaccatgggccctgtggctctgccgggcatctccgccaaggcgtgtattggagggtacatccacccgccccgaccccaaggagaccccagccaataacagatgccagatgctggataaaaacctcctcgttctggcctcttaggctgactgaggggtgcattctactccatctccaggagctccccgcaccaggtatggcacttcacatcacactctttcaatcacatcattcccttccccatctcatttctctgcttctctactggtgttttctgggctcttccaaataaatcgcttgcactggaaacgtcacggtggggtcggcacctgggggaacccagactcggacacacatcatgtgactgaggcgcctccagcagcctttccttcccccatcgcgtcacagacccccgtccccatcatgtggtccaatcctgagtgtggagtcccggctggggttctggactggagcggtgaggatccaggtaagacaagtagtcccctcttgagagggttctgtatgatctgttggggtcccagcccctaggcagccctgctctgagctgatgccctcatcccccgaccctctctcctccggacaggcctggaaagcagatctccagcagctgtatcctagcacaccccggctctgtggggagccagcgatgatctaatcctgagaagagagggaggcaagaagagtagcctcccctacaagtaggggcctgcccctggggccctcacggaaccagagaatgccatgctggggaaactgctgagccagcctagagaccagggtgctctcccctcccccaacccctgcaaactccagccaaactccagagaaacccacaaccaccctggaggcttctgctaacaacagaatccatgctccctgcagaaaatatgggaaacaaagttgacgatctccccgcatccagatagattcctgatttctaagttgacattttggtatattcccttctgtttcctgtttcctgtgcctaaccaaatgtat

SEQ ID NO: 28458 - DNA, 707 bp, Bovine  19866880849922
ctcctggcatcttccggttcactggaccccatcctgagcatccctgcatcccaagtcccacgtatcctgttcttgtcccacctgcggtctgccctggaagccctgaagacttctcccagtccttttgcacagctgagagccactttgcctcccagcctcccactgctcaggcaggggggaaggaggtctgctctcacaccctccactcttcacacgcccagcccacacaggccagcagccagacttccaagtcccctgactcctggtgtactctgagggaaggggagtcggggcatatggaggtgtctggacagaggaagggaggacgtgaaggagagggcgggcgctcacctgggggcggcggcagagcgctcatatttggctttatgtcaggcgggaagggtggcttaacgtcttggctgggcgacaggtatggggggatgctgcttccgggggtcatggggggcgtggggttccctggaacaggtgagtgggggtagtttgccacaggaactggcctgggaggctggaaggaaagagagaccatagataggttacgggtttaagaaataaggaaggagggggctgtgcctctggacacagaccccgcccaccctagcatcccagggctgcggcccttgctcccccaaggggagagacacccccccgccccgcagggaaaccccttcctccactctgggcgcact

SEQ ID NO: 28459 - DNA, 1685 bp, Bovine  19866880857582
cgcctgtcagtgaccagtggccatggggtgaagcagatggccagggagggggggccaccctcaggcctgagccaagagaggccaagtggcccacacaggccagagcccaagaccttggcaccggccactcggagctctcgactcgagagttaatgattcatttgtggccaatttctgctggcctttgcctggaaattcccaagcctgccccttcccttggctccgggagctccaagagtacagtctcatttacacttggcggaggacatctccccccactatccagggaatggcttttacaattacagctgtagtgatgctggttagcccttaggaggaactgattctgacctacaggctgggggctggggtgcttgttgaactgtagtcaagttagaggcccctctctgaccccctgggtgaggtgctgatggaaggagccctgtttgcattcatggtgctccacgctgagtgcagagccgatgcaaacagaaaccagtctggtgtaatgtgaaaagtgtgacaacagttacaaagggggacatagagcttgacctggagtaggacttggctgtaggaaagaaaacaataatatgtgcaaaggccccagagcgtgaatggacaggggagattgagtcgttcttctctggctggagcaaagaggctgtaagaaacatctggaagttcagacacaactcccaggtgaaggacttagacttgggggtttggcagtgggaggtgctggcagtggggagtcagggctgctgcctgaatagggatagatgttatgattggaatttggggggggtcacttgcccatatgagtcttgattctgccggtcagcaaacctcccttgacagcctgctctgtgcccactcaggcccaagccctacacaggtgtggtggtggatgagagggaacagatcaagtgcagcactccaggtggggtggcagggacccggcagagccgcgtgctgctgacagatgtacgggtctgtgctgacattttcagactcgctgagccccattgttccaagtcttcaggtgagcatgtggcatgttcaggtcatcttaaggaactgcatgttcctgacagactggagagatagcctggaggctaaccctgtcccctcagaccgcatggtcttcctgaaggtcgaatgggtatctgtcactctgcacgtgcacaaactgaggcccagagaggccaaggctgatgatggtgctcggggccgtggtctcccagtccttagctgactgtatgtatatcacctcccacatcctcctccaccctgatgcaaatttaagaatatttccccaaaccaggcaaaatatacagcagcctggtcctccaggttgaaaagtcccaggcttggggagggggcttccgttacatgtcttttcaactttgcacattcagtttcttctgattatttcttgacagtcccaggcgttggtggtaaacagccactctccccagaatgtttccccgcgacagcagctttctctggagagggtgctatcaacacttggcagggcctcctcccagctcccggcttgggctcctgagcaaggagagctcctgaaaggcgttcaagaatgccgtgctctccgggggggctgggactgcagggtcctggcgggcgtgggcctggcctctttgttccctgcagcagccggcagc

SEQ ID NO: 28460 - DNA, 1388 bp, Bovine  19866880968060
gcccccagcaggggtggcaggatggggatgcagctatgtttcaccaggaagccccactgtacctggaagggctgcagtcagccctggggacctgggggggtgagtccacagggcagtcctggacagggcaggatggacagtgaggggaggactggggcctctgccccaccccacgtccccggagtgcttcctggggttccttgctgtctccctcccttactcctgagccgcgggactccagtccctgcacacttccgcctccacaagcagcgcggcagagcggaccctcctgcaccccagctctctcggtgtctcccaacttgtaaaggtgcgacgcagagcagcatcagtgggaggaatgagaaggttgtccttcaaccccaagggctgatggccctcagaacgccacccagctgcgccgcatgggacctgcaggctggccctgctcacctggccccgaagcccccgctgccggggtagttgggccggccgtacatgctctgctggatgtagggctgagtggggccagccttggctgagaactgctgctgctgcccagcaaactgtggggagttgaggccggggttgctggtggtcatgcccgacgccatggggttgccgcctggattcatggggttgttggcattggccatagggttcccaaggacctgtgggcagagagagcggctgtcactcacgtgggtaccccaagtggtgtagggagggaaaaggagaaatggcagggggtgggggaagcatcaaaacacagggaggacaacagagaaagaggagggggaggaaaagggcagggggcttttcaaatttcctctgggcatgaactgctggcgcagtacacagtattagaagcgggtaacccagcccggaagcgggctttgtagataagaacgtcagccccagggtggaacaaggtgaggctggcctgcacatgctgcaggtgggaaaggcctggacttctcagtcttcccgtcctacaaagcagcctggatgcccaagggtcaggccccacggaggccctgctctgctgctctgtgagggccaagggaagcccaaccctctagctctggagggtggcagggccctggacaaggggctccctgtggcccaagactgcagataaagggcgctggttctctacagggtggcaagtggccctgagccattcatgtggccaggcagcgggaaggaaggcgtggaggaaagaggaaggaacaagagcgggaggcacgacagacgagggatgtggggtgcagtctgtcacgagttttaggctcaatctttcgctgaaatctaacccaggccatccagggtcaaagactccaggtgttgggaccctaaggtcaataacctctactaagttctcctgttaa

SEQ ID NO: 28461 - DNA, 1977 bp, Bovine  19866881008654
tggggaggaggggccgaaatgtactcctcatcaggcagcaacagtgggtacaacccaaggctaccatgttttctgaaaagacctccagacaggagagaggtgacaggccatccctgcagagcacctcctccatgcccgacactgagcgtggcccccaggatgtgccttctcattgactcctcagagcacactggtcctgccctcatcctccctgtatagagaaggaagctgagaagtggggactaccttcccaggttcacacagccagttagaagtggacctgggattcaggtcgggacccgtccacttctattgctggcctttagggatgccaggcagggatgcaacccagaccttcccaaggtttctccatttgtccgaagctgacaccatctggctccctcggggccactgggccaaaccaggcgaccgcctgcacttcccagccctcctcatcctccagcccctgggctgcccctccctcacccagctcccttaatcctctttgtggggatcctggctcaggctaagccccaagggcagggccagatgttactcctgtcccgccgctggtagtcgtgaggaagggagggggtagcgctgccatgctccctgtcccgagcttgaccttgtgagattgcagggacctaaggctgaagccagtgatggcctcggtcaggcggctggacaggtgggcatgagatgaccagtaactggccccaccatggccctgacatttatctattcattcagcaaatattcaccaagtccacacttagccctggaggggcgggcagtgagcagtgtggtcctctcgcaggcagcttagctttctgtctgagaggctgacactaaggcccatgaaggagtaagttaaggatgtttcccagcaccctgtaagagggagcaggatggtgatcagaaagtgtctggaggagatgcgacctgaagagcaaaaaggagtctgccagggaagatgagcgggaagggttgtccaagcagaggcaatgggagtgcgaaggccctgaggcttgatgccggtctcaggtgacaggatcacaggcgtgggcgaggggtacaagaggaggtcaaagaggggggcagaaaccagctgaccccaaggctgcagaccgagaagagtttggatgtgattggaagggcagtggggagcccttgcagggtcttcagcaggtgagtgatgggatataatttatctgaggacaagagctctgaaggggagcatccctggagggtaggatggagggattatggaggtcttcgtggaggaggaagcccaggggaaactgtaggatctgattaaagggggatgaggccatggcttcccaggcacaggaaactgtttagacaaaagcccagtgccggctgtgcccccagcttaaggcactcacttggttgaatggccagctctgaaccccaccccattcccaacctgccacttagccagaaaggggactcaggccactggccacagctgtggagacctgagtgtgattgttgcttagggccctataaaacctgcagcaggaaaggctggcagggggcgcggggagtggtttatagaagacaccctcggtgcccacgtgtctccctgttactatctccttgcagccttgtgaggaccctgcaagggggcagggaagggtttatcaccctgttttacaaacaaggcaacggagtcggggggagcagtttgctacagtcccaggtgggaccgctgcccccgcaagagcccctggggcctgccaccagccctcctgtcccctgggcgtcctcaacccagctgtgccccgggaaagggatgggatgggacaggtgaatgatcccacggggtctagtcagggttccccccaacacacagacacactcgcaccccttcccatcccgagggctacctgagccctccaggttgccctcaccctttcagtgacctctggaaacaacttcctctggattccg

SEQ ID NO: 28462 - DNA, 1316 bp, Bovine  19866881026638
tattctggcctggagaagtccatggactgtatagtccatgggggtcacaaagagctggacacaactgagtgactttcactttcactttttcacttttcagggggcgtctactatgtatcaggaactatgccaggcacttttcaggtaacatctcatttataccacacaaatcagtgaggtagagagtatcccctccattttggagcagaaacagagcaattcgtttgcccaacatcttaatagaaggatccaaacccaggtacacatgcctcagaaatatttaatgcagctgggatgatcttaatgtatacatctgaccaggccacatctctgtttcccgctgctccctggtgcctcaaggaccacagggaaattcaagagccttaacctaacatccaaggctgtccaccctctggccctgagcacggctccttctctagcctgtctccctactcagccacctgcagtcacagtgctgtgtccccttaaacatgctgtgtatttgaagagctctggccttggtaaagcctggtccatctgccagaaatgcccttcaccctcttctctgcctgtcaaattcccatgtcatatggtgtggtcacatggtgtaatcacctcctagaggaggtgtcatttgagttggagtcagttaatcctctggattcatgaaacaactttcaccttcattacaacttgacatggctgagaagacgtggatgtttataactggtcactagactggggatactctcagagcagagagggtgaactgtttatctctgtatcctagcaacctgcacagggcctggcctagcacaagcattcaaccagagtatatggatggaagaatagatggatgctcggatggagagatgtgtggaaataacataacagatgggtgaatggatgatttgactggcaaatggataatttaatggagagatgagtggagcttggaaggatggaagaagaaggagcaggtgaattataccaacgaacacaaaactattcagcactgacaaagtatactgagtgccctctccactctccatttggatggcatcactgactcaatggacacgcatttgagcaagctccgggagatggtgagggacagggaaacctggtgtgctgcagtccatggagtcccaaagggtcagactcgactgagggactgaacaacagcagtagccaatgactcaggaagcttccctgctcgcctcccttacaacaactttttgttacaggttgaaaaagacctggcaggcctctgggcaaggaacagaagagtgtcccagatggggtggaaaggaccc

SEQ ID NO: 28463 - DNA, 1223 bp, Bovine  19866881048895
tgcttctggacgtggacattaagtctaaccggaaatccttcctgtccaggggaattactggtttccacggctccaggagatgtcgaaatgcaggctgtgcttgccttggatttgtttttttttccacagaaaacaaagcaaaacaaatacatgggcacgtgcacacgacacataagggcagaaaatcgaatggtagccctgactcctcaggcccaggatggggtcgctcagcgagtgaacaagagaaccaggttcctgggttggaggcctggtgtccccgtggacaccctgtgtgatctctggcctgagccacagacagtgggagcaagcgatccacagtgctggccccctacccgccgcccagctgccaagctgtgtacagggccttgtgttcactgggctgacttatccacacaacatccccatgggaagccacggctcagagaggccaggggaactgctcagggtcacccagctgtgggagacaggactgatctggaagccagcacgacagggcacagggccactgagatggacggactccgagtcctcagacctgtaccgggagtgcagccctccctgggctgcagggggagatgccctctttggggggtttattctcttcctcgcccagtcttctggactgggtcccctctctgctcactgcttggctgcaatgacacccacctgccctgcccatcatttcacaaagcctgaggccaggcacccagaagtgaattctttctctgcgccaataaagggaaagggcttgatagatttcaggattcactgtgcgccccaaagaaggcaagggatcccgctttgggagtcagggacctctcttcctgcctcttccccacacttccccatctgtgttccctgatcccaaggacttacatcttgttttctctgctccatctcagaggctgcagtctggaggcatggactggcccatagacatgtcgtttggctatttaataaactagttgccaaaatttaaaaatttgaaaattccatgtaacaacttggacttctagtctccccctaccacccacttcccaccacaccccaggtgctgtattcttggcagcaagtgcatggagctgaggatggggtggccagcggggaggcagagccccttgtgcacagtctcattcccatccccatcagcctcacaggaccataaggcccatttccaagcctggtgcttctcaagcatgcat

SEQ ID NO: 28464 - DNA, 1217 bp, Bovine  19866881121198
ggaggggtccctctcaaggagtggtacagacagcataaggtaatgcatttgagtgccagacacacaggtcgctttccagccgtgttaggtgaggtgaaattacttccaggagctggtgctgggctccatggagcactggcccctaaacctcgggctcccacagaccggctcagcacccctactccacatgagggacagaatgtctctggggcctgactctgactctgacaggccccaaactctgctcaccgtggggacacaaatggcccttgactccaactctcccatttcacagaggaggacagtgaggcctggagagggcagcacctgcccccgtcccagggtcacgcagcaagtcagaggctggggcagaacaggaatcagcctcctgcttccccaccggccacagctcagtcctttcccaaaggctagctggccgcagacccgctgacaaagagaaaataattattttggcagctgagacagaagccagagccggaaagtcctcgctcactcggtgagcaatgtcccggccccgaggaatgacgcccgcccatcctgcctcgaagaggtgctccagctcacggcgacacatacgtgtctctccaccccagccatccttggttctttgctgttggacttgtgcaaagaggcaaatagaccaaggtcacacagaaagggtatcacacagagggtcaccaggatatgaactcaggccctgattagggactatgagccttaggactatgagctcataggacccttccctgtgagcctgcactggaccctcatctgggaaggagaaaaggaccaggagcttacctgaactgggtccacactggggactattcctgtgatacttctttagccctcagcaaaatgctatgaagtggaaactaaatagcacccccaatttacacatgaggtctagagagattctgtagcttcctaaggtcacacaggtaatgcagagtgaaaagtaataagaacagaggcgggcatgagtgggtgatctgtccacacagactcagcttgttcaagatgaccaactggacacccgggctccctggtctgtgccctgggccccactctcgctggctgcacagacaggttggggtggaggtgaggaactcaggcccaggcggggctgtgaacactcaggtgaagtcatccgccctcatccctggccccctgggtgcccgtaggtagcctcaccg

SEQ ID NO: 28465 - DNA, 785 bp, Bovine  19866881127422
tgttacgtccctgcgtgtcagagcagaaaggggccccaggcatcatctggttgagctgttgctctttgcaggcggggtggatgttttgtgggtggcagccatcaggggcagaggagaggagaggaggcggccccagcatcggtgggcagcttggcttccagacactgatgacctttccctgctcctttctctgccaccacagcctaactatggaaaccagcaatacggaccaaacagccagttccccacccagccaggccagtaccctacccccaaccccccgcggccgctcacgtctcccaactaccccgggcagcggatgcccagccagccgagcactgggcagtacccgccccccacggtcaacatggggcagtattataaggtgagtcccactgccctacgggccccttccctcctcaccagctcagctcccttcccccacctgcgtcatcctggccccgggcaccccctgaggtcaccagggggcaggcggagatttctggatgtgacctcgtatgctccgagctatgcatgtggtgaccaaaatgacagactggcttttcttggttcctgttctcacggggctcagacgatggttttccttctccttttactatttatagtgcatgtaagataataacaatgaaggaaatatatttttttttaagaaaaagcacccgctcaaatatatttacattcgattattctatgcacatgagcaccaacaatgttatatggttcttattacggttgtgattttgaacctgttctctcacttgaca

SEQ ID NO: 28466 - DNA, 1201 bp, Bovine  19866881163745
caagagggcatgattcctggcagcagctcccacgggaaacagtaaaagcgccacccgcgggaaacacggggtggacaaagggggtgccgggcagggtttcctgttgggtgggtgacctgtgcgcctgtggtcctagggccaggccagggctgggtctcgcctcatccctggctccggcccaggccaccttgagtcccatcctccagggcctggcctggcttcctgtcccactggcccctcccagcccaggagagagcagggccccgtggaggcttcctgagaagcatcaacttttgtagggcaggaaggggcagctgcactggcctcctcggtggcctttggcctctgacccccagacctccagctctctgttttccagcaagaggcttcgacaaaatctccactgggttttattcctgggacttcgggcacagctgagtaggggctgcaggaaccggcttctccctgcgatcagtcactgtctgccccgctctgggcagcgtcacttccaaggagccgtgctgaagggactgggacaaggagagatgctaaagaaggatggatctcaggcctcaaggacagattctcaggggggcaaagatgagagacacttctgaagaaggtgggtgtggcatccccactgggcagggaagccccacaccaaggacaatgtgatgacaatccatgggaacagcacccagagagagatgccttcatccccaccgccccttccccccaagtttggggggggaggtgtcaggtgtctgggtgggatgggaactcggcctaggggctagacccattgtctccagtgaaccaaacccattccatgtgcctcaggagctggggattcacctgtccacaggtggagatgtagtgggagtgggagaagttagtggactggcccagtgagggggaagaggtttgaacaaaggccctcaggctagggcacaggctatggcagaagcaccccaggtctgtctcagggctgctgggcaaacaggcgactcagaaagcaaacagcccaaagagggcagaggactcttccagcggccgccacggggcccaccacggacaaaggcctcttgtagctcagagctggggaggagcgctaacgggaggcggcctgggctgaatggggctggtcctggcctgggatcaccctggggacaaggatgacggggatggagccaggatcaag

SEQ ID NO: 28467 - DNA, 961 bp, Bovine  19866881206434
tccaaagggtcgcaaagagtcagacacaaactgaagcaacctagcatgcacgcacaaattaaaacgaacacaggcttaaagagtgaaaagatctgaagacgcagggttgaactcagagagtaagactcgggatgaggggtctgctgggggaattgtgccaggtggtgggcaagggggagcgggttcctatggccagggttggatgaggactttggaactcaggagaccgaccccaggaagtattggcctctcatgataaattgagaatcaatggattggtgggtcattagatggaattacccatgtggatgtgggtaagatcaagaacagaggggtttttagtcacaaaccgcagtgcccaggaagtcacctgaaaatgcctccccaaaagctactctgcacttctttgctatcaaaactttgattttgttcagaatgacagtgcaccctagcccttagagatgaatcatggtttgtctgggtcaatcgagcaatcacattccctttggctgatgtttacttttccagactgccttgcagctaggagtgctcacgtgataagttctggccatctcagaaagtcagcttggggcttctgggagagctttcacctttttgatgacatagatttgctagtgcttctcttctccctttttttgccttgaacacagagctgatgcttgaggctgtgctgccattgtgaccatgaggcaataaacatgagtgtatacatgtagcacgctggcggtgttgacgcagaaacagcctggaccttgacaccatcattaacccctgcccaccttcagactttttaagtgagatgaggaaatgactttattgctaatttttttttaattaaaagaagaaagttcagaggtagtaactggaaattagaagaatggcatgcagggttggagggagaaaaagctgatagggggctgctttgagcagaggatgtgtg

SEQ ID NO: 28468 - DNA, 1317 bp, Bovine  19866881261401
tttgcaatggggccgcagttcccatcccatcagaaagcaggctggagtggagattcagggggaaagtgaatgaggagtttgagagaactcattaatcctggcctgccccatcctgtgtgtctcctccccagggaaacctggggtctttgctgccccggactccctcacactgcactggcctcacttctggagcctcacgctgcttcctctccctctcccacagcacttacagaaccccgccaacttccacaatgccgccacggagttgctggactggtgtggagacccgcgagccttccagcggccctttgagcagagcctgatgggctgtttgacggtgagtctgcctcctcccagcctgtgccctcacccagggaggatggctggggactcacgtgctgggctgcggccggaggggaggacccgtctgcatggacccctgataggcttacacctgcagggaatctagtctgatggggagacacatttctcggggttacgtgcattatttacccttgatgagaaagacatgatcctactttgaagagttctaaacttttgagagtaaatgttccatcataagtaaagcagagagactcttgaaggttttcagccctctttttagccattcattcattcacttcagtaaacatctgttgagctctttttacagacatccattcatctattcattcatataagtatttatcgagcttctattacatctatccatctatgcaaataaacactgattgatcgctcagttatcatgcacaaccccctctgctaagtcctgggaaattgaagatgggaaagattccctcttcaatggggagatagctgtgggaagagacagctgaggagatcatgagaaggtggagggaacacggagaagggaagtggtacccatcttggtggtggggcaggttgcagaaaacaggaaaggcgcccctgatccgtctgtaggagtctgataacctacaccagcacctgaggatagcaagaatgtcctgagcatgtggagcagagcacgccagtgcccggatgtacggcagaatccaggaaactgaaattaactcatcctggtaagggtctaggatccaagctgggcagaggccaggcccagggctagcggtttgacttgccaagcttaggagcccactggctgacagccacgtggaaggagctcaaagcttatgactgtccccagccacgtggcctgtatccataaatgtgagggcacctctgcggccagtggggacagctgctcagaccatccagagtcagactttaagggaatgtggtaaacagatttcc

SEQ ID NO: 28469 - DNA, 1303 bp, Bovine  19866881280977
cttcaccccaaggtccccacgagtttcctcttttcattcagccctcccttactggaggtcagctgaatacctctgctctttgccaccctcagagcccaaccaaaatagcctgagttctagcctagacatgaaactctgggcaagttcagagcatccatcccctcgttgtcaacatggtgatggtgagtccagctcatggcgcaggggagggctcgtgaggactgacgtcagaacacatgtgggggcctggcaggtgctgggccctcaaacaggtgcagctaatattagtatgcttgctcctgcctcgatggctactgttattattagtggtggtattaatatcccagcaggaaatgagcttcaaggtcacagagctccccatgttactgagggacaaacaggaaggccaggagcggtcagcagcagagctggagtcagaagcccaacgtgccccagtgagaccaaaagctcctggggccagggacacaccagccacggccacactcatggctttatcccttgcttctctccacagttaatttttggacacatgtcatgggccaggctctcggccaggggctgtctgctcacgatggggcttggcccctattggttctatcaatgtttgtagatcagttcgtggcctctcccatccggccagccactgggaacctaggccaggggtggagtttgggaagggttccctaagccatccccccgaccaccagtaacaaaaacacagctgttactttgagcagatcccagtctgggacactccgggtaaaaacaaaacaaaacaaaacaaaacaaaaaaacggcctgattcctcatccccttagctgggaagaacacaaggcccagagagggttagtgcctggcctgggacacacagccaggtctgggagagccagagaacacaggcttctcagtataggttctgggttccagactgtggccagagatgaccgtggaggacttgagcagatggactctggtcaggacgtgcctgagagtggggcgcagagagcagggtctccatgggcagaggacagggtctgggagctgagtctgctggtgcagctgtcccagaaatcaagcccctggagcagccacttctcgcaccctctgctcaacagagcgacttcactctcaactagcggagcatccgtgctggacgcagctgactgtcctgagaaggagggaagatggagtacgggcctggcagagccacctgtcctagccaggggtcgggtgtgaaggagaggagggcgtcctaggggagctctcgctgggaggaggtggc

SEQ ID NO: 28470 - DNA, 961 bp, Bovine  19866881335612
ctggtacaaaaaggtttacaatgaaaagcaactctgcctcacaatttctgctcccaattctcctccatggaacagcacttgaaatagtttttgtgtatctttatggaattgttttagttgtatacaagcatagatagatagatgccttcatgcatgcacattcacacacatctttcaaacaaatagaaccatattacaaacaccatacagcaccttgattattttaacctcaacgatttatcttggaaatggtgccatatgagcacatgtagaacctccttacttttttaatggatatttgggggttccactgaatgatgtactatcatttttcacccaacttctatagagaaacactttgggaatttgtcccaattaatttttttttcttcttaagcacagagctgactgtgtttctcttctatttaaaatcctccctggctcctcactactcacaaaacacaatcgaaagccctggttctgactagtgaagtcttaacagcatggccacctttccctctgaacctcatcccaagccatttctcaccctgggcctctgacccaccacctcaaacttcttggaagtccctctgtactcctatgtgtctcttagatgcagtcctcgtgacctcgaatctctgctctgtcttgtctactctgctcagtaatcacctctgctgtgaagccttcccataacccccttcacctccttaaaaataagcactccacacacacacacgcacacacacacagccaggccaaatgagttcattcatcctcaatgcccctcaaacccacaccttactctacagtagctcctactatccttcccaacatagccccatcttctctgagccgtctttcttgagccttcaggtaacactgatcactccatccctcacctcactatcttatacctctcataggacccacagagcttcatttatagcacatccatggc

SEQ ID NO: 28471 - DNA, 758 bp, Bovine  19866881354133
cctggggcgcccctgcccaccggagggcatctatagcttgtgccctatagagtttagcagattcactctagcgcataacatgtacaatactctagcctgctgtgcagcaaagaagtggtagtactgataaagatgctgatggtgacagcaaatgctccatagtgcctcctgacttaacctctatggaggagaccattctatcctcattttacggaaaagtgaggctgagagagcttaggcaagctacccaaggtcagagagcagacaagtggcagagctaggatctaaacccaaccagtccagctccagaacacatattctaaaacatgacagcctccccgcggcagagtgcccttgtttggcctcctccgatgctgcctggacttaaagtcagaggtgggtggctctgctgcaggtgctttcccctttgctcttattgggaattgatggtataaagccagcttgcacctggagcctggttcatcccccagcctcggtcaggaggcacttctacttcatggtatgcaacgccaacacctgtctacctcctggttcccagagcatctctccctgggtggcagaggctgagctgagggtgggctctggagccggagaccagagcagcagcccgacaagagtgatgtccaagctgcgctgatttgcagatggaaatttacatacataatgtaatttggaccaattgaattgtcgattaagatggaatcacttgacaagcaacgcatactctgggcgggtga

SEQ ID NO: 28472 - DNA, 928 bp, Bovine  19866881526877
gtgcacagactaaagaagggcctgggtctccaccaggcagcaggtggacaggaagtggcatttggcagctctctgatcaggggtgggaacactgccgcttccccaaattggttttccgacagtaaatgataattgctctaagtgttctagaactcagggatggagattaattacagctccgtatcctatggcgccctgaactttaagcacagcatgacatgcaggttgttaataagaaggaggatctgggaggacttttctgatgagcaaataagaaaaggaaaacaatttgaattggcttctgtacctaccaagggggaccctatgggcctggaagtatgcttcccatcttcccagcctggccacgagtcgtgtttatgatggtcagagacacaaagtggctcccaggacatggggactgatggttggtctccagtccccctggccaggatggatccaactcccaggccgctcagtctctacagggctcatgagaccagcagtcacaactcaaatggcagccaagtcaggaaggcaaagtaaccaagcagggcctgcagacaggggacacggcagggagaagtggatactgggagctgaggagcccattatctcaggggcaacctcatgtcaactccagcccgccactgttaccagggaaagctgggtctttaagagcagaatgacaggtttctatataaaatctctctttttacagttggaagcttattaacattttaacatagttgacagggccaaataaaacatatccatgctggaatctggtctgtgggccaccatcttgaaacctctacctcagcaaccagttacttccctctggcgaatgggaaatctggacctctgtcttcctggagagaggagagctttccagccatctgcctcctggtttcttccctcccactgcgtt

SEQ ID NO: 28473 - DNA, 777 bp, Bovine  19866881741009
ccacggctgccttcccggctgcagagctgtgatttattggcggctcctcctcgccagggcccatggcaggaggagttcaaacacccacaagaaaagccaccagctattgatccccgaatcgggcttcccaagcgctcccgggcattcatcaaggagccatggcgctggggccgcagctctccctttcttcttcctttcttctgcctcccaagtcattcccccaggctgtgcccccctcgccgaggtcactcggagagctcgccagtgactgcgtgcagaggtggagagcgcctttgtctgctgcctctttcctgtagatccttatcaaggcaggcgcccagggggtggagcgggccactttggaccttgggcttttaagaaaatctttggaagttagagaagtggagttggaatgtagaataagtagggggatgcctttctgaagcaggaactggtcggagtatccatgtttctctaggctctgggctgtagtattaagagcttgctaaccaagtggggctggaatgggaccaagcaggtcttgaaattagcatgtgaaaaccctagctttggcctggaggccttctgtgcgggctggtgaatggattgttgaaaacaatttgttttcctaattacataaatctgctagcagagtatttacctttttttttttccctctcacctggggaaagtctgttggtcccaggcctgtgaagtttaaataagcatatcaatactcttctctcacccttccttggggctccttcaagaatgggt

SEQ ID NO: 28474 - DNA, 825 bp, Bovine  19866882006773
tgaggcagagatagagggaccatagggatgattgaaacaacagagcagtcatgagttcagggtctgaactgagacctgagttcaaattccagggtctccacacgggagtcatgaaaattacttaacctcctcctcctccctcctgggcctcagtttcctcatctgtataatggtacattagcctcttttgaggttagcatggacatccagagagccagtaggtggcgaatgctgagtatggttctggctgtgagtgctgaacacttgagcagttttgtcgctgacactgattttttcttcctcggacatgctctggttctgtgggtagggatagaatgttttacagtggagcaaattgccctggagtaaatgagccggggcatggcacccaggggaggagggcagcagggggctacatgcttgtttacttggcattagcgcactgacactcccctcctccggaatccagacagagcctctaagcttacccacattcagagggcgttgggaggctcacacttatatttctaaattcctccgtcctgggaaagccccccaggcagcttccatgccaaagccactcctggtgattaggggtgactaggggtgagtgatggccgtgggggttaacagtgcctgatcaatgtgggggtgaggtgcatgctcactggttcagggatagcaggtgaagggtactttgttaccacgtatgactggtgcctggctgcttcatcatctgcccttgtgcacgcagaagctaataagcagttccctctattttgcccctgggggtgcctactcgaggagggaaactattatttttaa

SEQ ID NO: 28475 - DNA, 1218 bp, Bovine  19866882028659
agggatgacctgaccgccctgcttttgaagcattcacaaatgccaataaggtgtccccagagaggactgggcctcccggtgcccggtcccaccatcccgtgcttccaagagcccgccagctttggagtccctgcccttgcctgctgtggtgagaggaagaccctagcccagcttggacatccacttcagctcctgctcagtctacagcctcaggcagagctgggggcctctgcagctgagagccatgggctgtggccaggcctgtcccacaaccacaacccccgccaatcgctgcattcctcatgttcaacatgtcagcaggcccagccccaagccatgccactcaccatgatgtgacgacagccaccaggtcagggtagagggaactggggggcagaaatcccagctgacaggacttcaaagaggtcatgacagccatgcccctgcctctaggcctgctggccccagacataagcccctgtcttagcagggtctgacctaacacaggacaacccttagcatggctcaggccctggcaccagcggaaattctcacctgccacacctacccacaacacttctaacacagcaaagctaatgcttctgaaaagaggccgaacacatgactaaagagcaaatgcatttaaccgagaaaggcgccctaggctggagagaggctccaagtctggacctgtgtgttcttgtctgtgcctggcctccctcctccccttcctccttatctcctatgccgagtgctcggtgggacacactgggggctgtgggcagagaccgaatacgctattactccaaagcccccagcacatccacaccccgatgccattctccctccgccgctccactctcccggcgctgccaggcagggccgacctgctgcttgtcctgttgcttagctcctggggcagggaaggcactatggctgccaggacaagctccagactctcagaaggagaggacaggctgagcgaatggccgcggctgccctccttccagtactctccgggcacaagcacactggctagtccccgtgacattctccaaggtcgccccgtcagtatgctacttacagaagaagaagtcgaggcaggaagaggcccaccatacctggcacatgaaggacggaatcactctgtggaaagtggatcctttgtacccgaagcccttctccccggtgcacagggctctgaagttctctgggtgg

SEQ ID NO: 28476 - DNA, 1425 bp, Bovine  19866880285251
gagttggtgatggacagggaggcctggcgtgctgcagtccatggggtcgcagagttggacacgactgagtgactgatctgaactaaactgaacaatgacagcatcagcaacagtaataatagtggccttttatggaggatttaaaaggtgattttactgatccctcagaacaataaaatgacgcagattctatatctaattgtatttcacagataaggaattgggggcttgaaaaaactgtgtggaaatgagggagttgagaattgaacctagggtgcccagttgccagctaactgctcttacccagtcgttccattcagtgcttgtgaaatgtttgttgagtgaataatcaaacacatcaatgagcaaatgagtaatgagggggaaaatcacacaaatatagaaaaattatccactccattgactaaagcaaggcgtttcctagaatctaagtcatgaccataaacctttttcctccatcatccaaccgtggacccctcacaactcaggaaaattccaaggacacgcttgttacagaagccacaccagtcggtgtcattccagatatgttcctaagggatacagagaagcatgtctcatccttttgggtccaggacaatcctctgatgaccctcaggaagacaggaacttagtgctgcagccaggctagcagcgatgggtgtctctggctcattttctcagccccttccatgatcctccagggacaaatactgatttgaaagctgctacacagtgtcagagagcagtgcaggcaggagatgtctggagagcccacggaagccaaatggaatgcaggaagtgaagagaagggcagatggagagccgccatggcaaagcaggcgccaggctgcagctgggctttgcttgtggggaaccacaggtactgacaaaatggaggtcactggtgcaggaatgtggggagagtaacctgtctcagtcccagagacacctagtgtgctggataagcacttgccagacaagcttagctcagggaggggccatatttacctgcagttcagccaggagcaaacatacagactgtggcctggtccactggcttatggcagccacccagtcctgcctgatgctcagaaggagggggagcaagtcctagagtgttctccatccttccttctcccacctcccccctcacagggagaattctagaaacatgggctcatacagactttcactcgcacatgcacacacacacccccatgctgagaaatttggtcaggcttccagcatttcaaagcacgagtcaattggtggatcttgtttctggagagaaaccaacatgtcctgaaggctgctgagctgggttccagcctgtaagaggctgccaattactcttcaatcctcatggtcagcctggcacttttcggcctgcacaggtaggacagt

SEQ ID NO: 28477 - DNA, 1507 bp, Bovine  19866880347324
aatatcaagagcctgaggcctgcccccaggagcctgcagtctaacggggagacagacattcagaccacatggcgccgttgtgtggtggctgctgggtaggggcacatgcaggatgaagtgaggcatggagaagaggtgttaattaacccctgttttggtggatcagggaaggcttcctggaggaggcaacatctcagccgggtacaagaggacaaacaatccatcctgcccacagggcgtgggggaaagttttgcacaaaaaaggcagcagcaaaaaatccccacagtgagcgagacactagagcaggaatgtcaggtgtgagttgggagcagccagagatgaggctgtgtgggaaccagattcttgggtgggctttataactcgacctcacctgactttctaggcttgcagcttacaataatgtttataatttgctgtgattttcctgttggctttaccctctgccctatatgccaattagaatataaaaatctagcaaagtgtacataaaagagatgtgggtatttgcttgtgaactggctgctctgcttagagatttaacaacttcacagtgtctccatatcttatgggtggggggagaaagaaaaaaaccatctcttggcatggttgcctttgttaccatcgggccctctccaggatcaatcctttaggggcgacttctctgcaggaaggggtctatcctgtgaaatttcatgtctcatcttttcccagagtgctggacacaaagatggcctcaaaatgtttctctctctctcttgattccagatgatgatgtgccaaccatttgtcactgggcagaagctggtacctggatgtttctggttggaggattcagacagcagcattccctgcctcccacaacccactacaggctcctttgtaatctctgaatttgcacgtgggcgtaaaggtgcctcttgagaaaatccgcccccgccccagatttcacatgaagaagtcgccggagttgggagggatttagagacatcaaataaaatatttctcagattcaagcaatgcttgaatccccttttaaaatggaaatattttcaaagaacccttcccccacttttgttgagtcaagtaatttctatcataatgttacttaagtacgtaccgacatgaaggctagagtaaaagccttctgcttatggctctcatatgactataaaagcaaaacaaatggacaaattatagaatggcaaactacaaaatcaataaaattcaaattaacagtattaatttaatgggatgtcattttatcaaacctaaatcaccacgctgcccatgagcaggggctgagtgagcggtgcagcccttgagagcctggcaggcttgcaggagctattttccacgtctctcagttacaactccatggaagcgatgtctttggtcttgccttggcccaaatgcatcacccacagagcatgcacacctctgcccttttcttcttagcttgctgtcattagcaaaaataaagtctaa

SEQ ID NO: 28478 - DNA, 1846 bp, Bovine  19866880355200
tattctgaccacacttttttccagaatgcttaaccaaagagagtctcaaactagggcatatacacctaaaaatattcatgggtaacgcatgggtgagaaggcaagcccttgaatctgaaatagttcattttgagtgtgtactgttttgcttctgtagaggggtcaaaatttacatagtgatgatttagatgggaaaatacgagaaaaattttattttctataagtgatattcctttgcttttgagatttaaacctgaaaatggtgggcaaaacttaaacttgtaaagtaagactatcttggttttttattttgaataaatattcagttaaaagttcaggctctttattgctgttattctctctcagaggtccattctcctttcaaactggggaagatgcgggtgtaggggaaggcatgggtggcctcagggccacaggacagaggctgtgtgtcttctggggctttcttggaaattgccactgacctgactggcgagccactgctatctgttgggcatggcttgtcctgtcctgtttgtgtgttgtgtgctaactattgttgctgcttctggatttttccactctgtgcgatcagaaccagctttctccaggccagaatactggactggatggtctttcccttctccaggggatcttcccaacccagggatcgaacccaggtctcccgcattgcaggcagattctttaccatctgagccaccagggaagcccacataaggcctcacaaatcatgcaacatcatggccaaccacatcctagttgttacaagtgagtcatatgccagtaaatattcaaggagtagggaattaggctacagctcttgatgaggcctcattacagaagccattggtacagtcatctttggaaaatactgtctggcataataagcatctcacctttgagcccaatttatggtgaatgaatgaatgaatggaatagggatctaagtgttctgagaactgccaacaatcccagggtaagattttgatatggaagagaagggaaatctctctctattttcctgttcaaaaccttcttttgtctaggacatcctctgcctctccctacctgaggatgagcactgaggccaggagatgtagaaagagcaacagagggagggagagagagacagagttggggggagcagaaaagaagggaaggaaggaagaggatgtaagatttccaactcttgggaaggtgagaaataaacacccctcccttgatatttcctgctcaaaccagcttccatttttccagctttccccaaataagaaatggaacagttgggattcactttgaacccagatcatgggcttccttggtggctcagacagtaaagtgtctgtctgcaatgtgggagacctgggttcaatccctgtgttgggaagatcccctgaagaaggaaatggcaacccactccattactcttgcctggaaaatcccatggacagaggagcctggtaggctacagtccatggggttgcaaagagtcgaacaggactgagtgacttcacttcactttgaacctagatcagtgattgagaagaacttgactataagtcaagcttgatagtccatgtgtccccataggaattgtttctgccctcctggctccaggcctcagcttccctgtcttccagttagaacaaagagggctttccgccagcttatctcctagaaaccctcctgcttaagccctgtgattccataccagccacccccaaccgtcctagcagggcatcaacctcccagggagaggcagccctgtcattcagagaactctccttctccaaaatctaatatcccctcatctcccattatgagt

SEQ ID NO: 28479 - DNA, 1190 bp, Bovine  19866880356275
ttgccctggctgttctgccaggccgggaataatggtccaagccctgattctgcatctttccatcccaggcctgtagggagagtgtgtgctttcttggggatgtgtggggatgtctgacataggagcagcttcaaagatgggtgcaccctcgaaatattgagaaatggtcacagatccctggagcttccttcaggggtggccagtattttctgtggcttcacgaattccccttatttctatgtcagtcaggattcaatcatagaagctgacaaatgttgagttttctagaaatagagatatattataggaagttgtttttatgcaattgtgggaaccagttaagacctccgtgtaaggttgttgcttctgtgtctgcattgggtctgaagtcacttgcagccggcatagcagactggtggaaaggagaattggaggtgaacttggggaaagcaaagacaagttggaaaccatgaagacaactggaaccagtgacgtgccagagcttgtaagactgtcttgtgagagctgattattaaatttttaggaattctatgatgcagttgttaaacacagtcattataaaaattaaattagatgaacttacaattaaataaattgcattaaaaataaagctcattgcttcctaattattctgctatgacctattacctatgcccctggaataatttatatcaactttatctgtgtggtggaaatactgtatacaggtatgctactggatccgtcttcccaacttcatgttcagtggtgtcatggtggcagcttgcaattagccctgtggggatatttatattattgaaattggcaaatactcaagtcaggccttgatgaattattttataagttgcctagacctaagaagttgatggacagaacatgaataaaacaaattaaacttaaaaatgtctaatatttgtagcagttacactgtgggtaaaggaaatactcctttggtattcaaaactacttttcaacctagcaaagacgtagcttacaacacagaagagcagcttcgttgtttcacttttgtcttgcttgttatcgtaaacaatgtcaaccaagattcactctggaactgcacccggagagcaggttgtctgacacataccagcacactgttgattgtgtctgtttcttgtggcctccagtctcgatgacacaggtgatgt

SEQ ID NO: 28480 - DNA, 882 bp, Bovine  19866880387124
acacctcatccgcatcgtctataagccagcccttagcagactgcttctctaaaattctgcaaatgctgttagactgggcagcctggatgtaagggattaatgtattcatttagtcattctcttagctgtccacacatctacccattgtttgtctctttgtcattgctgttgttcattcgccaagtcgtgtttgactctttgcaaccccacggactgcagcacaccaggcttccctgtcccctcccccattcccagagtttgcccaagttcatgtctgtttatctctttactgaagacagtatagaaaaatggtttatgttacgggttccgatcctgttttcccagcttactagctgcctcaggtcttcacctgagaagtgagaaaacacagtacggatacctgccttccagggctgttatgagaatgcagtggataaggatgtaaagcatttgccccaacaccttgtaactacgccgcacctgtcccagtttcgttattgtttgctggtggtagttgttagtgtgtgttgggggaagcttagcagatgggctttgtcggtttttaagcaaaggtggtaagaaaacacaaagtttacctttctatttccagagggctcaagttcccaagggaaacaagatgcttgcttcactgctgtttcaatattggtttacgacgtattatgtacaatctgtgtgctcgtaaacttgacatcatttacttaatctgcaaagtcttttgcagtacactctgaagagtctcattccacaggggaagagcctggggctcagagaaggcaatggttttgttgagtttgcacagctgaagtaggggaaggggggtcacattgggggctgcccacaacctcaccatcacaagatccc

SEQ ID NO: 28481 - DNA, 1748 bp, Bovine  19866880455394
tgcatggagccacactgcctaccgcgcagcctggtgcaaggccccagaggaggctcgcatccagggtggacgcggacctctgggaagctgcctcagaggcccgaggtgagcgcaggcagaggagcaccacttccaccttcagtaaaagacgagaaaactcacaaagcccagggatggtctagcaggaaagccattcaagtacaagggtggaaaaatgtatgcaacacagaacaggccactgtgaaaagacttgtgtgctcagtcgctcggtcatgctcgactctttgtgaccctatagactgtagcccaccaggctcctctgtccacgggattctccaggcaagaacactagagtgggttgccatttccttccccagggcatcttccctaaccagggattgaatccgcgtctcctgtttcggcaggtagattctgagcactgagccacctgggaagcctggaaagaagttacttcagtgctaacaataggctgctggcattggacacgggcctgggtaagggtgacaactgtctcctaggggcatgtggatggcccgcactgggggctgtctcagaagacgccttacacacagagacgcctggtcaccacagagttgttcatggcagcaaaacgaggacactcagtgctcaacgcaggagactgcgacacaaaccaccccacctctgcggtagaacgtgcctcatagtcattgaatatagaaacatgccctctaagagggaatataagctgagaggagactttttggtggatggcttggcaatgtctatcaaaacctaaattccccatccagaagttcattctctgtgcaccagagcacagacgtttatgcaggaggatgatcactctagcacaatccatatgaccaccactagggacttggttaaataactgtagtgaagaccggagcgaaatgctaccaagtcaatacaaagaacgatagacagatacaggcactgagagacagcccagatacaaagtgaaattcaaggcgcactctaagtggaaaaaaacaagtttcaaaacaatacatacatcaaacttgtttaaaaaagaaaatttatatatccacatatatgcgtaatacacggacgaataaacaaaaacatacatacatagaaaaaaattctagaaggatctacactggactattgcttctctttggaggcgcaagattagagaaacttttatactttctacacaatatatcactattttcttattttaattttattattggagtataatttctttacaatgttgtgtaggtttctgctgtatatatatcactattttctgcactctatcaacttgtaacaagtatgcactgcttttataaactgaaaaaaaaatgacaggtatttccactaaaaaaaaaaacttaggaagaattctagtaacattggaaaacactattaaagtttataaaagctggatataaatcatatatacaatgtattaataactatccatgtaaaaatatatttaaaagcagagccaccaggaaatggaccaaactggtgagaggtggagttgtgggtaatttttactttcttatttaaaaattttcctacaatgagaggtttttctgcaatcactagtgataagcaatttgagaattttcacctagaaaaaggtgacagcctagccccccaaagaccagcaggaagaaaaatacctttatgcagatgtccctcagctgtgctctgacttcagctactagcatcat

SEQ ID NO: 28482 - DNA, 1416 bp, Bovine  19866880554491
caaacgaactggaacttgagagtctggagcagagataggtttattgcagggccatgcagggagaggggcatgcctgcccctactccaaagtccctgaagaatttcagcaaagcatttttaaaattagtttttattagaggatagttgcttcataacgttgtgttagtttctgctatacagcacagtgaatcagctgtatgcatatggatgtatccatatgtaacagatatggatatctgtgtgtgcctgcagcatgctaagtcacttcagtcatgtccgtctctgcgaaaccctgtggactgtagcccaccaggcttctctgtcagtggaattctctaggcaaaaacactggagtgggttgccatgcctctttttttggatttccttcccatttatcccctcatttttttggatttccttctcatttaggcctctgggtcaggccctctcttctgcgggcactccggagtggatcaggccagggaattcaaagtcagtttatacttcagggcactaaacgcagtgccggccaggcatgggggatgggagtggggggtatgtgatcccagctcagggatggtgctggcaccagatcctgcaggtccttaggagaggacctgcattctagcaatggaactgtgaggagtaagctggaaacattcaactgtccttgggctgatgtaaagcatcctgaccaccatctcccaaggctgggaggatggctcctggggagggagctaacgcagcaatggggtgaggaggtgggaagctgagcccatgcttctctggtttcaagccttttccagcttgtcttggaaaagcaaatgcatgactgttggcatccccttccagtgggtgggcgtggaagaagcattaagcatcttattctcaaagccctggaatgtcaatgatagaggtccttgcagggctgctggggttcgcctcctccattccagccacctagacttggtgttgcccgaaggaggctctaaaagccaggctttattcggttttattcagctgcaaagtcagggggagcctgggaggccggctgggcacgtgcaaagatctgtctttgcagatcttgggcctgtgagccgcctggctctgagctgagcaaggggggccaggccctgcctttctaagccttcagatttcctaccatctgcttggtcggaccgcctgtttaaattctccacttgtctcgccttccacaaaataattagcatccatttgttcctagagctcgcgtggtggcattagtcattgtaggagctttcagcgcagctcacagaaatttccatttgatgtaaagttgaaaatggctttcgtgggactctgcagggcccccctcacttctgctctctcaccagcatctggcgctgcgtcggttccctcccacccgtttctttgttg

SEQ ID NO: 28483 - DNA, 1470 bp, Bovine  19866880554883
ctgggaagcccgaaaactagatgctgctgctgctgtcgcttcagtcatgtccaactctgtgcgaccccatagacggcagcccactaggctcctctgtccctgggattctccaggcaagaacactggagtgggttgccgtttccttctccaatgcatgaaagtgaaaagtgaaagtgaagtcgctcagtcgtgtccgactcttagcaaccgcatggactgcagcctaccaggctcctctgtccatgggattttccaggcaagagtactggagtggggtgccattgccttctccggaaaactagatgagaaaggtccaaattgcccaacactgggccttgcacacagtaggtattctcacagaggaatgggccatcctctgcctccttcctcccaccctgtgggcatcagccaaggctcgctcaataattcttccacccatctctcccacacctattacttgaacacctactgtgtacagggcaccacgttccaggacactcagccttatttccactctgcttctccagtggctctggcaaacaatgagcaattcgagtccccgcccctcccccaggcagagagatgagaggagtctattgagtatgtgcaaaggaggcagtgggcggagaaaacttctcactgcttggggaaacgctgaacaaacctttttattttttgcccacagcaaaaatttcataaataaataaataaaggaaaatcaatagcgttttctgagcgtggcttggcagagccaaggatctcgacactcagaaaagacaatggatggtgtcccagccagggagggtgatgcagagcctgggggtggggcagtcccttaggaggaagggggaggggaggttgccctcagtggagggtgttctggacatagcggggttgttccctcaggtgccttgcagcccccaagaaggctcctccccacctcccacctcctctgtcgagcctcaggggaggctttgcctctgcgagaatgtgcccagaatttcaccgggggggccaggcccacatctccttcttagggttcctgccacatggggacaggagacaggaggctttcactattcttatacacccctgcacacacactcacacactcacacagcctgcttccagagctcagtgcttcctcttgcactagaaaagctcttcaacattctgagatcgtaagcaagtcacctccctttttgaaaccttagcttctccatctgtaaaatggacacatcccttgagttgtcctgcctggaagagtcagaggatcttatttctctccctctgatccaccacaaggaccaatgtgactgggacacctatccccccatgctttttctggatgaggcgtgagtcgaggactttttcctggatcggaggggggcaagcagtcactctgggtgtccacgagttcatgtccaggggcaccagtgaggaagcactgggaggggggacaagcagtca

SEQ ID NO: 28484 - DNA, 2078 bp, Bovine  19866880590100
aggagtttattaaatccgtaaaggatttgatgtatatcaaactgttagcataaagtcaatactttgcagagaagcagacaataaatactcagcaagaggcaatatttctatcagggagaaggcaatcgcataaagattaggggagcaatttcaatattgcccgtctctctgctgtaaggagacatgtcttgttttccagaatgatcacaggggaaggagcgggggtggggcagcagccttctttacttggctaatctcaccatcaagcccgaactagatattaggcaccaaatgtttgtgttccctcctacattcatatgttggagccttatccttcagtgtgactggatttggagatgggacctcagaggaggtgaactggtttaaatgaggtcataagggtgggactctgatccataaggtgatagagttggtggttttgccagtaatcatgtacgaatgtgagagttggaccttaaaggaggctgagtgctgaagaactgatgtgttcaagttgcggtgctggagagggctcttgagaatcccttggactgcaaggagatcaaaccagtcaatcctaaaggaaatcaactctgaatattcattggaaggactgatgttgaagttgaagctccaataatttggccacctgatatgaagagctgactcattgggaaagaccctgatgctgggatggcaccttgctggtggagaacagagaccctgtctcccttgtctgctcatcaggacagatggtctttagaggggcaggtagtatactgagacatgtaggtactgtagtgtacatgctaaagtatgttaagaagatagattgtacatgaagtgtgcttaccaccaaaaaagtccctaagcccccaaaccagagcataaaacagcaacaacaaatcacacaaagaacacaagagcatttttggagaagatggatatgtttaatgccttgatcgtgttgatggtatcacaggtgcatttatatactcaaactcatcaaaatatatatgtaagatatgtgcaatttttttgcatcagcttcagttctatctcaataggacttccctggtggctcagacggtaaagaatctgcctgcattgtacgagaccatggagaagggaatggcagtccactccagtattcttgcctggagaaatccatggacagaggagcctggcaggctatagtccatggggtcgaaaagagttggacatgactgaacaactgatactttcactatatctcaataaagcttcaaaaataaaaaatgaatgaaactacgagggagaaaggacagcttttgcccacagttgtaagtacactcaacagtgctttcaaaggggagttccttgtgccaggaaacaggaagacatctctgaattacaccagctagttagggttttgggaggccatctgtgcacactaggagtttttggatgcaagtaacagaaaaatccagctggttaatgtcttggctcgtgatagggtgagtgttcagggttgttttgatgatgatgcggccaagccccaggttcccttttcggtcccctcctccgtgatggttcctttttcatagatcctttttcctcctctcatgaccaccaagatgcctgccagtttcggagggctgtttgatccctggttcacggtccctggggagaagggtatttttgccctcccaaccagcaaacaaaatcttcagacttcagctggttggatccatttaggtgagaaatctccaagaggatggagctcacagcttagtgaggcctggcacatggccccaggggtggaggaagtaggagctgggggatggagtcagcttcctctgaagcacccaggatgtgtgggggagagtagatgcctgcctgaaaatcctgagttgttaaccaagagaagggagggtcgtactgggaagctccgaacagcacatgctcgaaacagcaatgtctctttgcagaactgttagtggtgtgccaaacccagagacagagatggaaagaaagcggatgaggctgtcatacatcaccaggtccaacttcctgattttacagatgggaaagcaaag

SEQ ID NO: 28485 - DNA, 2383 bp, Bovine  19866880622906
gaaattttcagcaggaaaggagcatctggaaacacaggtttccatggaaaagacggcaggctgggctttgttctcatctccagctgatggagacgagcctttgtgaaggcggcagggaacgctgtcggggtcaccaagtggtggaagccttctctgccctccggcacattctctttttgttgcactgttccacatgccgacttctcccagagctggcttgattttagcaggacacagagagcttgtcctggagcttctctgattgttccctgtgtctccagcctctgcgtcaacccacgctgcactgcctgaccatgcttctacctgaccaggaatgagattcagctctgttcatttacggcacagtggtgaccggtcagcaggaccaagctggtcatttccttatttgggacctagagaagggggagtgctggatgttgtagatggtagggtccaactccctcctttagagatgaagacccacaggcccagagagacccagaactggctcaggcacacacagtgagtgagacactgggtcccctggccccaagcttggtggtctgttcattgatacatggagcccaagatttgagtcggccctctcgagccatgtccttggtaggggaagtggaatgagatatctggcagggctaagctctgtggcagaatgataaatgtcccccttgcattgctaggaagtgggttctgggaacaagggcagccaacagagccatttatccacctcccagtcagccatgggccagcactgtggggagtaaagagagaggggaggctaggggcactccaattcattactggcagagactgccatcggggggtggaccagagcctcagatgtgaggtctgtctgtcctagtggtcagggctaggccaagaacatccttctaatttcaactgcatttaaaatcagagctttaaaatttatgttaattgcaactctgagccttgaaagttcatgtgtgcatatataagatacatataattttttttaatggtataggatataggctgtggtgagacaagaattctcaaacataggtgatgaaaggataattttttagaggccatttggcaagtgtctgtgaaagccttaaaatatttatactctttgtcttaggaattccatttctggaaatacatcctaagaaaatgattatagatagagaggaaaatgtttatagcagcactaaattagtttcaatcttaatacttggctattaaaatacaatggtaaactatgatatatccatttggaaaattattatgaatcatttaaaaatgaggtaaagaattctaatgatataagaaatgcttatgatacagtgtctaatgaagaaagtagagcattgtagtctaagccctgactgatctgactgatttttttttctgttttgtaatacaagtgtctgacttaagctttgatttcgaaggcatctatttaaagaggtgtctacttcaaagcttcccaggtggcactagtggtaaagaaactgtcaatgcaggagacataagagatgtgggttttatccctgggttgggaagattccccggaggagggcatggcaacccactcccagtattcttgcctggagaatcccatggacagaggagcctggcaggttgcagttcatagggtcacaaagagtcagacttgactgaagagatttggcatgtatggcactacttcaaagctggctatggagactaaacaccttgccagccacagcaggccaccttccctcatggaagtgcctctgttttagaggttgtggttgatttcaataactgaccctttgggatgctccctatttttctcttctcacttcaaattcccattctcctgttttaaattcaccaataaagactgagctgtagaaaccctaggaccccacctagaccccaataaaagcagaaccccagactcatgacatgtgccctctccctctccctctgcaatcttgttctgtggcccccacaggctgtgtgatttccaggtcttacaagtaataaacctttatgttttttcaaagcttcctgatggttattgctgaggagcatcttgcaatcataataagaaccacaagggcccatccagctgcagcattgcttattggcaggataagaccacacaacatacgcatacaacaggcaatacatatagatatactcatttttttaaaaattttgcttatttatttttggctgcactggatctttattgctgcgcatagtagtagtgaaagttgctcagtcgtgttcgattctttgcgaccccatggactatacagtccatgggaattctccaggccagaatactggagtgggtagcctttcccttctccaggagatgttcccaacc

SEQ ID NO: 28486 - DNA, 1438 bp, Bovine  19866880625383
attggaggacggaacagaggccaaatcatgcccagcagcccagttttctccagaaactagggtgatccactaaagaattctaaacagagttaccatggtcaggttctctttacacctgtaattctctggttgctgctagagaacaggttgaaagagaaaacctataggcagagagcccaggtaggggcccaggtaatcatccaggtgagagaaggtgatagtttggactggaggagtggtaccagaatgagagaaatgaacaaactcaagagatatcaggaaggtggaatagacagacctcggtgatgggagagggtacggctgggctggagaggggtcccggccagtatcagagcccatatagccagggcaaaagggtgacttttgttcagtcgctcagtcatgtctgactctttgtgaccccatggactacagcacaccaggcttccctgtccttcactatctcccagagtttgctcagactaatgtccatttaatcagtgatgccatccatcagggtcttttccaggaagtcagctcttcgcatcaggtggccaaagaaatggagcttcagcttcagcaccagtccttccaatgaatattcagggatgttttcctttaggggtggattttagccccaatcaagatgcatagatcctgagagcagacctaaaatcatgtccatttgagcgagcctgagcagagtgaatcaggaagtaatccaaaccagatcactctgggggcccagaatgtgctgacccctggaaaagtaaggaaaccaaggaagtgagtctcacggtggcagtggggggtggggtctggaccaaggtgagggcaggtggtagactctcagcccaccacctggggtcctgcgccctttggtgtgggggttaggtccagggcagaggcgacagcactgaagggcagctgacatttcagccctcgctgacagggtcacagtgcagagcctgctggaaggtttaacacccagacacagaagtctcaggccctcagcctctcctgcaggcgacccaagggcttccgactgactgtaaggtctgtgcagccatcagccgtgtggctgccaagaaagcaattgcctcctctgactacattaataggagtttagtgtccggatcgatgtggctaagagtcccactgcagtcggcacttgtcagactgtatctggagcccaggcgctgcgaggagctgactcagacactcctcaacctgggtctgaaaagcctacgctgcccatttggggcgatggctctaggccccacctcccctgggaatgttccacctccagccagaattggcccagacactctgcagtgacaagagtacaggtccagtgttgctaggtcatctcagatgtccagagaactcagaacttgagctttgcaagtgatgtatgtgctgctgtatataaaatgga

SEQ ID NO: 28487 - DNA, 811 bp, Bovine  19866880721529
tgggtgtggggcggtggggtcactgttcaacaggcagtgtaactcccagatgagctcacaatccatccaattccacatcacagcaggcattgttagcatcaggctctagctgtttccaaggcaaaagatttttggaccatgtactgccatctacttgtcttctctatctctgtcgccaacatttccctccttggaaattcaaaagagccagggaaaaaaaaagacagtgaggaaaaattgttcagggagataggagggtgatgcaaatggaaatcacaaagaagaatcccagggaatgggaatttcaagatgggagtggttgacagtgtcccacggtagacagaattaaaaggagaggtggcaggtgtccattggatttagcatggagaaaatgacggatgagctggtgagagtcatgtcagaagagtggggcccagaggggagcagaagccacggggcaggtaggtgagaggggagttgatcggctggggaaggagtcccacagttgatactggatgggttagctacatgcccaccatcttacctccaactttgctttttgttctctattctcatcaatagacttaagacctcttaggaaattacaatattacagaataagttttatgccacgataacatcattatgttggaaggcctttgagatgccttaggaagtgtcctgagttcaggaattcccagcctacagtagtgcttcttatcttttcaggggactaaagtcttggcttggtaacctaaatgtatcttagatttcccctgcctcttcccacttacattccatctgcccccac

SEQ ID NO: 28488 - DNA, 1589 bp, Bovine  19866880790457
cactcagctcatctgcatccctggcttccttctgccctgtaaaggcatttgaccacgagaaagccacttttgccctccctcacatcagcacctggccattctgcttgagcttggggtggggttctcggtggaggcatttgaggtggtttggtgggaggtaccagggcccccatgggcaggagtgaggggcatggggtacacagcactctccaaggcctgactgcttgtgaggtttgcaagagagtctttccttcctctcttcccaactctccaggaccttaaagaacaccccagaactgccactggctcatgtggtctctaacagctgttactgacctctgaggcctggagagactggagtaactgcccgtctgagatctcctggagggaaacagagatgaagaaggatctgtaacagtgctggttatttacacatatgatactcctctaaactcctacctacttctgagatttctctcattctgagaacaagctacggataaattctgatagaatctggagtaagggctggaagggcctttagagattatccaggtgcatcccttccttatgcatatggggaaactgaggcccagaggccatgattagacagagggtgggagagagataggaggcatccaagtgaacagcagcagtttctctcagcatcccagacacggtttatccagtgttgtcctgaagggaaccctggtagagaactaaccagggtttagatagcttaaactatctaagatatccttaaatagtttaaggacgtcttaaacttctgaacagacatctatctccttgcccatgttggccttctagattcacacagatcaaatctgttctgaattttgatgtcagaagatcaagggacttccctggtggtccagtggctaggactgtgtgctcccaacacagagggcctgggttcaatccctgcttggggaacttagatcccacctgctgcaactaagagttcatgtgccacaactaaaaatttgcaatgctgcaactgagactggcccagccaaatacgtaaataacttaaaaaaagaagaagaaaaccttagcacttgggagtcatgggataatttcaatagcaaaacaacagaaataagtcaaggggcttagacagttacttgcataaggcgaggaaggggctgttcacagcagctcatgtggacaaggcctgaaagtctgagcagactcagattcactgtgacctgatggtctgtggaggtgggctccaggagcatcaggttcatctggagggtggaggagggtattccatgtcctccctgaagactggacactcagggagcccatcctggctcatctgtaaatgggaacatctaccaggagggtgtccggatggcaaagaattaaaaaaccaaaatacaggaggaatgatgggaggaagtagagagatttgacttgcataagaggagacttaggggaggccttgatcccagtcttcaagtatcttttcttgatactttctcctgggctctcccaggagaaacagataagaaatagaaatagatctgtcagttccaaggcacagaatcaagataggcaaggat

SEQ ID NO: 28489 - DNA, 1667 bp, Bovine  19866880800837
taatgtttctgcttttgaatatgctatctaggttggtcataactttccttccaaggagtaggcgtcatttaatttcatcgctgcaatcaccatctgcattgattttggagccccccaaaataaagtctgacactgtttccactgtttccccatctatttcccatgaagtgatgggaccagatgccttacataagcataactgaagtgattaatacttctaatttttgccaatctggtaaaatggttttacagggttgttttttgaaaaccaaaaacatctaaccccccacccatacacacacacaggttgaacactgaggactgaaactaccagagtctccttgcctcaccccccaacaacttactgtttacattagcatgactctactattctagaccagaataatattttcattgtccaaatggttggattgttcattatgaaatccccagccaaagactgatgaactctttaatgggatgcgtggcgtgcgtgttctccccgtgtctgactctttagatcccacagactgcaggccgccaggcacctctgtccatgaaattttccaggcaagaatactgtagtgtgttgccatttcctactctagagaatctcgccaacaatttgttacagcaagattctctgcaactcttgcttcagcagtttctaccaatactggactgattttcatgagctctacccagtcctaatcaagcctccaaactaaaaaatccaccttaaaccaacagggcctctcttcgggaactgatcaagtcctgctttcagttcagttcaagtcgctcagtcgtgactactctgcgaccccaagtcctgctttaggttactattatcacaagcctatcttctctgcaagccttagatttcctgagggcaggatgaataaggcttcaaccgatatttgcaggtgatacgcgcgaagtacacaggtcacctcaacgagttgaggagcagacgctccagaaacctccgggcaggaactacttccggcttgagaactggctcccgacaggccccgcgcccccgctgcatgccgggaccttcagggtggaggttcgcggcccgctggcgacgctgctccatcaggcagctctagcggccgggatggcgccccaccgagtgccacctgttcccgcttttcttcaaagaaaatgcagccccgtggcacttacccaagcgactatgagagtgataaattcgaccaaacaccagcttcccgccacctcctttaaaccaccgcaggctgccagagataggcggcgcggttgactcccccagattctgaccgctatccgcttcagcgaacgatagcaagggcacgatgccaccgcgctcctaattggccgactgtccggggaggggccacctagattggtgacggaaaggggccgggcgggaaagctagctgtggccagcggggattggcagaatgaatcggtattcactcccttccccgagacgttggtgggtgggagaagctaggctgggccgccgcggaaacgcaactcgtgattggcggatgtgtttttattcgggctctagcggttggtggctggacagttgatcagcgctgattggatagcagcataacggggagggccccgctctggttccgccctgatcccgccccgccgctgggatggactgg

SEQ ID NO: 28490 - DNA, 2211 bp, Bovine  19866880843936
gcagatgctgcccttatgactgggccccagaaaaaaaaaacaagtgaaaaagacctgagtctatcctgtaggttggagctgagcccacctagattaaaccatactataatcaacttgcagatccaagactgtgaaaacaatcactaatagtttaagccactgagtttgagggggtggtttgttatgcagaatgactatagcaataactgactgatacagccttgctagttcaagtcctctactctcattcccctagtccaactgccatacaagatgttagaccacttcaatcgctacaagcaagaaatgcttccctattaaagtttttagtttttcttccaggtttattcctttatgcattttgttcatacattcaataaatgaagacttgtgctaagccttagcaagggcaatggggggcaagtaagggtggccataaattggaatgaggtgctttctattaatacttcttgaagtgagagagaaagacgtgaaagcaaataattacatctcaaggtgttagccatatttcttaaagcaaaccaagtggagataaaataatcattcttgcaaatgcccttgtttatacttaaaagcaattatctgtgggcattttaaaaagtaaaatctatagtaattatgactttgccttttttctttttcacatatcacatgagccagtcttaccatatgtcaatatcatacattttcctttaaagtttgttttgcacatccttctggaagacgtggagagagatgtacttgtaaacagacagaaatgattcacaggatcatgactgctttccatcagctgcatcaattatatacagcaatggtacttggtgaaatacacttacaacttgttaaaaacactccttgaaacaattcagatcttgttaagtcctggtgtgctcagctaagcatgggctggcagtcggcataccttactcttcacaatcaaatccaagatgaccttggccttgaggaaggcaggccaggttagagtttccttctgatcttgctttctgttgtcatgaaacagaaaacagggaagccagctaagaaatgagtacagacttctatcaggttgtcagtaaagcatccagtcagtcatcaagccaattaatactctgtcaaatgatggagatatagcaatgcaagttaaagaataaatacatggtcacaccctcaggttacttatggtctcatacagatttgcatgcacactcagtcactcagtcttgtcggactctgcgaccccatggactgtagaccgccaggctcttctgtccataggatccctccagccaagaacactgccatttccttcttcaagggatcttccaactccagggaccaagcccaagtctcctgcgtatccttgcaaacgcaaggtgcattctttaccactgagccacctgtgaaactccctccaaggagatcacagatagttaaacatgccatttccagctcctccatcttttaaaaaattcacctaacttcccagtccctcaatttattcatccataaaacttcaaaactaatagcattcataatcaaaaacaataaagttacaaaaattgcatcatggaattgtgagaattaagttagtatatgttacagtagacaaccagttgcctactcaatatccataatcctccccctttttttttttttactaagagaaccctaatttttttggaatggcaatgtatcctgccaaaatattcagcctcccttgcagctatggtggcagttgattcagttctggcccgtgacaaatagatagaagtcttggcaagggcaagacccaataaaaggacaacatttcacgggatatacttttcattcatcttcttgtcagaaacacacatgtggaacatccaaccactaccttgagaccatgaagatgaaaccacacacttgggatggtggaacagaaaactggaaggaacttgactttcaaatgatttctttggacaccctcgtcaactctattctatatacttacttccagactcaccgtgggaggaatagttctcgcttaaggcacttgcttgcttaagccactctttgaggggggtggtgtctgttctacacaggtgaataaattcctaactgaaaacaacatgcctggcatatgggaagcatttggtaaatgccattagtcttattaatgttatgaccacaccgtgtgacggcggcgtggtg

SEQ ID NO: 28491 - DNA, 746 bp, Bovine  19866880847444
agctggcaacagaaccccccctccccatgttcataaccccagtcttgagacaaacgctctagtcattaaccgagagcgtatacgacaggctaaagttatgactagcgtttgttcgctgcagtaaagaatgtcctctattaatgacaacagctgtcggtttaataaccccagaaaagatcattaaattccttcacatttcccagaaacagatggaagaatttcagaaaggttcaaacatatggggaaacatattggattgcagcagctccaaagagtggccagaaatccgatattctgatgggctgttccgcacacaatcggcctgtgggcacccaacgggagcaggtgcactccatgccttgcggaggacgtgggaacatgggtgaggactggtgtcgaaacaggcaagccctgggtgtgctgggctggactggaaagatggatgcctgagttggcaggttcctattgaagccaaagagggtagctagggtctgcagcccttgaccccactttgctgcttcagtgattgctagaagtaccacccattggcagagtatgacacattccatttcccatccatgctcccttctgatcactgcacacttgctccaatgtatatagatatatctgggtcagcaacagtcgggctaatgcactcgcaggtgaactcctgataccttgcatcaacaaacttactctgtgacggggggactgcccacatcagagcccatcagctgatctcaaag

SEQ ID NO: 28492 - DNA, 1397 bp, Bovine  19866880856175
cagaagatgcttttagagttaacacgatgtcaactttggaggcagacaggaaggggaggaaggagtcagctcagtcgggcgccagggctcaaaccacagaaaagagggtcagtagcctgagccccacctgtggaacccttcagagctctctctgggttgaggaaacagatgtcactgcgccctgcaggtggctgtgggaagatgaagagctggcagacagagacagtgcagtcaggcagaactttgtagaagtctgagctgtccagggaagggagtgggctgccttgggaggcttgtagtctccaggagaagaggacaccgagatccagagaggagaagcgtcttcccaagtcacccagctgggcagctggggtgctgagactaggcacagctgccgacagcctaggaagttgggcagagggtgttctttctcggacagtgtgtgtatcaggcagggaggtggagagacttctttcccctctgatgccttctcctcgatggtgaaaggaaacagggctgaattcgaagctctttcttgacttccaagcaagcggaacacacctgatgagcctcttcaatatttattttcccaatagactcgaacaattctgaagagacataatattacgtttcttagaaatttccctgaatacatatttatcagggaaacctgcataagctaaaaaggtctcagatctacttatttatgtattcagtcatctccagagtgtgggctctgccagcattaacgagaagagacagtaattagattgcactgggcctgagcccccgctccaaggctgggaagagggcctggctgccaggcagggttctggggtcctcaccctcaggatgcttgtccttcaggtttgcgcctctggggatctgtggatctcaaacttggctgtgtattggaatcatctgggaagttaaaaaaaaaatactgatgcttatgtccttttcacagagattctgatttaatttttcctggggcaaccttggcatttgggactttcacaaactccctgggtgatctattgtgtagcaaaatttgagaaccactgactttgtgaacctgtaggccaggctacactcctgtgtcatcctttcttctccactagtttttatcaaaagtgggctgtgctgatggaagggagagcccagggctgggagtcacgggcaaggccaacttcacggacctgtgacccgggcagtgacaggggggcccatgctaaatactctgctgtatctgtcttgaaattcctaattactttttaacaagtgcaacttacatttcattttgcattagtgttagtcgctcagtcaagtctggctctttgggaccccatggactgtagcctaccatgggaattttccaggcaagaatactggagtga

SEQ ID NO: 28493 - DNA, 804 bp, Bovine  19866880860604
actcctactgtagatatgaaagacttagaaaagaaacattttcaaggaggcccaacctaaggactgtggagctaaaggtatgtttctaccttatattcttttcagatttttcactctctcatctgtcaagatttgttgacaaagaaaaaaatacaaaactaagttatatttatgagaaaactgtttggctcacagataattgcttttaaagcatcttatttcaacctacttgataaaacagactgacttccaatgagacagcaatgtggtaatctaggcaaaatacatatatatatcatatatactataagtcattatcacaagaagccaatgtgcagactacagtacactgacgtttcaatagtagcaaacacaccgtaagaaccactgattttaaggaattttctgcatgtattacaaattatacagataaacactaaatggaaacacaacttacctacaattcactgttgattttccaccttcaaattcagaattctttccccatcttttaggtaattctaatatcataagtccttttattcctataagtgctacatgatgttgtgttgggcttaacaagacttgatagatttcaaacaggggtggatttatgcaaagcaatctctgaaaattaaagcaaattggtcaaaatagttcactttaatgtaaatatatattggcagttactcaaaagcatagtaccgctttagttttctattaatgtagaataaagaagcattctggataagtactaacacttcagccattaactgatgaaatatttttttaactgcttacatt

SEQ ID NO: 28494 - DNA, 845 bp, Bovine  19866880923181
tggagtgtgctggcaggtctggctggtttctggtccctgacatcctcagatttggcctgccatgtgccaggaacctccaggagtgccactcatgatcaaagccagagaaatgcacagatgagggccagcctgggggagcgtggggggaggtgtggagcaatgtcttaaaactctggaagggtcagcccagggcccacccgccattctccattctcctctccagaggggcaggctccttgcctctgacaactagctctgcttttttctttatgaaaaaataatcaaagcccaaatgcggctggcagagtttctgaaagtcaatagaaaagaagcaaaggaaaggagccagctgagatggagataacgttcaatgcctctgactaaggagggcctaattaaaacaaatctttaaagcacagaacttggaagttggccccagagggaacggaaatctccgagatggacactcctcccggggtgagcgggtaatggtgctaggatacacacccggactccaactccctcggctcctcccagagcagcctggctacggagcaatgggcccaggtcttagggtcctgatcctcccgctcccccgccagatcacccacccccagaaacccagagccagggctttggggagacacagtagacagtctgccaagacctccctgaagcaggcagctcaggatgggggcaggctttgcctttccaagccttctgaagggctttcgaggttcaagcccacattcctgtagaacatttggtgcttgtccttcagtcgtgtttgttacccacccacctccctagctctcccttaaaatactcccatctggcatcagcgt

SEQ ID NO: 28495 - DNA, 1181 bp, Bovine  19866880935221
cagacacacaggacacaggacagcacccccacagggctccaagtgaaataagggaacccctcaccccaaaataaagcatgcttccagaggagctgtggaaatagtcctgctgaagactggaagatgctgcagcagggaagggccagggggcttctcctcgaggaagatgagggctgccaggctaaccccaccagcccagctgtcggccaagcttcctttaggagatgaacacagctgctcttcccccatggaaccactgggctctgggggcaaccaatgggcccaccggggcatcatctccgagggacttgtgaggccagagctaagtgtatggggaggatgagggcggtcaggggaatactggacagaacctccccccgaccttgctctctctccagcacttgcaacggccaggtcgaggttgctgcaggcagagcgcagcaagccagccctctgctgcctgtattcccctctccaccagccctcacttcctgtgcctgaaaacctaggcgatccagaggagaaaaagaaaaagtcactccctctccccatctcctgatcccaaccatggcgttctgacatgggataagccaagcactccataaactgaagcccgcccttccagcgaaaagagagacgacagcgtctaatgttgttagaaaagtgcagtggagttccgagtctgtccatattgggtgctgctggggaccaggagagtgtgggcagcagcaggatcccagggcagggctgtgagactggaaccctcacgtccagccttcccagtgctcagagaagggtcagaggtctccctccccgcccctgccttcccactgggcgagccggcaccgagccagcatcattcgtgggcacagatgctcagggaaaacagacacccgggaggttatccggagcagaggacccccgaggcttctcctgagaaacgaaaaaccgcaattagcagcctccagtcatgaatctccttctacacttaggaagatgcaaaagctctacttagggtaattttccggacaaaatacatacgtttcgcctttgcccatgcctccgttcaagttcaccaagagacggagaaaaacctccgctgaccggaaacctggcgtgctagcagaacgagagggagctgccgctaggtaaacgtctcctctaagaaaaggcagtgcgca

SEQ ID NO: 28496 - DNA, 1438 bp, Bovine  19866880974412
ccaaagatgcaccactgcaaggtaattcaatgagcctcttgatttttttttttagcattttatgcaacaaaaaattccttgatcataatctatgacacagtcaccccatctaatatgcaggaggccgtgggaacccctgatgagagcaggggtgcaactcagtgggggagagggcagtctgggatgatgggcagaattccctttgaacggcaggctgggtgggaggttgggagagaagaaacccacaaccacaggttgcttcccggcctccagctcagccacccaccaggaccccctcctctcccagcctggtctggagctgtgccttctgcgtcactcttttctcggtagtgccagcagccttgattgttgaaaacggctgtatttggctttaatcagagcccttgtcaagcacccgccccctccttttgtacttcattgtcctcagaggggaaattttattacaagcgtcattttatacaaacttcctgacgtgctgggattccacaattcccgatgccactgacttggtttctgttcctcactcagggtcacaaaaagacagaaatggagactgcccacttctccctgagctgttgcatcaattcctgattgattaatgacttgctgtgtgaccttgagccccttactactcctctttgagcctcgagttaccatctctgcaaccagtgggttggagagagtctccaaggatcatttcattgcaatctgctataatgttgaggttcatagaataactagggttgcccagttgtctacattgggtccccggctctggccctctttatcttctaaggttgatggagcttccttactgcacttctgagaacagctatcctcaactcccagcctctgacgcctcctcgtttcctgacctgacattcaaaccccttcctagcttgccctccacttccccttcctgcctcatctcctgtgcctggcgcctcaccccattgctgccaccagcaagcagcctgcacttaaaagttttctttaggcttctttgattttgtgtggaagtctttgtttagatctcagatttgtttcttattcaaaccctaaagtgatgtatcgattatgaatatttaaggcttctgattcctatttctgaactatactccaaaatgctaatttggacctctattcaaacctccttttccctagagtgacttttctccttttccctttacctgtctggctctaactttaccttcaaaacctagttcaaacactaaagtcccaaggaggtgcctggtacaatcagtctgcccctcctttgggcttccagcctcaagacagagaaaattcctactagaatggtagcattagatgattggttaagatgctataggacggttaatagggagggtatattacctaaatggggtcagagaactggccagtttcaatccagaag

SEQ ID NO: 28497 - DNA, 1782 bp, Bovine  19866881038870
gagatgaaaatgacattggaagaacagctgaagaaagaaactgctgctaaggtgaaacattgttgttggtagtttccttaaaaaaaaaacaaacagggacttcctggtggttcagtggctaagactgtgctcccaatgcagggggtccaggttcgatgtctggtcagggatctagatccgacctgccacagctaggagtttgcatgccacagctaagacctggcccagcctaataaataaataatgttttaaaaacccacagcactgtaaaggatgtaggagcacatcttccctgtttaaaaaaaagccctgctcctttgatagagtccccttctgagagctggtgattctccgcttcagggagaaaatggatttctctcttcagagctgggttaggtctcggcacactgccagctttgcgggtctctgtcacagaccccgctggctgaaggccatgaaccagacttggcaccattgaagccagagacactgctctggaagtgccattccatttgattgattttatccaatggtgcactgaatcgtatttgctgcccacattctgattagtcctgttagaataaaagtgcatgtggctaattgtgggggaagtttgctttcaggggggctgtggtctgacctttaaatgtaaaaatattattttttgatagtcctttgattttagaaaggctcacacgcacgggtcctgatggagtttctgtcaggaagactggagatagcagggctgcctaaggctgactcagaggattttcctggcagatgcttaactgtcgtgattatcagagaaaagccctaaagtttctctccctgttgctatgatagctgttgatcttaacagcagctaatttttgatgattaatcattatcagtgggctgctgggggtgagagctggggcctgcactttcattttaatttggctctaatacttgattcactttaggatctagagcaggtagtttaagcagcttgcacccttgccttgtgaagacagaaataaagggagactaacaccatcttacagagaaggcaatggcaccccactccagtacccttgcctggaaaatcccatggatggaggagcctggtaggctgcagtccatggggttgctaagagtcggacacgactgagcgacttcactttgacttttccctttcatgcattggagaaggaaatggcaacccactccagtgttcttgcctggagaatcccagcgatgggggagcctggtgggctgccgtctatggggtcgcacagagaaggacacgactgaagcgacttagcagcagcagcagcaacaccatcttaaagggttacaggcaccattttttctctcttgcagtaggaaacaagagctgcccgggttccctgagtgactcatctgtggctttccagcattaatcctcattcaaaacttgtattttttaggttactgtcgaacaactaatgtttgaagagaagaacaaagctcagaggttgcagactgaactagacgtcagtgaacaagtgcagagagatttcgtaaagctttctcagacccttcaggtgaggcatttgggaaacccctagatggaacaccgaggaggcactttcggggttcttggcgtccaggagaattttctaatccctgactcaacctctgacaaaacttagactagagactatggctgcccctgccccatattcctgcctggtcatttcagctggaaacctgtccctccattgtccctcacacatacccctttttttcctccttgctgcc

SEQ ID NO: 28498 - DNA, 1648 bp, Bovine  19866881053982
ttatggtttgggttggtcaatcaagaggattgatttttccaggaaacccaggtgacctcattatgtaccaacttaaaaatgctacttgtcctggctgacagagcacagcttcctactgagcatctcgcatccacccccattcctgcaaaaagcaacttcttaatccgacagctcattgttgttcttgtctctgtcttcatctagttctgccacagagatagagaatatcagaatcccagggtctctcaatccaagccttgtaaaaaaccctctgggctgtaagtaacagaaaccaaactcaacccaacataaacaataaagggaatttattggctcatgtaacaaaaccatccacaggcagggccagtcacaggcaaagatggatcctatgcttaacagcatcaccaaggatctggtttccttctgcctcctgactctctcttctgttgtcagcttcatgctgggaggggtcccctccaggattcccaagacagcccctgtcaagacccaaggttacctacttcttcgttgacatctagcaaggtgaataaaaagagcctttactcaacatttccagaagtcttgaaattccctctggctccattgccttaggaaacatgaccatcactgtagccagagagatgggatgaggtgtggacttagtccaggtaatgcatcccaccccagaaatgatgacagagacagctccagcagaacataacccgcccctgccaagagacatcaggggctgctgggaaaggaaatggggaaatgaacaccagggatgcaaccaacagcctccaactcgtctcccattttacagatggggaactgaggccagagagagagaaggcctgttctaagatcacagcagagaagagctgggaccacgacccacccctttaatctgcagacttgatcctatttccactctactctaattcgaccttgttcaggccaactcaggaaatattgagtggtcatcaatgtgggttcagatcaatcaatttctccccaaaccttaatgaactacttcggaagcatcacattttaaacacttccaacaaattttcagccaaaagaaaacaaacctcagtcccaggaattcttgcagccacaaagatcaaccccagcacttccatcccccctcttggggccccctaagaaccaagtggctcctgttacttttaaggggaaaaaatgcattctggtgtgcaaacattctcgcatattcatgcactctaaatctaattttagctgcacgagacttcattataagacgctcacataattaagcagttttcttcccagggtttggaagcctgtctattcttctctctcattaacacatcactgggattatcaagaatgggtttcagttttttcaaattatatgttttggtttttccaaattgatccacaacgggagatgaaatccatgaaaattacatgttttaacacaggtttgtgcaactccacagctttgctattaaaattggaatctgtaaacaggatttctctgttctggtctgattagctacatctgccatgcttctctcctaaattcaagcctgttttactccttggctggctgggacagcatcttctttatggagaagctgagagctagagatgagacctaacttga

SEQ ID NO: 28499 - DNA, 1930 bp, Bovine  19866881125412
taaaaggaggaacatacgtgtaggtagaagtagcgaagcccacctgtgtgcccgttactggggccacaggccctggggccacctgttctcacccccaacccctcacctccttcccattcctccttcaaggtcagccaccacccaggtttgatctgtgagtcccttgcttttcttgaatatctattgcatgcacaagcatggttttggttggcgtgtttatgtcttgattttctggtgaccttccctttcatatgtcatgttttgtaaggtttacttttgatgtattttcatcacttaaatactattccattctatgaataagccaagatgcatttatccttctcctggtagacattggcacgttgcttttttcacttaatacattttatagatcattttttctctgtacatgtatatttattgcatccttagacatgcatctttatgtttagtggtaatacatttacgtagttcaaattaaaaaggaattaaagagtaaatagtgtccttccctccaggggctcccgaggccccctggtgttttcattgttgtgtgtgtccatctggagacacaggtccctgtacgaggttcaggtaaatgagtgtgcaattcacaagtgtaagtttgctgggcttcagatttgcatacatatcgccaaattgcagaccactatttaaaaagagaattgagggtttccctggtggctcagtggtaaagaaactgcctgccaatgcaggagacacaggttggatccctggtccaggaagatcccacatgccacagagcggttaagcccgtgcaccacagctattgagcctgtgctccattgttctccgcaatgagaagcccacacagtagagaaaagcctgctcactgcaacgagagaaaagccccatgcagcaacgaagacccaacacagccaaaaataagcaaaattatttttggaaaattaaaaaaatgaaaagagatgagctgaagacagtgatgtcatgaatagttttgaaaaatacctcatggggacagtgtggttgtggtcattactgtggtttgacttaggctcgtcagaaatgcactgatgtgatgaagcagctgcagctccatcctgttttgagtgttcaactccttttcatgtctgtctagatcacatccaggcggccatcgcccagctggagctgctgggtgcccttgaacacagggatggccagctcaccctaactccaatgggaagaaagatggcggctttcccactagaacccaaatttgccaaagtaagtgccaccgtcttctcagtcccctccctgtaccttacaggtcggccatcccacaggggacgcctcagcccagtgcttccatcttcaccttttctcttaaacagttatcagcgcctgctttgtgtcgaacctcgacttaggttctgtgtgattcaggctcgtgttaagtcatgtgtgtgtgtgtgctcagtcatgagattctctgccaccccctggactgaagcccacaggcttctctgtccatggaattttccaggcaagaatactggagtgggttgccaattcctccaccaatgaagtcatgagccctacctatatgggatcagacaagaaaggcagctgtcccttctacagaaagtaaaataatatacaaatgaatatataaaagagcataagttatattgtcgtggttttagaaacacctgccccttcacgccttacaagggaagctgcagaagcaatgaatggaaattcagaagccaggaaaaaactggactcacacagtgtttcgttgtggtttgcagaccatcctcctgtcccccaaattccactgcacagaggagatactgaccattgtcgccctgctgtctgtggacagcattctctacaaccctccatcacggcgggatgaagtgcagagcgtgcggaaaaagtttgt

SEQ ID NO: 28500 - DNA, 1749 bp, Bovine  19866881144673
actgcagcatgccggcttccctgtccttcaccatctcctggagcttgctcaaactcatgtccattgagtcagtgatgccctccaaccatcccgtcctctgtcatccccttctcctcctgccttcaatctttcccagcatcagggtcttttctaacaagtcagctcttcacatcaagtggccaaagtattggagcttcagcttcaacatcagtccttccaatgaatattcaaggttgatttcctttagggttgactggtttgatctccttgaattcagggttggctatctataagccttgagagctgatttactcttaccagctattgagactaagccatttagtttacctctgccctcagcattcccctctataaaatgggcctaataagagcaactatgtacagggtggttagaaaattgaacaggaatgcagggtaaagcacctgagagtgcatggcacctggtgggttataaatattcaataaagacatattattgctcccatcattctggggaccccctcacacagggtgcaggagcattcccacagcacgtggacacagcaggtgcccaaactattttcaaaccactcctgtcacccacaaactggggaggctccttatttaagaagcagcctttcccaccacctggtggtgtgtttccatttcctggcctgagctacagtgttgccacagttgcgcttcacagaggagatttgagaaacattagcactctctaaagcccacgctccagacccaatggggagtccacctctccatctgtcatgggccccaaactgagtatgcccatgcaggagcaattaagagccgtgaacatgctttcagtgactgaggcgaggccgttcagctccaagcagagtgtattcccagtgaacacttcttggttagggccccaggccttctgggcagcaggatagagtcttcatggaagactgtgtggtgtccactccgaccctgctctccttatggctagactcacctccgggacccaggatgttgaaaagccactgccatctgttcaaatctgttacttgcaagccaccaagggctgcaggatgatgtctgtggaatgagagcctggcacatcaaataggacacactgtcctggtatcctccaccacacatgcacacagcattgtaaatcaactgtactcccaatatcaaataaagattaaattaaaagaataaaatattgggacttccctggtggtccagtggctaagattccatgctcccaatggagggggccccgggttcaattcctagttagagaactagatcttgcatgccgcaactaagacccagtagagccaactaaataaataaaacaataatatattactttcctcccttaaaaaaacaaacaaacaaagattgctgctttgcaggtggagtagggaagaagccaacaaaagccaccagaagctggaaaagacaaggaacagattgtcctctggagcctccagaagcaacaaagctctgccgatcaacacctggatttcagcccatgacacttctgatctccagaacggaatgataaattgatgctcttataagccactagttttgtggccactttttttaaatagcagcaataggaaaaactgatccatcatattcatggcagtccctgatggaggtgaagccaatggctacacttgtagccatttgggcacagcaggtgcccaaactactgagccactcctctccccaactattctcctttcc

SEQ ID NO: 28501 - DNA, 1566 bp, Bovine  19866881146848
cctaaaatcactagcccccatggtctctgccaacgttttcaagttcatcaaacaaagacaatgtctgtttgagtttggcctgaacaattttttgctcttctaattctgcaagaagggcctgcttagtgcacaattcagtcttatacttctcctgtaactgttcaatttctttttggagaaagtggaattcttcctcactgtaagactgtgtctcctgagatttatcttctggaagcaagacatttgggggaatccgcaaaatcaactgtaagaagagctgctccattttgccaaaaaggttatcaaaacgtcctttcatgaagcaaagaaacttttctgtgcacttgcgaatctcgactgggctaatcgcacagtctgggatgccatccagcttctttagaataacctgttcaacagcctgcatcacttcaaacaggtagtcttgaaaggcaatgtagatcctaagcatgcaagtctgtggtgtgaagccaaagaactgggcctcataggtcattggatcaacagacatcttcgtgggtttttttgtttttggggtttttttgctttgttgattgtgaacaacctgcaaatgtaataagaaaaattttcgtttaaaaaaaataacaaattacattatagacagcaaaacaaacaaaacagagcaggaaacaaaaaccatgaagcttatgttccttgatacttgatgctacttccagcctcacacatccacaacaggatacaaatcctgcctctccgagactctcatcagcctcccttcttcctcctctttgtccatttccctcacctctcaattactgaggcttctggcccgtggctcagccttctgaattctgttattaccccatgtaaacgttcagatttacaaccaacaccctagaaactcagttctgcatgtccactttttcagaccttcatctccactctttcagcaacctaggtattgacatttgtaacttctctccccaactctcctactttttgaccacaacctcatatgctagtcttccaacactcattcctatattcatattatatcttaatcttcaagactttcagccctctgagcctctctttttagtctctcccacttcacttccccactccactttaggatccatgatccatcacgttaaccattcctttgccaatgtcctcaactccccgtccttccaatcttgccatctgaaaaaataccactagaaggtgagcaaacctccagtaagctttacaaccctggcattttcttaagggtctgggagtcattcctttcaaatgtaaacatctaagaaaatagcattcctatctccctgtcactgtgggtgtttaacctcgggaccttttttgggctgtaaccagatacttgtcttagaaacaaaagaagtttcattattcctgcagacaaattagctaaaacaaatggctacatcaattaccaggcaaatttaggatgaaccttatcaaagaatctgaagcaaatagtgctgtcaaatctttttataagactgtgctgttaatcttgagaatttatgtaatggctaaaaacag

SEQ ID NO: 28502 - DNA, 1618 bp, Bovine  19866881147015
ggtggggacaggttgcaatgggcctcagaggcctgcctctcaatccagatgtttttcagttggtaagagggagctatggacggtgtcagcggggagcaggcagtgtaactggtgtgggcttcatagctgtgggtgggatgctgggatccctctgggaggcagtggtcctcggggccacccccagagatgccttggcaatactgtgacccaagtttgcctgtgacctggctctggaattagggattccaggtagggcgaggatgatgctacagatgtgctcgcaggtaaagccaccatctatctgagagagtgagcctttggtccccagaatgtctgttcctcccttctccctcgtcctgccctgtggttgtgagtatgacttggactcaggccttctggatggtccctatcagctctcagtgggagctggactaggaccctgatctcactttacgtcagggttgctcatccttgcaactgttatcagttgggtcagctaatttgtgtggggatctgtctgtacattgtaggatatttagcatccctctaccctgctacagaccaatagcacctccatgcttagatgtgacaacccagactgtctacagacatagccaggggtcctctgtggcactcccattgagaaccactgtccagcgggccacctggaacctattggctcagccatgccaagacccagctcacatttgccatgcatctgaatcctagtgatggattatcttcaacagttatttagggaggatgaaggagcaaattccacctccagccctgaggtctggtggatggaggatcagtcagaagttgaggcctgcagaggtcacagttctatttgccagaagggttttctttgtcctctcctggatgtggagggtgagggagagaggtgaattgggggattactggctgtgctttcctgcctggagtgccaagcacttcctctccagaaaggccagcagcaaccaaggctgcagagacatcccagttgcagcttcatctcatcctaatttggcttctagacaagctcggatatactgcaatgtgggaatggttacgtgatgccatggccatacagtggactataatacagccattgaaaatgttttccaagtcttttatgatggaaatgctcacagcagaatgttaaatggggcacagctaaatcggggagtcggggctacaggcttaattagggctgactgggcaggggcgccaggagcagcagatgccagaggtggggcacaaaatcaggaaaagagggggcgccttccttgtgccatgccccagttttgagcaccatctgaggtttatttgtggctcccgataaaaatctctgctttttttttttctctttgctagttagttacaatggatttggggagctcccagaatgtagtttgacaaggaaagaacattttgggccacatcagcatcttaatgatctgactgtctgccaataagagcaacttgacctatgtaaatgtgtttttaaacacagtaaaatgatcttgtctaattttctgcgatcgtgttggagctggaagaaaacctgctcattctcagtctaccggatcctgtcacctccttcattggacagaag

SEQ ID NO: 28503 - DNA, 749 bp, Bovine  19866881170677
cagttgaatgactaacacacacacacacacacacactgtctgcctttatccacgagaatgtaagctgagatttttgagtgcctggcgtgctttgctgcattctcagtacccagaacagtactgacaacatggtggatgcttaatgaatgttggatggaggaaccaaggaatgaatgaatgaacgtcctttccagatctcaactccccccaaagttgttggcaatacacttggacatgagccttctctgggtcacttgtgccccaggcatgagtaaagagaagaaagtctgctccatctaagcaaactctctctgacaacaggaaccccagggggctctgccatcctgagacttctgctcagacaagaatctcagccacatggtaaaaaaaaaaaaaaaaagtctgctcttgggctggctctgtctccctccctggtggtagtggctgatgttgaggcctcaggagcctgtatccctgggctgcccccaccagtgacctgaacctttttgcttccttgagtggattaaactgtcacgtttccgggtgtttgcagagcaacgggagagctgcagacagtaatgtggttttatttacaacataacctcttcagcaacatcactggatcctgaaaacacagaacagtttttagccccttgggggatttctaagacaggatttccataaaaattaaatattgataaatcttatcttgctgccgacctccttgtttcctgtacctccaccccaag

SEQ ID NO: 28504 - DNA, 858 bp, Bovine  19866881230256
cccttctcctcctgctcttaatcttttccgcatcagggtcttttccataagttggctcttcgcatcaggtagtcaaagtattggagcttagaactgtctcttttcctctgttaccatgtcttctccaacattgccccagctctcaccctgagcacagcagaggccaagcatgggtggggggtgggaagccagcaggggtggtacaacccgcatcacccacacaaacacacagaaacatcatctcactttgttcagaccaggttctgtaggcagaatctgagtcagggtccagacatatctgctttgatccttgttctgtactcctcaggccatagacaatgaagaaaagatgttccagtttgtgcgaattcacaagccacccccgctgaccccactctacatgggctcccgctacattgtgtctggttcagagaagctggaaatactgcccgaggtgagcagcccaggtggtcagccatccctggggtcagagctcttgcttagaaatggtctcagagctttcccagggaccgggtgaactggggttgggcaaacagcaagtggggcttccctggtagctcagctgttaaagaatttgcctgcaatgcaggagaccccagtttgattcctggagaatccccatggacagaggaactggtgtgctatagttcacagaactggacaccactgagtgactaagcacaacacagacagcaagtgagatttagggtgagcaggaatgcttcaaagggtaggagacaggaagttggggagggtcacattcaggatggggacaacattgggaagagttgggctatagagtacaactacctccaattaaagccaccaaggacttcc

SEQ ID NO: 28505 - DNA, 986 bp, Bovine  19866881246997
ctggagcccgtcaaggaccaatatgttacaacatatgttgtacagcttcctggggtctctaataaatctctcaagacttctttatttgccttttctcccccaaggttatgaagccaactgtttccctctgctgacagatgcgccaaggcagggagttcttttccatcggaacttgtcctcagaggagggaagatgctgggggaggctggtgctccacctccaggaagagattgcaggcaggagttggggtggggaagtgtgtgggggactggtggtgggagatccccaccttggtcataattttatacatatatgataagaattcaggagagaacgaacaccaccaaagcatgatagaaactactttcttcttcctttttttttttttttttaatagctgtgtacttttgctttctatgcataagacatgtcaattggacacataccctgccctcagggcactggccaggtagccagggagtactgtgctgtgctgtgctcagtcacttccctcctgtctgactctgtgtgacccgccaggctcctctgtccatgggattctccaggcaagaatactggagtgggttgccatgcctttatttccacatttactgcatatcaggcacaggtgatggagacgataatagtattttaaaaaagccccaacttactgagtttctgatatgggttggccctttggaacagtctggattcctcaacaggaattgaatatatcctgtcttgctaccagaaggctggtcctggaccagtagcaatcacgttatctgagaaaaacagaatattagcctcagcccacacctgctgaatctgaatctgcattccaacaaggtgcccagggggtttctgggcagattgttattcctactgaggaaacacaggctcagtgggaactgaatgacttgtagaaggtcacagcgtatcagaagcttagtagggatatagacatgcttctcaggactcaagtg

SEQ ID NO: 28506 - DNA, 2020 bp, Bovine  19866881269704
tgtgggatcctagttccctgattagggattgaacccatgctccactgtgagtacctccctgcagcctggggggaggcagcatctgggtcacccttttgcaccccacacccagtcctgaccctgacatacagcaggtgccctatacatgctgagaggtaaagatgcagcatgagctgtgagaagtcagtgatgtaagatgctgctggcagaacctcagctgcctctagacttcaggtgtggcacaggctgtcactcccatttcacacccttctccccggctccccaggtgagagccccaggccacttagggcaggagggcacctccaagatggagccacagatgacctactctgccccttcctctgatctcaacctgaagctcaggtcaaacagacaagtttttctgtctctggcaggtgtttgtttgctttaatctaaaatttcactgatgtacatacttcagtgaaattgaatccaacttcacaaagaagtttcaatccaggtccctaccttggcggactcaaaacctcctttcctgtcctccgtggaccctaaaacctaagccgtgtggccaccaagaccagcagcttcccccatgaagacccagtgctgcaccgcatcgttgactgtcttcatctcaccaccatgattcctagttcccaatggagccgggggatttccttacttttttgatagttcagctttgcatttacaacaacacatgttcagttttacccagcactttcacgggcttccctgatagctcagttggtaaagaatccacctgcaatgtgggagacgtgggttcgatccctggattggaaagatcccctggagaagggaaaggctacccactccagtattctagtctggagaattccagggactgtatagtccatggggtcgcgaaaagtcggacatgacagagtgactttcactttcaccagcatttcagggtgttgtatagctaggaaacattcctactatctggtccgccccgggtaatgaaagtctgcctcagcacttgacaaaatagactggaacccaaagatgggaggccacacagcatgtctgagaaacacctagaccaaggctctgggcctcctgattggtttttctctcctgcagaggacaaggaaagatgtggtttggtcatgaactcaagcgatctttggcagaccctaacacctcgccccctgccacaagcctgtccagggaaggtggtagggaaggcagagcacaggttccgtcccacagaatttagatgaagggctgtggatgcagaggtggcagagagcaggggcagacagagctgagggagaggctggcgcactcacgcttcctggagccgggctgcagctcctccacgcggtacacggagagccggcccacacctccgcacacggagctcttctcccctttgcactcgtggttacactcctctggcccgacactcatcgctgggagtcggttcccacagtagcactcggccccagcctccaagccagcatagatgtaggacctgcaggtagagcagggcctggggtgagtccctagcctggcccggggcactgaggtctggatccaggaatgcccactgggtctggggcctggataaggatgagtcctggaatctcaggacaggaaccccgggtctcctgacactgagcccagagctctttccacaatcccctgccgtctcgtcagtaaaccttctttgttttggacaactgcatctgatcggtcgagctctaaccacactccaaaagccaactggcagcagaagcaccacctcagggacaccactcctactctctgggattgcctattagccttatttccagtggagctgaccgttagggccccccacttaccgctcagcacatgcgtccttggcagtgggagacagtcatctttctcaagtcaaaaaacacagcccccttcagagtccgctcctggcccgtcgtcactgaagcatcccacataggtgcctgcagggagtgagggagaaccacagcag

SEQ ID NO: 28507 - DNA, 965 bp, Bovine  19866881350207
aacatagtaggaactcaacaaagacttgttgcttaaataagtgctttaaaacatctctatagtatgccattgtagggttatactctgtaacaaaaagtaagcttgttcagtagtcttgctgtgactttagagatgttgcttaaactcccttgagtcttaattttttcagctctacaatgtcagaacagcttatatcctatagagttgacaaggatgaactaaaatgaagccttaagtgatctgttggcgtctgctacttggtattgttgtttagtctctaagtcgtgtccgactctttgcgacctcatggactgtaacctggcaggctcctctgtccatgggatttctcaggcaagaaaactggagtgggttgccagctgcttccccggaagatcttcctgacccaggaattgaacctgagtctctgaatctgacaggcagattcttgatcactgagccaccagggaagcccaggcaaatgatagtggtggccatttagcttgttttcagctttccaccttctggtaaatatatgttcacacttttccaattatttccctcaataaatttgtatgcatggagctgctgagtcagggagtatgtgcaatttaaagtttgatgtatagcaacaggtcagacttggggaaagttggtgccatttacaacaccactgatcctggcataatgataaaccttttccatctggtgggttcagacaacttggcgatatcatgttattctgcatccctttgatctcaggggaggctaaacatcacttcatctgtgtaacctgtgtgaaggccaaggtcttgtggcccagcacgagggagcttcatcaaagaagcacagacaagtagcccaaagtaattaaaagggaatcaggctttattggtatctctcagagaacattaaaggggctctaattcataacttaaaaggactcttctcaaaagctattccctttc

SEQ ID NO: 28508 - DNA, 1134 bp, Bovine  19866881479824
aaaaaagctgtagccccaccttcacccatggtgaagggccaggtgagcagcttaggctttcaccctcgccagtttcttaacaaggtgccctaatctcctgcctcctcactaggcagagtggggaagaggtctttcatccccatgtcgtgttgatgagccccatccaagcccttggtgtcattggaaacttcatggggagcctgcactgccacctcagctaggcagtaaggaggttgaatcagtgggggtggtatcagcgaaggcctactggaaagtcagattttcatcacatagaggccaggcccctcttccaccattaccctcttgatcctcaacagtgctcaccgttcatggtgtggtatcagtgaaaaccatgttgggagcagtaaagaggcacttctaccccttccagcctgggaggtatccctggaggcttagtggggagccagtgatcccacccccacccagaagtaacaagccccccaggctgtcaacagattctagtaaggaacctggacttctgtttcaacttgacagtagtgaggtgatgttccacttccctgttggagaagtgctagaggaagccagctaaaacagaaggttaaataaaattcagagtcttagaatagtcaaaatattcagatctcaaacaaaaagcacagcttattctcaaaaaaaaaaaaaaaaaaaaatcaaattctcaaacaacgtcagagtgaatgaaaaagggcaatcaataaatgccaatatcagtaaggcaaagatgttaggattacctgacaaagattttataggagccattgtaaaaatgcttcagtgaacaattgtgaacacattcgaaacagctgaaaaaatagaaagtctcaccaaagaaataggaagtctcaaaaaagatatagaagatataaagaactaaattgaaatttcagaactgaaaaaaatgtaataaccaaaattttaaaactcaacagatgaactcaacacagaatagaaggggcagagaaaacaatcagtggactacaagataaaacaatagaaatgacctgatttgaacaacagagaacaaatagaattttttaaaaattgagaagagactcagaaacctgtgctactataacaaaatttctaatgttt

SEQ ID NO: 28509 - DNA, 900 bp, Bovine  19866881590543
atgagtggcttctgagagtggaaaatggccatgcccgttcttgatgactcactggctgccagattgccatattatgtggaagccctgcctgctagggggccctgggctgcagagcaccccttctctaaaaaagtctgacctgcttggagtcttaatttaacaaagactaagacagaggctgcaggatgcctttgatggtgggaggagagcctgggcaaggcaaactcggccatttatctaatgtatgcaggcggctttgttcagtgcatttgggggccacatgaataaatcacacttttatttgacagcagctccatccacacagaagagtcacttgggtcatctctctgtccaggacttggcatccacagggccctctcatgagcccagttattttgagctgtaatgaaaatcataacaagcagtgtcatggacctcatttttgctaactgatgcaaagtatctttttcttaattataaaactggctataaaaacttttaaattggggggtattttcagtgttcaaggaggaagccactctagccttcatgtgggatgacaggtagtcaatgaggagagaaaaaatccccaggctgcctccgtcggtccctctgttctcgccgcactaaattacagaattaataggctcttagaaaagactgacactcacttactgtgagaaagacaattaaatgtggaaacccacttttctcatggcattgaattttaacgggaggctttgagactcaataaatctctttcctatttcttctcttgtgttctataggttcttccaaacaacatctagaacactgaagaggctcttctctcctcttgatcctctcaaactcctcatgcaggttgtgattttttcccaggaattttctttgagatcaggt

SEQ ID NO: 28510 - DNA, 975 bp, Bovine  19866881800497
actatgtacagcagcttaatgagtatagtggaatcttaagggacacttgggatctctatgaagtttcaatggacaagaaaagtcagaatcaaagggctcatcctctccggatgccaatttcagagcaagctccaactcaacacactcaaacacatacagtgatggaatgaggtcagccctggaatcccaggacttttctgatgtgtggtcatcttcttcttccccctccagcacaacgcaataatgaagcattcctgactcagtagtaatcaccaggatgttggcgacacatggtaagcaaagcacagcacaagcatggtagccatagttatcttcaacagcaggatgcatgggcaacgggccgaatagcttacccacactcccagggctgtgcaacagactaacaaacgtaaggaaagtctcctcattttcatataagatgtacagggagtagccactacttcttctttgccttttcatccaaatatgtgctttgggactgctgacaatggcccaaagtcaaatgcaactgctgtctcttccagagatgctgtgtaggcacttcctttgttgagtatgagactttcctcttctgcttctgaaagtacgatgaccttagtcatacgcaaagggtaaattcttatgacgttgtctgacgttaacggcacaatttgagtatctagcaactctctcggataccaggcaacatgcttcagagtcagagaggttgaactggtgaaaaatctctcagcaacgggagtcgtgctacaattcactgctgattttccaccttcaaattcagaattctttccccatcttttaggtaattctaatataagtccttttattcctacatgatgctacatgatgttgtgctgggcttaacaaggcttgatagatttcaaacaggggtgcatttatgcaaaagccgtctccggtactgcgagagggagggctcctcaccggcgcagctgg

SEQ ID NO: 28511 - DNA, 2107 bp, Bovine  19866880122642
tgatttgcatttctctaataattagcagtgttgagcatttttacttatgcctgttaactcacagtatgtcttctttggagaaatgtttagatatatcttatatttttcaattgggttgcttgtttgttgctgagatgtatttgagctgtctgtgtattttggatattaagcccttgtcagtcacttcattggcagatattttctctcagtccataagttgtcttttcattttgtttatgttttcctatcctgtacgaaagcttggaagtttgattaggtccatttgtttattttgctgttgccttgggagaatgacataaaagaacattgttactatttatgtcatgtgtcaaaatgttttgcctgtgttctcttctaggggttttatggtgtcatatcttaagccattttgagtagggtctgaatgagggttctaaccctattgatttgcatgtgcctgattgtccagtctccaaacaccacttgctgaagagactatgttttcttgattgtatattcttgcttcctttgtcagaaattgaccaaaagtgtgaagatttatttctgggctctgttctgttccattaattaatatgcttgtttgttttttttccaatatcgtgctctttagactactatagttttgaagtattgtctgaggtctagaggattatgcctccagctttgttactttcctcagtattgctttgataatcctatgtcttttatggttgcatataaattttatgatctaagatgattcaaagaaattaaaagctatccatgctcttggattataacaattactattgtcaaaatagccatattacccaaagcaacctacagatttaacccaatcccaatcaaactaccgatgacatttttccacagaactgaaacaaatgttcctaaaatttatgtggaatattcttgatattagaattatataccttcactctttggggcagggtaagtgctctgactgctacagaatcaatggaactttcctttgtgtggaatagggttcctgatctctccttgcaactgtggatatgtcaaaaatagacaagtgggtggagaaatagaccatctttctaaattattatttaaaaataatgttcactagctttcaatagatagtgatagttcagggtactaagggagcatgtattcactatattcccaagtagcatttgaacagaaaataaaaccttaaagttggatcagcaaaaacattttaaaagataataagcatgagactaatgggaaaaatcattttatttaaaagaatgcccaatatactgaaaaaaataccttaagaaaaattactagtagtacttaaagaaaagccataagcttgttcacagtgtgtatacatagagcttagcattttactaggagctcagtaggtatgaactgaaaaaagtagtttaattccttgctctttgctttgttttactagtctgatttaatatatttgagtgagtaaaatactcatttaatttgctttagcatataaaacactttagtatctggtagataatctcctccaattatttttcttttaaaattttccttagctgtctttaaccatgtattcttccagatgatgtcagaataatttctgtaaagttccacttttttcatcagtgttaaatggaataaatttacatttgtatggagctttataggaaactaatgtctttataatattatgtcatcttcttcaggaacacaatattctatcaatttcttaatgtcttcttttatgtgcttgaatggctagtacacctgtcaaaagtgtgtgacagaggacacaagaaaattcacttcctcaggacttgccttgcaaaaatccaggagggacattttttttttttttttaaattaaaaaaatttcaggtatacacgtgctcccattcctgaaccctcctccctcccccctccccataccatccccctgggccgtcccagcgcaccagccccccagcatcgtgcactgaacctggactggcatctcgtttcatacatgacatttcacatgttttcaatgccattctcccaaatcttccccccctctccctctcccacagagtccataagactg

SEQ ID NO: 28512 - DNA, 2338 bp, Bovine  19866880590220
catttctcaacagtatgtgtaataggtgttgatggtacttagtagaatagctttttgacacgaaaattacttatgtccagtataatcattcagattctgacagttcaaatgcttatcctaacagagatgactttgctcttgctaggaagtgaaactgacataagggttgctgaaggaaataaaatatgcagcactctaatatgtgttagaaacagtcttctcattttgcttaagaattttgagatccatacggtgattcaaagttaaaacatttgaaaacgatatactagttttgttttagcccacacattttaaacattcactgagtagtccaaagggtttatagtaatacagggatgtctttgtaatgtattataagatttttgaatgaatttgtaaaaaatgcaaatgaatgaaaggttttaaatctttcagtctggcctagtatctagaggttggagttcaaatatatctccaaatacagagttcttttgagagttagttgagtatcttaattgcttaaaataatctgtgatcatcatgtatacctgtggtggattcattttgatgtttggcaaaactaatacaattatgtaaagtttaaaaataaaattaaattaaaaaaataagtacaggacaattgtatggatattagaagatgacaattattactatagatttaacattcagagaagatttctgtaattaatgaagacttaacctttagaatacttaatgagtatagtgaaggagaaagttattttaaatggaagaaaactattttcagtacaggtatacctccttttattgcactttgctttattgagcttcacagatagtgcaccgtttttccaatttgaaagtctgtggcaatcaagcatcaaacaagcacataggtatggtttttccaacagcatttgctcactctacgtttctgtatcacattttgctaattctcacaatatttcaagtttttaaattactattgtatttgtcatggtgatatatgatcagtctttgaccttactactgaaactgggtgaaagctcagatccctagtgagagtttagtattaaagtattttttaatgaagttttgtatttttttaatataaaatacaccatacaacaagaacagagtatatattcttctcaattatacatatagcattttccaatgtagaacatatttttgggccatagagcaaaacaacagaaacagatatcatgcaaagtatgttccatatcataaaataaactagaaatcaataacaaaatgctatctggaaaatttggcaattacaaataaagctgctgtaaatatcttcgtgtgggtttttgtgtttacataaattttttacatcatggggtaaataccaagaatcattgatgaattatttagtattacagaagtatgtttagcttgtaagaaattgcaaacctgtcttctgaagttgtacaattttgtattcccgctaacaatgaatataataaacccattgtagctcaaacggtaaaaataaaatctgcctactatgcaggagacttgatttgattccttggtcaggaagatcctctggaaaacggaatggcaatccactccagtattcttgcctagaaaaatcccatggacagaggagcctgctagctacagtccgtgggatcacaaagagtgggacacgactaagcgactaacactactagtactaacaatgaataaaaatctctgttgccatccttgccagcgttttgtgttgtcagtgtttctgattttggcccttctgacaggtgtgtggtggtatctaagatccctttaattaatattttgctgataatataatattagttcagttcagttcagtcgctcagtcgtgtctgactctttgcgaccccatgaatcgcaggacaccaggcctccctgtccatcaccaactcctggagttcactcaaattcacatccatagagtcggtgatgccatccagccatctcatcctctgtcgtccccttctcctcctgcccccaatccctcccagcatccagtcttttccaatgagtcaactcttgacatgaggtggccaaagtaatggagtttcagctttagcatcatttcttccaaagaacaccgaggactgatctcctttagaatggactggttggatctccttgcagaccaagggactctcaagagtcttctctaacaccacagttcaaaagcactcagccattaaaaagaatacatttgaatcagttctaatgaggtggatgaaactggagcctattatacagagtgaagtaagccagaaagaaaaacaccaatacaatatactaacgcatatgt

SEQ ID NO: 28513 - DNA, 1136 bp, Bovine  19866880691706
attgcctttctttgggattggaatgaaaactgaccttttctggtcctgtggccctgctgagttttccaaatttgctggcatattgagttcagcattttcacagcatcatctttcaggatttggaatagctcaactggaattccatcacctccactagctttgtttgtagtgatgcttcctctaaggcccactaatttctcaactgaaattagaattctttcaaagaaaatgttactgattaagttatattttaaaataaatacaaatggatttgacttaaattgcactaatttatttttattctcccattttgccatcatataattcagcaataaaactacccttcaaaatttaaaaaaaaaaaaaaaaactacattcttcatttatttcttctctttagggaaataccagtctcttctatcatgaagcaaacctgttgagaactttgagaatgcaatttccaccatctgttttcatatttttagatagtaagcttattttctatgctgcaaataactgttgcttcaaatatagagtttcatttctttttcaataacattgaatgtttttattctctacatactccataggacctcaaggaatgaaagtgataaaaggaaggtaaatgaaatacaaaggaaataagaatgtgaaataaaaagaatatgtccaatttttatgtgcaacaatgtgatctaaaactcaaacatgaaaatgtgcagcattccttaatcgggtttagaattatagatgattaaggacaggaatacagcagcatattagataagcatgtggctaaaatttggttgctgtataaataagactaccactaggattttacaaatgattatcactaagtaatattttggagaaggcaatggcaccccactccagtactcttgcctggaccatcccatggatggaggagccttgtaggctgcagaccatggggtcgctaagagttggaaacgactgagcgacttcattttcacttttcactttcatgcattggagaaggaaatagcaacccgctccagtgttcttgcctggagaatcccagggacggcaacttagcagcagtagcaagtaatatttacatgttttcttgtgtgttatttcagttttttcataacctc

SEQ ID NO: 28514 - DNA, 2009 bp, Bovine  19866880701637
tgccatttatggcttgagtcctaattagaccaaatcaagttgagtacttctatttgtccttcaggtagctcttagtctggatagtacaaacatttacagtaatttgtaaaaaagatttgttatgctccctccaaaatcagggatatgggttccacactaggaacagtctgtagccatatcaagactgctatcacactgggacttgggtgtaacaactgcaagtaaaactatccacaactttcttactcttttcaagttgctctttcttgattcagtatttgctgggttgagtaaatctctgtcttccagagttctgacaaggttctgatgaattgccttttgccatatgaatgtacgtgtgtgtgtgtgtgtatgtatttctgtggaatgtgaacatttagagatgcttactctttacttttctgatgttcctatcccacacatcttctgttatttttatggcaaaatggaagcatcatatgcaatgattcctttactaggagtattttttggacagttgtgtaaagaaaagatgaggctgttacctttgccctttaataccgtcttacttttcttcatagagacatccaaattctctacacttccttccatttcacataaaacagtaactttttcccaaagaatacaaagtaccactttaaaatttaaaaacatacttgcactattattacatctgtgtaaacggttactatagcatttgtcattaggttttactcagaaacagctgacatgtacatgcttaatttttatgctaagtgccattaatggtgctctgataaatagagaaggtaactttaaatatgttatttaaaacttttctgagaagtctgaatatgttaagatcagctttatcttttttaaggaaatttcattgttcatggcataatgacatatatttatttaatttagctatttatacacatctatgatattgaaaataagttttatttcttatcttatttttgaacaaaacaaaaagaaaggaaatatggtgagttctttgactgaaaagcactcagttcttcatgacatcagtctaaaagtatcaaaggggcaggtgtcggaggatgatttcaataggaaaaataaaaatagaacctaagcctctgtgacagatgtcaagcatgctgacaactgttaaaagaaaaatcattttcctgatcctgtgcaaggagacagcttgtaagattaaagatgtatctctttatctatgttttcagcagatcatttgtactgaatagggcatgaaaggtacttcagatggagaaaaggactccaggaattttcatcatctcagccacacaaaggctataatgaaaagtcagagtgtaaagaaatataaaaataagaacaaaatctaaactgagcagaatttactgtgtgattttaagcccaaatattagtatgaaaagttatttctgctttaaaaatccttaaaatgctcccacaatagataaataaatcatcaaatagtgaataacatgtaataaatgcttaataaatagttgagcagtggttaatgttttactatgattttttaaatttaacagtgcatctcagtaatgttttcatattagaatacatagagctacacaaattggcatagtattccaaggtatgggttaaccaaaccttatttatctgtagtcctactgatgggcattaattatttatgttaatttttgctgttgcaaatactgctgccctggacattcttatatatgttttcttttacttgttgagtattttcataatgtaaagtctggcaagtagaaatattgggctactggaaatacacattttaaattttaatttaaatttaccttatatacattgtgcaatgtatttattattattattgcagttactaacaaggacacttatccactcccctgctgctgctactgctaccaagtcacttcagtcgtgtccaactctgtgcgaccccatagaggcagcacaccaggctcccccatacccgggattct

SEQ ID NO: 28515 - DNA, 1599 bp, Bovine  19866881080636
cctgatgcaaagagccgacttatttgaaaagaccctgatgctgggaaagattgaaggcaggagaagggggcaacagaggatgagatggttggatgacatcaccaactcaatggacatgagtttgagtgaactccaggagttggtgatggacagggagggcctggcgtcctgtggttcatggtgtcacaaagagtcagacacaactgaacaactgaactgaaactttcactctcctctttcactttcatcaagaggttctttagttcttcttcactgtcataaggggaggggatgccataactgtttgcaatttcttaatttttattttctatattttccttactacagttttcttccttcccttctttctttttccttccctctgtttattcttgcctttccttcatgctttctctttcttcctttcccagaaacattgagtgactgtgtttcactctgaaaagacttaatatgttgaaaaaacagcatcatataccttaagatccatgttattagaaactgaaaatgtttaataacttttaaaattctaaataagatcaccccaggtaaagcacactaaaaaaaagtgtgtataatttgctgagcagcaatacatttagacatatctgatagtctctatctgagaatttatgctacaatggctacgggatagaaaccgcttttgtaaccaatttaaaaacatgaatgttcttctctttaccctagagcttaaagacaatttacagaagtaggtcagtatgaagtattgccacaataaaatgtgttttacttcccttttgtagcaaaaattaggaaaacactgcaatgctgtagagttataaaatatgttagcaataaaacaaatacaagccatcaagtttatttaatttctactattattgtcattattcagaaacctttttaaagtcttccatatatttgaaagtaatttattttgaaaaaatatgtcaaagttggaataacatttttaaaatgttatttgttcagttatgaacaaaatcatccttcataaaacaaaatataagggttattttactagtttcattgcaggaaatatttaaaaataattttatttcaaaacttttttttttttttttgccagtgagctttctgtgacaatataatttgtatctctctttgaaaacagttatctaccttttgacctcatcagattgcaactaattgtatgcagtaaatctgtgttaaatatggaaatgtataggaataaaatcattacacttcccaatattcaaaatacacagttgttcaaataccaaaaatcaaaccttaactattgacatttttgcatagtaaaggataattttcctattctaagtgctaataattggaataaaatatagataaatgtgttttgtaattgattcaagtttcaagagttataattagtgggaatgacaaaaaataaagctataaaacaatcatataaatgtaaggaattgttttaaagttatcaaactgtattcaaatggttgaacaaaagacacattaatattctatgtacttgtttctaattaagaaataaaaatgtttttgtaactttaccaagaatatattaag

SEQ ID NO: 28516 - DNA, 1006 bp, Bovine  19866881128429
tcaaggctatggtttttccagtagtcatgtatgcatatgaaagttggactataaagaaagttgagtgcagaacaactgatgcttttgaactgtggtgttggagaagactcttgagagtcccttggactgcaacgacatccaaccagtccatcctaaaagagatcagtcctgggtgtttattgaaaggactgatattgaagctgaaactccaatactctggccatctgatgcgaagagctgactcattgaaaaagaccctgatgctgggaaagattgaggacaggaggagaaggggatgacagaagatgagatggttggatggcatcgccgactcaataaacatgggtttgggtgtactctgggagttggtgatggacaacaaagcctggagtgctgcggttcctggggtcacaaagagtcagacacgactgagcgactgaactgaagaaggggcaacagagaatgagatagttggatggcatcactgattctatggacatgactttgagcaatccccaggagatcatcaaagacaggagacctggcgtgctgagtccatggagtctcagagtcaggcatggctgagtgactgaaaaacaacaagactataagattcatatgaccttgaaggagaaaatctggattattctctttgtttaagactgaccacacctgaaagtgcgtctgaatagcacatttttaaaagattactaaaaagaatgcataaatgattagaatcagggacatgatagagaatgataagatatggtcaactgtgtcatatgaataaaagttgttgaaatcagaggtgttttgcaaagagaagagaattgctggatgaagggaaaaattatctcagtcctagttttcctacattgctcatgttcattagtattcatggcaccaataactatttctctgattatttcacagcacatgtagccttgctgttcaagttgtcttaaaatcattgatcccaacatcaaaatgtagaggttttaaaaat

SEQ ID NO: 28517 - DNA, 1599 bp, Bovine  19866881390037
tagatagaacctagtggtactatgactttatcaaacccaatccactttcttaactcttctttttctttctttcttttttaacagtatatgttagttatgctctgtctcttgtattttaacaaacattcatcagcacatgataaaatcagtctaacctactattctaggttttaataattcttcataattcataatatgagagtcattgatcctgtctagataatctggcatgcaaaattttataaaatatgtttgaggataatttaatatcaagatgaagattcacattttctactagagctggtgtctgtgggagtgattatgaaagaaagaggcatgaagtgaaacaagataagaactggcacacacagtgattcatgaaatgactcaaaaataggaagaagcctataaatcattccatttccttctaaaaataagtgttaccagatttttattgatgctattcaaagttctccatgtgataacatctctatctaaatttggaagaaatattcctgcaagtgaaatagggaaaatgccaaaataacggactcggttttgttgaacaatcccaactgaaggattcttttgatcctttgagtcttgtgaagcaatagcacattggagttccataaactcgaaaaatggagcccgtagaggacactgctgagctcctgaactaaggtgtcccttaaagaacattcctgggacatttctaatttcaatgttgaggtcacttcaaaatttagatttgttcctgtcagtggaatggccctgacttttctactagaattgtttagatattcatgaaatcaccttttcatataaatctggggtttaaatctgtttttagatattttcaaaggaaaaaaaatcatctatcactcttctataaattatatatgaatttataatactggttcatctaaaattacatgcgtccatctgtaaaactaaatcttgatcttcctggatgacaagggaacttctaagattcatataatataccttcctattatccatattggtcttagctcaaaaaaatgcattctattctcaatatatgtctgtcatttctgtgatcaaagaggatgttcctgtggtaccttcccaccacccacaccccccagagagtaataaggggaaggagagagtgaagcagctagctttgctttcaaggatgtgaaagcatgtctcatatacttgcaaagaagttgtaaacctcacttttgcttagttctgttggcctgaatttaatcacgtggctacatgtagctgcaagggaggctagaaggtgtcatcaccaccttgaaggcaatatgttctgctaaaactcaaagtagaaagaaagagaaacaggaagagagaatggatatttagaaacactaagaaatttctcatacattgtgcatatgttgaaataagttactggtattcatggccctgtgtggaaatttattttacactttattgacatacattatattatccaaggtggcactagtggtaaagaattgcctgccaatgcaagagacttaagaggtggtggggttcgatccctgggtcaggaagataccctggagaaggcaatggcaacca

SEQ ID NO: 28518 - DNA, 856 bp, Bovine  19866881814881
agcctaaattgtatcctgaaggggtcatgacactgatcttattccaatgccacttctcatttcagcatctcaaactgtggtataaatgaaagtctggatttctcacctgtcatagtttttaaaatcaaagtcgaagagcacattctagttaatgagcataaacttgaaccaaataagtttatgaaattcacagaccgtattgttcagctgctgcttcttcatgtatctgctaacattttgttcctttaaataaaatctacatttgcagggtattcaaaactgaagaatgcaccagaaactctgatgtaaatttgtagtttctatcattattaaaagtgactgctgctactgctactgctgctgctgctgctaagtcgcttcagtcgtgtccgactctgtgcgaccccagagatggcagcctaccaggctcccccgtccctgggattctccaagcaagaacactggagtgggttgccatttccttctccattgcatgaaagtgaaaaagtgaaagtgaagtcgctcggtcgtgtctgactcttagcaaccccatggactgcagcctaccaggctcctccacccatgggattttccaggcaagaatactggagtgggttgccattgccttctcctattaaaagtgaaaggacctataaatcttaattgatttttggtttaattatagtatattatccatgctgctcctctaggccctcctgcacccgcgcagccacggctccctggacgtggggatggtcctcctggccatcgcccctggcctcggtcatggggttgctcctccctgccgccgcccatggcttcaggcttagaggcgtgggatatctcctcccggccg

SEQ ID NO: 28519 - DNA, 750 bp, Bovine  19866882132826
ggagcaagtgagaaagagggaagaggcagagagaagaatcaaaggggacatatgtgtgagagagaaaaaagtgtgagggaagtggcaaaagagagaatgtgctagacagtgtgagagacaaggagaaatgtatatcctaatggagaacaaagaatttaagtctattggattttttttttaacagcaatggaaacctaatgaactattaccacacctagcagcaaatgctgtgtgtgtgtgtgtgtatgtgtgtatgtgtgtgagtgtgttggggagtcctttagaggatcaaagtaagggttagtacaaaacattactttctggatagaagagaaagactaagtgctcgcctctctccaagaagcccaaatacatttacctccacagtagtccctcagcatctatgggggattgatttcaggactccagtggatatcaaaatctgtggatgctcaagtccttcatggaaaatggcataggatactcggcccttgatatctatgggttctgcatccctagacagcaagggccaattttatcattcttcttcctggataactcattgaaaaccaaactttaaagagaaataaactcttgtatatataaatacagtttcaaatgctatacatgggtgttgccaccaaattttctctttaatctatttcttgtttgttttgacttccttgatagcaggtgatcataattaagaaaggcacaactcattatgtctgaaaatgaattgatttcttg

SEQ ID NO: 28520 - DNA, 615 bp, Bovine  19866880352702
ccgccccctctccccaaagcctttgttcatttttggccccgatgctgggcaaccagagtggaatgcccatccccttccggcttatctaaatcctcctaattcttcaaagaccagctcaaggccctccccactcagtgcagccagctgattgctcctgggcccatctgaggccgcctcctcttaccgagataggtgggcctttctaccttccaaataggctgtccaagaccaccaccgagaagggaagcacctgagcacaggcttactttctagctccttagaggggttcccttcctgctccccaaaggagatcaggcacacccactaagtcaaggttttgccaggcataaggagtggatataaaagccctgagctataggagtctcagtcacttacctttttcttcaaatgcacttgaatatctcccttaaaaaagtaacaggagtgaggggactagggggcctaacctaaaggaaacctattaaacgaaacttcctcaaaaaacctattgctcctaaccttaaccctttgttttttattactcacccagagagctcttctaaacaagtctagcgtcaaggtctccattttaaaacctaaattaagggcgggggt

SEQ ID NO: 28521 - DNA, 2176 bp, Bovine  19866880430591
acaggaattttttgtctgttaatatattcccagcatgcaaagcagtgtttgactcataataggggctaagcagtgatttgttcaatgaacaaatacatcaaagtcttaagtgttcaatctgtaaacactgaaagaatggaaacaggtgtatgatagggtaattaatgatggagaatatctggccaagttaatattaactatagaaatccttgtgtccatgttaatgttatatggtgttggagcataaatgagcatgatttaggcgcttagaagtacataaacattttttttttcattaaagtaaatggaatttacacttttctactaagaagaattcactctacaatggatttttcaagactcttcatcaggcaggggtagcctatagtgagaaattagaaccacctatttagtaaccacccttatttgttaactatggtctaccaatactatgagatattatgcaatggttaaaaaagactagaaagaatgtgtcttagtttgtttgggctgctgttataaatataccatagactagatggctcaaacaataaacatttatttctctggataagatcaaggtacgggcagatctggtgcctggtgagagcccacttctggctttgcagatggctgtcttctcattgcatctttacatggcagagaatgaagagacagaggaagcaagctctcttatgtctcttcctataagggcactgatctcattcatgaggtctccacccttacttgtaacctaattacttccccaaagccatcctccaaatataaccacattggcttcaacatataattttgggaggatataaacattcaatccatagcaagatggaacagctgtctgtgctaacagagctccagaatcactgcatgaaaaaagaaacctgtggcatggtacttatagtatatttatctcaaataatatgtgcatacacataaatatactacacacacatacacacacacacattcctggaagaaagtctggagagatacacacaaaactattaatgatgcttatgaccaaagatggatagggttgtagtaggattgggagaacttcagaatttgacataataatcaaagggaactccagtgttatttgtaatatttttataatgaaaatgtactaatggatgacttatgtagtgaaatttttaaaggtcaaaacaagaaggaaaagaaaatagcttctgttgaagaagataagaggatagggtcctgccagggacttaaagtgtaaaatacaaaggttatttttcaacagaacggccataactgtgagtgagagcatcttaatgatttggatttctttgtcatcaatgtgcctataaagctctaagacaattcaaaggattatacagatctctccttgttttctcagaaaagcccaaatcaagtattccaagtgcatagtttgtaaagattgtgatgatataaacagaaaaaaattgtcatttcaatctcactggaaaaagccaacttccttagccaaatagtgtagtgtgtctaatcttcctgctaaacctgaacaattctaggtctatgtaatgactacagaagcaatttcagaaacttctggagggaaacaccacacaaatgaatgagtctgtggttcccggttattagcttgatgcccaaatgcttatcatatttgcaagaggcagtttacaatctgctcatcttgacaaatgtagcccaaggggatttaaatccctgcatttgcaatttctatctcttcctctccaaatttatggagaaatggtagacacgaataatgtgtcagggatgaatgaactgaggtctctgttccactcctgcagctctatttcactcaaaggagagtaataaatagaaaacaaagaaaagtctcagcagataatgaatctgagtcctaacgaccttcccaaactacagaaatggattgtaacttacttggcattgcccaaactatttgatgcctgtagagaagtatgaaaatatttttgactgtttagggccacagctgggcattttaagtatgtcctctatgattcatgaagagtcaaaactactcttccacaaaaaggtgaaagtcatccatcagtggtaatggaaaacttgcttccaacctgccctgtctattgccttgatggtggtgtgatgattattaaggagt

SEQ ID NO: 28522 - DNA, 1264 bp, Bovine  19866880438865
ttgctcagtcgtgtccgactctttgcgaccccatgaatcgcagcatgccaggcctccctgtccatcaccaactcctggagttcacgtgcttgttttagtagatggtaatttaaaatattagagacactgagaatttaagtgttctatttctttgtcaaaaaattctcaagagccatgtgaatgtgcttgtcttctcatcatgtaactttataatagagaacaagcctgttttcctatgccttcgcacattgtcgtacttctaagtttagattagcttccaacatttcttcctttgcattctcaatgttacaaaacacatccgagaattcctttagtttttgctaccatcacttctcagatagcttcattcttctttttaatcacagccacattcctcgtttaatgttaataagttccccttcaataagtttctctggctgcatgtgtagaacctctcacattcagctatttcttctatttccatgcaattcgaattcacttccagcattattttgttgttgttgttgttttcttgcttccctttcgttttcgttggccaattccttcttctgattattcatgtttgtaacatgtcatatagatttatcacttggagacaaggaagcaacgcaactgaagactttgctgtcagtatatgaacttaacaacagatacccagtgaccattcacaacagactctgaaagaagtgatgtgattgttcatggtcatactgcacatgttatctatgtaggaatttgtggactaaagaactagcagcaaagcttgtaatctcatacagggcttccctgtcaactcagatgataaagactctgactgcaaagcagaagacccaggtgcaatccctgggtcagaaagatcccctggagaagggaatggctacccactccagtattcttgcctggagaattccacagacagaggagcctggcgggctacagtccacagggtcgcaaagagtcagacacggctgagcgatgaacactcttcaatatatcatgtaactgaaatttaaactgtgtcattgagatctggtgctattgaactaaactgtgataaactgaattttgtccgtattagaaccaggcaaagtgagaaccagtggtacttaaatatttcatctctggctcagtcccctctgctttaaaaagaatctatttcctattcctgtggaccatctcaccactctttaaattagggaatgcaaatatgggcaagggggaaccaatattcagactccattta

SEQ ID NO: 28523 - DNA, 1860 bp, Bovine  19866880444646
attccacatgtgagaagacgaggcctagagagagtcaaatatcactttttccttcttcctttccttggaaggaacttgaacttcctttgaagttcagtttcctgtctgaggccctgcctctccccagggaatgttactgggcttctcacaggaggtccagaggatactgccctgtggcctccgttggaaaaacaccccagagcacagtcaacctgaggtgcacacaaaagagtaacatacaccatcaaatgagtcaatagttttgaagtgctcagattagtcattatataaatgccatgtacgtattaagtaaaaacacatttggacatggacatgcataccacataaatccttttttaaaaataaaaaagaaatcacaagctctgctgacttctactcttcatgttttgtttctctgggatcacagtgcgagggtgtgaatgtgcagggctgtgaggtaatttcccagagttctgttcaggagcatccctaaacagagctttaatgcccagtaagacagtcctgcccttcacggcccaggcattctaacaaatgagtgaataaataaccataccacccgtgaaactaagtgtattaaaccctgcagtctggtagaaacatcagctgctttgtttccaccgggtagaaatgaggacatggccagtacctctgatgtgggtaccacggcaccaaagagaggcacaggccaggggccgacagtcaggtttctgcacgccttttgcgcagagaggtggggtagtgatgatttgtatcaggatggccctcttgggactgctgacagggaacagcttggcaaggaacagagaggaaataatacggagcctgagcagctcatcgggccataagtgattgtgacctcagcacagaaacgaggctctaaaaatgaggtattttaataacagattttctttcacgtttaagaaaacacagtcatgaacatgctacttccaacgagaggacagacataccttgctttcgctttcattggacagaatttccaaggcttccaggtgtgacaaaccttgatactcatcgaacagcatcccatagtgtgcggtcctctcggctgtgagctgctgcgccagcctctgcttctccttctctttggcctcccgtaacatctgcacaaacacacatttgtacactagatgtatgcttaaaagccccatttactgcaagatgtagggggagatgaacactgacttggtactagtgaagagtaggttttagtcactttggaatttctgcaaaaacgactttttaaaaaaaaggtaggggagtttttatttctctattttttgaccacatcacacagcttgcagaatcttagttccctgaccagggaccaaactcattctcccttcaatggaagcatggagctctaaccactgtactatcacattcccctataatgactttttggattaatttttgaattcttcatgttcatatgtacacaacaaaacaaagcaaaatttctactcccaggaataagattgaaaagaaggaaagcaaaacagtggtttccactgaagtgttttctgtgtgtgtgattaattttattttttttaatgtccagattttctatatgagcaaatttaatgtacactggaaagctcaatctactgtgacaggattcattgcaacttgtacacctaggcagacttcaaaggaaaaataagttgatctgatttaatttgaattatttaaaaattttttgtgtgtggttattaaacatcttcaattaaaaaaataataaaacataagctcatagtatattcctcaccagatacctaatataaatgtaaatattaatataaataaatgttagcttatcaa

SEQ ID NO: 28524 - DNA, 871 bp, Bovine  19866880590535
tattctgaaaattgggtttctttctgaagtgcttcagtatctatggtgctaactttaaaaaagaaaatccctagagtcataaaacaattgatatctggtagtatatccagccagaattcatgttggagtgagttggaaggaaaggattgtggtgacttctagcattctcgtttgcaagcctgatctgtccccttattagacctggtttctcatctgaaacagtaatgccgccgctggagacaggaaaccagacagcagtctgccctgataagggagggcattgtctaagggagggagccctgcttccccctcaactctccttccttgaaatttagtagcaataaaagagatacaatactacaaacgcggtttcacaaccagaactaagactgttttctcccaaagcaaaaactggctctgctttctctggattgtcaccatagtttaatggcacattagaaaaaactattagtatattttgtgtctgttggtcagagtatttaataaatagtaaggtcctttctctagcaaagcaggttcctagagcgattggaaactcattccattgtgttggcaggtcgaatacattaccatttccccatctcattattaaggggagccagacaccaaatgcagtcacttacatggcccttcagcttctatgtaaccctgggtttcactgttaccctctcctgggaagagggtgctcctttgagatgcagccccctttcaggaggaccagcttactctgggacatgtccaagatggtggccagtctctggaaggcctggggctttccagggatggcctggagctagtctcaggccagatcagtggagtttggccaaatctagacagaagagatccagtg

SEQ ID NO: 28525 - DNA, 1723 bp, Bovine  19866880648145
tcagttcacttgaggcatatacttaggagtggtattgctggatggcatgttaactctatgattaacttcttgagaaacggccacactgttttcgaaaacagctctataagtttgcattcccaacatccatgtatcaaggttctagttagtttacaacattgccagactattataacatagtcatttttgatttgcatttacccagtgaccaaaaatgttgagtatatgtgttgggcatctgttctgaacctttgcccatattttcattgggttatttataattcatttgtaagtggtttttcaatattctggatactgaagatatgatagagagcaaaagatagagagatagacagataaaacactgagatatatcatgtccagatacatctattgatatatatgatttgtaaacatttactccctttctgtgaatatactttcattttcttcatgatgtccttggaaacacaaatgttttatattttgttatcatccagtttatttttctttgattgcttgtgttttagatatcctgtctaagaagaatgattaatctaagggcatgaatatttgcacttatttattctaagtttaatacttttaatattacatttagatatttgatttggatttgggagaatggcattgaaacatgtgaaatgtcatgtatgaaacgagatgccagtccaggttcaatgcacgatgctggatgcttgggactggtgcactgggacgacccagagggatggtatggggagggaggagggaggagggttcaggatggattttcttttaaaaatttagaaaaaaaaaattaattaaaaaaaaaaaaacaaaaaacaaatagatggtgagacagggtggggcagagggaaaaaaggattaaacttttttcttctctgtccagctttagaactgctgatatttctggatcatagtactacattgtaaattttattttcccaataaatttatatataatagttaaaaaaaaaaaaaaagaaacccacccatctcctttttagtgttattgtaaggaccaaataaaacaaatgtgtaagcattttgtaaacactaaagttttatataacgatattgttatatgctacaaagatataaacatagggagattaaaaatatttgaaagtaatccatactatattaggatatatgtactctgtgtatctccagttttcaaatgtgcatttgtttcataaaacagagaaatacaccaataacttagagcaaacattttaggaaaatcatcacagagaaaaatgaaagtagataaaaatacagataataaagagtgttgcaacaaagaagacctattactacaattcttggtctgtacatgttgctgagaagtttttcaccaaggcagtgaaaagaggaaatagcttttaaaaatctccttacaacagtgggaaaccaaattagagacccatggcagtgtaataaaattacatgttgctagaaagacaaacatgcaaatcattagctaacattattaaaaacagaggagcccaatattaaatttatctaaaaatgacagtttattacattttctgagacgatcaaataaattatttaggtgttagaggtattatagtaacataagtgcttacaagaaaaaatatgatgaaaaagctctggtttctcctagaatttggctcctggattgtctacttgctctcactgacgagattgttcttgacag

SEQ ID NO: 28526 - DNA, 730 bp, Bovine  19866880681242
tggtgaagttattttagctttaaattaggctcttgtgacacattctcatgcttgattaaaagctctggaagtatactgaatagtaaaatgcatcactgatgggcctacatcatttaccaaattaatcatagtctccggtactaaaaccctattcatatttcaaggatacaattaatgggaacattttataccttaatattcctccagtatgatcatgcaatagttgggggaaggggttgatgacaaaatgagtaccattagaagccaatttagctttttgattaataaaattcttattgctccttattattatatggttatacagctgtcaggcaagaatgtaaatgctatttccttaaagccactctgacttaacttttcagcgtacacagtggtaaacactggtgcagaaatctccatggcaacccagttccaagggccttggagtgacccccatgtctcgtataaacagttttggcaggaacctccatagccagcgcataaggatgatctaatttttgcaagcgtgtcattaccaaccttcagagccacagctcaggccaagtttttccccttgtgagtattttccaagcccgaggaagaaaagagcaagacagagttgagagcgtggccgtgttatttcgtattcactaaaccagatcccctcaagtctcaaccactcccggcttttgcagttggacacctttctgttgtcagccctgtccagcct

SEQ ID NO: 28527 - DNA, 1748 bp, Bovine  19866880735316
ttatctgtgctctatactgggattccttgtaaaattcattcaggaggaaaaggtggagaaggtttaggttgtcaaattcagtttaaagttacttgtttagtcaaaattaagtttaaaaacaaacttatgtttcctaacatccttattttataaataaggaagctgacacccagcgaagttcaaatgatttgatcaagtggcagactacacctgagttcctcaatatcctcccctcctgttaacagtatattgctattctgaattaatgctcaatttctacagattgtgcaaaagagaatttcctccaaaggttcgtctctgcaggagtggatttccttgggacagctccacgtacaggaacctcacattaggaaagtcttagcattgtaaatccgtcatcaaaaggaaggatgcagcctgaaaattccagatgtagatgggcttcagatttggtttgatcagagctctcatcctgtaatcttccatgggctaactcagtctgattccccacatgacagatgtctgaagggacaaacataagcaaatcccaacctttgctctggaccatctatgaaccaataactgcagcaagctgtcttggttgctcaggatgattaccttgcattgttggtgtctgcctaatgcttgtgcaggcattgatcttacctgtgcttattacagtttacaagtatctctttaactcaatgatcttacatgatctagtgatcaatttccttattttactccattcttccttttctgctaaagctttacctgcggtgtttccttcttagtacctcatgattcagagttccacattgtgtccctttagtgccagcttcatttttaacattgtccaacctgaaaatcgaggtgggattgctcaacttttgcaactttcaccattcaagtgatctggagagtggtctattcatcttccctaattgatgctggtgagtttgtattccctgtgcgccatttcacgagtatcctctctatggagatgactgtggcgtgtgagaaacacagcaagcatcatggtgagctgaggttgctcagggacactcatatcaccagatctctctgacttcaaacactgtgttttcaaacccccttccccacttccccagccatgagcagggacttgggattggggctgtgggatgtgtcccagactctgaactgtcaggacatccctgcactttctatcttgtctggattagcagctaatccattaaatcaaaatgtcctgagtctttgttcctaaggataatgaaaaaggatgaacctggcttgaggaagaggacaccttaaagcatgagtgaggggtgatgagggaggttggctaggagaaagggatgagagtaaggctccaccagaggatttgggaatggaagacctgggttcttgacagagttcttggttctgagggtatgtaatgggaggataaaagagacagttgggggctttggggaaactttgaggaatattttagtcaaaacaccacccagttataatttcatttgcaggaggtttaacttcccaggtggcactagtggtcaagaacatgcctgccaatgtaggagacataagaggtaagggttcgatccctgggttgggaagatcccctggagtaggaaatggaatccaccccagcattcttgcctggagaatcccatggacagaagagactggcaggctacagtccatggtgtcacagaggaagacacgactgaagcaacttagca

SEQ ID NO: 28528 - DNA, 1294 bp, Bovine  19866880904152
tcatggatcaaaaaaggccagagccacttcacaagtgtttcatgacttgcaagaatttgaggtcttaagctgacctccgttttacatagtgtttcataggagttaagggccaattaaaaaaaaaacaaaaactatgaaaagtataatgttttgaacaaaaatacttaaaatcagtaatgaactggctgagagaaaaatcaaaatgaaaaaatcccttatccttatgatatcatttaagaaggaaaaaattgaggtcaaacattaactttcatagtactcatgtttcaggaatctcagtatccctctctctctctacctttgtcctttctctcaaacttggaattggcaaaaataaaaaataagagtagggctttgataggaaaataacttccacattctctttcctctcctcatgtgtaaacaggaacaacctcaggacccctgaacaaagaaataaagacagcgatgcgcaaggcagcaagcggtactgtgagcactgagactttgaacaaacatctacatttactgggctgtactctgtcttgatacctagaaatgacaagtggaggacagaggaagggaaagagcagtgacacccaatatgttctccagaccaatgaactgtagcacagttggctccccgtttctctaggacactttccgagtcttagaaaatgattcaatacatgacaattcacatttcgttctgaatgtctggaacaaagaaacctatggacaggacatgagccaaagaaatgggtgtgggcaggcattcagggctttacaatgactcctcattatggaccttttaatgacaggactcttaagcacttttgtagaaggatgaaggcataggtggggctaatagtaaaaatcctgcctgtcgatgcaggagatgtaagagatgcaggttctatccgcaggtcaggaagatcccctggaggagggaatggcaacccattccagtattcttgcctagagaatccccatggacagaggagcctggtgggctatagtccacagagtcacacagaatcagacacaactaaagtgacttagcgtgcacagatgaaggcatagaccaggccttccttgggactctgttgtccccacagctgccatttggcacttggcatttgctgccttgagttatgggtaactgtcctcatggacatgacttttctactctggctaaatcttaagttccccaagggcaagaatacccacagtgaaagtgaaagtcgctcagtcatgtccgactctttgcgaccccatggactatacagtccatgga

SEQ ID NO: 28529 - DNA, 1148 bp, Bovine  19866880929047
acatgaccattgggaagaccatagccttgacaatacagatttttcaaataatgaatttaggctcggaaaggtcaagtaaattatccagcgccattcacatataagtaatagagtcagcattacaatccagacattgagaagcagagcttacattcacccaatctgcaatgtttcttctcctttacatgtgacatctttcttatttgccttactattcatacatatttgttcacattttgaactgattcttcatctcccaacttggaattcttcagcagaagtttctacaaatacagtttcaagctcctagtaaagctccttaagaccactgacaagatcagttatttacataaaggattgatctaacttctccaagtcttgagtttgttaaataaactttaactgactttatgactccctttaaggattttttttagactcacaagaagtaaccagttgaattgtgttctccaaaactcttctgctgacgtcctaaaccccagtacctcataatgtcactttatttggaaacgtagtcaggtagtatattaaactgggttgtcaggatgggccataatccgatgtgattggtgtccctataaaaaagggaaatttgggcacaaagaggcatagagggaagaccatgtgaaggaacacagagagagacagtcatctgtaagccaaggggaagaggcctggagcagatccttccctcccaccgctcgagggaaccaaccctgctggaaacttgatattggatttctaccttccaggactgagagatgatacatttctgttgtttaggccacccaggcttggaaccctaccaaactgatgcgtgactagtactaagcaactgaaacttggttgtgaaatcttaaagttcaatacaggaagggcaatcatcctagagaaaacaggaaaatccagctctaatgactgttgcaacatcccttacagaacaagcgcgttcatacatttttagcatatatttcatggttttaatttgctttctactattaattctcatagaagtataaatgataactttcatatagccctatattctagtcaagactagactagtcaatccctagacttctagtcaagtctccatagcttgactttcaaacccctgacaatatgat

SEQ ID NO: 28530 - DNA, 1231 bp, Bovine  19866880990659
agcttagagcaacgacagggggtctggagcaaaagcagactgtgtatgcccttgcacacaacaccaaaggggtcggtaaaccacctcagccacccctccagccccacccctggacatacctctaacctcacccccatagaaggaaccagctcacctccctctcaagccagtgaacaaaggagcctgttacttgttctcactccctctgctgcagcaggggccccaatgaagccttgcctgaatttcttgtctggcctctagtcagtttccaatgattggggaaggctgagaaccctggtcggtatcaaactccctgtcttcaagcattgaatgaaagcatggcttcagttttctgcctagctgaattggttgactcaaatatcttctatttgctcaacttccattttgccctttcacttgcagtcactatttgaagccctcagtttattaaatcatttatatttctataattaagaagtcaaagtgttgcatatatgtgtttagtcacttcagtcatgtctgactccttgcgatcccatggactgtagcccaccagtttcctctgtccatggaaatcctccaggcaagaatactggagtgggttgccatgcccttctccaggggatctttccaacccagggatcaaacccaggtctcctgcgttgcagacggattctttatcacccgagacaccaggtttaggcacttaaaggagatataaattatatatatcaaacttgctatatcagtgaaaatcaatacttttgtcaaggtcctaatgaacagcacagaatctcatctatagtagcagctcaaaattactttactgccagacaaaattattatttgcaaagttaactagtaataaattgctgtaatttgatagtataaaaatatctccagatgtgtttatgtctattttcatgattgttataggtttagcctcaccttttatgattcagtgtatcaataaatgggaattgcatttgccggaagactctggaggcagggagtcaagactttgacttgtcttaatagctaatactcatacaatcaatctggcccattaagttcagtcccacaaatatttatttagagttttctttgcacgagggcaactagctataaattttaaccacaggctgaaaggatcaaaaccagttcaagagcttttctgctttgttgtctatgggttttggaacttttgctttctgtgtaaagaaaaactcac

SEQ ID NO: 28531 - DNA, 1483 bp, Bovine  19866881026679
tatggggtcacacagagtcgggcacgactgaagcgacttagcagcagcagcagaacattcttatcttaccatctaaaaatcttactaaatagcttattttgcaaaatactttggttaacaagtcaactcatttcataaggagctattgttgtggttaaaaattgccaccaaataaaaaagacaaaacaattgtgcatccttagtttaatcaatatagaactgtataaaatgagtctatataaatttgctcctggtgatccataagccattataagatataaagcattattattatactatcatatgtgtaaaacattttgcctaatcaacttttcacttatgtgcaaaattcctgctaccacaaaacggtatcaggacaaaatggtggttttcaaatagttttgttttttggccccaaggagagttccttcaaaacaaaattctcaaataaatccatcactccaaaaagagtgggagaaaagttcgacattgcttttggaccagggaaagagacatggctattttaagttttaggaagcagtaaatgtagtattgaaaagctactgtaaacaactaggaaactgagagtacaaagttgttatcatgatggtagattatttgtcaatacatctgcccccaaaagaataatttttaacatgcttttttaacatgctacttgtcacaaaacactaaccagtcattaacagatcaattaaaatatatgctatgattgcttaatctaagcaacataatgccagaaaaccaagagaaatttaaaaattttaattattcacaaaatgtacattcacagtgtttattaagcaaagaaattatctgctacttcacatcacgtatatgcaatattaaataacccttgcaatatgacattaaatgtaattaacaacagcatattcatcaagtcacttagtatatgtatatacaacaataaataatcattgtaaaaagtcatcaaatacaaggttttctctgattttaatcagttcatatgataactttttaatgaccgaatacagcattttctttttaatttttcttcttataaaatgctaggaagcacaattaccattcaaacaatcatgataatatattttcaaatcttactgacatataaaagtagtttaaatttacatctatttcttttcctactctaggtctcagcaatatcacaattttctgaaatataaacagataattttaccccattattctctagttacaaatatatacaggtatatagccacttaaatttttacccatcttattttagctgtattttgaaaaaacgtctttatacttttttttcaaaaagtaacagtgagcaatttgtgtgaaatagttgtaatggaaaggaatgcaagcatttttaacatagtaaatgttactttatgtataaagtaattccaggatataaaggcatatttaaagctgtttgaaggaaactttcaaagagcaagatcatatg

SEQ ID NO: 28532 - DNA, 1299 bp, Bovine  19866881038069
atggctggtttgcattgttgtatggcacatcactgtaaagcaattttcctccaattagaagataaatttaagaaaaaaatatataaaaaattaaaaaataataattaaaaaatttaaaagaaggtgtgtaatatgcaacctaaactctccctagagttttgaaaaggaagataaaattgcggacattgatggggaaattctttagtgcccatttttaataacacgatttctatcatgtttttgaagaacattttaaactgcctgcctccctttgtgctttttaaattcttcaaagggctgtggaggctcatggctaggtcttcagggagatagtaattagagacataagaatagtgagcacaacttcacatggaaaatgtctcagctatggtcatcatgacatgggtttgggaataagccacctcattccacaagacaaaattgggagaaaataactgagtcatagggatgtagaactgaattcccaggaagacatgaaccactcgctccagggtgcaccttcgatgatgccacatttatcacagggccagggattgtttacagaatgttgtgtcattcacctccagttgaaatgagagacataggaagactatttttaggctgatgagtttcagatttttacattttcccatcttcagcccccttgattactcatgtggaaagcactttaaggagagaaatttcagagttgtttaccatgatgaagagactttgggtggccctcacgatccccacatcttggttttcctgtgtttgtgtaattccctccctttgagtgtagctgggacctatgacttgcttctaatatggcaaaagtggtggggtgccatgggcataattagattctgttatatggcaaagtggatgggctgccactgtcatgattacgttacactgtgtaagactctgtcttgttagcagatacactgtgaagccttactctccttgctggctttgaagaatcaagcttctatgagtcctatagcagtaagtggagtgagctgagaagcccaccttttcctggctgattctctagatgagaacccagtcctagctaccatctcaactacaaccttttagaaatcccagataaggtatgccaagactcctgacttaaagaaactgtgagatagcagatgtgtgttgttttaaattactaagtgtgataatttgtcatgcagctgtgaaaattgaatactcttactttgataacttgtttttctgaccaaggattcttggacaggggtttatttctttagagtttgaaaaccactgggt

SEQ ID NO: 28533 - DNA, 2574 bp, Bovine  19866881104340
gaataatttctagagccgaagctgtagaaattaacctgtcttattccatgaatatactaattataggcagttattgctagtttctgaaagtatgcaagagccatcgaagcagcctgagggtcctacactctagggcccttagattaaagaattccctaaattggcatgactatttgacatttttatagactgctccaaataattctgttacttgtgttaaaattgtttcaaacaaaatcgggaactgggtcatctattaattttttgtcttagaagcgtacctattcatgcacaccaataaaattaatccttaaaatgttttggttttcttaagcaccttttaaaaataacattgtatgtcctacaaattatatgatatatgctcttccaaggaaaagaaaataggattaaatcaatgataaatctcctgatgagaaaaaattgtgacttcatattgcttttaatatttgaagatagttcattctaggaggtgctgactgcctcgaaatagcaaaacgtaaaaacctaatctcatgcaattacctcactggcagggtaaaagcgtcttaactggtggtcttgatgctttggaattcatcggcaagaaaaccatgaatgtccttgcagaaagtgacccaggttttaagcggaccaagacactcatggagagaactgtttctttatctcaggtgggattatgtacttttgtgatttgttctttcagtcaataaagtaaataagattttatttatcttctttaatagatattttaaagcacatgtcaaattcaaagacctgaaatagcagggagtgaaaattgaaattttaatatgctactttccccagccactcttcatgggatacaatcattgttaaccattgttaacagcttcttacagattctatcagagacatatagacaggtttagatatagatatggctgtataggtaaatatagctaaatatatatatatatatgtatatgcacatgtatacatacaaattttttcaaccaaatgatagcacactaaccaactcttttgtatcttgctttattaaatataaattatacatacttaataatttcttaaagataattccattgataccatttgtctaagtccattcagctgctataggagaataccataggctgaggttataaacaacgaacatttatttctcaaaattctggagtctggcaagttgaaggtcagaacagcagcagattcaatatctggttaagggcctgctttatgattcagagactgatgttctcccagcttcttcacatggtggaagaaggtggaggagctctctgggtttcttttataaggacctgaatcctgtttgtgaggggtccacccttgtgatctaatcacctcctgaaggcctcacctcctaataccatcacaccagggattatgtttcaacaaaagaattttggggaaacacaaacactcagtttgcagtaccatcatattctggctctaccaggttctagctccatgaccttgagcagatgacttgaccttgagcagatgacttaacccttctgtgcttcagattactcttctgcacactgggaccatcaatgcctattaacagctttgttgtgaggattacatgagttagaagagaacctgactcatagttctcacccaagaatgttagttcttatcattgtcttttttatgtgtcacgatgataggtaaacatgctatctcaatggaatcttagtttacatttctcttactatatgcaaggttggacttctcctgtcacacttccagctgtaaagttttcctccttgagaagtatgatatgaagaatttaatttatgttttgctttacttacagtagtcaattaaattaaaagtaatatttatcttattttccaaatacaaaactctaatattgaacttgcttcttcatactatacctcttccccccttaagagtctgacataccaggtctctctatgtcttaccaaaatcagaagcagcagatgcaggattttataaatttcacaggcaggacagacacgccttcccatgactcagtgctagaaagccacaaaggagatatcactgaaaacaggtcatatcagctgtggcagctcctaaaaaatttgatttctaggtgatttcttcttggctcttccactctaggggcttctctggtggctcaggtgataggaaatctgcctgcagtgcaggagacccaggttcaatccctggatcaggatgatctcctggagaaaggaatggctacccactccaatttttttgcctagagaatcccatgaacagaggagcctggtgggctacagactatggggtcacaaagagtcagatatgactgagcaactaacacacacttccataataacccacatgtaaccactgtgatattatagtcctggtagagacttggcagagtcagctagaccattaacctcttgatctttaaagaagaaaatagattttgtattaatcagtccattaacatcagatgctataaaaatgcaaaataaaacaaaaccaataatagtaataataacccaggtatca

SEQ ID NO: 28534 - DNA, 1707 bp, Bovine  19866881173436
tgccttgggctctaagcctttgctgccgatgtagtgttgaagttaaggagataattctttcctgaggaggaatgggacaaggaaacaacatcctagaatgcagttaagaacgaccacagaatttggaggttgagctgtgctaagtggtcagattgctcatctgcaaagcaggctgacaatgcccccacccaccaccttgggcacctctagggagcccaagggctatgaaagagtttggaacagagtaggctgaagaccttgaaatgaggatgtgcagcaaaaccagggctacctgaaaacacgtgcctgtaagtcacatgtatggactaatatccctcagagaggttcaggtggcttctctgaactccgaatatttaacagggtcttttattttttttttttttaatttaaatttatttattttaattagaggctaattactttacaatattgtattggttttgccatacatcaacatgaatccaccacgggtgtacacagggtcttttaaagtggattagccatgtcacagtgcaaatgcattccccaacaaggttctagaggccatgcttcttctggaagaaagaagcttctccctctcatctgatttagcacctgcattatacccagcctcttgaaacacagccagcaaaaggcaaactgggcaactataaaaattattttctaataataattcattcttagcttccagctaaatgtgactggctctgtggcaggctggccagggtccaggccagggagaatggagctgagagcactgtgaggggagttggcatacttccgcttgaaactggggtgctgggttggggaaatgaaaggtaagctctaggcatgactgggaaacagaagatggagccaaactctgcccctcacctccatcccccgaccccagtccatggttctctgtgagctagtgaacagagcaaagaaaccatagccaccgccaactccttttctcctaggaatcatgtggaatagacccttgtttatcattgttagaaggtaatttttcagtcactaatttctaatcagaaaagtctttagaagattcagaagacatgtgctttcactgaaaagaaaaggtcaggatcctggcaagctgggtgggttgtgtcatcactgcttccaatctcaggaagccactaataaacataactcaatttactaagtgcttaaacacattcctctttaatcaccaatcaactctgtgaggtaagactttattattcccattttacagatacagaaactgaggcacagaagttaattaactagcccaatgtcacacagctggtcccatagcaatcatacctctgattttctgaaaacataaccttttagaatatagagacttcatttcccagcctcccttgcagctgagtacagacacaaactaagatctggcctatgggctaagaggagaaatggtacaggttgcgtaacttcctggtcttggctttaaagggaaggagcatccctgctctctcctcttccaccctcctgctgctggaaattttaaaagagtaagatatcttgggccttacagttgaaggcatcatcctatagatggtggaataagatcaaacgagcctggttcttgggagcctagaggtgtagaccatcctgggtcacctacctcagagctattaagtaatggaaaaaaatatacttctctcttgctgaaac

SEQ ID NO: 28535 - DNA, 2454 bp, Bovine  19866881194591
ccagggggacagaaaatcaaagtaactgttctaatgaatcccataaaagaaaggaagatcctcagggacaagaatcggttccttacctttaaggtgagtctgactccactgcagacacagggaaggagacagtgaatgatgaatggagatgagaagtaaacaaaaggataagcactttcctttcaaatccaggcctaagcctccacatgaagggatgatgtactaacacatttctacttctgaaatttttgctttgtttcttatacctttttcctcttctctctcttaccctaaataaatatactctacagctgaccccatcttgtgaggaaaatatctgaattcatatacacactacaatgaatatatgaaataataatatatttgtcatgatcactgctattttcttagtacccacaccagtaaaatgcccatggaattttctttgagaataaaagtcctaagtttgttgacttcaaaggtagaaaaatttcatgagtattcaaaatcagctcaaaaaaaaaaaaaaagctcaatttttaaaggaagcaaccaaaataaaggctacactgatacagaatgtaaaaacacattaaccacaatatgaacttttaaaaggtgagaatttagtttatactctttttatattaagatatgttaatgacttataccctaaagaatttatcataaaatactgcccagtgcacttgtgcaaacaataaataattcactgacagtattaacattcacatgtgtaattaagagtttacaaatgtacaaaatttggggtaataaatactttaaactcatttgccaaacattcagtaagcccatccctccaaactgtttgattacaaagacgcacaaaggattactaattctggcaaaagataagaaacaaggcaggagaggcaaacacagacttgagaacataggaatatccaaacagttctttgatataaaaagacaaaatcaaaacatttttaataatataaaagaaaacaaatccatataattaaatgctacttaggtgaaagaaccttagagggtatatagcatttattttctccacaaaatgtgcatatcttgaatttaatgtaaaacaccttgtttcagttccaaaggaagaatatcataatatagagttcttgatgaatctagatggaatgaatatttaaatagatcccaaagatcaaaacaagcttttatttggtcattgttctaactctttaatgttcattaaattgattcacttagaaactttagaaataaaactctacaaccaaagcacagaaaattcagctattcctgaaaaaaactaaatgcatagtctttagtatatcattaaaatagtggttgtggttaagcaaacaaatgaataaaaattactacaactcatgtatggtaaagttacaaagcaatacattagaagttttatcagatgtatttgcactataataaaagaaatctggataatagtattcagtaaaatgtttttgattattaaaagaaatgaaattcccaattaaccctgggttgtgttaggagcagtgcatttgtcgtcatattctatatatcaggaacatacattcacaatccaccagacacagttttaatctcctaagaagtgaaagtttttaatcctggttcttctgttctttccttccgtgttttaacatcttcatttagagatcaggcactttgtgcccaggaatgtggcgttgcaaatttactaaaaacatatccattgatagcagaataattatactaaattcataaaggaagaagatatcttcatttagaaaaacaagcacgaagttatagtttcacagtcacaacgcaagctccagctcttccaaggcacagtggagcaacctaaaaaaacaaacaaaaaaccaaaaagacttgtgttgggattgtgggtaaaaatgttgataatactacaacagtcaatgaaatattgaaacagtttgctcacagtggttgccaaagagctgctgcccaaaccctactgtccgagctcttctgctggctcttttcttaaacgagatcctctttcctgatgccacagcttcacggactaaatcgttttgggtatataacacaatgtagcattcacttctctttaaagatgacttttaaagacagatcaggaactggtctacgtgaaacactattttggccaaaattatgtacaatatggatgtgagacaaggttgaacacttagagtaactttgtgaccaacatggagaaaataccaagtattatccagagctgccgttactttgctgtctcagagagtacacaaaatacactgctgcctgggatctgcttactctggaggaaccactgacttcacagttattgatgaccttctcagcatggctgagaagtctaaactcattctactacttgttagcagagtgaatcaataacacatatcatccacccag

SEQ ID NO: 28536 - DNA, 1072 bp, Bovine  19866881242832
caggcaaaaacttgacaaccaaaggcaccagcaaccttccagccaacaaaggcagtcattatgttttctgcacttaggagttttcactctgccaggcagatacagagagcactcatctccttccaaatcctaaacctcttcacttcctctttctccttctctgtctagagccttttgagcgagatggccaataagccccttgtttccatctctgcaggaacaagtgggtactgctctcaatgtccaccaaaccgtaagtccttggaggatacaggaagacatccaccaatctcaagatcaaaatgcaccagagaaagcctgcaaacaaagaaaaggctgcccaccaccactttttcttacaaaactaaccgaatccctgggaataggaagcagcttacttttgcatggtgtatatactgacaaaaggttcaagaatacttaattttactttttaaaatgttcttattatacaataaactacactattagaaatcttattctttgctacatattctctctctgaacctgatagtaatccttctattcacagcaataggagccaatgttttggataggattcgaactcatgcccagcagaccccaaggctcctacactttccttaaaagcagattgtcccttactggattccagagatccagagtagacatttatgatcatattttcttaatcagtttatcctaccttctaaaatatgtgtaattctacattttcaggaaaacaacacaaaaatgttctagagaatgggagcaaagtcttttttctttatttttcagactttaatcatgaaaagcaacatatctactccaaacacactctctctctttgattttatgattcctgtaaagctcacctagccccaaatgctaggaaggggcaattgggtaaactcaatcaacggacaaccaaatcaacagaaaaggtcattttgaaaataaaatggtttatgatgggattgactactggaaaagcagggtgcatgcatgttcagtcactcagtcatgtccaactctttgtgactccatgaactatagccctccaagctcctctgtc

SEQ ID NO: 28537 - DNA, 1849 bp, Bovine  19866881254973
tccttccgtatctggcttgtcacttgaatttgtcacttcatctaaatgtacatcctttaacctcctttgtgcctgcagctacttgggaggtctttgccaccactgggaagggagccagagctgctgatttaggtgggtgatgtctgtcagttgaggggatggatgctctatttgcctagcatggagttggagcaaagaggcatggaacagaagcagagcagggtgggcagaggaggaagccatctattcctgctgggcaagggctttctggtgagacttcatcattttgtagctgggcagagcattcagagtttcagtctctctgcatgttcagctgtgcagaatcctattgcaaaggacttctccatgcacctgtctccgtttctacaatgtccttaatgtggatcaccaagcgttgatcataggaatgccacaaaaatatctgcccagaaatggtaaaaaaaatcttttgggtaaggatatgaatggccttcttttatcccacctatttaatagcttttttgcaaacaggaaaactttgagtggtaattgtattcccctatccaattaatcatggaaccttcatatggaaacttttctgtttgagctgcaaagtgcctattggctgtcatctgtgttcaaaatacatatcataaataagcgtctgctaatgctttaatagattccttcgatctaagacctgagtgacactatttgtaaatataaatagttgtgaagcacacatacctttcttgatttctgaaaaatctggaaaaccacagttcagggattcataaatgtagctcaaattcccaaatgtttactgtcagagctggcgatttcctgtcattatcaaatatcccatcaggaaagaacaaactgaaaatgactcgtgtttatgttgaagattaatagcaccattattttaggggaagtttttcaaaagcaggcttttgagcactatagtgtaaatgccaataaaaataatctacgcatagaaatgccattggtcctaaatttgaagaaagtgggcgacggtggtctagtgtgggagcatgtaagtaaatgcgcattcatccctcgataaaggaaggaggagcagagagaaggacggaatcctgaagattcatcccagccacaactcaggatccaacgcaaccgtaactgggaggaatatactgttcagttgtttttaaaacaccagtgcatgagtgattctggaggcctgcgatcgtgtggggagcttactttgatggcgccatgttaataaaagtgagttgtagggactgcgcacctaagagatcccgcttatcagccctcagatccaactgaaaggagatgtagttgagaaatgcagagtaatttgttatgtggcacttggttttattttctttatttttttcttaagcactgcaaaatttgtttagaatattaaaccatccttatgaggcttttttttttttttgcaactatgacgtgaattgagggatttcttttgaaaaatggctcttggaaaagtaggtattgtctatattgtagatgcttagtcacattcatgccaaagtgtcgatagtttgaaatggttcttccacaacacaccgaagaataaagttggagtgcaaagaacattttttttttttttaaatgagctaaccagtttgtgcatgttctaacccatcttgaggatgggaaaagagtcaaaaaagggtagaaagttgatctttgcataattagctttgagtcaaagtccagctgatagaaagcttcatgggttctcatgaaatttaattcgtgtttgctatagcatatttaaatttttttcaaaaaagcaagcaggaccctgcaaaga

SEQ ID NO: 28538 - DNA, 642 bp, Bovine  19866881273506
caggatgtatcataaatctatttatgtgagatatacttaataaggtgatactgaatgaaaaaagtacttaagctattcatggatgaagtgaagtacttaacttgcacagatccaacatgaaaccctttgtggtggtcaggttttatcttgaagttatggtttagaacatctttttaaattgctattttaaaataaagagtagtgaattgacctggatgataagaaaagaaaatctgtgtcattcattcttctatcagcctggcaagttgtctcagagcctgacgaataggatgtcagaatgtaccataacttctagaaagaagccaaattgggtcggcgagtgacacatttggggctcttcccagctacaaagcagacactagttttgttttttgtttcatggaatacgtcataaagagaaagattttgacaactcatataatcagtgatatctcttctgagtgttgaattcaagactctaatgtaaaccctgaaaatgaacaaggtcccaaaggagtgtccggggccttcgcaagtcactgtggataaaagtcgttccaatgccagaggggagaacaaagcatctattcttttcagtacaacagatagatagacacccaatctgggtaacggctgtgtaca

SEQ ID NO: 28539 - DNA, 787 bp, Bovine  19866881289763
atgacctctgcctgtaacaggcaaccaagaaccaaacaggatggacaccaccccaccctccatacacacccaagattttacagttacaagttacaatgtgtttatttcctttttagttatccatcagccatcactgacagtcttgtggttaaactgttaaccgataatttttttttaaagcaaaatcatgactcatgaagatacctccaaatgaacacaaattaaagaatttatttagctcattaattaaatgaaagaaccagtcagatgttataactggttcaaaggaagagccaaataagtacaaattcatataaaataaagcaattttgaaatgaatatgcaaatggatacaaatctggttttccataggaggggagcttgtccctccactggacaaaatttgttcccatgtctatagacaaattattttgcactgctatcagatatctacaatttacagagttataaaactgctcccatggaatcagaatctgataatctgctaaactgatctagaaaatgccattttccactgaaacaccaacttttccctacaaaagcagggtttggggtcagacatgatgtgatcaaatgccacttgtagctgtagtatgattttggacctatcttacctcaatctccttatctatgaaatgggaatgataataatctacttcataaaagtattaaaaaaattaaatgagataatccatgtgaagctagctgcaacttgcctagtacataataagcagtcaagaatgttagctgccattttatgcatata

SEQ ID NO: 28540 - DNA, 1669 bp, Bovine  19866881328531
tgacttaatttatcttcaatacattcctttcttataatatcaagataatgtaactctcatttaccaggttgaactattaatcaattgtaattgcacactatgggtactgtccttggccatggaattcattaaaattacttctatcccttaagtaaaatttaaagtctgttgtagaatgcttaaaaaaaattaaactcaacataaaccctttacttgcatgcgttttaggggaacatattttcagtggtaacatgtcaagtctgcctgcagaggattacttatatttagaatgttttatagtaagagtgaaaaataacatactgtgcctctctcccggctctaaagttcgatgcatttgtgattctgaagcaacactagctcacaatgcaactgagaaaacccactaatgggaacttataattgaacagcttaaatgcactattaatttctgaaccttcctggccccttcggtggccactaatatgagttattaataactgtgggacagcagtggttttgactgggattactgagatcacaccctttcttctctgggcctcatcgggtgaatctccacctggctatgcatccaactcatcagtgcggctttaaaatcccattcctgcactttcaaaataactattatattcaaaaacagttctataaaaaaaggcaataaaaattactaaataaatattagacatgcaagtgtcatgaggatatgtcaaaactggatattcatcttctaggagactgtgatgttaagattagaattggacccaatgagatgcctatgagatgaacttaacacacacagtggtcccagagtcttttcttcctgctgtatacgacaggtgtttacttcagtgggctttgatgttatcaggtattcttcagactttactaagcacacagattcacctgggaatcttgttaaaatgcagattctgagttactggggaatgactcaagatgccatagattgaccttggactagcatggctctaagtgatgagatatagaacaaaaacaccaatttttcttactaacatttggtaaattatttaaatgcaatttaaaggtggggagggagaattttcactaataatactgcttaaaaaccaggacatgaggatataaaatcaggaaacacaaaacaaattgttgtttttaaaaatagttttgaattatgtatcgaagatcaaatgaagactatttctacctttctttagaataagacacacataggtgcaacacaagatgagaggctcaaaatatacagtaatatgaatatgcaatagattgaaactgaaatgttaaaagaggcaaaagcaagaggcacaaggtttgtgaacagaaattacacattatgtacaatgagggcttaaggaagtaattaactacaggaggaaaaaagatttctcctagttctaaagtttagccagcttgatataattttctaaagggcaaaagttctggtacaagaaacaaaaactccaggaaatgggaggcagtgttcattgtttctactcacagaaatgtagcttctcccttattttcagccctagtcttaaaagacatccctatgaccctagattttaataccaagttattggcaaccacatcggaagcaagatgaggacttgctgtcattgctggatttttctat

SEQ ID NO: 28541 - DNA, 867 bp, Bovine  19866881341214
aatagtgccttgcatggtaactatttgatgagtatattccatattgaacatcgttacacatttatcttaataaacttttgtaaagagtcaacactggggctgctggatagaaggctcatgaatttaggatttcatcggtagtactaactgctcttctgagggttacaccaatttctactcttcttcaggtgaattttggaaatagaacaatttaaaagtattgactgcctttcagactctactatcaatgaattcaagatattataaaaagttgtgagaagtagctgtttagaaaaacacacagatggtattgctacactcaacatgaagcaaacttcatgacagtaaacttcatggcagaaaaagtggagcccgtcaaccttcctttcgggaaagtcttctctctccattatgctggttgatgtccagtctgtaatcatgtactcacttctctttgggatcaaaatctacaaaaagagtttctgaactcacagtgtttgctttgccaccacacaggaattcattaatccctgggccctattcatagtttgaaaggattgtgaacaaactccaagcattaatcctatgatcttttgtactgatatttgagaattgtcacatcatcagcaatatcacctttaaaacaaatccatgtgataccgagagtgaaatacctggcaaagggttcttactgtagcgtcattctgacaagtttgccgttctctgtgataaacactgtcattacttctgacagtgctggtagaaggtgttcattaaaacgtgcagaaggaaaacgccacgtaactcacgagggatagggaaggagaacaattataacttgaaaaggtaaacatacagatcagctct

SEQ ID NO: 28542 - DNA, 1320 bp, Bovine  19866881342805
gctctgggaactttcttagctttttaaactgggaggttctcagagccctaatttgaggaaaaaaattgggttgggtgcccctaaagagctcaattaaaaagaaacttagactttctatgctcatcattagcagtaaaatggttaacctatggcaaataagaagcattagctaagtcatcatttgacatcagcaacgtacaggaacttgggcaaactctgggtgatggtgagggacagggaggcctggcatgcggcagtccgtggggtcgcagagtcagacacacagggtgacttggacagcaacaacaaaaacgaggggaaggttgatgaaaactgcatgcggtcagtgccaattttgtttgatgaatgaaacagacaacacagggtggtttcaaatggcgaaagtaatatttatttgtggcatagcctctgctcgcccttcttacccggtgcctgtgcctgccattcatgggccaggcatgttctaacccagtgctcctgggctttgggttgacttaagaattctggtactttctcattttaagtcataattctgaaccctgtagccttgtctgagaaaaagtcagtagttcccctgtcaacctgtataatcaggggaagcacaaatttaaagtactagctaaccacaagactcacctcacaggttctatttatgagcctgtgatttttatgcaccagagaactctgcctcagccatcctttccctttaatggttctcattaaaaatcctctgactttactaccaggcatataatattaatgtttagagtgggccaaggggtgatggcctttttttaaaaccaagaggtctttggaagtttagcatcttaaagggaggaagaagcagatgctttcttgttataaatattcctctaaccttaaatgcagtttccccccttccatgataagttgctctttctgagagagaaatgggaaggaaataatgtctcccccgagtgctgtttctaaggcctctctttgtaatgatggatgatcagcaacagtgagaatctaggagaaaaaatgtgccagcatgatcctctggagaagcagtaacataagtgaaaaagaaaaaaaaaatgtagttcaaagagagcagtgactatagtcacattcagcagagcagcttgctgtcagccctgcctgtacgttccagaaggtctcttcagttgctcatgtattacaaagtaagtattgtgacacacatacacacagagatatagatagctcacaccctcaagaagataagagagaaatagcacccttgcactgcacggggcctggcacgtgccgggggca

SEQ ID NO: 28543 - DNA, 955 bp, Bovine  19866881407430
taacctataacttagattacaaatttagaaaatttgatggtctaatccaaagaattttagatagtatctaaaaattatttgaaatttccaaattataatgtgaagagtatgagttcaatattttcattatgatttactgatggaaaaagtaaaaaggttgagactaagaatgaaatcctaaatccacccctttcctccctccccctaagatcccttctccaagattacctgaatcaagtaatcaacatcccatggttatgcagttaaccacaaaaccaccaactgggccataacttagttctcatttctcatcagatctacttttaaggatattatgattctgataaatgcactgttgaatcaagcctcgctatatcttaagagaactttcttaatataaatatctaataaccttatcaaactctttgactcttttataataaagggaactgaagccaaggagattaactgctttgccaaaagtcggagagtttgatcatggcagaaatagggctgttgcagagaaatctgtgtgttcaccaaaaccctttttctcctagaatatagctagactgcatttccagcttttcttgcagatggggtggtcttataacggaaatgaactgtgtcacctcccagctaaaatggccaagagcaggtgtgtatctcccattctttctttctctaaccatgaggacggaggacttacatggaggaagaggcaaaatatacacaagtgtttataactaggattatatatacagattctactcgtaagaattctcatgttgattcagatgtatcagttttgaaagttaggagggccatgaataataaatatctctacctaaagcccctcccagcccatcgcagtttcaatgccatacaaacatgggtcctagagaatgttcttagaggatccctgtgaataatgataatagaagcaaaatataga

SEQ ID NO: 28544 - DNA, 1165 bp, Bovine  19866881410427
tggtctctgctcattcttcgttcggtttttcgtgttactccctgaatgagatcctccctgccctgctaatcaaccacaccctcctcccctgcccattgttctctggcaccgaactcctcctatctccttcagagcacattgttcaagttatgtacttatttgtttaccttcatctaccttccccaactagactaaaaagtccaagaaggcagacacacaccactggttgctcagggcccattagggcacctagcacatagtaggagctcaataaatgaggaaggatggtgtcttctaaccgaagtaggtgaagcctattctcactctcatacattgttcagaattaattctgagtgtgaattagatggaagaagcaatcaggcagaaattgagaaatgggagttttcaaaaacaccccaaatgagagattggaggtacaaactattatgtatacaataagctacaaggatctattgtacaacatgttttataatacctataaatggagaatgaactttaaatattgtggatcactatatttacatatataatatatatcaaccatacttcaataaaaagtaaatttaaaaaattatagataattttttttaaataaaaacaaaaggattggaaatgtcttaaagataagaaaaaataatattaaccaaagtgttctcaaagagaatagttctggtgaacctatcagtgaaatatataatttcccttacttagtctgcttggcttgtatttgctcctgttttgctatcactttcttatctcagaagaaccccacccacatctcagtttgccccagtcgtgggtgctttttcaaaaattcccttcacactctgattcaagccctgggtgagatgctgtggaaaaccaagatgtcaaagtaaaagggtaaatttcacggttagtcatgaagcccctgaatttaacatctgtttgattgcaagtataaattttgcaattctgagacaaatgttatgatgtttaacctgaaagctaattatagcaagaaggctgtatgttaccaaatgcttgtcactgagtgaagaaattagcatccatgggccctgattctgctccaggattatagcacgtatccacgggatcagttaacttccaaaattataagataccaacagcttttgagggcttc

SEQ ID NO: 28545 - DNA, 2684 bp, Bovine  19866881479007
agtaggacacgacttaacaactaaacaacaacgacagcatctatgcttcttatatttccttcatctggagcttcctccttccactctgttgtctcaattcattcccatccttcaaggcccatgtccagtgtcatctattgcctacttctgctatacaggagaccactcttgacttcacagaggctagtgtttgggtctcttatcagtttgcttttggaccttctctgtaatgccttatcttccttgctgggtagtaatctccttgaaagcagggatgtgcatttctcttcttggattctctgctgcttaatgactagcacataggaggagcccagtaaattattgctgaatggaattggatgttatggagaaggctgtgttgtgtaagggaattgaactaggtgttctctaaggctagtttctgctgtaagagttcatgattcatttgaaaccatggttcagaggtttccaagttgcctagttttgcacttgattaaggattgtatggagaatgaaatcttccttcaatgccagtccaaggaacactttcattaaggaaatttggggtttgtattaatagatacattcaatgatggttttctgagagcaaatacaaatggtttcagattgtgtacagttttatgctatacaatatccacactttctttctgttccttcccctctccaattaatggggacaatcttataaaaggtcaaaattaggaaataaaagtaggattccagtactgccttcaattattccatttccacaactgtgcaagagtctcacacgtacatgtatttaatgatttaattttggcagcacacgtatgtatccatttctaatgccaagattgcttaatgcaagtatatattcaaagattgcttaatgaaatgtggttaagggaagttattcttagcaacaatttatacgggaagttgttcttagcaacaggttacatttatgcatgtatcagttagcttttgctagatgacaaataatcccaaaacatcatagcttaaaataatagtcactaatttaattcttaattctgtagtgtgcagtttggcctgggatagccaaaagtctggtctgggttggcttggccaagtccactgtgtatctgtgatcaactcatgggttggttgggcctggatgatttgatggctcagtagaggtggttgggaaaactgagttactctccagtttttctcctcctgcataggctagcctgggcttctttatatggtggcagcaggattccataagtgagaaaccaactgggtaaagcctcttcaggatcaggctctgaacttttcaacattgtccaaagcaatcacaagcccatgttcaaggggtagagaaattatctcctgctagaaggagaagcaaagttgtattttgcacaggccatagatacagcgagtggtgaagaactatggccatttttacagtctgtcaccatcagttagggggcttctggcctaagtaacagaaaattcagttccagttgcataaacaataaggatacattatctcacaaaataagaagtttggaggaaaagtgattacaggcttatttcagctccttagcaatgctatcatggatctaggcttttctatcaatcaactttcaactctgttgttcccaacatgttcatttttgtccacattttaacagtatgtccataacagtttcaggctttatttatagatgacaaaatccagagaagaatggaatgtgtctccttatagaaatgagaaaatctacccagaaaaggaatcttgcatctccttttagaaatgagaatctacccagaagcccttgtggtcttcctgttggatcccatcacatcatatccctgtgcctgaggattgaatagccctgcttatcaatcttatactaggagcttttgggcaggaaagatggggattagaggtggtgagctggggatacatttccctcaataattacagaaacttaggaatgttgaatggaggacaagtagttctacccagaaagtggttttggatttatcattctgctattcttaccattttcagtgattcctttcataataataatgacaacaatgacaacagcaaaaatagatggtaaacatatgtgcaagcataaaactaattcaattggtaggacgtctttgactcaaggcaatttcaagtaaattaaaacaaacaaaaaaatactcttgttaagtgagccttatttggactacttgtgtgtgcttcttgagccatgtaacacaaagtataattctttaaatcttagaggtcagtgataaaatctgattttcacagtcttaaacagtcagagtaaagggatgaaaaaaaacagccaccatctaggaaactttaaagcttttgtttacaaagtacatttgtccttaatttaattaagtcaaagaacatccattagttctcctgtctttaaaatttgacctggagtgacataaatggcaaatgcaagtatcgtttttctagaaagtcgtgagtaaaatatgcctctcctttaactatgctccataaataaaatgtcttgtaaaaaggctatcaccttagcaactgtcaactgaatcagctttatgaagacaaagtaaaactacaagtaaacctgcagataaggcctgaataatttttttttaccattaaagaaagtgaattt

SEQ ID NO: 28546 - DNA, 1034 bp, Bovine  19866881719870
caccactcactttgagagacttcattttcatcatgaggttgggccccttcggaggagccagagttcacactatgaatccggagggtggcccctgccttttccttcactgctgtcaatccatgacctgtcaggaaagaaaatacgactcatagatacaatagaagtccacggtctgcaggttccataactcatgtcccagagctcctgtaagctggaggagaatatcccagttgtgggagaatgtggtgagcccccgggcgtgggctccagtctgagctcagcttcatgtctgcctagctgggggactttcgagaagttctcaacctctctgtgactcagtttctccactacgctgttgtgaggagcaaatatgataaacacatgtaaagtgtttattttttcctcttatttctcacactatccaatgagcaacctggggttcccagcccaagatgttatctgtgaacgatattcctgtcttaccctctttcttcttttctaagtctctcagggtgagtatgcatcatttatgttttgattttttgcatgcctatcccattgtaggtgctcaattaccattgaactgaaatcagttgcgccttaacaagctctttcaaagtgctagtcatctgtttagtacagcctctgtgtgtgacagcccggtctggagatatgtccagatccaaaggcaagccggtgggaaaaccaggaagggcacactacagttgccctgacatttgtctttagcagtaaaacagtccaaacacaagaatagtcaggatgaggggcactgatcttactccatctttgtggggacaatgcctgtatttcctggagctcagcacagtgggtaatcaataatgatttagtgaatacagagctgaccttcccatctaccctcccactaatacacacacacacacacacacacacacacacactgcttggcttgatagaaaaatagttttgtctacattttattttggcacaatattttttttctctttagaggatcccatgattctcaaaccaaa

SEQ ID NO: 28547 - DNA, 1649 bp, Bovine  19866881754842
aataatttttccttgaccgtaaacacatcaaatagatcctgaatggaaagttagcttgcatcacatttaaggttaatattctaggaatggccacttgtgacttgatatccgagtttccaaaaatagggctaaccttctagggtttatattcattgtcttttgctgtatacaaaattacatcaaaacttagtagcttaagacaataataaacagttacctcatacagtttttgtgggcaaaggaattcaagcatagggctgattgaataactttgtgttacatcagctgctttcttccagatgagtgatccaagaaagcaagacagaacttgcaaatacttttataagctggtcatgaatgttacataaaatcctttcaaaatatttctattaattacacagatcagcccttgctcattgtggaaggggactgactatacaagagcatgaattccgggagagaatcatggaaggccatcttagagatggctaccacaatccatcctctgaattattcatggcttctcacatgcaaaatatactcacctcctttcgaggaccccaaactctcatttcatcatagcatcagcttaaagtccagactctcatctcatctaaagcaggtccaattccttgagtagagttaatcttgatttgaaggcctgtgagcttatatgcccatctctcatcctcccaaaatccagtttataatggtagcatatgagtgaaaaaactacagtgtggaaaggagagacctactagaatcacccctctctctctgtgaaagtcattcaattgtgtcaaactctttgtgaccccatggactatatgaaccgcacagtccatggaattctccaggccagaatactggggtggataaactttcctttctcaagggaatcttcccaacccagggattgaacccaggtctcccacactgcaggccaattctttgccagctgagccaccagagaagcccaagaatactggagtgggtagcttatttcttctccagtgaatcttcccaacccaggaattgaaccagggtctaccagtgtcactggtctgtgaaaattctgaaattcagcagggcattttttcataattccttgattgggagttaagttttggtaataattctctggctactgacttcaccctctgggctcacgtttttgccctctgaggcatcattcccttcccaaaaaggtttacagttcaatagctttctcagacttcttcctgcctataaagtttggggtccttttcttcattttatattatttttctctttttcagctcaagcaggagatggttttgccaatacagtactattctcttaaaactttttcaataatctataaatattattgatagtcattatattagtcaaaaccatgcccacaaaactctttgagataagcacttctatatcttaagcgtctatgaagaatacctggggacatcacccttaagcttgttagaagccctgttgtttgacccaacagttctctaagacactgacttagatctttctagatgttagcaaggattttacaggcacatccttgccttcatctctatatcaggctttcctgagaggccttggatttgatctttgctcagaagtcatttcaaattttagtgtca

SEQ ID NO: 28548 - DNA, 1362 bp, Bovine  19866882025986
aaaaaatagagcagatatatatcttttagtgggaatcgaggaagactttctccaaatgcacacagctagaagctaaagtcaaaaatgggagatgatcactttaacccatatgtttccctagagcaaaccacttcctttccaaacatgaatttctttatagattgttgaaactagttaaggctccatataaggatataaactgatgcctgtctttaccagatgccaaatctctgaaaggactatctccgaaacaaagtttttaactcctcaaagcaaattatgaatttaggggagaaatgaaaattttaaggtcaccattctgtattaagtatgagagaaagaggagtaaggcaggctgtggtttataataaaaaggaatgaaaataaaaagcaggctgcactaccctggacaaaggagaccctgtctatttccagttctgtcactgacaagctctgtgatgtgaccttgagagaaaccctcaacctctgggagattcaatttcgtcagctgtaaaatgagggcactgaccagatgatttctaagatttcttacagctcaaacatcctatgattttatgaaataaaatagatgttagaggttgtatatagcaggctactgaagcaggaaatgatctttttgcaaggatgttactggtagcttgtggaatcgaagagaaggctggagaaccaaactcaggatcaaggcagtttggagggggtgggtggatcctagggagtctaaaagcaggaatgatgcaatttaactgccagaatgaagaactcaaacaatattttccattctcatgtcactataaattcaaagtcctgagaaagtgggtcagattcatctagttcaggtcacatgtcaccccttggctgatgggcaagaaacctcgatttacatacagccttgccaagacatcgttcaatggacaagacataattcctacgaggaaagtggcataagatcacaaaagaaagataatgacaaccattcaactcttcactacaaacactgtgcctgtctttgtactatcacacactgataatcacctttctatgtagaaatagttgggctattttcacagtccatctgaaaatagacatatctttggaggaaatgatggccctatgacaaccctgtggacacccatcatgaaatgctggacgaggacacatgctgatgaagagccttgctgctgctaagtcacttcagtagtgtccgactctgtgcgaccccatagacggcagcccatcaggctccctcgtccctgggattctccagacaagaacactggagtgggttgccatttccttctccaatgcatgagctttagtgtgcctcaaaaggttgtcccgagg

SEQ ID NO: 28549 - DNA, 1009 bp, Bovine  19866880918231
tttccaggcaagagtactggagtggggtgccactgctttctatcttaccaatttctttcataatgcttcttccataatataagatttatacatgtcagtttgataaatattaatttgcttggttttgatacctggtatgtctaccaagttcccttgggtcttctatttaacaggattaaaacttaaaatctctttgggtcttcaaagttcacttttattggattatttttaaaaataacaaagtatattattgatattaatttttatcataatccagccactcttgtgaacttcagtctagaaaaagtggtttctctgcacaaatgaaatatagttttaaatgttaacaatattttcatcagaaaagataacaactttatacagggcaggaaatgtactcattagctttataattataacatcttaattagaagcaaaagtaagaaggcatagcctacttttatttttcccataggatgctgttctttcagagaggctcttctgattgtattagcatatcctgtccggtatctaaaacccaggtcattacagagttttcttcatcttgggaaatgctcccctaggaaaaacactcccaggtggagaaatccgcggttagagccaaagcagtgtgattctgctcaagacggccttgagatggaacccattcatggattttagcatccatgaaattggaggaataagcataccttgaaaatggttttattttctttagcaagcagaatagtactttcgtgctttgctgcttcttgaaagtttttggatcttcaagtggcattaaaagctagagaacggaaaacaaaagctgcgagcaattgcccagctaatgtgtgcctcagatgcaaagtcgggaaaaagtggaacatcttcaaagagtgtaatcagtttgaaatgagtgataaaaatttgattatctaccagtgcaaatttgtgcagcaaattgctatcagccttgtactggcctaggaacctatttgctactttcaaa

SEQ ID NO: 28550 - DNA, 1489 bp, Bovine  19866881078092
gagcgagaaaaagagaagcagcaaattgggatgccagaaatcatggtggtttttgctgacagcaaccaaagagagaagagaacatatgaatatattattttgaagatatttaggagaagaaaacttaggaaaaaactttatgagaaaaactagatttgctttcatatactagatgtaaaaaaaaagcaaacggcaggcaatacattttctggtctgaaacaaaattccttatagctgatgttatgtattatggtattctgtacactaagtgtcttaaatgattatttctttatttaactaaattgaggcatgtaattcaattataaaattgaaggagggagtggtaaagggaatgaaatattcattaagaatcatttcccatcaaccacttgttcatgcttagatcaaacagatctaataatttcttgttaaattcatcagttttcattagaagagtaattgtagttggtaaaaggtaatggttacagtgtattacacaattaacacagtgtgaaatgaaataaaatatgttctctatagagggttttctgcaaacactagatactggatttaggatatataaatgtaagattttgctaaacactatcattttgttaaatcaaatcaaggcctatttatatttcaattgaaaactcatgctgtcatttagacattacaaaagttgatgttttaacagattggttaaggctaagggaatgaaatttgatttttgtaaaagatcatgatgtctttataaagtgttagttcctcagttgggtcctactctttgtgactccatggactgtaacccaccacactcctctgtccatgcaatttttctggcaagaatactggagtggatagccattccctcctctaggggatcttcccaacccagggactgaacctgggtctcttgcactgcaggcaaattctttaccacctgagtcaccagggaagcatgctgtctgcataaaatgccagaggaaatagcttggactcatgttgataaacctattaggtcaaaatctaatgtgcatatttcaaccctgaaaaccccaaacagaaaatgtttattttctattttaattttttctatttatcaagacaaaatcatttataaaagtatataaagggtaataatattgagaataaaacatggtaattattattaaaaagaaaatatttgcaaaaagcttaagtgataaaagactgttaaccaaaatatacaaagaacacttaaaactcaacactattaaaacaacccaattaaaaaataggtcaaagactttaactgacaatggaatattattcaacactaaaattaaatgaatgaccaagccatgaaaagacatggatgaatcttaaatgcatattactaagtgaaagaaacaaatctaaaaaggttacctatagtacgcgaccaactatataacattctagaaagggggaaaagaaaactacagaaacatgaaaagatagtgcctgc

SEQ ID NO: 28551 - DNA, 2173 bp, Bovine  19866881119598
acatgaatttgtaaatcataaaaatcaaatcataaatatgagcaggttcttacagaagactttttctaatatatggtataatcaaaagcaatataatagtatcacttggaaatatcccagtagaaaacaatcaaacaaaaggaactcagatagttatatataacggataaatttaaagtatatgtcaagctgaagttccaacagaatctggtaatcataatgcacaacattgattttcatccacagaaactgagaattcacttacacaaatgcttggaagcttaatactaaatataagatctgaataactgactatgacctgtctcccagaattctaacacctaaacttttgtcctttaagctatttcattattatatcacaaatgttcccttcaccttatactaagatctctttcctttgaaatacagatgctgatactcaaggatggtttggtttgattatgtcaatcttaatcatagcttaaatcccatctctcctttcctcttcagacactactggattataagctaaaaaaaaaaattgacattctatctctgttaacctttagagatgctcaagaaactattccttgtttgtgaaggcatctaattgctaatctataatccttttaatatgctctgccttttggattgatccattgccagctgacctaacactgcccatagctatattaatcctattactcacatcctattacagagtatcagtgaaactcttaatgaatcctgaaaagcttgcttgccagataccaatattaaggatgattacacatgtatttattcttttattcttaattataaagcttctgattgtattaattttattcagtgggattcagcgtttttcttctccacagctatctgggagctgacactaggttctgggaaatatcagtttctaaacgttattatcatacatattgttttgattcttcttaatgtaaataaatccacaagataatatattgttatgtattttgagattaaatcctgttgtaaggtaaagtatgttgcatatggtagaattattaaatagggtttattgaggtagataacatatcctagcaaaaagtctgcattttgtgttcctgatatattcacagtaccattaatcccctaataggatggataaatctgtcatggatgataagcctacatgttaagagaagtacattctctattgaattaatcaccccatacgaaagtggaaagtatcatcagcctgaaaaactatgatacctaaccatcaattttagtctgatgagtaatcacaagagaatagattttttttattgaaatgcattggcaataagattcattttatttaaaaaatctgaaaaagaaggtgtatagaaaaaacccactatcactgttgatgatgatataactgtgtctcaagaaagcataaatagatggagctttatggtgattcaaggtcctagagactggagcttgtggttagaagaggagtttggaagctgcagaatggaagcaagtgtctgtataataagagtcaagccagtgccaaggaaccatggatcctggaagtacttagaatcttgagaaacagttaaagaaatataacacacatgggtgtcattgcagcctccctctagaaattttaccatgtatgttttataatataaagccatcactgccctctaatatatatccattgtcccttcgccaaatcacaatgataccataaaaagcagatacatgactgccaacaaaggtccatagagtcaatgctatggtttttccagtagtcatgtatggatgtgagagttcgacataaagaagactgagtgtcaaagaactgatgttttcgaactgtagtgcaggaaaacactcttgagagccccttggacagcaaggaaaccaaaccggtcaatcctaaaggaaatcaacacggaatactcattggaaggactgatgctgaagctgaagctccagtactctggccacttgatgtgaacagctgattcagtggaaaagaccctgatgctgaaaaagattgaaggccgaaggagaaaagggcagcagagtatgagatggttggatagcatcactgattcaatggacatgaacttgggtaaactccaagaaaatagtggaggacagaggaatctggcatgctgcagtccatggg

SEQ ID NO: 28552 - DNA, 2060 bp, Bovine  19866881181355
tatttcaaagggactttgaaagggcagatgggtgaagactgaagcatattttcttctaatcttgaatgttggatcacagggcagattagaccacataatgaaagtcacaggccactaatcaaatgataaaaaaataaaagatatttgctttctgacttactctcctttttgttaagagagaattaactcctaaatgaacattttgataaataaacccctgaatagtaagatttatctgtggaaaatatgttatgcagctgggacttaagctcttcttgccaatcacgccagggaagtctgttctagcattagcttctaaatcccatggcaaattaattgatacattgatataaatggttgtctagctatattggagggatttgggagatggacagtgaacagaatgatttgcctttaattggcaattgaaggctctgtttagtcaaaccagttactgagttcttgctttagaactctatagtatggggttccctgtagtacttctatcattttctatacgaaacatacttattcctatgtagcatgaagggaagatgagaatgagtgaatgttcttaatttgacttctttggttaacctttgagacttttcatatcccaatccccagtttgtgaccttaaatatgggatattaccttaacgtatttattcttctgtttattatgctgggattgtataccataattactttttaaaaataaagtttaatgtccaaaaataatgctttatacatacattggccccttttgctgtatgtaaatggagcatcgaagccctccactactactgtcatttccttagttgagtcgatatggtagaatcgggggaaatcagccacaatcttcaggcatcttggctttcttttaagaaaaaaaaaaataccttctaaacatcctactaaataaagatgttgtacaggaaaagtaaaaaacaactagctataattaattcaggagacctcaattatctctttatgttcattgatttttttggtgttcttgaacaactaacatgacaacaaaccgaaaatgtgtgtaatactgaatgccacaactgtttcccaggcttgagactgagactcctaagttgttttgactaggtaactaataacaatttagataggtctatacagatttagagacatgagatgcaaaaccatgagtgtcctccagcacattcttcttgtcagaaccgtttaaatcaccatcttacacaagtacatattgaaactcaactttaagcattttatttttatgtacatttcattttgtccagaaataaaatgtctaaatacagacagactgtaatgttgtatatgtataggtttcaacaatacttgagctgaataaatgctttgtacattaagtttgtctttttaatggagttcacagctacatcgatagaatggattcctcatatcctttttttttttattctttttaaaccaataacaagcagagagacaagtacaagttaatattaataagcagctcaaattacacttggttaaactatgtacaatacaaaccattcatacaaatgaagactaggatattgaatttgttacaatatgtttagtaaagataagacagacacttataacttacatggtgtctgtcaggcatttcccttcttatataatgatcagaacttgttttaagcagccttagctggtctcgactttgcaaaagtccaatgactggtgatgaaagctgtagtccagtgtctgcccacatgtaaattccaaatgtttgctcatctttactgagaacaggctccctccatagaaaaaagagctatcttggatcaccttgaatgtgcctactgaatgctggaaaaaattactacacttgttgtgttcataaaataaagaatactgagctctaaaaacacatttttttttccattttaacaagcattatactcctacagtagtatttaccagtacagctactccaagcagtagaaatgcatgagtggggactattgattagcatgtactcaagacattaaagagagatttccataacagcaagtgcta

SEQ ID NO: 28553 - DNA, 1782 bp, Bovine  19866881263320
agaacttttctagtaaaaaaaaaagtagaaaaatagggacagtaaaagcaatgggaaaatactttatccctaaaattctaaatgcatgttacttttgaccaggcagtgtgttttgttttgttctagtaaaatgttaattttaaatactagtctaaaaaaagataaagatttgtccttcagcaaatgacctaaattactgctttaacttttttagaaagtatcttgctgtcaatagttttatttacagacttcctaagatataaattgaatgagttgggatagtatattattacacatctgttggtctattgcactgaatccagcttgattttgttttgttttttaatatatacaaactatatttcagaagtctttcaggatatgtattgatttccttaccaagtgtgtatgtgatctttgtctttgaattttacactatccttggaaaatatttctaaaattttgaacattaagtgagcaaactgtaggatgctatgagatttatacaacttaatgatatctataataagttactaataagacataacaaaattatgacaatgacaaacagtgaaagaataattactattataatagagggctgggaaattatgtgaacgaaaacattaaaggaagttggaaaaaaaagcctcagtgtatctgtgagtgaaagaaagaaaaagagatatcatacatttggatgtctggatttaaggtaatttctctgtattgctgctgctaagtcgcttcagtcgcgtccgactctgtgcgaccccatagacggcagcccaccaggctctgccgtccctgggattctccaggcaagaacactggagtgggttgccattgccttctccattgtgtgaaagtgaaaagtgaaagtgaagtcgctcagttgcgtccgacttgtagcgaccccatggactgcagcctaccaggctcctccatccatgggattttctaggcaagagtatttggagtggcttgccattgccttctccgatttctctgtattaaggacttccaaaaacctcagaatggccaaactgccgagtaaaattaacaacagtgccataaaagaggaatttgtgaaactcttggattatcttaaaaaaaaaatcatagaagactcattatttctattcaattcaaactgcacctcagttctctttctaccaaagctagtgactttaagtaactgtggacaatgtgcaagagtggggtatgtgcatttatttgcctacttcaatgtaactttgtactgttcatcacatctagttctagttctgtgataaacacatcaggaaagaagtagggctggcaggtggcagaatgtggacctggcatattccctgcataactggctcagtgtatacatttaccattctcctttacgattacatgcagctctacactataaaaagaaaagcagcctactgtttaaaatgcatttagggggctatgaaggtcacaattgaagtgtgaatttattttagttggtttgagtttcaattctaaatgcttttactttactgtgtaaaatctctctctcgtgctgttttgaaaattgcacctgtacagagaaaggtctcatttaattcaatattactttacttttatatatagtctttcttttaaatcatgttccaaaaggttgagttaaataatactgcttcaaagtgaaaattaaaatgtaaagccagggagagaaaaagcaagtgtccaccaaaatggtgaaacactaagatggataattttaatgtgcttatgcacaaagccatg

SEQ ID NO: 28554 - DNA, 1129 bp, Bovine  19866881343075
attagcagagcttgagtgaacctgacaaaagttcacaaaaacaattcacttcagataatgagaaagaagttcaagtgtgagggaagcagaacgagattcagattatttaatattccttagttattgtatttaaaaaatacaatctggcctgctcctaaaatgtcagtgcacattttttgaaatttcactgcacatctagtcattacatagcttctttaaaccatttaatgctattgtgccggttctcaggattttcagatatttctgaagctacaaatgtagtggtgttaaagaattaggaaaaagcaaaagtgtaaaaaaaatagttttattatagttactttgggcttccctcgtggctcagtcagtaaagaatctgcttgcaatgcaggagacctgggtttgatccctgggttgggaagatcccctggaaaaggaaacaacaacccactccagtattcttgctgggggaaatctcatgcacagaggagcctggtagactacagtccatggggtcacatgagtcagacatgacttagcaacttcaccaccaccatagatatttttacaataatcaaaggtttaaaagtgataatatgttttaaaggaaggaatatgataccaaatgaatacatgagatgaacacatgagctgtttcctactcttaagtcagtgtttcacaattaagaagctggatgtgatggtggaaggatggatttttatgatataaggagaacatgagctacttgtaaagtaagaacttagtgaataaccttccagggagtgcattaacttatgtgcattgtagaggggcctgaacaagctggggtgacagcaatgcagacaagatgataatggcaaggacccacctttgatcaagtagccagtgcctagggagcaggttatcgttcttgttcagtcactaagtcaggtcctactctgggcgatcccatggactgtagcccgcaaagctcctctgtccatgggctttcccaggaaagaataagtattctttccttctgccctttccttctccagggaatcttcttagtccagggactaaacccgcgtctcctgttttggcagataaattcattaccagtgagccagatgtagcgaccaaatctga

SEQ ID NO: 28555 - DNA, 1470 bp, Bovine  19866880221381
aatgttgagctttacgccaactttttcactctcctctttcactttcatcaagaggctttttagttcttcttcactttctgccataaaggtaatgtcatctgcatatctgaggttattgatatttctcccggcaatcttgattctggcttgtgtttcttccagcccagtgtttgtcatgatgtactctgcatagaagttaaataagcagggtgacaatatacagccttgatgtactccttttcctatttggaaccagtctgttgttccatgtccagttctacctgttgcttcctgtcctgcatatagttttctcaagaggcagatcaggtagtctggtatatacctgtaatttatataatactgtacatcaactgtatcccaattaaaaaatgcattaattttaagaggaagaaaattatgttgaaacagcaggaatgctataatatttaagtattttgggaaaaaagagtccaaagtcatctcacttgaaaagcagtggatataatttctttttaattacatgtgactcacccttctcacggagaaggtaatggcaccccactccagtactttttcttggaaaatcccatggatggaggaggctggtgggctgccgtctatgaggtcgcacagagtcggacacgactgaagtgacttagcagagcagagcagaagataatcttcagaagtactgtttccttgaccaatctgaaaaatcctaggacagattcgataggcccagtttgggtcatgtgtccatccttgaaccagtctttggtgagggagatggagtattctgattggtcaggcccaaccctagcgctattgacaatgacgtcaactgcaaaggtcccataagcattttgcaactgctaaagtgtagtgcaaatgtaagtagcatttatcatctgctgatagtagattagaaactgtattagaagggaagacagtctgtcataagtaagctctacctaagagcaaagagaagtgggagccaatattagggaaactgataagaaaaacgattaaaatcctgtatgaaactttagacgtgcagtattctgagacatttgttgtacaaattgctttataatctttaccctattgttatcaattgagcaaatttttgtgtatgttgaaaaattagtgcttgcctatgtgtttaacttgtccatctacaatgacttttctcgaagtttccagatagttggtgatttaacagggactctgtcctagagaaaagtttatctcatggggaagattgtgtagatttattacatggcagtgtagaatcagaactaaatcaatcttttacacaataaactctacacaaaaatgaagttttcactcccactctcaaagacagaatattgaattgggtgggtctatgaaataggacaatactcatgttttcacgttaagcttgctggccagatctgctagctaaaaatatacccacttacctacgta

SEQ ID NO: 28556 - DNA, 861 bp, Bovine  19866880410867
atggtggccccctctgcagaggccatgcggcatctggatggacgtcattgtcacgggggcagagggctacactcagtttatgaactgactgaatggggccccctggacccaggagccatgcccagccgcctgctgccccgcctgcctccggacagggagttgcaccctgggctcccagaggccctggagggtggagcacgactggggcttttgtacaagaagagactctgtaatgttctggaaggagctcgtcctgtgggtttctgagctctggccccccctgaaaaaccagccaggagataaaagttgaggagggggctttgctgcctcctgggagcccggaacttgcaatagcctgttagggtcctgccccgggacccacccaggctgaggcgccgtcagagggggcccctcctggcacctgtgctccctgcctgtgttctcttttctaaaggacacattatggtaccagaatctgccaaagatcccctcttgcctcagcctccgttgcaggggccttgagggctgagtagcaccacatccagagtggggtaacagctcaggcggtgtaattctcaaaccctgctctatcccattcttgtgccgcatttgtattttttatgatttttgctcaaggaccagagactgagtgtcatccttgaggtcccagccctagcccctttttgcagacccatcaccacagtcaccatagtgactgcttcatcgccatggttacatactaattgccatggctgtggctcagcccactgcttcagctgtgggcccatctgagggtacgtgccatcatctctccagcccaggcccttgggcatctcctgctggggatgggggaagggacta

SEQ ID NO: 28557 - DNA, 1116 bp, Bovine  19866880446058
acccccagaacagaaatcagctgaccccaagccatgtgatccacacagatcgccacctactgaagttgctcaaaagtctacttttgaaccctaacacaagaatgaaggtgggcagaaacggtctcctgagagatcaccatctccatcaatgccaaatggggctgagtgctgggcccctttctctttaagtgatgtgacatgaccagatattacttttagattagatggctgtgtggtgtctgttgaggcacacaggaagataaacatcaccttctgtaccgagaggagagcatatgaagaatcaggaggtaacctcgaagaaattctaagtgctggttcctgcccatgcagaagagcaatttaaagtcaagtgggtctctgcctacgcagccctgagcctcaatgcacccctatgtatcttggatctcagctggagatggagtcaagtttcccccacgatttagacaagtcgaggaaggtacagagcaggtgttcccaaatgcttaaggatccaccaaggatctttcagagtggagctactccagatctgtccagtccacttctgcagagacagagcccaggaatctgtcattttcagtaagttcccccagaggattctcttgaagccaggctgccactatttgggtctgaaaatcaggggactggatctgtcagcgtctatcgtaggagagtcagtatagggagtttcccaaagaaaatagttctgattatctcacattgaagaggaagaaggtgagagtcatattgaatatacttaaggttagacacaaagatatttgggtttggaaatgtattgttttgagtaagagtttaagataaataaacactttagatttcttggtagatgccagtcccaagaacacttggttttagtactttctgagcaagataaagtcaatgagggacttccctggtggtccagtggcaaagagtccatgctcctaatgcaggggcccaggttcaaaccctgcttaatgaaccagatcccacataccataactaagaggtcccataccacaactcaagatcctgcatgcctcaaaagaccaggccacagcttaactaattaatacttttttttaaagatacagtcaa

SEQ ID NO: 28558 - DNA, 1157 bp, Bovine  19866880488915
tccccaaggtccccaaaccccaaagtgaaagcgtgaggggttgtggaaaaggcggggtgggggggcgctcagtataggcccgagaggtcgagggtgtcaaatgaggcacacctgagcgggctccactcaagtcaatcagcaccaggggatttaagaacgtgcctcccaggcctcagcctcagtctctcccgactctctcaccctgtgctggctggccctcctctcctaaccgtggacctgaaactgcagcacgtcgacttctgggccagcctccatggccaggtcccggggctgctggactgggacatggggaacgagtcctttctggccttcgccacgtcgcacctgcccttagccgaacagaaccgtgagtgtcctggacggggtcgtgggggatgggcgcgccgcgacggctgaggggggcgctcatgggcgcgccaggcccgaggctccggcgcttggacctcctccccgcccgccctcacgggccccgttacgatgttgcgattctggactccttgcccctttgctgcgcccctgccccgcccctacttttcccaagaggcgagggggccccatcctcgactggaagcccacggaaggcaggggcctgcccgaacactgcttttccaccctcgttcacgggcgccgtcgcaaaacttttaggtctcttttcagccttttctccgtggcgcccaggccgtttgggcccactactgatttcgatcatctttctctttaaaaagatttttaaaatcaattttgtctgtggccgtatccccctcttaatacattgtctgacacctagagccgctcagtatttgctgaatggatagttgaccgttgtctttaaatttttttttttttttagtttgggggttctcgggtgtttctcaggtattgagagttgaggtaattgcttactacattcttgatatatgactgccatctatttgggcagagtagttggattaactcattttcttccttcagtccccaccctctttcctcacttcccacactcccaatccatttaatgtctttatagacaaacgtatctttgaaaactgtttagcattattttgcttttataggtaaccttactatacataaatactctttgcgtccccccattcacattgtttttgagagtaatt

SEQ ID NO: 28559 - DNA, 1827 bp, Bovine  19866880503303
aactgcacagactaaaactatctaattgttgtcttaatgggcatttctctaatgattagctagattggattttttaaagtaatttgagtatatataaattgtccccattttcaattagttatttttttcttattgatagaatccttttacttttttataaagcaacttaaaagagagcttctcagaatggtgctgatgctaaaggggtgtataagtagtgttgctcactaaaaggcacatgcaagcctgtatctgcattttcctttgctgataaaatggttactctgaaagtctgggcaaaattctcaggtgcaagagttgcttcagtgtggtgaactgagcaaaagtgaagctcaatacaggaggtcaaaggttttgctagagtactaactgctggaggaaaacaggttagacctggtgacctggcaaagtcagtgtaaacaaactaagacaatgaggtgccaaaatagtaacagaagggcatgcacctgacttgttcccactgcaatgctcccaatcctagccagccttacgtgtttatggccagaaggatgagtgttcagttgctctgttcctataccattaaggtctcctctgaattccaagagtgacaagcgctgattaccaaaactttccccaaccacatacttaaaatttctcatttccttattttcccaattccacacttttcaatctcctaatccaagggttcccattctgagcctatattttagaaatctgggaaagttttcagagactgagactcagagctgcctctttccatcacgttaaaaggtcagcattacatgtatttcttctgtttcatctgtctctgtctactactcatctgtcttgctctcacttcctttttattcaatcctaatcagagagtaaggccatatgtacacagtagtatacatatctgaacacttctgaaataaacacaataaaggcaaagtataaacgtttctcctttcctaaaaataaaaacacatcttttttggagggaggagaaagggagcaatttctggcctgaaagtttgtgtatacgctcagaaaactaatatatttgggaaatagcatcctaattcttctagttcatatattacctatagggcggaagctagacttgatctttactttggtcccagatgaggaaaatcacttttctgattagtgagatattgtcctaatttttttcacatgaagggtaaggatcagattttcctacaagtctgttctaaaagcagtaagctatgaaagtgtaatgaaaaagcattttgcttgagataagactctgaagcactgggcttaagaacaaacctcatttctctataggctagaaggctctaagtcttcctttaacacacctgctgtctacagctgcatgtgacttgtttcccacacctacaactataacctgtttcttatgctaaaaaaaatttagcatctttgttaagaatctttcgctaggtgatttgtaaaacaagaaagcttgacagctttgggagcatgatgggcatctgttattccagaaccacctgttctctggtctttttaagccagggataggacaaggagaagtcccccaaaccaaacaaacaacaaatatgaacaaaatgccaacttctgccctaaatataaattccagttgcaattaaggacccaaaggatatttaatttgggaagaccccattctaggtcatctcatccactgctactggctcctccacttaccagactgctgcttcagctgctctttttggattgctgcaaactgtttggcatcagccaaggagccaaaaagagcagcaaaggggttacttg

SEQ ID NO: 28560 - DNA, 1247 bp, Bovine  19866880550465
ttgctgcctgtgggagcaattgttactataaattcttaatgaagaatctgattgttattgtgggggtttatattttcagaagcaccgataaaatgtaagatgtaaaaggaggacagaggcataaggtgtttgatgcctgacaacaactggacttatgaactgaggtgaatggaatttagtggattcttaaaagagactgacctggtgttttctaggttttatttggaaatgattctgaaattatgtcaattctttccttctacaattggatctagctgacataaaacgatacctgagtctcaatctacaagatgttgcaaacaaaaaaaaagcaattacttaaaacctgctaacaagtatggctctacatcagatgacccacttactgcctcagggcattcatgtggtagggctcctgtcttctctccacagagttacttactgatatccaataggaaagagcttatcctcacagtcagagagatcattcagaatccctaagcagtcaattgtcatggagcctgagtaaggaaagaagaactgattagaggtgactatgagaaggcccactttgtaactgaagacttaagtacctcaatgacacagccagcctccccgacaaccaaggcccatgtcctaccaatcatcatgtggatattttctggttctaatccattgagaaacttccttctcaagctgattccttcaaagtccacaaacactcttctaaaaacttcaaatccattctcaggaaccaccttaaatgaaaggccagggtagctgttaggctctccctttatacactattctcaggatattgactcagcgggaaagacaaggcgtatctctaaatcactcttctgtttcactagcagggcctttgataattctcccaagagaaggtgattctaggagcacctagtaggaaggtgtaatacagctcaccaccttgctattaatatcttcagcctcttttcccagagaactcaaaaagcaactaaagctcacctcgcctttgatcaaatcccgatgtcgttggcaatacacttttttatcatccagaaacacacagttcttggctcgggaacacatgaagtgatagttgctggtgcaggatgtaaggcagcaacccacagtggctcctggcttttggcagaattcacatctctaacaatccagaaagaacagagcctgagtcagacttttcagatgttttagccattctccatcttctctacagagtcacc

SEQ ID NO: 28561 - DNA, 1458 bp, Bovine  19866880592283
agatagagacagaaaagtataaaatatatgggaagagcagggaatagctggactgcttcatgaaggcaagtgatgaactaagacccagaggtgcatggggccatattacatcgaatgccaagttgtttgtacttaatgggtttggtgtgatggaatctcacttaattttgaaggtacatttttgcagtctaattgttttactgttgtttgctatagaaaacagggagggggggaatcttttcccctgagtagtgagtgactagaacagtaggtaacaggtgtttggagaattcatatgagaaacacttagcctcaagttgtggtacagaaaagctgtacaattcagttagttaagatgatgacaaacagatctttgtaaagagcagcacttttttatttttttacaaaatgagctagacactggccttttatgagaaaacctgccaatctttagattgttttttaaaatggtcatgtagtagttgcatgcttatattgacacatcaaggttaaaatgaccacaaacttaggctctaatataattcagtgtagtggcacacttacatttagtaattctaccatttgggaggtctagcaggaatatgatgagacttctgacaccattttggatgtttttggttaacctcctagtgataggagctgcagctccctaaaatgtgagacatttctgtttggagctgtggccttttatgcctccatttgtaagttatttccccctacttctctgctgatcagagaaacagtctgttgtttgatacgctctatttaaacgagactgaactccttgataatacagactggcagcttgaatttttttgaggggaattttaaagtagtataattgggaatagaagcttagttgatttctgtttttttattagaatccttttctgccaattttagaagtaggtgatttctatgtattgatatggcatatcagctggggataactagagttgtatgtgttgactctagactataataagttaatcaactataccttggcttcattcaattttgttttcaacacagatggttgttattgtttgttctgggcttgcctccctctcagggtcaagaaagtgactcctcggagacctctgtgcgaggaccccggattaaacatgtctgcagaagagctgctgttgcccttggccgaaaacgagctgtgtttcctgatgacatgcccaccctgagtgccttaccatgggaagaacgagaaaagattttgtcttccatgggaaatgatggtaggttggggatgaccttgggtttgtgtgctgatcatcctgcgggtacgtagtgggctctgcacagcattgtatattaggctgggccccccaggaaccagatgtcaatgggaggattgaccaggtaaagatcttattagaggaaatgcctgaaatacagggagggagttgggaaagcttgggggag

SEQ ID NO: 28562 - DNA, 1311 bp, Bovine  19866880613609
aaaaaataggttaaatagagaggattattaaagtcaaagaggaaactgagctactagttataacaacaaaagtagcacttaaacatgacaaaaatttcccataaatctctaggctggttgactagttctcattcagcatgagcataaagtggtgcttgtgcttgctcaggcttctgtgacttaagggttggagccaggaactcctcaggtacacagaaactaaatggaagcctatatgtcagaagtggaattgcaaaccaggataggaatcagattaggagcataccatgggttttaaatctatattaagcaatccatctctacctcctggcttatgactactgatgtttcttcctccaagaactaaatggtctttgcttaattctacatttaaccttccctgtttatatggttttgacaatactgaagaaacacaattcctgctgtgtaatatgaaatagatatatacctcaaaggtatttagaggagctgactgagcctgcatttgcactcttctgataaaatttcctcatccaagcgccaaggggactcaggggtataatgggatgagcagagctccctgaaaggctttctccccttttgaaattttaagcccacagcatagaaatacaaccctgaaaagggtgagaagagacaaagggtatgaatattctgctcacgaggatgctgaactgctacaaggacagaggttcttagaaggagtggggtcagggatacaaggcaggaggcaaaaagaacacttggtttacctttaattgaggtaagattccttacggaatcacactaacaaaagctaatacaagttgaaaagttactcttttttggagagagactataacactttttttttgggacagtgctgaggcatctctacctgttgcttcgtgctcctctgttgagctttctgcctaaaagctaatggttactgagctgtaatgacagtctagtctcgtctcagcatgctgctggtcttgactacttcaaagaactcaaaggttagatgttgctctatatattttactttttattatgtatagtttagttgagcttaatcatgcaaaaaagaaagacagcataacattggagttaacaatccttgcgaggtctttccttccctttaaacactgcagtgttgttcagtcgctaggttgtgtctgactctgtgactccagggactgcagcacaccaggcttccctgttcatcactatctcccggtgtttgctcaaactcatgtccattgattccgtgatgccatccatccagatcgtcctctgttgcccccttatcct

SEQ ID NO: 28563 - DNA, 859 bp, Bovine  19866880623444
taatattagcttcaagagcttccacccttccaaatgacccaatatccaaagtatcttgcaaggtattataattttagtacttatattcatgctatattttaagccaagcttggtaaagaggaattaaatgtaagtttcatgaaggaagagacttattcagggctaatgccccaacacttggttatctgcccggtacataagacattcttagaaaaatagctaagatagctaagttgctatctcttactttgtagagtgctatgtttatgaatgccactggggggaagataagcctctttacaagctgttcatcatttgtaaaagaaaactatatagtgacacttgtaaattatttccaaatgtgagtgtaacaataatttgactgaatttataagaaaaagagtataaaatattcaagcatagtcaaatacacaaatatcaggagataaacttcttaagccaagatggtttctgaaatccaaccagctgagagatgtatacagttattgaactgacatcatcatctctcgtcaacaaactggcagtggcagggccaaggccagattctctctggctcttggtgcatcaaagagaactatggctgtttgaatgtgtaacacaaaggaagagatttcaactgttttaaatatgttctctatctgatactgaacccccaaaagtcacctaggattaaagagtgcaaagacagtaatacactgtccctcagtaacgacagttggttaagttttcacctacgcaggaatgaaaccgttttcaaatatttaattcaattctacctagcactgttacctacaaaacacaaatgctacccacttgtaattagagaaagaactgtctc

SEQ ID NO: 28564 - DNA, 1027 bp, Bovine  19866880626230
ttttcaaatgagtcagctcttctcatcaggtggccaaagtattggagtttcagcttcagcatcagtccttccaatgaacactccaggactaatctcctttaggatggactggttggatctccttgcagtccaagggactctcaagagtcttctcccaacaccatagttcaaaagcatcaattcttcagcactcagctttctttatagtccaactctcacatctatacatgactactggaaaaaccatagccttgactatgacctttgttggcaaagtaatgtctctgctttttaatatgctgtctaagttggtcataatttttcttccaaggagtaagtgtcttttaatttcatggctgcaatcaccatctgcagtgattttggaaccccccaaatagtctgccactgttttcactgtttctccatctatttgccatgaagtgatgggaccggatgccatgatctttgttttctgaacaaaaattgttttgtcaataaggagttttaaacccttttatgctgatgctgataatctgtgataggtattctttacctccctctttggaacactcaaagagtgttccagctgtgtaaatcaattagtaaacagatattgtttactaatatctgtatttcccactagctggtaaattcctgccctaatcccactgtatcattttgctaaacacagtgactaagggcatgtagtaggtgtgcaacaagtattcattgaatgaatgcctgaaccaggaagtgatttagtgtcctctctgggaaattgcttttcaaaattgggcaatgcagtttgtaaaagcctgggctcctaagtggggaggataccaagtaagaaaagaacgaggaaaggctagagtcttgcaaaagagagaaagatgatattgtattgtagggcctgcccaacctaccatcaggtgtaatgaggtgttttttggcgattaggtatgtgatcaccaatctgaagcagtgttgttttaattcagtgtatattcatgagtacaaatcacacatc

SEQ ID NO: 28565 - DNA, 696 bp, Bovine  19866880711375
tactgagagtaagatgatgcagtgtgggaaatgtgatcgatgggtccattccaaatgtgagaatctttcaggtacagaaggttggagtcttttttattacaatttccttctttcttggtacactgcactagtagccccaaagtactataaatataacactgcataacattacagtagtgctgttacttgaagtctttttaagtttattttttggtctctaaaataagatcattgtattacattgtgttcatttaccttgaacacattctttaaaatacttaaatgttgtcctttgtggataccataacctgttggctctccagtagctgaatcctgagttagtggtaatactgtccctttggagatcagtacataggagttcttagggggtgtgagagacttaacgtttctaacatacagcctgatgttaagttcagtggaataacttcctcttttccccctcttccactctgagagcaccttgtcacagtaggtttttgtctccccagatgagatgtatgagattctgtctaatctgccagagagtgtggcctacacgtgtgtgaactgcacagagcggcaccctgcggagtggcgactggcccttgagaaagagctccagatctcgctgaagcaagtactgacagccttggtgaactctcggaccaccagccacctgctgcgctaccgacaggt

SEQ ID NO: 28566 - DNA, 817 bp, Bovine  19866880747280
tttgggaagaaagggcaaggcaagcaaggggctgtggtgggaacatagtggtctctgctttgcaccagttaagccggagattgctcaggttggggccaagtaccaggaagctcagggcccgggccttctggtcatcctctttgccctcgtgcgtgccaacccgcctgccaacgtgacctggatcgaccaggatgggccagtgactgtcaacacctcagacttcctggtgctggatgcccagaactacccctggctcaccaaccacaccgtgcagctgcagctccgcagcctgccacacaacctctcagtggtggccacaaacgacgtgggtgtcaccagttcctcgcttccagccccaggtgagcactgccagccacgggcccagcagagcctcaggtgggtgtagggtcatggtacagaaatgggaagacttgtcttttgggtaagttctcatgaaagctgtccccagccaccttgggcaaagaggacagagtagggacctgtggtgtctccaagtcaggggtcatgcccacttggaactaaccagaggaccacctgcagggctcctggccacccgggtggaagtgccactgctgggcatcgttgtggctggagggcttgccctaggcaccctggtggggttcagcactttggtggcctgcctggtctgcaggaaagagaagaagaccaaaggtaaggccaaagcaaggcaggtacagaggatgctgggagcatggagatgaggtcaggggtgggggggagggcacgggcaggactggagctgggcaggtctctaacaagtggtaggacaggtctt

SEQ ID NO: 28567 - DNA, 1744 bp, Bovine  19866880763324
tgtctcttcctgctggctttattctgtgtttgatctgattatttcatcaaatccttttcagatttccatttgatttcagtggactttgaagatgggtcaccgctctcattcagatgaaattggttggagagaattttgttttcaaagtaagggttttcattaaagtaaaaatctattctgaagcctgattgaatgttttcaaattctgtcactttgacccttgtcaaataatgtagtgcgtcttcatcctcctccccaagctgtgcagacacttgtgggtggttatcaaatattgttaccccaaattttgggatttttgccatcaattctgacctcttttgaaaaaatggttggtgaattttgttatatttctattctacttttaaaatctcctcactggcttgttcattaagtctatctcattttgcacttcatcaatatgttcaattgcttcttgctattctttttcttccttcagcaaagttgaagaagcacatgcctcgtctggcctggaggcaggagttggcctcgctttctttggtttcttcacttggggtggaagtgaagactggtgtttggtggccatgctggggaaaaaaaaaaaaaaaaaaaagaagccaagaatcctcccaggggaggagagcagtactgcaaactcagagaactcagacttttttatttttaagttttattttgaaatatagattaagagaagttgcaaaacagtatcaagcgctcttgtgtaatcttcagtctttttcccacaaagattacattttcatataatgatagtccaatatttaaatgaagaaactgacattgctacgatgtatgtgtgcaattccatgccattttatcacatatgtagattcctgcaactgtcactgcaatcaagatccatcaatattccatcaccacaaagatttccctcatgccaccccagcatccctaaaccttggcaggtctaaaactcaggattttattcttcaacaaagctcaacagagttgagattcatatttggtggtgaaagaaaatattcctgatatgtttttaaagataagaaaaatatatccctcaaattttctggaagtctgtgtgatggaattatgataattttgtttgtttgcatttttaaacttttactgttttctatgtgactatgattatcagttctgctagagctgccacaacaaaatatagaatgagtgtctcaaagagctgaaatttattttctcacaattctggggctggatgtccaagatcaagtgctggaagggttggtttctgatgaaagcaagccctctctgggcttgtacctggccctgttctcattgtgtcctcatatgaccctttcccatctatgtggaaaggcagtgatcactggtgtcctctagttctaaaagtaaagctcttcatgctccatctcttggacatgacaacacccggtgtcctattccctcactcttcccttggcctccattcccctgataaagtgcttctgtgctgctctgtagtgtcactgacacccccaaatctccatactgttgtccatagtggctgtaccagtttacattcccaccaacatgtagggaggggtccctttcccccacatcttctccagcacttgttgtttgtagaattttggtgatggccatcctgaccagtgtgaggtgatacttctttacagttttgatttgcatgtctctaataatcagtgatgttgagcatcattcatatcctttt

SEQ ID NO: 28568 - DNA, 4903 bp, Bovine  19866880763642
aaccatcatgcaatctgcaaagagtaacagttttacttctttctgtccaatttggctgtctttttttccttgtctaattgttgtggctcagatttctatgttgaataaaagtggcaagagtaggcatccttgtcttgttcctgattttacagaaaaaagcttttagtcattaatcactgactatgatgtttgctctggcataccagacaggataaaacacacctctcaacagtgtgggtatagaggaagcataccttaacatatagagaccatatatgaggttttactggagaaggaaatggcaacccactccaatattcttgtctggagaatcccacggacagaggagtctggtgggctatagtccatggggttgcaaaagagtcagacatgactgggtgactaacacacacatgagattttatatatatatatatatatatatatctcactctattttaagctgatcatcacaaggttgaatgccttctaacactacactccacattttccacctttgacatcacattttacatcatttgtttgtgtatcttcttccaaatttttgtagttttcgttgatttgactacgtttgtcttttaacctttacagtagccttgtaagtggttgatttcactacttctactatatgtttgcttttaccaatgtggtttttcctttcatgtattttcttatctctggctataaatttttcttttctgcttgaagaagtctctgtagcttttcttgtttggcccgtttaggtagtggcatactcctttagattttgcttgtctgtaagactctctttccttccactctgagcgataatcttgccaggtaaagtattcttgattgtaagtttttgtttttgtttttgttttccatcagcactttgataaagttccatgccattctcgcctgtatatagtttctgctgaaaaatcagctctctctcttttttttaaatggggtccccttgtatgtaactagtttttttctcattgtgcctttaagattctctatctttaacttttgacattttaattataatgtttggttgcatgagcctctttgggcttatcgatttgagactgtctttcctgtactcagttcagtgcagttgttcagtctcgtccagcactttgtgaccccacggacttacagcacgccagccttccctatccatcaccatctcccagagcttgctcagactcacatccttcgagtcggcgatgccatccaaccatctcatcctctgtcgtctccttctcctcctgccttcaatctttcccagcatcagggtctttcccaaagagtcagttctttgcatcaggaggccaaagttcctgtattcagatatctgttttcttcactaggttagggaaattttcaggtaacattaatatttcttcaaatacattttgtccctctcttctggtgtctctgtagtacagttgtgagtatcttgagatccattaaactgtccttatttttctaaatttttttttttttctttttgatgtgacaaatgggtaattttctagacccatattcctggttcattcatcttatttttagtgacttacttatttgtttgttttggctgggtctttgttgctgcctgggttttgctccgctgcagtgagtgggggccacctctagttgcggcacactggcttctctctgcagcggcatctcggttgcacagctcaggctctagggtgagagggcgtccgtggccgcagcatggggactgagtagctgtggctcctgggctcccaggccctggctcagtagttgtggcacattggctgagttactgcgcttccttcttctgaatcatctaatccgctgttgactcattctactgtatgtttcatttccattattgtattctgaagttccagttggttcttttttatattttctacctttttgttgatgttctcactgtgttcatctgttcttctaatgagttcagtgagcatctttatcactgtgactttgaattgtttttcagataaacttatctgaataatttttgccttcattccacggtttatttctgagactttgtcttattctcttctttggaacatattctgttgtctcctcatttaccctaactttctgtgtctgtttctatgtgttaggtggatcacctatgtctcctggtcttgaaggaatggccttatgcagaaggtttcttgtggggcctgaaaaagcaatgctgcctctttatctttgattatttgtagtttgaaagtgatatgcaaaggtgtattttgttttgttttgggtttttttggcatatatcctgcttcatgttctgtgagcttcttggatctgtggtttggtgtctgacctttatttgggaacttctcagtcattattgtttccaatatttctcttcttcctgtccctcttctctttgaatattcccattatgtgtatattgcccattttatagttgcttcacagcccttagatattctgccttatatcagtctgtgctctctttttaatttttgaggattctgttgacacagcctctagaccagagtttctgccctcagctgtgtctggtgtactactaagcccatcaaaggacttcttttttacggcagttctgatcaccagcgtttctttttggttctttcttagagtttctgtgtcctgctcacatcgaccatctgttcttgcacgttgtctactttacccatcagtgcccttggcattttaatcctagttattttaaattcccgctctgataattccaacatccttgccatgtctggctccactgcttgctctctcttgttttctgttttgggggacagcaagtaatttcttcttgacagacagacatggtgcactaggtaaaaggagctgctctaagtagccttttggttacgaggtcggggggggtgcgctgccagccctgtgattagctctccgtcttctagtgagcctatgctgtgagctgtacgcttcacaagagtttctcagtttgtttttttcctcatagtttaggtgggacaggagggctagaatggggtggggttgggtatttcccttttgcaggtagttgggtctgatcacccctcagcaggacaggctttggttgactagcttccactgcgtgtgctgctcagtcgcttcagtcgtgtgcgactctgtgcaaccctatggtgccaggctcctctgtcatgggattctccaggcaaggatactggagggggttgccatgccctcctccaggggatcttccagacccagggatcaaatctgagtctcctgcttctcctgcattgcaggcagattctttcccggtgagccaccaatggggaggcagacttgttagaaaacagtcctctggcaaattccagaatggtttcttttctcctccccctactggaaacacaagggaatttttctctgctctttactgtgggaagctggtcgagctcctgggggtaaatctcacagtattgtgggggtctgcctgtgactgggtcccttggagattttaactctcaaagagtcatctgagtaatttgtcaattacgtttccattttttctaaccctgcactgctgcagtggctcccactcatctctgccctcctgagctggtaatctatgcatttgcctgtctgatccctccagtcttggggagagtgttttttcctgtgtcctcttctctcttgaagatccaaaaagagttgctaatttttaagtctggtcagctttttacttattaagaaagagaggccttatatgtgtagccaaaaaccttctgcttctctttggcacagcagtattttggcattgtgtgtgaaggtcctgtgatggtaagattaaatcttatattcctataaatactccttattgttttgctctgaagtttttttagggattatattcttccagtctgtccctttctatcttcccagatcatggctctaaggttaaaaaagtttcccaattgaatcaaagaggccattcctctttttctcccactctagcaatttgtggttaaacctactgtacatataacattgcactgttcattgtgaattgtgaattctgccacaatgtaatctactggttgcttttataggtcttccattgttttgaaaaagtacaaataaatgaaagtttagcattatttaaaaccatatttgagcccataaaaacatgttttgtaaatataattaattctaatgaacactgtccccataatcaaactggaaaaaaaaaattcccgattataaaaattcagcacttacttttcttccaattgttgattgctatttgagtctgtctgacttgattgtttatgttgttcataacttgtattttataaaattattggttataattgctagcctaaaggcagggatacagtgtaaataagtcataagtcaaagaaatgctatagaaaatgaaaatatagtagctgaaatagctcagttgggagagcgttatactggaggaaatgaaaatatgcaaaaacgtgataaggcattaattgttagtttctgtaataaatcaaggcacaaatggtattgttgaatctttgttgactgaatatattcttgaattattttttcaggaatgattatattcacatcttaactctgtaaggtttagacccaagtaatgttataatcacaaagactttctagaatatattagctcacatttgcctctttctgtgattcctactgaaatcagagggtggatcacacagctgaaagtgttattatgtaatgtcttgcacgttagttgcaattggttgtccaaatgaagtttaaaatctttaaatcacacttcatcattttctctaggggagaatggagcataatttcaataaataataattatcttgatgcctat

SEQ ID NO: 28569 - DNA, 1804 bp, Bovine  19866880786166
ttttttttcttatggtaagaacttttaagatctactttcttagcaacgttcaaacactcatgtaatacagtattgttaactacagtcaccatgctgttcactgcatccttatgactgttttattaccggaagtttgtaccttttggaagtcttcacccattttgtcacccccaacccctgcctctggcaagcccaaatctagtctgcctggttttttttttctttttaaatattccaatataagtgagatcatatggtatttgtctttctctgacttatttgcctcacacaatgcccttaaggcccatctactgtccacctgaataatgctgcaatgaacatgggggtgcatatatcttctccaattagtgtttctgttttctttggataaatacccagaggtagaattgctagatcatatggtagctttatatttaatctttttaggaacctccatgccgatattttccacagtggctgaaccaacttaaaatcccaccaacagtgcacaagggtaccctcttctccacatccttgccaacacattatttcttgtctttttgataataaccattctaacaagcatgtgtggttttgatttacattgccccaattaatgatgttgagcactttttcatgcagatgttgaccatctatatgtcatctttggaaaaacgttcattcagatcctctgcccatttttaaattggattgtttggcggtttttgccattgagttgtatcaggaaacatcttaagtacagaattctgaaatccctggttataaaatctaccatatttcaaaaactaagttttattttttctactcataattaattgtattccataatgccaaaagtagcaacactatcttccctaaagaatcctagtgagcaaagaattatctaatagatcaataagcctttacttatattaaatatatggtttttccctgattttaagagaacacgtttttcttatttttaaatttttatttatctatttttggctgtgatgcttggcttgtgggatcttagttccctcaccagggatcaaacgtaggtccttggcagtgaaagcagagatataaccactggactgccaggaaattcccttgccttttaaacttaatcagcaccaacacctctctgttaggtcatttataagccaacctcattcttttcaatagctgccctgtattacactgaatgcatacaatgtgatctatgtagcgacttctcaactgatggacatttgtattgtttccaatttcccatgatttcaaacaacactataccacatataacttattatttttgtgcacctgtataagtacttctgtaggataaattcacagaagtagaactgctggattaaaaagcctgaatatttaaaagttaacatatatgtattaccaaattactttaagagagactactctgggacttccctggtgctctagtggctgagatgctcccaatgcagggggccagggtttaatccctggttagtgaactagatcccacatttgttgtttttgtttagtccctaagtcacgtctgactctttgtgacccccaaggatggtagcctgtcaggctcctctgtccatgggatttcccaggtaagaatactggagtaggttgccatttccttctccaggagatcccacatgccacagctaaagatcctgtgcagctggacctcatgcagcaaaaaagaaaaccaaaaccactacaatttacatggctacgagtatatggggcttcaccagtactcagggtaaaaaatccacctgcaaagcat

SEQ ID NO: 28570 - DNA, 1832 bp, Bovine  19866880801445
ccactcagctcccacctccccaactgttaggtgagccagaatggggttattaaaatccaggcctgctacacccctggcactgcgattaacttttcatgtctcttccacctcccaggttaccccaccccaggaggagagaagctccagggagcccgccgctgtccccccgcggccactgcccccctgccccagccaagccaatgcacccagaaaataagttgaccaatcatggcaagacagggaatggcggggcccaatctcagcaccagaatgtgaaccaaggacccacctgcaacctgggctcgaagggcgtgggggcggggaaccatggggccaaggccaaccagatctcacctagcaactcaagtctgaagaacccccaggcaggggtaccccctttcagctcgctcaagggcaaggtgaagagggaacggagcgtgtctgtggactccggagagcagcgagaggctgggaccccatccctggattcagaggccaaaggtaccacatttcctgatccctaagaccccagcatcgtccatcgtcctagacacacagaggctgggagagcatctttctgcacccctggcctaatcctcacttgccattcctctccggcacttatgcaggggcagcctctttcgctatcctccccacccccattatgcccattctcacccatctgctcattctcaggactgggtggagatgtctcatccttagggccacacagggtgatggggcctctcctcaggcctctcttgctttcccaccatagcccccagagggggaacaggaggtgctctggggtgaggcgcagacccacacacctcccaggaacctcctggtgttccagctggtgggagcaggcactggggcctggaagagtagcagcagcttcccccctcccccccccccagccctaattagaaccagttgtggttggggattacgttgggcttggtgctgggtgggggaggggagacaggcagcagggctgtagagagaaatcagaaacaaatggtgttgtggtgggggtcaagggctggcaaagtgcccactgtggcctgggcagtgccccctgggcactgggcactggggcatctgggggaatgggcttggggaggccccaggtgtgggaggacgggccctcctggggactcgctcactcactctgacccctgcctgcctgcctgggcagaggtggcaccccggagtaagcggcgctgtgtgctggagcggaagcagccgtacagcggggacgaatggtgctcaggcccagacagcgaggaggacgacaagccccttggggccgcccacagtgagtgcccatgctgccaggatgctgtgcctcatggtgtccctggggaacagttgccctgagggagcctcctctcttcacctagggctttcaaggacccaggctgggccaaaaggagcaagggatcaggagcctgggctcctcctctcccatctcccatttctgactcagtccctcccggcactgacagttcaatccctgccttccaggtgctcagtagccccctgtccttagggacctgggtggggtaggtggaaccttagatggcctctcaagccacactgggaggcctcctcccgtgaattcctggcctctgctgccacctactggtcagtagaggaagggcagtgagggttcagcatccctgggagctggacagctggctggaccctgcaaaactgtgcggaagaagcctgggtgtgagctgacattgactgtgtctctggtgcccttccctaacctctaattgatttctggagtgcatcaccaagacgaagagtgagtgtgggtg

SEQ ID NO: 28571 - DNA, 1257 bp, Bovine  19866880825063
atgacagcagtgaccggagaagcagaaggtattcggtgtcggagagaagtttcggatccagaaccacgaaaaaattatccactctgcaaagtgccccccagcagcagacctcttcctcgccccctccacccctgctgacaccaccgcccccactgcagccagcctccagtatctctgaccacacaccttggctcatgcctccaaccatccccttggcatcaccatttttgcctacttccgccgctcccatgcaagggaagcgaaaatctattttgcgggaaccgacgtttaggtggacttctctaaagcactctaggtcagagccacagtacttttcctcagcaaagtatgccaaagaaggtcttattcgcaaaccaatctttgataatttccgcccccctccactcactcctgaggatgtcggcttcgcgtccgggttttctacgtctggtcctgctgcttcagcccgattgttttcacctctccattctggaacaaggttcgatatgcacaaaaggagcccgcttctgagagcgccgaggtttactccgagtgaggctcactctaggatatttgagtctgtaaccttgcctagtaatcgaacttctgctggcacatcttcttcaggagtatctaacaggaaaaggaaaagaaaggtgtttagccctattcgatccgaaccaagatctccttctcactctatgaggacaagaagtggaaggcttagcacttctgagctgtcacctctcaccccaccgtcttctgtctcctcctcattaagcatttctgttggtcctcttgccactagtgccttaaacccaacttttacttttccttctcattccctgactcagtctggggaatctgcagagaaaaaccagagaccaaggaagcagaccagtgctccagcagagccattttcatccagtagtcccactcctctcttcccttggttcaccccaggctcccagactgaacgagggagaaataaagacaaggcccccgaggagctgtccaaagagcgagatgctgacaagagtgtggagaaggacaagagtagagagagagaccgggagagagaaaaggagaataagcgggagtccaagaaagagaaaaggaaaaagggatcagaaattcagagtagctcggctttgtatcctatgggtagagtttccaaagagaaggctgttggtgaagatgtggccacttcatcttctgccaaaaaagcaaccgggcggaagaagtcttcatcactcg

SEQ ID NO: 28572 - DNA, 742 bp, Bovine  19866880839913
tttgtcctcaaggggacactggccggctgtgtggattcccctggctcaaagggcagggagatgggacagaggggtttggatctgtggggtagggtgtcccctcctaggtccttacagtgagaaagggagagacacggctgctttgggggtgtggggtgaggccggggagctggaggtcctcccctcacggtcctccttgcagctcccctgccaaggccgaggcagggacccaagcggggctcgcacccttcttcccttccctgcgggcatgcgcacccagtctggagtagaagctgctcatgagcccctccgcctggcacaagaaggcattgaggtcaaccggcaccagcttgctggttcggatgctgctgagcgaactggggttcgggccgcccacgagccagcgtgaggagaagtcccagccagactcggcgctggccttgagctcggccagcagagtgtcccggttccctgtgaggagagggcagcgacagacagcaggctggggcctgacgcacggcccaggcccacgctcagcccctcccttcctgctgctcaccttccagcaaggtggcggccagctctgcgtctttgctgtaagactctggcctggtgggaggagagtgggggggggcgtggcactgcggctctaaaccctccatgctcttgcaggaggcccagccacgctggctcagctgtcctggggccccagacggcccagggctatcagctcatcatctga

SEQ ID NO: 28573 - DNA, 1153 bp, Bovine  19866880852265
aacattcctactctcttggtctaaaaatgtcttttagcttctgtctatagcaatgcagttaaatctttttagcttggtcatgaaatcaccaaatattaaaaggaatgatagacagcactgtagatttttccaggagataggtaatcatttgttactattttgtgcttttttgtatataagattatttgcttttgagcatgtgttatttttataattagaagagctaaaaaactgggaggaagtacataataattaagagtgattcattctcagtggtagaactaagagtggtttatttccttcttttcacttctctgtattatttgagttttctccaatttggcttcaacattctttctccccaggcttatttcctgccagtttccataccccttcccccagctaccccatgttctagccatgtggagcttcccactgttcttagttgtttcacagctctgtaccttcacagttatttcctctataaaagggattcctttgcttgataaacccaacacatttttcaagactcaactatgaagacctccaccttctgcagaattcatcatttactcccttctctggattcctagccctagaccgtattatgatgatctgttaacatatctgcctccttttggagcctttgagttcaaaaaggacagggactgtcctttattcattttcctaagaatgaatgaatgagtgaatatccaagtctgccaaattcagagagaaggtctcagtaaagcataacatctaaaactatcagtttttaaaagtctgccttttaaaaatttataatggcttttctttttgccttatcttctttgagaatgagggacctttgtggaaaaggatatggaagtgaaggccttatgttacacacacacagttttgagaagaccagctcccccctacctctcatgtgtacatttttaatttttcgttcttcatcattcaactccttcagggcacagtaagtaggattaaaggtgaggagccgagaggatctgggtttgcaaaatggctggcatagcttcaggagagcagcacccagattcagaaagaaggcatccgaggcatacatttggaagaagatttctggcatctgattggcccaaatcttggtgcggcctgcgtttgcatgcaa

SEQ ID NO: 28574 - DNA, 1867 bp, Bovine  19866880859368
actgatatggactcaattaggtccatattagacagcccaaggccttgaggcagcaagagaatgaaccatttatactctctgagatccatgagctacacttgcatgaaaacctgaattttaaaatcctattccagtacctgtgctctcaaccatatctttgctccctctggacagtaagggggtgagaggaagaggttgggcattggaatagagccaagtccctgctccccgcttctcagctgctcaaactagggatctccactttccagagctttgacaagctggagacagttttctcaaaaggttgtgctgggactcagatgtagctcaatgagcaggagtttccttcccaacaatctacatgaggtttctacagaatgtcttttacagaaaaagcacactagattttgacattttgtggtcttcctcagattcctttggatgagggtgatgagcttgcattctcaggaaaggcagatctcgctcagagatgtatgggtttgcacccacccagcttatgatgcaacctcctggggaaaccccacaggtgtcctgtaccaatcccatttcccttcacaaaactcactgtctacgttccacttgatgctccgaggaggaagtttcagggtttcattgatcttctccaggacagtctgcagcttttgcttctgggcaatctctgactgggtgacctcagcgacgttcagcttctcactctcgagtttctctggggcgacaagggaaagagaacagctattacttttgctacacaccaccctaagccatgcactcacaccttcactcattcactcactcaccaaatacatactgacacctagtaagagggttgctgctgtcccttcctcagctgatggtggcactgtgctgctggtatgtattgtgaagacctagggattgtgtcttgaaaccccaaaatgataaggccttaggaccatgagtgagtgagtgaaagtcactcagtcatgtctgactcttgtaaccccatggactatatacatatacagtccatggaattctccaggccagaatactggagtgggtagcctttcccttctccagagaatccaggaccataggtgggcatttaacccagtttatcatatttgagctatttcccctcatatctggggtttaccctcttttttcatgtctgccttcttctccagggacattcctgtgccccgactggaaagccttccgtgcttcccccgggcagtggtcaagtcctaattcaaggtgttctgaatactctcgtagcgcagtacaatatgaatcatatttatgtctcaataaccttctttccttttaaacccacttggaagataactaattggatgtgtcctatttaatcaactctaacgcacacatcctttcacattttaacatccctgaaatcaggctgtcttaaaactgatgggaccctacaactgctgacagccagatggaagctgtaagatttaccactgcgtctatgtggatgaacttggtcataactcttcacagtgtgggcacgtccatgtctcagtaagcctacaagatgctgtacagcagaaattaacaaaacattgtaaatcaactatacttcagtaaatttaaagaaagcctacatgagcaatttcaaaaagtagaacataaaaattccaagtcataagaaagcatcaggtaatagtttaattgaaggttttttttttctctttgagtggtacttatcctggtatcttttaaaatcaatggttcaggtatgcaatgacataaccccttaatagttcctcccctcatcccccttcccgccctcagaggtgtcatctcaccccagacagagccatccacctcctctctgtaccca

SEQ ID NO: 28575 - DNA, 1609 bp, Bovine  19866880876302
aacgtaacaagtatgtcacaatacaatgtgataaatgttttcacagagttaaaatcaaactgttgcagcagcaaaggggagagagagattagtttaccctgaaagagtcagggaaattcaagagaaggagaagctgcagcagggtcttggaagataaggaagagttttccaggcaaacaagggaaggagggaggggaatccaggtgagagggaaagcacattgaaaaaaaatttttttaatatctaaatagggcttccttggtggtctagtggttaagaatctgccttgcaatgccagggacaccagttcagtccctggtctgggaagatcccacatgctgtgaggcaactaggcccatgtgctacaactactgagcctacgctctagagcccatgctctgcaatagcagaagccaccacagtgagaagcccgtgcaccaccactggagagtagcccccgctggctgcaactagagaaagcctgtgcacagcaacaaagacccagagcaaccaaataaataaatagttatttttaaagatctaaatgagtatactgggtttggagaaggaaacagctcactggaaccaatgagaagaaatagcaagaaacaatgtggttcaggcttagatcataaggaggtcttattagaccatacttagaaatagacattttagttattttttaccaagagttctttgccttgtgggaggccacagattcctttaaaggggactcttactcccattatataaatgtgtacatgcatacacacacacagagaaagattttagactctctcaaagtcagatttttctcccaaggttccaagcccctgaaattgacaatggagaatcaacagagttttatgtagacttttgctaccttttttttttttttttttagtggatttgttcttagggaaaatactggatcacacctgctcacctgcttttgataatcagaatccagttaacctctttggagcatttgctgaccaagaatagtgctcgcttatttaaattatgttgccctccatggctgttctacagcctctctcactgctcaggcatttctgtcagcttggtgccaaaacaaggaaaaggaaaaaataattgacttggtgatctcctgttcatttggaaagaattagagattcatttcagaatttaccctctgaaccacagcactgtacaatcttatttccaaaaaaaagagactaggaccatgctattaactcctctatctctttctctccaaattaatatccacaaatttccctttcagcagaactgaggtcagcctggaagaaaggaaggcatggatgcagaggtctggtgctgtccagaaagcacggctctgaagagggttgacggctcaggactgcaactggacttactcatctgaaacctcaatagacgacttcttatagccagacttgctcctcttcttcagccccgcagacttccttcccattcgcaccagtagcagaataaccactacagttgagggaatgaagacaagaatggaaagaagggccacagaggacagcatcgtgccaaaacctgaaggaggaaaagagaaggtaaaagaggatgtgcaaagtgcttc

SEQ ID NO: 28576 - DNA, 1776 bp, Bovine  19866880922710
ccagaggaggaaggaaaagggttaggcccagtcagtctccctccctccacctgctgaggacagagtagagaaagtgtttggctcagagcagggcctctgcgtctctgcctcctccgcggttcactggcacggtccctctgcccagagctcggggctccctgcccgcccaggcacagccactgccttccagtcagcccccggccctttcccagaagagctccctcctcctctggtcagagctgaagccatacacagttgggtgttttgcccccaccttggccccaggagtaaaacacttctccttttctcacttcctttcttgccttgtgaggtggcggggcagttccctggctgaggccttccgtgcccgcctccaggacccagggccatttctcggcgaggggtcttctgcctgtccctggccttcctgacctgagggggcctggtctcccgtcggcagctgtgatacaaagggaatttgtcttcgcttctcccagtctggtgctgtcctcagtcccccgtcggccaggtcaagcgcttcctccggggctggctgtgggctcctgcctcccccagcccctccccggggaccagggcctggggctctgggttcagggaccacctgccctccgccccgccagacgtgttccctccctgtgtccaacctgggccccgtgcccttgagcctcccacccctgacccaagactccccaagctgactcttaagtgtttcctgcccagaggagagacgggtcaaactgaaaagggcctgacgccctccccctgcccctctcgtcccacctctgccaccagactagctttccgaggtgaactccacaggccagcttccctccatccgtggccacacccccagccattttgtaccattatataaatatatatatataaatataaatatataaatacaatatgtgaagacatcttcgtttttattttgagacaatttttaggcttgttccggggctctctgtgctgcctgtactgtattgacctgttttataggtgcctttttattaaaaagacaaaattaaacatctagtttcttgctttcttctttcatgtctggctcctccattgcccagcttcctactggaggctgggaggaacaggggaccccagggttctccagtgttccatggtgaagacaagagtcccctgggtcatagatctaatattccctgcagagaggcttcttaaggacctccgctgacgggcttgagtgggcctgagcaaccaacgtgtgccctcggcaagtgcgggagtccctgatgtcccattctggtcagaccagaggccagggtggcaggcaagggggcaggagcaggactggcacggagcagcttcctccggttccatatgagtagtaccctctcgggacagggctcagcttcctggagcctgaggacttccttgcccaggcctgcttgtcacactgcccagcccaagggggtgctcctcggctctcgctgaggcacagaaagatggcccggcctgcaggcagggggctggatgcgatgacccccagggactctaagtctgtctcctcaggaggtcttgccccactcttggctaagtgccccctctgctgcggctccaggggtctccctggcactgtagcttgtggggagaggggtgggggggacgtatctatctccttccccatcggctcccacacccaccagggccctgggtcatactgggagctctctgccctgggcagagaagacagctggctttggtgaagatgtgtgcctc

SEQ ID NO: 28577 - DNA, 1092 bp, Bovine  19866880974564
gcgagatgaaactgatttttgataatctgaccagacgttcctttcttaaattgagacacagttttcaagacagcagtattgcaactgaggctaaaaggtgtcagtcccttcctaagcacatgacctggtaatgtatctgtcctacccactccttacttgttgcctgatctgcctaattgctgcgatctctgtgtaattatcacttgtgagggtgctctgttgcccaaccctctttccctgggcatgtatttattaaggacttgtttaatgagaaggcaattaagcagagggtgtttagtcccactcagaggaaggaaaaggaaagggtaaataagcggttcatggcaaagaagatgggaaagcagggaagaggagaaagatcccagggttggggattcattctttttttggacgtgcaggcttgtggggtcccaagtcattatggctgctgtggcgggtgggaccagcatgttaggtagaccccaggcacagattctcccaccttgccccgctgctgagggtgtaaggatctctgcagaagccacacccattccatggcctgcaagaggagggatgggcacactgcttggaattgtttgcaaagctggttttgttgagcatccagcgctgtctcaggggcatgtttctatcctggcaaagctcctgggggtgggcaggaagccggcaggttgcctagggagagggagctgaaatctttcctctgtctttgggcccaggggccttgcctggctcagccctgcctcccacagcccccagggcctgcaccccaggaggggtcttgtcctgctggcctcggcccactttctccctcccagctcttactttgaacctgactcccctggggccagtgtatcagcttctctattaaagtcagccgagattctgcctgccttgccaggcaagcccggggagctaaacttagagtgtgctccacgctgcccctctttcctcctctcggcctaagttgggtatcactgtacccggatatgggaaaaggtggcagaagatttctgccttggcatttgacttggaacgtctgatggtagatatgagatcccccttggtgtattt

SEQ ID NO: 28578 - DNA, 950 bp, Bovine  19866880993965
ttctaatttgtaaatcttaaattaggcatcaggttatgttaacttaaaaataaatgttctggaagaattagaaattgatatatcaaaaaacaagtttaaattcactattttaattgctaccacactctacttcacaaaaggaacaaaatttagtgattaaacttctcaaaaaacttccacaaagaacatctccttccttttcctcacctgatcttccaatacgatggagataggtctctgccagctttgggaagtcaaagtttattaccacattcacagcttgtatatcaatacctcgggtaaacaaatctttaaaacaaacaaacaaaaaaaacctccattatatccttcaatttggtgtcataatactctttaacatttatttctaaaggaacctaagcttcactcacttcatgcagtaattcaaaaggatctgtaaattactggcattatttctcatgtgcattaaccataagcagctttctgttcacaagttaccttttcgcggtgttgtatcaaagttttaaaaaatggtctgaggtaacatagtgcaaatcaaggaaggctgaaaaagattatacactcaaaaatgagctcccaagtataattttcttcactctatttttaagtatttaattcaaggttaataagttatttttaaagttcattgcataatggagaatactttaaaaaagaggcaatctaccagcagtaatttatactttgttcagatttctttaatcccattctgctgaatgatttataacaggtctgaggtaagctaatatgcaagactatcccttctacttttttccagtcccacaattattatgctaatttaggctttgacaaatacacgcagacacaactccaataagttcaataagctaataactaggtttccctgcacttctcagctccacacgtcaaaataatccagaggtcagaca

SEQ ID NO: 28579 - DNA, 1662 bp, Bovine  19866880996722
cttcttactcctgatctgtgtccatgttcgtcatgggttggtgagggtctgccccgtgtcgattctttctctgcttcagagcatgcctttctggaatgctgctggctgcagtggcagaaggtaaagagaagtgtgattgggtttgcactgggttaaattccccagctggagtctgtccccaagtcactagcgggcctgttcagccagtcacctggccgcacccaaccacaaagccaggagacccgtcctgctcagcgccggggggggggaaagggccggaagtgtgtggtgctggagtcatgcagcctggagcacccggctttccccctgaactggtccccagacaaatgccgtctcttccaggaagccctccccgcccacctgggcccttgggtgtggggaggcatacgggtgtccccatgtttccacctaggctggaaacggactttgtcaggcctgggaggacaattccatcttaggcatgttgaggttgaagtgcccctggggcatctaaggttatatgagaagggtcagggttagaggcagagtaaaagtcgaagctgttgcaatagtaatgatgatgatggtagcagatcatacttattgcacacgtgtttacaccagatgctgtgctcagccctccatgtgtatcgtctcatttagtcgtcatcataatcttgtgaaggaagcactggttttacacctgttttgcagatgaggaaaattaagcacagagaggttaagcaacttgcctaaggtctctcagcagctgagaggcagaggttaagactgagcttggacagttagacttcagagaagagggagaaacagagccgcacctcagggcagggccacccttgtgagggagaaggaaaaggaggctgcggtaaagcagggtgcaggaggcgggaagtcacaggccaggtgctgagctggcgcttggcatgtgtgaccttccttcatgtctatgaaaccaacgggggaggggagggcagggcggaaatggagaaggcagaggagtggatgtgtgcctgccagcagggggtgtcatggaataaaaaagtataatttacagaagaaactgagacattacggtgatgatggacgccgcagaaaggccaagggtaatgtgcacccaaaggccatttgattcaacgattggatcttgatgagagaatggtttccactgcgtgctggggcacgagccagattgcacacaacccatcgaggataggtgggcggtgaggaagcggaggcaggaatgtgttactatttccagtgaaggaagagccaggagagaacagaatgctgccgttctccctggccttccttgatcctgctccctcctcctccgtgaaacccacattagaacgcacctctgtgaagccccacctcactgggagtggttcctgccctcctctgggtaactcctgcgttacacagggtccctctgccatgtgacaccagccctgggcataatgatgtcatgacagatccacgtgtgtcgtgccagacaccgtgctgaacccttggagtgtgtcctctcgcttaacgcccgtgaccaccggtgacctgtaggtgttcccttggagtcctgatcacacccaagtcacacagcgaagtgggtgtgtgtctgtgctttcttcccccctaaatcgtggg

SEQ ID NO: 28580 - DNA, 1064 bp, Bovine  19866881030933
gcttgcaggcctctgtcatgtccggcaggaaacagaaggcagagtcagctaagactttaaaaagtgtatggaccacttttcagagggacttttctcagggtcagggtcaggtctaactcttatctgtctttctcagggtcagatccccaacgaaggcacaaagtctttaccactccagtcctgaggggcaaagagaggaaatggtgttactgcagcctggtaagaggtggatgtgtggcccatttgacagaagctgtatccacagccactatcaaccatggcaccatgacagggagggagtatggaagaaaaatgtctttctcctcctgccttccaatctcctgccaatgcctcccattgaccaaatctaattggaagccagaggacgggagcctggatgatgtagtttataggttagctttccggggagtaggaaaaacagagaagaaaagtgaatggatttggtgagagaacagcaaattaagaataaatagaccctacttactcccagcttccctggtggctcagaggttaaacgtctgcctgcaatgtgggaaacctgggttcaatccctcggttgggaagatcccgtggagaaggaaatggcaacccactctagtattcttgcctggagaatcccatggatggaggagcctggtgggctacagtccacagggtcgcaaagagtcggacacgactgagctacttaactttcacttttcactttaactttcactcccagctctggatggtgcctcagactggcctaaaccaatcattacatccagaggtgtgctggtgaaaaactaaaaatagaaaacccaagtgtgtagggtttcacaatttctgtggtacagatactcccaccatggccattttcaagctacaaatggcaaagtctgtgaatgcgagttaggaagacacatgcatgatcaactcttgaaagccagtaggaactagatccagcacaccatcctcctgaccacagagatatacctggggtcaacatggcatttaggttaatctaatcaaatttgttggaaaattacttataccgccatccc

SEQ ID NO: 28581 - DNA, 715 bp, Bovine  19866881111833
ctctctgccccgggactacggctctgctgtgccttccccctgggctccctgttcttccgtgaccttaattaagaactttggtggctctgctggaacactgtcactgttttctctgttgtgcagggaacccagcactgtggccaggatggcagagtctccctgtcatctcagagaagtgccagcaggggcctggggcaaagcagtctgcccagacctcacctcccttcctccttttgcccgtgaacaagatacagtggcccaaggggttccactggtgtctggtttcctttattattgcactgtgtgaggtttttttgtatatccttttattcctttttctttttcttttttttttaaagaaaaaaaaaaaaaccttaagctgcatttgttactgaaatgattaatgcactgacgggtcatgaattcaccttgaggaagacccaaaggccagtcgggagtgggggaaactcagctcagtagacctagtgactgccctgctaggccgtgctgtactgtgagccccctcctcatctctttctaccaaccccaaaccctgaggccaggggaggaaccccccgcttccttctcctgccagctgcagatggtttgccttgcctttccactccctaactgtcaaccacagaaatgaggagttcctcctagatctcagccttgagtccattgccaaaattcagcgtacctgccagcaacttgg

SEQ ID NO: 28582 - DNA, 1155 bp, Bovine  19866881123452
ccagcctgggagttggaattggatggaggggtgaaatgctgtcttgccttcagctagagctttaaaatgctgtgaggagaaaggagagggaatatggaggatttggggatatgctagttatgacactttattaagaactaacctctgcatagggcttcccaggtgactctagtggtaaagaacctgcctgccaatgcaggagatgtaagagacatgggtttgatccctgggtcgggaagatcccctggaagagggcatagcaacccatctagtattcttgcctggagaaccccatagccagaggagccttgtgggctacagtccatggggtcgcaaagagctggacacaactaaagcaacttagcacatacaacctctttacaactctttaagctccattcttctcccaattctacttctaaaacaattccttggtattgtctttgaaaagtagctagaaatgtgccctgcctccttcaaacatgaaccccctttttcctatgcttcctgcttccattcattaggccacttaattctgtaagactgagtgtccactgtagatcctcacctaccctaaggcccacatgggttctatttccccttcctttacaagccccatccctgcctgcttcacagttccctccgttacggggagggcaatgataactccaggcagagacctcctccattgtcacaggcagaatcacagcaggttgaggacactggcggcagcagtcactacagctgaagtcaatctctagtgctggtcttacctgtgagttcttgaattccgagtagagggaaaagagcagatggagggactgaattcgactcttgtagacagggatgtctaggatagctgaaatcgagaactcccatgagcagaaacaaaaatctgggaatatggggcatttctgtttaggtggctagtcccttcccagatggaatgtgttactgtaactctaggggttaaatacccagcaggtagtcacaaaaacccaaacaccaccctcaagtgctgccaaacagcataactggcttaaagaaaaggctgtaattcagagtaaaaaagccttttcaacagcccacagtgaatttatccaaagacggggcggccaagaaagggacgggagggcttaccacagaatcatatca

SEQ ID NO: 28583 - DNA, 1816 bp, Bovine  19866881149691
cctgaccttctgtgcaggcagaagtgtcttcagtcagacttgggaactgcaagtggtgggagaattgagtgaattgcttctcctggttttcatcattttgggtaagcgcctgctttgtatttcttaagcagtgacttgaacttttctcactcggaataaagctggttctgaaggttttcatttaaaggccatccttttgggctgtgaggcaatcccagaactgtgagcctctgcaggaggactgccataaggtagtctagtgggtccagttttcctttctgcagtgtagagtaacctgtattaagatcctcagagaaaaaaccagtaaggtttgctcttaataaaagaataaatgatgatgatgatggtgataagctttagcttttaagttgcctgtgtctttaagatagagctgtggctggctgttccttggactcatggcagaactcttcctgaactgtttcttttctcccaatcctacacaggccaatatttaaccttaagaagtcaggaacttaaacctcccaagagggctaggctgttgttcatgcttgcctcaccatctgcatggctggatctcagggaagataaagtaggatggtttagatagaagctggtctaaaggagagagcaggaataatgactgcctgattgagggaaggtggtgaggttatcggtgagctcagtggtcacttgtccttactaggggcaaacacttgactgagagagagtgcctctccgttattttgtcctgtaatattgtaatattgagggggtcatttccacatcctctgtggtcatctcattgccgtgaacctcttttctgaagattttttttttttctgttataattgtgccaaagacaacaattcccttacacttttaataatagaaaaggaggtcctgatagttacaactccccaggggtgatagaagatacttgccaagagttatattgtgaaagaaccataagcttagctccaaacatttgaccaacacatgagataacttactatgcagaattacctcaagaacatgcttgtgagaagataaatcagcatctgggaaggaagctggcagagtcgaagattcagatggagtccatcaaggtgcttaaggttcatctgagtgcttttgttagattttttagagactgagattcatatatgtattctgaattattcatctgaataataaaattctgaactatatgtgtgtgtgtatatatatatatatatgtatatataagattacccgtctactattatttatctatctgtattacatggtaggaatttctgaatatctgccaactaactaggaaacttgaaacttgactcaagtcatgttcttggcccatttaagtgtttattaattcatctgatcagtggtccctggactttcactctgggtcttactctgtgatggtgctggagatgcactggccaataggcatggctcttggcctcatgaagcttatagtcttgggggttgaggggtggagtacaagcctttaatcaaacaagcacttaagcgaatatgtaattagaaattgtgacaagtgccctaaaagaaagagaaataacagtactattaaaacatgtggctaggatgtgtcctggatagggtggtttgggagaggtttctttgaggaaattacatttaatttgagatctgaaagatgaacaggagttaactaggggcaggaggtgagaagaatagtcagtcagggggatcagattaatcttgttttgttaaatgaagttcaggaaagcttgctctaaaacactatactttcacagcaggaggagacgtc

SEQ ID NO: 28584 - DNA, 1187 bp, Bovine  19866881167732
cccatgaatgctgccgggggactgcagctacaaacaccctcagaagtctgcatgagctttgtgggtacccaagtgctgtcagtaaccagttgtagaaatccttaggagattgcaatggtgacgcccagatgaggcacaacccaatgccagccccattccttagcaggtatacacacacagccacaacatatacatgctcggtcccttccacctacccctggagaatcttccagtctcatgtccagcaaagcagtagacacccaaagcaaggagcacagtggcaatgatgtcggtgatgatcatgcctgccagggtggctgtgtccagctccacacagttctggcacactgtgggggaagggaggccagaagagaaggggagggtcttcaagatcagggaaccatgcctcttagggcagccctaggagcgctcatgtcaagatccaaacttggaaaaagagccttgctccatccacttttaaccttcagtccaagaagtagtctcaggtttgtaggaactttaaaaaggcagtaggccaaccacgctgcagaccaagcccctactgcttgggtcacaagactactattgctcttttaccattaagctctttcccactcaaggcttcaaaatctggttcatatccttacaagagcaagccagtttgttgagagcacagatgggtacactggagctccctccagcaaggaagttcccatgtccagaagcccccacctattccacccccaaaggatcctggaagcacatacttcgatagtatacttgcagaataagttgttgggtgttttcaccacactgatacattcctcttgggtcctggatacgttttcctaagtcccgagttttattattgcctgacacctcttgtccttctgttccttgtagcaatgtgatgctggaattgcattccaacattactttgtcctcaggttccagcacttttagaatgcggggattcactaagaaaaaaaaaaaaaaaataccacgactggagccagctctttagtctgcaccagaccactgttctgctgaggctcattacttaagaaggaccactatccaagtctagaacagttcgaggtttctgctgagagagacggaagtcacaagagaaaggcttcagcaggcaccccacaaactgccgaggccaagaaggacacagagggggg

SEQ ID NO: 28585 - DNA, 913 bp, Bovine  19866881198292
aaatggggtaataatacttacctacttcacaggactgtaagacttggaaagttttggtttaaaaatgtctttttggcttggaaagggatttaggagttcaggtatcaaagttggagggagtgttccaagtctatcctgtcctctgcgtcctatccctatagtgcacacactcacacacacacacacatacacacattctcactcttttctgtctctctcttcccacccaccccctgcccttagaattattttagcttttgtaatgttagaaaccttggctctgatgcttaaagcttcttgtccatggcttttgtttggtagttttccatagaggtgattggaactgtagagggggacactttagattgctccaaggcctgaggactcatggctactgccgtttaatgagcgtgagggctaaggatgttcaactcagtccccacaacaaagactgtcctgccccaaggctgggattatacccatggagaagctctggcatgaacttgcagtggaagatgtgtgggcaaagccatcttcccaagcagaccctcagcgcgtgcaggtctctgagagggatcttcaggggctggtgagggtgttttcagggtgtgtgggctagagagcattcacagtattgaacttgggagcccaggacacatgcagtttctctgacactaaagtcaggagaccacaatcaaagtctttcccactcccccttccttgacccccaagtaggacctgagcattccaagccttgggattctcctgatgtaggaattgtgcagaaggcagccagaacgagcctggagaggtctgggaggacagctggtggagctcagactttcacatctggctggctgcccacagctggatgcaaagggaggggtgtaagagcaagctcctgagatggagg

SEQ ID NO: 28586 - DNA, 1935 bp, Bovine  19866881224347
gggtcgcaaagagttggacacgactgagtgactgaactgaactgactgacaaaacaaagcctactgtgaatcttcaagattaatctaacctgtaaatttccagttaaactagtgatattcaaatcctgttatctgattagtttgatagaatcctgactgagcacataactgcaacatagcataatgcaaactttaagggtccaataattccagcttgggtgtgtttgctgatttcctgactagcctcacaaaaagcagcatcatatgagaactgctgtttgcatttcaggtttctacccctagaaaatccccattgtttattctgtcctacttttggccaaggaagaagagtcatataaagccagccatagtttcctgcccactcaaaataaagtgacctattttaagtctaaagaaaaagggactgcaaatacagccttgcttccctcactggagccaccgtcactacaacaccctaccgggacacctactgtagctactgggagatgctacctggcattcaataatggctcctaaaacaaaatccaaagcttacacattaaaatcaaagagaaagtacttccagtgaaggaaataggataacaaatgaaggatactttcaaaaacacaatcttacataccgctatgacattcacattcttaataaaatgtatcctgacctaggatgttgctgaaagcatacggagaaagtattttttaatagcattgcaatcttcaattagacatcccacaatggatttgagccataaacgtgttttatatgtgtgattaaaatatattgcttctaatatttcaagaccaaatgtcaccaacagcatctgtcatcaacataaggtgccaccacttccttcaaagggagctatgtaaatcaatgcagatgtttatacactggagaagatgccaagataaatctacacagtaccgatatgcaaacagatacacccacagagatgacctcacatgacaggaaatgagcagtattaagtgaaaggatgtctaagactgggacctgtagaatttttctatccaacagcctggaggtaccctttttgtacaacaaatctgaaactcaagctatgaagccaagcaaaatgaaacaacaaaggggaaacaaaattaaaccacatttcctctgagtttctgactggttttttcctatagcatatttgcaagattcttatgtagaagaaaaagccctccatgaccaaaaatggctgtcatacagagtagaagctcatctccttctatttaatagaagctcatcttctatttgaagatgagaaggcctaaagtatgcctgtgacttagaataaaagggttccagagttgctgacaacagaaagctcaaggaaagagccttaaagtatacacttactgggatttccctggtggtctagtagttaagaatccaccttgcaacgcaggggacgtgggttctatccctggttgggaaactaagaccccacgtgctgtgaggcaactaagaccacgtgccacaactaaagagcccatgtgagtcaacacagccaaataaatgaatgctgtaaaaattaaagtgtacacttactgattctgtgcgactgctgctcggaggccggtatgtccagtctatggtgagtttgtctgtgatagaagaggatgacttgaaggtgcatctcaacttgatattttctccaacataaccccggacgtgggcatccgctttaatctccagggaaaagatgacataaacacctaatcaaagcaagcccaaactttaaaaatgtgtgcattggatggaatacatagatgtaagtgaacaacacagaagcagtaggtatcatttttaggtctctcatcaaaaagccatgggaataaacatcttctcaggcaggcccaaaaggatagggtagtagatatctacattaattaaca

SEQ ID NO: 28587 - DNA, 993 bp, Bovine  19866881231466
ttgtaccttggccatgaccttaatcctcacctaaagtttccatcccatctacggataaaatttgttcttatttagaccaactgaattctagtcttgtgtgttaagatgggttagcattggtgactgaaaggaatcctaaaccaatttcagaccatttagttaggttttaagcatgtctcaagaaaagatagacatctcagtgggaggataacattgttcagttttaccctctttctgcctgtagttaaaaaaataaaaattatatgataatgttaagtctagtgaattttttcaaagtagttctggagacaagcaaaatgtttttaatactaggaacttcagccttgataatacacagaagatattaaaagatgataaaatgagaagggttttggaatttagcagcattcaactgcatggatttaaagtcatttaagtgagactcggtaggtccactgacttacctaaagacctcaaagacttttatattacgtgatccccttggctcttacaacttcacaagaggttaggtttatgggatagagaagagaatccagtgtttggtaggtatgcaagttgagattcaaagaaactgttatgcacctctgttcacacgcaagtcttcaagaaaagaggaatgacttatctactacattcagaaaaaaatagaaactatctagcacagacgccttcagtttcctccccctcttcagctgatctatttctaattatactcttccctcctttctcctcctggaggagaacatttaaaacattctgtccgaaacgatctttctacctttgcgcttgatgctctgcctttccacgcttcagctgaagagacccacccattccccattttcagttgtttcatttatttgttcaacaaacatgtattacactcttgtcattaagtgcttgagataccgaaaataaaagacacatttcctaccttcaaagagctcaaagggaagcggtagcaaaataaacaat

SEQ ID NO: 28588 - DNA, 1934 bp, Bovine  19866881236292
ttctccctccacccatggtgcttgatgaaggtgcctctgaaaacatcaggactgaggttacggactgcctgggagggtgtgccctgcctctaggagtcctggtagggctgggaaggaaggatggggcggtagcctctgtgcaagactcaccaggacagcaggcagcttcccccggcgccgcacatacagctggaaggtcagacagaaggccagggctccatagagcagcaggacgaaggtgagaaagatgctgatgttggtcactgtgaaatctgtggggtccagagagatgggtttgtaggccgtgggatgtggaggggcgtccccgtggcccctctcaggggcccctcggtgagtggccgagtaaccacccctccggcccctcaggctacctctaggccacagctcccgaggccacagctgcattcttgttttcactgtggcatgcagaacctagtttcctgaccacggattgaacctaggccccctgcactgggagtggtccctggattcttgggaatccctgcctggctttccaccctccacgctgaaggatccctcactaaacacatggaccctgccgccagtctttgcagagaactcacacgatggcacacagagctgaggcgcaggatggtgcaacaggtaagaaggggggctctgggagcggccagacctgggttccgatcccaggtctatcacttactagctgtgaggccgtggacaaattactcagtctccctgagccttagtttcaccatctacaaaatggcacaataagagtgcctccctcacaggtggctgtgaagttccaagcccttgaaaacagcaccccccgccccaatctgtggtttcagtgacctgtggtccaaaaacgttacatggacgatttccagaaataaataattgataagttaaatcatgtgccattctgagtaacagtgaaatctcatgctgtcccactctatcactctgtcccacctgggacatgaatcctccttctgtccagaagatcctgcctgtgtcacttagggactgcctcagttatcagatgggcggttgtggtattcagtgcttttgtctaagaaacccttattttactcaatcatggccccaaagtgcaagagtaatgatgctggcaatttggacattcttttaacttaaaattatcttcgatttaattgataaattaaactctgtcatatgcatgtatgtacaggaaaaattagtatacatccatgatttcagggccaccactgggggtcttggaacgtatgccctgggaataaggggggactacgatacttatgttatctgattcttactcttaagaggtaaatactattaccgtccctatttttatagactagcatcctgaggtccgcagagattaagttgcccaaagtgatatatttcctaagtggtgaggctgagatttgaacccagacctgtacacaaaactatttctgtattagtgagtggatgttgaaaaagtgtgtaaggccacgtggcacagagatggtggccttgctctgcttcagtgagagtggggcttaaataacaaccagcttctaagtgtctgtcataaattgaaatgtgtatagaaaagcaaggagtccttctggtcactgctggatgctgcccccactggaccgggcactctcccagcccactgactgttgacatcacccgctaggcattcaacatctactatcccaagtagctagatgcagcctcctcttgccatgccctgtcttcccaggcagaccataggatccttgtgggcagaaccacgaacttcacacccttcacacattcccttgcctgccacccaccctccacacccccagcacttggttgggagcctggcacagtgtctgctgacttttgcagctgcggagaagagctagctcagttctgcttcctctgagggg

SEQ ID NO: 28589 - DNA, 1246 bp, Bovine  19866881409029
tggaagtccagcatgtgtgtggtggccatttcaacttataaaaaaatgattacctaagagtttcttatgtgaattttaatcaacaaaattctccaactgggtcttccctggtggctcagtggtaaagaatctgcctgccagtgcaggagacatgggtgcaatccctgatctgggaagatcccacgtgccgcagagcagctaagtctgggcaccacaactctgtgctctgcagcctgggaaccacagctaatgaagcatgcacgcccagagcccgcgttccacaacaggagaagccaccacagtgagaagtcagcacaccacagagaaagcccgcacacagcaacgaacacgcaacacagccacaaatgaataaaatcatttaaaaaaattccccatctggaaaatcagggtcaagctgttcaaggcagccctacctaggtcttgcttgtgccgaaagtcagttgaccttgatgaacctcaatttcctcacttataacatggggataacgacgcaagaatcagatgtaagaatgtagatatcagtgctttaaaaaatagaaagcattactatataagatcctattttttatagcctaaaagtcatataggaaatttagaggagattttggactctgagaatctacctttacaagaatggcaaatgatgaatcagaatgaactggaaacttcttaagtttcggttcttgaatccattacaacaatgaaggtaacaattacactgactcagatgtaccaaaagtcacattaagttttcccaaatataagtatttctaatgaaaatacagatctctctcaagatagccacagcgtgctttattccagctctatataaaagatacacccaccttatcccacacatccatcgctgagcataaggggcttcctttatagtataactttaattcatcatatctgggacaactaagatccctgttgtattctggatgaattttttctccaggaagttggttgtgctcccttcattccccagcaaatagtttttctatattccccaaagcagtgcactatttgcaccgaggagtagtcattgattacagagtagacttacctacaccctcaagggcaggaccaaaatgcatctcatttctgactgtccatgcctgtgctacagcactgggggaagtgtctggcatatactgggatacgtgctgatagctgccaatataaccatcaaattgaaatcagcttcgacatcctgcaaacg

SEQ ID NO: 28590 - DNA, 510 bp, Bovine  19866881416484
cccctcccccactccttcctgggatctgcgggaggggcgaggggacaggaccgggggaagtcgggtgaggcttccgtgtttgtataagtctgttggttggtgtatctctggccccgtgtgtgtttctttgtcactaccgggctcagctctcaatggctcccttgttgtcgggcctcagtcttttcatctgttcaatgagtcgacgcgccccctctctgcctctggccgcctctggaaacgtgcgcccccggctatttctgcgctcctgcttcggccagcgcctccctagcggtcccgcacacctccgcgggccagcgtttgagcgcgcctctagtttcctgggctccgtgcgtgtctttgtctccccgtccacgtgtgcgctgcgagtgtgtgtgtgtgtgtgaatccagagttcgggtgctggtgggtccccggggctcctgcctggcggcgtccggcgcagagctgaaactgggctccaccgtggcgcgcgcccggcccctcgccgca

SEQ ID NO: 28591 - DNA, 1251 bp, Bovine  19866881557207
caaattcaaaagctactgtcaggagtacatgtgtgtgtgtctcaaatgtagaaaaatacacaaggaggtacaatacttgttatagggagaaaaggtaatgaatactcttagtatttcctcttaaaagaaacatatcattaatttttaatcttagatcccattacatcattctgaatcagcaagaagacaccaaagtatgagagggtcaacagtctaaaaaacattcattttataatactttttttgattaaagaatctgtcttctttgtgtacactggaatgttatattccctatgtattttacagggttacaaaatgtctctcattttaaatattaccccaaaagtaatttcagaaaaaaaagtttttgtgaaactaaatctcacttttaaaaaatcatatggacaagcaactctccaacaaaactgaattaataagattccttgtctacataactacatgacagatttcttgtcccagtccccttcctcaaaaaaccttatgtggaaaccaagctagagataaggattcttccctgatgcgattaaggggaagggaaaggccagaaatttctttggcaaacaattccatccatggccatttgtgtgtgactgctttgcttgaagtacaggacactctttgcagggaaggccaaatgttgttcagagtgggagtggtactctccaaccagctgaaagtgcaggaggtcgtctcctgtcatctgtctattcctccgcctgtggctgcagcctggcaacaactctaccaatccccagtgcaaattaaaagccaacgctaggctggctgatgcagtcttctccactgaagaaataatggatgaggggggcgctgagaaacaaccactacacgatgacactcaacagaaaagacgtaggggagaaagaggaagggtttcagagatgggaaggataggctgctgaaaaaaatgttgaggcggctagaaaggagtattatcagcaattcctatatagcaatataatcagctgcatcttgagaggctaaagacctggtggtgagactggagtctccttgacagtttagggcccatgggattggcacaaagactctctgagggttcaagcctccaaaatcataaccttatttcagatggaaaggaaaaaactgatgacatttagagaacattcaggaagagggaggtggtcaatctcaggaatgtgaatggattacaaagaccatgagctatcatgtattagctgaagtacccaaaat

SEQ ID NO: 28592 - DNA, 870 bp, Bovine  19866881759656
ttcttggaactcggcattttggtcttctctcccttcaaagaggagctcttggatgtcaagtctgaagcactggaatgcttcgtttctaaagatgaagagccatccaagtgactggttttagtgcccacagtaaccgctgtcctttgcaaatttgaagaggtgggagtgttctgccctaaattagcattagaattcagtggccctaagacatgatcgaccgctttggcacttgactccagatccgcagtggcccctgtggtggagacagaggagacactgttcctggagtaagtgctcccagttctcatcggagacattatccggagcttagaccgctggggtgacaaggaagaagtactgtgacgcctggagccaatgcttcgaagtccagaggagagtaaagggtcacccactgtgactatttcatgagtggttggggtagggcttcctaaatgaaagagaaaaagtaacaaaatctattacagataggataaatgtgttgcagtctctggtttcaatgacttggctatgtatgttaacaggtaacagaaaatcaacattttcaattggcaaacatcattaagataaagtttcctgaaagaattacaaactaatcttgagctgaccttgttgggttgagtaggtcagtgaagtcctttacctgcagaaggcagtggtctacagccaggagatctctgtgttggagaatagctgggtgttcgaatcctagggacctttgagatgacgtgatagaaacaggaaccagaggtttgggaatgaggaggtcgatctggtgatggaggacttacaatttctgctgtgttttgactttccttgggtaaatttctgggcaagaaataaaaactctaa

SEQ ID NO: 28593 - DNA, 2220 bp, Bovine  19866880369933
aatgctgggccctctagctgccctagagcacctcaacctagctttacagattgagatcctggcccagagcctggaatcagcactgaacatgcaggagggtgagggcttgtgggaggttatcagtctgaattgggtggaggagcttcaggcctgacatccttcataatctgaagaatttaggtgcaacactagcacagtttagagcagtgcttctcagccctcatcacacattaaaatcacctgggagctttaaaatacacccgtagcagggcaagcccttgtccgtctcccccaatccaacctaccctgcaccagtgaaatgagcatctgtgattctccaggggtgtcccatggtagccaaggctgaaaactgctgatgtacagacaagagtggcttctcctcatatccaataaagatgtgctctgcaccatagcccccatggtcaacttgtctattgagtatttgaaatgagaccagtttgaatcaaaatatgccataagcctaaagcacataccagatgttgaagacagcctgaaaaaaaaaaaaagtaaaatattgcgttaatagtgagatgcttgtggaagagctattttgtatatctcagattaaataacacagtattattaaaatcagttcacctgtctgttctcacatgtctgaatgtggctgctagaaaatttacactcaggtgtgtgatttgcgttatatttcttttgagcagtaccttctttcagttctgattcacaaatcacacaaccgaaattgctttcccaatattactgctgcagatggtaatgggctggaaaaaacacttaatacagtttgtaattatgtatttatttgtgtgtttacttatttagtgtctgatttcctcagtggaccatctgtcttgtttacctgtctatttcagcacctagctgagtatccaggacaaagtaacagctcaataaatatttgttaagtgaatggatggaagaagtggtagctggaagaatgagccaaccaattaatatttcctattgctgcattctcacatgggttcatcagttaaagtctcctgctaggacttgtactgcaaacaagggactgttttgcacagaagggaagggctgtagcagaggtgaagttcaagggctttggtcacagatggacctgggctcaaatccaggctctaccaaggcaagtcacttagcctcttgaactctatgatttctctcatctacaaaatggagataagattgtctcacagggttactgtgttaggtgggcttagcaatgcctagtacaatataaggctgtcatcggtttaagaaggaaaacgaacagaacaggattcgtttctgggatgcaatatgttcttcacagggagtcgtagccctgctttacctcctggggagcaaacctgctgccctcacctgggcacggtacacgtcagtctttaaaggctgactttctatgccttgggcaacttatgacaatgggagaacatgtggaggaattaaaatgtctagtgtctcagtgatgtttgtttcagctaatatcatagtcttggccattgactgctctaggactgcatcattttacccgtcttcccagctgagcactctttagactgcaccttggaacaagcctcagattcagacaggaccttcacaaatgggcagacagcttttgcatccatatctttcttggcacaaaagtaatcacttcctccttaccttgcttacaaagcccatgacatgaccaagggaataaagtggggctgttgggaaacatgaggcttgaccaggatgcccaaaatgttctagtctggctaaacaggatactcagagctgtcctgtttattaggctcacaactgaagaaggaaagtggggcaacttcccccaaacagcagcttattttcttctttgggggctatttgtaattaatattccagctaaatttatgcagataaagaaaaaactatccatatggacacgttttagtaacatatgtgtctcttcaagatgggtaggagcatgtctgtgtgcccaggttggtgcagtgatgatcaacaaaagactctacaccctctcattcccaggcttgaaatactctacaactatagggacatataatacgtttgacaagtcaggtcttacagtagtaaagcctacagaatcatgaatgccgtcaaagcccacattgccggcaatcaacagaaggaaggaaatgtcaa

SEQ ID NO: 28594 - DNA, 1573 bp, Bovine  19866880496693
cacaccttcatgtaaagcctgcacttcctcagagctccatcattttcttcctcttctttcccctcaccccatgcctgggagtttaatcaagattacggaaatctttttagggatcagaaactgaacataatgaagccacttcgacttcaggaagagtgatctgtgggatctaatagtagctgagctaaccttattagaaagtattttctctctcaaacacaccaagtcaactcacaaaatactattaatatgtatattttcaactcctattcctacaatagtcacaaacttacaaatcaactgatgcttttcttgtgatctttttccctctaatatacacacacacacacacaaatcactttttaaaaaatatttctcttccatccattccagaatttttaggtcccctttttacacagataccattatgcatactcatgcacacatgtttcttaagatgccaaatgtttgtgaaatccatgggggttctgttcattcattcatttgttcagtgaatatatattttgaacacatcaccaggcactattgtataggccttttggatagacatgtgtaggaggctcacagtccagggatggaggaggactcgaaagcagatgtgcatagtgatttgtgttaggtgatatgaatccacaaagcaggggcatggaatttgatgtggagggtcttccaactagagagatgcctgggccaagacacaaaacaagttaagtattgtttttcaggttgacaggaaaaagaagggcaacccagggagaaggaaccaaacgtacaaaaagatccatatgagcagtgaaaaacagcctgcctggggaaaagcaagctcttcggtgtggtctgttgggtggtctcctttcatggaaagaagcaaagcctctgtagacagcaaggaaccagaaggcgggaagaatttctccatactccaaaaatcgatagacaggtgaacatatgacataaaaagagcaatcatcagtatccacatgatccaggtatagtcaggaaaaagttgtagctgtgcatttcagtgcagagtatgaacaatctcactgatctgaatgaacgtttttcctccccacttcccgtttctatcagcaagactctcctttgcagtaaactgtgcacgctcacccttcacctggttgaggtcaagggtagtgcgatcatctaggaagacaatcacgaagatttgcgtgtaaatccatgtgccttctaataagtgcaaacatagtggctccaaggcagaccctgtttcacaaggtctcagaacacttcctgttaaaagcttgagtccatgctgctttctaccctgcctgcttactcctattgaaaatgcccaggaatgcccaatttgtccacggagaggcagacgagcagccatttttcccaggcttccttatttagctttggagatggttttaaataggcaggtggctgttgccatggttaccccattacaccagcggctaaatttaaggagggccacaagggataggaagaaagcttgatacccgggatttagaaatgtaaacgatattatcaaacacagcttcgt

SEQ ID NO: 28595 - DNA, 1870 bp, Bovine  19866880499562
attttggggtcatatatttaaatgggtttctcttctatcttatttatcagtacaaatataagatatggaatttcctcttccacattgcttaattctaggttctgatatgttgttttcattatcgtttctagacagagtgcactttcagttgttgttctcccttaagcccaagaaatgttaaagatagaattttaacattctttttttctgaaggtggaaggatttttagtttctcattttcttattgttgctgtagtctttctctctttttttctttttattgtatattgttctgagtatgctttcttacagcctaacacttcatggaattttgtgaatgtttcatgggcccttgggggagggagaaagtattttttttttcagcgtgcagagttgaaattttgtctatcaggtttccttactaatacttatatatataaaggatcttatccatcattttttagcctcttgacctgtcatggactgagagaggaaaattaaaatttcctactaacatgtttgtgtttatttcttcttatatcttttataatttatggctgttttacattacattgtatatagattttcataactattataccttcattgtgaatcttatctcattcagtatacttttgatgtacaaaagcttttaaggttttttgtggtcaacttttatcagtatcctctatagtttctgtgttttgtgtcatgctttaatagactgtctttactttcagcttttaaaattatttagtcatgtacttctgtgattttgctttttacataaaaattttaaaatcatctggaatttattttgatgtaaagagtaagtaggtgcctctcttcgctccccgctccccaaccttggtcttttcagatggcttatcagatgtataaacatctttattgaataatcagtttatgggaaacatctgttgtttttgcctcctgcccagaattctttgcctctttttttaatagcggccccttgagcttccttggggaacctcctcttggtccatatggcttgtttggaactgacactagctcctgctccagggttgggtatgtaaatcaaccttagtatcatctccctgcccacggatattggttcagggctgggggatgacccaagctaagatgatcagagtcaagatgactcagcgttaagactttcattggtattattttagaagagatagtttttttctgttggacttgaagctgtacaagtgtaaacctgggttttcagggacttccaccatgtgtagcccaaggatgaaactaatacaatgaagaagcagagtctttgtgatggaaagagactatagatactgatgaaaatatcctagcctatggatccaactgtgtcttacccctggacttttcagtgacctgagccaatttatacatacacagtgacagtttccatttgtcagcaaaagacccgtaactgaaaaaatccactgacttgaaatattcctatcatatataaaattatgatatgaatgtatctctctaatctttttcattgacctatttatctgttccaagtttcgtaaattagaggaaatttctcctcaggtaactttcgcttagttggctcaatgttttaaacatttcgaatttgaatgtgctgtgagtgttggctggtaataatttttaactgccctcttctttagagaattgcttttggtcaaacaggagagccctcctaccagggaggctatgccccctgggccccccagactctgctagtgactgactgtcgtataattgaaaaagggcaattttcttttcttaaagtaaggctatgttctagagcagcagtctccaaccttttttacagtagggaggtttcggggag

SEQ ID NO: 28596 - DNA, 1089 bp, Bovine  19866880526946
ctgcagtccatggggtcgataagagtcggacacaactgagcgacttcactttcacttttcactttcatgcattggagaaggatgtggcaacccactccagtgttcttgcctggaaaatcccagggacagggatgcctggtgggctgctgtctctggggtggcacagagtcggacatgactgaagcaacttagcagcagcagcagcaatccttgtccatcacatctggctcatcacccagcatccttgggtctggttcttgcttcattaacaaagcgattccacagggaacataacttagttttgtgtaaccaaccaccttccctggcaacaacctgtgtccagaggccactggggaaagaatttcctgaaatcccaatagttgagtcataatttgatacctcttaagactcaaagggagaaggcaatggcaccccactccagtactcttgcctggaaaatcccatggacggaggagcctggtaggctccagtccatggggtcgctaagagtcagacacgactgagcaacttcactttcacttttcactttcacgcattggagatggaaatggcaacccactccagtgttcttgcctggagaatcccagggacaggggagcctggtgggctgccatctatggggtcgcacagagtcggacacgactgaaatgacttagcagcagcaggactcaaagagggctcagaactgtgactttaaccattggagggtaatgggtctcttcaagaaccttctgatagttaatggacattctctccagaaaaatatattcaatatcttacatacagtttcaaggtgcccgcagaactcctgcagcccttgtacctaggttagtaattcttgttaaaatagcccagaaaactgaagagcaatgcaaaagattcagttttcctgataaattctagccctgacaagtcacattcccttgttcaaaacagaacaaaacagttacaactccctagatttaacctcagggttatccctgagggcctagtcctaggtattaacagtaaaggcatccagccaagcagtgactactctttggaaaacctaagttcagctgagtaaaa

SEQ ID NO: 28597 - DNA, 1271 bp, Bovine  19866880544696
gggagcctggtgggctgccatctatggggtcgcacggggtcgcacagagtcggacacgactgaagcgacttagcagcagcagcagagtgaggaagaagccatgaacctgagtctgaaaataatggcttatagtagagcactcttgtttggcttcatcttaagccctcataaagtcctcattcctattgctgacaaccaaagttgtctgccagaaggcagatgtgaggtacagtagaactatatatttctctcctcaaaatggagggaaaaggaattcttaaagtgggaaatatgcccttaattttcatttttctgtaagcgcagccacctcacccctcagtcctttcttcgtttgccctgtactccagattactttctttgaagacaaaaactttcaaggccgccactatgacagcgattgcgactgtgcagatttccacatgtacctgagccgctgcaactccatcagagtggaaggaggcacctgggctgtgtatgaaaggcccaattttgctgggtacatgtacatcctaccccggggcgagtatcctgagtaccagcactggatgggcctcaacgaccgcctcagctcctgcagggctgttcacctggtgagtctggaggtggtggactctctctctctccttccccttccacccctttaggcttttatgtaaaggagttttcttaagattttcctacctcttaatgggtggttgtctcttgttggctgctgagacttcagtcaagtgttagatcagttcatcataagaccacacgatttatttccactttctttaccccttatatattttaaggaataaagttttccttactgaacgtcagctgttttagtcagtacacagttgggatgggagttcagatcatctcgctttcaagatggtgggtcctgaactgctctcttctctgagttcctagcctgctgttcatttccgtaacagttgctgttcttttccccttgttttctgtgttttttttttttttttttttcagtctagtggaggccagtataagcttcagatctttgagaaaggggattttaatggtcagatgcatgagaccacggaagactgcccttccatcatggagcagttccacatgcgggaggtccactcctgtaaggtgctggagggcgcctggatcttctatgagctgcccaactaccgaggcaggcagtacctgctggacaagaaggagtaccggaagcccgtcgactggggtgcagcttccccagctgtccagtctttccg

SEQ ID NO: 28598 - DNA, 1064 bp, Bovine  19866880568514
ttatggatttatatttgctttgttcatttccctttgtttccccagagtttgctttaggggtaaatgtttctttttcaataacactaaagcgagaaggcgtcctgcccccactcctgttctattccgatgactccaaagctggagagacaaggcaacaacagcctccccagcagagggtgggggccagaaagagcgctgcaggaggcggggaaggctggatggctgagcccctgttaagcttcaggtactctgtgtgggtaatcagatttcattctcaccacaaccctgcagataaagttgattagtcccgcttgtttttcctcagacgaggcacagagaagttgagtcacttggattacacccagctggtaagtggcagagtcgggattggtaatcgggtctgaccctgtcttaccttcatggtgcctccaggctctctggctcatagttgactgtccccaggaccccactttcctctccctttggaggatcatgtgttttgtgtctgagctcccctcctacatgtatgagcacttcagaagtaaacacatcagtggaagaaagaaaaaacaagatgtccaagtcaggaggacctgtcccacctagacaggcccctcggccgggctttcttctcagggcccctgggaaggacacacaccttgggaaatggtcaataggcctaaggtcttccaatgggaccagggactcatctccaggttcatctgcaggagagagctttgtccaaggaaccccgtgcaggtggatctcagtgtggctgatgccctgagtcactgtgtgtgtcccctgggccaagccaaggggcctgagcatcagggatgcagcccttgacccaacctggaatgacagagctgcagggtctactgggttatcccacccagtctcctcatttaacaacactcttgggagtgaagtcatgccagctggcttgccagccagctccagatacccagcctccccagcctcttccctctcctcatagcttgctccagcccatgtcactggtgcaggttccgtttgcctacccacagcaagccaaatgctga

SEQ ID NO: 28599 - DNA, 3630 bp, Bovine  19866880594698
ccccaccccacgcccccggcccatcaggaaaatgttgaacatctttaaagctcgaaatagtgagctcttactttgaagcaaataggacaaggcctacccctcaatgaaggattgtcatagcctcagcgaatacaattgagaacgaagtgggaggaaactattgctaccaaaacaactcactttttttttctctctctttcctccttgcctgcaaatctgtgtctaattctttccattatgcttctcccaatcagagtgcagacaaagtagcacacattttagctggtttcaggtgggcctatccctcctctgtcctgaggctgtacctctgtcaagtctcaactggctaactgatcgtcctccctttgtaccccaactactgaagctcccctgcattcgtagtagaaaggacactaaccagagcgtgctttcaggtgccacctggttgactttcatggaactcctcccttgatccagattcagaggcaagcaggcctttctctggctctgaccaggaagatcagagagccattggctgttcactcagagtagccatgatgtctaagaaacaaataggttttactttaagtcggtggcaagaacagttggttaaaaaagtcttccatccctgatcatccaattaagaagtgctgaaaacataagattggggacagctgagggcttgagtgtcccggccccagtagcctagctgctgtacacagtcatttcaaacacagaacactgagccatctttctgactcctggtccaggatgaagaacaagctgtggtactttgaatttggcacctcggagaccttcgcggccacctgcaagaaactccacgaccacatagagttggaggtgagttcccaaagcttgctttgggaccttggttctggtccgggactgtcacataccctcagaacatgtgccctaggttcatagtggccccaggtgtaatccttcttacctccatcctgttcccaacatgtccacagcctcactcccagtaggctctaatcacggggtctgcctttctcggcctgaccagggagtcctggggtctgagacccagaggcccagtggactcagggctgcagtcctttcctgccctcagccctctccccaccatcacctttcaatttcttctttttcaagaaatgaagacaggtgctacccactcagggaaagaagctgctatggggatagaggcaatgtcccaagcctggtaaaagtctgggaactgaagaccacagggctgaggggtctgcagttgaggccaggggtgaccagacatcatcagctcacctgcctcaactttcaaggagccagttcaggcactcagggccagcttcccaagtgtgcaacctgcacagtcactcagaaggttcctcatttaatgctgttctgtgactgtcttaaaattcttgatagtttttttttttttttagcaaagggccctttatgtgcattttgaacactcaaattacatagctgatccagttggtgcacttggattttaactctcccgggacttgcagcagcctgcctcagacacagcctgtgggcttcacttactggttgataagctgcccacttctcattccccaccctgcttctgctgggctgctctcctgaggtcttctcacttctaagaaaagattgacctgcaagcccaaacttctgtgcacacctgctgtctctgctctgcggaacctcaggcccttggggccccttgcccatagttctcagttaccgaccctcataccccttcccatggaattcaggccagtggtcttgttttcacttgagaaaaacaagtgaaaggcagtcagagttgggccaggatgggctcttgctgggccaccagctttgtccctgagcttgcagcagcagtcaagtggggcccaggcatcccttggaggaggagcatttggcctaaagcagtgtgggaaagccccaccactccctgtggaagggagcctgcgctcacggggagttttcacaatcaaaacacaaagccagagattctgtgcttctctttgactcatctgcctgcctctccccagcggttgctgggttaccaaccccagggtgggaggagccgacctagctaatcccctgaacttctagccagctcagtcagagggcagagaggcccaggaatgtggggcacttttccccaggtggtaccacctccacctgggaaagtctgagaaacctgccttcctctatggatacataaatccatggccagaaactctacagcaaagggggaggcggctggactgggctggaaactggacgtggctggagctctgtgtgcatttttcctgttggcatgatcatctggggtgtctttaaatataccccaagtgagggacagccctggcctaaccactgccagctgcagacacacagcgactgcttgttctccctgcagctggccttgaaactgtgcccagaatagagcagctcagctcccctgcctcggtgggccccgccctcccagctcccaactcccagcttccagcccacagcatcatgggcccctctgagtccagtgcacagcggctcatcctcaattgcagagggggctggtggcctctggaggaggtggggctgttcacactgtgggttgttgggggcttttagcagcacttcttgttttccttagctccccatcgtgagtcttttttagtatttattcctgaggctaaggatgggggtgggggtgcatctgacaggcagcttctgttctgaaagcctgcaggattgtggcaggcatccttttgtacccagggagcggaggggagacggtcctgggtcttataatacagaggagaccagagagacagagggggaggcatatgagtaacagacgttaggaggctgtggggcagcccaggtagatgtgagtgcatcagaggccttgggaagaacaataacagaaggtatgttaagtgacctccaagtggcggctgcacacaacagcccaggcctgagaggaccagcatgctcatcagatcaaggtcagtgagcctgagaataagcccacacaggtatttatactacgtgccaccatttccaaagccccaccacagcctttattgcagagtcacacaacaaccagtgagctaagtaggcccggtattcttatccccacatcacagaaagcaagctaaggcacagagagttagatatataaacagaagggagacagaagtaacaaggggagaggagaaaatcacagactctgactgcctactgtagcatgtcctcatttgattccatcatccagcaaagcaagtatgatcacatttttttaaatgaggaaaccgaggctcagacacactaagtaactggaccaaggtttcattgctggaaatgtgtaagagtctaggccttcctagacctcctggaaaggagtttagcttggaacccaataaacagattgacctaacaagtgctaggagcttgctgaatttttcagctcggatacactgtttcttcctcctttactgaatgtatggctggcttgggttctgtctcagctgcagcagctgggcagggctgctgggaaacgctttaggagaacagaggggcacagtcctactgcttgctcatttg

SEQ ID NO: 28600 - DNA, 1061 bp, Bovine  19866880639768
ttctgacacctacacgcccccttattctctctgggaaccagagagtaacttttgccccttttcatacccattacccaatgctggaggaccacatggctaggaccggccttgctacagtgcctaactattgggataatcccatgattgtgtgcagagagaacagcagcccaagtgtcttccgactcctaccaccatgtgaattctatgtgtttattattccatttgaaatggaaggggacacaacagagatacctgggggtcttccatctgcatatcagaaagcactgagccaaagggaaaaaaagatacaggtctggcagaaaactgtgaaggaagctcgtttaacaaagtgagtattttctagaagtaagtagtaacttgtcttatgtaaaactccacgggaaagcaaattaatctgcatgcatcctcagtctctcagtcgtgtttggctcttttgtgaccccatagactgaagcccgccaggctcctctgtccatggaattctccaggcaagactactggagtgggttgccttttcctactccaggggatcttcccaatccccaaacctgcgtctcctgcattggcaagtagattctttacgactgcgccatctgggaagccccccaaattaatctgcacatgtttataattgtgctaaacaaacaaaatagacaaagtgtgtcttttgttaaggtcagtattccaggtactgtttggttgggggatgggagcaagtggatactcaagtattagactccctccttttttttttggcatagtaaattttattttttttatacacaaaaaaccactttgtattggggtatagccagttaacaatgttgtgatagttccaggggaacagtgaagggacttagccatacataatccatgtatccattttcccctaaaattccctcctacccaggctgccacataacactgagcagagttccatgtgctatacaataggtttttgttagttatccattttaaatatagcagtatgtacatgaccttcccaaatagactctctccttttaagaagcttcagttta

SEQ ID NO: 28601 - DNA, 1695 bp, Bovine  19866880685503
tgtgtggacctcctactgtatagcacagggaactatattcggtatcttgtaataacctctaatggaaaagaatctgaaaaagaaatatatatatatttaatgaataactgaatcactttgctgtatacctgaaacatggtcaatcaactaaacttcaatgaaaaataaagtgtgagcctggagccaggcatcagtaaagatcctcaagtgattccaaaatgcaaacagtttgggaacccctgggccaggttactgggtagatcattcccatgggccagtgattctcagagtgtggttgtttccaggggaggccgggaggcagcaccagcctcacctggaaacttgttagaagcggaaatcctcaggcctcacccagaccgactgaatcagaaactcaaggggctgggctggacggtctgtgttctaacaagccctctggaagagtctgaggcacactcaagttggagaacttgagcctcaggcaataaaactgccccaaacatatgcaggagttggcgtgaagaaaaatgtaaacaagttacttcctgactgctttgatccacagcttcctcactctgaaaaggcgaagttaggaataataatactgacctcaaagagtggttatgagattcaatggcaggggtgtatgtgaaagcgccgggcacagagcgggctccaaaaatattatcaattttgctttcttttatgtcacattcaccctcccaactcccaactctgtgtacctcagagctgtgtacaagggtctacaccatcatattcagggtaaaacatatttaacaatctgcagggttcctcatggtttcacatgtccacacaaatgccataattccagttgagctttagatgaactgggagtcctgctccagctgtttttcctcctttaaactcttccctgactctgctccttttcccacttctttgatctcaacagtcccagtttgcgtttctatcttgagacctgcccgcaggtgggaggagggactggagctcagtgccgacaggcagaggctagcagagtgctcatatttgaggggcacatcttccttcttcaaactctctggaagcccaagggacaacgtcttagttctcagtgaggcatgcgaggtcactcgctatctgtccctgttcccagcacaggaatgcctctgcctggagaactcatacttaccctcctgtgttaccccaggcagcgtgccttttcccctctcctgtgctcagtggatctcaccccacgacaactgtctctgtacacatcactctcccaagcccactgtgacatgaaggctgggagataatattcttattttgtttatgtttgaatccttagcagccagcccaggtctcagcacacagaagtgaagtgaagtgaagtcgctcagtcatgtccgactctttgcgaccccatggactgtagcctaccaggctcctccatccatgggattttccaggcaacagcactggagtgggttgccatttccttctccaggagatcttcccgacccagggattgaacccgggtctcctgcattgtaggcagacgctttaccatctgagccacccctactaaatgcttgttaaataaattgaacaaacgacatgctttggtgccaaagactatgacaggtttagcttgaaagaggaaaaagatgatgattaataataatgataaaataa

SEQ ID NO: 28602 - DNA, 821 bp, Bovine  19866880737350
aaattggaaaatacctattaacagatttctttttctaatttttattatttaaaaaaatttttacacactttttattcctatgtgtacatgctcagttgcaaagtcatgtccaactctctgtgaccccatgggctgtagcctgccagactcctctgtctgtgggatttcccaggcaaaaaatactgaagtgggttgccatttccttctccataaactgatttctttattgcaggacttgtcagagccttgatatacatgtacatttcacaaacctccaagaaagaaacaagtatacaacatttggaaaatttattggcccactgaactatttttaaatataatacctcacctggatagtaatacattttgggaaatactagtcaattgttatcctctacctagaaaaaaactatagttctaaaatataaaaaataagccctctgaaatgagaaatccggctccagagggtgttaagagtaaaaaaaatactttcatacactgctgggggctggtatgtattagcgtaacatttttagagagcaactttacaataactagcaacagtcccaatatttatactttcaactcagtaatttcacttctataacttatcctaaaaaaataacctgaaaggcagacaaatctcaggtcctcagttcttatttatgcctctgatactttatgaaaaagaaaaacatgctctgatttgaaaaaacacaaaagagggctgcttcatttttctactcaggtgatagaaaaaaggatttcctccttataattgagggaagagacaaaagtgcttttatattcttagttgcatt

SEQ ID NO: 28603 - DNA, 880 bp, Bovine  19866880801056
taaaagaggggatggttgaggattgggggcaaggcaagacacactcagacctgagctgtacttcgtataagtaggagacattacctcattgacattatgcaactgctcactcaacatagaacccaggcctttccctatttcataatctttcccatttcacagtggagtttttggcaccacgggcaagccctctggcttgttgtttgactaggggtccacttagatatggtgctgccatacttgtcggccacttctccccagactcctgtggacttcactgctcactcagggccatgtttctcaaaatagtctgaggaccagagcaacagagttgtccatattgcttatgaaaacacagacccctaggcctgacccagacatgctacattgggacccttgaggtgagctcagaaatctgttttcaacaagccacccaggagtcttcagaaccattcctaggtggctccactttccactgctgtttccctggtggggacggccttcattctccaactccaagaagcccactgtgctctctctgttctccggtctccaggacaaacaagctgctgccaatgcaagtggatggagagccctggatgcagccaccatgctcggtgagttattccagtctttgagatgagggtgagaagttttatttgagatccctttggggcactgacttaatatgaaattctgagtctctgagttacaggggctttgggagatcatccagcacagctcctcttccacttagttcatccatccatccatttatctgctgagcttttattgattaggtgctatgagccaagcactgggagacaccagttccaaatccaaaggagacagacctgtcttcaaggagcttatagttcta

SEQ ID NO: 28604 - DNA, 1593 bp, Bovine  19866880845431
tgcccagattgacagaaaggccagtggacagaacccaatgccatttcttcaaaggagaggacacatcatagaatctcccctttcctaaatatcacaaagcaaattaagtcaggctctgggcttgccattatttcaaaggggttgatttttgtttgatttagaatctagaggttagaaatggaaaagaaataacttccctaaaagtctgacatatgcttcttttggtagcatatacttgagtgttacacattaagccagcagaacaaaaaggtatctttgggttggtgtgattagaatgagaacaatgctctcggaggcctctgaacaggaactgtggttgtagatgttcagtcaggtccagggctcactttagtacacccaaggggacaggtgggcatgggggttgacggcaggaaattggagggagaaaatggcctgaaagttaagatgagcaaaggagaatgtgtgaattggaggcttaaggagaatcctgactggtagaggaaggcgggcttcattaaaggccgttagagaagatatacttatgtacatacatatacaatttctgttaagacttgttctaccttcaaagccaaagtttggtactgctgtgttctcctgagggtgtcttttggctaagtcgtgtagaaatggagccatgtttccggccacacggaaaagcatccaccccacattcttttcctcataatgtggcctggtttgtatgaggcttgaggaaagcatgtcgcccagactcactgaggctttttgaaagtcaagtctgtcatgtgagcagccctttttgatttatctcatttcacaaaaaggagcttttacgacttctttgccactgcctcgggcctaagcagaggctatacagctgcaggtaaacctggttatgaccctttgtaaagccgttattgaatctgttgctctccaaccaatggtaaagaaaatgatgaacagatggcaaaggaccccggctttcttaaagaaactaatgctaatccagaatgctcacataaatgccaagctgcccagtcacaggggagtctcctggtggccttgcgcctctctcagctgattaaacagctctgtttcttcagaaagtacttcttgccaccgcagcttgaaatccccgagcattccatgaactctgaaatattccattcccttaaccccaggatcagctctgtttctctgtgcgctttggccccaggacatgcagcacttttttccccactctctaatccttgtataacttggcaggccctcctcttggtagtgtcaagaagataccaactcctcgaaaaatgctgtaagaagttgtcatggggggagcttgaagggtgaagcggaggaggaagctgtttgggacgtaattgtaggcagctgtgtggctgagtagtgcactctgggtaattatccataatatccattacactgtgcatggaaattgtggttttagaactgcgttttggcaggccccctaatcaaatgtcttttgatagtcatccagcttagcaccctctcaattatgactgactcggctttaatctggagccattttaactgtgaatctgcattaatgaa

SEQ ID NO: 28605 - DNA, 1690 bp, Bovine  19866880851942
aacagaaggagcaggtcaacattgaaagacctgtcaaataatcagaacttcctaataaagaaaggaattcctggtcaccagagaagcctactctattccattttgaagctggggaaacaagtcatgcagataagataccataaattaggagctgcaaagaaatcaggatgcccagatgaatggcaacaagccctacctttgcattcttcctcttttgagaaatctctataagtttggatttgtaggtaacctcacagagagatttttgttgcatgcttctaattttcttcctgcctcataataagcaagataaagagggctttgtagtccagttccccaactttgaatccctgctctgttacttatcaactgtgcaatcttggacaacttggcttacctctctgggtagtgttttcttctgtaaatgaagtaaactacctccagttctgaagaacaaggatcacagctaatatatttcttgctgtgttggtgagcgttatgccaaggtaggctgacctctattagatacctgagacagacagattcaagccttctggccttttgtacctggcgggatgcgggtggtggagactggataaagaaactctgctacatcagcaagcacatatgccaaaattgcacttaggatagagatacaggagacagaaaaagtctgaaagccggccaaatcttaaagtcttatacttctcacaagagggattaaataagaaggggtaagatgaaactttcctgtcatttgttcgaatctggactccatgttccaccatatcttcacagtggtgccggaggggcagggttgatggtaatgaagttggactggagcacagtgtgcagctgtcttctgaaccagcccttctagatctataggtcagtggtccccaacatttttggcaccaaggaccggtttcatggaagacagtttttccacagaggaaggaatggctgcaggatgattcaagcacattacactcattgggcactttatttctgttattattatatcaattccacctcagatcattaagcattagatcccagaggttggggagccctgctagagatggttcctgaagctttgtactgtacccccagagctgacaagaaatcacctccctcatctcactgcagtggataaggcattagacctgagcaactttagccaatattcagcttctgacagaggctggctggtggctaagggcctgtcacattcttgatgagagcccccaccacacgcaccgcaccttgagctgggatacaatgaggacactaacagatgacctttttttctctgtcccccagtgtgacggggttggggtggacctgagcagcatcttccttgaaggcattgctattctcaacattcccagcatgtatggtggcaccaatctctggggagaaaccaagaagaaccgggctgtgatccgggaaagcaggaaggtcatcactgaccccaaggaactgaaattctgtgttcaaggtaagccaggcatgagaaaaatcgtgctaggtcagtgccccagtgggagccatattcaggtgggtctgtcagcaaaccatattagggtctacagcaggctctagaaggttctgcagccttacaagaacccagtgatacactgactcatccctgctgcatcatcatttataacctaatgagaagagaaaa

SEQ ID NO: 28606 - DNA, 910 bp, Bovine  19866880875831
tgactttattgctacattagtttccttgtgcatccagtgactatccattcctacacaggtaatcatccctgtccctgaaatgtccttctttcttcttaacccagcaaattatcttgacattcatccttcaagaccttccttaaagtctctggcaccttccttccataccttgcccagaatcagttactcaggcatccttcttcctgtagtttactcacaacattttctatacctaacactttctccctcttggttaagagtccttagagtagaacattttgtattcccagttcttaacacagtgtctggcacatggttgtcacttagtaactgttgaatgagtgaattaatgcattcctgttttactaaggtacacagacattccatcttaagtacaagtgagtatattgagtatagaaacaatatggagatgatatgaattgccaaaaaccactctctgaatcattcgtacctgaggtaaaacagggggcttaccgggtagctcagttggtaaagaatctgcctgcaatgctggagaccccgattagattcctgggatgggaagttcccctggagaagggatcagctacccactccaatattcttgggcttccctggtggctcagacggtaaaaaatccacctgcaatgtgggagacccaggttcgatccctgggctgggaagatcccctggaggagctcatggcaaccctttccagtattcttgcctggagaatccccatggacagaggagcctggtgggctatagtccatggagtcgcaaagagtcggacttgactgagcgactaagcacagcccagcaaggtaaaacaggacacctggtatagcagatgtcctgatcctggattctatgttctgaacactaaatgttctatgtacctggtcattga

SEQ ID NO: 28607 - DNA, 856 bp, Bovine  19866880884106
cacaaatcaccgcgcgtgccgcagacccttctgcccttccgcggggaaagaggggggatgctgaaaggtctccccgccactctgagtcccgcacctgggttgctcacacctgggagctgcctcttcgctcctgtctcgtgcttcccgctgcagcgatggcgcggatgagtgcagcgcatcggattcacctgtagggctttttcgaactccacagccctcctcctcaaattctagtccacttgtccagaggaagaaaatctctgaaagtgcccgatgagtggactggtggagttttcgaaagccccacaggtgatactatatgcacgcacatgcacaaacatcttttgagtccgaaactaaacaggtcaacccgacctccctgaccctcttctccttccgtagcttctagttgtcaaggtctccgcgttctcttcagcttccctttacgctcccccagcacgggggctttgtggagtccccccaaagtcccggaaccctgcgggacggtcagaggtttggcggccagacgttagaaaaagtgtccccgctctttgctgcccttgtgcactctggggcgcgaagtggataccaaaggtaagtctagaagaggggaaatctgaacagttgcttcagcaccctgcgtggagccaggccgcctcccgcccgcacactttgaggttcggaaggtccttccaatcaaagaggaagccggtgccccaccctgggcggctccccgtgccctcacactgccaggggggcatctcctcctgtaggggctgtgcggcaggtggcatcgtcaggaggggggcgctggcatcgtcaggagggggggcgccgtggcctcagctgcagctcc

SEQ ID NO: 28608 - DNA, 896 bp, Bovine  19866880939114
ttgcgtttggaaggattttacacacaggctttgatcttcgaataccctggattcagtagaaaaaccatttaaatgaaattttgtacagtagaaacttttcggcaatcaaaatttagactgtaaaaaaatatatgcagaacatgcttttctgaaaacattgaacaaagtgctgaatgcagaatgaaagtaagattttaattccaccaaaagtagtcatcgtagaaggtgtaaaagtcactgttcactttaaaaagtatattatccacagacaatatcctaactctaggacgggctttagaaagtcttcaacttcttgctttaatagcagtgaggtgaatatgattgagctctagagtgtgatctgtatcctccacaactacagtagggagaaggtgactgtcttctgcaggtctgatccctgtcttgagcagttccccatcttcctccttcacttcctttgtaagatccactatgacagtcctgaacatcatagcctcaatcatatcctctgttgtaaaatcttgacggcatgagctgctgtaggtagatctccccttgtagattcctggtgtaggattatgtggtctttttgctatagagtaatcaactctgatcctatgttcatcaagctccattccattggcacactcttttgcttccttggcatcatctacattttcaaagtatacaaacctgaacatctagactgctggtcataatgcaatagacatgtcagccattgggccatatttagagaacacttcctttagacctctgtctgtagtggtgcaggttcaatccaaatactgccggagctgttctgagttggtgacaggaggtgctgagttgaacatgtgtcttagaggcctggtgcattgagggctgttataggtagc

SEQ ID NO: 28609 - DNA, 784 bp, Bovine  19866880967174
tattggtgatgaaaaagggaagccaaatttcctgagtttggggattttaaaactgttttttaaggaattgttcagctccgaggttgaaaatcgccccttggtgagaggagctcctgcaaaaatgccagcacgccaggggccactcgagggtttaagtaagatgcagagaatcagcctgtaacggtttggagccagtcttagccctctcaaataagcagagcggcgacaaatgccgctgagaattccaggcccgaaccaggttacttctgtgcgcagattccgccgaggacgtgcgcaagttgtgcccagactgccccctgctggcgccactcaacgacagccgggtggtgcacgcagtggaggtcgcgctggctaccttcaatgccgagagcaacggctcctacttacagctggtggaaatttctcgggctcaatttgtggtaagactgagaccctgctgacaggttgggcaggttggtggcactttggggtgtgaacgtggtgaagcaagtgtgagggagggagcaggggcagccacaggaagtcaaggagggtggtgggagaaaagggaaagaaagggtcctgagtgtcctggacccagagaaccctcaccgcacccccgacctaagccacttcaacataaaatagtcagagtctgcgtgtgtgttcaggctgtattcctcggttagttaacacgagggtgggagttcccgttttatccagaagcacacaccgtaaattcatgggtctccacaccaccatcacctatcaccgctgaacatca

SEQ ID NO: 28610 - DNA, 2258 bp, Bovine  19866881009335
aagccaaattcagggaatggctatccctggcgtcctggcatgtcagagctggaaagatgacctgggccaatctttgctcctctcctctattgatggagagcctgaggtctgggggaaaccaggtttgctgagtcccttctctcggcaaccagtacttccaatacttgagtctgtacttttaggggccagcacagtatccccccaaagagacttccaagtctgggacacaaggatcaaggcaggagtcaccaggattcactgaaatgtgaaaaacatctttgttggtcctctttgagcctggctatggttctccctgcctctcttctttgaatcagtgggccatctccttttcaccttccatatcttctccccgtttgcttacgtctttgcctccacactctctcttcttgttccgtggtgctaggtccttgcagccctggaaggatttcctcccctccccaccgttatccttcccttctcagcccacagcccaccctaccccagagtccttggcagtaggctcttttcaacttcaaggcaaacatgatgaaacagaagcacagtagcttctggaggcaaagaattttttttttaatttggggggtggtcaagttcaaggcctctaaaactgacagagataatgaggaaggaagtggggacgtgagggagggaggttcaccttagcttctctgtttgtgggtttcattgcatgaattctcctgttagcagaatgatgagacaatatctgggcatctacttatataagtgctaagctaaggctcatgtgcatgagcacaagagacccccgaagttaggacctctgttacttgggtgatcagactgagggctctaattctaccaaagaatcattcattagccatgtgacctttggacttgcatttcctcatctttgaacatcgcagggataataacatctacttcacagggtttttgtgaagcataaatgagataatgcctgtgaaatcctctagtacagaaattgttgccagctaacagtcaataaatattcactgaaatgatatctgagtcatttcccctgtgaagactttgctgacctcttactcccaggagaagtgaccaccccctcctagtataccccttataccctgtttatgcccctttgttagaacctataacacatttttttcacctctcagccctcacctgccctgctcctcaccactctctggctcttagcatctccaggacagtggcagtcttacttgtctttgtcctcccagggcctagtacagtgactcgctcagggagacgccttgtaagtagttgctgaattgatttgaaacagtgggggtttctgagcacaagcctctcaggccaggattgttttgaatatatcatgccagttgctgcctccttgtatttattaagatcgatggcaaaacccgttgaaaggcatctggctctcagagccccaggagattctgtcggctctggtccactccaggcagacgggccttatttagagacatcgaactgtttactatgctggcagtgcccaggcttgcttcctgcccaagctggggcagtttgccactcaatgctgtcatattgttgaaatgatgaaggctcaactgaaggctcacgcagctctccaatactgccaaaggggtgtctcatgggctcattttccctggggacagtctcctccggttacgaccagagtctttcaaaggtttcatggttggtcccatctggatgtgacgggtgggagtgcagcccaaggagtcacatctggacaggaagagtcctggggcctggaaatgccagaagctgttccacaggacatcgtcaggatggagtacagtgagctagctccctacatacgaaccttcaagttgtgaacgttcaaagatgtgaacatgcccctgcatgccagatgttgtactatgctactgtaccttgcaaggtactgtgctgtaagattaaaaatgttttattttttgtttgtttttatgtattattgtgtaaaaatactataagcctattatagtacagtactatatattctgttagttgggtaactaggctaactctgttggatttgtaaacaagtatgtaggggacttactgtactaccaatactgtgactcaggaaacagtcagtggtgtgcccaatctgagggtgacatggaaaccgaatagaagaatgagctgctaagacatagttgggaattgctaaaagagggtacaagagaaagtgggaaactggttgaatg

SEQ ID NO: 28611 - DNA, 985 bp, Bovine  19866881095913
tgaatggatggttagcactgtttctgcctggcaacagtttccaaaaataaaaatttgaaatgttatcaaatttaggggcacaagttccaaaagtagaattggtggagatatgggggactgccattttctctaatatctgacagtgctaacctttgtaagcataaattaaaaaattgaatgtagcaaaaatcatccataaatagtaaaaaatcaactatttagtaagctgtgctaaaaactgtaagtccctcaaaagccttctcttcaaatgtgcacaaacctctccatttgactcactcagttctttcaccactgttttaaggtcaacaaaataacatggatatgaggtgagaaaaccccacaacatagggaatttccatgcctaaggtcagcatttctgtatatttgtgtttctacatatcctttaaatatgtaccctaaaaagtcaactacaaaatagctggcaaggactcttcaaaaaaaaacaaaaacacaaaacagtcagtgttactgggggggaggagggcaaggtgggcagattcttgtctgatataagagatgtaacaataagcttgatgtacaattcttaaattctagatcaaaaacaatattgatatcagttataaaagacagctgggaaattctgagtattactgaataaaagttaattttcttagactatgtagaagaatgtcctcagtcttttgagatgcacactgaagtatctgggggtgaaatgtgataaagcttgcaactttccaataacttgggaagaatatatagagaaatgaagtaaatgcagcaatatgtcttgaaaaaaaaatcaataaaatggctattatatcatctcctctgagatacttggagaaaaaaccctatcttacggttgactgaacaggtcagcagacgtgctaacaacttcaaaaccatgcccttacacacgaaggaagtcaccccggcctattaccaaacctaagaagaccgt

SEQ ID NO: 28612 - DNA, 4675 bp, Bovine  19866881217295
aagaaaggagtgcttacttaacgaaagaatcaatgtaaaaaaaaaacagaatcaatgtaaacaaaatcataacaggtaaatttaaactactcaagagaataagctgtttaaacacattttgaaagtatttatatgtaattgatatcatgaatataattttccctattcaataagaaggtctagtaggactgctcttcagcaacattttgttaatttactcaggttacaattcttaattgaaagtaatataatttttaaaaatctgcctattccaacattctatgaataatcattcatctttcctttacctgaatgagtctgaatcgatggggcctcaatacatttaattctaaccataatctcaggtcaagaattgaacagcatcaaccaaattcagaacaactgatagtgctgatgttttcagaaaggaggatctgatgtgtttagttatggaaaatgcccgaccacatccatgctacactgcatggctccatggctccaggctgtaagatacatccatgaatgtctaaggtcaaatgccaaatgcaatggcccataagcatttctgaaaatctaggaaacatgtatgtttccaccctcaaaagcttctccatgcacccaggaccactcagaggagtggggtcctaactgaactctggacagctcctgtggtgagatgttctgtaggcagcgacccctgtgtatctctgtgaaatggcatcaccaaacaggaccatctttcccaaatgctgcttttcttaacttgaaaaacaaatcaaccggaaggcaaattaagaaggaaaagccaagattatctgagacctgagtgagtcacctgagggggaaggggttcagcctgctgaatggcttctgctccctgtcccccaggacgggattataacaagaagtcactgaggaagaatgagaaaaaaatacatttctttgggtacatatccacaggaagtcaaattattaagaaaatcaacaataataagagagtagatttacatgtcatagttgctcctctgagctcacagaattcatgttcaggctcacctttaaccttctaacacttgaaaatgataaaaatctgaaacaaatcttaaactcagtctctccactgaggatagttggggtgttctctcgtagctctttaagaaaaaaaaaaagtttaacactaaaatcatgtgactattttatggaaaaaaaaaagtattgagatttttaactatgaagaggaaaacaactcagagcataaaaaaggaagcaaagtaggcaaaggataataataaattttgatggactggtatatataacctgtgtagaaaatgttgtattatatttactactagtggttctttaaaacaatatagaaagcacatatttttcctaaaaagcagatattcccaaaggactgtgatattccataagcctcagtttgtccaagttcataaggaaacaaccaacataacttatcttttttattccaaattaattctatcaagttttgaatgttttgagattttacattgttaaatatgattttttgttttttcaaaaatagaattaaaaattttgtattcacatatagttgatttacaatattgagttggtatcaggtaaacagcaaagtgattcagttgtatatatatgtttttttcagattattttccattataggttactgaatattttcctttgttttatacaataaatcctcaaaataaattttcacttcacattaactatcatgttatcaagacctttaagagaaaagattgaatgttttatgggaagtatatgcaagtaaagtcagcatacggaagtaaagtaagcactgagattcaataaaaatttaaagacatgactattcaacaaatttcttcaagaaataaatgtataacaaaggcaggtaccaaagatcagagggccctgctgttttgcatttttagtggggaagagaactagcttgtctggtatcaaagtgaccactgcattttgcctgagaaagattttctcagatttggtatagtaaatagcatatttcttagaaaaccaacgattttaaagaagggtaaatatattttcctcttgtagaccatggctaaccacagcatggcacaattttggagaaataagacctcacccagttacaaaaatagcaaaaaggactcttgcttctggcagaaaagtgacatctttattgatactacaagaagagtgttttaaacttctcaatttggcttttttttttaatcaactcttttagattaaattgaaaggggaaattaaattgtgttttagaaaatgtaagtaactgaaatcattcttcaggagaaagaaaagaaagagccacaaaacaaaaagaaaaggaaacaactcaagttaaatactgaataagtgaccctgtcttaagtactctgaacaatctgggcctcagttttctaatctaagaaatgaatagagtagtagtatctgcctttctcatcctacaaggtgctgtgaaaattaaataaggagtataaaaggcatcgataaactgtaactgttattactgctgttttataaggaattctagttttattccaaaaggagttaatcataaatattaatacaaggggattattctttttcagtataagtgccaaagcaaccaagtctctctttgacttgctgacttttcctgattgacttaattcaaccctaaatgatccctggatgatctctaattcttggtattcaccttttgagtaatcccttccctttgagtgtggacagaactacagtcttgtatctaacaaacaaataaggcagaagtgacaacgtgcaatgcagtgactaggccataaaaggctgtgtggtgtcactctttctcggattactcactcagggaagcctgctgtcgtgctgtgcacagacccacggagaagcccatgttgtggggaacagagccctccagcccacaggcagaaagacactgaggcctgccaacagccccaggagtgagcctcgcagcagatcttccaggccagctgagtcttcggataactacagacccgggtggcaacttgactgctattccgtgagagacgctgagctagaacaacccagctaaaatgctgcatgtttctgaccctcagaaaacgtgtgagatgataaacattggttgtttcaaactgctaaatttgggggtaatttgtatgcagcgacaggttactaatacagagcatttgacagcatcttgctctgcaactaacatttaagatcagtcgctaccttggctatggattatcttgcccattggtaaacctgtcatttttgtacttgtcagtttattccacaataacttttgagcctgacggcttaaactgatatttgatttactacataaaaaaacacaccttaagtttgattcttgtatccacttattatcttgcaacagaaggacagctgcttctgtttttatcaaataggtttttctgtgagtctcagcagatttttaatacaatttgggttatacagagaaatatctacagggaaaattatattttcatgtaatcatactgaatttaagattaaacctatttttatttttttttaactgatatgcaaaacttattctggttccaccaaatccaaatctttgctttccaatatttattttgtatctttgtgcaactgctcttttacagctcaactcagtttaaaaagatttcatacctaaaatgcccatgaaggtttcattctaattaagccaaagagtaagtcaaaagtttgaaaatccccctcacaaacaagcaaaatctctgaactactattttccccaccctgtttgaaaataaagaagggggaaaaaggagggggaaaaaaaaagtaaattattaatgatcttattatgactttaattttaattaattcattcaaaaataattaatgagcagctgtttccagtattcaaggcattcaagatgcaacagtgcaaataaaaaataagaccagatctcatggtacttcaaatttttaaaattcaaaagaccagcccccaaaaaatacttagctatttttggggaactgatgactgtttagatccatcacaaacaaggagagtcacttaaaaccctgaattcccagatcctgtatgggttacacagatgacttgctaactttttttttggagtgaggcatttatttccagtacaaatttaaggtgaataaatggagagacacaatatttgtaattttttctgtgtcaggcatgttaatacattgtaatataaactacatagtaacattaattatttagtattagaatcccatttgacagctgaaagttaggctctaagataagatactagtaagcaacatggttggggtctaaattcagtcaattttgattccaaagtccatgttccacccaccccttgatgagttgcattttaagctccaataaatcctaagatcaacagcatctacaaaattgcctataaggaaaaaaaaatctcctattaaaactatactttaataattacttctaacttaaatttcagtctggcatcatgtagctgctttcagagtatctccacttgcatatctcatatgacatcaaactcaatacacccaaaacttgatttccctcttaaaagctattctccccccaaggttctttttaccaggc

SEQ ID NO: 28613 - DNA, 916 bp, Bovine  19866881309702
cgttttgtcaaagttgccctccagcatgcattgagcatttcaatgtggagataaggaaggcaaggagttggatctctggctctctggacctcatcttacaattctatttctagaatttcatcaattcattttaagagaacagcaaactggttgtggtgggaccctccagttgatgtcctggatggttgttatacctagtttggaaagtggtctccaaagacattctttataaatgttattgaactccttacccccactctgcccccacactctgcactgaaatctaaagagggctttcaagttgttatctgtaggaatattcaggacccacggtgagggggacaggcggcgctgcctgctgggtgatgaggaaacatacctgatggagacagaggagcactgggctagcctcctgcctgcactcttcaggccagtgtagatctgccccatttccatggctccctctagccccaccacttcaagaagctggtcactgaggtctgtagagtgagacaagcagaaccagtgcatacacatgtctctgttccccagtgtggtttgggccagaaggtctagtctccagatggccaacctagaactgtcaatatccttcagctcccaccaaacagcatttcacccttattctgaatagggcatttccccagaagtcaataaatgtaccttttcataaacagaaaccttctgttccagtgaaaaaaggttttgctccagattgtatgaccatgcatgcaatgaatagggtgacatatccagaagtttcttcaaaggcagagtaatgtaaaggatgaaccatctgtttctgaaataccctgcccccctgcccccaccttgcagctaaagacacactggtttgggattaggataggaaggaatgctgatgaaggtcattatccag

SEQ ID NO: 28614 - DNA, 1292 bp, Bovine  19866881364502
ccgctacatgtgggatctttgttccctgaccgggatccaaccccatcctctgcattacaaggtggattcttaaccactggaccaccagagacatcccaggataaagtctttagtttcccaaatttagctgaccacagaatccccctatctcagagcatcttgtgagactagtattctgctgagttcacactgatgacaaacgtgcattagagacaaacaggagcaaacgtgctcaaataacccgtagactatttttcccttcgagccatggatgtgggaacaagtcacacattcagagggatcctggttagtatctctggtgactctggtgtcttgagtaggaaaccaagaggcagagttgatgctcctgtctcttccagagccgtgagtcaggattttagaagaaacaggcacacatgcatggggagcgtgagctgctctgtaactgagccgaggacgcctgttctcctggaccacagatttggatgctggaatgacaggccccttggcaaggaatcgggagcttgtcacataaaccaaggaaaacatttttggccagagacttgaagaccaaacaggagagctttaaaatgggatttaaaggggataaagtggaatgttcaaatgaaactctaaaatcgcagcccatggaggggcagcaggtgtgagctagaaataagaggcctggcagagggggtgccgagcagttctctgaggaactggagcagggtcacatccacactggggacacgctcaccagctgcatcgtgaggggcccagcgaatgggggaggcaagcacgacctcggagacaacagaggcgaggtggctaggacacacagctaggacgccatgctaggtcagggtgacaaggtcacgtggttgtaggcactgaaatgggtgttaggagggtacacagaagtagaagtcataaacatgagagtggaagcaaagccaagagcatatggatgagattttcaaaagggcaaaatagaaaggattttgctggcggtgtgtgcactacagtcttctcaggcagagacaggctctggctggtgctttcctatttaagacttttttcctaagtagcataggaagaagatggaataaagatgggaagagggtatttattcaagcatctgccccattttatgaattgttgctttgctaacaatttcatgatgtaaaagagagacccaggagggaactcccttactctgtacttagttctgaccaggaagcatccaactagctcatggtgtggaggcacagaaacttcagaggaagcagcca

SEQ ID NO: 28615 - DNA, 1186 bp, Bovine  19866881605044
ttgtgttaaatttgctgggaccatttaacttgtttatgaaaacttgcctccccgccccccccactcccaccctaacccccagcacaatggcagcaaatgcttgtcaagacttcctgtgagatgttaagagtaaatatttactgtgtcagctaaattgcttaactaaacttcgcgattaattagttttcttttttagatagcttaaatgttgaataataaaataattcagttaagggtcgatattttacatagcgttttaaacaagaaggttgtttggattggatggcggttaaaagccagacttttttagtccctgaaactactgaatattgcttctgagcgtgttgttgttgttgttgcttttaagatacatttgaggctaaacaaatatcactgtgaaatttataattatatttaagtgcactgttgttaatgaagaagtaaaaagttttgtggaggctggatttctccacagtgatttgcttacatgagaatgtctatgaggagagattgagggagaacatctttgtttaaagtttattgtggactttaaatttgggccctttattactcattctagaatttttttctatgtgtcgtaacttagtttatatcccattcacatacatttcttcaccattagtcattaagtagctgaattggagactctaagtgaagtctgtgacttaccacctttacaatttgtaattctcaacagtgtaaccatttacttgatttttgccaaaattgaatagattttaaaacaaactattctactttttaaacacatagatgttttgttaaggggtttctaaaaatgtgtgcaaatttccaggtatgttttaactaggcaacaaaatatcttttgtttaccaatgattccagtggcgtatcagaaaactactcaatacctttaaaaaaaagaggcaaaagttatgatttgcagtttcatgtgtaacgttaagctagttctctctaggaagagatgtaatgtgcaactgataggtttttcaattaagaattttaaatttgtatacttaaaaaaattttttttggcttgataaatctaagttcaagctttctgatatattaactatttattgtaagttagaattactcataacatttgaatattggatgaatatattaaacaaggtttaaaagaaccacccaaaatatttgatgg

SEQ ID NO: 28616 - DNA, 761 bp, Bovine  19866881998510
ttcaataaaactgtttaaaaaaaaatctagatatctaattatgttagggttttaatcaagaaaggatgctgaattgtaatcagtgctagctaccatggcagaaatccccatttagtcagaggatatggctttttagagagggaagcaattgtccccagagtaatctattcaggaaattctgagccaccttgttaaaaaggaatgttcaactatatatcttatggatgccaactcttactttggaagcagttctgggctgtcaactccattcatccattcagcaaaagtcatagaatgcttacttatttgccaagtattatttgtcaagctggagggggataataaaaaatgaaaaggcatggcttggcctttaacctgccagcatttcaaaacttgtggctccattaggagtttggcccttcttccttttctagctactagcctctttgacttcagagccacgatccttactgggtctactttcccatctccaaaatttattattttttctttttagcaacatttcaagcagggagaaagtatacagaaaaccataataaacatttgtgtgcctggttacatcttaatcttttagatttttaggttttaatcttagttctttaaacaaaataaaatatgacatatgcatttgaagccccttttattcacttcttttcctacagaggtaaatggtatcctgaagttggcattcaccatttctacgcatatctatatactattatttcacatgtatatgtatt

SEQ ID NO: 28617 - DNA, 2756 bp, Bovine  19866880350835
cgttagagggcctggagtttggccccttcccctggattgaacgcatcccttactgagatgagaatcttggggacataaagtgagctgggtgttttgtattaatatttgcgaatggctggaaaggctagcaggcccatctgagcttccaccatgggcacaagagagcttgtcccatgacgtgggttgactaggcagaggggagaaagagagaaagctgcttgaggtcctattctaagaggccagttacaaccacatgtgcttagactgtctgtcattctggttgctgtggctgaggtgggaacagtagaaacgactcagacataaagacctggagctttgctgcctgttaacccccatgaagtgccattttctcagctaaacatgggatgagaataagtggggtttaaatgagatgaggggtgcagagttctttgcacagagcctgccatcctgcagaaggaacagccgacagctccgggtgttctgatcattagtacacgtgttctcacgcccacacagtggtcacttgcgaattcatgtgcatagtcgctaacagccacaccgatctgcagtcagtgcttcatacagcagagcctgctactgtgggctctttccccacacacacacaagtaacactgacatcgacatttctttcttagcaccattgtcctctcctgacttatcggtcccaggctggtatgagcaagggacaggcttggggagaggatggagagcgggccactctgattctctctgctttgcctccctctcccctgctctgtcacacctggttacttcttttttcatacaaatgacacttcgttgcaattatctctccaattaaacactttctccactctctgtgaactctgtcagaacgtgctggaattttcatccctcgatcttcactgtctaagctcctagatttcttaaatgattcaatgctattattattttttattggtgtataatcgctttatgatgctgtgttagtttctgctgtacaccaaagtgaacctgctgtttttgttgtttttcactcattacgtcatgtccgactcttttggaaccccatgcgccgtagcccaccaggttcctctgtccttgagatttcccaggcaagaatactggagtgggttgccatttctttctccagggttcgcacccacgtctcttgcatctcctgcatcggcaggtggattctttaccactgagccacataaacatatatcctctccctcttgagcctctctcccatcccttaaatgatttaatgatattatttaccacggtgtgagaatacacatctcattcaaaagtataccagcactgcacaggttcaatccccagtcggggaactaagatcccacaagtcatgcagtgaggccaaaaataaaaaaagtgtatcagcacatgctctatataaatctatatttatattataagcttccccacagaccattactctaaccaagttttttctcaccgaatcatttcatttgcccagcagaaattccctaaaacctctttaccccaaaatacaatgtggctgctaacattccattatgtaaagcaaattcagggtgctccctgagatgccttaaattgtgtcccccggtggccagaagcagtagctgcttcctgtgaaagagatctcactgacgggaggaagtggtgccattccttagggagcagaaaataaggttccaagagcacatctacacagccaggtggccttctttcccagatttgcctccacatgagcactccacaacttccttgagaccttgctgcaccttgctaccccctgtggtccatgcgtatgcacagagtcaagagaaggcactattgcctgagagcctccaactccctgagagcatcatagctgcacagtcatgtcagtctgccacgccccgtggtccccggctgtgccagggcaagaatgctgtttccaaagcaactgcaatgttgtgccttacagatgctgcaggcagagagccccacatgaacatgtgcaaacacagtcacacacccagtatggggacacacttaggcaggcacagctgaaaaacacacacgcacacatccagacaccgatctcctatattataaagttgtgctgctggagaagactcttgagagtcccttggactgcaaggaggtcaaaccagtcaatcctagaggaaatcagtcctgaatattcattggaaggacgatgctgaagctgaagctccaatactttggacacctgatacaaagaactgactcatttgaaaagaccctgatgctgggaaagattgaaggtgggagaaggggacaacagaggatgagatggttggatggcatcactgatgacgttggacgtgagtttgagcaagctccaggagttggtgatggacagggaagtctggtgtgtggcagtccatcgagttgcaaagagttggacacgacacgactgagcaactgaacaaccacagtgaatcttttaaaaagaaatagacattttatttcttattctggccagagcagttagctttccaaggatatacttagctggtttcatatttgccctttaatatttcttacaagtaaacaaggggagattgaaacccaataaatgctctgtatgtatttgtaattgtctgctgatcccattcatccaactcagctcccttgttagctgggaagggctgagagggttaggaattatacctggccttggatgtggggggtcccactctcctaaggcttcaatt

SEQ ID NO: 28618 - DNA, 1765 bp, Bovine  19866880445667
ctgaggcacagagaaggctgttaggagagcagggtacgggcagggggctggggtagggaacactttacagccctcctgcctgaaagagtccttccaaaccccttctcgaagattctgtgacttgtcaaatcctgtcactggtagaaccaccttgttgctaatttcccaatatcattttgccccacggggaatgtcaacagaacttcatctgaatgcaacttgtacctgtctgtcttgttcctggagctgaagtggtttaggatagaagaaagtggatttcctagaaggggtggatcagttagaaccaagaagcacctcttctgaagatcatcagaaagtgaaagtgaagtcgctcagttgtgtccgactctttgctaccccatggactgtagcccaccaggctcctctatccatgggattctacaggcaagatactggagtgggttgccatttccttctccaggagatcttcccgacccagggatcgaacccaggtctcccacattgcaggcagacgctttaacctctgagccaccagggaagcccaagggcagtggcgtaaatggtaacaaccccttgttgtgctgctgttcttgggagacaggaacatgggttcactcttccgaactgctggaagaagttgctgaactaaaaccatgagccctgggcccagctggggtgccggttggggtaccgttccttctcggccttagtcgactcgactgtgaacggggcagtcactgctcctccctgctggggcccttcagttctgggagcccatggttttatcgagcttaatgaaacaatggaagtcaagtggcaggagagaatttttctaccccgtgaataccaagatggcactgctgacacttgctggctgtatctgtctaaaccgtttttagcttcaatactaggataatgtggaaacaacagtaacgcagagttcagacagctgctttaggctttctgcctcctcactgtttgtttgaaactcttcccctgcctccaccctccggtgttcatgacccacgtgggtatactttctctagagaccctgcccctagtctcctcccatgttggagctgataccagccctgggtcccgcagaccagctttaacctcctttgggatccacgcactcattctgcttttcccacagcgctctctgcccccttcaccaggcctcccgagagttgctgctgctgctcagtcgcttcagtcgtgcccgactctgtgcgaccccatgcactgcagccctccaggctcccccatccccgggattctccaggcgagagcactggagtggggcgccatcaccttctccactcccgagggttaggatcctccagtcccaaagccaaaatgttttctagcttgtgtttcccaactgtatataatgttactttaaaagggggagaaggcaagaaagaaaggagggaaggaaggaagaaaggaagaagcttaaaatgcttcatgaagtcagggtgagagagggagtggcatgtactattcaccagaattcctgtagagtaatcaagtcttttcattccagagggtgttattgcctggtaattaatattagatctgattttgaaataagcctaatgatgatgactttgggggtatatattcttttgctgtatttgcataaagcctctttctcagctttgcatatggaagttaaaaaaaaaatgtgagttttgcctataagattcttcttggcatactgtatggcagaaaaggtgattgtaggcagggaccataa

SEQ ID NO: 28619 - DNA, 1133 bp, Bovine  19866880478395
ccaaaaaaattaagtctgacactgtttccactgtttccccatctatttcccatgaagtgatgggaccagatgccttgatcttcgttttctgaatgttgagctttaagccaactttttcactctcctctttcactttcatcaagaggctttttagttcctcttcactttctgccataagggtggtgtcatctgcatatctgaggttattgatagttctcctggcaatcttgattccagcctgtgcttcttccagcccagcgtttctcatgatgtactctgcatataagttaaataagcagggtgacaatatacagccttgacgtactccttttcctgtttggaaccagtctgttgtggtccaggtctccccttggaggggattaatcaagctaagtaaagtgcaatgataacactgctctgtttgtacagctttttgttttttgtggcattttaagttgcctttctattctccaactattcatctttagcaaatccttaagtatttctagtgtctcaagaaagcatcaaagactttctccccaaaatatctcttttctgaagactgacactcttctgtttcagtctaaatgaatggggtagtaggaacatagattaatacacccaggacttcccttcatcgctcttctaagttggatccattgtttcctgggcccctcagaatccccattgctttgttcatgtgtatcctgtgtgagagactaaaattttaatacatgtgcaactgcgaaaactgtgaagataaatcaagtcatatgaaatgtaaagacctaaaattatatttttaacaaatggatcaaaaaatcacacatcttagaagggctgaatacaaaatcattaccataggaggccacatatttattataaaaatgctgccatggcccaaaccacatttatcctttccttggaatattcattcagattctatattgcatgctttagaaaccttcacaaagggagaaagatctgacttgagaaactgtcaaaagttctaaagcaagtgatatgaaggtccaagagggaggggatatatgtatacgtatatccctggtggctccagaggttatagtgtctgcctctaatgcaggagaccctgggttcgatccctaggtcgg

SEQ ID NO: 28620 - DNA, 2011 bp, Bovine  19866880594767
ttttttgccaacttgcaggcaaagcctagatttttgagggtgaaagagctcaactgcttccacgaggaaagaaaggattttgagtgttgatgggcagccgaggaaagaaggtttgagggccgcagcatgtcggaaggaactctcagtcctgtggcaacaggcagtatttctagacaaattgtgagagtggaaaatttcctgtgggggaggaaatatggagacctgtgaaaaaacgacgctgttttaaattgggggttgaatttctctggttgttaggaagtgattgtgaagaaaccacactggttgtccttaaaagcctcagtgaaagtgaaccacacacagcagacttggatactgttgcgtggagagagagaggggaagaaggaagatgagtggcgatcacaggaagcggaatgccccattcactccttccggttcccatcctctccttccggttcccatcctctccttccggttcccatcctctcagacactagaaaagaaacaggacttctcctgaactaggatggggccatgagccacatcgttcagatgatataagaagatgtgccctcagctagccagacagtcctggaggcatctggctcacagaactgagtgagtgagaggaaccttcaagccatggtgccttttcacgagtcacactggagacgtgtgtcctgtacagacatctgtgtatctgtggctttctcaaggcctttaggtgacacacgcagctttcctaaaggcccgaaatctagttctttttgcccaacccggctatgtgaaggagaggaagggagatgagataggaggagatggttgtaagatggtttgcctggggttggttgcatgagtcggagcccaggctttctgttgacatcacttgctttggaagatggctgaagtctacgtcgtttttcggagcatgttccctcaagatgtcttggttttgttgcatcgcaaagatcatgtctgctttgtctccctgcagttctgggagttcccagctgccagatgcagcataagaggctgtcgaagaagtcgtttgccaaaggtgaaaagttagaggtgccaaggcatttgctgcagtcatttttcttgtctaatatttgtcatcttccattagtcaggaatactaatgagtagtcagggtgtccaaatgacaataattcaccgttttcccagtcatactgagactgtttaaatgcagctgtaggaactgtaaagcatttgcgtgttactgctatggtctaggtcccataaagttctttctggagttttgctcactaaatcagccctaacgcactttcatcttctgtgtgcgtgtctcggcttttcactaaagcttgcttctagatgtttgcttggttggttcctcatcccctttaatgtccgttcagatgttaccgctctggcgagaccttcactgcccttccccccaaccactctctggtttagagtgttgctcctctgcctctctgccgttctgtagtagtttttcgtcttatgcggcttttgttttgttttagtggtacttatcactaactgccttgctttgtttagtcccttcttggttattgcctttttcctactaaaatacagggcttctcctgtgactcaggggtaaagaatcctcctgccgatgcaggagatgcaggagacacaagttcgatccccgggttgggaagatcctctggaggaggaagtggcaacccactccagtattcttgcctggagaatcccttggacagaggagtctggagggttatatccatggaatcgtaaagagtcagatacaacctactaactgagcacacactagaatacaagctccgtgaagaccagggtctcatctaacatgttggccattttacgcaattactcacactgtgccctgaacctagcaggttctcagtaactatttatttagacacggacaaatgaatgagtgaaactactctttatgacacattactttatgggcttgtcccagttctcattctcttca

SEQ ID NO: 28621 - DNA, 999 bp, Bovine  19866880614560
gaaaagggggcctgcctttaagcctgcagcctttctttgctgagccacgtagggcctgttaacctgacccacatgtttggagacagagccatagcacccgcgtggctggggcagcacacaagtcctccactttccctggtgagaagccggtacaagcgatggactccactctccttatggacatacagatgtacagaaccccacatacaattgcaggaagccctgggcctgaagcccctccaccatgccccctcataggggactcaaggccatcgctcaagtcctctacagcaaccattctgaacctgacccactgcagaaatcgcagactcatttcctccagcagaccagtagaaacagtctaatccaacataacgaaccctggcagtgtccgccaggaacagctcaccctcccaactctgcaatcatccagattccagaaagtttatccttcaaaaatggccaaagtcaacccgtccatttccctcccagactttcacaagtcttggtggagatgagaattgaggttacctgagttttagaaatcggaattgccagcgtgttgatggaagggagtggagaacagggataatatataggttacctagaattgatgggctgcaccacggcccagcaccttccttgtgaaagtcaagatcaagcatgagagataagaactcgacctgcagctgagggaaacttggtaaggcgttaagagtgtgtgttcattacgcactcgtttatcaagcgcccactacatgccaggccctgttctaaacacccaggaaacatctgagacaagaatagaaaaaaaaaatccttgccctgaatgtaacctctgagcttacgttctagtgagggctggtctgctggaggaaatgcgtctgcgatttctgcagtgggtcaggttcagaatggttgctgtagaggacttgagcgatggccttgagtcctctatgagggggcaaggtggaggggcttcagggtgcgcagggcttc

SEQ ID NO: 28622 - DNA, 596 bp, Bovine  19866880700696
tgttcgtggctgggaagagcgtcctcagggactctccgcaggggggaatccaagcaatccgcttttgaggtccctgtttgtccagagagaggaatttcacccaaacaggattgatttagcagtctctgccccagattgactcacgtttccgtctggggatccctgatgctgacatgactctgtctgctagcatatggaaaagctgtttgttttaaaaaatccatctctcggggaggagtgggctcgtgtgaatgaggcctggcacaaacaccggtgtttgacgttcccgtgacagtcgccagcagtggagggattccccgtctcgggcaggggagccttggcggctcctcggctggaggcccaggggcttggcagtgactgccggcgccctggctggtagcggcaccctgcccccccgcccccctgccctgctcaggagggggccgccctgagagcagggtaggggggcagcgtcagggagggctgtatactgactccagccgccagaccacaaggtggagggactccaggcctgtggaggttgtgataaaggcttgcttctccttcagcacccctttccagaggcgacatggctg

SEQ ID NO: 28623 - DNA, 1197 bp, Bovine  19866880730734
agatagtgggggacagaggagcttggcatgctgcagttcatggggttgcaaagagtcacacgcaacttagcgactgaaccaacaaccaaacatatatctatatccatactgtgtgtgttctactgtgcttaggtgctcagttgtgtctgactctttgcgacccccaatggagaaatgcccaccaggctcctctatccatagggattctccaggcaagaatactggagtgggttgccatgcccttttccaggggatcttcctaacccagggattgaacccaggtttcctgcattgcaggcagattcttttccgtctgagccaacagggaagcccgaatctatatgtgtatgtaaattatagggggaacattcatacattacataattaatgggggaaagggcaaaacaatggtgtattagccaggcttctccagagaaacagaaccagtatgtacatgtatgtttgagggaagctggtaaaatgactgtggtcttgtcacggagactctttgacttttttaattcactggagacttccccattcccaccagcgcctttaaatagatcagctttcttggactcagtcttccttcttgatttccaggctcactgcctactgtttaaggacacagtccccaaggatgttgtgatgatgcaggataaagtcactctcaggaggataacagtcctggccccaaagctgacccaagggagctgttagaacagtgctctctggaagttcctgtgccttctctgaagatacgagacatctaagagtcagatgggttttcataacctcttagcaatatccaggtccttcaatgtagtgtttctgaaggctgtaggcagactacgcagacccagaactctttatctgtaagtttacttcaaaagcactttgttctggacatatttttatgtccagcatcagcagcagccctgagcatagagctttccagctccaaggaaggcaaagcttaaaaggggaccatctgcagcttaggatttcccagcttctttcctacctgggaagtaaaagaagattcctggtgttggatgctctgaactgagggtctccaggatgggagtggactctcctctgttgagtggccctattttgatctacaaagcccagcatgagctgctatggctctcaggaaccagctattcacacaagttccgcctcttggagaccaca

SEQ ID NO: 28624 - DNA, 1051 bp, Bovine  19866880815879
tttttcaaaaatagctcaactgtaaacctctttcccctaagccttctcaggtgctgcaggagttaagtgccacttattccatgtctttatagcagtttacttccattttaacattaatgcccactgtatgttagtcttgtcaattctacctcccacgtgtgacaaactcattttatataaatgataatatacaatacatctgtgtggttattgttattattacctgcattcctttctccttaaggtcagctccctgaggtcaggagctatgatttcccgcttttctacctgtcataccctatatgacaccagcctctgctgtttagtagaactttgaggaagttacaaatcctgttaaatgttaatggcataatttatggtctttgtttagcaatgatgtgtttgctcctggaatcccagggaggctctccccctgcttcctacatcctgtgttctggaactccccaccaatgcttgtccctaggggaggcagctgccacctttgctgggactttgcctgttaccctgaaccctgctatccaagatttccacattatctgttcagcttatcaccatgactaattagaggcaccatttaaaagctagcttaattggaaaactgcaaagtaatttagatatgataacattatctccaaaagggaaacattaacttattttaggccataattttagtagaagatacagaattgctaattatctgaaatgaggctgctgggtttttttatttttatttatttttttggctgtaccgcatgtcatgcagagcttccctgaccagggatcgaacctatgcctcttgcagtagaagtgtagagtctcaactattgggccatcagggaagtccgaggctgtcttttttgtgtttttaataattttatttatttatgtttatttttggctatgctgggtctttgttgctgcacaggcttttctctagttgtggcaagtggaggcgactctcaagttgtagtttaaaggctcctcatcacgctggctcctcttgttgcagagcccaggctctcgagtccag

SEQ ID NO: 28625 - DNA, 842 bp, Bovine  19866880841530
gaattaacaacacactacatttgaccctctctgtgctgactgcctctcaactttctcatggctccagcctgctattccgtcatgcctcgttttgaaaatattctgtttcatttaacaagggtccatgatccaccctctaatcttggccatttttaaactgatgtttcattttcttttcttttgtttttaattttagccggtattgcagatgcaccactttctccactgctcacttgcatacccaataagggaaagaattattttaaaattagagataaataagctatatgtggtttttgttaagtacagcatccttgactgtattgcatatgaattttagttaatgactagctggagagcttctatctacaaaacctgttttagaaattcatccttgatattgaagatttggaaatgttcaatgtaattcttgggactgattctttcctcctgccgcaaagcatagcagttgtgggactaagatgtgacaggatgtcttttctttcactcctgtctctcctcaatcccagagaggtctggttccattgggattttctcttaagacttggatcacagaaagaagcaccaagaaactacaccgaactcaaaattttttaagagaagcataaaattggtccattcaaaggacacatttgggcccattaagttattattgcaagaggtagcctactaggtgattcagttatacaaaataatgatttcattgtaaatatgatatttctcataatctattttatcacacatatggcattcaaactgactggtaatataccaatttgtaaataaagatatttaaaaacggaaaaaaaaaaaaaaaaaaa

SEQ ID NO: 28626 - DNA, 929 bp, Bovine  19866880851853
acacgactgagcatgcacacatgcattggtaaaatattcagtatgacttgaataaagcaatcaaggctcctgaagagggagttatcattccaaaacaatgcttaggtttcacttactacgatttcaatcaatatcccaaatgggtgagttttgaacttgacaaattcatgataatcactagtattctttagaacttactgtatgccacatatatctatgtgccatatgagttttaattccgttaatcctcaccacggtcccatgcagaaggtgatactattgtccttagagaagatactactattgttctcatgggagatattgccattattctcaaatgcggaagctgaggcaacctgcccaaggttagaaggctggcagatgccaatacaggatttgaatttgaacggaaatccacctgaagttcctatgttctaaatgccattgcaactgtcttttaaaataaaaactggggaaataaatagataaggctaccaaagaaaaacacgaatggaggcagactagccccgacagctatctctggggtggggtgtaatacacagtgtgatattatatgaaaacagataaagggactcaggggaacaaaaccaatcactgagaaacagaatctattgtgtacattaatttaattataagtgtattcaaaatcagacagatattttaataagttgttttagcacaacaggctaagaactgcaaggggagggtaaagattcactttgaattaataatttctcctttcaccatatacaaacagaaatcctaagtggaataaagagttaaataaaaccaaattgtatcataaaaatagaatgtgtattattaaatatttatcaactctcaatggagaagaaaagcttatatagtaaattacaaaggaaaatagcaacgactcgataagataaaaa

SEQ ID NO: 28627 - DNA, 914 bp, Bovine  19866880911188
aatcttcccctagtcgagccttcagatgagatcacgggtctggcaacagctgacatagggaacccagctgagctgagctcggattcctgacctgtggaaactgtgagataattaatgtttgttctttaagtcactaagtgtgggggtaatttgttatgcagcaatagatagctaagatttaaaaagttacttaacattaagtaactttcccaaagccacaataatgtaagtaaactgattaatataacaaccaatatgaattaaaccctcagaaataggtaatgattgtgacacagatgaggaagaggataacaacggctgattgaaatgaataagccaacaaatgctgtatcaaaactgtggccaaaagggctttctggatgaattttccaaagtgcatccttcttcttcagaaaaatgaagaaaatcaaagtctgctttctccagctttgtctggatgcaaagaagttcagcacaaagcagcacatacctactccttccaaacagggcggaactgcctcaccgtgtccatatctcaccagagaaggtcctggtgttgtcatgaagtaaatatgcacagcagaggggatccaaactccagtcactgggctttttaaaagcttgtatttatatatttgatgtgcaacctaattagaccagagcatctttaattaagtgtgtcagccccagtggaagccacagagttcaacgttaataaagctgataaaggtttttgtttcccagacttcttttatttaatgcctcgaccatgttaagccaatctgtaacatatgggcagtttctcccactatggatttatcatttgggtgtttctttctgtgaattaatacaatcaaactcctgccagtgttaattatttttctccaagaagcaaacccagaattcagcaacaa

SEQ ID NO: 28628 - DNA, 1838 bp, Bovine  19866880993370
gtgcccagagcaggacctgtttctccggaaagctgtctgtgacttggggggttcttttacaaagttaggtgattttttcctgctttcctcagagtgagtgttcaaagagaaggactcagaagatcagggagacatgagttcttggaagggtctaacccagcacaaagaagatgctcaaacactcaacatatgctggtggaatagatgcaagcagaggattattccagaagcttccttctctgagtgtatgttggctttgggcaaagatgcaggtctccccttcacaaactgttttgaaaaataaactcttttgaacggggcttagaattctttggcaggaagacattggacacttggaaatattactattatttctggagccaaatttagcaaggacggctctgtctttaattattggttgatgctgagttgtacaggcaaatgattacatgcacaattagttgttcccacaagtagccaattatgggaacgattatttaagaaaattgtggctcctgctaagggactttacattgtagcctcaaagtacatttctgtataaaatttccttttattgcatgtattattattttttcccttctcccgggctgctggagaaagtggcccttgtggtctcatttgtggggagagagtccatggaaacccagaactttgggacatgttgagactcgggcaagagtggggttgacaactggggttgacagctcttccatggccccttttgctctggagactgtgtcttaaccccaaaggtggaatgactggaggaagacttaagtctctgaatggtgacaagggatcatctggaggcacatggagccctgtagcacagccacgtgttactgttgactcagtcttggccttttcctgcttccgcctgactgtgcttcttacctaggcctctcctctcccggagcatcacagatcccaccatgcacccaaaccgtcctaaaaccataacctttcagaatcagaggggcagaaacatcatctggtccatctatctcatttcagagatgataaaactgaggccagagaggagaaagactcgcccaatgttcataagcccagctgaaacgtgaccccagcgtgccctattccaaagccttggctctttccactgtgccgtgccagcttctgggggcagcagccatggggcagcgtggccacaagcatgttgtgatcgttacaactgaggggctgatggctccctccaggcctgaaacacactgggaaccatgccaaggcacggggaagggaatccagagaaacttctaggttcctctcgttatgtacctgcgtggaattggaaaatatatttacctgagatccccttctccctttgaatatttcttatgatacagaccctgatacctgcatgagcaaccctgacctcatgtaggagaaaccacaaatccaaatgccagtgtttggcatctggtccataaaaccctgttccgtccccctaaatgttcagttgggtttctgtgttaactgctgtggataaagagtctttgcccgccttgttttcatagtgacacctactcttctgtcctaatgtggctgtattacgtgactgggcccaactcttctgaaccctgcactggtattttacagtcatacccctgccacagcctcacggtgcgtgaaatgtactctcctgtttttgaatttggatttggccacgtgatttgctttggctaaagagttgctaatatatgtggtgtgagcagagctttggaacatgcccgcacatctggcctgctgtttgtgaaggactgtatcctcagtcaccccacttactgggccacccttcg

SEQ ID NO: 28629 - DNA, 1308 bp, Bovine  19866881006846
atcgaactcacaacccctgtgttggaagctccgagtcttaaccactggaccactggagtggttgggggcactcttgggggcactctcacaagtcttctctaattaaaaactggcagatctggttcttctttgctgccgcacacaaatggcactgaatactattgaaatttcttatcacagaagtaggtccgtatttctcctcactttctgttccctcttctcatagagtcagaaggaaggtctgccttttccaaggcaaaatggaactcctgatttaaattcaaaggagaagtaagaatttatatgaatgtattttcatgtctttgtattcttcctttcaaagcagttcaaaccaaagcattaaacgatgcttaagaaacttttctttttgtaaaaaaaaaaaagatagtgggagtaggaaaacaaaaacccactacggcctgaaaatacacccccacacccacccccgcagcccgccactgccctttcagttccctttaataatgagagacagctcacgatgactttcacttcagcatctcaaaacactctttctgtttctggcgcctccttcatttataatctgttaataaatgtctctaaacaacctgaagctgaaaatgccttccaaaatgttgtcacgggaatgaatgcttctctattaattctttagtcatgttgtgacaaaagctctctctctggagctactacttttgaagaaagaatttggttcctgctcccaggtttcttggcaccagaaatgggactttgttgagcttgatcgcgccatctaaagcggtacaaaactcaagactctcttctgggttaaaatctgtcctaagatggtttattctgcccctctcccccagtccccatacacgttcagctatatagtaaaatgcctcggccaaaagcttcatctcacttccaagacatagcatcctgaactctcatctcctacttcctcatcggcacttagactgcaggcaactcaattctcttacctacagacttactaatggatctagtgcctctggccctggagataaaagacgctctaagggcacccagtccatctgtctgttctgtttctccttactgaatcagacagacacatgcggcactgaaggtacacaccatccaccacagagaagcctgtaggagggagcgattatttggcaaaacgggaaaaatattacaaaagaagggatattgggtcctgaaggatggaaaggaataaaaagcgagaggtcaagagaggcagagatgagaaacgcatatattcacagatatgtgtcacactctgta

SEQ ID NO: 28630 - DNA, 2008 bp, Bovine  19866881160392
ctgctctggcccacgtcccgggaagcacactgtgtgtggaacatgcagtctgtggagcaggcataccgcctgggacattcttatgctaaaacagttacttgtcatctatgtggttttataattccccaagtctggaaacgctactccagactgcctgaccttgaatcctggccttgcccttacaatctgtgtgactctgagccacttactgaacctctctgtgccttgtctcccttgtaaaatgaagatggtgttagtgactttgaaaggttattgggaggattaaaagatttttaaaaggtcaagcatctagtgtaatatttggcaaaaagctctcacggcatggtaactattaatgttgtctcccgagaactgttttcttgggttccaagatcgggtgtaagatgccactagcagtctcagtgtaaaacaggagggcagctgttgcaggtggggccagtggggtcagaggtggtgcagaacgacagttctgagcacaggctttggagctcaaggggtctgggttcccaaggcctccagttcctaacagcaggctcttccacagactctttgaggtgacatcctgtgtccttattgacaaatggagttatgcatggcccctgcctcccagggctgctgggaggaccacccaagatatgtgtagattgctcagaacagtgcctgaagtatagacaggacctctcccctggaaccccagcctaatggggaatagtgacgggccaagattcctgttccgcgtctgccacatattgtgtaagctctgtgactctaaacaagttactcgacctccatgcctcgtcttcctcctctgtaaatgtgtaccatagtacgactgacgccccgggtgatgatcggatgagcctagcacttaattagttgctaggataagatgttggggtttcagcagctgtgattccttttctcctgcagactctccccatgttggccccggtttctcgccagagtggattctcaggcagggcgtctgccgggcttacagcgagctgccactgggagatgcactgtgtccgtgacagctccaatcagctcggaacaaaagaacgcctggcagtcctgccgaccgccttttctcaggggcgtggggttctctcgaaggtcgtgggtgctatgcttttgtttgttgttacttatggaacgaccggctttgtgcttaggtatgcacgtgcacacacagacacaccccgtggtcactgtcctgcatgggcccaggtctgctgtttgctcctctgcacccacagggtcaccctgaagaacacaggtgtgacctaaaggaagacgtctccctccacactcgagaggggagagaccttgttagcttcctgatagaagaactggtagtaaaacctattgaaataaccatgagacccttactaagcgctcgctattcactccaccacccattcaggattcatggattcttttagcaaatctttaatgaatcacttttccctgcaaagacaggaagggtcatcccatgggactctgtggggaatggggtttttttgttttgcacagagcttttgacctagttgaggatggtgcatgagtgctttgggggcaggggagagattcaagggggccgaagggagctggaaaaacaaaccaggcttatgggggtttctactgattctgtttggaggctgccttaaaacctgtctccagttcaaaaatgtccatcatgtacaagctagcgtatccactactaagggtttatcctccagacctgtgtgtgagactgttcattcaacatagatttgaggaacaaaagactggaaacaaccaggatgttcattaataagagaatggtaaataaatgattgtcgtttaaacaatgggatattatgaacttgtgaaaaaagaataaagtggatctctatatggtgacatggaaagaactcaaagctcttttgttgagtgaaaaatactgaaggcgatataatgagtttggaatgttccccttggtgga

SEQ ID NO: 28631 - DNA, 1494 bp, Bovine  19866881224200
aatactggagtgggttgccatttccttctccaatgcatgaaagtgaaatcactcagtcgtgtctgactcttagcgactctgactcttagagcccaccaggctcctccgtccatgggattttccaggaaagagtactagagtggggtgccattgctttctctgatatatatctacatatatatataattttatgcttttatttttccaagatgcaacaataaacataaattgcttttaaaagtagaaaagataaatagtctcaataagtcctgcaaacctgatcatgttcatttcctagttcaaacatctccacagtcatcacgttctctggaaggctttcatttattcccccaaggtagattcccctcatgatggtagagaaccccatctttccctgtactaacgcttttcctcctgcactctaaactgcctattttctgaactatatctcatactagaccataagctcaggcagtacaatctcatcaattccctagagcggtggttggcatatatttggtgttctcttaaattgagatgagcaaatgaatgatggtgttatgaatttagccacatctaccacttttttcaccatccaagagacgtagaggggctcacatctttgcaatctaaatgtgtgtctccaacacttaagatttttgataattaccatgcctgaaccattccttagcaattgctcaggtacaagacgctgtataaactcatttcaaggatagtttaagcccctgaggaaataatcttattcgatgaggaatgacttcgcataaaagtctatactgcttgaaaataagctgctatctatccacagggaataatttaaaataactttcaaaagctgagagaatcatatacccagtcgatattcttcaggtgtctaccatgtgccaaaaaatcaattcagctcatccagtgtattctctttgacaatatttgcctcttcaaatactggtactgacactcaagaagttttatcactgactgttcattctggaattatatgtgtttcaccttgggtacaagtggtacatagaggaatatgtcaaattaacaagttgtgttggttcttatgtgagtttcatagtttgttaatgttttgaagcaatcgcaggaaagagctctgacaaggaaagagaaagacttaacaatgcttgaagatcaagaacaaagctggaaacgcattcaagtgccttcctttaatctgagtagtggcccatggtggcttcaagaattattacctttccagtatgctaacatgactggcaaagctgcaaattacagatgaagaaggtacaaaatatttcttttcatacagacgaatgcagagggctacgctctgggttagatttcatttcagtgaaaacggtctccattagaagtgaatgacctcttcgagctacagagagaagaaagaagtaccagcccaatttgaaggctgtaaggatggactgaccggtaagagcaaacatcagccag

SEQ ID NO: 28632 - DNA, 1861 bp, Bovine  19866881243249
tattgtatatatacatcaaagctgttaaaaagtatgtacagtatgattttcttttctgaaactaatatatagcatataaatatgtatttcttaattttagagaaaaattgcgctgtgaataatttttaacagccttaatgaaatataactcacgtaccatactattcacccattttcactcattcaaagtgtacagctcaatggcttttagtatattcacagagttgcactacaatcaattttacaatattttcatttcccccaaaagagcctcccccattccttccacccccaggtaaccactgccctactttctatctctgtggatttgcctattttatttcatataaatggaatcataccgtaagcagtctttgtggctggctcctttcacttagcatgttttcaaagttcgtcagcaccgtggcacgtatcagtgcctctttttttatgactgaatatgtacacactgttttttgtactgcttttccgtcctcctcatatatctaaacatctttccaagacattaaacattcttctgtgacatcattttaaatatttgcctgacaatctgcggtgggaattcatctccagttgcttacccatttccctgatgttgaacagtcctgttcttgcattcaaaatgaccaccaggccagacattaccgtcaattagggtgctgctgcctaggctctgggcttggttttaaaggctacagaggcttctggctccagaacttccttacttcatgacttaattcgtttaaatgaaacccagttgagttcaattcaattttgatggctcatctgtactgaacacactctatgtaccaggtacgttgctaagcattttattttctttacctcacttagtgatcaaaacctatgcaagagatccacacgttagcctcattttacagatgaagaaactgaggctcagagaggttaaggaatgtgcccaaggtcacacagcctggtagcaaagccaagactggctctgagcccttccttggagctggtaaagggtataactctgcagatcgccccagggggtcaccttgacccctcacagggcccccctgcaggcctagggaacaggagacactcctacatgcccagggaggcttccgccacccccagacccctcccagccagaggccctggggcctgcatttgagcccagctgcgtcagaccacagagctgggtcctttctcctgtccagcatttcccccgtctgcagtcacttgtgtatctctgtcatgatgttcactgtatttcctaccacttctgttaaatttacaaaatcacattttcatttaaatcaactcactctttccctagctcatttggaagggaacccatgacaacccagggcaaagccagcgttgcgcgctgccaaaggagaaagtgatgagcgccgagtgctgtgatgaagcacaggtcccgagcactggcctgatgctgttgctcttgccaagaccccatctctcccttaaagagaacactgggaaagtattcagtgttaagggtgtagtggcacctaactgagacgctctccttgacccggctgggaagactggaagagaagaaaggattaactttctcctggtatgattcagggctaacgagtgaacagcagggcccacagaatctccacctgagcccctggcctccgcgcccccccactctgggaagttccacagtgcagcgcttggagcatttcctggctccagggtgcagtgggggcggggtggggggctgtcacccagagggcgagtccccaggccgacccttccccctgcctcacagacctcagcacagagaggaagcactctcccccgacgcccgcagcacgggatt

SEQ ID NO: 28633 - DNA, 909 bp, Bovine  19866881246365
aaaatacttcccacttatgctaatcaggggtccttctgaggatttcattagactgaattaacactttgagcagactttctcaaaatgaggttttccccaggcatttactaaaccagaacatctacagatgaagccccgacactgcattacaacaaggctctcaggtaatcctccacacaaccaagttatgagaacccccttttagggcccagttctgttggggacaatagatgatactgagccgcccaggcactgccctcctccagaagccagcaccttccctcgctaacatttcctggagctgccacgaagctcctatgatttccagatcaaattaatggttgcttgatggtgtctccaaatctagattagcggaccttgaactctagaagaactggaggattgagggatgctcaaacacacacctaatttggattttccagataaaaaacaatacagtaaaaagtatagcattttgggacagttctggtttgaggtagcccatgatgttaagcttgcggctggagggctaaaccccagacctccctttctaagatcagcatcatcacctgacattctaacagaaacaaaacaggctcccaaagccaacctagcttggaatccatgctctttagatgctgagcttttgtttacccctgaataaattcaataaagtgcagtaaccattataataaatgtagatgtcactaattacaacactagattttaagtgcaacgctagtgtctcaagtggcctttaaaactgagtaaaatcacagccaattcaaatttaattaaaactatcagtttaatttagtttgcctttacaataaaaactacactaacccattaactgcattctgaatctcccattacgcagagcaaccagcagcttgtgggcctccacag

SEQ ID NO: 28634 - DNA, 2523 bp, Bovine  19866881300597
tgataattctttggcgattcttttccttatagtttattataagatattgtatatagttccctgtgctatacagttggaccctgttgtttatctattttatatagtagtgtgtgtgtctaatgcaaaactactaatttatccctcccctcttttcctctttggtaaccataagcttgttttttttgtttttttgtttttttttgtctgtgagtctgtttccattctgtgaaaatgttcatttgtattattcttttagattccacatataagtaataacatatgatatttgctttgtctaacttacttcacttaatgtgataatctctaggtctatccaagttgttgaaaatagcattatttcattgtttttttatggctgtctcactcaagcttctcaagagtgttacccatatgtctttacatccacattccccacatccccctgcatgcatcatcacactgcaatcaagccctcccaccaaaacactctatagaaaacatgccccttaaggtttccaatgacttactgtttattacagccaaaggactctgttgaccacaccattcatgaaatacaattttccattaccttccataacagcaaagtctcttgttttgcctcctacctctcttgctattccttgtaaatctgatcttctgtctcttcttccatcctgtaaatgtccactttctccagtcctcctctcctggactcccctcctatttacattctaatctatatgccaatgatttccaatctctatctccatgacagatcatgcttttgagtctcatgctcacatgacctactgctgtgaatatctatacctaggtgtcccacaaacactctgaactcattgtcctttccactgaccccacttcctccaaccaatgcttcttcctcgattctctatctccactactggttccaccacccacctaatggaccaaaacagaaaccaccaagttatgcctcaactcctgcctttccctcaagcctacataatgtcagtcaagtcttacttgagaggaatgaagagagtataactgaaaatcacattttttagcctcctttgcagctagctatgaccatataattattcaggccaataagaggaaagcaagattgcatggaactttcagcagctgtttatagaagattactcaacttttgcatctccttttctgcctatttcttccatcctctcacacaaaagatggctagagctccatggccaccttggatgcagcagtgaccttaatgggagaagccacagctgaagatgaaagagacaagaagaagcctgatatcctgagaactttggagagcatcacaccaatcttggactgcctaactccaagtttatttcatgtaagaaaataaaccttgtttcaattcagttcagtcgctcagtcgtgtccaactctttgcgaccccatgaatcgcagcacgccaggactccctgtccatcaccaactcccggagttcactcagactcacgtgcatcgagtcagtgatgccatccagccatctcatcctctgtcgtccccttctccttctgcccccccatccctcccagcatcagagtcttttccaatgagtcaactcttctcatgaggtggccaaagtactggagtttcagctttagcgtcagtttaggccactgttattgtacatttcctattaaaagcagccagccataatcttgactagtgtaccaaattacgttgattcttttttaatctttcaaattccatccatttctcttcatctgtattaccactcctttgcttcaagtcaccaactgacactccttccaattaccaaaagagtatattaactggtcaccatggcttctaatcttcctccaaactaatccactgtccatttctgaggggcaatctgagattatgcaacaaaagtgttaaaaatgttagcatttttcaacctagaaatttcacttctcagaatttatcttgaggaaaataataagacaggaatacaaataattatgtttatggaggttaaaagcaatatttaagttgtttataaatggaaaaaatctagatgtccaacaatagggggtcagttagacacaaaatagtgtatcgatttaagtgaaaattaacctgtcattaaaaatcatgatgtagaataatatcttaagatacataaggaaataatcattatatatatgtataagaaaaataaaacaatatatatcctatgttctaatttgattttttaattatatagatatagaaaatactttcactcatatttgtacctataccaaggaagctaacactttaattaattcagatatcacatcactatttaataaacatcaagtatatgctaaatgtataatatatgtataataatatttatcttagatatattagatatatatatctatgctgctgctgctgctaagttgctttagttgtgtccgactctgtgcaaccccatagatggcagcccaacaggttccgccatccctgggattctccaagcaagaa

SEQ ID NO: 28635 - DNA, 972 bp, Bovine  19866881311377
atgattttcccccatagcaccttccctcttacctacctgcctcctaccaaattgctattaatatcaacagttctgctatgattaggtgcatttctagaaaaactcatcaaatacttgattataaaaacagtgctttcagtgggggagagtgagtgaaggagtctgggagatttagacttacagcaggaaagttatttttctgtaagcaatgtcagtgaggtttttccccacagttataaagacataaagctgcagcatcacattgtaaaggctgtctttgatttctctagcttttggctccgcagctatagttcttccagatacacttttatgttaacaaggtacagagttcctcaaacaaagcagccttgttgttggccccggcagcctctgtcaatatcgctctaggagaaatgctcaactcagtctgcatagggcctcaaatatctgtgttgggaaaaacgaaagataagattcgccatacttttgtgcactaaaaccaattaatatctatactttgaggtgataaaattaagaaagcatttacttttttctgttttctttttcctagagctttgaaactcacaactgtactacatctctacaagaaggaagccttgggctagatataaatagtatgtgtattttaagataaaaactgaaatttggaaggacattccttttcagatttctctcacccagtaaaacatttctgtaccaggattgtgattcaaaagtatctcctgttttcagaaaactgaaaagtaaatttctgttgaagtggggaagctaagctaatataggtctcctttagaatttgctagaatggcatctaatcataatcacaaccaaaacaaacaattaaataatttaactgagcatttcttctgtgccaggcaccatactaaggtggttatatgtatcatttccttaatcttcacagcagtcccatgaacaagctcttttcatgag

SEQ ID NO: 28636 - DNA, 962 bp, Bovine  19866881345677
acctgcatttcttacccattcccaggtgatggtgatgctgctgacccagagaccacacttggagaatgactgtcttagggtatatttaaaagaactgggttaaaacccgccattcagggaacttaacttgaaaggcgtcaaatcaacttttcccactaaaaacaaaccaaaccaaacaggtgttgggcctgactaagcagatcactggtggacttcaagtgtggcctgtagctgcagaaaattctaagcaggaagaatgttattggaaggtttgaagggaggagagtgttatgaatatgaatatgactattagattagagtggtcatgatataaatcttgaattttgctaatggtggccaagggcttgccccccacctggctttcctggtgggcagtgactcactcctagaatgagccaggtttgcaggctactgtttttttccctatgtgatgccaactgggttatataatgactgatttcttcaatcttttgtccaataagtatttatgagcactgaccatgcacaaacactattctaggtgtggatgggctagaaggatacaatttgtttttccctcaaaaatatagatcacagctggttacacataactggattaatataaaaggtgaaatgaaaaagcaaattcaaaatttccaaaggttgtcctttgcaacagaggaacttactaaatacgataaagaagtctattttaactcagattatacaaaattaaagtgacaaatgaatgacataagtttctttgaattgttttccacttgaaattttagttctttttaaaaaatattgatagcttgtagttagtttatagcaacatcctaccttatattgtgcaaattctagtcttggttgaggatagtctccaaaaatttcttgagtcactctctgcactctttctttttcaactttgttttcatgaatgatccttgaatccactatag

SEQ ID NO: 28637 - DNA, 1165 bp, Bovine  19866881362946
tggagcctgtggtcactgtggccagcgtgcatcagtgggatggggagatgagccagagagaggctcctggcggactcgtcagtcttgccgccatcctgcctaagctcaaaggtggttgaagtcaccagcattggagtcagggctcagatctccagttttcagctatgcaactttgagaaaattaataaacctccctgggcctcagtttccccaactgtgaaatgtgtgtgccacaacttcatagggacttgtgggaagactggaagcgctgtgtcaaaagcacttgcacacagcaggttatgaagtgttagttctcttcccctccgtcagagagggccagggtgggtgaggttcaaagccaggtgactttacaaactgcagggaagttcccctgccctcgcctcagcctgcttctctggacctgcttagtcctgcttggaaccttatatatttgggcatttagtgagacagagaattgttacattttgctaccatcaccagtaaacaaaatacaaggctttccccaaaggaagccatgcacaggggacttagtaaagagttctggcagcccgaggatatcaactcccttcacccactcaatgcccctccccttccccccatacttgccccacaagaccccatttccctacaaaaaatcagcacctctgtggctctgaatttcaaattcactagtagcaatcacactcatagctactgattgttgaggtccttgatgtgctgggcgatgttcaaaggtatttacacacagtatcatggaaaccctctgatgggccatatcagcccattttacagatgatgaaactgaggtccagagagtttgactagcacacccataacctgttagttcagttcagttcagtcgctcagtcgtgtccgactctttgtgaccccatgaattgcagcacgccaggcctccctgtccatcaccatctcccggagttcactcaaactcacgtccatcgagtcagtgatgccatccagccatctcatcctctgtcgtccccttttcctcctgccccccatccctcccaggatcagagtcttttcaaatgagtcaactctttgcattggaggtagccaaagtactggcgtttcagctttagcatcattccttccaaagaacaccaagggcgatctcctttag

SEQ ID NO: 28638 - DNA, 902 bp, Bovine  19866881367639
catgtactgaccctctcctgtgtgcagaatgggtataagagtgctccctggttgcagagtacggcagaagccaacacaatattgtaaaacaaatatcttccaattaaaaattttttaaagatttgaaaaataattttagtgagagcaaaaagtcttctgtaccattaataattaaaaatgaaaccatgtttatttcaattaaaaaaatgttactccaggggctaaattgttaatgtaaggctcccagaactgaactgggtccttgggaaacccagcctgagtatggggccttctggatcagtcctctaaacctggaccttacctggagggactccaccgtggtggaaggcatggtcagtggcctgggccagcaggtctctgggtgatgctggacaaggcgatggaacatttctgagcctcagttccgccatacgtagatggagctgggactaggaatacttaccttgccgtattgttgtgagtcaaccttgccaaaatgtatgtgagagttcacaccagcgcttattgtatccagcacacacatttaagagatggtctcagtaagccacccccacccccaccccgaccccttcacatccctggaatggctcaaataagttcagataagtttcaaataagcctgtgatgattctgctgcttctctttcaggtgaagtctactacaggagcaaatacctgagaagtgatacctacactgccaacatcgaagcaaacaggattgtggtgtcagaattcggaacaatggcctatccagacccctgcaaaaacatattttccaagtaactgtccgttttgtatctagtcccgctttccaatatccttgacggtcgagacaaccagcgtttgctcctctgacggtgtgtttagggggaggaaaacttc

SEQ ID NO: 28639 - DNA, 769 bp, Bovine  19866881395472
gagtctttggacgtcttgttacgtagcattgctgtggcaatagctgactgagattcttgtcaagctggtaagatataaacctagagttgttagtggtcattgccccccagataagagaagaacctacctgaaaatgaagtcaacagaaagaaaaagtcaatagacagaaatgaacagtgtttgtatacatatttaaataggggcttccctggtggtccagtggctgggactcatgctcccagtgcagggggcttgggtttgagccctggtcagggtttaaggtcccacatgccacaactaaaagatcccatgtgccccaactgagacctggtgcagtcgaataaataaataaaatattaaaaaaaaataaattcaaataacaaattctaggtacctccgtggaggtccagtagttaggactccatacttccaaagcagggagcatgggttcagttcctggtctgggaattagattccacatggcaatcaaccaatgaataaaaaatttttttaaataaaattaagtgatcaaatgagtccactcttagacaatccagtttattaattcaaaaaatttccaacagttttatcgggcactcaaaacaggtactattctgttttgagtgttgggaagagaagagtgaacaaaacaccaaaaatcctgccttcgtggagcttaccctctactggcatatgtaaacaaagaaaacatgaaatatatagcatgttagaaagcgataaatgctaaagaagaaaatataaagctgaa

SEQ ID NO: 28640 - DNA, 2263 bp, Bovine  19866880512459
tatgccttttttccctcctctcccttctctgtatcctcctaattctcttgtcccacccccgtctccctcttcacctcccttcctcctccacattctcccttatgttgatgctcaaggtcacagccacagagacctctcctcatctgcccccaaagggtctttggctctgccctgggccggagtgagggagatatccagagcctgaaggtggatgggagtccgagacctgggcccgctgagccgactcagattgggaaaggcacacccaccgcagtgcatagccacactggtccccagcacggacacacagccctctttcctgtgtttcccagaggaaacacattgtcgtcctggcaggaggggcatccagaggtcatcctgtcccttcccctgcccccagcagctctggagctgggaagggctgagtggagtttgtctctctgggagagtgagtcccacactatcctcttcatctccacgatgaccagtgtccctgagcccgcatgacctggaagtcctctctcaggtctgccctgcgtcctgcatgctgtagggctgggcaggtgaatggttctctggtcttgagccctccctgtgatcgggtcccggctcttttccagtctcagcgccgttcccacatcctttccctttgcttgtgtttcagcccctcagacgtggagccttgatccttgccttcccatccctgttcttcctcctactttcctccatgttccctggggttgcaaactaccatccacatctaaagctggactggagacctgggctgtgcaggggtccctgcccagggtcctctccagaagctccccttcttgggaaggactgggccttctccctctgcagcttccggcagctggatgggctggtgggcagcgacaggaatatggatgctgtgtggattacttaagtctagtgtggcctgtgggaggaccatcctggggttcctgggggtaagaaaaagtcgtgattggaatttattccgtgtccactgaacactggacactgagactggccgagctctagccagaccctctgcctgaaggagaattgcagtgctttcccatgcgggaggaagaggtcccagggcagctgcctggtgaggccagaggaaggaaggttatgtgtggggcctgcaggggccggagctgggcagccgtcttccttgtggtggatgcggtgattgttgtgacacaacagtaggcctcgcgtgactgtcctccccattttctgagccttcaggcccagtgagagttaggaggcatatcccagcccgaggccaccactgctccatcccttgctctcagcaaaagtccatggatggggacccttgttgttcaggtcccaagttgtgtctgattgtgtctgcgaccccgtggacagcagcacgctctcagcaaaggtccatggataggaacccttgttgttgttcaggtcccaagttgtgtctgattctttgcaaccccgtggactgcagcatgccaggcctccctgtccctcgctatctcccagggtttgctcaaaccaatatccattgaatcagtgatgccatgcaagcatctcatcctctgtcacccttttctccttctgccttcaatcttgcccagcatgagggaccccgcccggtcccttttgggcgaagaggcagctttccgggtctggtgagcaaagggtggggccagagtccctttagcacccagagatgcttctagactggctcctggcctcaaggcccctgactgccgggtctccccatccacctctgggtgctgtcctgtccagctgagcacccatgtctcccatcgaccctcctctgcaggaagccagtgaacatgaccaaagccaccgtcaactaccgccaggagaagacccacatgatgagcgctgtggaccggagcttcacggaccagagcacgctgcaggaggatgagcggctgggcctctccttcatggacgcccatggctacagcccccggggtgagtgcctgccccttcctcgtgggccccaggcactcctgccccagactcctgagccaacagcacagagccccccatcagcagattctgtaacaccccgaaccacaggactaagcatcctgctgggtaccagcacaggccctggggatacagagaaggcaccggtgttatctttgcactggaggagctttaggaaaatggaggtcttagacatagattcatctaaaaggagtgtgagttcccatgttaattgtgagaagtgttctggaga

SEQ ID NO: 28641 - DNA, 2384 bp, Bovine  19866880570556
tctctggccccggattgaattcttctcctccgggggccaagaatcccggtgtctttgtgtgattcaacaacaacctttcaaaagcaagatcctctatgaccgacctgctagaaaaatggaaataaaaacaaaaataaacaacggggacctcatcaaacttaaaagcttttgcacagcaaaggaaactacaaacaaggtgaaaagaaaaccctcagatgggagaaaataatagcaaatgaaacaattgacaaagaattaatttccaaaatattcaagcagctcatacaactcaataccacaaaaacaaacaacccaatcaaaaaatgggaaaaagacctaaacagacatttctccaaagaagacatacagatggctaacaaacacatgaaaagatgttcaacatcactcattattacagaaatgcaaatcaaaattacaatgagataccacctcacaccagtcagaatggccatcatcaaaaagtctacaaacaataaatgctggagagggtgtggagaaaagaaaactgtctaggattgctggtgggaatgtaaattgatacagccactatggaagacgataaggagattcattaaaaagctaggaatgaaatcatcatatcacccaacaagcccactcccaggaatataccctgaagaaatcaaaattgaaaaagactcatatatcccagtgttcattgtagcactatttacaatagctagaacatggcagcaacctagatgtccatcaacagataaatggataaggaagctgtggtacatacagtgtaatactgctgctgctgctaagttgcttcagttgtatctgactctgtgcgacaccatagacggcagcccatcaggctactcagccataaaaaggaacacatttaagtcagttttaatgaggtggacaaacctagagcctatcatacagagtgaagtaagtcagaaagagaaatataaacattgtatactgatgcaaatccttgaaatctagaaagattgtactgatgaattaattttcaaggtgcaatggagaaacaggcgtagagaacagacttatggacatagggaggagaaaaggaggaagagggtgagatgtatggagagagtaaaatggaaatacaatctagaaggctgggatggggagagaaataggagggaggtcccggagggaggggacatgggtgtacctatggatgattcttgctgatgtatgacagaaaaccacaaaattctgtaaagcaactatccttcaattaaaaaaaaactttaaaaagctaaaaaaaaaattggtcattccacataataagtatgacacaagaataagcatttagaaatctgttcttctctaagttattcccataaatatggtggtatgaatatgttagtgcactaaattcaattaaagtgctaaagaacaatatttttacttcttttacaatcaagcgacaggaatcaaatagtctatgccactaaaaacaaccgaataaaccaggaaaaaatatgaaacaacagtttgtgagacactggatatctggctatggaggacagtgatccctgaaagatgtaaaccaaatgagatacattatacaattgtccagcttactacctttagggagtttgcaggctgccatgcagggaggaggaaaacagagcccagcagagtccctgataagttgacacagatgcaagttcaaggagacaaaaaaaaaaggaaaaatcttcacacagagataactttggaaatctgcagagcatccccttaaatagttaagtattattcagaatatatatgaaaggaaagtaacgaaaggaaataaatctctggaaagaactagagattaacgagctggtgctcacacagttagcaatattgtctgtttccaccaatgaatggaaaaacgtgtgagtcacagggcagcaggtagagtactcaatgtctaatttcagtggcaggaaataatcagcactagactaaataccactctgattccaccgtaaatctttaaaagatgctccaaaacagtcaaagtacttcggagtgatttaactgaattccagaaaaatagctaaaaatatttatagaaatagaaaaatatccagcaaccaacaaggtaaaattcaaaatgtctaatatccaaacaaaaatcaccaggtacacaaaaaggcaggaaaacagaacccataatagagacaaataaattaataaaaataaaccaaaaatggcacggatgttatagtgatcagataaagacattaaaactgtatattaaatattctaaaagttaagcggagataaagatataaaaaatccaaattattcattgccagtgagccttttctataagaaatgttaaaaaaagtcaagcaaaagaaaag

SEQ ID NO: 28642 - DNA, 750 bp, Bovine  19866880574093
tttaattcctgggtggggaagattccccctgaaagaggaaagggcaacccactcttagaattcttgcctggagaattccatggacagaggagcctggaggagcctacagtcggtagggttgtaaagaatcagactgaagcgacttagcagtggttcttcaggaggaggggttgtgagaggcaggggcctggagcagggcaggcagaactaatgaatagtcccaactcgtgtgggaagggacgcgtggaacccctgctggaacagctccgtggatcacatcattcttccctgcatggggggaatgggggtggggtggggggtgaggctcataaggaccacgtctcagactccaaggaaggcagggactggcatcctgagatctttcaaatccaaactcttgcggcttgctcatctcaattctgcccacagctactctaggtccccttgccattctgccccctctctgtaatttccccccatctctctgctttcagtttgattaacagaaggttataaacaagtcccagaaagaaggaaaaccagcatctccccagggcagctgcagtgttttggcagacggcaagttactctgtaacctgatatttttgatatatatttttttaatttttgtatagataaacagaactaaactaattaggttttttttttctttctttctttcctcaggtcgggctgacaataggagactcttggccccccaggaatggttaccaggtttcaataaagggt

SEQ ID NO: 28643 - DNA, 3841 bp, Bovine  19866880595092
aaggagggaggcctgtgtgaaggctctgacgcttatctaggcacaggatggtggtggcatggaccaaggtgctctaaagataagaagggaaagaattctggactcatgttgaaagggagccaacaagacacgttaacggattcgtggtggaataagagagaaaacaggagtcaggatggcttccaagaacctgaaggatgaaattatcattcaatgagatgtgatgggtaaattctgcatgtaaatgtcttccttgaaaggtagggcagtgacctttagatcaggtgaattggggtgaatgggtggacaatctaaccagtgcccagattcagcaatgcagggggtgatggaaagacaggctgaggagaattcaggccaacaagccattgtcagggtcctccctggtctcctggacacagccaagaggcagagagcaaggtggtctcaggtcacagcgcacagaaagcctgtgactgactggttttccaggagccatgctaaattcctgatccctgaaaactgaccgcttgcttttgacaaaggaaataaccgatttagggtaaggatgtttgagataacaaacccaaactgaacctaaggaccatcctgcctccagtgcgattgaccagctctattcagaagcagataataaccggcaagattggtaataataaccacacagaagcagctcctcacaaaagaaaaagaaatgagtataaaggaatataaagaaaaggcagatgaagaatttacttcataaaaatgattaccttagatccagaggaaaactcaggtaacctaacaggatgaccaaacacaaaacaagaaactcaaagggccaagggctcaaagaaaagctactgatgagaattataaagagggctgaatatgagccggtgtatcttaagagagaaaatgaagaaatgaatgaaaatgttccagagatgaatgccatgaaaatcaataaaaatgagtaagcatgaatggagattccaggaggaaggcagaaaatcaatttcaggaaattattcaaatcaagatggaaaagaacaaagctggagaagagatcatagaaatttctcaccctgccgtgcggtgtctgagcccggtttgacttccaacatgtctgcgcagctggtcaagaggggctgcagtggcctgtggaccatgcacaggaccctgacctcaacctcattagcctgtccacttccatacactttctactgagtcccttgcccactggctggagtgctgtgtcgctataaaggccctgggtggagggtttacaggtcacagggtaagttaaactgtcttttaaactgtctcagcagccaggaagcagaagcacttcacagtctttttctgttgttctggaatttcgatgccttggtttggctgctaaaagaatggggttatttgaggacatttcaaaaggaatgaacgattttttttattgatctctttgtaagagcatcctatcaagctgtggtcaacaggtaacagatgccaggataagaggacaatgaagaccgtcacagagtcctgctcagcctgcagggaggacatcgccttgtgaagaaagcagtttccagggacacagagaagaaacccccctcacaccactgcctcatcccaggagggctgaagctactgagttacagggcagtggctctcaggcagatgcttgagacagttctcggacaatattattttctttagacaatccttggagtttcattaggaaaaaagcaatccttaggtcttaaagatttcaagaaaatacaggttataaagtcattctcattgtttccaattgacaataggaatcgactagggtatctactcaagctgtttgctgccataaaacgcaatcagaaaggcagcaagatcaaaagacattacactatcatagttcatgaaagtgaaagtctaagcgttgctcagttgtgttcgactctgcgaatccatgaactgtagcccaccaggctactctgataatggaatttctgtgtgtgttagatgcccagttgtgtctgactctttgcaaccccatctactgtggcccaccaggttcctctgtccatggaattcttcaggcaataatactggagtggattgccatttccttctccagggaatcttcctgacccagggattgaacccgggtctcctgcattgcagatggattcttcaccatctgagccaccagagaatctcatggaattcatagtattacataagaaaaggtgtgtgtatcacacatattcacgtgtactctatatatactatttactactacatatactatgctatctatatattttatcttgctgattgtgtgctcagccatgtctgactctttgcaaccacatggactgtagcccaccaggatcctctgtctatggaattttccaggcaagaatactggagtgggtatccatttccttctgcaggggatcttcctgacccaaggatcgaactcacctctcttgtgtctcctgccttgacaggcatattctttaccactctaccacctgggaagtccatatggatactatattataagtcatttatactgtatactatatatattcacaatgtatatactatatacacaagtttttcattgaactactaattgaagctttaaagtcatatatgaaacttatcagtcttagatgtttaataaaacatctttgactctaaagaaaaaatgaatatagagacagtatatagacatggaggacagatggggaagctggatactacacagtcctgatggggatgagaacacagcagttggagaaaagcagcattcagagacccccccccaactatgtccactaaatctgctgtgcatacaggcatgtgctgtggggtgctaagagtatcagtcagacataattcctgcccccaaagagttctccagcctgtgaggactagaggcaaataacaagtgcttaaaatacagtgggagggcttccctggtagctcagtggtaaagaatccacctgctaatgcaggagacgtaggactgatccctggtccgggaaggctttacatgccacagagtaactaagatcgtgcaccacaactattaagcctgtgctctagagcctgggagccacagctactgaagcctgcatgccctagagcctgtgctctgcagtggaagaggccaccgtactaagaagcccacacacccacagccaagagtaaccctcgctagatgcaactggagagaggcctgcacagcaagtgaagacccagcagagccataaataaatgaaaaaataaatacaactattaaaaaaatgtttaatataatgggagaaattctagaaaagaggtttgctctgggtactattgggggccaggatggaccatggtatatggcatgtgtcgggccctgagcttggccatcaagtcaccttgtcaggtcgctgctatggagaaacctgggatcagagggtgggaagtgacttgctaaaggtcacataacctgcaaatggtaaaactgggctctaaaatcaggtgtgtctgcttcccaattcatcctcctcctcgaatattctgcctctggtcttgtatcagctggaagccatccataatgtctgtaaggaaagcaccagcaacagtaaatcctgggtgtcttgtcattagggtttattgcgagggctctggtctccctggggctggggaagaagatatgactgctacccatggaaagagcacaggtgtgtcaagactttatctagggatggtttccatacccaggcaggaggggcttgggagaacagcaggcacactcatcaagcaaagtcacaatccaaggcaaaga

SEQ ID NO: 28644 - DNA, 1575 bp, Bovine  19866880628539
caaataagctggacataacacagtcagtgcgagggaacgaactctactgcaggtaaaaaaaaatcatttaaattaaaaaatttcaactatatcttaatacaaatacatttaaggacttccctggcagttcagtgattatgtctccaccttccaatgcagagaggtgtgggttcactctctggtcagggaactaagatcccacatgctgcaaggtgtggccaaaaataaaaatcagttcagttcagtcattcagtcgtgtctgactctttgtgaccccatggactgcagcacgccagacttccctgtccatcaccaactcccggagcttgctcaaacccatgtccatcgagtcggtgatgccatccaaccatctcatcctctgtcttccccttctcctcctgccttcaatctttcccagcatcagggtcttttcaaatgagtcaattctttgcatcaggtggccaaagtattggagtttcagcttcagcatcagtccttccaatgaacattcagggctgaacattttaggaatatgctttacatacatgtaggataaggcaatcatacaagaaatgagtacaggaaattctttttaatattaaaagattcaaaggcatataaaacattttagattcacacttctcctgctacttggaaaagtttcatactagcataagaactggtggatcacctccaagtctagttcaacaataagaggctctgagtccatggaactttccaaataaagattcagaaactacattacctttaactgttgctgcaattcactattcaatctggccaaaactgtgttggtttccttattgcgtctaattgatgcctgaatagctttcttatctttcccaacagacctgagaagataaagagagcaaaaaacgtgaccttcattcttattattaaatttgctccattcttccctgtgatctatggctaatcccagaatgctgaggaagcatctttgccctgctagcatagctcaaccttgcttgatcagttttaaagctcaaccaaaaactactaagcttcagaggcttaattactgtagttattgatttagtgacttttctgtagaatcacctgagtttaagtcagtgcagaggaggtataagcaaactttttctataaatggtcagacagtaactattttaagctttgcagaccataccatttctgctgaatattgtttttttttttcatcttttctttttctctttttaaacaaaaatgtaaaaaaatttttacattttacaaaaaatgtaaaagcccttacaaaaactggctatgggttgactttggcccataagccctagtttgccaattcttgattctagaacaaccatagttaaaacatcagtgttactgtgcactataatttttaaagtctgctctaggatttgtaacttgagttgaactattaggcgggtaaaagtgggaagaatattccacgtactcataaatgagaaaactctcaaagcggaacagtggaggaccctgtgttcaactacaggacccagtgtgaccataattccttttctgtttaatattttttaatta

SEQ ID NO: 28645 - DNA, 1788 bp, Bovine  19866880666837
cctagacttgatcacagggattctgggaggcagatcctgccaactgggtccctccaccctaagaactcagagggccacctttgaggggatggaaagggagaagggaggtgagatgatgaactccaagtgggttgttctactcccatttgctccaagttacctttaaagaggataaaattacactttaatcccttttatctccatgcagtgcttctaaaaacagagcaccttgacattttaggaggaaagaaatctggaaaagatgagctatgcaatatccagtataaactgaggatggagaaacttcaatgaactcagagttaaacctctttcatgcttgaaaaataaagccataaccaagtagtccaagaggaaagtccagccttgaggtagaaagaaggctggtagggaagtggcttggggcagagggtcctgctggaatggggatctgagacatgcagcagagggtaggtttgggggctgatgcaagaactctagggtctgggatccccaggaatctgctctgttaatgcaacatattaaaaagcagagacatcactcttgttgacaaaggtccatatagtcaaagctatgttttttccagctgtcatgtatggatgtaagagttggaccataaagaaggctgagctcttcgaactgtggtgttaaagactcttaagagtccttgaacagcaaagagatcaaaccagccagtcccataggaaatcaactctaaaaattaatttccccctttgggaaaaggactgatgctaaagctgaaactctaataatttggccacctgatgcatagagcaggctcactgtgaaaaaagatcgtgatgctaggaaaagattgagggcaagaggagaagggggcgacagaggaagagatggttggatggcatcactgactcaatggatttgagtttgagcgaactcggggagatagtgaaggacagggaggcctggtgtgctgcagtccatgtggtcacaaagagttcgactcgaattagcaactgaacaatccctcttaactaactttttaacttcctatctttgcaaactggctcctgggccgccttgctgttgaaactctccatgacaaggcctcatcaacaggcgcttactgggccctcggctcctgacctcaccctactcccagcctcttcatggttgcccacgaccttgtgttcccccatcgccctcctcccttccccttgtttttgtcctattcctgctccttcacatgccattcactgcttcttctctgaagatgctcccaagctgttccagggtcccttctccccgacctggtaacatatctagagtcagggactttggcaagaagacttaggaacctgtaggtcaggattatgggcagtgggcccactaaggaagcaaggccatgataatggcagtagatggtgctctctctctcttttttggcctttttgaaatacagagccttggggatcttaggcaagctcccagggacccagctctttgagtgctggactcaaagaactattacgtgttacagttccatatccactcacagttctgatgctatcatttctgtgtggtatattctttgcttgtggcaataatagatggtctgagcagggtggccaaacccctcaggccaccgtaaaacagaggcaggcagcctgcctgtctcctctgctcagccagcatggtcttcaaatgctctttcttcagtagacctgcccctccttttcctctgacacgtgtcccctctcatggctggcttccccactgtcctgtgct

SEQ ID NO: 28646 - DNA, 1511 bp, Bovine  19866880811991
atattcttattaaatctaaaatgagggcactaagggacttctgctgccgatccaccaaggccttggcctcatgtctgggagaagatgctgcccttggactttggggtttggttcccccggggacatacccgtttaaggattccacgcaggcattagctgtccttccactcacttgttcacctcttcagtgtttgttcattcacttctgattgcttgcaggcatctcttcacacacattcaggtgttggtttattctgcctttcaccttcagtttcattcattccgacttctgtggcgtggcctttcattcattccgttattcttcctttgtccattcgtgcacccggaccctcactcagtccttggcgatttcttcagtctttcatcctttagtttgtcagttcatatgttcattcactcccgactcatgcactcatcgcttcatgcatgcatttgttcattatttccttgttcatttgttggtgagtttgtgcactcattcattcattcattcaacatgcgcagaccatctgtcggcagatggtatgtactggcaggtttggttcaatatgatggttcaacacacctctccatccagcacaagcaaagtccctagggcctcttaaggacactttttattgcagtgtaacacagtatatgacaagaaaaactcgcaaatcacagctggataactgaagaatttttgcaaacagctgtactggcctccggaaatcatctgtgccctctccctgtgcccgcccctctgacttctaagagtgcatttacctgtgctgttctgaacctcaagcaaacatacttacagcctgtgctttgtcctcccctctccctgtgtgtgacttcctttgtgtgctagtgtggaggtgaggcttatccgcctggttgcattaatttgtgtactttgctccttttgatggctagggttctcctgtatgaatatgcaacaaccatttatgtatccatcaaccctagatagggtttcaatgctttcctattttgcgctcttgtagatagggatgttactaaggtcttccaaagaccacattcctgcctccctgtggggcatgagtccaggagtggagctgttgggtaaacagttatgcagaagttcaacttcatgatactgagttttccaaagtgactgttggggtgtctttcccctagacttgcccctgagacactggccctctccagggcctttggtctgtttcaggtcacccctcccccatcccagcccacctgctcaattcttcctcctgagtctgggctcctcccaggggcttaagtacaagccttcctcgctgcagtcctgccactggttcctttcagccttggtcctgtctttctgtcctggagatacatcctcaagctactctgggtgacgtcctctgggcctggtctagcctggccatctttcttaccctgtgggtggatggagcttaactctgctgaggaaactctgggacccaggaatgatcccatctgagggctga

SEQ ID NO: 28647 - DNA, 1652 bp, Bovine  19866880965769
atttattcctctgtgctggcttcatttgtaaataagcacctcctatgacagccaccagcaactgtggtcctccatctgaccagctcaacaacattaagggaaaggaaaagcctatttatgctactttcagactaagtccaagggcaaattctgattggattaaccagggtcatgtgcccacttctgagccaatcactaagcccagaggaatggcagtcactgactgcccagtgctgagccaggcgttcacccttaaagtcatggtgggctcagtgctgggcaaagcacccagactgcatggatggtgggtgaggagcacagttgctaaagcaagaggagaacactggtgggaggtgagggggagtagaggtgggttctgagcattgcaaacaatctcaatgtacaggctgaaactaaattttgcctcttgcctgactactgggctggaacaaccaaactcacctgggctcatgtaggtcaccttagggacctcccttatcaggagccagtgcacctgcaatctaacacccgcttctggatcctgaccacctggagcaggtgattgcatcggcctttggtccaccccagctgacctggcctcttcctggccacccacaagggggcatgggtcggctgagctgcaatgaggctggctgtccacagagcacctgctgattcaacctgcctctctgcctgtgtgactcaagtgagttcctcaacctctctgagcctgtgtcctcatttctaaaatgggaaagattatcattgttgtgaggattggtgatggcacctatgaatcgcctggtctccagcacgtagtaggcattagtgataagaagtggatacaggaggtgctcctggaatgacagccactgccatgcctctagtctggcactttctatgtgggatggtgtgtgctgctggcgggtcagcctcccccatctgaccatgacctcttcaagcatagaacattgctgagctttctttctgtatccagagccctgcacacagcccagtactctgggttgacatctgctgaatcattggaaactgacatcccaaaggagggaaggaagcggagggcacttccactttgtgttcattgtccaacagctgccaagccttgaaaccctctcaaaggtctgttttcagccacacacatctaggaagggcataaatttcttgacagcagaggggttatttaaagtctccattaaaacagctgggccttgttggaaacagagctgttgtcactgctggggcctgagaagggcagggatgcacaggcaagattaattctagacctttcagagacgcctgctttatagctgtgtttagggcataaagatgccaactggcctcagtggcatgaaaggacagcctggcgctcacagaagcaggagccttgctgaatgatacttctgtcttggggatatgggcagacctgtccactttttcttttaatctccctcttagaagtttgccaagagctgggttgtgaactgcagggagatgctgtttcagcaagagcaaaaatagacatcaccagcaatcacagattcatcagcgcagcctcatggacacccactgtgcgctgggccctgggcttgctgcttacagagagcactagaagaaggcaggcacatagtagg

SEQ ID NO: 28648 - DNA, 959 bp, Bovine  19866880997340
acggcagaaatgaacatgccatgctccctctcaaagaccatccacggctcctgttgctccgaggactaaaatcccaacaacgcatgcgggttgcagggctcttgtaaactagccatgcagaccacccttctggtgcagccccatctcttaccacccccggctcccactccgaccccacagacccagctatgtgcaggcctttgcacatgctgggtgtcttcctggacaggaagtaatttcctaggtgctgcctgacaccagctttcttcacagctttgctcagtgggtagcgctattaaactgggtagtattaaactggtgtgtatgctctgggctatggatgttgcacgattatctcaatactcacagcaactaccctgtggggatcattattagccccattttacagaagagaaaactgagattcagagacacaaaacacctggccaaggtcactaggctgggaagtggtgggatttgaacccaggtctttgcatgatatcaactctccgcatcccacctttcccctcccagattagggtcacctcctctgtactcttgggttttctgtatacaagcttctgcctgattgttccccagttgtcagtttctccacttctcacgggctgtgaactcctcgtggccgtgctgggtctccgttgtttctaaggcccagaaccaagggtgggaccaggtgaacacttggccagagtctgctgcccaaagagtgggtggtgacagcccctcctggcgcctccctctggtgccctcccctccttccacttgatacctcagtaagcaaagcctttaaaccaaaaacaattttacagttcatttgagttaatcatagctgctttttctggaaactgttttccccaaattgtctgcagagaggcaggcaacctgcctggcagctccccaccttccatcacagagccctgaaatcacaagagggggtg

SEQ ID NO: 28649 - DNA, 3370 bp, Bovine  19866881063183
ttgcctggagaatcccatgaacagaggagcctggtgggctacagtccatagagtcgcaaagagttggacacgactgaagtcactcagcacacagcacataaccttgagcagcatataattgggtcatgcgtactgtggattccccggaatcttttacccaccaccattacatcatttgcaagactgttacagttagagtgccatgtctgccctgcccaaatatagatacacacacacacagcttgtgagttccttgaaagtatggactgagtcttaattaatttctctatttgcagcctctagcccctgcctggtttagagaagggactcggtaaatatttgtggagtaaatgaacagaagttatttatgttgaatacctcttgcggtgcaggcatttgcatttttacaaaggacaaaactgcaagccaaagaaatgacgctccagtgatggaatttcaggcacccatgagctgggcctggaagcttctttcattgtttagtgcctgagggagggagaggctgtcacagcaggtgaaatcttccattcattgctttccagagcaaaattagggaaacaatcacattgtctcttgaaaagtatgaatgtgtcatggaaacaaatgtgtctccctgtggctttctggaagagcaaacttctctagtcttgtcaggtttctctgcagtggttgcactcaatagaacactgcttcctgacattcccgtggcctgtgaggggggatattctgctgactgtaggggcatcttggctctctgacttcacagtcactgtcatcccagctctggccacaacggaggatctgatgttatctgggagttgaaggagctgaattctgcaactcagacacttccacgtgaagccccttgggctggctgcttcttctgagttgacctgggcctcatcctcaccactgggctcctccctggtcctctggctgactgccaccccctcatgccccagctctgtgcactgacagtgtctctgccctcaagcaccttctctccagcctgccctccactctgccctggaatgaccctccacagcataaaattgactgggttcctccagctggaaattcttcccaggctccgtgctgttcctggatcatgatccaaaccccttggcccttcaccagccatgcagagtaacagacattagccaagaacacaccatgcaagaaaaaaccccctccccatttttgcagtgcctttccctctgccttccctccctgtcagcctggcgaactcttactcactcctcaagacccagccatcaaaacacccttctctgtgaaattgatccttcataacattatgtctcccccaatgagcccatctctgtctccacacatggtccgttattctttatcccccgagtcttccctctactttactgtgaccctttccaggcctgactgtgttctcagcatctgaaagcagatgtgtcaatatgggtttatggagggcatggaccaatgaatgaatagacactatcactgcgtgcagaccccttccttgctactgttataacaacagcagtagcagtaactctcatctctggagtgtatcctaagtgccaggccccatagttggctccttgctgcatccactctggtaacttcacaacccccaagtgagctggcatgattattaggtcgcttttacacatggggcacagtgagcttacagaggacaaggatccagtcacaccgcaagagagtgaagaggccaggatttgaacttgggcagttacttgcttactgcatgccaggtgctgtcctgtctgaggccacagcagggaacagaacagtctgtgtccctccccgtgtggagctcctgctgtagtgtgtaaggtggggaggggacaagtgataaacaaatacatttctaaataatgtcagggctgataagtgctctgcagaaaaataaaacagggtggggcagagaatgatatcctggggtgggtgacattttaggggacatctgagcagagacctgaatgaagtgaagggacaagccctggttacagcagaaggaagcatgttcctggcaatgcatacaggttcagtcgcttcagtcatccaggcaagaatacttggagtgggttgccatgccctcctccaggggatcttcccgacccagggattgaaccagcgtctcctgcgtctcctttgcactggatccacttgcaggtggattctttacccactgagccacttgggaagccctgttcctggtagaggggacagccaagggcaaaggccctgaagccagaatgggcttagcttgtatgagcaacagcaggagctcagtgtgtctggagcttggtgagcgagggaggaagcaggaggacagggtcacagggtggtctaggggggcagttgggcacatgatgagtggcatgtggactatgcctggagctccagcttttcctctgagtataaaggggggccctggagggctgagagctgagggagtttaaaggtcacctctagcttctgagagtaccattgtcaagtgggcaaggccaaggggaagccggagactggttgggaagacctagaaaccccagtttctaggactgttcgcctgccagccccaccagctttctccctggtcctgctgcctcacctcccagcatgccccacatccctgagctgatccttcgggcaaactctgtgtccaccctttccctgagttgctcgaccccctgagtctccaagccgcccctgccttctcactacccagtctattttttctttaagtggaggataattactttaccaatattgtgatggtttttgccatacatcaacatgagtcccctccttctttatccccctcccacatccctctccactccatcgctctaggttgtcacaaagcactggctttgggttccctgcatcacacatcaaactctcactgtcactgaccaatcttgagctgaaccctctgaccacaagtcacagggggcctaaggttgccctgctccctcttcccgggtatccttctctggctgttggccaacagtgctttgtggctggccactagatgtaccccaccatcagctcagccttccttcagcaggtgggaatgaactaacccccaaagcagcctatgaggggtaaaaaaaatcaaaaggacctgggcttgaatcctgtttttgccacaaacttactgtgtgatattaagcaagtgtctaaacctctctgggcagcagttccttgactgtgacaaggctcaggggaatatcctgaggatgtaagactgcatgttaggacaccagcagctcctggccacagaaagcctcaatcatttctgtttcctttttccccacttccttccttg

SEQ ID NO: 28650 - DNA, 734 bp, Bovine  19866881079709
gacccccaggttctgtttgccaacgagttcaggacacctggctcccaggctgccccaaggaccacataagaaggtactgtctcttccatcacagaagcaccatttcttgtgttgataatttatgcctttctctgaatcctccaagcaagaaagatgctgtcactctctactctgctgacaaggacacagaggctctaccaggtcaggcataccctccaagtccacaaccacaagtggcccagcccagcctcctgcggccctgcctgcatgtcccccttttggctgccaggtccttctgcaatgacaaaatgcctgttgttaagggaccttcttttcagcagagcaaacgcagagcttttggacatgcgctgaaccaggcagggcttggccacacatggcctttttggggacatttgtttatgaacccaggccaggcaatctggttacatgtgttgagatattgctctgtgtggcttgatggtccctctgtgaggggacagattgtcctgacatattgttggtggggaggcaagggggagggacacagagaaatacgacagcgagacagagatgaaggcagagagagacagaggcagagacagagagagggtatgttcacacttccacagcaggacatgaagtgaaagtgaaaagtgttagtcactcagttgtgaccgactctttgcaaccccatggactatagcccaccacgctcccctatctgtggaattctc

SEQ ID NO: 28651 - DNA, 1772 bp, Bovine  19866881197499
cttcttaatatcttctgcttctgattgggcgttttaaagagagaatgatgaaggaggaggggagatggcaggggcttgagcagagtcagggaagtgaaccattacagaaagtaagaaggaagattgctaagtcacttcagtcgtgtccgactctgtgcaaccccatagacggcagcccaccagggctccgcccatccctgggattctccaggcaagaacacttggtccatgtttaaaaaaaaagaaaaaaaccacctgggttttctcagtggcactcaatgagttaagctcctgccctcccctgaaggctgagagactgtagccatatcttcaggtgttggctagaagaacaaataataactgcttctggcagcctggagctttgtcaagcaggctttttaagaggggttgtggatatcctagggacgtggcccttgagctgttagaaactatgttagtgttttgttcaattctttataggccaaggttaggcctagtaagaggagggcccagaggagccaggctagagttcaatcaaggaaaggatttttgtcagaagccagggccacgtcttcattctgggctgccagttcaaacctacttatgatgtttagggctttgctaaatctcctgcggcatcagctccccaggtaagttcttcttaaaagccttctctgtgagagagttgacagtgccagtttcccttggaatatagatcttattcatctctgttcccctacagtgccaagcgcagcacccagctcttagtaagaacttaggaaaacattggttgaattggacagaacttgaaacagaaattgagcatgtttttaagggttgcattgaagcataaaagaaatgggtttataaatcaaaatctttttctgtaggcccctggtgagtgcagcatttcaaggaaggctttggcaaaccttttctgtaaagtgtagaattgctttctattgcaaacagctcttctttgtaaggctgtttcacacacacgcatgagcttgtgtgcacaaattacagaggtaatatgtgattttgggtagaaggaaagagagagagagaaggagttagggaagaagaaaggaaaggaagaagggaggcaggaagccaggaaggtaaggcgagaggggtgaacaagcagttggatatacaagcctggagttcaggaaaaggtccaggctgaaatgtacatttgggagctatcagcatatgaaaggcatataaagccacaagttggtgatgtgcccaagagggtgggggaggataaggagaagagaacatggggcagaaccctagaataactcaagggtaataggttgaggagccaagaaagaaccagcaaaggagacagaggagaagaattcagggaggtagcagtcaagagagggtgagatcccagaacagagaggagaaaaggtttcagagaggcatgagcaactattccaaatactgatagttcaaatgtcattgaaacttgaccattgggcttattaattcatgggtaattggtgaccttgtcaagagcagttatggtggagtgtgaggggctgaaatccatttagagtgcagtgagaagaaaatgagaagagggaaatcaaagatagtgagaacagtgactcctttgtttttactgtgaagggatgcaaaggtagcagaagagatttaatactgattttatttggggggattagagaatggtgtgtttgtacataggtggccctagtcgtaaagatcccacctgccaacgcaagagacaagagact

SEQ ID NO: 28652 - DNA, 3031 bp, Bovine  19866881250949
ttcctgggttgggaagatcccctggagaagggaaaggctacccactccagtattcttgcctggagaattccatggacagaggagactggcaggctatagtccatgaggtcgcataagactggaacacgacctagcgactaacactttttacacttggaggttactgacatatggaggaaaacctgaggattattcctagtcctactgtggcagagcaggaactagaatccaggttttcagatacttatgcctgacctcttgtcacattttagaggcaaaagccagcttctctcctcttaaaatcagcaatgggtcacatcacatgaaaatgtctgcttgccctttctcacgtgtcaaagatccctgaaaattaactagggcaataatcacagagacggccatggtgccaggatcaacccctttccctctgtcttttttcctcctctcccaccctctctctgtgatgattccacatcctacaataattgattgagtgcattttcggagagttcctaatggctggtggggtccctctgagaactattgtgtattccctataatgacattcattagtccagctgacatcagtactgttctcaggttaatatgtttaatgtaatgaggcatttattttcagttagaaaactcctgaagaagcatgttttctcctgatgagttcagctgatgaatagattaatgctggccttgaaatagttgattaagaaaatgaatctaaccaacttcttcttcatcagatagaggccgcgcttaaattaagtcatgttaagctgcccacttcttagagaaggaaacaggaaaaatcctcacttagctctgtgacttgttctccatttgcctccttgcttccctccccactgtacctccccaacgctccaagatccaaagatatgaagagatcgaggacaagtgtgtgacgagggattgcaattgagaagcctgagtacccagaagagaaaaagaagcactcatgtagtgcagaggccacagagatgagttcacatagccgggagtcaaattggccagcctctgtcgcttaacagttttctagggtttactcttaaccagcctcctgtacccgtgggcacttgtggatatttgttgaatgagtgaaggagatgctcaacagatggtggctcttactattattcacagaatcacatgacctcaaaaggaaaagatgtcggatgtcccagacacatctagccagtgaataggctgtgtgataggttcatgatccctggttctagggccaaagatgacccaagggccaattttctttgatgatgtaaccagtagcttttcccacatcactctctcgatgggcacttagagctactgccaactaagagatgctagacagcatgcactttcttccttccctggaatgagcttccaggccatgccattttagtgcgatctctgctgaaagtcagagaaaacagaggcacttgtccctcttttcactccaaccctacctgctcataatcagaattccctctgagggcaagtccagccttgaaaggaaacaatggagttgatagtggggatgtcagcaatggatcgcacgctttacagaaaggcaggggtgatgtcatacttcattctaccactttacaactgcgttagttatctactgctgcataacaaattgccacagacttaggggctttaaacaatccccatttatcacctctcagtttctgaggtcaaaaggctgggcacagctgagccaagttttctgctcagagtctcacaaaactaaagtcagtttgccctccagactttgttctcatttgtaggctcgactagagaagtacctgttcccaagttcctttaggttattggaaaaattaatttccttgttgctgtaaaatgcatggcaacttgcttctttgaaaccagcaatgagtaaaagggacctctaatgcaccaatgtctgacctatataccactttaaaagggctcacttggtcaggcatggcccatacagttaaaccttccatttaatgaacttaaagtcatctgattatgggcttttactctatctgcaaaatcccttcacctttactatattctataggtaaaggaagttacacaacctttcacacacaaggagtaagaattatacaagactatgggtcacagggcgtcatcttagatttctgcctgttataccaccgggaaggtaatgggcaagtctctttaccactgaggtttcaaatccttagttataaatggcaacaacattgctgtatttaggattgctaaaataattaaatggcatcacatataaaaataagtagcacagagagctctcaggaacactgtgtaaaattgaactgaaagatggcagaagtggcatcactaggaacatctggaattttgccttctacgttcctcaaatctatcctctctaattgattctgatctgttatctgactatctgatttcaagctggatcttaactctggaatactcttcccttcctgtcccaaatatcccccacgttcctggtggtttatactactggctatatctgttgtatcagtgtcctgacatgcaacctgtatgggatcttgtgtaataaccccatcctggctccagagtacttctttttacctaatttatccagcatctattaagtgagtacctctgtcagttctctctaccactctggaaaaccggcttgattatttattcccccattcttcaaatggagacatcatagctacaggggggcaattagctttggtatatttgtttctgcattacctctgacctagagaggatatggcctgagactcgcagcagaagggtctcgttcagcagacccccagatgtcacttagaggaccctgcggatctttgtgctgccgtcctgtctcccagtgtgccttccacctgtggtttcccagactgggaggaacaacaggatagagcactgaaagaggcggcagaaagactgattctagcagggagggaggcgtttgcaaggacagctgtgtcctctt

SEQ ID NO: 28653 - DNA, 1531 bp, Bovine  19866881290287
atgttccatgtcctgggtgatggagacacgtgactatgaacctgggatccctatgtcttggttgtgaatcggcaacttgcattgtctgggaaacaatgcacgcttatgcagaacataagcatatgctaatgacggttaattaccatccatatttatagatttatcaaaatatacaaagccatctgacaattacacacctacagcagatcacaggtaataactgcacaccaggctcctggccagcaccgtgatgcaagcttggacaccaagcgtgagatgaaactgccacccagccctgttggggggtccttggctgtcaccctgttggccccctgctcagacctatgcccatccccaccatttccggtctttctggtcctcctggctctaagacacacagaccttgtgggggatagacgtgtgagagaccctgaagaccacagagaggggacttcccttttccaaatgggaaactgaggcttcacccaccactctcacacccaacagtgtgctgagtgcctgccacctgccagactctgttccgggcactgggatgagctgatgttccctttggggagacagcagtgccgggtgcagagactggaagtgggcagcaggagagactgatgggagggggcagcaggggcccaggaagacctcgctgagcaggtgaccttgagctgagcggctgacaattgaaagaagtgagggctgagccatgctggctccggggagattagagtgtgtaggagcttggtagggtggggagaccccgcccacccaggaaggatgtccctccacctactctagggtttttgcaaaccttcaagtctctaggtcacaggtgggaccctcatcctgagggcaaggggaacagagaggagcaaggctgggtccctggcctcaggggttccttagggacataggggttagagaaatgattacagtccatggtggtcaggcaccaactggagtgatgtcccaggagccgagagaagcagagggtggatcccaacaggccaggactgagtcctcacaccaacacttccttcttcagcccctgtagcctctgtttccccatctgtagaatgggtgggtgagagtgggtgggcatcaggcttattgcagagccggtgctgctaatggtcacaggatgagagccctggtctgggtggtcttgcaggcgcatttccagtcctgagcggatagatgatagacatttaggtggccaggaggatgggaagacctgaattcagatctcttctgaagctctttcctttagctccctgcccctcttgagctgtcctggatcatctgggactttcccctccctgttctcaagacaacatctgaatatagagccttggggacctttcctgaagggttttatattaagattctgaaccccaaaagtggagactcagtccctattaatggtccctacctccagcatggtggagggaggcagtgttgcttactggttagatcacaagctctggcccacccggtttcagccaaggacttcaggaaa

SEQ ID NO: 28654 - DNA, 900 bp, Bovine  19866881299576
tgctgcaatgattttgagagctgggggatccatgtcagatctcgtttgagaaaatgtgagatgatccttaatgataatataaaatttacataaaactatttaataaataatatctaaattctcttccagcaaaggctagagtcttggcacacaagatgcaggctggggagaccaatgtccttcatccaatttcccacacagagactcatcccccatctggagaaccctggggtggaggcaggagccagggcttagaggcttgatgtactgctaagtagaatctacctgtctcggggtgactaaagatatccaactggattatactgttctgatggagtggtgcccctttcagaacccagcaccctctggaacagagtagatccaatagacactgctcatatcacctggatgaggctttggatggagttcagcccaccactcactggaagctcagctcccatgggtgggcccagtatcaagactgatatttaaagacaataatttcatttctggggttcccagccttccccactaccttcttcgccacatacaccaggcagagtgccctgggtcaagagcactgttaacacccttccagtaactccgcctcctgaaaataaataggcaccaactcactgcaagaggctaagagccctcatcacagggagcttgcacataactggaaataactttaacacccaatggatggctgttccccaccctcactctgtgacaaagttgtgacagtcagaggcatcaattttctggaactgagctgtgaacccaagatcaagaaggggcgggcaatagaggttggcacggtgtaagagggggctttacaatgaaattatgattattgttctccggtagcatttcttctgtgcctccaggcagacagct

SEQ ID NO: 28655 - DNA, 765 bp, Bovine  19866881360162
gagagatgtgtccaccgccaggatggatgggcagccctggggaggggtaatgagctccccgttactggaggtgcgcacagaggaagggtgcatttggagaagcagagaggccttggaggccaagagatctgggctgagtcccggtcacattgcttgcaaggagtctgaccttcagcagtgacttgtactcactgagccttggcttcttcatctagaaaatcaggcaaaataagttcccatgtcccagggttgtcatggagacaaaaggacataaagtgtgcaaagcactgagcagggagtgcagagtatcattgcaggaagggaggaagctgggttatgacaccccgagccatctacgattccaaacggctgtagttgtagaccttgagatccaataattcaattatcctaagattataagatttcctaggattctaagactttaaaatttatgattctgttattcttctcatctaagtctcctcaggaacataggctgtgtgattcgaattctaaacctgtcccttcattggtgcggcggctcagccatgggctgtctgctccacggggagtgtttatctctgctctctttccacttcagatcttccatctttatcccccactggcccattgctacttctccagggacacgttttctaattccagccttatccactgcaccttttgttcaaagcacatcaggcccctgcggtgctgcgaattgtgtcctgtacccctgcccccggcacactctcctgccctccc

SEQ ID NO: 28656 - DNA, 1032 bp, Bovine  19866881508696
ggactgcatgtaacatacctgtcacccttgttctccatagcccttcaggtggacgaatagttaatatgcaataagacaaaaattgtgatagctgatgcacattaactgcttcctgtgtactcagcgttgttattccccacaataactttggaacacaggttctagtctattccattttgtgtgtgtgttaatcgctcagtcatgtctgactctttgtgactccctggtctatagcccaccaggctcttctgtctatggaattctccaggcaagagtactggagtgggtagccattcccttttccaggggatcttcctgatcaagggattgaacccaggtctcctgcattgcaggaggattctttactgtctgagccaccggggaagcccattccattttacagatggagaaaaatgaggctcagcaagcagaagggcacggcaggggtaagaggaggagctgggacttgaactcaggcctgtctgccccaagtggcccctgatgcttctttttcctagtggaaaatcttcattcctccacagactttttgggggcagttgaattggggtcccctcccttgctggagctatgtctggacttcctccagcttgaccacacctcctctcgggatcccagagcagacaccctgtcttagcacgcttccccatccccacagtccccattctagcctggaggttttctgccaattcctcaccctgccacagttgctgcagctggttggagatgtggctgcctttctggaaagttctgttcccttttcttgttgtcagatattcctttgcagtttcctgtcttcattcctggcaggaccctttgcacatgaacagaaggctcctcttggcttctctccctgtgatggcgcaaagccaggaattctgctcctgagtgcctggggcttcctttgggagggacgaggggcatgtgacgagcactccacatccctctttaactaaaggttcgctggggccatcacagctttttggccccttatccccatgggtcccatcttcc

SEQ ID NO: 28657 - DNA, 684 bp, Bovine  19866880481249
tttctggaattctcttgctttttcaatgatccagctggtgctggcaatttgatctcttgttcctctaccttttctaaaaccagtttgaatagctggaagttcatgattcatgtactgttgaagcctggcttggagaattttgagcattactttactagcatgtgagatgagtgcaattgtgcagtagtttgagcattctttggcattgcctttctttgggattggaatgaaaactgatcttttccaatcctatggccactgctgagtagttcattaatgattttgtaatcacttcttttctttagatttatattcctttgttctttaaatcccagctgatttctattcatatacctagaaataactctgtgaaatctcttttcaaaaacaaaagaacaaacaaaaaactctttcattcagttcttttctcttctcactattcaaaaacaaatataaacttacataaaatgactgttcctacttgacttctttctttatataggctttttatgaaatacaaaattagcttgatagtagcttaatggttattaataataatacaacaaagttatcatgacaattgttttcttccatgcctacatggggagatgattcattaggcatataattactccctcctaattggaatcaaaccagtcaatcctaaagaaagtcaattctgaa

SEQ ID NO: 28658 - DNA, 1923 bp, Bovine  19866880596474
aagcctacactaccgaatttctttacctaaagatactgtgttttttttttttttctattatggaaattattcctgtacctatatccaggatactagggtttgttcggtttgttggggttttttgcatagtacgcaatatactctgtgtttattttctgtattactgaatcatatccctacgctcttgacttgctaatccagaactgaaaatattagagatagaatcactatagacttttttttgtcacatttattaatgtgtcacatttattaatacttctatcacatgtactatctaaatctaacagatacattcccaatagaagtttcaatattgaatgagctataaaaccatgtaataacatctacaagttcatttggaaataaatggctagattggagtttcaacctgggttaataattggtgtaggcatattgacctttgtacttgttcatgtggattgttatttgctatgtcactggaaaacctgattcagcatcacacaagggtatctggagagagaggtgtgaggaccagaactacagggtgatacacgttctcattctcactctgtttttataataatattaagtctaaaatatgttttaacaaactttatggctcccaaagaggggagagggatacattaggtgcttaggattgatagatatacactactatatataaaaataaataatgacttactgtatagcacagtgaactacattcaatatcttgtaataacctataaataaaatgactctgaaaaagaatatgtatatacatatatatgtatgcaatggcaccccactccagtactcttgcctggaaaatcccatggacggaggagcctggtaggttgcagtccatggggtcactaagagttggacacgactgagtgacttcactttcatttttcactttcatgcattggagaaggaaatggcaacccactccagtgtttttgcctggagaatcccagggacgggggagcctggtgggctgctgtctatggggtcgcacagagtcggacacgactgaagtgacttagcagtagcagcagcagcataactgaattactttgctgtccacctgaaagtaacacaccactgtaaattaaccatacttcaattttttaatgttaaaaaaaatatgttttaagctatttcagctccttctttaaatgctaatcaattaattatttgttctacagacaaagtattctaaacaaaagcatcattgtcttattccttttcaggctttgtattcataataacttcattgagtttattctctaccatgacccaagaatataacttatctttacaataagaaacagtcaccactatcactactactctcacctcacttcctctttatcattttattggcaaaatctatcagccttccatggttggattgaacttgtagctgtggttcctagaagccaaccatgatcaagatatatatatatgattaataacccagagctagcttgagatcatatggtgggtggttaccaagatgcctgtgaacaagctgtgtaattcaagagattagtccctccagctttatccttgcccctagattcagttcaaaataacaaagaccagggggcttccctggcggtccagtggttaagactctgcacttccactacaggtcgtacgggttccatctttggttggggaactaagatctctcattgtgaccaaaaaataaaaataaaaaagaacagaatgggaacaatacatgcaaagcatgtctgccattctagtaaagttccagtctcctgcctctgatgaaacacatagtaaaaaggggaaaatcacttcactatccagttaggaaattaaaaactggaagacaaggacactactaggtgaagacgaagacaagggaccatcaaccagaagctcaac

SEQ ID NO: 28659 - DNA, 1198 bp, Bovine  19866880613252
tattaaaagctaaagcgatggtgacttggttctgctttttaaatcttcccctcagcataaagcaaatcctaaaatgtgcagcagctttgtgctctcactttctgccatcttgttataaatgcttctctctgaattaattctgatataattgttcactgcataatgctgaattttcataatatatgagctgcaatatcaaagcatgaaaatgatactagtttaaaaaggaaacccattgcaattctgatattttccctgtgactttgtgtatcacttaagaagttgttctcaaacttttgaatcttagaaacagtttatgatcttaaaaattattgaagagctcaaataattttttaatgaaattatatttattaatagtctttgatttagaaattatgttatgagttttaaaatatttattcattttaaaacaacttaaaaaacatgtcaacatagataaaatatatttattaaaaaatgacagtttccaaacaaaaaagtcagtggtaagaatggaattgttttacctttaagcaaaaatttaaacagcactgggctaatagaatacagttacattcttacgtgcttctttattcagtctgttacaatatcgtatattatattgcctctagaatatttcactgaacactcatgagggggtaagggtgaaaaacccaaacaacatcttggtattgtgaaaataattttgacctcccagacccactaaaactctttaggatcctcagatcacttgttgagagccactgacttaggacaatatttattcagtgttaatcacggatgaagataaataaaacccctaaatactaggcgtaagtatatagatcaggtagaaataatgacattacatatattttagccttaccaatatgtacatagtctgctttctgttttataaactgttagttctgctgtctgagaaattattcttataaaaggtatgggtttatataaacatttggcaaaaacatggtcttattatggcagtccacatgaaaaataaccacaagttttgaatcacatgaaattttaagactcattctgaaaagtcttttttttttttttttaaagaaacttttggttttgataaattatagatttagaggaagttgcaaaaaaatacatggggaagtcttgagaactctttagctaattcccccaggagcacttcccaggt

SEQ ID NO: 28660 - DNA, 647 bp, Bovine  19866880716003
atctgcaagcagtagatgacaccgcacaacttaaaaaaaaatcctttatgttatcatgcaatacccaatggaatttttaagcgtttggatccataacctcagaattaatgccacacaccaaggcaggtcatcgtgtatttgatacataagtaataaagaattctgcaaatgaagatttattttggcattctttaattgctgggttaactgaaatggctaaagaaataaaaagtatgtactatttcagcctattattactgctatgaaatttctgtttttgtttgatagtgtttgtttgaaattatgtaccacaaataagaccagaggtagaaaacagcacatgaaataacaaaacaggaaaagaaaaaaaaagacaaaacaagaccacacgtactcacaaactctcctgaaccaactatgttcaagaattaataagctatatcccttacccctgtgcactcacgaggctgctaaaagtcaagccttctgagtttttacaatctaagtatgttctcggcaccgaataagctttttaaaagccagtttaaagtcttcattgaaacttgtgtagagcagagggttgatcagagaattcacataaccaagccaggtcaaaaaatcagccacttcggaggacacagcatagg

SEQ ID NO: 28661 - DNA, 2533 bp, Bovine  19866880759336
tctttgcgatctgtcccgggattctccatgttgacttaggcaccgatttaagtatcttttgttaatgatataggtgtcagttttagaacttaagaacacttagtagattcttcacactgtattaaaatgcaaagtaagaagcatttccttaggaagttatcctttttttccccatgaatacattgggtttattccagaaacatgcaggttaagaagtaacagaactgaactggttcaaaattgggaaaggagtacgtcagcgctgtatattgtcaccctgcttatttaacttatatgcagagtacatcatgtgaaatgctcagctggatgaagctcaagctggaatcaagattgctgggagaaatgtcaataacctcagatatgcagatgacaccacccttatggcagaaagcaaagaggaactaaagagcctcttgctgaagatgaaagaggagagcggaaaagctggcttcaagctcaatgtccaaaatataagatcgagccaccacttcatggcaaatagatggggaaaaaatggaaatagtgacaagatttcttggggtccaaaatcactgtggatggtgactgcagccatgaaattaaaagatgcttgttccttggaagaaaagctatgacaaacatagactgtgtattaaaaagcagagacatcattttgcagacaaagttctgtctagtcagagctatggtttttccagtagtcatgtatggatgtgagagttggaccataaagaagactgagcactgaagaattgatctttcaaactgtggtgttggagaagactcttgagagtcctttggacagcaaggagatcaaaccagtccatcttaaaggaaatcaaccctgaatattcactggagggactgatgctgaagctgaaattccaatactttgggcatctgatgcaaagagctgactcattgcaaaagaccctaatgttgggaaagattgaaggcagtaggaaaaagggacaacagaggatgagatggttggatggcatcactgactcaatggacatgagtttgagcaaattcctggagatggtggaggacagggaggactggtgtgctgtagtccgtggggtcgcaaagagtcagacactgcttagtgactaaacaaaaataacgcattcctctacactgtgctgtgagcaaaaaagtgagagcctgagagactaggtgagtgctctgtcccggccttgttctctaaacattcatggctctggtttcacatctgcttaaggtcccatgtgtggacactcagcttcactgcctttctcttgccacttactcaaggataaacccagattttctgcttcagtgtcatcaaagttttgcaagtatgcttgtatggtgcttattatttctttttctattattccttgccattgctctaagtgggcttctcaggtggcgctagtggtaaagaatccacctgccagtgtggggatgccacagacgcagtttcgatccctgggttggaggatcccctggcaacccactccagtattcttgcctgaaaaatctcatggacagaagagcctggtgggctacagtccaaggagttgcaaagagttggacataactgagcacaacatggcattgctcaaagtatgaaatgcgaagatttcatcctcctgccaatttctcttcaaatggctttggatgagaatgttctggactgatttacatgattctatgttctgcagagggtggttcccagaccagtgacatcagcatcacttgggagtgtgttagcaatgcagaatctccagactctctccagatttaccaaagcagaagtatgaaaaatatggccttttattgcattttaacacactgtattgaaaatacttgtgaagctctttcttcctttcattagaataaaatttcagtaaaatttcagtttgggagggaatctgtattgtctagctttccattgaatatccaggacctagcatagttcttggcagatggtaggtgctcagtaaatgtttgttgaatgataaatgaatggatatctgcagagtaagtcttgtttgcttaacctagttgttaagtaaccaatgtgtttagaagggctcagtgaaagaataatgctaacagtgcagacaaatgaggtgtgtaattaacacctctggtcctattgtttcctagaagagattttctgcccagttgactgtgattaaggtagggttgacagtctccaaagtgggaaaaggattggcctgtctggcaaagaagatgactcttgctctcttctactactgtatcctcaaattatgagactggtgatccactccttggcaatctgaaactttgcagtattttgatttcaaaaggtcattttctagttaaatatactgatttgtctgtcctcatattttacctctgaaattgaacatctccccaccttcccttccccctcactttttttcttctttggtgcacactccccctcaccactctctgactattccaatatctggctacctagtctccgttcttccattct

SEQ ID NO: 28662 - DNA, 791 bp, Bovine  19866880763487
cttagttttaggcctcccatttaggaggcctgcttcattttcacatttctgtggtctgggggctgaaaaagacaggcagatatatttcctgcatttgctaagttggcctcagacacctccattcgtttgtttgttgaagacagtgtcacctcatttaattcagcaggaaaacaagtacaccagtaagagaagaaagactggcgcataatctcctctgtatttcaaatatgttttccatggaagatactgcacagggagccagacccaggcccttgcttcctgcccctggaaaagggttaattcagggaagccctggattcacaagtccaccttgggtgtttaaggtcaagcactttgcatctgagtgtagaaactatggtaagtacatattgtgaagccatgtcaagttcagacctgaacatatactactgtggagctgggagtaagataagaatgctaagaggaccctgaactatttgggaaaacacccctcccccaatccacttgaccatctattattccctcccagactcagagatttgatgcaggaagtatggaaggacaacaaggaaggttaggaagaagcatcctgggaggctgacaccctctgtctcatccttctaagccaaggacaagcaggctaaggttgaatacaaggtcctaccccaaactggacgcagatggaaacacataaaaaatgtatatgatattttaacaatgcaaacccttgtttgatcttgaggtaggagcaggagccccttccatttagcctcaattccctttcattttca

SEQ ID NO: 28663 - DNA, 963 bp, Bovine  19866880781472
acattttagtgtgaataaagcaatctgaagtgaaaaaaataagggtgatacccaaggttatatattacctagatgataccctaaacattatttcaattcttattgtcatggtcgtcccaatgcctatgtaactttgttttcacacacaaagagtttgaaaattttgcttccataattgtagaaagttgagaaatcaaatcaagactatgttttctgaggaaactctaaatgtaaaatgtgactgacgaaccctgaagcacccatttaaggtgagtataacatagaagactcagctgtaccctccacccacagtgtctctctatttcttgccatctggtgagcccccttacaccagctgaagccttttgcttcttcctactgcctatacccagaaggaggtggtcactcctttcaccgtgtcccctctataagtgtgatatcactttcctctccatatttgtctgcatctctctctcccaatcatgaaaacagggtttgtgtcttatacactcaggagtcccccaaacctaggaagtctctcaaatgataaatgaacattatagaaattgttgtccaaatagtcaaatatctagataagcacttaggctgtataagcaatggtatggattcattttgtttaagcacatattttaataaaacactcaggaccttctgttctaatgaattatgtgtgctgctcctccactaaattgtgaggtgctagaggacaggaattttgtgtcatttacccttgggagtccttgcatcatctacaaaaggctttaaaggcagtgagtgctacttgctgaaattaatttaaatccttacaacaggcgtaagtgctgggtgactcattcagcaacagtgaagttaggtccccattgtgtcatatgattctaacatttattactgatacagccagtatgttttcattaattggcccagtccttcattatactatga

SEQ ID NO: 28664 - DNA, 887 bp, Bovine  19866880827059
tatggatgtgagagttggaccataaaaaagctgagtgctaaattcaaattttggtgctggagcagtctcttgagagtcccttggacagcaagaagatcaaaccagtcaatcttaaagaaatcaaccctgaatattcattggaaggactggtactgaagctgaagctccaatactttggccacctgatgtgaagagcctactcattggaaaagaccctgattctgggaaagactgaggtcaagaggagaagggggcaacagaagataaatggttgaatggcatcactgactgaatggacatgaatttgagcaaactctgggagacagtgaaggacaggggagcctggcatgctgcagttcatggggtcgcaaggagttggacacgacttagcgactgaacaacaatgtgacatatggttccctaattctcagtgtcttaagtgaagccttgttgagcttcacacaggtgccactgaagatctgacaaaggtgaagacactgtaacacctttagaatctttgggctgacaccattgatacgtcttatcctgatgacaaatgccaacttgggttctacaggtacacaaaagttgcaggcttttcatgccatcctggtcatttgactttcagttcttaaagctgcctgtattccttgtgatagggcttagctttctcatagataagcttcctccttgcctctcaaagcaacatttggggaaacttctttcccaggcacttgatcataagctctatgaaattcttttgctctttcttaagggtttctagcacaacagaaaccttctttttcttctcttctgtaccctccatggttctggctgggaaagagataactacatctgcagatatgtcttcttgaaagctaggcaat

SEQ ID NO: 28665 - DNA, 757 bp, Bovine  19866880848899
cccatcttgtgtttataaaatgcaagagttcccttaaaccatttataattacataggataaaacacttttctataaggaagttggatgttttgattttactgtttatagatgttagattgtacagatttgtctgtattttcctgccatatctaatgatacttttttcattagattggtcttccagaacagtattagttgttataattgattattttgattattcagtatatagttagctcttatagtttagctttattcaccatatttatactgtggatttacggccagagatagaggttatttcaggagagtttatgaatctttctttgaagtccaactaaaatcagtactggaaacaaaagaaaacattctctcaaatttacttttgtttctgtttgccatgaatagtagcattgatttttgactttgtttgttataaaccagttacattcacaatattattgcctgagatattgatgatattgtgatatgaaaatgtgtatattccctgtgcaacatcagacttggcaggaaaaatgaagcacttaatattaactgaaattgctggtactctgaataaataagcatggtcaaggagtgaattattttcttttgggaaatatttttttaagttttattattaaaatattatagttttatttttagggccaaatggggtatatggaatagttggtttctcctccttaaggtttattaccaatatgcataaaacttacacattaaaatctctaccct

SEQ ID NO: 28666 - DNA, 726 bp, Bovine  19866880906727
acacacgctgcctcagaggttttagagtccacgtcaacaccatttaccgtatggatgttctccttgttctctatgaaacacctcttgccgcccccacctgcaaagtccagctagagagggggctttagcttgcagcctcagctcttttgtatcattgtttcatacctctgaatgtgtattttatatattccctgagttgttctccttagccatccaaataccaactcaggcttgattgcttaactgagtaactgatttattcatttgctggttccttactgagtgcttaaccatgaactggaaacagttgggatcactggtctgctcattattaggctgctcaggagtctaaattttcctcagagaactgtctccatcctcattcctttgggtgtcttcatgaagtagctttgcctaaatcatcccttgacatatgactacttgataccatacaaaatggacaaacatgccaacctgatttcttgtatccatgttgtttatccattttctgaaggaccatcccttctcctccattcttcagagcctctggtatgaccttcctttcccctgagaatcagatgagcaaatgctctctgctgcctcatcccttcctcatcctcttagcaaaggcaatgcttaaaatcccctctaaaattctgttttatctaatggaaaataaatatgatcagatttctataaatctgcccctaagaccagggtctcata

SEQ ID NO: 28667 - DNA, 1094 bp, Bovine  19866880950461
cagactgtatcctgtggcccctgatgttcgtaacagccatttcttatggccaacacatatttaaacttctcaaagctttttaattacaaagatgtttctattttatctagcaagacagcctccacttgagaaaatatgatgcccagataagaagtatttcttctttccctttattgttctgataaatactccagaagagtatctcaaaaatcagtggcagctgcctgtcaagaagacattctgtcaaattagacaatttaatgattttgcagtgtgacttgaaattcctatttttaatagaattgtcacaaaggttcatcaccaactacagacaggtacgtgatttagctgtgagtcaccaaagttagcaccagctagagaatttatctgaggtaccagacttagtaagaagagagagacacttgtggttttgatagaatgcccatgtgggttctgtttatacagaactagagtgactttgttgaaactctgttgtttctattggtgttttacatatatcttagctttgctagaatctcttaaggctatcaattcatgttattttgccaagaatcaatatcaagcaatgttttgtagttctcaggagatttgataacctataaaagcctttctatgaagaagtgtccttagaataacaagcttgtttaaatctttggcagtaattttccatcatacactctctcataaatgcagactcctgtccattctcatttatttcctcattgacttagtagtataattttcaagttcaatatgataaaaattatctttaaattcttatgtttatcattattataatcattaaattcacattatttcaaatgtcataaataattcataacagtggaaataatcatttaatgctattcagtttcacagcatctcaaatttcacatggttttgctactgttaaatcacacttaagcacgacttttatattgttatggtaatatgacatcaacctgcatttacttttatgtcataaagctctcataactaaaatatggcaactgaaactgacttctccctggattcgggttcctaggaaagtcaaaatcttatataaaccaact

SEQ ID NO: 28668 - DNA, 1996 bp, Bovine  19866881113936
acaagctgcatagcaacgcccaccgttcaggagtcagcaaggaccaaagaaaaacagcacaagttcaactgaaagagtgaataagcaaaataaagtgaatccacattaaacaagcaagtccctttagtgctccccagcccaggaagcaatagcagaggggaaatgaggtcaactctgcgtatttggaaaaactattccacctgtacttctacagaatgagactaaccaatttgggaacttcagtagcctgtgacacattatctttgccagttgaaattttgtaagtcttgccttttttctctccatcataatttgatagtaggtcagcattatttgatagagatcagcattgttactgaaactaggagcataaagggtgagatttataactcacccatctagattaaaatctgtctaaaggcatgacatggcactgcaggcggtcctgaggaaggagcagatgcgtgtccactccctggagaaggtggtggagcagaagactaaagagaatgatgagctgaccaggatctgtgacgacctcatttccaagatgaagagaatctgacgcggcagccctgaccatgccgtcttccctttgtgtgtgtgtgtgtgttgtctgtctgtctgtctgtctgtctaggtttttcttctctattgacgtcttttttcaatttcgtttttaaactaggttgctttaggaaaaaactaaataaagtttctcttaaatctaaaaaaaaaaaccatttacaaatatgtcagaaccgcctaaataaagagacagaagttcttctaggctttctaagcaatcttgatttttttgcatcaatttctatagtacactctctacaagccttaactgagctaggatacaggatacaaaacgttgtctttctttggtctcatttatatccatcaattgtgttacctccctctggcagtatctaaggatttctctgcattctacacaatgtggtcctgaaatgtggtgtaatctcaagttacttggtgaacacccactgtcctcacatcagtgcagtcatctcagcctctgaactgtccgctccatattataaattttctctatctgctcatgaagctggccctcggaagacagatcaggccttgctttgaaaggggaatgattagcagcaaagatggattctagtgtaaaagagtatttaaaaaattatgaaaccaaaatacatattatcaatgcctctctacacaacagaataaattatccaaactgaatgcagcagcaatatcgctatttgagtttgcctttctctctctctctcattctctctgtttatcttttacctctctcctgtttggtacagtacattcttttaaattacatgttgccaagggcaaacagtttttgctggtactttcctatctctggagggaaacaagggtgagtgtcatttgaaggtagacagcatcttatttgtactgttggaaaccttgcatcctgcaggcttgataaaaactcaaaaaataagaatcctacttctactttcagtggtaccatcaagatcagtgtccttggttataatgagaataaaaaatttaactccataaatgcagaatttgtgatctcataaacaaaaaaaaatccttctgaactcaggcacttgactagctagatgtaagcttataaagtgacagctctgatgatctttttctctccataaaatcatactttctactcctaaaatgaatgcatacccatcaatcagaagttaattacatattttcttgccaaagtttttttttttttaattaataacattctctaaattatggaattttcctcagtggactaacacactgtggaatgtggagataaagatgattgtctgtcacagaaacctaaagctcttactgggttaccagataatgtgggttgatttgtgtccccccaaaagatacactgaagtcccaggctcttgttcctgtgaatgtgatttcattcaatagaaacatttgttaa

SEQ ID NO: 28669 - DNA, 957 bp, Bovine  19866881145397
ttggctgttcagttacgtttcacttttccctgtggctacttggcatctggtgggccctccccatggtaaggctcactcttctcagtgactggaaatgtacagcttgttattcagtaactgccagcaaataaagaactcctcttgcttcccattctgcttccattgccaaatgaatatgctgctctaatatctaatagcctttaccagctgctgggttctgttctctccagctatgattacttggactttccaggttccatattgtcctgccattttcatagcaggggctccagagacattacaaaagaatctcaaaactctgaaacctcattaaaccaaagcagttgtatcttccatagctccccaactgcaatatcttggcaaaaacaaacaaaaaaacagtgttccccgccccccagtaaattttggatcattctctaaggccttttttttttttttttttttttactttacttcccaattcagatcttttagacaacagcatacttcactttatacaaatgattacttccttaatagtagggtgggaatcaggttgttaaaattaaaatatgttaaacctactaggaataattattgcataagagaactccactagaattatttgatatatcagctctttgcttctcaagtgaccattcttaacacatgagtgtgaaaacaaaatgtttacatgtcacttaaccttagctatacagtgctcttgtaagatgtgtttccattactatcttccatttcagggcattgatttgaaagctgaccaatcagagtcactagtgagtcttattatttgaaaatccattctctgttttcctttttgcttatttttgaagtgaaagatcaataaacctcagccctgggctgtttttcccagagataccaggggtgagcagcagggttgatggcaatggaacacactagaagaccagtgtccat

SEQ ID NO: 28670 - DNA, 2003 bp, Bovine  19866881175646
taagatgaggtcttatggtgggccgtagcctaaaatgactggagtccttacaagaagaggaaagtgtcatgtggagacagacacacaggggcaacaccatgtgatgacacaggcagagaccacagtgatgcagctacaagccaaggaacgtgagggactgtggccaccatgaacagctaggaaaaggcaagggaaagttctgcccaaaggttcagatgaagcagtactctgctaacaccttgatttttgaacttttagcctcaagaacggtgagggatacatttctactgttctaagtcatccagtttgtggtactttgttacaatattataggaagctcgtactcagggcaatgagctagttgggagcaatgacatccccttttcccagctggagggactgcacctgaacttgacatctcagaggacagagacaccatatagcttgtaggtgctgggcagttgacatttcccaacacgcattaaagaggtgcttgtctcctgttttaccaggtgctcttactctcccctcattaaaaggttgagcaaagggaggaggagttctgctgctggagcacagtccccatgatgagtgccactgtgcccaggtcaagcacggaatgctgaagacacaagaggtgagtgtaagccactgaccctgctcatgagtgccagcctgcaccaagtgacccagctggaacttgccccaggccctttgcaggacacatcatgaattcaaaacaatgtgacattccatttacatatcaaataataaatggagagtgtggaagtataaaacccatatcctagagtcacggtacttggcttcggaatcgactcctctctactagcattgtagccttcggcaatgtattaacctccttggccttagtctccttagctatgaaatgaagataaagataggaaggtttcttctgggtgtccctgaaaagagtaagtgaaaacaaaatccatgtaaagtggtgaacacaattagatgcaagtgttcattgcagtggttgatatttcttttacctgccctgagcactaagtgactgagaatttatttctcatgactgatgacgaatctccagccgcccactgtgccaaccctctgtcttcctgcaagtatcacactgacaaatttcactggctcagcattttcccttgcatgcagttgttctggggcttcatgtccttaaagagagccatgtttactgtttccattatttttccaaaatcagtaggcaaaacatttacttaaatttttgtactgaaaaacagcacagtctgaaggactctgagctcccttgaatgaatgatgattgtgagtatcaggtaagtactgtcaccaccagtcattcagttgctttctcactcaactgagaacaaagagccaccacaccccaagatgtgcttgcttttaatcatatatgtaacttgcattcttctaaccaaattcccatcaaaatgtctataatacagcaaaaactaacgtttaaaaactaaaatatcatgatattagatcattttggttccttgtttattgggaatgatgagtcccaccagcactgggttattcacagagaaaaggattgcatacatataacaccctgtatcctacaactgcactgtaattgctcttattcctggaggatttttttcttttctcttttttggctgattgttttggattttctatatagacagttgcattatttacaaagacagttttatttcttccttcccaaataatgtatcctttattttctttccttgtcttattgcattaggaaagacttctggtacaactttgaaaaggagtggagagaggagatatttttgcattgtttctgatctgaatggaaaaactgctctacaggtagagtgggagggacttcccaggtggcgctagtggtaaagaaccctcctgccagtgcaggagtcctaagagacgtgggtttgatccctgggtcgggaagatccccggaggagggcaggcaa

SEQ ID NO: 28671 - DNA, 3731 bp, Bovine  19866881213267
tactctttgctataagtcccattgctgttaagtcactcgttaccaagttttggggagtattaggggcaattagtggaggagtaactttctttcttctcttagaagcactgtttcccttcttatttaaatgactagaccttgtgttctgaggaccacttataactgaaacacgagaactgctaccagtaaaattttgtgatggcccgctagaattagggaatgaactagaacacaaaccattttcaacagtctttagtagtaagtcgtttgttggaaaaacaggcaaacttctgcattcctcaatggaggaagttttggggtttggtgtcccattctggtctgtcagcagggggcctgggtggcacactgtctgcagcagggttggcacaggtggatttggcatcactgttgtgtttacttgtgctgtgtcggagacacaacctgtggggacgtgagagagcacatcggcaccctcaaatgtactgggaatgccagcagtttccaaagcctgtttgatgatttcactcccctcttgactaacacttgaattaaagctagtcacagcagtccgaggaaatgtatttggtaaaaatgttgaggagcggttttcggcagcaagaagttgcaggaatgatggatctttaaaacatgcttctgcactgaatgcagactgttgtggctgctgcaggttcacggcatttgtggagagaatcatgctggcaagaagagaaggctgcccattattctgtagaagttcttgagcaatttctgctccatccagtggtttacagtaagatcgcttagacaagtgtccacccagagatctggggttagtgaaagccctgtaacacctgctacagataaatttcccatctctgatgattgccggccatttagcccttttgttgtgcttgggttttctttccttcccatttgggccccgcccgcggtcttttttcactttttctggtccaggctgttgggcaccagcgccactgaagtcatttgcaacactgacttgtgaaggaaaaactgcgttctcaccattccctccctttagaaaggaggaattggtatttccttcgatctgtgaagaaaaatgacttgtattattttccagttgggagaaaacagagttagtcccactgtctgctggtgatgggaagagagagacagagctgctttctgcaggtaacggaaggaaaggatctgagccgctgtcgatattcaaaggcaaaaccgttttggttaggtcttccatttgtgctggcaaggtggtgctagataaagtctccatctgggaacataacagaccaccaccttgttcgtttttatcctgagaaggtatacttggattcatgacactttccaccgagggcaacagtggagctgacacacttgctagatgagctgggaaaatggaagatgagacatgctgcaactgagcagaacaggcaggagtcccactggctttggtctgtggtgtaaaaaatgcattattagagctgctcacctgtgatggcaaaaaataaacaaattttccattatttggtgtatttaaattgttagctttctggccccttttgcttttgcgctgcattttgaatgctgcgtactggtcggggtgtgctgtcttcatgtgtttcccaatactctgtgaagagttgtaggttcgagtacatccctcaacctggcaactgaatttctgaactggcgcttttggaggcactgatggagttcctaaggaattactgaggttgggctgtggtggaacaaatgtgatactttccagcgtcttcagaggtaaattataaagactagatgacgttttaacattacctccacattcaaacttgggagttggtaaactgttctgaaaccctgcctggttttgcacagaaaaggtcatcaggttgctcacttgtctttctaagttttgtgtggtcatgccgtctatcttgagggcttctgaggccactaaagaattctgagtaatctgggtttcattaaaacactcctgttcctttctctcttggaaatccgtgtgacacaaatcattacaagcattttcaactggtacatgtaagtttgtgaccagtgattcaccagtgttttccacagttgagttttcttgctttccaaagttctcctcgatcccctgattgagggacaccttaatggacacggctacttcactggcctgaagcagaggagtgggagcagcgtttcccaaaccatttggcagtggtccatcagcctgcccaagctccgaagcagaaatctggtcttgcttggtcacaggtgattctgccttgcttttatcccaagcaccacttctatcagctgggatggtgttttcaacactattttctgaaggaagcatggatctttctttctcagcattcccttctgcactctgattcactctggaaggctgaacagaatctctggctgaattaagttggtcttcaggaggcagcactttttcaggcgtattgtgatcttccagatgcttttcaagctcactctgagaacggtaaactttaccacaacctgtgaacttacacgtgtaggtattataatgctgtgcttcatggtcatacagtaaataagcttctgaaaaaattcgaccacatttaggaaacatgcactttgctctaaagacttgatgttcctttcggtgggttaagagctccgcatagctgttaaaaccagccttacacttcatttgtatacagatgtatggtttactgccacagtgcatttgtaagtgatcattgagatgagtaacacttacaaaatgccgcctacagtactggcaaataacttttttgctttgcatttcaagaaagcgcttggcatcttcattatccttatgtccctttacgtgagcaattaaatttttaaagtacttaaagccctttttacaaaaagtgacagggcaattgaactcattaacaggtactggtttctggactgggatcacctctggctcgtaagatttgtctttgtcatcagtttcatcatctgagccatcattgtcattaaacactatgaagtctgtggaatagagactgttcttcttgattggccgctgctcctgcttggccacagcatttgtcttctgattctcgttggtagctgtgatcttaggaggccttcccaaccttcttaatggtttcatagctgccagtctctctttacttgattgtttaacatgcaacgtgacgtgagggacaaaagtttctttagaattaaagttctttgcacatatggggcaactgtaaatcccatctttgtaatgcttttgagcatgtcgtactattcgatgaccaaggaactctttgtcacacagcacacaatactgcatgtaggcttgccaattcctgaaccgagctgatataaatcccctctctcttaactgttttatctctctctttttctgcttttcatcacaaatgtctctaaggccagaattagcaccaattccaccattcacagaagtgtctttactatcttcctggtagtctgctaccttctcataaacctcactgtcatttaattcatctattgaagacacaatggatgcttcttctcccattaatgcaagacactgtcgttttaaagttttccaatcccagaattctggatcaaagggccactgagttttcaatacaagtaagagctcacagcgtagagaatttggtatggaagattctcttcatcatatt

SEQ ID NO: 28672 - DNA, 1142 bp, Bovine  19866881234886
tgggttggggtttcccggtgatgctgtggtaaagaacccacctgccatacaggcgacataagaaccacaagttcaagttcaatccctgggttgggaagatcccctggaggatggcatagtaacccactctagcattcttgcctggagaatcccatggactgaggggcctggtgggctacagtccatgggattgcagaatcagttaccactgcagtgacttagcacacacacacgcatacttagattaatatttacagaaccgtagaatttatatatgcaaaagatcccagagataattacttttctcaatttttgttttttggttgggttaagtggaacttgtatcacaccctactggtgatctttacaagacccagtggttcctaaaacattggaacagtgcctgggtcgcagtctggtcatgagatctaagaatttcactcatgttctctctcctggtgtctggtttatcatgtccacaccatcgtctgcacatcctcatctttttggagatcttccctacccagggattgaacctgcatctcctgcactggaggaggattctttagcactgagccacccaggaagccccttttcttccttagaaatggtttaagaatggagaagagaagaaaaaggaagaggagggaggttgtgtcttggccacggtaactttctatgtcaagaagacacatcatttctcctttattcctttcccatgtggctaaaacctccccacactgcagcacattggacactggctaatgctcctctaccctcgagaattggcctggtttaggtcatcagtgtgtccttgatcgccaaatccaatgcacacttttccaggccttcactgacttgacttttctggacattgacatagtttggaatttcctccttgaaattgtgcttcctttggcttctgtggcaagtctggccttttcctcatcttcctgccccttaaatatttatgttcctggtccatgtgcatccttcccaaggctgtaccatttaactaggaggcaggatattgtaatgcctaaaagcttgaattctggaactagattgcctaggcttgagtcctggctgttccacttgggatcggttgctctatttgttgatgcctcaattttgtcatggaa

SEQ ID NO: 28673 - DNA, 1650 bp, Bovine  19866881241736
atccaaaaatgagggggtatatgtatgtattgctgattcactttgctgtacagcagaactaacacattgaaaagcaaatacactccaagaaaaatttttagaaattaaaaaagcccgttaccttaaaaataaccgtgattgggtcagtggtgacagctgggtggtgtccaacatagctttgccttggggaattcaagttttgtgttagttaattcagataattcagccaattcagcatcacttgccacctcccagcctctcactgttctgtctcttcacagatcagttgccagcctgtatccacacatgcttttgaatttaaaagtcgggaaacatgggttctaatccaaaatctgcctgcttgtgtgacttgaagcaagtatctttacttcctagagttgcaatttctttgtttacaaaatgaagctatgagacgaggaccaccaagattttccaagaaataaagtcctaccatcctatagtgtcttccagcttccacttcacatctacagacattataaataatccacaattggaaagcctattgaaatctgaaaattatttaaggtatgctcatcctctatcttcctcatccacaaaagagcttttacttgtgatgttccctctgcccagagtgtttttcttacaatcacctacatgtttctcggctccccttctttccagattctgatcaattgcaactctggtagagccttcacttactaccttaataacataacaagctccacttccaaatctattcttttaactttactctgctaaagctttttgtatagaacttttgccatctgacatattacatatgtacatattgttgtatccccaaaatagtatgtgtatcagtcagcttttgctgcagcaacaaagggcctcagcactccagtggcctacaacagcaaatattcatctttgcttatgtcacatgatggctgtcggtgggctacagcatttcttcattctcctgagcacacccaggcttggctaggctggcttccacttcaggacttgagttgaaaaaacatattttctctaggataaaatgtccttatggtgaagggcaggaatatgaaaggaagcagagccaaagcaggaaatctcattttaaaattctgctcagatgtgacagtcacatctgctcaaattccattagctgaagcatgtcatgtaaccaagcacaaagtcaaaaagtcaagtagagtatatgtcaagtcacatgacaatcaattggaatctaattagatgcaacaatcctattgttaaaaacaataatccaataagccaagaaatataaactctagcacttaattcttttcctgaactatctgtaaggccctagaagagtaggcattcaataaattctatttgatggattaaaacaaaacaaaacaccacccttttcatcctttctagttccactcttactgctagaacatatcccaacttggcccacaattatcactatagatttgatctggcaaggagagatgagagggactgaataatttttttatggtccttgtaagccagtaattatgggataataaaagatactttgagctttgaaatgaaagtgttttattgggcctccttgaacaatgtgcttttgtcacaaatttcagcatcaatatt

SEQ ID NO: 28674 - DNA, 1146 bp, Bovine  19866881350531
ctggtccgggaagatcccgtggagcactagacccatacaccacaactactgagcctgtgctctagaacctgggagccgcaactactgagcccatgggccacaactactgaagtccacacaccctaaagcccatgctctgcaagagaagccatggcaatgagaaacccacacaccaccactagacggtagcttccttcgccacaactagagaaagcccacgtacagcaatgaagactcagcacagctccctccaccccaaaaaagaaaacaaaaagaaaaaacaaatgaagaatctgccttccaatgcaggggatgcaggttcgatctctggtcagggaactaagaccccacatgcctgggagcaagtaagtccatgaactgcatctggagaaagcccatgtgctataataaagacctagtgcagcccccaaataaataaaacaaaatcctgttgtctgagactgagaaggtagaaaggagaaggtttgagtgcaggaaaatgatcatgagttcagtttagaagggctgtgtttgaggcactgacagtgttcacaaggagatgtccaccagacttaattcatgggttatggtgtgagaacgagacagatcacaatcagagaaacatattttagagcctcaggcaaggaaatatttgtggaaatgatggaggttggaatggagtatgaatatacaggaagtaagaactgatggttaactcccagaatgaagaaaaggaggcaaagaatgagaaggtaactagagaagtgagaaagtaaaggatcctagaaggcacgggcttaaacaagaaagggatggctaactgtttgaactgatgagaacaggaagttagataaggacagagggaaggtcactagatttgcccattggcaagtccccagtaacctttgggagatcagttttgggggaattgggacaggcatacccagatggcaaaagagagaataggcagtggcaggtgagaactggaggcagaacaaatgggtggataactggagactcaggtgggagaacgaggagagagatgaaggagcataaggaggtactacaggtggaggactccgtcctagtgcaaaaaaagactcgagcaaattgaggctgagagtaaagaagaggggggagaggaag

SEQ ID NO: 28675 - DNA, 688 bp, Bovine  19866881683031
tgatcgaagatgatttaaagaatctaggaggatgttcttaggttgtatgcaaataatatgccattttgtctgaggaacttgagcagctttcgcttttggtatgttgaggagtcatggaaccaattccccactgaaattgagaactgagggctgcctgtagtattatcgttcctcacttatataccagtatccttaaagttacaaatacagtacaaacagatcataaaaattacttgaaaaattgtgggatggatattaatatttcactgctcaactattataatatagatttaataagtccacctttcaggctaggtgcttaaagcaaggctaagtttgatttgattttctataacattatcagaaaattaattctacttcattgttgatattgccaagtaatttccttggttttgaactacttcagggaggtcttaaataaatggagccaaatatgcattttcgtagttgattttatctgtcctctaatatcctgccttatattattatttagaaatgtattggaagccacagtcactttggtcgctggtaaaatccatgttatttacttctctaagaagaaacttctttcaatttaggtacctgccatgtagagtttcaatgctgttctgtttgactgcaaagaaaatactgcagtctctagtattatggcaagtcgtataccatt

SEQ ID NO: 28676 - DNA, 618 bp, Bovine  19866881882668
tgaacctgtgtctgatatatcctttgtaactaatagaactgtttataaggaaggccaatgtgtcctaatgagtgaacaaactttttctcttttcagttgacttttcattcagttgtgctccctttgttttgtcagagtataagcattgctattcacacagaaatgcaaagtcctgttgagtgcaaagtgtagatgtcttaagtgggttctaaaatatcaaaggtggtgactcttgaagctgggtgatgagttcatggcagctcattatcatgctctaattgtatgcttgtaaatttccaaattaaaaattaaattaaaaaaaaaatagaagtttcctcggtatagcaagccactctggactctaacttttcaagggacatatgaacagataatcctttaaagtgtatgtatttagaattgctattcaaaagcagagacattactttgtcaacaaaggttcatctagtcaaggctatggttttccctgtggtcatgtatggatgtgagagttggactgtgaagaaggctgagcaccgaagtattgatgcttttgaactgtggtgttggagaagactcttgagagtcccttggactgcaaggagatccaaccagtccatt

SEQ ID NO: 28677 - DNA, 931 bp, Bovine  19866882182849
cctcgataggcttgtttgggctccgtcatatggtggtggtagtggtggcggttagaggggaagcccccaaagcacaagtgcttttcaatcctttgcttgcatcatgtttgctagcatccattgctcaaacatgtcccgtggccaagttcggagtcaagtttgcgagtgctccattgttcgtacttatggcacatagcttactaagtaagatcaaccactgaggaagggaactcttgttgtataattttggcacaattcaaaatctgtcatctaaaaaaatattttgagaattctttggtggtccagtggttaggactcagtgcttttaccatgggcttggttttgatccttggttgtggaactaagatcccccagaccacacagcatggccaaataaataaataaaacattttagagataggtcaaagacagactcagtgacaaatagtagataagttcagctaaaattaatcctttgtccaaaaactttgggaaacattgtttggatgagcagacattgattatgaaattaagtcagagggagttgtgtgtgttctctctgctcagagttaccattgtctatattaaaaaagtgctgagaatctttgcttgggttctagaatggctttcttagataattcagttcaactcatcctattgttgtgtgtctagagttgtagtgaaagtaagtatttttagcttatgtgctttaagtatatatataattataccgtgaagacttttagtagagttgtagttataaaatcaaggtagaatacaatattggagttctaaaggactgagaattattgattcacagagctgagagagacaattttccatcactgcctaatattagggtgaggccagagtgtgaccactgtaactcattctggaaaacagcagaaactgctctcagggataggattca

SEQ ID NO: 28678 - DNA, 2171 bp, Bovine  19866880201889
ataatctttgaaatagttttaatgcagtttttttcctatgcaattgttaaagttttgacatagacaattactgacacaaagatatattaagttttaagagaagattttaaaacagctgatagagtatgatcttatttctgtgcatgataatttatacatatattttacatatgcaaagaaagtctgaaagtatatcatctagataataatagtgattttatacagatgggtagaatacttttttggatgtaatatttcttagtataaaaaatacaattttaaacagcttttccaaaggaattacaaatatgtgagttgtttattcaagatctcccactggcaaccacaggagatatgaggactctcagttgaaaaacatttttttaaaaaaatgatgaagtcctccagcaaaatcatctatcagatcagatcagatcagtcactcagtcatgtctgactctttgcgaccccatgaatcgcagcacgccaggcctccctgtctatcaccaactcccgaagttcactcagactcatgtccatcgagtcagtgatgccatccagccatctcatcctctgtcgtccccttttcctcctgcccccaatccctcccagcatcagagtcttttccaatgagtcaactctttgcatgaagtggccaaagtactggagtttcagctttagcatcattccttccaaagaaatcccagggctgatctccttcagaatggactggttggatctccttgcagtccaagggactctcaagagtcttctccaacaccacacttcaaaagcatcaattcttcggcgctcagccttcttcacagtccaactctcacatccatacatgagcacaggaaaaaccagccttcctcatttcgtacatggtgaatcttcaatcaatcttcaatactagggaaaaatgatttaccatcagctccaagggcgaccattcttatttgcatttttaaaatcttgcttgatggtttcctggtttgtattgagcaatacaatatattatgatttcttttaggtctcaggcttgtggttatgtgctaatatgcagaaatgaattgaatgcagtgcatagaagacagtcattacaagattgtttctttgtttgttttaccagtacccctttgtagcaggtgagtaagaatcaaggggaaatgctttgcaaaatatgatcccaaaatatccactgaaagaagtatgatgtcttatgaaataaagggcaaaggtgttataagttaagccaaactacagactgtatggcaccgttttcattgagaatactcttaagtcatgtgtcaatattgagggagagttaattctgggaaaagagtaaatctccaatattaaaacagtagtcggaattacaatgcaataagctttttttggtttgtttttgctattgatatctttacctaggactgtgtctgagatctgtgggataagcaagcatatacttcatgcttatcacattttggaaggcagacaaatctcattaatttcatttaagtactcaacactgccatctcaaccccagacaaactgtggacaaagaacaaaatgttgacttccagttgccaacaagttagacaagtacttcaatgggaattttatttgagaaactttctcacaaaattcttgctttcttcttttattctttagccaacataatataatatggtgagtggattgatagtcattataaaactggacacaggagaaactagttttcttccttttgatcaaaagatacataagtatactgttgacatctttcctagaggaaatatatatagagagagatgctatcatgccatataaactatataaatatatgtgaatatattatcaaatatattcacatacatataaaatatgtatggaaagatagaaatgaaagaatcatcttttattaacttttgctctttcatactattattaaactaacacaaagattagataaaaatcaacttaataaataatatcagagaatgcatttaaataatatgcatatgcatgcatgtgtgctaagttacttcagtcatgtctgactatttgcaacactatagactatactccaccaggttcctctgtccatgggattctccaggcaagaatactgggttggggttggatgtgctctcctccaggaaatcttc

SEQ ID NO: 28679 - DNA, 1838 bp, Bovine  19866880498488
tggaagagccggactggaacccggcaggcttagtccttctctgacctgctgcactgcatactttacccatactgccttctttgaggacattgaaattacactttcagtagaagaatcaaaagatcaaatttggttcaaatgactggccacgagttgcagctgtaatctggaagagaatagaggtaatttcctacataagaataaaaatcattgaccttgcaattttagtataatgctttcacatgttgcactcaactctcttctgaagatctcttcatcattactgttccaccattttctgttcattgttactatttccaatacttctctttttgcccatcaactattacttcattttacttcctcaattgttgaatccaacacattcttttagctagaactcttgaataagataaggtaattttttcttgggcttcctaggtggctcagtggtagagtctgcctgcctgccagtgcaggagacttgaattccatccctggattgggacgatccttggagaaggaaatggtaatgcactccagtatttttgcctgggaaatccagtggacagaggagcctgatggggtaccatccatggggtggcaaaacagttggacacagcttagcaagtaaacaatagcaacagtatttcctttgtaattatctttattattattttgagaagtcagtgagatttagagattagaacactggatttggaataaaaatccatggattttaaagttagatctaccatcaagctctgggtgacattaggtagatgacttctctaagacttaactccccatctataacttacctctagtttacctcacaggatggttacaagtttcaaattcaatagaacacacaaaaagcaagaatacttataaaattttagaatttttcattggtcctattattgtgatacaggttatctttgatatatgattatttttatattaatcaattttaacctttgtcaaaaatccaccatctgaaaatgagattttacatatgtgctacatcagagtttctaacacaattaaaagaaatatataaacataaagtaatctctcattgttatttcttaatatgaaggtagcagtaagatggtccagctatttggcttcctgtatctaggttttattttatctaatgtgagttggcttatttcatctgtttactaaacgttgtagaataattgagttggttcagatacttggtttggcttactgaaatatgattcaaagttgcaaaaagccattgttgagtgagttagcagacagttttatcagaacactttcaactgttgtgtgctattccaggtgggacaattagctattattttgaacagttttacaggcatgctttacttaagtgttatactcaatcacagttcagtcattactttgctattcatgaccaattatcctgaaatacactgaactttgtaggccaaactgaactactatatacataaattctcaattttttgaaaatgttttcaactcagagacaaaaagaatgtttacatttactgagaatgatgattttcaacaatcatttaaaatctgtttctatgaagctttagtatatgtagagcattcagttcagttcagttcagttgctcagtcgtgtccgactctttgcgactccgtgaattgcagcacaccaggcttccctgtccatcaccaactcctggagttcactcagattcacatccatcgagtcagtgatgccatcgagccatctcatcctctgtcatccccttctccacctgcccccaatccctcccagcatcagagtcttttccaatgagtcaactcattgcatg

SEQ ID NO: 28680 - DNA, 1362 bp, Bovine  19866880539022
tacatttggagaattgtaatgaagattagtttgtaaattaaatggcacatttgtaggcattcaatgttagtattcaacatgaatattaattggaaggactgatactgaagctccaaacactgtaatcacttgatacaaagagccaactcattggaaaagactctgatgctgggaaagactgaaggggatgacagaggatgagatggttggatcgcatcaccaattcaatggacatgagtttgaacaaactccaggagatggagaaagacagaagcctggcatgctgcagtccatggggttgcagagtcggacatgactgagtgactgaacaacaaccaatatttgtacacatttcactcattaaattgatcttttcatgtttttcacttttattattttgttataaatgttttctctttttgaggggtgatgaaattgctaaacttttttggatattactgactgtttcatggataagcatattatattttatatttgaaatttatttcacagttgtctattgcccctagatcttaaattgcacaaaattcaatagaaaaagtaaaatgcattaacaatagaagaaattttcatggactttctttagaatgactgcaggggttcaaacataaacctgcttttattatctttctgtgactgcaagcccatgggaagcctaggagtctccaagcagattatggctctatgtaaatgaagaaaagaaaattaaaaccaagagctttcccagctctatttaaagaaaatttaaatggctttccttacttgcatgtcacagagaaacaggtttaaatcactagagctgtgtaatgtgagacgtttagaaattcagcaaagcataagagataaaacactttcaatgttaagtaacagcatctgattgacatagctttcctcctagtgtgtaagagcttagtttaccttaaaggatagctgagatcactcaaaaagtccaaagaaacagatgaacgcttgctttgacatcaatgctcaagaattaattttcagttcagttcctttgttaaacatgattatttgccctatccttgattttgattttttcaaaagtataacttgtttaaatttggaaagaatgaacttacattatcataaatattttaagataggaaagaatgaagcacagttattgaaccattctccaacagtttttgaatagattccacaataataaccacgtaaaatttagttcatgtttgcatacctctacagagggcaaacttactgtttgtcaaggaaatccatagcatcattgaatattgaggtttaaagaaagtcccattagatctagtattttttctgtattatagagatacagtcacttca

SEQ ID NO: 28681 - DNA, 1061 bp, Bovine  19866880596617
ttcctagtggttagagatgcaaggaagggcacataaaactccaaggaaccaaaattttgacatatacattatatatatattttataaagcatgcattttaattatcatcatttcttacaatccagctatctggagtttgtaacatatatcatgaatgtttttacatttagaaaaggagtgtgcaactaaggattaaacaaatatttgtgagtcagattatttttttcattgtttggcactgatatattgttgaaatgtattagaatatttttacaagtgactctttcacagtagaattgagaatgcaaaagaggaagtagaaggaaagaaagcaactggaaaaaaatcttaaaaacttgagattattacagagaaaaatcgtcctgtgacttcttctgaagataaagtggtagaataaagttagaaatttaaatcttagattaaggcaatattaagtgtttttatagatcagaataagatgccaagatagagtttaaagtccctttctggaaatctcttagaagtgaaaaagattattatgcacctaattgaggtataattttgcctgagatgtaaaagatcaactaaataacctctcaaggtccttttgttccaatctttcaataattatttaaatgaaatcaagaattaaatgcttgctttgacttgcaatatcttagtgcactgacctgggctttgtaacttaatatctatgagtactaatctattttaactagatgggaacaggaaaaatgaattgcaaaacatggtaatgagatcaaagatctcaatatatcttgcttggttccaagacccagaggtcaaaatcttatctcaagagaagtgaagtggaggaggatgaaaaggaggagcatcattcagagttgagcttttagtacatgctgtggataacaaagcgaacttaattttactgtgtgtgtgatgagaatatactttagttgaaaaatttccttcctatgggtggttgtaattgaacgaagttacatttcatctgaattaatgacctaacagtagccgctgtttctaattataaaaatcac

SEQ ID NO: 28682 - DNA, 723 bp, Bovine  19866881026330
taagtacatattggaatcatgtctctaaagcctaatttcaccatgaagccagagttattagaagcatatctttcctgcaaggaaaatttaaaatttataaacatactggataatggtcttggtggctcagcagcaacaaatacataatttagtatttgggcttattctgattgccctacacacatcaattatcttcactcccagactgtatattaggttgacaggcagtattcaaatttaggtctgtagtcaccgttccactttctcatcacaaggattattacagatatgtcaagtatattgggaaaattagaaacgtatctaagaatattcataattaaatgtttaaaaatttactgaagatgatataattttaacagcaaaagggacattctgcagtgtttctatcatgtatgaatattgtttcaaattaaaataatcggattatatatatatcaaaatttctttttaaagtttgaagaaaactaattgggattatgtggtttaaaagaggagacttgaatactatttacatattaagagagaatctaaaggtctttgagggttttactttgagaatatgaattaagaaagatgtgaatatttcactggactgaaaatataacccatttctcagctaggactccgtacaaaatctgtgaggcactgattttgatctgctcagtccttatgatattttctctagtcacatatttctatatt

SEQ ID NO: 28683 - DNA, 738 bp, Bovine  19866881081496
agagaatcgtgaaagtactataagatatataggtacctaatattatgctgaaaaatatagttgaaatatagtattctcttaaagtacaaggcttaccatttgaggtaaattacctaggaggacaactttcagaaaatgatagtttgccaagataattatttcaaatatacaaacagtttatttccaagagggagcatgttttattctccttgactctgctgtgggattaggatctccatctaacatttattgaacatcaccacatacccagaactataataaaaccttgatttaactggagcccaattattcagaaatataagttactcaaatgtttttctcttgtattcaacatttatgcaccagttatctgaaccataattgaaatgaaaggcattttaaacaattgcataggggattctactgtgaagccagagttgagaataactggtcagattcataaggtttcaaccttagccacatatggaattacctggaaagcatggattattgatgccttgatcttaaccccagatatcctgctcgatgctacctgatcattgggtcatttaatagattcaggtgatttcaacatgcagttaagattctgagggtttcttcagtctaatatatatgaattaataaccaatatgaatagtctatattacttagaagggtgaggaaacaaacaataaaaatacttttcataagagcacccactatgtactgctgctgctg

SEQ ID NO: 28684 - DNA, 776 bp, Bovine  19866881084066
ttttaatacctgagcaaatgttcaatgtgaaccgatggcttttatttccccttagggaagttctatcctttaaagtgtttccattttagaatatcaaaacaattttcattatataattcttcttgaaaatgaacaagaaaatataaagtttagacccagatttatccttgaagttccataaaaatattaacctgtatttctaccatgaaaaagaaaaacaatatttaacttcctcttcaccagaacagaggcaaactaaatacttattttctgctgcattagtgtaaagtgatgcttttatttgttcttcttggacacaattattccaggtcaattctgagaagagtgtttagggccaggtttacaatttatatcaaatttaataaaaaattaaagttgttcaggtatgcattagtttttataattttgcttatctaaccaatgttaaatacacattctggaaacacaacagaatgcaattttggaagcaaatagataatacatttgatatttattcaaatctgagttaagtcaaagtttaatgaatttatagagttctccatttgtgttttatttagcttgcagacagattctgataacaaataattcttttcttagagtcagtttgtgattaaccaacttcttttttcacactaagatctcaccttgctaaaaaaatgttttattaaagaggtttgcataagaatacattgtttactctaccggttctaaaatgcacgtcccataccctacttaattttgcctaagaaaggagt

SEQ ID NO: 28685 - DNA, 1361 bp, Bovine  19866881448396
acaaaaaaatcacagatccagaacaaataaaattcaatctcttagcttacatttataggctttgtctgaaccatattttttttgctattttttcataattatttctttccaagcaacaaacagatcttcctatgtcttgtgatttatttgtaatattgtgctcatgcaaaagtaatacttgttttattgcgttaacatttaaatagttttggatttgggtcccaaaactatcatctaacattttacttgatgttgcttcatccatattgtcactttatttggagtgatatgatgatttgtttttggtgagttacaaaatgacaaacatagccagttgaccacagttcaaaaatcaagattttaagcttcttgatcatgcacattttactttcattcttgcaaaattttttgaatcaggaacaccatttgactcaatatttattagtttttttttttttttaatatttctaaaaacaacaacaacagaaagaatgaaagaaaatactgtcccacatccactgttcacgaaaaggaagagcagcaagaatcacactgaccattgttagtacagtcaggtggtgacaccggtaaacactgaaggtcattgaatactgcaggaatgtgatcgttactataacccatacttctgtaacagttcagattgccactggcgtttgcgctctggaaaataatctggaatgtggatttttttaaaatcctgaatacactttttcatttcttcttccacacttagcttctcacagactttctttttggaaagattggtttcccgggacttgctgatgagcgtctgaaagagttcactgtttctacgtttgtctggtgggggcatccattgcacaggtgcttttttggaaggacgatccaaagttaaagtgttaggttggtgagctgtcgcctgctgggcactgggtgggttgtcctggggagtgctcgcctctgagtggctgtcgcaactggaagtggagagctcattacaggaagtcccactctcacttcctttatccgtgactttgtcatgtttcctatcttcgtgttcttgtttaggtgacactattttctgaggtggtcctaaaaaggagaaaagaagtagaaaaactgagtaagaagtgggaaggtcaaattaaataagctttatatatattttattttcaaccacaaacatttaagaaaaatgtggtctgctaccctaatttatatttgaggaattaaatccaacacctggtgtagttaatgcacactgaagcatgcaatgtgctgattaattattgataacaattaaatttgaggggtttgcttgatgagcatttatcccataacagatcatctataacttcatg

SEQ ID NO: 28686 - DNA, 863 bp, Bovine  19866882081875
atataagtaaagcatgcaacattactgcttttcccactcctacactatactttggtgagggtacccaactcacacctaactcaggtttagggcacttaggggctttagaaacatatatacatatgtgtatatatatatatgatttaaagatagatttgcattcttactttataaatattgacattaaaatttttgcacatctcaaatatgagggttcttttctctaacataggcattttgacattctggcagggtctgtgataaaaactgtgaattgccagatggataaatatgtaacatcttgactgacagattatctttactatgtagataaaatttaacactgaaagtgggaacaagatgcttctgatttcctattgatctacaaaaacaattagtgaaatcaaattgtacaatatttgtatagatcagaagagatctgaaaaagtcattataatgcttatgggagatttcaattacctaaatattgtctgtgtaacaggcagaaaatttaagagtgtgcttcttagagaaaatttcattcattcgtaattcaatttgatgaacaactattctgacagaatagaaagaatcattttgttatatattgtgagactctcagccaggaattattgataaataaatacgaaaccaggatctttaactgcatgataataaccatgatacagttgacacacacacacacatgcacagacaaatgttacaaacctgtagattataaagtgctgcatcattttctctggttcttacaataaatttcctgcccaagaaagactatattcaactaatgtctgtagttaatcttctttctctatgtttcctaattttgggtgagatataat

SEQ ID NO: 28687 - DNA, 1152 bp, Bovine  19866882202769
actaacatgctgtcagagagatgcaggaaacataggcttagccttcctctgattccattattttgaccccatctggtcctactggccacaatctatttagcagtaatgttcagtacctatgcatattcataagaagagggtttattcccctaattcagaagtttctagatatagatatctcagtcttagcaagggatttaattcttcattactccatagacaccgatttctcttccttcccctttctctctgtcttcttctttcactccattgttttataaaactggctttcttgttttgcaagaaactggtacctgaggttgtaagcaactctcttgtgtttttattttcttattacatggttcatggagcagaaaaaagagaagtctgaaaataaaagaattttagaaggtcctgtcctaaggtgaaatttaattcaatttattgaattgatattcagtttaattatttgaacaccagttataaaatgaagcctagaaaaaatatttctggtaaattcatcttttgctttgactgatggtggtggtgggggcagggagatccattgctaaggtactcacagtttattctccactcatgatatgttgaacattacacagactttactaattatgttatcactgcctattagaattctatgttcctaggcaatgaattgtaaaagctggtaaaaaaaaaaaaattatttaaatgcggagagagaaaggacaataatatagcattatagtgaggctagaacaaagaaaatcaaggtatcattttacattgtaggatgatagtcacaaagtcagaaacagaagagtgagggtgaaatcaggaaaacatagaaagctctagaaaaaaaataaattgctgagaaaagacaatacaacagaggaaatgcaaaaggaaaaaagaaaataatgttaaggcaaaagagaaaagtttaagaaggagaatgagaagagtcaaaaaaaaaaagagaaaagaacaaaaagtggaacaaaagtagagaggaaaaataagaaggagaaaagaaggaaagaacagatgaaatactgaatgtatcagatcaaatgtgctttaactggatacaaatggaaagaatgatataatatccaatcttttttattttatataaagagaattata

SEQ ID NO: 28688 - DNA, 1708 bp, Bovine  19866880351222
aatgatacaggaaagatgcccagagctggaagagtaccatcgagaggggctgactttgcactgacaagcatctttccctgctgaaaagatagttaatctgaaacgtgaaggataaggaagcagcctctgggtggaagaggaaggggcattccaggcagatgccaaggccctacagttgagtgtgtgctttcggggagttgaaagtattttgacctagaggacaaagagaagtggatgtgtgtggtaaggctctcagttccttctcttgtaatatcccaagctgcctttctagtttggctttcattcacccctttattcattcaggaattcaacaaatgaatgtcattatcctgtggcaggcacagtgttaggtatggatacaacagtgaatacatccacagactctggtcccaaagatgtcacaggaaaagagaaaaggatgcccgggggctatggggtcacagagggaaagctttcatcttggccatgaattaccaggatgaggatgagaagaaagagaatttcaagccaaagaaaacatatgtacacaggttcagaggcaaaggaaagcttggcaaggcaagaaaccttgagaactcatggaggcttccagagtagattgtgaaggtctgattggatgaaatgaagggaaaagaagcaggcagtaaccagtccttaaagggttctttaggctgtattgaggatcttagatttttcccccctgatagtcacagggagccactcaagaaatttaagcagggaattggtatgaccacatctgtactttaaaatgatcatattcatgtcaacatggagcatggatgattggctaagaagctactgcagagacattgctgagggaaaataagggcccaagttaaactagtagcagagtgaatcagtaaatggggacaggctttgtggccattaggaaggggaagtttataggacctggcatctgactagatgtacaatagaaggaaaagtgttaaaaatgtctttggttaaggatggtttctgttttgggcagctatgtggacagtgggcagcactcaaaagatagaaaacacagaaaaaagagtttcttaatctctgtgtttcttgatctgtaaagtagacattattttaatcatcttgtagggttgcctgtactacactaagaactaaatccctggcacagagatgttcaattaatagcagcaattatttctatggacaaagttgcatagaagcagttagccactggtaataggagacaaagtggttaccaagtatgtcaatgaagacatggcagggctattgggccaagcttgaaatgatgagtaacgaattcccacggcataaatggagggatgggtgacaggaaacattcttgggagagatcacaacaggcacagagctcagagttcttcaagaaacttagaaatggcccactgttcctggagcataggagttgtggaggagacagcagacaatgagctagaaatctagggcttctgaaagctctataaaccaagatgaatagtctgtcatctaccccagtgtttgctgaagtttttctgcagaatataaatttcctgtagaatgttaatagggtcaaattaatatggaaaattctggtttaaacaaaattaactttattgcctttttaatactgttcatattatagcaccactgatttaatggacatgaacttgggcaaactggg

SEQ ID NO: 28689 - DNA, 1709 bp, Bovine  19866880351517
tcatcaacacatttttatcatcttctctatattttctctacaactgaatatttaattgggttttttttggccactctctgcacagcatgcgggatcctaatttccaaaccagggatggaccccaagctcctgctgtggaagcatgtagtctgaaccaatggaccaccggggaaattactaaaaatttaatttctaaaattctaatgctaaataaatattttataagcattgaaaaagcattctgaaagtgttcatctcccaaacatcctctgcatcctacacagaatcaaagaaaggttaagatggagtgaagacattctctcaaatgcatttataaatccttgcagctcttttttttcttaacggaaaaattcctttgtggctcatattagattttagctacaagacaaggtaccttttacatttttattactagccaatcagttctgtaattcagagtataagatcagcaaattataattaaaaagtttccagtgattaatacaatttggtactcctgacagaaaaatctcccacattaaggctgcaaaaagttttaaagaagatatataatcaaatagccttgttctaataattcctgggaccacacagaaccccaagaaaactgaaggtcctttagttaattatgatgaactgagatctaaaggcaaagtgaaaaatgttaaaaacctcatgagacaccctcaaagcactccacgtatcttcaaaaatgtcaataggagggaagagttttcaagaaatcattatacacagtcattccatacaacaggggcagaggggaaaaaacacatgttcatccatgatcagcaaaaaaccacgttttgttttgttttagaaaaaaattaacctagcttttcttgtaacatataactgattagaaaacattcaagtagatactgttcctatctgctggattaaaaactagttcaaggaactgcatgaccttagttactgaggcacagaaagtaaatacaaaggacaccggagatgacagacacataggaggcctaatcatctaggggcactagggacaaaccaaaggagcacagaaacagaaaacaaaaccacctgggagctttaatgggaatctgtgagagcagatcaggataccaggtcacctcttaggttggccagtttatggtacaaaagatcagaggtggatggccatctgtagcaaagcttacctgggaccagaggggtggggctggagactgaggtatggtacccaatggaggatcccatgaggtttcgaggtggcaccaaacgagctgccaacagaggaggcggtgtccccaactgaagtcgctcagatgcagcagcaccatgttcacgagagtacatgggctgtcctacagaggaaagaacaggagggcagctgggattgagagtcacaagcttctctaagtaatgatctacttcctgagacttgagccaagaacagagaaagtacaccaatgggaatagtacttgagaaagatgctattaatattctttctaactcaagaaagagacatgcaactgggtaggatgcactgaggtataaagaaagggtacgaattaggtagtgtgactgcataatgtccgttttttatcatcttaaatggaataactacatgctgatcttaccagaaactgatcaactatatcaagttattgacaaaggagcccctgagctattattcgtgtag

SEQ ID NO: 28690 - DNA, 650 bp, Bovine  19866880418271
atataccaacacagccaaaaataaataaatttctaagcatccaactgtagtcacttaaagtcttctggctgagcctctgtcatttggctaatgttcccacacatcagtgcagagaaacctgtgaccctcctgaccccaggaacagttttctgagcctgttgtgttagatttctgcccggagcacttggccataacaaagtggagagggaaaaatcaatacaaccggaaccgaatgcacacttaaaacatcagccttcaactgtgcaatcatgtccttgtcactaacatccaagtgcttttgctccatgatctgctcagagtcttataagtaaacacgaaggaggaaatggaaacggctccagggcatgggagagaaaagtgctgttacaaacagggacacacacagtgacagcttcccagggtggaggggtggcaagaacacagcttgtttgactgtccaccgtggatccttcagaagttcctcaccctctttgagccttagttatctcatctggaaagcataagcactaacacagttaaggttgtttggcaaggtcagtggacatcaatgcctgtaaagtgaccagacacagcctggctctcgaacagtgttcaataaatggtagcttattaaccagctttttctgttg

SEQ ID NO: 28691 - DNA, 1031 bp, Bovine  19866880484151
atggaaaaggacagttagaagcaaagtggagaatttcacactacttacctgaatcaatcgggcatataaagaaaatcctgaaatgatgatattaaagtaagatttcagatttgagttattcaggggtaattgccttagttttccagctcactgtttccccttcgctttccttacatggacacaatcttcagaatggacctctgtcaaaggccacagtcataattcccccgcctccttttttattttttttttaactcatttgcactctgggtagtgattgttggagccctgtgggggaataattgaagaggaattaacctctgacatttttctaaaaatagccctaataaatccaatcataggtaatttacctgtccatgttcctccagggataaccagtattgaagaaaggcttggcaggctggcattccttcagcaattatctgtgatctgagttcctggcgcctgtgtattttctctgtttagagatatacagtacaaatttccctctccgctctgacctcgtgaccctgttttctcagcacctttctccttgcagtaaagccctgctcttccagaagggtgtggtgggcttaccagaaaagggggagcatttccagggttcctttttgaatttccaactcctggagtttccctgatagtttctttgagttgtgtcccttcatttttgatgtctgagcttcaagcatctcaaccctgctcatcagccttcagtcctcgtttagattccacagctgaaccccatttggggaagtttcttggtgtagaagaaagggggatgcagaaggccatgggtgggaaaagagtctgtggttggtagaaattatcaaagaaaattgccatttccctgagccataaggaaattcattttctattgcccaaaacaaaagaatctgaatgtgctttttccttttgttctctccagttgttcctagagaccacagtgcagtgtgggcatctaggaaatttacttccccaagtgccacttctagggcacttcaaatacagga

SEQ ID NO: 28692 - DNA, 1673 bp, Bovine  19866880497558
tccaatgatgacaggtggacatgcaccagatttgaaggataaacttgggataacctcacttaaaatgtaggctctctggcatactcagaattcacttaggggattccctgaggacacttcaaagaaccagacaatttctagtgtggttgagactgcggtacaaggagagactgaggagagacaagtcatacctactcagatgtgtacagataaaaaggcatctttttatctattcttgtgaaatgatccctaagatgtatatttagcaaaagaatatatatatatatatatgtaaaatgtaatgtgtacatatctatatatatctgtatgcctagacttagaatttatctggaagtctatataagaactgcccacaatggttgtgtcctgacaggtaactgggtggccagggggatttacttttttacttcctctcccttcttactgtgggaattttggatcacgtacacttattactccagataagtaaattaaataattaattataaatattaagttctaagagaaaaaagagatgttgacagagaattttctgtcagtgagacagtgtttttcaagtatgaagccttgagggctggtctctgaattgcaaggattgattagcagtcgaggtgcttggcacccgagtaaccccagtggaattgtgtccatgggcaatgacttcagggtggtggtggatcttgggagcattggatgggatggaccatgaggtaatactgtggaggtccccaggtagtggaactgagcctgtgtgacggcaccagaacacacacggtttctcccctagggtaccctgtgtgaggactggctggcagtatattgttgctggccttgctccatctgccaggtggcccgggaactcaaggtgagaacctcccaactctacgaaatctatacggccccttcgaccagagaaactattatttgacagagcaagaaaactcctccttcctcacttccccacaccctcctcttaaatccctcttggtggagagattgttcttaaggtttccctgaagtagtatgaaaataaatggtttcccactactgtgtttactgttgtcctttcttcacacataccccctgatgaaaacgcttattggtctgaagttgctgtcccagctcggccatgctaggcaggttagagaggtaagctttgtgccctccacaccctgcgtggagttgggaaggttgaattccaccccccatcttcccctttcacaagggatgtctgggaagctggaagaattgttatatggctttcttatgctaagcctcttttcccaaagtatcgatgatggggcagaagatggttaattaaattttaacgttttattttcttatttttaaatttttattggagtatggttgatttacaatgctgtgttagtttcaggtgtacagcaaagtgaatcacataggacctggactgggccctaaacaccactgtaatataggagcattgtccttcctttgtcctgactccttcaatcctgactgcataaaggagagagcctcagcttgttgctgactttgaacaactccccagcacatgtaaatctttagccccagactcaaggccttaggtgggcagctgttgaattgtgcccctcccccaaccccttcctaccaaagatatgtttaagtcctaa

SEQ ID NO: 28693 - DNA, 1083 bp, Bovine  19866880522526
tcaaagaataattttattacagtgttttaagttctgtgttattagtacgaagcatagctcttaaaatacaaagtaggccattaaatgattttattcctggaggaagagggatcatgtcctctttctacatctaacatccagcacagtgcctagaatagcctaaagtcctacaaaaagagcaattagtcaacattagtattacttttacttaaaaataaatatattctgcttaaagctttaaagtaatatttggatatagatattcaaaaacatttatgagagatcattacataatatccttcagagataaagaatttttagacctcagtgaggtcagaaatgccatgcccaaatgacatttagtatgacaaaaagttaaaggcagtatcacctcttggatttgcatccatatctccagatgttaggccaatcaagtttgggcgctgtgtctgcgttcttgaaaaaaactgtctatattgagatctaccagaactggtaatactaggagcttctggattataaccatcaggttcataggtatctgagggaaaacaaaacaacagaacacgtaaaaatcaagagtaaacaatttattataaaataaccacaaaaatgtattttcttcaacaaataaaattatatcaacccacatgtatttctctttgaattaagagtaaatccagtcacaaaatacagacatgcaaatccattctgaattatggatatgtttctggattcatttacctaatgtcatttttgtcctctataataatcacataattaaaacttcactgcacatttttaatagaaatgttcacatatacaaacaccatatacaaaagactgagtttcctctgtactcatgtctcaccactttctaggtattcttttaattaaaagagaaacaataaatctattaacttggttatctgcatttttttttttggccacactacacagcatgtggactcttagttccccaactgggatcaaacccatacccactgcataaggagtgcagaaatcgtaaccagggacagctggggaagtcccggctattgcactttaaactagagaaaagag

SEQ ID NO: 28694 - DNA, 849 bp, Bovine  19866880574742
atcaggatgctgagatgcacggagctcaagtcactcacccaaggtcaggtagccagggggtggcagagcctaaataccagttcaagcaccctcctatttatcatgctacgctgccttccagtcatactgagagtgctttaattttgtgtgtaaacggcatgagatcctctctgtaggaaggtcaggaatgaacaaacaaacaaacgaatcatgagtgatggcttcccttgggatcagccctcacgcttgtcccaccccagccccctcaggatgcagcctctcccagatgccactggtctggagtctctaactgctctgaataagtcaaaccgcacatgatcaacctcactgcaatagattgtggggctacatttgttttctccatccttctctctgtcaatacgttacagccatctcagacacgatggtttccctttccataagcatacagggcacagatctggatagtcagagcacaaatgtgttggcacagagaaagaaatcaaagatattactagaaaatggttagaccctcggcaggctcatgaaagtttaaaaatcagagtaaacacgaggctctctaattagatagccctctttctcctgcccagcatttctacccgattcccatttctcctagaaatagatcttcaggaaggcaagcatctttttaaaattctgtgctacagagagccagactaagatggttctgttgaaattacaaaacactatactttcaaatagctgctgaattatttagtgactttacactgtccaaatgcggggctctttgggtagacaatgtcttggtttccctcctatttctttgttatgacattcagtaaatgg

SEQ ID NO: 28695 - DNA, 1184 bp, Bovine  19866880581394
tttaaccattcagcaagtattgattgagcaactgaaaatgtcattcataccatatgagttggcatatgatagcatccaaatgaaaatgtatataaagcattattaatatcaattatgaaggggaggggagaagtgagcaaaaaaaaaaaaaagacaatttaaaaaagttcagcacattgatgataggacaagtatataagtgtaattcctcccatataaatttctttgtgaactgtgagagttcagtgaacagaatagttatcaaaataccaatgatgtttatctatggctaatggaacttttatttttactatttatcttgtctaatgtatgacagttttcaatacttatatgcattgtttacacactaaaaattataaagctgtcattgtgaaaaataattcatagagtgtctattatgtgtgaggactaagtctctggctatcaatgtactaaatattcacccaagttctaactattttcttggaagtcccatttgtaactcttcaaatgaaaattgatttgaagagtagtgaaaagtggacactctccaattctgtaacaagaattccattaaagttctcttacctgtaggttcaagtgaaagggctttgggaatgaacttggctcttaggtttagagctcctttggtcttgggtcttggcttaaacagtaagggtaagatgatacttgtgagctcaacctatcatttcataaggggcctggagaagggtcttggaggaatcagtgaaaatcaattgcaatgatggaaaagtcatcgaagaaaaaatgtcttaaatcctgtgggttggagccagcgcctctgtacataaagggtctcaccgtctgtgtttattgacacagaacgtacttttaattaccctgaaggaatttctggcatgttttgcctaagccagtcttaaaatctttaatcagtagtttcatgacaaccaggcccactggcaatggggacacctgggggcagctggtcaagggtagtgtattgcagagtggctattagtgacagagcaaaagtatgctttatcagagagacagaagcaggaaaatgagatggccttgactttgaaaagtttggcatgtcttgtgtctgagaagcctgggtttccttcccagttattgaccatgatctaagcaacctccataacctctattttttgtatatt

SEQ ID NO: 28696 - DNA, 2486 bp, Bovine  19866880596711
actgtcttctcatcccttgacagcttcagcaaccagtcaggtcagttttcccacactgtcactctacagagatgtttcagtctctggccagccagaacagtgttctagttaggggatggcctctggagctaggttgactgggtttgaataccagctctatgatttcctggtagtatgactcagggaaatttcttaacctcatgtcccatttttttctcatatataaggtagagttgtttggagcataatgctttaaaaatgatgactggtacaggctcgataaattttagccaatttatgcattgtccaatatatcaaaactgtgaaacttacatggtccaatagatggggttttggtagcactgaagcctaatataggtagcatttaactcacacaggtgtactttctttcaattctcttttcctctttcaaggacaaagtcttcgttagtttctagtatgtccattaccacctcttttacattcactaacagaaatggtatgaatagtttgaaaaaccccaatccagtccattagcactcttctgcagtcacacaatttgctacatggtctccatgatcaattctgtaacctcttaaatgaagagcttattcatacctatccaaaatagcctggatttgtggttttctctagcagagagggctcaagagagtgagtattgatctcgaaacacctttctgaggctgattcccaggttaataagtcttgctgaatattactagtttgcacctaggcacatctttaccaacatattaaattagcctttttaatttccctccaagctcagctccctctcttctctcccctggtttggtaaatggtgccacagttttggtggataagtttcatattttagcttatcaggagtggtttcctggaaggtaagatcttacaatctaagaagagtagaatggaggtcagttactattttctgccctgggtacacagtgagcagagttgatcaactcttcagttacaatgaaagtggacatttagtcccttttctttgactttattcattcctccattacatctccttgggcttacatgtcttcattttcccaccagttcaatttctactcctcctgaagatgcaacaaaagccctatctttctttttctaaagactttgttttagagctgttttaagtttatagcaacccttagagaaaagtgcagagatttcctgtataccttctgtccccacatgtgcataacctcctcccttattaatgtcacttaccagaatggtagaattttcaccgagatgaacctctgttgacataataatcacttgaagcctacagtttactttagggttcactcttggtactgtatgttctatggggttggacaaatgtgtaatgccatgtatccatctttatatcctacagagtagctttaccgccctaaaagcccactgtgctctcacacaccctgtctcccctgcaaccactattgtgttttattgtctcaataattttgctttttttcccagagctctgccttttttaagtagttagaattatatagtatgattttctttcatttttaatttatttggctgtgctgggtcttggttgtggaatgttggatatttagttgtggtgtgacaagtgggatctagttccctgaccaggaatcaaacccaggttccctgcattggaagtcttaaccactggaccactagagaagtccctatagtttgattttcaaagaggtagccttttcaggttgacttctttcacttactaatatgcatgtaagatttttccacatctttttatggcctggtaactcattctttttagtgctaaatagtatttcattgtctgaataaacagcagtttatccattcacctactgaaggatatcttggttgctttcaagtgttggcagtcgagtgaagcagctataaacatccatgtggattttgtatggatacaagttttcagctcctctgggtgaataccaaggtgcatgattactggatcatagttttgtaaggaactgtcttcctgggaagctcttccaagtggctgtagcattctgcatcccctctaacagtgctcctgtctgtccacatcctcttcagcatctggtggtgtcagtgttctggattttggccaaactgataggtgtgtggtgaatcctattttcctgacccagataatgagtcttagtcattttagtttcccacacaatgttgagtccataataattgctaaataaatatttgctgaatgaatggaagactttgccttcttttatgtaggttgttgcattgaacagcctatatgtttttctgaactacttacaaaattgtcttcaaaactaaaccgggcactatggagggcaggaatcaaccagaccttactctcacttgtttaatactcattgccttgttcacaaacattcaatttgagaattttgtccttcaggttgtggcacgccaggtctagggaa

SEQ ID NO: 28697 - DNA, 1778 bp, Bovine  19866880629856
ctgcttgaggccccagtagtgggagggtggggttccttttggaagcttgattgagctaaggtgaaaggtgaggctataattcagatatactagtgaaatgcaaacagtttcatgtattaatggtcactaatgacctgtaatcaagctatgatttgttaggttaaagatgcaattagtttatttgttcaggggtgtaaatggaagaatttatcaatctgctgattgttcttctccattggaaacggtggacaggagcatagtctggagctgtgggacctcggggtgccactctctgttgctgagattctcccagctccagcccctcttagatctaccatctttgtcaaatgggatgaagagagtactcttctggcaccctctctctgtgacttttcctcttgctaagcaagcccctgcagtagtcatttttctctttttggctctgctctggtcctaagcttctactagctgattttctcgaagtactactatttgttcaaacatgtaacgcataaatattgagagccagttatgttccaaacactgccctaagccttaaggtttgtaatgattttcaagagagtcttgtctcaacctttgcaaaatttacaatctctgtgtaggtatctttaaaattttctgtgacagtaactactccctgcagtgcttatcaccaaaacccctcagtgaaaactctcttggtatgaaacagatgctctgttgagataggcatctttgagaacaaggcactttgatcttttgggggtacatcaaaattggcactagagattttaagggattagaatgactccttagaaaagatagacctggtatcttccctagtctttcatttaacccaaggaagtaaatacatataaatccttatgggagaccatgacattaaaatgtaaaatcctttcatccttaatcaggtgaaaacactgtgttctacttgacgtgcaaccacagagcaacaatgatgcaggttatcctggcgaggcactggctcacttgagagcatgctgaggcagtgggaatgatcacgctcccatagcacatgacttctttttaatttttattgcagtatagttgctttacaatgctgtgttagtttctaccatacagcaaatcagtcagtcatacatatacgtatagcccctccttttgtattttcttcctactcaggtcaccacagtgcttgcagtagagttccctgtgctgtacaatatgtactcattcattttcgattttatacatagtatcaatagtgtatatgtgtgaattccaatgtcccaattcatcccacctcccttttcccctttgtatccatgcatttgttctctatgtctctatttctgctttgcaaaaaggattacctatgccattttctagattccacatatatccattaatatatgttatttgtttttctgttcgtgacttacttcactgagtatgacactgtccaggtccatccacgtctctacaaatgatccagtttcactcctttatgtggctgagtaatagtccattgtatatatggaccacatcttcttttatccattcctctgttgatggacatttaggttgtttccatgtcctggctgttgtgaatagtgctcatgtgagcattgggccatagcacatgacttctttgctcatcaaaactaatcacattcacttgcaatttactcatcccaaaggactatcaatctcctcccctcaaaggtgcgaacttgtgtctctcactcagcatttatcctagaatgctaaaacag

SEQ ID NO: 28698 - DNA, 757 bp, Bovine  19866880630450
catcctagatagaaccatcactttcaggctttcgacccgactctgccactgattcctggtcaccaactcctttctctattctcagctagtttccccaatgtcaaaatactgatgtgacctcagtgagtgacttggagcttcagagcacgctatggaggagtgaggagatggagggggcagggatttgggcccctccgctgcaacttcaaacaaggttccaccatttccatctgccttacatagtgaggtttcaattcttaaaggatgtttagtgctaaccactgggttaggactctgagttttcctctcccttcaccctttgctggttccactgggcacactcaccagcatccttcaccagttccctgtgtttccccaggtttgtagctctgcactcctactcagcccatggacccgatgaactggacctacagaagggagagggcgtcagggtcctgggcaagtaccaggatggctggctcaggggcgtctccttggtgaccgggcgagttggcatcttccccaacaactatgtcatccccattttcaggtgcgtcctctccaatctcaggcatcagagggttggatcatctaggccagagtccatctctgagttgaatggctgaaagactcaatcctttcagagtgtgggccaagaaacaatttttgcttcactatcctcctaatgcttaattaaaaaaaaaaaaagtaaaatggttatcttttaaatagctcttcacattttacaagtattgat

SEQ ID NO: 28699 - DNA, 5501 bp, Bovine  19866880637762
tgtgaatgaagagtgagtcttcctactggacaggatgactctgctactgaggccaacagagggccagagcctctgaaatgacagaagcttcagcaatcaactcccaatgacatttaaaaaattttaattggaggataatagctttacaacattgtgttggtttctgccatacattaacatgagtcagccctaggtttacatatgtctccttcctcttgaaactccctctcacctctcaccccatcccacccctttaggttgcccaatgacagacatttaactgcttgagcagctctggggaaaaatatctccctaggagtcacaatgaacatttccatttcagaggctctgaaagatctagcagttaaaaattggttccaaatttgtggtagccacaaacattttggggggctgaaacagagcttcattccttccttcttaccatctccaacgtcactccctaggtcaggtcaacctcatctctcacccaagtccatgatcatggtctccaaatctgacctcttcatgctattcctgctaactttccatcctttcttctctcaacagatagtgctctccttaaagtatgaatgacagctccttccttctctgcttagaatccttgctggtgtttcactgtgttaaggtgaaattcaaccttcccccatggtctctaagctcaacatcatctggtgctaaaaccagcccctctgacatcagctttcatcattctcttcctcagtaccttccagccccagtggcctcctcccagctcctaaatgagggaagcctttcctgtttctggacatatgctcttgcttcagcctgaaatactgtttctgagactttatatgcctctccctccccatccttcagatctcattttagctatcttctctttagacaaagcttttgtagccacctgctgctgctaagtcgcttcagtcatgtccaactctgtgtgaccccagagacgacagcccaccaggctcccctgtccctgggattctccaggcaagaacactggagtgggttgccatttccttctccaatgcatgaaagtgaaaagtgaaagtgaagtcgctcagttatgttcgactcctagcgaccccatggactgcagcctaccaggctcctccatccatgggattttccaggcaagagtactggagtggggtacccgtcaaaaacacaagctcctgtgccctgccccagacctgctgaatcaggaattcggatggaaaagagaggtagctatgtgtgtattaacaagcctccaggggatgctgatacaggctaaagtttgcactattctatgatagtatcctgtttatttcctgtgtgtttatcacaaactttaattatttcttctttgtttatttaacctgtattgtctaactcccttactagactcactgtgtggataggagaattgtagtccaggaccataacggaagttaattactatttcctgacatggaacacaccttgcgtaatattgctttaaataggatatggattagtttatggataaacttcaagtgccatgagccacatgccaccaatttttctcttttctctccattcaattatttaatattcctttacatctcttacaggtcaggcactatttcagacaatataaacacaaacacgagcaagttcttgttctgaaagaaattacaggtaagtgagattgaaaaataggtacatacatgactttcattctggcaggtgctacaataaaacctagtaaaactcatcaaaatcattagaaatacatatgcacttgtcttctgactttgttataccggttgtaaaagttaactctgtgaaaataatcaagtatgtatacacagatttatcaaaaggacatttaccatagcattatgaattatagtaaaaaaaactcaggagcaacttagatgtataagtatggagaataattttttaattatcctaagcatcagataaaatactgaaaacatttatgacatatgaaattgttcataatatattgttaagtagttgcattacactgttaatgatatataaacatagttttatacagtatgttggtgttgttttttagtcactaagtcatgtctgactctttgcgaccccatggactgtagcctgccaggcttctctgtccatggaattctccaggcaagaatactggagtgggttgccattttcttccccagggaatcttctcaacccagggatcgaacccgtgtctcctgtattggcaagtggatttctttacccctgagccaaagaaagccctaatatagtatgtacactatatatttatatctgtatacaaatacattgaaatatatatctttgtatagaaatatatttaatatattgaacatagaaacaagtatattggaaaggtgcataccaaaaaattaatagaagttcctaggtggtgtggtaacaggcaatttaattttcctccttctgtgtttctttatatttccaaatttcctacagtgtaccattacagagaaaaatgccaagggccacgggccagactagaagaagcaagtaaacctgctgtgtggaccggagggtataaacacagaggaggtgtcatttgagcggtgacctgagaatgcatggggcctggtgtcaggaagcggtgacagcacaagcgggactcagagagcagaatgtatttggggggcaggaactagctcagtgaggcaggagcagtcgtacaggggacttgcagctctccagaaaggtcagcctacagggagtgacttgtttgtttacctccacacaagaaggcaaagccccatatggacggagacattctttattaatcaaaatcagagtctacttacgcatggtgggccagccaagctccacaaggctctctgcattgtgaaagccacagacagctttccctttctggaaacgataatacaaataaatagaaattgtactgagatttcactccagctgaattattctgagatagcatcagatggaggagaacattcaaaaatattctcctatcttagacctcaagctcccagtgccagaattctagagacaggcctaatcccgtggtctggccatcgtcaatagccaagatgactgaaaaagcaggaaaacacctttttgacgttcattcatcactcagcaccaatacagaaatttcaaaggccatgataagtggcttgacaacctggagacagatgataaggtctcagcttctgatcactaaacacaataaattcattgtgaacaggtgctactaatttttttttaaagacttatcttgtgctgtcaataactgtcaggtcaattacatgagaacctgttgacctgaagcatacttggatttagctaaaattaagtcaaatataaatctggggaaaggtccatgtggtttaaatagaagggattgccctgtagatgatttatagcagaggttacaaacttaaatatcaacagagtagtggcaaatgatcaattttctaccaaatcagttcttctctgttgtcatttggtagaagagaaggaaatctagggatcaacctaaaggaaatcagaatgtgtacatcctttaaaccagaaccccctcttcaaagatgctatgcgcttgtacctgtacatgacagatgacagagagtcattcactggagccgtgcttatagtagaaagttagaaacaactagaaatatacctgtaggaaaggtgttgaattctggaacatccatactataaaatacaatgcaatctttaaaaaggataagatggctctaaatgtactaagaaagaactctaagacctattgctgaacacaaaatacaagttgtggaataattcagtccctaacccagcaaacatttattaatggtttatatgtttgggcttccctggtggctcagaagataaagaatctgcctgcaatgtgggagacccgggtttgatccctggagaaggaagatcccctggagaaggaaatggcaacccactccagtgttcttcctggagaatcccatggacctcggagactggtaggttatagtccttggggtcacaaagagtcagacacgactaagtgactaacactttgactatgtgtcaagctctgttctagacactagataaactaatgaacaacacagacaaagactcttatggaacttaaatgcacacagaatgtatattttaaaatcctaaaactatacattaattagcaatacatatatttatcatttctcaatacagaaaaaaagacataatgatacccacaaaattgctcacagcagtgacctctggtcaggggagtggaggctgaaggtaggaatagtaactgtttggtctctatccttctgtgttgttttcattattattataggaatgcatttacgcatttgaattcctttcaatggaatgcttttcaataatggagccagaaaactaccttgcaaagtcctccttggaacccctcaaggcctatatagagaagacgagtgagacagtcttcttccttcttcaactggcaccttcacttactttatttattcatacccacatgtgagatttcttttgatgcaagatgtctgtggcaacaaagcttaagaacagccaaccttgctcattatcagaaaattagaatacacaaaggagtaaggatgaaacctcatttgggcccaatactagactgatcccatatcatttaaaggtttgactgtctacttcttttattgtgaaggctcctctgcctgtaaaggacatgatatgagcttttcagatgtcaaatagtactcaataaacatcacaaatgagttcagatgtgaaaagcacattttcaaatagaagagtttttgttttattttaaaattgtattagcacctaaaagacccctgtaatagtgaagataaagttaatctagtaatgcatttaccatagcaaacctccagaacagaaacacattacttccctctgatggaattttaaatcagcataagggattatacagtattatccagctgatggacagtgacctggaaaacgcaatgggttatgggaactgaccctcatgggtccgatcatttgtgttgcaggaactctttttggacgttccatgattaatatatctggtatacttctgggaaggtggtatcttttctccctgaacttctcatttcatcttttcaaaaaaatctgcacaaagcagaaccagtcttcatgctcttctttcagactgtggtttacacaatccagcattgaattaaatcagtggaaagggtctccacttctgcatttccttgttcagtgtctggctgaccagggaaacagagtacattctcctttatattagtacacccaccaaaatcacaaattatggcctacctactaaaataaatgctgtctgaagaatacagagtaagtggactgaatgacacgcagagcccaaaggcaatcaaagtctatcccttctttcttttatatccttttcagtttgctctaca

SEQ ID NO: 28700 - DNA, 753 bp, Bovine  19866880651338
aaaaagtcggtatataaatgcttacaattttatagctcattagttttcaagcactttaaaatataatattgtacttgaccctcctaaaacgttagtaattgggtggcatttgcttctttttacacataaggaaactaaggcacagagaataacttaactcagtcaaccaaattacccaactagtaagtggtagagcctaaattggaatccaaatattcaacaagtccatgagtattttcatgactcttgagcttacagtccatttagagatatagaacagttataaagaataatgcaagcaaatgcaaattaatatatctcattacagttaatatctaaaagtacaaagagtaaaaatgagagattttagtgagatagcataatcaaagctttccaggaaattcgagtatgatgaaagtctttccccccccccccccaagtaaacacggagatgtgggtcgcagtactattaagataccgtgtcatttctgaatatgtgtctctcgaggaacctaagaagaaagagctgctttttcagcaccatggacagcacagcaactctctgaagggttgttccatatacagcatgaacaaagtcctgtctgtttgatagcatcagctctctgaagcccaggggagctgacctgaccttgtaatgttcactcagtggggaacataaatttaaaatagcagtggagttgcattaaatgcttattcaggagggttcattagtgtcaataagtatgacacatt

SEQ ID NO: 28701 - DNA, 2335 bp, Bovine  19866880696757
tgtattgattttgtatcctgcaacttaagcaacaaatgtttattgaacatttacgtgcaaaaccctcagtacaaagataaaaaacaaaattctgccttcaagcagctcacatcctaggtaagataagctgtggattgttaaatactaatgtgaaaaatgatgctttctttgggagagaacccaagcaaatggtaagtgaacgggccagaccaagtgtgataggacttcagagaaaagatcatttggtctaaaataatatgtaagtaaaagatgaggcatatgaatcaagcagaatatgacacaagtgaaggaggaaccatcaggacataaaaatgggaaatatccagaggtatggtgtacatccagtttgaactagagaagttcaaaaaaaggttagaaagatgaattaaggcagcttaataagctgcagtgtcttttattcctgtaagtgctttctttagtcctgtaagtgaaagtcagctgaatctatgggaaaagaaaagcagcaactggataccagagcaaatagaaaacacagacaaaagatattgtagccagtttacctgagactgaggctcaggaaagttaaataacttgcccaaggtcacacagctagacaatggtagtctgaccttaagcttaaggcagtctgacagcaaagtcccactattaaacatcatgatccaagagagatgaatacatatgttcacatgaaaacttgtacatgaatattcatagcagcattatatggtatataataatagtataaaatatatgtatagtatggttccattcatgtaaaatttttagaataggcaatttcataaaataagaaaatagtgtttgcctagggctgcagaaattagggaaagggagtaagtgctaatgggtatgaagtagttcagggttttttgtggggggaggagatgatgcaaatgtcctaaatttaggctttgttgatgattgcatggttggtggtattatctttaatataatcacataaactgtaaaatttagatgagtaaattctatggtatatgaattacatcatctcaaaaaagtagaaaaaaaatttaaacatctaagaagactatattttggtatgtagcaatgtacactattgctggtatcacaatgatacccaatgtgaaacagagcttgtgcaagcagtcagctctgtgaacggaacaagtcccgtgagagtccttccatgagaaacatgatatagaaaccagtgacagtttgttctactgccagggagctgacaggtctgcacgcccgattccaaccctaagttagatggttggctttctagctggcccaaacacgttcaaatcagttaataaggaggtactaaatttgttctcttttgctttttgttctgcagtttttgaagagccagaagatccaagcaacaggtcatttttctctgaaattatctcttcaatttcggatgtgaagttcagccacagtgggaggtatatcatgaccagagactatctgaccgtcaaagtctgggatctcaacatggaaaaccgccccatcgagacttaccaggtacagacccccacccatccacacgtacactgggcacttgagggttctgagtcagcctctgcctgcaggggcttacaatgtagagcaaaagacacagtgagccacttcaatatccagaaatagctggtaggcaggtcagtgtaagtttggatagatctaacctaaatgagggaaaaggcatggcaccccactccagtactgttgcctggaaaatcccatggatggaggagcctggtaggctgcagtccatggggtcgctaagagtcagacacgactgagcgacttcactttgacttttcactttcctgcattggagaaggaaatggcaacccactccagtgttcttgcctggcaaaccccagggatgggggaacctggtgggctgcagtccatggggttgcacagagtcggacacgactgaagcgacttagcagcagcagcaacctaaaggaaaggtcagaactaccctgaggccctagggattacaggctgggaagagggaatggatctggcaagacaagttggagaaaagtgctggtaaaatgggtgagaaactgagaggtgtcctggaagccaactggagaaaccatctcaaggaggaagtcaccaactgctgaatggtgttgttgaatcaagagaggactgaaaaagggccactggatttagtgacatggaaattgtcaggtgacagaggtgaagccataggaataaatgtctgattggagtgggttcaagagagatcataaatagaggatgtgaatgtagtgaaatttggaaa

SEQ ID NO: 28702 - DNA, 793 bp, Bovine  19866880720509
cactgcagactccaacgcacaactgcaattttccttttgaaagtttagagcattgctgcctaaagatgcctgggttgagccactggagctcacagattggtagggaatcgcacagccacaggtgcccggaaatgccatgggtatgggagaaaaccggagcctgtctcagggcggctgcgaaaggaacacgcatgccattaatcttctctcagagtcacccttcgtaaccactcccttcctgacaggcatttgtcttatttttagtttccgtctcaagagctttctgttttaaccccctgtgtcttcaggggcttgctgagtccggttttgattctctaattggcttttacccttcaatcctttttgattcccccagaacgataactggcccatgcctttcctgtgttatcccaacttcttccactctgtcacctcatttcacctgtttttcatcttccagtgagacttaacctcccttttccccaacatgtcatgggggagatttgtcaagtctctcaaaccctggcttccctgaccttgcccagtgaagtgcttcccaggggtaatttattcctctgatcctcaagttccacaatccttggtttggatcttccctataacacgttctatgccgattcatatccatgagtttctgattgataaagatatgccagagaacggacttccctggtacagaggataagaatccactcgccaatgcaggggacaagggtttgacccctgatctgggaagatgccacatgccaaggggcaactagcccattcccggcaa

SEQ ID NO: 28703 - DNA, 1112 bp, Bovine  19866880776789
agagagaggattttaggggttgcatagagaactcaattctatactaatctttaagcctttatacagtggaattaccaactctaaaggtttttaatatcctacttggaagaagccatctatgctcaaaacaattcagaataaaatcaaatacaaaagggtgctaattgaatagcataacaagaggattagtacacataaattaaacaccctctgccaaacaaataagctggagagaggcttatttcatcatcctctgtgtgagtctttgaggagtatacatttaagcataaatcaagaaacattgggtttgctttttgcctatctccagcacttattgagaaagggtaatgctcatatgtcaagataaaacataatgcagactgtgtatatacaatgatcaagcctatattaacatttttaaagactggaatgaaacacactgaaagatttttcatgtaatcttatgcattatgagtgacttgtcaatttgttacttttattgttttcattttctaagttcttacaatttttattttaatattatggtaaaagagggaaagtttttaatgtatatgaatcccccaaatccctcaaatgtaagaagccagtgtataaatctataaagtaatggttctgaaatagccagcgtagggttattcaagcatagcttatctcaacatgaccagatctccactcatctgttcctccagattccaagtaatttaattcttcctcataactgtatttattgttttgtttacatttttgtgctagttgttcagttgtgtccaactctttgggaccccatggactgtagtccaccaggctcctctgtctgtgggattctccatgcagaagtctggagtgggttgtcattcccttctccaggagatcttctgatcttgatatcccaaaagtgaatgtgtttcaagttcttatcttttagttttgtgtaagttttactcaaaggctcaacagactcaacacaacttagaatggaagaaacttctgatgattttgacttaattacttcaggcagagaaaaagtatctgattatcttctctaggctagctttgtattatgaaatttagcctattgattattataataa

SEQ ID NO: 28704 - DNA, 1204 bp, Bovine  19866880799981
gaagtctcatgctgtggccagggcctgggcctgggcctgggcccgggcctggaccagggcctgggccagggcctggcattggaggcattaacattccaggaggcggtggaggaggaagcccaggaggaggtggagggaaaggaatcatgcttggtagagcaacttcatcaacaaccaagggatcatttccatgatcaaactgacaaaggtcaccaagtacacagaatcctctttctgtaagaatcaaagataaatttcactatgatctacactgagttcagcaaacaattccctgaaacatccaccaatctgatttatggagtgctttttgtgcaaggaatttaaagccttcttagtgttattctgttaccattgcatattcctgaggtaggaacaggtgtactctctacttgctatactgtgacactatgctttactgagacagcaaataatcaggtcaaaagcaggctaccaaccactatcagattaacccatttgctactgagttttcataataaaaattcagatattttaaataacttaacaaaggtagagaggataaggaatgtgaattagatgacctactttcaactatctactttcatgatattattctaaagcaacaatttttgctataagttgaaactttaaattattcaactaagtattatgttccaggttattcactgcagaattgtaacagcaaaatatctgaaacatcccaaaagtgtcgtaagtttaaacacatttttgtacatagagcatacaaagaagtattaaaaaaaaaatgctgaagaagctctttatagttactatatttacataggatgactgccaggaaataatgttaagtgaaagaaaaacaaaatgcatagtatgaatgaagtataaatagtataaagtacaataccatttatgttaaaaacagagtgggggagaatatgtttttatgtacacatgcatagattaagtggaaagatacacaagaaactgacaacataaaattggctttgagaagatctttggggctgggagaccagggtaggggtgagttaatgcctgaatcacgtgattctattccctacttaaaaataaataaaaagaaaaaatatatacattctatatttaaagaaaaatgttatgatgtctagtcatttgctataaatagcctgggagctgggaagtatacagaaaacaagactgc

SEQ ID NO: 28705 - DNA, 3814 bp, Bovine  19866880846329
caattttctcttcctcatcttttagagctctgtatccaaattatttccctgttgtcccaaagaactaaacagcaaaggcaaaacagagcaatggattcaaggctaatatacaaggcagacagccaacagattgctattaaattaaccctggggcttgacagatctgttcatcctgaccccaactgcttatggcattccttattaatgctgagcccaggcaaattacctctgctaacaaaaggggttaatatgcctctctgctgggactggaggcagtgctggggacgggagggggcacagccagtttggcagctgagctctacgcttggaaggcaggaggtgggaaggtgagggcactgttgtgccaggcaatggcctaaggcatcatttaaaataataattgaagacgctaggaggtcacctcttaagggatcagcttcaaacaaataaaaagccaaggccataaattacatccgcggtggggtaaggagatgaagagggttatggcaggatgctcaaggggagatggggaccattcaagagtcatttccttgatcccaaatttggaaaagttttccataaaaatgtctatagaaacattataaaggagaaagactgacaacaaccttaatatacagaaacagggaaatgattgagtaaattctgggtgatatcattaaattgtttatgcagtgaaatgccaggtctgttaaacaacttgcaggaaaaattctatctatagtgtgaccataatgccatttaaaatttatactctgaaactgatggcctaaaaggcaaaactaccaaatgtcattgatagttctactggggtgggtctatgaatttcttttcaattatcagttttttcatttctacattttcttttagtgaaggttgcactattttaagattgaaaaagataagatttttttaatgcttattatgcatatgtataattttaggtgaggtaagttagatataaaatatatacagtctgatcatagccatataaaaagaatgagagaagagagagaacagaatggaagaaaatatagttatatatcacaggggttatatatttaaggttagtattatgttatcctttaataatgctagcttgggttcatccatttgttccttcatgtatttcataaatattcacaaagaatctgccagggatagattccaggcacaggagctatagctgtgaccacagcagatcaaaaaatcccctgaaccatggatcctattttctagaagggaacatggttactaaacaagctagataaataaatagaatatatagtttattaggtagtaataactgttaaatagacaaaacagggaagagagaaagtatatatgtgtgaatgggcagtgtgtatgtgtgcacatgtgtgtgtgtgtgtgtgtgtgtgtgtgtgtttgtgtatgaccctagattgaacagaataagactttctagataaattaagaatttaaaaaattttctttatttttctgagccctactgtggaattaatcagcattaaaattgtgatgtaaattccttgtatatacacaaaattaggtggtgagattataggtcattttataatatctacaatgaatccatattattaaatcaagaaaacaaacagtgagtaaagtagttttcttggcttagaaccatctatgagacagttgagaaatcaggaaccgcatctctgggtaaagctgaagacaatattgtgataaatactgcaattgtaacaagtggggtcaaaagattagaattcattttgtttccacctctattttgctccaagatatgggaaagtcattttctctctctcaggatttcaatttctttgcctttgaatgggtatcattctgttaactctgttagtctgagaaattttgatgatcaaataaaacagtggagaaaaagttatttattaaatgtttttgcagtggattgaataatccaaactttcaaagaaaacatgtctttttttccaaagataacttttatatgcattaggtttgtgagtttttgaagattttctcatatgcttctgtctttatctctgctaattttgctgatactaagaagattttttccctctcctttctttctaagccaactactggtagcagagcccagcaggaggctggactctagatttacctgggtaagacacccatgttcaaaagcagtcgaggcttttcagatagcacaagtctgccagtactgaaagtggagaatagccttgaaaactgggcatattagagctggattctgttttagggagcaagagtttatctgaaatctttattccaaagtctgaatttaatctttggatagaaagcagtgattacaagccatccagatcttgtcagcagaaaggacttgctgcttgatggcaacacactgaaaatctccagagaggactccgagggatcttcctctcttaagagcttaaaaaaagccaatgtgcaaatattcatggagggctttgccagttgctaggctcactgtgagaggactgacaaagagacacatggtgccctaggcggtgcttttggacacgtgttgagctgcgaaagacatgggataagatgtcctttacaactgtgggtggggggtacttgaaagtcccataaccacagccccttgcctattcatgtgacacagagcttgaaatttctccattagaaaatactcaatacttccttcaaaggccaatccacgtgttactttctgtatgaaatgttctagcccttctttcatgatccttcctacccacgtatccatagcaccttgaccatacctctaggaatacacttaagatactgtgatagagggcattttcctcgaatataagagtgagataggcctagatttggagcttcactggtgactcagtggtaaagaatccacctgccaatgcaggagaggcatgttaaatccctgggttgggaagatgccctggagaagaaaatggcaacccactccagtgttcttgcctgggaaatcccatggacagaggagcctggcaggttatacccatagggttgcaaagagttggacatgacttagcaactaaacaacaaacaggcctagattttaatctcaaatcctgtggccagttactacctaaccctcattttaaatgcctttgaacttgtgaatttatcaacaaaaaaaggaagaaaactataggagatgatgtaatccacctgctacttcatagaggcaaccccctcccccaccccaaaaagactgtcagtctcatcctccctagtatggttacacgtctgtctccctcggtccacatgctcactttggaagctttgtgaaatgctaacttggtgaagctcaacatttctaaaatgtttctggttgtggtggggtaacaaggttcattctctcgggtgaattgagggacaaaagagagaaagcagcctctctgtacacacgcaggttttcccagtattcagtccaacagtgatctacatgctgttataatggactctgcagacctggttaaaggccccagtcagttgactttaattgaatcataagggaggttatcctgggtgggcctcaactagtctgttggaaggcatttaaaccaaggtttaggtcttccttgaggaagagatcccaacagatgccgagaccacaacttctctcttgatggccatatgtgaacgtggcctgtggtgttcctgcctctgtgttccagcttcttgtggtctttctgtgcctgactgctggccttacagactttgggtggtcaggcaattcactgtaatatgccaatctgtc

SEQ ID NO: 28706 - DNA, 1791 bp, Bovine  19866880855574
ctcttccgaactccctccccgcccagcgccacgcagctcagggcggcgtttactccagcacccagagtcccctagctcaccgcctttcttcagacacctgtgttccaggatagcaaagagaaggttcccttgagcaaacaggaagtctacatctcggcctcttttgctcacccttctatcaagcatatggtctctggatgaaggtcaagggtgaggcctggggtttgaagcctcacccagaaagcagagaatggctcagaggctagcttaagcccttctctgcgttaggaataaatggggaatcagagaccagaacttttctgaggatcacacctgacttctccctttcaaagagagtaaaaaataacttttaactgggggtgtctatactatcagagggaggaagagggtcgaattatgaatctagtcaacatgctctgaaaaagtccatattccctaaccctttgcactcagttttggtcaaactgctccagcccctcgggtgggttttgcttgctaagacacagcattgcaggaaccgctgaatttgctctcccagtgaaaggtacattggagccctgtgcccccagagcgccactgtttcccaggaggaatttcaaagatccaatgaataccaaaaagtggcctgtcttcctacttcacctaggaagaaaatacagaagtctgccccgcccccaatttttcctgaattgccaaatcgcagatttcatatttgaaagaaaatgagatcattactgttatgaaacaacaatcatttctgaagcaacccaaatcactagaaagtcaatttggacaagaaatgtccctgatttcctcttgtagaaggtattcatttcagtgagcgtcactgcaggggagagacatcagcgaatgttttgctcagttaagctccacaagtttagctggatgagcccagagggatctgagttaattatatacatacaatgcttcggctaacacaatttagaaagtatttgaagttcaaaaaaaaaaaaacgggaaaacaagtccttaactgaggttgggaattgccattagacttccatgaagaaaacattcttctggcaggtagaaaatggcaaggtcctcatctcccgaaaccaactgcttatctctggcaaaagatagaagaaatattctttgatatataatattcagcttacaaaagattccatttaattctcatctggtgattaagtcttccctacttctttgactgtgtgtgccaaattcacatatgaaattccaggaagagatgaagactgatgtacaaattgatgtaatccacttcagtgccagttgccatggctggttctttcatgttatgagtcgtatccatcaccaagactccagtggtcagctcatctgtagttattcagtccagcttctcttgcagattggcataagggggtaggggaagggggaagaggggaaaagctaaatttatcttaaattggtgagaggacatcttgctttgagttgaaatgacctttagttgccactagagaccttggagtagtatttgagatgaaaagtgaaagtgttagttgctcagttgtgtccgactctttgtgaccacatggactgtagtctgccaggctcctcagttcatagaattcttcaggtaagaatactggagtgggtagccattcccttctccaggggatcttcatgacccaaaggattgaacccaggtctcccacattgcaggcaaactatttactatctgagtcaccagggaagctattctttcccatatcttcccaggag

SEQ ID NO: 28707 - DNA, 1342 bp, Bovine  19866880857850
aatttaggaaaataccccttcactattgccagccatagtgggagaactgtcaactcaaactgccctgggccggtcaagcagcaggcatgattaggctaggcaaattgggctccattgctgacagagtaattctcagacaggaaagcataaggattaaaatgtttggagttgaccagtttgtcaactatctcttgattatgcatcttgtccctcgtaagcacaggttttcgtttatttcctgattttgtgaactgccccatagcctcctaatgaaattcaatgtttgcttcagtattaatttcctagggctgccataacaaaatacaacagactggacgtctcaaaacaatagaaagtattctctcactggagaattctggaggctagaagtctgaagtcaatgcgttggcagagttggtcctctggaagctctggggaaagtcttttccatgcttgtctccaaactttggtggttgctggcgctcgctgaccgtgtctggcttatagatgcattatttaatctgtgcctgtcttcacatggcaatctttctgtgtgtgtccaaattggattagagcccaccctaatctagcataacctctttttaacgtgacaacaatgcaagactgtttctaaataaggccacatgcagagcctataggtgaacaggaattttgaggggacagtgtttaaccctatatagtaggcaaccaaaaaagactctgatccagttatgttccagaccagtgttcttgagtaggtactatgcattatctgctttaatcctgacaatctttaaggtgggcacctttatttaccctcattttaggggtggaaaaatgaagactgagaatttgttcaaggtcaaattgccagtaagaggcaaagttaagattcaaggcgaggactatactcaacacaaatgtgttctcctaaccactacattatatttcaagctttgctctacttagaaatgccttgatatcccaactcccaatcaccagctacaagctatgaaaggaaaatcgtccagttcccaaattggggtaaggtctccatatctccctatggttattctgccttctctgtactacaatactgggtaacaactgaagtcagagagtgtggacaagaaccaggaagaatcctgacagaatcagagaacagctgccataattgtctggtcaggagttcacatgggtagcagtggcaggaagaaatctgctgggctctgggtcagatggtcaaagggacagcaacagaaggtatggtttagagctgggagctctcttgtctgtgaggcccaagcaaacagtgaaggctcgggcttggatgatcaaaaca

SEQ ID NO: 28708 - DNA, 1703 bp, Bovine  19866880866102
attagctactagagcttgctgctactgctgctaagtcacgtcagtcgtgtctgactctgtgcgaccccgtagacagcagcccaccaggctcccccgtccctgggattctccacacaagaacactggagtgggtttccatttccttctccaatgcatgaaagtgaaaagtgaaagtgaagtcgctcagtcatgttccactcttcgcgaccccatggactgcagcctaccaggctcctccatccatgggattttccagtcaagagtactggagtgggttgccattgccttctcctagagcttagaggaacctgaatcagtgaatcttagtaccaattattttctattgcttggctttggaatgtattctattctaatggcaagacaattctcatatttttcttattatgaatgataaattactatactgagaaagacagaaattagaggtaaaacataaagaataaaaattcttaaaatccctcgagtccaggaccaccatcattaaccaccattatcaacagtttacagttcagttaataatacagtcacagtatttttctatgcattttttgaagagaggtacaaacctataataataccacatacatagatttatatttctcattttattgtaaaactggtacatagaattgtagaaaatgaatataaaagtaaaaaaataaaataaaactttctcgattccactagacaaaaacaactattatgaaaattttgtgtatatccttattttgtgtatatccttatattatatatattattgggatgtggaattacataaactgtttttaataaatgtaacatactatacacagcttatactatgcctttcccccagtcatttatctatttataccaacatctatctccacataatgtataactgagaattagttaaaggtctaggaatgggagacattaataaactatagaaaagtcatacaatggaatactattcagtcattgaaaatgttacagtattttaggagaaatatttcacaattacaaaggtattcctgttactaagtgttatattattaaattaaaaatctggttgcaaagttatagaatatgtctcacttttggtaagaaacagatttatccatgttactttgctattccttttaaaaagccattaatagtggttctctctgtataggaatactttccttatcttctctctgcttctctgaattttctaaattttttacagtgaacaattattactttcatagcatgaaaaacaagtttagtatacattttcatctaatcataggtattatgatagaaggagacatctcagtaaaaaatttgtcttcagctggtaaataattttaaggtctagcttcacaactgaatgttggttttatttttcattaaaaactgtaaagctgggactgtattctagcagaagattaaaaactgtacccagctataatgagataagcacaattttttttcaagataattgatggtgaattcaattcaattccccatggttaggatgcctggagtcattcttgactttattatcacaatttttcttgactcagtatcttgaagctttgtggataaaaaagtctgagaaacatgtggctgataccatgagtaatggctttttcttccttttggctggctctctgagtagtttatcattacttgggcacctttaagcacaatcttat

SEQ ID NO: 28709 - DNA, 3111 bp, Bovine  19866880881322
ttaatcaatagggacccaaataaacatagataaatgaaatctggtattgtagaggtaggaatagggtctgttcaatgctcggtactgggaatatgagtgagagatgatttttctccgaagaagctaaaaatctaatagtgggaaagaaatatgtcaaaaattacaaactcacaaaaaaccaattacagtgtattttggtgttaaaaataaagcaacagagtgcctcagaaatacatgtaacaaaggaactaattctgcccgaaataaaaccttcatctagtctaattgtcactcagttttgaagagcacaattggatgttaaaagaagaaaaagaatttccccactgtataactgtgtagggtatatggggctcctggcaatgctatttaaaacttaatggcaggtatggttataatttagaaaaaaacatgaaatttggtttttgttgaattaaaatgtcacagatactctgaaaaggatttaaataatgaaatacagttggaagtgtatggaaaaacacctattaaaaacaactatttcctttgacatacttaagcatttttacccaaattcagagtcgccagtttagtgtatggttttggggtttgaggttttgttttgctttgttttcacaggacagaaccattttaaattatatttctttaaatttgacttgtttcttttgcttctttgaagaagatgtaatagaaatattttgtacctgctaagctccttgtattgagtgtgtgaaagattagtagtagaatataacagcctaaagattgattcttaggttaaaggcagttgtcagtcttcaggtgaatttacataaattacttttatctttcagagaatatatttcctgttagctgtgtacgattattaaaacatcatattcttaaacttgagatgcctcatttaattctgtgaagtacataacatttttctgtgcacagtcacagattttgatgtctagaaaagtcagtctatagagtcatatattgtctagaatttctctcccctcatgtgttacttggatttgttttgcattagttgtcatattgcccatttcaaataatgtctgatgaatatcaaataaaggtattcatcctaagaaacacttaaatgtcattgggatgcagttagtaaataaacttgcatccattgtgttaagtattgagttcctactatgtgctaggcaccatttagaccctgaaactttaaaaagtatgccagggaccttggattctaatagagaggacacataacaagtatggccaataattggaaggtatagctttctattttcttctgattgagctttcagtttaaaactcatcttaagacttttttttcccttgtgaatacacttgaagacaaagtcaggagaattacaaagagtagctaaaattttagtttgaataaagactatcttcaaaagactagagttaacattgtgtgtgtgtgtgtgtgtgtgtgtgttgctcagtcatatctgactctaaagaatgaaaatattgctatcaatcagacatataagatacatgaatgatttacaataggagcatgaacttaggagacttgcattttgaaattattcagtcactctacactgataaaaactaaattgaatcagaatctgaaaaagaatatatgcacacacctatatttatgtttaactgagtcaaattgtacatctgaaattggcacagcagtgtaaatcaaatatattccaataaaagtttgagaaaaaactaaagtgaatgaatctaaattatgactggcttatcttcaccatcattataaccaacttgatttttttaaactttttattatggaaaatttcaaatatacctaagagaataaacactgtagtaatcgtcattactcagttgctggtttcaacatttatcaatgtattgattaaccttgctttatctgtaactcactcctgacttgattatttaaaaacaagttccaaacataccatttcatctataaatctctgaaagataagggataaatacacacacacaattactatactttatcacagtcccaaaatataacaggtattattgtcaagtatctaatcagtgctcatatttcccagttgtatcatagacattcctttatatctggttcatttgaagatgaatccaagcaaggttacacattacatttagttgatgtgtttcttaagcctttgaatccataacaatttctcctacctctttttttctcccttgacacttacttgttgaaggagcagataatttgtcctaaagaattttaccataatctagacttggcgtatcttgcatctgctggtgacatttaatgcattcctctattccctgtttttttctggaaattggagatttatctagatgtagattaatagggtcacatttagggtttttttcctccttattttgcatgaatgttgtactgatggggttttgtacttcctactgcagtatatacctggtgtacaatatcaagttgtctcctttctgtgttacaaatattgatcactgtgtacaggtgttttcatcctgatccatcctttcaaaaaattgctcttggttgtttgtgatccctgcccagttctctttgcttcattgggggctataaaaatgtgatactctagttctgtgatttcttctacatttattggctgacagtctacaaagtagaacttggcagcgttcaccacttggttaacctgaaatgtactttttacgggaaagacaggataaatgcttctgtcctttaatttatcagttttcagaaaatgagtttgtttccaagtatcttccagagggaccactgtactttttctaagtatcattatgaactcatggatttctaatgtttggtatatttcaccccattgtggcctttttttggtgttcagattggctcttatttgaccatgggaagcctcttcatgttggcttctggaggttgctttgttgtattttttacatgctggtgtttggtagccatcttgcttctggagcattatatgaaggtgtaccagactcatcgtacaagttttctatccagacctagaatcaaccttttacctaaggaactctattttt

SEQ ID NO: 28710 - DNA, 2587 bp, Bovine  19866880896542
actctagtagtaatcgtggagagtgcctcgcacatgcctgcctgtcataaaccctctagtggtggtggtggtgatgagggtggtgagggtgagggtaaggatgggaaggaaaaggtgctggtggccaggagaacgcccttgccttgaatcctacacaccagacacagtggttttccttgactctaaactgagaacaggataggagttgaactgacacaaggaaggtgaaggatatgggctacagcagcaagaacaaaagtccaaaagccaaaggaagcagggcgcctttagagaactttacagggttgaaaatggctggagtgtggactcttaaggaggcagaaagaggagggttaaagtggagctagcattatgtcaggaactgaaggctaggttaaggatttaggatccatttgcgtgctgcgattcatggggtcacaaagagtcggacacgactgagcgactgaactgaactgaactatccttgggtgaacataaagtatgtactcttaggcttactctggctatggttgggaaaaaataggttggaggtagatcatttaggaagctatttcagttctataaaatgatagggactctgaaagtagagtttaaagaatttgaagtccaacaagagaagatcctgccaacaggttgttagtgtgtgggaaggagcaacaaagatccaaggagaccagagaagaagacagagttttatttgccggacattttggaatattttaatatacttttgaaattgttatctcatggtcatgataattctgtaaaatagatgaactgagcagaaccacttccaaatcagagaagaatacagaggctttgagaaagtaagaatcacgtggttagttgtggcccaaaggacaatgagattatatcttttaacttgtaccttttttctctcttgtgagagaacaccactgacttttctggtcttatagtccattacgaagcgccccccaaccccccacccccacccttttaggaatggatagagtagaatctgagctccttgggaccacatttcccttgggactatttaaaacctaatctcctatactccagtacttctgagggcagggggacagtttcacaatctctcttatgataaagtagtttgattgcaagcccctaggtttataaataactaggtttatgtacataaataactaggtttatgtacttagccaagaataatgttcagtacactaccaagtgtcattgactagctaataaaaataatgaaatcaagacccaacttggtcattattcatagctgacacctggataatttttaagcatcaggacaaaaaagtctgcatttaaaaattattttaactgaatttgccaattgagagtcgaggagccagactttctaagagtcagtacttggttgtaggacaattgggaaatgcaaacagtgcatttaacctgggcttttcttttccttttgggagggaaaaggaagcagagtcagttggaaagaatagttcttttaaaaatgtgcaatgatactttacatgtctcttttacccaggcgtagttaatgctgccttttggatgagatggaccccaagtagaattggtactagtgaataattaaagagcagagagaggactacacacattctgatagagaaggtgttactgcctctaacttctgctttgagttttgatttttatgttatagggagaaaaaaaagaacttgaaaaatcctctctcatctttaaaaaatctcagctcaaattccatatttcccccaaagtctccttgactatgtaatctcttctgaaccccagcatcagggattctaattcgtaatgcttataaaatagcatattggccactattatttaatgcatatctgccttgtttctatttctggttgtagcctccttgagggtagactttatatctttccctctagagggatagatgcatcaggtcagggacacatctggttcttttatgactttaatttcatcacagtgtctcacatgttatagacaatcaatgaataattttgaatgagcagttctaatatttcagcatcatttatagctctgatttttatgctacatataccatactggtgattgaaaaggcaatttacttttcatttttaattagaggataattacagtattgtgatgctttctcccatacatcgacatgagtcagccataggtatacgtttgtcctttaccccatcccacccctctaggttgccacagagcactggctttgggtttcctgtgccacacggaagacccccactggctatctattttacgtatggtaatatatatgtttcagtgctattgcgtaaaaccaagttggagtcaaagtaggaccattggaagtgatagaatctgagactgatctttgaactctggttgttgtggacctgccaaaaaacatggggtatttgcggactgtctaggttttatgaaactctctgttggttttatttttagttaaatccttagaacagcacttttaaacctccagttgactaaatgagagattactttggttattctaaagacagagaaaacaaactaagat

SEQ ID NO: 28711 - DNA, 1473 bp, Bovine  19866880901569
tatgtaaaaagaaatcctcctgaggagcttatggaaagaatcttattcttgatataagagggcaaagcccaaggaggagccagtccatccccttcctgcacactttggatatgtcatgtgagggcatgatatatcaagccgctgtggcagccattttgcaaccatgaagtaaaacctagagacctagagagaagaggcctttgacatccttgagctgacaaattaacaaccctggagccatgtacctttaaacttcttgttacatgagataattaggtatccttacagtttaagctactttgactctggtgtcctgttacatgaagccaaaggatcctgactgatacaatatagctcatcttttcagaccaggtcactcaggtcccaggtcactagctggctatcctgtagattcactgtctcggagtcacacacctacctccaatccatgtgtttattcccctgctccaaacttctatgaaatttctttaatctgcagaaaagttgaagaaataatacagtgaacaccaaaatatccctcacctaagattcaccagttgttgatatatgcagctaaatgctacatatgttcattgtatatttccatatatttgggggtgtgttattttcactgaaccatttgaaaggaagttagagagcttatgaaacttcatcctgaagtatttcagcaattatctcctaagaaacaaggacattatcctatataactaagttgtcattatagtagattcaatacatattgttattctatgatataaaaatcttactaaattttttgtttttgcttttttctagtcccctttattctacaaaagctttttttttttttttttggtctttcctgtcactgactttcagttcagttcttttatagaatgttccataatttggattatccagttgcttcttcagaattagatttatgtaaagatttttagcaaaaactctacagaggtgatgttgggtccctctcagcacatcacaggaggcacaggaacccactgtgccctattactggtcttgctgtttaaacagttgattaaggtgctgtctgccagaatgctccactgtaaaggcatcttttcaaactttatataattaataagtaatctgtgggataacactttgagggtatcttgtttcccaacagctttcacccgatgttttagcagccattcataaaccttgcctgaatcaactattatatcagtgattacaaaaatcactttttaaaatattttattatttcctctacattaactggcattctatttaagagctttctctcccctcacactcaattttcttgagtattattatgaacttggatttttcattaccactaattttcaattttcaagttgccccccttcaagcagggagccccttctagctggtctctgtccttcagacatgaccccatcaatgtctgagcacttctttgctctctag

SEQ ID NO: 28712 - DNA, 1121 bp, Bovine  19866880960980
ctcctccgtcctgggatttcccagacaagaatactggagtggttgcctactccaggggaccttcctgacccagaagagtgaacccatgtctcctgtattggcaggtgaactcttcatcactgagctacccgggaagcgcgatataaggataatgttgtttaatattgtaaaatgttctctggctgccatatgtaattattgaaaatactgcatttatttatgagtgcttacaggtctacaagctggaacttgaagaaagcaagaaagtagacgctcagtactcctgggaaacgatactttatcatgcaagaatctatagcattcatgacatctgagaggaaggatttgacaagtgaattaatttgtcttttcccttacctaaatgcttccacagctcaaattctccttactctcctaagcagtgtccttctatgctgttggcagcaggacaactcacaattcttcttgacatttgattaaggtaccttttgctttcagaacagagagcaagagatgtggagaagcattttctgcaacctaaatggtattagtcatgagtgtggatgtttaggacgacggctactctgtgtcatcgtgggtacccaatctcatagggtctttaacaagcttaccgtttcactgtgtgttcgtgatcatcagactctctcacaaatgaggtccaaggtaagagcccttcttgaccagatctacgggccaacctaagctcagtaaaagaatcgaatactagttatctgtacaactcatatgtataaagtagacatagcttcctcccaccagtacctgaataaatgggtgttcctttttctaggcatcttttacactaatatatacatatatatattcttaacattaaaaaatatatataatattttatttctatttacttatttttggctctgctgggtctttgttgctacgtgggcttctctctagttgcagtgagcaggacctgtgctctagttgctgtgtgcaggcttctcattgcaggcagcttctctcgttgcagagtatggactctggagcacacggacctcagctgtgggctatgggcccagtagttgccactcccaggctctagaacacaggctccatagttgtgg

SEQ ID NO: 28713 - DNA, 1307 bp, Bovine  19866880982173
tttggagcctgatttcttttctatccaaggactcctgctgatttaacaggccagttttctctttggggaaactttagtgatgatcacagcctcactcttttcagggtgacattgcaagcaaaatttatgggaaacagcaatctggggagtctgactcgaactcccaaccctcgaaaggccaaactatgatttgttgttacagagacagagtgtactgaaggaggctgagctttcaagcaggcagccacatctgggctaaccactgaacttctttaccctctcagggcctgccagtgaattacgagccttactcctttgttgacgtgcttcactctccataacagcaggtaagaggcatgaggggcttaatggggttgcttcctattgagagggagaagcaggcataaatacagagtctgcctcccatcaagataataagttacacaggatctggagttacactgcctccattgtccacccccaaatgtgggcaggagtttcagcttgctgttcacaacttttatttattatttaaaaatttttttattattatcttttttggccatgccatacagcaagcaggatcttagttctctgaccagggattgaactcatgcccccttcattggaagcacagagttttaaccactggatcaccgagtaagttcacaacttttagtccttaaatgggaaagtgcctgtgttagtcatatcctgcttcttttatctttgcctaagtgggtaccggctctgatgctgggcacctgcctttagagatgggtcaacccatagctatcgcagtgggcccagaaatgactgctttggtctgtacatcaggcctgacatcagcagctgggggcatatccctctgaaactgcaggtaaggtgatttgagttgactgcttcttgatctcaagggagtagtagcggtttgttagctctttaagtacctttattgtgatgtagcatttctgagagtcagcacagggacagggtagtgataggaaacaactgccaatggagggctgactgccacatgaatctgaccttcgggttgtgctaagtgatatagaaagaacttccactctaggatccactgacatcttaataaacacctcaaaatcccatcagtggcaggaggtgtgaatttacctgtggctggcattgtgctgtaccgggtagcagctcatatcagtcctgtgtctacaggccaggggctttaggattggcaggtgatgattctttgtttattaagtgatcaggggacaggtctattgaagtagaaaaccctggtttctgcaggaaaa

SEQ ID NO: 28714 - DNA, 1388 bp, Bovine  19866881057877
tccccaagaaaggtttgagtgaagagcaaaaatttgaacaatcaagtactaaccattacctcaactcaactgttttaagaactaaggggtcacatatcaaagtaatagaactctatgaagtgattagaaaactcaagtgctgtaggtaatacaggcttctattgagaacaaactaataggctactaggctagggcattctttccttgcttctctttcataaaaggaaaaatataaatacaaagaaaaagtaacaatgtttatcatgcttcctgattgctgctgctgctaagtcgcttcagttgtgtccgactctgtgcaaccccatagacggcagcccaccaggctcccctgtccctgggattctccaggcaagagtactggagtggggtgccattgccttctcctgactaccacaactcaaaataaaaatttgaaggaaaaaaaaaaaaaatctttgcagattttttgcagaagcctaagaggagactaaaaccacaaatatcctgcaaacaatcatcaaacactattctgaccttaatttcacctatatcaggtcacccatctcagagtgtttgggatggtttagtaaacctaaggttgattacagaaccaggtaaatggtagatgatcctgtagaaaggagatcacttggcagtaaatcaatttagcataaatgaaggtgattcataacacatcaattagaagcacagttttggtttttttttttttttagtcagtgtaggttggctcctcaaataatcttggagactaaaagtgatacaaaatggacaggtctgacttgcaaaattttggttcatttaaagcaaacctggcgcatcttaaaatgatcccatgggctgacatacacactcatctttattggaacataactagacccagcctagatactacaatggggtttgcaattcaaaatgtatccttggctttagaataatttacatcgaaattagtaaaaacttcaaataaagccagtaatttaatgagagctccattttagtaaaatgtttgacttgttactattaaacaaatttaactatgttcagaattatgcttgccctctcccaaaagcctcagactagtgtttaccataaacatatactagataaattataatctattcaaaacaaatggcaacacagcttatttgctacttaattcataaaatatggataaaactgtttatttgaaaagaaggaaaatgaaatttactcccattctttagtattttcctgtataaactgagatttgaagaacgactcttcttggacaatgaataaacatttggagggaactgtatacaaaaaagcagtttttaaaataagaaaatgggagcccaagcgatatacttccttttcccatcaccacc

SEQ ID NO: 28715 - DNA, 1628 bp, Bovine  19866881061657
ttggctatgagaaattaaatcccacatgctgattatctttcctcttctgtatattttcctggaatgatgtgtcaaaccaggatcatttttaagtttttatgtaactttcccttcataatggacttcctctttctaggttattactatcttttctgataacacaaagcttataagagaaggaaaacatcacaatggggtactagaataagcaatcttgctccttcttcctccatcatctctaatgaaattttcttaatgtctgtggctcagtatagtatatattttgaaagattcattgtggtgaatattttgagtcctgacagtttaaacgtgatagagggaacaaaggatttatatattttttgtacaaagttttttcttaaactgtataattttgtaaataatttgtttggttttttttgtgtactaaaactaccagcgtatagatttcaataagaattgttgtatttttgtatttggaaactgaaaattacagtaaattaatggagctgtaagaaaattttcagtagactgacagttcagcagaatgagattccttttcatatgatttttttttaacctaaaattgacatcttattacactctcagtacagacagagttaaggatttgtttgatttttagttcttgggggagatggggtgaaagagaaggatgttaaagtgaagaataaatagacactttttccagtaagtttttaagccctttaaaacttagtttttgatacaccttaaataggactaaaacgctttcaaaatgtcatttctaatgtttgactctcaaaaataattcaaaatatgcattgaatattggaaaatttaaggttagcataaactagttgaatgtatgtatgttttcctttagggctgaggtcccaaaccattagaatttctcttaaaagcgagtaaacatgatttgttttcttggcatcttcacttacagaaataacacataccatctgaggcaaattctgttcttttgaatgtgtatgacatctttctaagtagctattaagcaataacaaccaccaacctggcttgttcaacttggttttactagtggcttactgcccaggcttaaaaaggtaaccccggggaatgtagaatttccctcagtttcttcatgttgtaacattgagaaaatattgtcactagctaaggtgataaattggaaaacgtcttgtgggtggaaaaagaaaggtccatggtatggatcattatttaaaaaaaaaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattgggaaaaaagaaagaaaaaaactaaaagttacaaatttaaaagaatttgcaaaatttatgaaccattccaaaaattataacaatcaccaaaagagctgtaattcggcttgttcggaaagaaagaaaatgtgtgtgta

SEQ ID NO: 28716 - DNA, 1745 bp, Bovine  19866881119734
aatttggaactattgttaatatccaggtaggtgtggctatgttggtgacagaatcccgtatatataatgtagtttttaaggatttatttctttttggctgcactgggtctccattgctgtgtggggctttctcttgttgtgtaggtctctttgttgcggtgtgcaggtttctccttgtggtggcttctcttgttgtgaagcacaggctctaggtacatgggcttcaatagttgtggcacctgggcttaatagttatggtacatggggttagttggtctgtggcatatgggatcttactggaccaggaatcgaacttgtgttccctgcattggcaggcagattcttaaccactagaccataatgtatctttggaaacagctcacttttgcttaagcaaatcagtgattagtttgatcatctctgctatgtgttttaaatcccaccatgtatttgtatgcccaactttacgttgaaattgtgctgaatttgtcctctgaatgcatttggtttctttctgaaactcttccctgaaagacattggggctggttattgtatctttgttcatagttttatgtctggacaaatgactttttttacctgctttagtattctaactaggtagtgagatttttggtagtttctaagattgtatttttgtctactgaactggcttttgtgaaatattaattgattaaacatggttctaattgtgagaatttcagatactaaaatttaacatcaggtaaatcatagcttttatattttgctatgtgcttgcgaagtttttgaatttaccaatttggtggttgagtgttttgctgtaattgagggtaataagtagaagatgtgtttaaattggtatttcagtcagtttacttagtgttgccatcaaatcaaaatatagtttacctatctcttaactaccttttttctcttaaattgttctaggtcattattctttatggcatttagaaaaaataggtagcttaatgtagatgagtatattagtcggcttgggttgctataataaataccatagcctggaacccaaggtactagcctatatggatcttggtttgcagatggcaccttcttgctgtgtgtttacgtgttggaaggagagggagggtaagagacagagagatctcttcctgtaaattcactcgtcctgtctgattagggtcctgtcccttagataccatttaaccttgtttacctcctaaaagccctgtgtccagaggcagtcacactgggggttagggcttcaatgtatgagtttagtgaggacataattcagtccatagcagtaggccataatttatataaacactattctctggggaaatttacttttttttttttttttaatagaaacaatgctatggtaaggctctttctggataaacttttttttcttttaatgacacattgctgaaattaaggaaattttaaaactttttatttgaacagccaaattgatactcccaaatgcaatttatgaggcctcatcaaaactataatacagatccattaaaaatttttagaccagtttcataagtgaaaaatcgtacttacttgaatttgctttgtttttattcctacgtagactctaatttatatacaccatttgcaatacttttgcatttacctatccactgtctttgctcatttttttaagtgaaggcagtataataatgcttttccaaacctttgcttgttatatatattaaaattactttttcat

SEQ ID NO: 28717 - DNA, 890 bp, Bovine  19866881227455
gactgtcacaaggaaaataaaaaacatttcagaggaagaaagagccagccacagagaaatggatgcaggtgtctggaagcgaggatatgcatttgtgtatctaaatgttaggaaacctgccttgggaagaaataatcttaattcctccatatgttgaaggtggcataagcttaccataaaacacggagttataagaaataacctgattgttcatgtaccatgctcttctcagcacagaaaatatcatacagaacaaagctatcttgaaactcataacactatccctactccatgttttattacggagggtcttgctttctactaaacctaaatagtcttccttacttttaaatagtcaaggtactctcctaacactcccatggcactctgaatttcctgacacagaactgaacacacaaataccacccacttgtccatcttcttcaccggaccctacaagcgcagggcctgtgtctttcccattcacagttgcctttgagcccagcatagcacatagaggaccgaagattataacaagaaaattatgatagagtaacctggacgctctgaggtgtcccttgggaaacgtcatgagctgatacaatggatggagagggaggcgtatggaagtaaaaaattaaaaacagcttctggttttcacggtctctaatgtctggagtcttgctctgttcctgtcttgaagcagtcgaggattaaagggaagaatttgtttgggagaagaggggcaaagagtgggaccatctggtggagtttccttctccactatgacatacccacctgcagagcctagagtcaatcctcattaggcaccacataaccagaagaaaacggcttttggtcaatttcagccaaggattcagtataagcct

SEQ ID NO: 28718 - DNA, 1780 bp, Bovine  19866881230251
catttgctgagcaagtcattttgctcagcaaaaaactgagtcgtttgctccagacactggagttttttactctggattttgctgattgcatcctctgtatttcctgtgaattggtagagaaaatgatttttaaatatagtttaataattgtagaatgtttttgtcagcaacatatggttgtcatattgtggctgccattttatgttgcctggattttactaaattgttatcttctgttccattcactcatttcctgatttgtgcatttttaaacgagcctctcattagatgggcatttgtttagctcttccaaatgtcttcatttgtcttaatttccctctagtaaaggccatatatttatttttttacttatttatttttggctgtgctgggtctccgttgatcatgtaagctttgtgtagttgcaggggctactctctagttgtggtatgtgggtgtctcattgagatggcttttcttgttgtggaacacaggctctaggtacctgggctcagtggttgtggtgcatgggcttagttgcctgaggcatgtgggatcttcccagactagagactgaacccgcgtcccctgcattggcggtggattctttactactggaccaccagggacgtcccatgtatttgttttgagattaacttgtgtttaaaaaattttaatagaatcactagttctgtatttctggtcaatcttgacttcaagttttaaaagaagccttaacatttccaataattctgataccatttttccataattcacacgaaatacttagttttatagcagtggttaaattaaccatttgttccttaaactttgtctgtgaaataaatctaaagttctcctcaaatgaattatattgtgaatatattttataattaggaaaacacacaaaccattttactatatgatacttagaagtagagatttgttatttttactgttatattttaaagaatgaattagttttcctcctacactgctattagggtgagatttaaaatttaacatattgctgttaaagtaatttcaacatctttttttacttcttcctgttggccaactttgggggatgtgatttgattgtagtatttaaatatatttatgccctctcttgtggccagaaagatttatcaggtggatgtgttttatagtttatggaagaactgttcttgtttctaatgaatattttcttgtaggtatttcaggagccagcagaggaagaacgagatggcagaaaaaagaaataccctagtccccagaagactcgttcagaatctagtgaacgaaggtttgtgtttatctttaattaggaaaacattgataactcactttccagttaccttataaggacattagcaggatttttgacatatgctctactcctctcattgtaaaatgattaaagaagtaatttttttttccattccctgtgttttttgtctttgtcatactttctcttccttttataaacaataatcattatgtgctttccccaggagctcagaggtgggagcagtctccttagagaatattaatgaaatgttccatttggttaggggtgctcagtattaaaattgtccatagcattttatattacaagtagtgcagtttatatcttgattcatcagcctaccatcaaaaaattagtttttgtttaggaactctttgttttgaactttttgtcttttctagttgtaaatatgtttttccttttacccctccccatgctttggattcacctctttttttatttctccccacc

SEQ ID NO: 28719 - DNA, 724 bp, Bovine  19866881252605
cccaccagtaatagttttgctgattaaaggacacatgtttcaattatacaaaatgacttaaatttagacatgtcctatgatacatgaacaaatggcttctttttagacaaactcctttgactccaccctgagaatagagccctgactttgtaacaaaaatcaagtttttgtgacacaattccagattttacattgctcagatgtattaaaggttgcttgttggtgttcagtccctaagtcatgtctgactctttgcgatcccacggactgactgcagcatgccaggcttgcctgtccttcactatatcccggagtttgcttagattcatatccatcgagtcagtgatgctatctaaccatttcatcctctgccgcctccttctcctgttgccttcaatgtttccatcaaagggattctgacacccctgtgatacaagaagacaagcaactatggagttttagggggaagccacttggactcaccaacactcctatttggatcccggtctttgctgcgcccccggcttcgactccgacttcgactcaggcctcggctcttactccggctcttactcctgcctcttctccagtcatacttctcacggtacagttcattccgctcatagtaccggtcgtagtctctccacttgccatcttctcttttcttctcccgtgtcctgtaatatacagatataaagccataggtacactacagaaaccagga

SEQ ID NO: 28720 - DNA, 2002 bp, Bovine  19866881261509
ttgaacaggtaaaaataggggtgcatgtgaatccagttttgaggatatgagaccctttctgcatatggctattttgtgactgcctcctcaatttaatcttttagtggaatctcgacatatgcaaggaggaactcaggaatgctacctgagacattttgtgctattactgtttctgctaagctcttcgtgggcgccacagggcaggggagagggatgggagctttcaccagatgagaattgcttcacaacttaccgtgtgtgtgtgtgtgtgtgtgtgtgtgactttgagcactgaacccctctgagcttcaactttgtcattcaaaactggaaataatagtattcacctcatgaagtgcttctggaaatccacaaagtcattcagataaagattttaacacaatattggctataataatagttgctactattattagaggaaattatgtgttttccatctcagttttgatcagatgttagcttgtctgtctccagctgcctaaaacctcagaccactgtcacacctcttccccacctttgttcacagttcttccttcatgggatggtcttttacaccaagtgatatgtctgaaaaatggtcattcctctagacacatattaatttagagaaatttcctcttgtgttttttccaaggcatcttatttaaaagtggaatgaattttcttctttgggactggaacttatttctttatcatcagcaaaatatctcaaagacaactgaatatttgatagagcaacttttcatgagctggtagaattagcgaagacatcctctgcatttaagcgaggcacaaatttcaggatgtaaaatggatgctttacaggagactccattggtttactcttttcttcctcagtattagtaacttaacaaccattttcttttaaaagaacatcttaaaataattttttaatcaccagactgtgacaagtggagactctgaaaagatgtgccccaaacaggtggtctagacaactttctcaaggtgactctctgctggacttgtacgttacaacataagaaacggtgtgtgtcagggtgacttaattaggtgacttaattaaagtccttctgatgtctatttgggagaactaatgagtttcttttatcaaatttattccaagcacttcctgagatgcaaaatctgaattaactaacttctctataaatctgatgaggaaaccaagttctaaaaataacatgtgcagtgctggaaggatctggatgaaagcatagaagccagctgagtggatgtcaagaaagaatgtctgatcttgatgttttcaagcttggctcaattgaaacacttctgcaacttagagtagtacaggtgtcctcaataataagtcagatgccaacatgaagggtggattcacttcacattacggaaagtgtatgttgttccctccatgttctgggtactgctctttgaatacaggagtcaccttgaaattcagaggaataaagagtagagagtaaaccttatttctcttatgctgttacacctccttgatgaagctttttttttttttaaccagaatggtagcaattctgaaaattatccagtactacgtgggacacacacaatggctagacatgggtttcctgtgctcagtctcactaaaaatgtatttaaaggctttcagaaatcatatcaaaactgtattttaacttataaatggagacattaacgggcctactgtggttattatttacaactgtgagtctgagtgacctttttgaaattaatattcaattttctacaacatataaaaaatccttacctagttggaactttaaaagactataaatttgctaaagtagtatatctgacacttttgataaaatctgcttattccttctgaaacctctgtttccagctatgcattttctaccaagagttaaattgttggccttattagctcttcgtacttctgagaagaataaaattcttaattgtgtttcaatgaaatatgtag

SEQ ID NO: 28721 - DNA, 1788 bp, Bovine  19866881301778
ttgcatatattagtcatgagaaaattttgtaacgggaagaactcttaactctgaagaacaataaaatagcttctaaagaaaataggtatttgtgtgcacccactggataggataattatgaggttgtagtgcataagaggctttattcgtgtgttggaaattggattatataatataatgtgaaacctgatttccctttaaatactctcagatacagcactgactaggttctttggaactgtactggtgtgttttcttcagcttgtcttttctcactgagcttttggcataattcttacttcctttgttattctagctgtgaataatgttatcataaagtgctttaagtttgatgttagtagctgctgtgaattttggaaaatagagaaacattagggggagtttgcaattgatattcctccaagtatctacagaagagctctaaacttaagacttttccaaaagccctcaggattctttgatatctaagagaactgagtatgtgaaatgaaaaaggagtgaaattcaataacatacttctctgtctgctatgatagccagcaagttgtccaattagtgccaattgtattgagggtgattatgatctaggtccaggaggaactaggagctaaaatcatcatttcactccacaaaggctgtggagtaactatttgattataatgactttaaatcacttaaaaacccatgccacatatgaactaataatttggaggtgaaaagctccatttcgcattatcaatccctaaggactttcaatcattctcatcttttctctaagtgccttaaatcttgtgtagttgcagatttaaatttcaacattttcaatgataagacaggtctgggataagaaaagatagtaaagccactaagaaagccccaagaattttatttgcagtaatgaagtacatggggaaacatcaaagcagatgtgttttgtcacttaggagcctgattgggtattaaggcttctttgaaatagtttgattcagaattgcttggaatgatgagggaggtctgtttcagagagattgagatggagggacagaggcatatctgcggtaaaaagccttgtgcataaaatctgctggcaggacttgtcattgcttctgtaagaaaataatttgataccaccgatgtgcatgttgaattacaatagctattaaagtgaattgtattcttccgctcaaataagaccatggctgtcatgaagattgggcctgctcctttctcattttaattttcagggcttgtgctgtatctagggatagattatatggcctctgcagaacctctgtaaagactcttaggcaggattgccttcatggtagttgcaggtaattgctctgtaaaccctcagatccctactctaagcttgtcatcctttagtctttgtttcccaaggataatagaatgcctggataacttgtactcctcgaatagctgccagctgcattaatgtctccttttatctttttttaaaatcttatccctctcatgctaagagtcatagtctcaaggcagcatgagggagtatagctcacggaccacccagcaatctactttagaaaagggtgggaaataagtcagaagatatcttcagtttctgtagatcaagttaagcataaactagccatgctacgcttagaatgagcaataagcccagaatcagcatttgtagtcatttatggtgtttttccaccttgtaaaataaagccatttgatgttgaaaagtctcagaattgctgaaataaatacatttcttttggg

SEQ ID NO: 28722 - DNA, 1087 bp, Bovine  19866881306836
gcaaaaagctttcattgagtaactgtgttggcaacaaaattccgcataaaaaatgatgtagacatttactcagaagttttagttagaagaaatattgtgagatgttaggagcaacactgaccaatccgttaggataaaacttgtacattgtaatgtttgtcatttatttcttgtttcaggtatactatttattctccaaaagatggacagccttgtatggatcatgacagacaaactggggaggtaattatttgtgacatagaatagttgttgtcataattcttaatatagtcatagagtttaagaaataaatcagaaacctaaaaatagctttattccagtattgaggtataagtcatgatactctggtggctattaaggaggaggcaggtagtcatcataggtacctgtatcttctctagaaccttgtctagaaccttgctggtaggtttagctgcatcagcttgtgctggaaaagcacattcttggatttttttttttttttttgtcacttagcttggcttgcaggattcccagatcagggattgaacctgggcccttggcagtgaaaatgtggtgtcctaaccactacactgccagagaattcctagagaagtagattcttgaacctcacccccaaattgctaaatcagaagctctgagggtggagcccaggaatctgtcttttaatgtgttctctgtgtgattcatatgcctgctcatgtttgagaagcaccacttggagagtgcactgttctaaaaagagaccatgaggaaaggtaatgagatatgtggtttactcatgtacacagattccatttatacttgctttggtcacatgcctacttattttcaaagtacttcaagtcatgcatgacatcagttcattctgcattcctggaggacacattagtgacattgttccctgtaatacttgaatgaagcaagggaaaatcattcgtctaaagccttggcacagtaaatcaacaacaatgaactttgtagtccctatgagtgtgtcattctctgttaccacctttgaacgcattcataggctaggactacctttcaaaatcagccttcaatt

SEQ ID NO: 28723 - DNA, 2923 bp, Bovine  19866881317490
tggccctgcggggcttacactctgtccaatgcagcaggcgcagcaccctgcccatggcgtctgctcacatcactcagagtaaggggcctacgggaactggttggcacacgccgaggccccccactctactccttgctaccctctaccccactgcctccgggcctttacattagctgttctcaatgcttagtagctcagtggtaaagaaactgcctgcaatgcaggagacctgggttcaagccttgggttgggaagatcccctggaaaaggacatggcaacccactccagtatttttgcctggagaattccagggacagaggagcctggctacagtccatgggatcacaaagaattggacacgacagtgactaacacttttttttttttttttaatttaaactggagccgattatacagagtgaagccagaaagaaaaacaccaatacagtatactaacgcatatatatggaatttagaaagatggtaacgataaccctgtatgcgagacagcaaaagagacacagatgtatagaacagttttttggactaacactttcatttatgcttggaaagcctttccccagataccactgagatgcactcattttctccaggttcctgctccaatgtcgccttctcaggtgaacttgactactcgccctatataaataatcccccagagctcccactaccctttttccacttttttttttgttctcattttatcaccatctaaaatatcttacacttgttgcacagcagaaacacaacataattgctgtaaagcaattatattccagttaacaaataaaatttaaaaatcaaaaaaagaaaaatatcttatgtatttacttggctacacagtctcttccccaatactgggaggaaagcaccccaagggtattctgtccatggctctatcccaagcatagagctggcattcaacaaatatttattgaataaaaggctgaatgaatgggtgttgtctaaatgggctaagagacttccctggtggtccagtggtgaagacgctgcacttccactgcagggagcatgggtttcgatccctagttggggaactaagatctcacatgccacactgcacggcaaaaaataaaaagttttttaaaagatactgacccaaaagtaaataataaataggcttagaaaatgggaatcccctgcttactggggccctgttctatgctactatctacgtaagcgagtttgtttaatccacatgtgccatgtaaacagctccaccaaacccatcttaaagtcccaaggctgagaagggccgtgcctgtgctaagacccagaactatctgagtcaagccacatttacactggaagaatgaacagctcccatccaaagaagagctcacagaggaatcattttttaaaatattaataattaacaccctcttaatgtgttttccctgcccctccaggttcacgactacctccgcagcaagctgtgctccctctacgaaaatgactgcatttttgataaatttgagtgtgtgtggaatgggtcagacaggtaagaaaggtctgatggctgggagccttccacgggggggccctctccttgcaccggccctgggccgtgtatcttaaggggctgcaaccaaagagccatcagaatcggccctgaggcctggcagggctgcaccggtggcccagcgggtgaccctcgaggtcaagtctggaaaggaacaggcgatgggtgagaccctggactcctctttcagaactggctcaggtgaccctttaacctcacaaaaatcctaccttatacaggcaagaccctcccagagctgggtccatatacctaaaatgaagctcccctggcaaattttaaggatgaactattccaatgactttaaagtgtgctgtctggatgggaaattatccctcgaggctgcccgcagagactagcctaaggccctggtggtcatgaactgaattctcatcagccctcgtttattctgtgccctcaaagagatttatgactattagaggcctttggtttcaacagcacttccttatacctccccgcagtttctttttggcttgatgaatagatgctgctgtgatttccaggagaagccagcacaggctaccaggggctgttccttagtgaaggcagcaccagcagtcatactgaaaagcagggaaattctatcactgcaaaacattcagaggcgagcttctagtgagcacaggctctacctctctgacccctgttgggttttttgggccagtgatccaaaaccagccttctactcagcaggcctagcaagagtcaccacatggtagacgacccagatcacaccacccagttagtggagggcagagggcccagagcaaagcaactgttacttagttgaacaaaggccctcaggggaaaagtagctatccttgccctgttattttattttcgtttccattggtaatttattcatttattcaatgttcattatgaatagattttttaaaatatttgtggttatttttgttcaagttccccttctatcttaaccaagattcaaaacctatacttactaggtactttcacacatcatgattttttaatcctgaccacaatccatcaagattgctttcactgtccccattttacagctgaggaaactgaggctcagccagatactagttcaggagcttgggcagatcactgtaagtagtagagacaagaggaagaatttaaatcctaaaatgaacattctttccaccacattacagtttctttccataaccgagaaaatgttatttttggtccagataaggttgaaattacttttttacttttttccaaaaaagactttctcctatggtttaaaaacaagtcgggtggtggtaatggaagcagaggtcagtgcgtgggaagcaataaggcca

SEQ ID NO: 28724 - DNA, 2593 bp, Bovine  19866881340346
ctgtgttcctcctgccccacactggatgccctgcgttaaatgtgttctgatcagctggcggctattccagggacccacacagcagattggagtccagctctggttttccatagatgggcagtcctgccccactaatggggatttaagcaccttcctttcaggcaagacagcaggtcgagaatataaggcacagatgtgtatgattagatttagagttttccaaattgttgcttaaacaccttctgtggcccagctctctattttgatgactgggccatttgcccctggtttagacacttgagacactcaccccacctcctcccttcacttctctttgttatagaaaaattcaggagagaaaagacctaggaggagtgaaaatttaacttgagagatcttgactgaatgccatcagtaagatcaagaatgaataaaacagtctctaaaaggaagaaaacgaaagtgacggggctgacaacagccttgacaattttcactcaaatggcctccaagtaggctgcgatatttgaggttagcatcatatgtggatatcacattcgtgtctttatcatgaccttcctaatcatgtcatgtcccctcactgggaagactctgatgcagacagttgggggtaggagaacttttattttctacattgcaattttgttgagaaatctggccccctaaaatctattctggaattttaaaactattttaagatgatgtactttatgaaaccttgataagctctttggacactttgggaaggagatggataaaaaatagtattttcagtgaatttatcactaaaccaggatagaaattgttattagtaatgctggatggaacgcaacgagttgctacagcttaaggaagaaagaaatgtaccaattgtatacaattcttataggaatgtactctttttaacttaatttttattggagtttcattgctttacaatattgtgttagttttagcgccagcaaaacgaatcagccatacatgtatcccctcttttggacttccttcccattcaggtcaccacagtgctttaagcagagttccctgtgctatacagtatgtcctcactagttatctattttatatagtaccaatagtgtctctgtggcaatcccaagctcccaattcctcccaccccacccctcactttcccccttggtatccatgtatttgttgtctatgtctctatttctgctttgcaaataaaatcatctatatcatttttctagattccacaggcatgcgttaatacacaatgtttgtttttctctttctgacttacttcactctgtctggcagtatctaggtccatccacatctctacaaatgacccagcttcactccttttcatggctgagtgatattccacttcatatatgtagcttagacttaaaagtggcaggcagtttggacccttatcttgtccagcattctgccatttgtgtgattccttctaggatcgccctgctgagtgatcctccaatgttctatgaatagcctcagccctcaaaagttgaagccctcatattccttctccagggaatcttcctgacccagggatcgacactgctgggcactggcaggcaggttcgctactactgagcctccagggaagctcaggctatttctccctcttggctattgtgattaaccctatgtgaacattggtgtacaagtagctgagttcctgctttcaattcctttggatatacacacctagtgggggaattgccaagacatatatttatgtgggtatatagtttccccaacgccactgttgaagagactgtctgctccattgtgtgtgcttggcgtctttatatgtgtgtgggtttggctctgggctgtctattctgttccatttgtctacatgtctgtccctgtgccagtatcacactgtgtactatagctttgtataatattttggaattgtgatgcttccaaccttgttattctttcttaagagagctttggctatgctgggtcttttgtgattccatataaatatggggattgttttttctgtttatttaaaaatcccactggaattttgatgaggacagcattgactctgtagatctctttgggttctgtggaggttttaataatactgcctgccagtccatgaatgtaaaatgtctttctactcgtttgtgtcttctttaatttctttcatcagtgttgtataatttttgagtactagtctttcacctccttgattaggtcttttcctaagtatgtttttttaatactataataaaaaggattgttttcttaatttctcttttggattgttcactgctggtatatagaaatatagttgatttttgtgttttgattttacatcttgcaacattgctaaatttgtttattagctataatagattttttttagatttctttaggtagaagatcatatcatctgtggatactttgcctccttgttttctgatctggatgtattttctttttctttcccaattgttctagctagaactatgtgaatagaagtagtgaatgggcattcttgtctgttctagtcatagaggaaaagctttcaaactttccccat

SEQ ID NO: 28725 - DNA, 2917 bp, Bovine  19866881368413
taaatcattcactgcttgtaaaggcaaccaatcacactggataacaatgctgccctcagattattctgtatagaaccttgaggtaggaagagggaagcaggcaaagaaagaacttacaaaatcaaatcagagacctttggagttctcctcgtcagtcattatgccaatggtcctcaagcctagcagatattcagaactgcctggaatatagccgagaactatgggtaaatctcttggccctgtgcttggagattctgaattggccagctggggatgatttaagacattcttagaatctgatgatcacccagattggatgaaccacggtctaaacccatgcatcctttctgctccaaatccctcctccccacaacaaaacagaaacctcacctgtgcccaaggttctagcaacttctaccatctacttcactgttttttttttctagcctctgtttactcatattttggtttatatcaactattcagatgaatatatcaggcattctattttgcacaagagtcagaatagtagaatggatttttagaatcatacagacatgaattcaagtccaagtactattaactagtgtctgacctcaggcaggatatttaaccaatctggctttgggtcccacatctctgaaatgaggtttattttagtacctacatgcatgtatgcatgctcagttgtgtccaactcttttgcgaccccatggactgtagccctccaggctcctctgtccatgggatttttctggcaagaatatcggagtaggttgccatttctttctccagggtaccttcctgacccagggattgaacctgtgtctccgcattgcaggcagatgtgagccacccgggaagcctattttagtacttacattacaggtttaccttgaagattaaagtagccaaaggagcatctctggaagagagcaaatgttaacaagtgcctgctgctcttattgttatttcagtggaagtagttcctttgtctcactgaatattagccaaagaacaggacagggacatctacaaccatcacccccaaaaggcaaatgtgtcaaaataccaacgcttggtggggagggtagtgcctgagactcctgtggagtgctttctgatcccataaatgaaaccccatgatacagaccgacagaatcagataatgatggcaatcaataatgataacagaaatgattatttattttcataaacacagagtatgtgcatcccgctgagttacacacatcacatgccagcatccacttgcagggcagtcaatcaatgggggattgcaatatccccccacggagacaggagggaggatgagcggaggttgagaaattacccaccccagagcgacacattcacaaagttaatctaatccaggggccgtccgggtgccattgtgagcctgtgaatatggaacagccttgattgattgtgcactgcagtagctaaatacttcattgttacttgcaacaaatataaggaaaggaaggctgaaactgtaaaagggttggctctaaagcccccagagcagcaacaaaccacaaagtgaagtctagaaaaattaaaaatgggtaggggaagactgtatctgtgtcctaagaggcctctgttgtcaaagtgtaagcccaaaatgaaaacctaaggtgctgatggtgatcctgcctcaaccaataatttgccccgccatgggcctgggattacccattctcccggagtgagcatcaccacagttatcacaggggcagcaagagagcacagaggttgtgtctagacagaatgcatctgatcctcagttctgcctcccagagcctcccagttcttcctcttttcttgtggagataatcacatccaggttatcagaaacagggaactaacagtgcatgtcctgcttgactcccaagatccttggagcattaaatgattaccgtttcccgccactgcctgcccaccgcccagcatgaaagacgcatcctgcaaactcttccctagtcttacccctctgttcttcctctgaacgaccatggtgatctcctgtgcttttctctggatgcttacctgatttggtgtttctcaaagtctgacccagggatcacctgtatcagaatcccctgggggtggtttctaggagggagctggtcagtaacaacattgggtacgactcagacctttgtcctttgagcggctccatcttgacaactgaactcgcacagtgtgataacctagtgattgcactgttttcatcagtcacatttttacaaataggtagactcatttatcggagaaggtgatggcaccccactccagtactcttgcctggaaaatcccaaggatggaggagcctggtaggctgcagtccatgggggtcgcgaaagagttggacatgactgagcaacttccctttctccctttccctttcagacctttgtaaccagaattcctagtgctgaggccagtgactgtgttctaaaatatatatacaagtgactgaggggcactgtgctttgaaatccactgcttgaagtgatttcaggttgtagccatctgtaatgctcccctccttgcccgtggatggcagcgtgcttcactcatctttgtaagacccactttgtagtacgtacttcatacagtgcctggtgcatagtaggcactcaataagtaggataacaagatgaaaagtcctacgtgtcgatgttattattctcactgtcgtctagatcaagaaccacgcaataaatagttctgtatgatggtgattgggcaggagccatgggatcagacagacctgggctcttttctgggctttgccacttatcatctatgaggccgatgcttatctccctgatctcctctttacacatctataaaatgggcatgatgcataagccacaggactgtgatgatg

SEQ ID NO: 28726 - DNA, 982 bp, Bovine  19866881376538
tcctgtaatggcaagcggattctttacctgagccaccccacaaattccccacatttggataaatgagctaatgtgctacttccagagagcttagttttaggtaataagctctcctctctttgtgattcagttcaatttagttcagttgctcagtcatgtccgactcattgtgatcccatggactgcacaacatgccaggcttccctgtccatcaccaactcatatccatcaagttggtaatgccgtccaatcatctcatcctctgtcatccctttttcctcccttcaactttcccccagtatcagggtcttttccaatgagtcagttcttcgcattaggtggccaaaatattggtttcagcttcagcagcagtccttccaatgaattttcaggactgatttcattgatgtctaagcatccttaaagatcagctcagccatcactcctgggaagtcttttattttcccatctgtgagatatccttcttatctgttcccacagaattttgtttcagtctatcataccaattagagtatttttattatctggactcaattgtctcacagatgagactgtgaacttgagggcaagaagtgtgttttctattttaccagtacctagcatatattcttatcaagatttattaggcaggcaaataattgcaagcgtgaatgacttagcagagttacattaacaaatgaaagagaattttatctcatagactataaatatcagcattccccatgattagacagatgtggatatattcgtatgtctcagaagtctcatttaaaacaaaaaagtatgagaaacagttgggtatgggcattaaatgcaaactgtatgggcattgaaacctgaccaactaggttgagagggcttctctggtggctcagatggtaaagaatctgcctgaaaggcaggagacctgagttcaattcctacatcaggaagatccccggagaagaaagacaacccactc

SEQ ID NO: 28727 - DNA, 1040 bp, Bovine  19866881392709
taattgtcaaaagaaccctgcaaagaggcatgtattttcttctattagctgtaaaaagagtttcagagaggtaactaatttacttggactttaagttctgtgagagccaagtatctggtacagaggtatcattcagctaaatgttggttgaattaaatttatccaaagtccttgatgggcagcagtgggccaagcctgaatttgaacccaaagctgttggtccttaaagcccatcttctttccactactgtttctcctctaaggaaaatttcttgtagagaaaacacagaaccaacaatattagcttttcgtttttgctcttagctttttctgctcaagctacataaaacttgagttttcaacatttggccccaaataccattttcctctgtgctgtttgcccagagatgatgctaaagataaacttgacttcctggcaacaactcagccaggaactgagaaactgttagaacaaactcttcctgataccctaagggaacaaaaataaacatttggaaaaaataaagttgccataatggtaacactctttgcattttagactctgtctccccctccctacccgcagggtagggtgggctagtcgccatccagacacagccaaaaagcagcaagttagaactttatcttgttttattgttatgctttgcaattttatttttaacagaaatctggctctcccaagtcactgatgactactccatgtggtcagcagatttaaaagtcttttcctaaactatagtttaaaaaaagagagagagagattaagttttttaaatcgtattggggtataattgatttacagggctgtgttcgtttcaggtgtacagcaaagtgaatgttttatgtgtgtgaaactgtcagttgctcagttgtttccaactctttgtgaccccatagactgtatgcccaccaggctcctctgtccatgggatttcccaggcaagagtactggagtggggtgccatttcttcctccaggggatcttcccaacccaggaatcgaacccacatgtcttatgt

SEQ ID NO: 28728 - DNA, 681 bp, Bovine  19866881449936
ctggctgaaaagttagagaagatatccaggacatcagagcattcatggtcctagtagagggatcaggagagtctgtaagcccagtccggcaaagcagcaaagcaagccattcattactcccaaagccatccaatgttggcagtctctccagccttaagatcctggtatcctctcatagtaagcagacaggcagcagcctgcccaacctcaacagatggtgtggagtcccttgtgccattggcatcatgcgtcctttagatttattcaaatgctctcaaaaaaaaaaaagaaaagaaagaaaaaaaaaaaaaggaataccctttggggccataaagtcccaaatctagcaatttcctgctgtatcacagcaaagtaccttccccccagccctgcccctctggctgttgttgagatggttaaccagtaattcctgaaaacaattctcttctgacacatgcacagcattttcctttgtaagaacgtgaaggcttgatgcctccagagcccattacatagacagattggcccctgagataattacaagaagatagtctaatgggctcgattaaggcaatcccattaccttggtgaagaatcaccagtgaggtgcaaacccagaggaagtcttccccatcacaaaaaataagtactttctacctagaaacagaaagagcattcagt

SEQ ID NO: 28729 - DNA, 1376 bp, Bovine  19866881485633
aatggagggagaccacaggtaaaggctgatcctgggccggctcctctttctggacctcacactggacactgcacaggaactcacgcccacgatggagggtcaggagggggccccacgcctctatcccgtagtgtgggggctgagcacacaggtagctccaagcttagcgggtctgggtggaaattcagcaacagagctgaattcagcaacatagcaacagagctatgttatgaagctttggacaagtggcttgatctttccaagcttcattttccttatctgtcaaatagacataagaggcatatataccctctagtgtggttgagggtcagatgagatctttcacgtcaagtgcctagcacagggcttgtacccacaataacacaggaggcagcagcaatgcagaagtggtgctgcttaatgcaagcctgctgtgcaatgagtctggaagcatgatgtgcttttccactggaaccagatcttaagagctactggttgttaagtcgatttctaggtcttctatctgggcctttgatacacaacagctttgtctctggaccatcagttgatacataccttcctcagtatacgcacctctcatttggtgctgaacattgtcagcccctccccaccccacccccattctgatgactcaggcacaggagagagagagtaaaggaaactggggaggagggtgaaaaaggaacagactcagaatcacgcacagggttttaaatcgccgacttctgctgacatttcttctgtgcagaagcacagctggcaggcttttccgtttggagacacggccgacagtttccccacaatggggatacaactggcaatcttcctacagagtaaggcagatggcaattttccttcagaggtatgtgcaggccacagttttgcccctggagaggaaaggctcactgattgagatgcagccggtaatctttactatacagaagacacattgaataattttgtccagcgagaaaaatggccaacagttttcccacggtgggtaagaatgcccatggaccaataatgctcgcctttatccagctaaggacagcgagagaagtttaagatttaattagtggctattgtactaccgtgggcataatgacatagtctccagacatgagctggagactggagcttggatccgatgaagactcagcggattctgaactgggaaacgaccaagcccagtgggctctacttttacagtttgtttttcatacagaccttcactaatcctacagatgattgtttaacagtgaagactgtagcaacacaatgcatagcatgatggagcaggaacagttcatctaggagagaactgtggtctctgactttgtgtaactgtttccatg

SEQ ID NO: 28730 - DNA, 939 bp, Bovine  19866881491471
tcatcaaagagcaggccgtggcttgaggaagccacagcgactgtgagggcaccgaactgtctttcccagctgtattttagtgtcggggaaaatgtgaccggaggaagtggagtgcaagctgaaggcaaagtggctcagagcctttcttggaagttgtaattatcaaatctgttctgcaaagctcctcttccctttgcccagggcttctgcaaggtgaaggggagcaccatcttcacttgtactaactcagccaggaggagtgggagtgttagggaacctggcctggggcagcctctcattctggcagtaaacaacatactgtttcccacctcttccaagccttgacccacctgtcagctaattaagacccagcacccaggagtgtttccctgctcaccagctgtctggcggccctttgatgcaccccatatgtctcagccccaaccccaaccccctttctttctccccttttgtgtgtctttctgtaataggcactcaacatacagctaaaaatcactgggataatatgataaaacatggcattatgctggggtcctggaaactgggctgggggtggcagggagtgaagaaatatgatatgaaaaagtcccggttcagaagttactcatctcactgactgccagctggatgagtaacttcaagagcaaaagtagaacactcacaaataatggtggctagcatccattctgagagcaagactgcaagtcaggtacctgccacgggcattgtctcagggggtcctcctgataacactcacgaggttagtgctgttgacattcttactttcagaggaggacgctgaagcttgggaggtggtgacttttgcagggtgagagcttttgagtgctggaaccctctttcaacccaagtctacctgaccctgatgcctgtgcactactgtatctctggcccatcagg

SEQ ID NO: 28731 - DNA, 895 bp, Bovine  19866881609385
ctttgaaaggaaaacccgagtaatctctgcagatgctgggtttgaaagaatcattgtccctcatcagaaagcataattaagagcctctctgcccgttaaatgaggcagtgaatactaacacattttgtaagagtataaaatgctctataaatgttagttattgttattcccgagctccatgggacagcggcttatgttgcagaactgcgggttcagaatccttcagaagtagtaaatttacccagtagtcaaggaaaggaaatgcctctggtttatttccttccatcatcccgaaaactaaatagaaattcattcttctcctgtgtttccaaaatccagggtcagagatatgcaaatttaaatatgcaggctgcttttaaatgatacatgaaagggatttttgaaatgaatgtgctgtgattgaatttctggtcagtcacccagaaggcattttgcactaagctctggacccaattccactgaaaatgcatgaaactttggtgcctgcagccagtctaaccccagacggagatcagggtccttgccacagaacttccattaaacgatgcagacccccaggctcaaagttgaaaaacaaattagcacaagcctaaaagaaatccagtacaaagttactttaaaaataccttttccataaccttagcctgacgacataaactctttgatttcaagctgcttgataagaacaatgtgcattaatatataacttagttttttcaatggaggcacctttgtcagtttcaaaagaatttggctattctttgggagtaagaatattgtgaataccaatagataagaaacatggataaaataaatcacttattgtgtgtgacttggactgaggtgatttgtaagagtaactgacaggagttgg

SEQ ID NO: 28732 - DNA, 1433 bp, Bovine  19866881666581
ttttggagccccccaaaaaagtctgacactgtttccctgtttccccatctatttcccatgaagtgatgggaccagataccatgatcttcgttttctgaatgttgagctttaagccaactttttcactctccactttcactttcatcaagaggcttttgagttcctcttcacttctgccataagggtggtgtcatctgcatatctgaggttattgatatttctcccagcaatcttgattccagcttgtgcttcttccagcccagtgtttctcattcagttaattagtattaattaattaaccagtttttagttagtacttgcctagcatatattcttttaattaataatattgttgtataatttttgtttcatttaaatttcttattaatagcctgctcaccattttggggagaagttcttcatcaactttcttggaaaaaacaaaacaaaacatgtagatgactaatcctcctgcagcctgtatccactgggcctcaccgtcctcctttggtggcagtaattgtagctgagcaagcaggcactgttctatcctatgctttttttaagtattcacctattttaactaaataggaatattttaaatcagtgttttatttattgtagtatctaattaaaaagaacttcaaagctttttaatgtatttaagtaagtctttaatcatccctttgaatttgaagtggataaccctatcaggtcatgataaccctaatttttaatcttaactcatttaaatttcaagataaccatggaaagattatcagtaaatggctcacttctgtgtgaacccagatcttttttagcttttttttaaacaagtctactgaaatatagagtggattattctgtatctgttgtgtctaacaggaaagaaaaggaacagccaaagtagactttttgaagaagattgagaaagaagtccaacaaaaatgggatgccaagaaggtgtttgaggtcaatgcatgtaatttagagaaacagaccaggtgagcaatcatttgtgaggttctccatgtcatacttccataaccattggctcagaaaaggctgtgtggcaggaataaagcagattgtatttataatgtctgaaataggctgaaggaggtgacttccattttctctatttcaaattagcatcctctttcctgtggaattcttaaaggattttttcctatgtaaaggtttttttaaaaactattatttctcatagttagacaaaggagagtgtttttaagttttgtctttgttgactgataaaaggatgtcgttctgttacagagattcatattatagtgataattatctccaaaggcacagaatataaattttttaagggtttctgtaatcttattttattaaatgtatattgcctttgatgttaagaattggatagtaacataattaaatgatactga

SEQ ID NO: 28733 - DNA, 1332 bp, Bovine  19866881685864
atggaagaaatggaaatctaacttagctagtctgacctcagagcatgtaatcttatctactctgctatgctgccggctcctagcagataaacaatgatatgtacttgatgatctctaaaggatcgttcagttctaacattctatgatttgtcttaatgaatctgtaataaagcattcaactaggccctgtaatctcaaatcgtatgaagcaaactaaggaagcgcaataaaatctcttcatatgacctgaaagttagagttcaggtttcctaggattatcagaattggtctttctccacatgaaatccttcaagaaatgcaattgttttcttgctatcagtcaatatctaatattttctcctcatatgaaaagagatgacacagacaatatctaaagacattccagaaagaataaaaaaaataaatatgcaatactgttggcttgatctttaaacacaactggactaaaggtaaatctgataaatgcagatttctgagggcggaaaaaattctcttctttaaaacacctaaatttaatataatcaaataactatttataaattatcaatactagccttgaaaaaatactgttggtggctaactgaatatatcaaagctaaaagaaattattttaagacctatttgttctttatacaaaatactgagtgatcacaatcaaatcaaaatattctcatttgttcttttaaaatcatcatcagagttctttttaaaaaggaaaactgattatctaattactcttcttaaaaaagaaaaacagctaactccataacggatgtaataaaaaagttgctagctactccttacccctcataaataacatgaagtacagctcatacaagaagcatactgacacttttgcattaacctgaagtactcacagcttctgggaaacagcaaacatctgttaaaaaacaaaaacaaaaaacaaagtatggtacaaactatttctatttgaggcctcaataaggaaaaaaaatttattaggtccaggaattgaagaaaacttggtatagttacaagtacatgcagaatttggtggtcagaaattaaatctatttaggtccagcctaaggttctcagagcctacctataggcacaatcatagcagtaatatcctcaaaaaccagggtaaatctcctgtgcctttgtttaatgaactaaatagatcattgtatcaccaatatctgcccgtagcccattttcagtaagatgaattttcttgttcatgagatccacgtggaaaacagcatgctcagaaatgggggtcttttcagcgtgctcttttcccaggacaggaactcgccgaggccc

SEQ ID NO: 28734 - DNA, 1018 bp, Bovine  19866880369407
atggggtcccagtaaaagacaggagatagtgtttttaaaaacccagtagaatttccagttggctcttttcaaatgacgatgaagacttaaatgactatgtgttaatgttgaagagcaacttctctgagtgaggtcctcctaaataaaagcagaaaactccaagataactactttttactgtttacatctgttcttcttaagttgtttagactccatttatgggtttcttaggaaatgtgaattgtatgatatttcatgggggttcttagatggaaaatttcttagaagatagctgaaagagatacagttttgtgactaaggagaagtagtattagaaaagaaagaaaagggtctagtttagagacttgtttgaagttaaactgattctgtaccatactttgaaaattaagtcttgtagatgaatgtgtcacttcataaaattaatagttctcttttatttttgataacttttgcagttgctttgtattcccagtctgtttatgtttgtggtatgtcccctccaaaaatgaatactgtaggtgaattcaaacctttggagaaatgatttcagcataatggcagattttactattttgtaaactaaggtttcttttccctctttttcttcttctagtgagagtgagtagtagacagctgatcttaagaggactgtgcattttattttcatacttagctgttattttaatatttcattgaggaagttgtgtgttttcccccctagctagttcactttagaaaattttgttggtgtcagtatataaacaactgagaggttattaagtaggtctattcagtttttgcttccctggtggttcagagggtaaagcgtctgcctgcaatgtgggagacccgggttcgatctctgggttgggaagatcccctggagaaggaaatggcaacccactccggtacccttgtctggaaaatcccatggactgaggagcctggtaatctatagtccatggggtcgcaaagagtcgacgaacgacttcactta

SEQ ID NO: 28735 - DNA, 1577 bp, Bovine  19866880597259
taaataaatttttaaaaggaaaaagaaaatcactatttggtcaccatgccaagtaggggttgattcaggaggctaagggtgtctggtggaggattgatggggaataagatgttggcgtaatctaggaatatcttcccacaaaatactagttaccaagagaaaaaatagtgtctttatggtggagaaacctgcaggcaccaacatgaccaggtgatgaaggttcatggtaccagtgacgcaacaggttggcattgtgtgccttatgacgtgatgcattgagaagggcacagcatcagttctgtgccaagaaaacatggcctgcgtctagtcctaaggaaacatgtgggtcatcattcaacatacaaaaccagaagtttctaaaacttctaaggacatgaaagataggaaaagactatggagctatttcaaaatggagaagcctgaatgatatgactgctcaatgcaacacatgttcctggagggaatcctggaccggagggaagaagaaacattattgggtcagtttggggatgggagaaggagaaagagaacaagtgagcacaaatacagtgaattgttaacattaggaaactagatgaaagggatctggaagttctttgtactgcacttgtaacttttctgtaggtttgaaaacatttcaaaatatattattttttaaaaccacgcaattgcttattttaccaaaccattttagatcaaaggctcattgcttaatttcaaccaattctgttcttcagggcaaagaggtaaagatatggtatgcctaaccccaaaccacaggtatgcaaatcatgttgctaaccaggccccaattcatactaattcatcaacatttccatgcccagtgctgcatcagctctctcaggtccaactgagacaccaaggtttgcagacttcacttccaatgtcgcaggtgctcattgctcaaaacagccccacccctgctgtgatgcaacaaagaggtactcctttgtggtaacagtccttatctgtcatctgtcagcctttggcaaacatgtatctcttcagtgtccctctgatttttttctacgtgctcttcctctgtcacctcattctctgctcctgctgccttgagggcttagggggtagttttgaggctcaatagttcgtggggacacgacttagcaactaaacaacaacaacctcctcaattagcatcctacatgcagggtctccctccgaagtgtcctgtccctcaagcacaaaagttctacaccagggataaccaaatattgggttggccaaaaatgtctttcaagttcttccataagcgggcccagaaaacctgaatgaactttttggcaacataactatatgaaagaaattagataatatgaataattaaagaatacaaattaaaccacaatgtggttgtcatgaattgtaaattagtagtcttcatggcggcatgatggtaatgtatattgagaatcatgaaaatattcatgccttatgtcatacattttgatacgataacctgacttttagaacttttcccagaaagattatgcaaaagatagagtattatttgcaat

SEQ ID NO: 28736 - DNA, 1835 bp, Bovine  19866880998125
ctagaaacacagaatgacaccttggaccttcagtgagcgaaaagcctgaagcaatatattaacacagggctctgaccttcctcgcatatttctcctttgtatcctggcacacagatgcaaactcccatgatgcaggtgccgtggccaaagcacgttggatcaatgcattgctcttctggaacatcgcactctggccccttccagccatttcggcagacacagtgtcctttttcatattctccattcccaccacacagcacagggcacgaatctgaaggttggcaaatgaacttgtaatgttctcataatgcttgtaaaatctccaaagagtaattctctattgattctcatataatatttctggcaaaaaaattgtactatttctggcttagcctttattaaatcggcacatgttcatgattacaaacagaattttcctcttatgggattgggggaaagataaattataaaaacaccctgagtgaagaaattatttcaagcacttgcttttgatactcttaaacaactatcatcatcaccatcatcattattataagttaggatttttctctcttttggggtttcttcctcaggcagataaaattcatagaactaggaggaaggtattcctattatagagtgttatctttcaaaagttgggcatttagagaattggtactggacagatggtctgtgcctattccagctgtgcagaccttcattggaacattcactctgctctgttattcctttggcttcttattaaaaaaaatatggacctccctgagggcagggcctatatctcgtcttattcatttttttccataccagccataacctctgcttctaccccctaccctccttaagatctattggagaactgggaatctagcaagtgctattgaattctctgctgaatagaatttaatctaaagaaactgagtggctgagaaacctgagatgaaagcattagcagactgagaactttaagaacacattgtgaacaagcagaaagcatctctaaagtattgataataactgtaagcctgtggggaaaacccagcatgatttacccacagcttttcaagaattaaactatgggcaagtctggtttagtaaagtttgaaactttaacttctgccttcccagtctttgctttataagctactcagctagctggtgactgtccacctcttccactttaccctagtttgtataagtggttacccaaagttcctccattataaatgagtttatgaagggaatagaagtactgagttggccaaaaggtttgcttgagcttttccgtaagatgctatggaaaaacctgaattaactttttggccaatccaatatcatggagtagttggtttcagaggatccaggtatctcagtggttagataaccttagttaagtgatttgacttctctgatgttatttctttgcccattaagccaggataatagatctatagcataggattattatacaatatatgaattaaaagtcccacaaagtgtttagaatggtgcctggcagagcaagtgctcaacttccggtagagaccatcgcggatgttggtactgctactctcactcctatccctcctccttttcctattgttactaattctaagttctcaaatgacatcaagttccctaaccaatcggtataacagggcaaccttacctctagcgcagtcaggtccaaggaatcctgggaagcagtgacaatggccagagatacattctccatttccattgcaatttgtcgaacagtcatccattatttctattaatagagagaaaaagaagaaaaaaaaaaaagaacaaag

SEQ ID NO: 28737 - DNA, 929 bp, Bovine  19866881048156
tgtcctaggctttcatatcctttaagtaaaagatactgaaactatggttgactcaaagggcagctgagtgcattttaatatccacatgtcctgtgaaagaatattgaagaaccacagaattctaatgcaggattatgttccatctgaatgcacaatgattacatggatggagttgcagcagttttttactttggtacaaaatgaatctttactgactgggtctatgaaataaatatagtgaaactgtaagtaaatttagaattcaacctgttgttcagggtccagaattgttattgcataaatggccgccaaatgtaactatgctgtaggtcaaaagaaaacaaagccaaaaaacaaaaacaacacacacacacacacccccccccccacctcttcagctaagtctacaaggaaaggtcagaaaggtgcattttgtgttgctgcttaactttcaattcccaagggtacttgtttgagtgcaactgcatgtgtactgctttgagaaggagggactgtttggagaacctagaactttggtgtgaaataaaagatttgcaaagtactcttagggagaggagggagatccagacagcagagtaagaggatgtggaggtcacatccctctaggaacatatcaaaaatacatgtacaagacttccctggtgttcccatggctaagactccacacgcccaatgcacagcatctgggtttgatcccggtcagtgaactaggtcccacatgctgcaactagagttggcatgccacaactagagatcccacacgttgtgaagactgaaggttccctgtaccgcaactaagaactggcacagccaaaataaataaataattattttaaaaagtacatctacgtgtgggacaatcctcactgaaaactaactgtaaactggtaggactcctgtatgaccaa

SEQ ID NO: 28738 - DNA, 1048 bp, Bovine  19866881171293
aggaggaggagaagggcattaagcaccacaagtaataggtttgttcactctgcgactggctggcaaacactgctgaagcatgaagccgaaccacaggggctggaatttctcttcacttttctaagtttattgctcaaatgccctcctctgggtcacaataacttggctcctgtctctctcaggtcctgactttctccctgtacttgagttcagtgagtcatttaaatatgtatctccatgtcatggaagtttcatttaccttcttttcttcgtttcgactgaatttccttaagcatgaaggttttttgtttcctttgttcctctggagtgcaataaataagcatctgctgctgctgctgctgctaagtcgcttcagtcgtgtctgactctttgtgaccccagagaccgcagcccaccaggctcccccgtccctgggattctccaggcaagaacactggagtgggctgccatttccttctccaatgcgtgaaagtgaaaagcggaagtgaagcatctactatctaaataaatactttgactgcagccatttgaaatcaccccagacttgttattgaactgggggagatacttcaaaatggagatgactaagtctcttggaagaaggcaaactttgactagatctcctggcagagaaggtctttcttgtggtacgtgagcatttgagttttgggggttctgtttaaagctttaaaaggttagaactgcacatagtaaacataatgagaagcaactaagcctgtgcaccacaactatcaaagtccacatgctccagggcccgtgagccacaactacggggcccatgcaccacaagccctgaaacccacgcacctagagcctgcgtcccacagcaaaagaatgactgcaatgagaagcctgtgcacgacaacagagagcagcccctgctcgccacagccagagaaagctggtgcatggcaacaaagacccagtgcggccaaataaataatacaaaatttaaaaaacaaaacaaaaaataacagatcaagaagaaagaaaaataaacataatg

SEQ ID NO: 28739 - DNA, 1260 bp, Bovine  19866881533017
ccaagcagacactgatctgctttctgtcactatggtttagcttccaatttctagaattttacataaatggaatcccctttcaacaggctttttgcagcataagtatttcaagcttcatgtgttgaacagatcaatgattctttcttttttattgatgaatagcatatatatatttatatatattaatttgtccactcattactgatggatatttgggttatttccagtttttgttggtgttcagttgctaaatcatgtccaactctttgtgacctcatggactgtagcatgccaggctttgctgttctttgctatttccaagaatttgctcaaacttatgtccatggagttgatgatgctatctaaccatctcatcatttgtcacgcacttctcctccttagggctattacacataaagctgctatgaacattcatgtataagactttgtatggacatatgttgtattttaggggggaaaatacctaaaagtaatatttggattatgtggtagttacatatctaacattttaagaaacttccaaacttctttccaaaatggttagattttatatgattcaatgtgactttctttgagcttaccctacttaagatggctgatttaaaatccttgtcaagtttaatgtctggcttcttcaggaacagttatattatattgactgctttttcttccatgtatgggccatacttccttatttcttgcatcccttggggtacaagaaatgggactcaggcaagttaaaatgccacaaagcttactgtttttatcaggatgctactgtttttcttaaaaaaaaaaaaaaaaaaaatgcttcccaagctgcttcaagcttttgattaccatccagagttctgaaaaagttgattctgacagtctttgccagtttatagttgtacttttagaggtgaaagctttaggtgtttcttactctattattttcactgatgtcactcctctaaattttaaagatctggtttactttatacttgcaaccctactcttccaatcagccacatttcaagtactcaatacctacatatggccaatagccaacatgttggacagtgtaggtttataagaaaatttctaagcagagttatttaaaggaatataaatgaaaagtaaggtctttaattgcttttttatacttttccatgaaacggttttcatgggcagggtagggaccctatgaaaccacaggttgcaaataataatagctaccactacttaagcacttta

SEQ ID NO: 28740 - DNA, 1848 bp, Bovine  19866880382445
tgaagctccccaatgaagtgagacttgcaaaacaaaacaaaaaaaaaaattgctaagagaaggcaaagaaggggctttttaaaattctattcaaaggcagaagatcaagaaagggaaagcccacttacagcttctgttgtaaggttagagctgagagagaaagcagacttcctaaatattgttttcttcattctctacaaaggaaacttgagaagcaggttgacatagtagaaaaaactctgtgtatttgtgaggtcaggcaaacttggatataattttctgtttcaatactcagttatattaacctgggtctccttgtccccatctgtaaaatggagaaaagtatttctttctcataggattgttctgagtaatggaagtaatgcattcaaaacactgagccaggctcctagtagtgactcaagtaaataggaacttactaatattactcaaaagagtagtatacatagtgacaggaaacagtactcttcccaaacagaaggaatcataagaaagtacctaacagtgccaatttagaatccatcatctaatatgaagtgcttgtactgcagatttgggggatggaagggtgaggggtacaaataagacctgagaatttttcccatctttgaggaattatggaaaacagaatattgctagaatgacatgggcaaatgtctgctttaagggtgacacgtggaaatctaaaacctggaatttggggggctgtttcttcccgttagtgtaatattcatttgcccagggaagggggaattaaaaaaaaaaaaaaaagctgaaacaaaggagtagattgaattttccaaagaagagcacaatgtgaaggcacagtcttcaaagctaaggtgatgaagaaagaacagatttcttgaatttcctcaaaacttccagaggtaaaacttaagaagaaaaaacttgtatccttaagcaagatgtagtgggttgaatgctgctgctgctgctgctaagtcactttaatcgtgtccgactctgtacgaccccatagacggcagcccacctggctcctctgtccctgggattcttcaggcaagaatactggagtgggttgccatttccttccctaatatctttagaatggtacaattaatgtcttggtgaatgcctctccacttggatactgaggctcttagtttttctctggtttatcaacctctgttcccagaaaaggaccgagacccactcattcatacagattgaaaaactttagtaagatactgcttccaaagtcatttaccttaagtcaaaggagtaaagacctaactgtggattttaggcatcagttagtcaacatttatcactgagcagatatatgtggaacacttaccatgtgttgagttgtattccaagcaatggagatgtacagtgaacacaatagatacaaactccttccatcatgggactggattctagggtggagagtgatgttagacaagaagaaactgggaaatagatgcctataaagggtatgtagtaagtgctttgtagaaaaataaaggacgtggggtggacagggagtggtgggatgggagctctgctttggtttgcatggtcaggaaaggactttctagatgacatcagaagtgcacatttgtcaggggaaagaggataagaatgcaatttgagggcaaggaccctgaaatgactttattttaatcatcctgcctgggtctaatccagaaccgaccatgtgcttagacccctgaatttttttgaatgtacatttcatactggtttgagaaacactttataaaacaattgttacattgctgcaaaacccccgataagctgcagacatagaatcagtaaaag

SEQ ID NO: 28741 - DNA, 1610 bp, Bovine  19866880456050
tccggaccctctgccactcctaggagggtagctggcacagcagaggggctctatcacctggggctgaagtgtgggtgcctgcctgactttggagcctgggaaaagcccaccatttgtggtccgtctggagcgggggttcattggaccactcctggcccacttctcccgccccatttccactacactcgacagtgatcttgaggcttttctacattagaatttttaatattttttcatctaaatgctcatctttagtaaatatataactagatggattgtgaagtgagagaattaaaaagtgctatcttatatctgaacgaataaatcatttatattagctcttctgtttctaggctggtcgggtgttggcaacaaataccagggcatcagtactctttgacatggtggattcattaatttattatttttttagtgctctgacaagttgtttactgtaagccaaatgtcaattagcattggcctgaaaaggagttgctgtgctacatgtgtttgtatttagctttcaagccatcctgattattttggcttttatttgcacaacatatttatcttcaaagactcaccaccaccacacacacacacacacacacacacacacacacacaaatcctacttaaaattttaacattttcttaaaaaccaaaccttgttggcaaccctatcattttagtattgaatttttttctcctgataaggcaaatgacactttagccttagttaatgtaaagcaggaaggtgttaatctcattttcaacatgtcagctctcccaggtagggtattaatacgcaagatcccctgctggcagactcaacagactctttctggctgtgaagtgaagtccaaacctggtaatttttgctttctattattgtatgtgctcaggtctatttcatccattgaaaaagatatatcagtagctaaatgcataaaaagaagcaaagagatgtttgcaaactattgactgaactctatattcagacactatgataggtttgttttaaaatagtcacacactacagatgctgggaaagactgagggcaggaggagaagggtgcaactgaggatgagatggttgaatggcatcactgactcaggggacatgaatttgagcaaactctgggagatagtgaaggatagggaagtctggtgtgctgcagtccatggggtcgcaaagagtcagagacaactttgcgactaaacaatggacatttaggtatgtttgaagataaacagcaactaggtaaggtaaggtaagtcacttcagtcgtgtctgactctgtgcgaccccatagacggcagcccaccaggctcgccggtccctgggattctccaggcaagaacaccggagtgggttgccatttccttctccaatgcatgaaagtgaaaggtcaaagtgaagtcgctcagtcgtgtccgactcttagcgaccccatggactgcagcccaccaggctcctctgtccatgggattttccaggcaagagtcctggagtggggtgccattgccttctccggcgactaggtaaggcatacttaaaagacttatatcttacttaagtaaggcatacctaaaagctctaaggtttta

SEQ ID NO: 28742 - DNA, 2265 bp, Bovine  19866880592879
atttcagagtgaaatgcattttgtcttcatttccttttacttgtgtgcctcaggaacgagatgttagggctgtctttaaatcccagaagagagcaggaaaaaggggtgagatggtaagctagcagtcaaggttttgtttctgtcactagtataggtaactcttctgttaatctgtgtgttctcttaataatttacatccatattttgtagttccccttttgaaatctactttttagtgccttacctcctttttgataaaatatgagaacttctggcctctttttcgctgtgaaatatataacctcatttgtagttagtttgatacaaacacttgaataacagtgagggtaacctgttttttgtgtcacttgtctgatttttataggaaatataatggtcacattgaaagtaagccactaaccattccaaaggatattgatctccatctagaaacaaagtcagttacagaagtggatactttaggtaagggaaatctgggtaaagtgttctgtaaatctcagttttatattatgctagtgaaagtacttgaatttatcttttgttgttagattcttttgttttcctaatcattaagtccattatacagactgaaatctttttcagagctaagaagctcaaaatgacttcatctgaattgaatttgtttttctatccacctaacttatagtaagccttatttttccccatttttcagaagaggccgtcttatgcaagtttgttacacagtttttgtaaatgctgaggttaccgtttttactatctcaaattctaagttgccatctgtatcagttttcgtgttttataatgttgcttgtagaaaggcatctgtatgtttgtattaaactacctatatttaaagcaattcaaccttatgttacacttagtagaaaggaaaatggttttaggatgatgaattggattagaaatagaaaactttacttattcaagattttatttggatatctctgaataagtcactcaatttcccccctgtatattagtgtttaaaattatgtaataactataatgattttaaatttaaagtgaaatttatatgaaattattcaaatcctataagagaaaagcatctaaggtgatattgtttagaacactagttttcagacctggctgtatatcagaaccacttaagcagctctttaaagataaagattctcttatacctacccttgatgattcagtaaatctacaatggtttctgggactctgggaatttgtgttgttttaagtattccacatggttctgattttttgactaggtttaagaactacagttttatatgataagaaattaaaatgacatttaaacataattttggtaatgctgtatatctttatgtaatttggtccttcttggattaaatcacaccaccacagaaaaatcttaatagagtcacttcacatctcataaagaattactttgtgaaacaaggtgccttcattacatttgaaagttgatgcttcatttacaggattgtatgtatgtgtgtatatatatgtatggaaagggtttcctacaaagtgtcagtgatgaacaatatacgttagttgtctagtgttattcagactattgagactggttacctcatccccctttttttctttttaactgtttttcatgcaatatttaaaacatgtaaaagcacttgaactttttgattagttatcccatttgttttgttaatctgataggtgtgggtacttggacaagaatacttatacacgtttcctgatttctaaaacagaattttgctgttcttactaataactgatgtgtaatggataattatcagctaatcaaccttaataatagtttaaattgactacttatcagacattgttacaagtgctttatttgtattatgttgccctcacagttctatgaggtatgtaactattactgacttttttttcaacttgttagatagaggagttaaataactctgaatgtggtagagacatttagcgagaattaggctacttaatgaacttaaaaaattgaagttaggggtaatgtgccttcagcttattcagtattttgttttacaattttgagcaataattgcaaatcgtacttgttaaataactgatcatgtaacatcaagattattctagttaatcagtaatagagatgttatttatgtttatatttatataatcatttgtgaatgcatgctctgtgtctctgtttaggtaaaagtagagggttttctacctgccttttag

SEQ ID NO: 28743 - DNA, 1315 bp, Bovine  19866880594835
tgtttttaattgagacctttaagaaggctgtctgcatagctcttctgtaattgcaatttcaatgttaactgaagacacatttggaagaaccacagaagctgttcttttctaaattgcagagagcttcagaaaagcaccccatgggtgtataactgagtctgaagagatttgggctcaatgagttaggcatgggtggaagagtgcagggcagcagaacttggatttttcctctcactgctgctgtccttagatttttttaatttttattttatttatttattgaccatatctcaaggcatatgagagctgagttccccaaccagggatcaaacctgaaccccctgcactggaagtacagggtctcaaccactggacttccaggaaagtctctgctgctgtgcttttatgaagagatagttatggtcacttaaagtaaccataaccataattcttggtctcacgatgtttgctgagaacatttatttactacaaatgctaacatggagctctccatgtactatataccccttcagatcaccttgtgaacaactcacttaatcttcataacaaccctctgattcatggacctttgttaccatccccagtttacaggtgggtgaactgaggcactgaacaagttagaagctggcctcccagctaggacacagctgagctgggattgcagcccgaggcagactggctccagtgtccgtgcttttcatcaccaggccatcctgcttctccagcaagccgctttagtcttttttattccaatgaaaaatggaattgaaaggagggagaagatgagtggcagcggaagggactccacagcagcctgtcacccattcaaggccaccagcatgcatacctggtgtcccttcaggaccaaaggtgagactgggactgactgcagcaaactcattaattcaacaagcgacaaaccagaatccaacaatcttaattaactgacttgtggttacattcttcccgattattgagtattttgtaaagaatgcctaacggctaatcagttaaggactaccagtgacttcgaattacacattattttgaataaatcagcattggtttaacaaacctttattagttattaatggctatatctttgttaatataaaaaaaatatgattgataccagttgactgtaaaatggctgtaatttgaagcaactgccaagttctcccatggcttttttttttaaggtcctggaagaacaaacgattaagcagtcaggtctttgtgttaccatcttaactcctcaccggactacccagtcagtgtgagaattagaaatgag

SEQ ID NO: 28744 - DNA, 1355 bp, Bovine  19866880598158
ctacgcttggctgggcttgtttcatatgtagtaacagagttcaaaaagagtgtgtgaatggcagtgtgcaaggcttcttgagccataggctcagaactcacagcctcactgctcctggactctagtagctaaggcgagacgtacagcaaactcaggttcaagaggtagaacataacctctgcttctagatgggaggagcctcactgtcagattatcaaaggcaagaatacagggaggagtgatgaactgcagccacttttgcaatctctcgcagaatctatgcagatacatttgcacatctcttaaatatttcttcatgtaaatattaaagccatcctgccccctactggtcacaatcttgtatgttaattttttttttttttttttaattctccctaccccagcatgccttaaaaaaaaaaaaaatctgattcagaaaagctgatgtgagaccagaaattggcttttttgaggggttctcaagattaggaaaagaatttccatttgttagtcacattttctcctctttgcatactccattatttctaccccctttgttaggcgacagttctttaaatttataaactcattgcagagaaccaatgaaatgatcattgcacatctacatgggataaaaggaaaccttcagaaaattgggatcctagaactgaattgtgtgctgagaattgaaagatttgatcattatatcctccttgactggatgctttcttctttactaataggcttaactccttatacccaagcacttatgcagatgattctatgtcatacgtgatatttatttttggtattcctcgtagtctgttttcctcttagtcgctcctttcccgtcaaagtttcccacaatatttcctgccttgttttctcttcacggtcttcacaccactcctgatgacagcgttcattagagagcagtcagttttgctttcatagttattctaagcactgagcagtgatggtggatgtatcagggctgacatgttccatcaatccagggtacttgaaaaggaatggttaaattgatgccctaaagtttgatttttgcttcaatactttttgttggttttagcaaactgctcggtacagatgtctcaaagtctccagacagcctctgggaaattcggcacatcttgaataaaaatgtgttggaggaaagaaaatgatacccagaatccaaacaggtgcatcaggcgatgcatttaatgaagttgctaagttgtgattgtgcaaaatggggcttcagtagaagagaagagagaaaaaaaatcccaaaccaggaaagatggtaactacatatgtgatttgcagcaattgcaatatatgtatatttctgt

SEQ ID NO: 28745 - DNA, 1564 bp, Bovine  19866880673788
ataggaccataaagagatgagattaagtttaagcgatgaaagtttttaattatttggggcaaataattgacctagttcatcataaaatgaaactgtttggaagtaccgttgaatctgtgccgaggccaatagtattttttttttctttttgcatcagtgatgcatgtcaccttcctgcaaggcaaccagtttgcagatctggccagagggaaaattactggacaacaaaatgaaaaggaggcgtaagtcagcccagatctctgaaccctaggaaaggcaacttccctcccgctcatgaaagaggacgattgtgctcagtaccacttatctggtgccaacaatctggtaagctctctattcagccctgcaccaaggctacagcaaggtgacctggagtttggggccgaggtcagggaaaggtcactgcctgaaaaatgaaactagtcaaatggaaagaatcccaggaatgggtgaggttagtcacccacaaaagtatcccaatccaagaaatggcataagaagctatttcttatgactctgaggttctgactctttttaaataatcttgctgcccctagcaaactggtgctaggatgctctgaagcatagtcataggaatctgcattttgtcactaaaattcctacagacttcttccattccttctactcttcaggttttccagttccctcctcctttcccttatttccaccaccacctgcaacttcaaaactaaagatcagacaccatcatcctgttgtttgaaactttctctgaaagctggtcctttcccttccccagcctcttcctggtgcctccctgcaaaggcagaatgttaatacacagatttgtacgtgacaatgttaggtggtcctagtatgccatgactgtccattttgaataagccttttaaagttaaaggaaccttagtgcttggaatatttgtttgccctttcatagcttttcttatctcacgtgatgcttatgagtcctgatataaagtacctgttaggctcaggattacttattttcagccttccaaagggaaaaaaaaaatgacatttcttctcctggatggcaagatgaaaacattttatttatatcactttatatttgtgaaaagactagatgactagatgtactttgaaaaggacttttagtttaaatagatagctggaattgatatgtacgactgatatgtttacattcatatgatttctttttctaagaaaccccaaaatcataaagttagagagtattcaattacttctcttcagtgtgttaaatgatgaagagggagagtgtaagttctttttgttttatatttgttgtcaagaattcatgtaataaagtcaaatttgtacaaaaaaatttcacgaaattatttttaagagaatcagttttcatagataaatttcaataggtcatacaattcttttaatatgagctccttacttttattagtgcattataaattatttaccttggaaaaatacattaaaaacagaattagaatgtctttggtttatatagctcacagcactaagttaaaatagtataatacat

SEQ ID NO: 28746 - DNA, 1318 bp, Bovine  19866880706043
tgcaaagtcagacacgactgagcgacttcactttcactttctctagggaatcttcccaacccagggattgaacccatgtctcctctggctcctgtattgcaggcagattgtttatggctgagccaccaggaagcctattcctataaacagttcagctggtaaagatttcctgtaaatagtttgatacaaaagacagtttcacatagtagatgaattgctgccctaagggtccagcaagtagtttactaattttagcttcttcactagggcagatcactctaaggtctctccatgctttcattttccctctttataatgggtcagtgaatgaatatggtagaaattagctacaaagagttccaggattccttagataagaataatatactttcccagataatgatgtttgtactgaaacagaagcatccatgtcaactttacctagggagctttcctggtggcttagatggtaaagaatctgtctacaatgcaggagacctaggctcgatttctgggtcaggaagatcccctagagaagagaatggcaatccactccagcattcttgcctggagaatcccatggacagaggagcctggcgggctacagtctatggggtcacaaagagttggacacaactgagcaactaacactttcacttttatcttctagggcattaacaactataaggttaggactctaacttggtgaaatattaagcataatgggcttgtgtccacccagttgtggctcaaaaactaagtttttctgtcttatctggatctttagaattgcttaaacaaagtgtgtgagtactcaggaaatgctgacttaaaatatttcatgagtgactcattcatcatcacaggttcctgcgaggtaggtaagagattgtcaccctcacctgcctgttcttatttgataaatgctaattgatattatctgactttcaaatgaattataagaaggtgggtttgttacatcccttcttattaatttcggttgaatagttctgactttcacccaaccctgatgaatagcttgtatctgattgccttgtgtttgcttcacacctcaatactgttgggaataatataaagaaaagctgccttccccaaaacaggaagagcaaagaaaaacctaagggagtctgcataaaaaaagatgaaagaagaatgaatataatggtaatacaaaggcccataggtcctttgatatcctgatagccactagaaatacaagtcttcactaaagagaaggctgagttattatgtattttccattaaaatatagattaatgaacaatttggagttagtata

SEQ ID NO: 28747 - DNA, 702 bp, Bovine  19866880771523
tttgcacaaatttatacaactagtatacatgaagccaagatcctaaatctgcctaacaaggactcttaatcattgccctgaagtttttagtgaattggtcacatgaataaacccatttacaaaagtaaattgttaaaatataaacctctattcaatgtttcgcatgaatacattacatgcccaatattttggtttagttgctatgtccagctctttgcaaccccatggactgttgcccaccaggctcctctgtccatgtgatttcctaggcaagaatactggcgtgggttaccatttccttctccagggtatcttcctcacccaggaatcaaacccaggactcctgcactgcaggtggattctttttaacatccataggcatctttttttctctgactctgcaatatttaaggaatttatggcatttagaattgacgtgtaaaagaagtttgcattaaagatgaaaataaaatgagattcagttaaccaagttggacagctaatggaaagtgtgatggaaggaccttatggtgctttatacatagtaaacacccatattagttgaaagaaaagagattgaattaatgaacctttcaatcaacaagcaaacatacactgaaaatcaacctgtatactagctactttagaataattactaaaaacatatagcaactccataaaatattggaattagacatacgt

SEQ ID NO: 28748 - DNA, 2138 bp, Bovine  19866880787784
ccactcttatcccacttgtttttccactcctcatacacctacactcattcagacaccagtatcccagtagttttttacaccaccattttataattctggcaaagccaaacaacagaaggctggtttgcagcattgccaaaaggacacccatgtgtgagcgcttcttttgtggtgtgcaagtctccagaacagaagctgttagcaatacactatctctgggcggaacactcagaacccctgcgtgtaaaggagctacacctgggaagattatgagtgcatttggaggctgtgcataggactaaaagctctgccgaatcgttccactgcagctgtagtcagtaacaaattgaagcactttataaaatttgtcgctcttcaataattttgaatcgctttaaagtgctcatgctccaaaaccataaagtctttcttaaccattgcaaacttataaaaggcacatcatcaaaatgacagtaatcaactccttcaattttaggtgtgaaactgttctgtgtttttttctccttgtttttgttgttcaccaagttggggggaaaaaaagaggtcataaggacacgatgtaaaaaaattctcagtttttcaagagcatcaagtaatcaaaattctaagatattctcagattaagaaagacttgatttttaggtaagattcccctaaagggagagagagagtgtgtgggtgtgtgtgtttcgtctgtccaggaacctaaatgaacagaaagaggccattcacaggtacaaagaagaccgttgatgcaagttttggggcatgatcctgcaataacatgctctgtgttagagaaagtaagaggtaagatagctaaggaaatgggttatgtactttacagggtatgagtttctttttgaggtaaaattaattccctatggcttaaaccactaactgaagagcattaaaagtgtcatgtcaacacaattttctagtttacttttgtctttatattctggaatggatcccattcagattacatccttcaagaattacatcagccccagttcaaagttgttcacctccaaaccatataaatccacacattactttctaagtgagggcattcaccagactagtgtaatactgtcttccatgtcctgggacggctggaaattatcttagttccctgaccagggattgaactggtaccctctgtgatcagaccgtggaatcttgagcactggactgccagggaagtccccatcactaattttctaaatcacaccaagtgttcatatggaacttactctcgagtctaatatgattttttttcaaacataacatgtgttaaaccttatttttccttcctctgcttatgcagttggtggaactagaatttttttcccatctaaacaagagctcaaattcataagggcaagacacaagcaagcttttactcttttgaatcccaatgtgcaatggactaaatatgtcccccaatttatgcagaaatcctaaccaccaatgtgataggaagtgggaactttgggaggtggtaattaggtcctgagagtggaaccctcatgaacgggattaatgcccttataaaaaagatccccatgagctctctcgtcccttttcccgcaagccagtgataggacacagctctagatggctgtttgaaattctgtgggagggccctcatcagaacccgaccacgtaggtatctgatctcaagctaccaacctccagaaccataagaaataaatcagttgtttatacattgccacccactctgtggcattctgtatagcagcccaaacgaactaagacacagcaggaaagatggctagctgaagggcctagcttctttctactgcaggttggctaccgtttacaccagtggtgaggaagggggatgaacctgttccagcctgtggagcctgagaaaaacatgacccttccgtgtccagtcagagatggagtacggcctttagcacctcagtaggtatgacagacttgggccacccaggaaagaactttctctacggataagtctgttaagtgtagctctggctcttaaccagatttgacttgcccaaacccaagtactctaccactgctctgaagactatatagctaacaagccaattgctattgctaagtca

SEQ ID NO: 28749 - DNA, 2007 bp, Bovine  19866880861403
tggtaaccagcactcacaaaacagtaatagaattttcagatgggaaaatacatatcataaacatatggtcttccttgacaatagagaaattatctacagaagaaaatcagaaactcaaaatttggcatacatataagcacataattgaaagtgatattcagcttttaaagaaaatatatggtatgtaaaacaactgttactataattatctggtagttttgttcaaaccctttaaaaacatttaagcactgatatgcaagctttactttaaaaataaaaattttaatttgggagcatatatatactcatctattaatgttcatattacagtattctaaatgtgtgtctctcaggacccaatagttttctttaattttctaagtcgcttcagtcatgtccgattctttgcaaccctaatagactgtagcccgccaggctcctctatccatgggattctccaggaaagaatactggagttgggttgccatgccttcctccaggggatcctcccaacccagggatcaaatcacctctcttaagtctcctgcattggtaggcgggttctttaccactagcgccacctgggaagccctttcttttatttaaacttagctaaattacaaattgaatttaaaaatagggtaactcagtgaagaatattttaagtattagtctatatgttaagatttgatacattttacctgttgtgcatataaacagagaagccttgttattcagtaaacttgtgtcccaagggactatgattatgaagtctaaattttcaagttaacatgcaaagctgcaagaaactgtaatcttataaaggaatgacaggcagatatttaaaatatgactgcagggcagtgtgattattttaattaatataaccaaacatttatcaaaatcaagattttcaaagtgatcatcttgtaaggtataaaatattcatttcagtgatggtcgcattgctcaatccagtattggatgtcctcttttgataattgtcttcagaggctactgcctaatctttggaacattttttttataatgagaaatctttatccaataaaggaaaattgactttgagaaactacatggagttaagtatagtgaacatcaacagttctgttttggatttaaaaataaagtgcgactataaagtaagaatatttttctagcagttaatagactcactttgaaggcaattccaaaagaagagcttggtaaatggttagggagacggtagagcattggctgcaggaaagcttatgtgtagaccctcagtgcagctgctataaagaagaccctccaaaggtgtccttgcttcatggtggtcaaactctgtaagaagagacccaaggagagtgttgctgactcacttttccatgtaatctcttgatgggacttgggactttaacatttagactgaaactaaagaaatttgacattacatctcacgttttctctttaggaaggagtttggctttctcagaattgccttaacagatgtttccaatttccctatgctgaatgagaaattaccgcatgtattgatacttcgtgaatatgtgctgagcagaaactgaaaggccttgtcagatcaaaagaacctttagcctctctatatctttagcttctgtatagtatcttggatattctgataaatgaaagagagtgctacttatagtttatgttcacccagatgaattttaaggaaactatatccaaattcatccaaatatcttcaagtgaaagcctcaagaacaaagtcaagcaatcttaaaatttaagagttctgtgttaaaaatattgtaagatctcctgacttgggaaattaatttttcttaaatctttcaaaaatagaatttagagaaaacacaagattctgaaagactttatgtgtagaaagcacattaggtacttctcaacttcagaaatgacagctgaaacattgggtcaaaatttgtcccactgaatctataagaaataaacataatcatgagttag

SEQ ID NO: 28750 - DNA, 2350 bp, Bovine  19866880864608
aggcgaggcgtaggcacgcccgccctcggccccggggccgggcctccatccacgcgccccgacccggtgggacctggggaaggggggacggcattcttgcttcctctagaggacattgctttgcgggctatctcttgttttcatttacttttaaaaaaaaattttctactttccccgttccgttttttctttcccccaacacatcctctttgccctttctctgcactgcggacgcccaaggtggacacgtctgtcagcagttagccagatttgcctcgagtgaccagagcccaccccctcgatccgccagccctcgaacccccagagccttgggttctacaactcgattccaggagtggggtccttccgctctgggcaggacagttgagggatttttttctcccaccacggattcaaagtcagagagcaaccacagttatgggcgctaccacagcgaggagccccaggaaaggctgggccaagcaccccacaaaccctctcgtttggtctcagaaagactttttaggaacctgagtcccttctttccatcggagccttacacttcgcttctgttaagaatttcctaaaggaaggcaagagatggggtagggaccatggagggaaaaaagagcgaacaggagacactgggattatatatttcatataaagaaacgatacatatgtaattttagattttcttctgaattagagtgctgaggctatagaaaacctatttttaacatccccttctcataacggccttgattgcttaaattgcttctaatcgggtggcacacgttagtggagacgaaggacgcatgacaagcagccctcattctttcacagatttagataatgtctctggatgagttcagatcagcgtaaaagtggggaaactcaaacacagttttcctaagggatttgtgcaatagggtagaaatgtcctgaccatcttatgatcatgcaaatagacggcatcttacagaatacatagcataagaagccagtgccaacgttttcctctaggtttggcgtggcacaaagagtaaacatacttaagaaaaaaaaaaaaaaaaaacagcaactcacttagccctctcctcttctttagcacctctttaaaaacatatgtatacctgagtttctccctccctccgccttcccattgcccaaagcttgggcggccctgagcgctcctggcgcttcgtgccagccccgacagcagccagcaaaggtcattaccgcgcgggcaggcgcgtttcagcttctcgggagagccagcgactgggagatacttggggagttcttggaccactcggacgtacatccccaacttgagtctgcagagggcctgggtccgaggtgaaggctgttctgtctaaggtgatctctggcgatactggtgggtagggcgcccaaaggagaatagacgtctgaaggtggtcacctgggcaaatctgacatggagacatgcatctcattatctcaccaaactgtggtttcactttttgccattgcccccaaacaaacaaaatgcataaagttatttgaggccagaggaaacgtgcctagaggaagtgtccctttcgctgtcaacttaaaaggcatccgattttcctcgcaattctttgcttctatggaaaggaaaccctagagtggcacagggaagcctccttagggaaccttaaattgcgtcacacagcaggattctgggtgaagtcagaagactctagagtgaggttgcttgtgggtcgttcaagggcaagtctacccaggtcatctgcctggagggtgggcgggagcagagtccctgccccagggggttgcctcctcctttcccgctgagctcacgcacaactttccttttccctttatgcatcaaaatgagaacccttccgttctggattatgctttaaaggcccactgctatacaactttatattggtcttcagagtgagtttattagtcctgcgagcaaagattagggcgctaagacattctcaacggtggcattccgatttggttcctgcaataggcatgtgcctaaaccctggccttggttgggtcatcaaatactgtccaaactccctggctgtctttagaaggttctcggttatgcaagtttcccctctactaactagttcctggatgggttggaggtacagcgtagagaaaacattcgggattggaggcactggcactcctaaagggtcaggaaaatccctcctgtttaggagatggcttttggaggcagtttaaaacctgagaggcaacatgaaagcttctcctttagaaaaaaaggtagatctggtggttcaaactccgtctttggcaggcaaaggagcaattt

SEQ ID NO: 28751 - DNA, 1839 bp, Bovine  19866880884818
atgaccttaattgaaaacaagcaatttagagaggtgatcaggtcattagggtgagccttaatccagtatgactggtatccttatacaaaggaataatttgaagatagcacacagaatgccatgtaagatgagtccgagatcagcggaagtccaggaatgccaatgattccaggaaaccacgggcatctagaagagaggcatggaacagatttgtccctcacaatcctcacagggactcagttctgcccacagcttgatgttgggcttctagctccggaactgtgaaatagtacatttctgttaaggcccttggtttgtagcactttgttatgtcagccctagaaaactaatgcaaaccccaaatatttctattttttagacatatgcctaaatatttctttttttgacctttctaattctaaagtactaattatttccctggtaaacttggagtattgcatttgtatcatattaagacaggaatttctcaaatatgttagcatttgtgatctctcaactaaatatgaggaactatttaaagagaaactacaaaattcaagtcagttctctgggcccttatcactaatttttttcaccttctgttatctctttgatttgcccaattaattatcattgcacactatttggctgtatcatcatgtatttgtgaagaaacattttgaatcaaactgtatcctgacattccatgatttatactcaatgcatttcttgaaagtagaattaaagcaaatactcactgaattttcccacactggccaccagtcctcagaaaaacaacttacatatcttatgaaattaagtccgttacatttcactaaacccattttctttccccccagaaagaaggcattttaatgccatacccatgaggtctcagaatctttctttactttctcctttctgcctagtgccctcacaactacgacaataggaagctaaaactggcctcgtattacatttaaaagtcaaacgcattttccaaatatttctctaatccatacacatctcttctttgtcaccaagatgtcttcctatttgttgcctgcctctccttgatggattagtttgcctccagggtttaccccagtgatagcctcggagattcctatgtagccaggccccaggctcgaagtcccatgctgccggggacaaagcccacctgctccctgcgtgtcctcagccttagcagagtgcctcttaccaagcagttagccctagcgtgtaacagcagtgtataaccctgtgtgccacatgtgtctatgcatttaatggatgaatgaagaaaaacacttgagttgaatgattttctttaaaaattcaaattttataatcatttagcacagacaattatcattttttggcatttgttatcccttttgctggaaggttaggaagttcaatgtattcaactttatagacacaaccgaaatctgtaataccagccagatctgcttttgagacttcattcctatcacctaatactgacctcattattgacactcagtgttcaaataaaatatcagcagcctgaactttcttagtgaatttaaacttgaacacgccaggagctgcaaggtcaaggattctccttctgttactgcaggcagcctgacagcctgacttactattaagtaacctgagacatgagaaagaggtctgggggttttttagtggcaattctactagtttgtgccttgggtgttttcacatattggtgagggctgaccaagcagatagcattcacctagataagtgatcacagggggggggttctaacatatacatgcacaggattccctgtaagtgcgtgcttgcgtg

SEQ ID NO: 28752 - DNA, 895 bp, Bovine  19866880955927
gggtctcgttcatttaataaaaaacatttaacctgagtatctacccttctgcaaaaaattcttattttccctcttggattcttctcttttccttttttattgggcccagtaataagttcaattctggattttggagccctatgatcaggactatagtcatcttttcgtgcatataacccaaagggtttaatttatttttttaaccctcatacttacatcaagaagaactgatagctatttcagatgtgctagtgtttagcatttatgaaaggaaagtcactcaatgttaagttaattgtagaaatacggtatagaatgtgccacaattaagatatatgactatcacttatccttttatttaacaaatacttgctgattattgctcccaccccctaaataagtcacaaatctttaaaaacagttttagataatccttgtagtcaacacaaggaccaaattaacacgacctagcagaaaggattttttccttatgtaccaacaaatctgaggatggataatccaggatatggagaggtgaagagatcaaggagtctctttatctttttctttttctcttcctttttccctccttgaattccttccttcctgttagaacacttaacaggagatctaccctcataactagagaaaatctgctgtacaactgagtctgtctcttaaaagaaattctgggaagctccagctaccaatttcaccttctccttggtcaaaatctgttacatggttactctaggagcaaggaaatctgtgctgtggtttggattgtaaaaactggaagaaaaagaaaaatatcatcatagagacagaaagaggtctttttagaacattaagacttttacttttccagcctccatcgtaaagaaaagcaaggcag

SEQ ID NO: 28753 - DNA, 1301 bp, Bovine  19866880998197
cacaaagggttcatctgaattttctggagcttcaagaacttttttcttctggcccacataactgaaagtcaatcattcatttcttttctagttgatttagccactggggaaatatgtgttgttttacctcagtgatttcatatgcaaaatgggaataattataattttcccttggcttactggaaggttaaggagattaaatttttttattaaaaaaatacatgtacttcatgagtgaaatatgctttgagtagcaattattgtttggactattatcatcagtaaggatttaaatatcttctttgtcaaaaaggatcctaaaagtaggaattcaagctaataaattaaaacagacttgaggggatatgaacttgaatgtctgtcagtgacaatttgatgcagtgagtaatccaatttccttcaggaaatatgtaactgtggcaggggtgagaaggaggtatgaggatggaagactaacaaacggagtatatagatattcattaattccttcaggaaacagtgggaggaaaaggaggggttggaagacatatttaccgagaagagagagaggaactgtaaaaggataaaataagaagaaagccctgagcattcagaatcactctgagaaattggcaaaactcacaacgtacagacttggatgttcaggaaatgtcaactgactgacagacacaaaggagattcaaggagaaatcaagaggttgggggagaaataaaaaataaccactcaaattattccataattagagctaaagttttcttaggagggaaaaaattggtggaagaaggagaaagctgggagaaaccacttaattgtccctgattctatattcctaagtaaagctaaagaagggagataaggggttcccaggggctggtgtgctgtccagggtgatggactgtaaagcttgggctcttctgtctggaaaggaaaaggcaggcaggcccatgatggaagtcattaattccatatatcctctgttgagaaagtacaagcttagcctttgagctccacagtactaactgaagggaattcattccccttgaggcctggaagaagagggaaggacacatttagcaagcataataatccaacagatggcaataactaataggtacacagagttaaagggataagttgaattcagatgtaaaattttttgtgcctcatacacttttatttcttacagtgagatgaattatttattaaaattggtataaactattgggttattttaatttaagcttcttattatcaaataaaatataaatccagaaaaatt

SEQ ID NO: 28754 - DNA, 1293 bp, Bovine  19866881196870
ttccttttaaaacttaatctcttcctttttcgtgaatgttaataagaaaatttctggtcatattatagtgtttttactgctactaggtaatttccaaaattatagaatgtcaaaatagcaaaggtgtcatatagatgaaccctaacacttgagatattttgatatctagtcatctctgattttttctatgatatgtgatcaaattatcaaatagaacaaacattaataaccacttgagtttaaattttaattctggacttataaaaagttataagtttgtcatattttgacaaattccaagagagaaaacctcaaatgcaaaataaccttgctggaccaaataagtaattctaaccatcaaaggggaggataaaaaggttgcaaacatggtacttagattcactgaaataactctaaattttaaaataattccacagaataataaaaatatccttttagccagcaaaaacaaggctgaaaaaggaaaatgtatactttttttggaagtttctattctgcacattaattaagatattctgacaaaaatacaacatatcaatggggcaaactgttggtagtaaatagtgtctagatattaataagcaagtatgttgataattccctagagcagttaacagtttttaaaaataattttacatatgaaaaataatttgaaggactccaaagacaaaattctaatgtaaatactagatgtagaattaatattgttaattattcagtcttccacagccaaaccacattacttctatgatgaaaaaaaatttaggagaattgacagtgctttacccactaccatttagactcttcacaggcaatggattaaactggggtaaagttgtggaatagcagaaatgtgtcccctcaagcacacaaattcccatcaagtttatgtatcatcttttaaaaagcttttgctatttaacaagatttagtgtcttacttttaatctcatattgcagtcgccgaaaaaaaagaaaaggaagggagggaggaaggaaagaagatctggcactttccaccatgttgcacttttctcatgggttcacaatatgggacatcacttccaccagtaagtaaacaagattctcaaagagcacttgggagacatactaacttacagtattgttagcggcagagggttttaaataagcaaatggtttgtggttttaatacaacatatcctagcaaaagaaaagaaagttagactaatggctgcttctatgtattcattcagcaattttagaggaatttaaagttgcataactctttttc

SEQ ID NO: 28755 - DNA, 725 bp, Bovine  19866881207056
tgttttcaagttcatctgcactaaacttagtaaacgctcagttcttggagatgtagatcttctggcggccaaggaacttgaacgtggccccacagagggcctcaatcacaggctccttgttctgcagctcagtggggatggacattatgacttggccaatgtggaccctggccagtgtgccccagggctttccaagggcaccacgcatacctgtctggagcttagactggggatagcatgccagtcatcaaagtccactggaaagagttgtatccaaggtcccttagggcaacctgtacaggcaacaggctgcatacactaccgaggaggctgctgtttgcagccactgcacactgggcccccacggggaaaagagcacagtcggcttaattggctgcaaaagtttttttttttcaagtgaggaaactatatacaatgttgtatgtgaactataccacaataaagttgggggtggggcagggaatgaggaaactcttctagactaaaagaatctaaagaggcataatcaccaaataccacatataaaattgctccttatttaagatgaaaaaggcaggtataaaagatatccttaagctaactgaggcagtgataatatggaccagctgctaaattctacagtggaatcactgttaactttttcagggatgataatggtattgcagctacacagaaaaaaatgtttctattcttaggagatacat

SEQ ID NO: 28756 - DNA, 1351 bp, Bovine  19866881306291
gcaagaatactggagtgggttgccatttctttctccaggggaacttcccaacccagggattgatcctacgtctcctatagctcctactttggcaggcagattctttaccactgagccacctgtaaccttgtacagacagagtaactacctcagttcaaaaactttacactctcgtttgtagagtgctgctagggttacacaagcatgttatccaacatgagcaattaaagctgactcacacagaaagtggcaacggaaatgagtggggaggttcattgtagttttttacttctactgttaacataaaacaccatactgacaattgagatatcagtatttttcaatagcccattttacttggcaggcaccccaaagagttccatccatctgcctgggactcggaggtgatacttttcataagattaaagttggtgctagtcacttcagatacttctgagtgagtgagaggtaaatcgcccgcaccaataacaacctcaaaaagtccccgtggcacctgtcactgtgagattgcgttttcagttcgcgcaagcttctgctgcttccttattccttcacctgcttagtttctacttcactgtgcttggaaaacaacgaacacatgtgcggcccacaggtgccaagacgaattacccacagtgtctgcaaaaccagaccctgggctgggatcttgaaattcaggagctcggtgttttggagcgcaaaggcctgggaaccacatctgggttccatgactaagtgtgtgatgttgagcgactcagttgtcttcactgattttcagtgttcctttttctaaaggaaagggtaagaaggggtcttgacagctcttttttagtttaacatctgatgattctgtattgatatctagcattaaaaatattgtttaataatctaagactttaaaggagaacccagtctggcagaaagttttaacaagagtagacagcacaaactctcatcaagtcattcactgtattaaggaattaatcatagacctacaattagacagatattatgtctctgatttgctggttaactcattgactctgctatatattgaccttcagaaagctaaagaatgatagatatcgacctagccattaagtaattgatctgcaaacatacctgcattaatattttattgattgcatttcattttaattgtagtgtggttaaaattccaatgagataactatcttcctttaatgtgaaaaaccccagagaacagtagctctgaaacatttatcataaaaataaacataggctattacccaacaattatgtttaaagatgtcctgtgaggactagactaatataggccttcatgtaaaac

SEQ ID NO: 28757 - DNA, 1290 bp, Bovine  19866881312042
gggccttatgcttatgataatttattgatacattcactctactagaaaaatagaagcagaatgacaataaaggagtttgtgtgtgtgtgtgtgtgtgcgtgcgtgtgcatgcatgcacaagatgggggaagggcgtggagtctggcagtgagtagacggtacagaaatgaaacaatgcccacgtacagttttatttcatggcaacaacatagtgggccttgggtcagatgtgtgaaactatttctcaaagaagctgcatacataattgaggccctcgaagggttcccagttgaagttgccaggctacattcatttcaaaagcagagccatttgttatcaaatttaaattaactctctgcacactgaacttgaattttagagccctgcttacttacagttcttgaaatagtagagaaaggagaaaacctgcatctggagaatggaaataagatagtccccacaaggaactgcagtgattcctgcctaggcctgcagtgtagcagtaatttagattaaagtgagaaagatctatttggagtgactagaaacaaacctgaatcttcccctgtgatttttgtagatccagacttaatgcaaaatcattttatttgtacatctatatttcaactacattttatcttcatcaagcattctagctccatcccctctcccagttaattactctttgctgtgaaatttagagtaagacaatttataaacttgtacaatagttgtactatattaatatgtcagtatcagtatttttgctgtcttggaatacagatttccccccctaatctgcattgctttatcctctattttaaaccaggtttatgaaactcactagatcattttttggtaactgccaattgttgatccatccattcactcaaaatggaatatgtaaaatgtcttgtgttaggacctttctacaactacacagaggagaaactttcctccaaaagagtggtgtgcatgttttttcataggatgcatgcagacataactgcacacagttctgtgtctggcagaagtatttaaaattgaagctatcttgattatcagaattttttcatcacatgtaagttggaaaagttaattgaaggacagacttttattcttaagtttgatccacagagctaaatagtccattctgagtaatctatgtatttttcttctcttttgaaaaacaaattcaaaggttttaatcaccattcctttatccttataagatattgatttgctataatcaggtgaacctgttttcattcttgtaagaaattttaacat

SEQ ID NO: 28758 - DNA, 800 bp, Bovine  19866881376677
tcatatgacctataaatggcagatgcaaaagttaacccttgttgattaactgctattgatattataaaatgagaacttccagaataagttggctctaatatatataaatatgtacatcagaaggccatgcatcagttcttcacagagcatcagatcagagaattggaggaatatatctgttcttaggtcagaataggaaaaggtgaacaaagtggaataaattataccaaaaaataacaatggtgagtattatcaaagagaccaattaaaagaaatggagagggcttccttactggtccagcggttaagaatttgcctgcgaatgcagggcacatgggtccaatccctggttcagaaagattccacgtgctgtggagcaaataatcccatgcacaactactgagcccatgttccggcaactactgaagcttgtgtgcctggagcctgtgctccacagcaagagaagccgctgcagggagaagcccatgcatggcaatgaaaagcgcctccagctcactgcagctagagaaagcccacgcgcagcaacagagacccagcacggccaaaaaaaaggagaaatggagaacagcaaataatacacaatcaggcaataaggcaatacataaaataaaatttgaaataaataataaaattgataaaaagaattttaaaagcaataaatatgacattgttcttaaatgtttctcctttgtttcctctgtcctaccaagccatctagaagtaggatgaccacatatgttgtcaaattgggatattttgaaaataaaggaggccctatt

SEQ ID NO: 28759 - DNA, 1931 bp, Bovine  19866881378846
cttatattgggcttcccttgtgacttagctggtaaagaatctacctgcaatgcaggagacctgggttcgatgcctgggttgggaagatcccctggagaaggctacccactccagtatgctggcctggagaattccatggactgtatagtccatggggtcacaaagagctggacatgattgagagactttttcacttttcactttcagcatcttatatttactcaagattgcttaacaagaaacaatgacaaatttaagtgtcttaaaataataaaaaattatttctcactcaagcaagagtccaagatagatatttctgcttaggcggttcttttcgcagcagcaatgtaagaattcaggctcctttgattttataggtttgccctcctctgagtcctcgaactccttaccctttagtcaaaagaaggacaaagcaaatggaaaaatcatggtgggaaggttttacggtcagtcctggaagtgatgtgtatcacttctgcccacataccattagcccaaattcagtcactcagctacaccaaaatgcaagatacaaccagtcaggaactgtcacatctcatgtttgtatcatacagcttttagaggactgtcctatacttcactacatagtatggcttcgtggaagggaataaaagcacagtggttaaatgtacgaactccagagttaaaaccacttgggtttgtttcctggcttcgctatttatagtgctactgtcacctaggataagttaattcatctctatctcatctgtaaaatggtgataataacaaagtctaacccatacgatgatggttaggaagattaaatgagtttaataaacataaagtatttaaatagtgcctggcatgtgcctggcaggtagtaaattcccagtaaagattagtcgttattatcagattagaactatcactttagggctggaggaatttaatggtaaagtggatattaaataacgtgaaatgcagaaaggtggtagcaaaggccagagaagaaaaagccatcaatttgtccattaagctatttgaataactgcagaaatttctgctgttttacagttgttcagcaccagctaaacaggaggtgatccccaactcacagcaattttcagttaatatgcttagaactgtaaaacaaataacctccaagcaaatcagatagcattgtagtcaagttaaatcctagaaggttcagatgggggttttattccaaaggtctcatactgaggtaagtaaaccatgccttagagaaacagtgcttatcaatttgagattcattttctatccttccttctctcagaacaaaatcttttcgtaggtcacaactggaggacctgagtcagttcattcgcctgtgactgtacttagtttagttcagttcagttgctcagatgtgtccgactctttgcaatcccatggactgcagcacgcctatacataacatgcacattacttaacatgtacttattatgacttaacatgtgcttatcatgactgtacttaacatgtacattaatgtcagcaggtatatcacctatgggtgtttctttattttggaaggctgtcttccttctgcagcttctatgctccctccccaccccatttaaaaatctttccaatttgtcactcttgtggtttattggtaaacgttcaaatatcttttttataaaacattctattttaaaattacaccttttgctatgacataattgtagattcacgtacagttggaagtaatgatacagacatccagtacaccatttcagtttagttcagttcagtcgctcagtcatgtccgactctttgcgaccccatgaatcacagcacgccaggcctccctgtccatcaccaactcctggagttcacccagactcacgtccatcgagtcagtgatgccatccagccatctcatc

SEQ ID NO: 28760 - DNA, 1850 bp, Bovine  19866881410387
aaatagtgaattaaaatcatgaatttttagcagacccatgtagcagtatgttagaaacaaattctttgcttaactgtttaaattcttcttaaagagacagtgaaacagaaatagctatcctggtttttttaatttaataatgctagtaaagaggactttgtagaaaggaagactatttcttattaggctagttgagaggttagtatcaaacaatctaagattatacattttgaggggggaagaataaatacttactgattttgcatacattaggtcaacttatgtaagatttgaatagaaaaagatcatggcaaaaccatgggtgtatgaaagctattattaatgtatataatgtgtataaggtctataccaagaaactctgtcactatggctgggtctaggctctttagatgttcagaaatcattatgaactgagatgtacagaaagggatagactttctatgatctctcagtttgtctccagcaaatgttatttgacgtatttgatgacaggctgcagtatattatggccaataacatacaatacttgtagtggtgctagtatttattccatcttaatgagactgcctttttaccacatgcagacttggtctgactgtctatttcctcagatggctttgccaccttaagtggaaagatcagttagtcagaatgtagagccataatgaaaactaaagtaaaatgttgaaagggataaataaaaagcaacaacaattctcttgaataattttaccccttttagaggataagaatacttttttataattttattttattcatttcttccatgtaattttagtttatataaaacatctttgagaaacttctatgcagcatataaatatctacatctttacttcatttacatcatagaaagattttctatgcatcaaataagctggaccacatttcccctcccttgcctagaccgtgtattgtgagtgaatcacgtaagtagtttatgtagttcagggatctttttttaatatatataaactattggtttgctcatgtccactactagcaaaaaaggttttacgggcaaaattgtaattccctttgaccttctctgattgtgcttggcacatgacagtattgttgtccggtatctcatttacaaataatataatcaagtgcatcatgggtcttctaaaacgctgatgatgtatctgtactgtgagctgctctaataatggataagcttcgttattctacgctccaaacacactcatcacaggaagattctgcagtatgtcttgtgtatgtgtacttgcattttgcatctgaacatgtatataagaatttatgagctttgattgacagttgggcccaaattaggcctttaattatactgactcttttttaaaaaaatcagggacctaccaggatagggaaaagtaattgtgatgctgaggatgcccacgcatcctcagaatgaagaaaagaaataggatttgggaaacccctctttaaccactctgttaagttgaaatgtatttagtttctactccacgcccctcaaaaaaggatgaaatgtgagactgcagaacactctctagacaaggaatacaagaactgcttctaatgttttggggcttgggggattttttttgcttgcttgctttcttccttcctttctccctccttctttcccatctttccttccttttcccttctgtcctctggtttgtatttgttttgagagtccgatatctgaattggaggttaaaaaacatccactgaagggaccactgcatctgtaccacagtctaaaacattaatacattttgagctgagtctgtgacaaatcagcattattcacatttcaa

SEQ ID NO: 28761 - DNA, 1573 bp, Bovine  19866881614914
tttgtttttttttttaatttcagaaaagaaggcttttcaaaaaataaccattacttctataagaaataaattgagaaaacaaaataaatggaatcataccaaaaaaaaataacattaatctcctaagtgataaaagaacactaaaaattttgaaaaaattagatttcagtgattttaacaaactgttcaatcaaccgtccatcactgtaacaaatggactatcatgatgcggatgctgaaagtctgggaggtcgtgcacgtgccaggacaggagatatggaactctctactctgatccatcttgctgcaaacctaaaagtgctctaaaaacatgaggttttaagaaaaatcaaatcaaatgtattcatagagaaacagtgtaagtaatgtcaaaataactggaaaagacatttgtaactcatatcataaagggataatttattgttgcttagactctttcgcaactccctggactgtagtgcaccaggatcctctgtccatgggatttcccaggccagaatatcagagtgggttgccatttcctccccaggggactttcccgacccagagatcaaactagtgtgtcctgcagtggcaggcggattctttaccactgagctacttgggaagcccaaaggtattatttacttgttaggtattatatagagttcttacaagtcaattactaaaggaacaaatgccttctttcgtatgtacacagagttctttaaaaaagggagcaaaatggctcttaaacaggactgtttttaaaatgcctttgaaacctgcctcaattctggtttcaatgtggatattttaatgccttaaattctaccaattgggttaaggttcagaccatttttatattctcctaacatcaaaggttacatttttgtctttttttctttcatatttcctatcacttgcttttactatcttattttctatatagtttgtgatagaagttctgcaatctccatacagtgaatgccattacaaagaacgctttcaggcagaacaaggccaagaaacatattagcaagtgtgtcagaaggttagtctatttgagattacagacgtaaaagcaaaagataatttttttagtcggaatcagggaaagttttgtggacaaagtgaacctccatctagccttgaaagaaatctgatagtatcagagaatcttcaaggtcatctagtacaatctctcacaaacatatgtaacaatttattagagtgtaagctccttaatggagaaggcaatggcaatccactccagtactcttgcctggagaatcccagggacggcagagcctggtgggctgccatctgtggggtcgcacagagtcagacacgactgaagcaacttagcagcagcagcagcaagctccttaatagcagaaaccgtatcttagtcatatctaataaatgttacaggtattaaatggcatttcagaaagactgatctgcaagatatgtgtgtgtgtgtgtgtgtgtgtgtgtgtgtgtatatgatggactgtgatgaactggggaaaaaagtcatcttatcaaattctctcctcttattccaaat

SEQ ID NO: 28762 - DNA, 1846 bp, Bovine  19866881627833
ctgggatccacataagaaaatagaaatcatacaggcttttagattagactaacccaaacttcagcttataagttggcataggacaaattgcctttctgaacttcaacttcctcagtgatgaaatgtagttgatattaactcttatattacagtgtgccgtgcttagtcactcagtcatgtccatctctttgcaactccatggacttgtagcctgccaggcttctctgtccatggggattctccaggcaagaatactggagtgggttactgtgccctctaggagatcttcccaacccagagattgaacccaggtctacagcattgaaggcagattctttattgactgagccaccagggaggctcatattacagtgtgatggtgaggatataattagatgacacactgaaatgtttaacattgtatcagatattagcataatttcattaatatgaaaaaatttttcattaatatgtaaaattagggttagggttaggattagggttagggtgccagagcaatatgaactcattgaaactcacatattttggctcgtttttaagaccatagaaaacatataccattcctagaatgcaaagatatgatgttacgtgacatcatttaacagtagcagagacattttctgagttattctaaaaaagaagctccaaatttgacccaaaccacacagaaattctctgataggcaaataattaatgattaaaaaattcaccgtgactttacgtggccacaaggcaaaagatgatcaaataatgacaacagaaaaatggtattgggtgaataatttcactacagaagattttttcaaggcgtttggctttctagagaaaaagtgacctattagataccagtcaatgattgtcgtatttcaagtcagtcaaaaatgtatttatagtgccagaaattatgcttagaaaatattaaacatttcatagtgagtcactcatgttttccttggtatatatttacattagtaaattgattacatggaatacacacatatttgataaaagtgtttcacagaatgaatgattcagtgaaacattcctattaatttgacacttcacatttaacccgtgttttttattctagaccaaaagaaagagggtaataaaatattcattaactgcatggaagcccatttattgaagatagtctctggagggtaaatttcaaaacatttgctagagagtgctgtgcaaaatatgcagttgtcctgacatagcaactagtgtgaagaacagcaaatgcaatagtcattattagtaaaggagaagatcatccattgtgaatcacagtgcagctaccttttatatttagactaagaaaagtatgagtcactttagccattgcttaaaatttggcgggattttatagagaggttaaaaaaagcacaaagtatgtgcacagtctcatcaagaattatggtaattccttaaaagtcttgataagactcctctcaacattctttaaattcttagacagttataatatttgggaacatacaatcttggtaagcacctacaggtattgtagggttgaagggaaaaaggaaggaggaaaattatgtataaatagacacattcatggctaaatagatggatagctagataatttaaaatatcagaagcaaaaaaatgttaaaaattctaatcagtctataaaacaaagcattattgtgctctgaatctcttagaaccaattggtaagtagatgtcttaggatacagtcaacattttgtggtttgcccaattgcctatttgttgaagaatagaacaattacccagatttttcaaactctgtgtatgttgctggcctccattatta

SEQ ID NO: 28763 - DNA, 816 bp, Bovine  19866880360725
ccctcaatacttgacctaccagagtacccaaaccgcctggccttctaaacccagcctcagccatgtattcaacatcatacccactcttaaacatgtcaggcccatctgacgttgctagtctccttaccacttgcacttccagccacccttgggcacggtgagcagtggggggtccaggcagtacgtgtggtagctaatgtcacagtcatcacagagcaggaggcgggaggggtctgaggcctggccacacacctcgcacacgatgcactccacacaacgccagcccttcagcagcatcaccttggtgatctggtgcaggagatggcaattcctcagggggtgatgcagagggcagggcagacctctccaggggtgctgggacttatacaggtggggctggaggacccccccatacccaggccagaccttcatttgagcacagggaagatacacggagcaccctcacccctaaaatagtggctcttaaacttaggcttccagggatctccgctgatcaaagaacagcctcacccagccactgcctggttaagatctttcactacccaggttgtatttcccccagcttttcttgaacatactgctccaagtcagtgaatgttagcagtggacaagttctaaatgttaatgaaaaccccaaaatgactgatcatgcttgagtcaaaaactgctttctctttgtgaacatgtgtttggtgctgattttatattttatatccagaccatgttttctactagaaaagttctcacaatttatacaatgtactcaattatactaggaagtcagacctatcacaa

SEQ ID NO: 28764 - DNA, 1310 bp, Bovine  19866880418845
gcaatggcaccccactccagtactcttgcctggaaaatcccatggatggaggagcctggagggctgcagtccatggggtcgcgaagagtcagacacgactgaagcgacttagcagcagcagcaaaatcactgcagatggtgattgcagccatgaaattaaaagacgcttactccttggaaggaaagttatgaccaacctagatagcatattcaaaagcagagacgttactttgccaacaaaggtccatctagtcaaggctatggtttttccagtggtcatgtatggatgggagagttggactgtgaagaaagctgagcgctgaagaattgatgcttttgaactgtggtgttggagaagactcttgagagtcccttggactgcaaggagatccaaccagtccattctaaaggagaccagtcctgggtgttcattggaaggactgatgctgaagctgaaactccagtactttggccacctcatgcgaagagttgacttattggaaaagactctgatgctgggaggaattgggggcaggaggagaaggggacgacagagaatgagatggctggatggcatcaccaactcaatggatgttagtttgagtgaactccaggagttggtgatggacagggaggcctggagtgctgagattcatggggtcacaaagagtcggacacaactgagcggctgaactgaactgatgggctggattgtatcccactctaaaattcatatgttgaggtcctaacctccagtagctcagaaggtgatttttcttagagatagggtctctaaggagggttaaagcggaggtcattagggtgggccctcatcccctgggattcttataaaagggggagacttggacatatctaaattgtgggaacacgtgcaaagttctcttgcagagtttggcattacaagagaaggaagtatggggacttccctggaggttcagcagttaagattctgtgctttcactgttgggggcgcagagtcgatctctggctgggaagttggggaactaagatcccgcatgtctcatagcacagccaaaaaaaaagaggacaataataacaagagaaggaagtatgggcaaacacagaaatctgtttccttttataaggaccgaagtacacataggagactttctttggtaacattcacttctggtccttctgggcgtctttaatggccagtggaacacgacatggtggcggggaaccctgcttccattcacaatgcttcaggaaacaggttgctcatatgaactcaatgatgaacacctgaaatgactcatttatgtaat

SEQ ID NO: 28765 - DNA, 1506 bp, Bovine  19866880437575
accctgtcccgatggggatgaagacaggtgtgtaagacaagagtgaggttgatagcagatccactgttacctacagtcccctggacactccggtagtgggtagagtcccaaaaggaggggccacgagagtaaatttagggatggagagagaagcagatgccccggtagctgtcatcttcattagaaccatctcccaggaaagagcaccttaaggtcttattgtgtcacatttaatgccccctttctgcccctctggaaggacagaagagacagagaataaaagaggctatgagaaatactgagcaactgggagagggcacaaagcgagaagacagtgtctgggaacttccgatacagaagaatccaacatataaccaagccccaaatggtgctggactcaggagtgggagctgtgaaagtacactgcctcccccaatagtgggccacaggggctccaagaaagttgttcgccaaatccctgcgggaggtagatgctgagcagggctggactgcaccattcacagggtggtgagagactaaaggcagaccaagacagtcttaagatgagacccccttctctttttcttgttaaggaacacgaacaagtgacctaagtgggaagccagttggtttgggtggtcttcctctctctcccaggcacagtgtttcctaccacagatctcacccaaccctgtcagacttttggttttctaactcccctgaagcccaggaagaaaagggatgagcaaatatcagattcaccctcctgggtgtgagactctgggagaggacaaggactgagacccagaagctgtccaagagcacccctctatctcacattcctcatccccgccaccggccccaatctctgggaggaggcagagaggggaggaaagggtagggaggcaatcaaaattcaaaggaataacttttctctggagttcaaatgggtggatctttgaggaagtttcctcaagagaagggctgctcctcgggtctctaacctcaaatcttagtgcccctttgaaggagactgactggaagagtggtaaatgtggctccaacccacacactggccacccggaccaccctcatccttttgctaaggagagtatctggccttagactagtgactctgaggagacttgctccccacgccaaccccggtgtggccaggctccctccttcagtcccagccacaaccgtccccctatctccactctctggcttctttccccctccctttaggttctcctaaagcagcccctccctacgccagttcccacgatgccttggcaatgcctggcacagtccttggcaaggaagtgaggaagggaacccccatcctggccagactaggatgaaatctgcccgcgcaacaggtgtagtagggtggccgggccccaatccgcccgggttgggcaaccaccgaggccctttgctgcgagagagtcccagcactaaaggggccgagcgtctggcgtgagggggttgggaggcggggga

SEQ ID NO: 28766 - DNA, 957 bp, Bovine  19866880482522
taatagctatgatgcaatgactccttagaaaaggatgaattctcaaatcacatacttgcttagatgtaacactaggataattcagtattttcttacatgataacaccccataaaagccaggagacttaggttcactaccttgtaacctcagtaactaaagacatatttaaatgtctatactgaactatttcaattaaccagcaagccttcttcagaaaaaagagattctttttgatgggaacaaatgcaaatttaagtctgaactgaggaactcacttaacaattagaatttaatttagatttagagatcatttaatttggtgctttgacacaacttgactggtgcttctttccttgctgtcacttcaagccatggggccaattctgttctcagtaaatgtttgacagctttttacttaacagtctcagcacttttattaagcatgcaagactaacaaaactttggcaatgcataagtgtaacacagtgacgagagagagcttttacaattaagtcttctaatactgccttcacagtgtggaaattgtgctacatccaccaaaagagggccccgtctactcaaatattttagtacttcaccccaggaacaaactcctttgcatttggattcagattgctcttgacctggaaaataagtaaaaaagcaaattcattagcagatatctccagatactcagaagcattcaacccagatccacatgcaaaaccatcttccaaaaaaagacaaaggcaagaattcagatggtaaggtcaaactgaattaaaacacatctatagcagtgaaagaaggaaccagatgtaagctatgtatattatatcaaattttatcaatttcctaaacagaaggtaggacttgaaattaaatttgcttaagtgtaaccggaaactcactaactgcacatccaccaaaggaatgtctcagaacacagaattcta

SEQ ID NO: 28767 - DNA, 1196 bp, Bovine  19866880498942
gatccctgagtagacgtgggccctccctccaccccctctacaggtggttagactcacacccctgcgccacctggtggcaagcagcggagatgcacgcctgaaacctcgccgatgacagtacccgcggggctcgggctgtgcaggcctaagcgcgctgcgctccctggcgcccccttctgttcattcaagtgtttcttctcttttctgcgctccaactgtgtggcccgcgtggaatctgcgcggtgaactcggcatcttgccctgggcgacaggagctgagagacctgcagctgagcgtggagagccagcaagtgcagcacgtcgaggtggaggcgaccgtgaagcccgagctgacagcggcgctgagggacatccgagcccagtacgagagcatcgcggcgaagaatctgcaggaggcagaagagtggtacaaatccaaggtgcgggggtacggtgggggggcgcgggggtgggagggtttgggagggcctggaagggtggggcgctggggggaagggccccatctggcccgctcacgcccgagttgccaccctcgccgcagtacgcggacctgtccgacgccgccaaccggaaccacgaggccctgcgccaggccaagcaggagatgaatgagtcccgacgccagatccagagcctgacgtgcgaggtggacgggcttcgcggcacggtgaggaccaggctgcgcgccccggccccgggggtggaggacgaaggctgggctccccctattgaccccccctcttcacccacctccccagaacgaggcgctgctcagacagctgcgggagctggaggagcagtttgccctggaggccggcgggtaccaggcgggcgccgcgcggacttgaggaggagctacggcagctcaaagaggagatggcgcgacacctgcgagagtaccaggagcttcttaacgtcaagatggccctggacatcgagatcgccacctaccggaagctgctggagggcgaggagagccggtgaggggagggtggggcgtggtcgggatgggtgggggtggagcagaggcgggtggaaggccaaggtcccccccaaccccacgccgagtagctgactacaggttttgtccccaggatttccgtgccagtccattcctttgcatccttgagtataaagacgactggtgagtcttccgcgtttgagttccaacctgt

SEQ ID NO: 28768 - DNA, 1977 bp, Bovine  19866880513106
tgctcctggagttggagactctggtgagatcctgggtccccagtgcccaccaccaagcctggcacagaaaggtcaagaactggtactgatcaggaccccccccccccccgcctgaccactgcctggacacctcagggaagctgcaggtgggtgcggtgccctcacacaggggagcatccaggcccagagagtaattgagctgctgcaggtggcaggcggtaatgtcagcaggggttaaattcagcatccgggctgcgcaagttcgtaagggggtgtggttacaggtgaactgcaaaaacaggaggagaggaggtatatattagggtaactgaggaggggaggggttaccagggccatgcccaagtaccttatatgccaggggcccaagttctcactgagggataacaagaggcaaagggagcaagccaggaggacaggggttaacctcactcctgctttggggaggaaatgtgtctcgttcctctttgtagccccagcacccagaacagtgcttggcacagaggaggagcaggagaattctccctggacctttaccatgctggcaacggcggaggtgaacacaagcaggacagaaaagatgccaactgcggtgctatgtgccctcgagcggacgatactgcgagatacacgttgcagggcctcagggaacagctgtcaggaggcaggagacagagacagaccacgtcacccaacggttaaggccacctagggccagcccagtggcagaggcctcaccttctcctccctccccactcccagtctggcctccccgaccagccctggaaggtcccccacgtacagaaccacaggagtacacggcacaagtcagcacggtgaccagtaacagcaggaagatactggcgtggatcccaagcatcagagctgagctgggcgggagagggccagggaagatgttactctgggagatctgggggtcctttcccactccctgggcaggcagggggcaggccccaggactgtgtgcttgcaaaggtgttttagaagggcctgggaagtggtagagggaagagaagcccagcaaggaggggcagagctctcaccgtgggaagacaacaagctggatgaagcagatgaagcagaagaccagcagggcacaggccacgtaggctccaaagcgggggtccaccttgcgtgagtactgagggagaggagactgagctgggcactgccactgccctcggaaggccgcgtgttgccagttggcccagctgaggtgaatccccacagtgccctgtggtcaccccccccgctccccagaaacttctcctgttccctcacttgtgctcagaccaccctgccgggacctcctcctcctgcccttgcatcccccaaaccttcttttcaagatcctctctctggaaggtgagcaggaaccggcgcacatggtccttgcgcagctgatcaatgctgcgggcatcaatggcccggcccaggaactcgtctacctcatcctcagggttcagggcatcctgagcaccccggctgagggcagaggacatggcttcaccaggcgcctgaccacggccacgtgacaggtgatgagaagggaggggtacgggcagcactcagaggagaagtgtgagcggggcaggtgccacccagtcccacgcgacatgtctgaagtccagggaagaggggtatctcagctccccaccttcctcaccccaggctgcaagtgccttcccccacccgccctcctcaacaacttgacttacttgtctttgctggaatcatcgatgccctggagaaagggacagagtgtgaatgaggtgacgggcaggccaccttcacctctacagtcccttccttccccaccatcaacactgtgctgagggctttccccagagactctggggagcctgggacccctgggatgaaaccagccttcccattcccaattccagaaactgcagagacaacagcctcaacaaggga

SEQ ID NO: 28769 - DNA, 860 bp, Bovine  19866880598607
cgggggcttctttagcccggaacccggtgagccagacagcccctggtacaggctcggggggcaccacgccctccacccccaccacccccaccacggagggtgagggcgacgggctctcctataatcagcggagtcttcagcgctgggagaaggacgaggagttgggccagctctccaccatctcacctgtgctgtacgccaatattaacttccccagtctcaagcaggattacccaggtacctgtgggacagagcaagggagacagcctgcgacacgaccagtgcaggggtcacctgccagttcttctctcacacgtcgtctctgtcctccagattggtcaagccgctgcaaacaaatcatgaagctgtggagaaaagttccagctgctgataaagccccctacctggtgagacagaaggagcctggagtggcgtgggaaatgagtcataggcagcgtgtcttcgggaaagtcaccttcattccttctacttcccactttcatggcagctgggccagtaggggttggcttctgtgtggggagtgtgagggcatggtgagggagtgggactgggcttgagactgagtcccagcctcaggctgtgtcctctgttcctcagcaaaaggccaaagataaccgggcagctcaccgcatcaacaaggtgcagaaggtgagtgggctcagggtgcgcaggggcatccaagtctggttgtggggcagcctccctgagggtgggggtcagagggcctgcctacagcagcctaactgttctgtgcctggtctcctcctgtagcaggctgagagccagatcaacaagcagaccaaggtgggcgacaggcccgcaagactgaccgaccggcc

SEQ ID NO: 28770 - DNA, 1321 bp, Bovine  19866880603844
ggtcctgcatgccaaaaataaataaaattaattaattaaaagagagagagaccccagaatccaccaatagcatatatccttcccttataaagtttctggctgctatgacctgagtctcacaagctccaatttggttgtatttgctacttccctgcaggtatacaagttgccccttcctggatactaaaaagcaaggacttgtgggcatgtggattatcaccaatttcatcaatatcctgcactattactatatgtcagccttggttccagagctatgagctggaagaatacaaaatagaaacttgaaaggaggtgtatatacaggacttctttaaaccacttgtctgcatttcttctaatgccaacttgtttaatgctgtcttttcattaattcagaacaagatccacaggctgccagttgttgacccagaatcaagcaacatcttgtacaccctcacccacaagtgcattctcatgttcctcaaagtgtttatcactgagctcttaagccagaattcatgtctaagtctaatagaagattagcttctatgccagcattgccatgttctgcactatgaccccactgacacggctctgggcatctctgtacaggatctgccagtgaatgaggaaggtcaggtggtgaacatctattccacatttgatgttatctgtgctaagtcacttcagtcacgtccaactctttgggatcctctggactgtagccggtcaggcttctctgtccatgggacttcccaggcaagaacactagagtgggttaccatttccttcttcagtgatgttatccatcaggcagcataaaagatctaccacaacctagatgtgcctgtagtcaaagccctgaaaaatcgatcacagtactttaaatgtagcttcaagtgcgacctgcatgaggctctggagacctttctcagcaggctagtggaagcagggagtcaccgactcgtggtggtggatgagaatgatgtgatcaagggaactgtatcaccatctgtcatcctgtagaccctggtgctcacaggcagagagaagctgccctaagctggggggatgaggtcaggtggcaccaggggatgtgcactgcctgcccaaagctctgggaaccccagaagaaacctgaaggctcttccttgctcaggagccccccaccctcctacccggaagctgagaaggcatggggaaaggaaggagaatgaatttttaggtgtccttatcctcacaatactcagaaaaacttttagcctagctcctgtcctcttattcatatccccctttctgggcaaaccatgagctctgtgcc

SEQ ID NO: 28771 - DNA, 1687 bp, Bovine  19866880611658
tgttttactgcttttaaaaaagcatcatcttcagtttgctccgaggtgcataaatcaggtatggccacaaaggataacagacaataaaaagtctctcagagtaaagagccagggactacagaggacagacgccctgtaaggctggctggggagaacgatggcgaagcctgggtccctcatatcattttggagatgccctacagccctggactgcttacctctggacgtttcatttcatgagagaaaaagaacctcacatttatttaggccattccgtggcatgcagttaaactcaattcctaactgttatgcacagaatcctgtaacctactgagaaattagccaaatttatgttagaaaaaaaagaatttttgaagagctacatccagtgttacagagagctggaatgtctttagtagtttttctcagtctgatttgccacaaatgtggatgggctgctcatacccgtcaggttaagcaatacggcatatttttgcaatagattaggaacatgcatacgaaagtttctcaacacaaaggcccaacaaatacaaacgattcattggtctggatcccaagataaaatctattagtcatctgtatcaaattcactttctctcagcttcagcattctaggattctaagataaaattacaaatatcaagatggagaaatgtgtcaagtacagatttctacacatagcatataattcagagagcctaagtatatgatcttgaacaagtcacatttttccaaggaactagtgttttcatttatgaaatgaaaaaaattaaaaagtcagaaaacctaaatctcccataaggttgatgctaagatcagatatgaatgagtgtgtaaaaccctaaactgtgaagtactatgaatatataattaataaaactataacacataaaaaagaaaaaagaaacttgatattattggtaaaagagtaattacattagtgtcattgagaactaggatttttagtatgggagcaaggagatactgatataaaattgacaaatttgagcaaaactctgtagctcttaatttgatactaaaagattggcaatgaattgataattggttaaggctgggtgctgggggggtggtaattatatcagcctctctatttgaaatatgttaaaatttttctataaaagatgtattttaaaaagcaccttcttctcaacagtaaggacttttttcctctctgaaacttcaccttcaaaaagagaatacatcggtacaagaatggaccgaaactgtcactagaaatttcaggatacaccactcaatttaagtgatatctcatctctgaaaaacaatggatagcacctctgctatgtatccaacactttgttgctgctgctgctgctgctaagtcacttcagtcgtgtccgactctgtgcgaccccatagacggcagcccaccaggctcccccgtccctgggattctccaggcaagaacactggagtgggttaaaatggatcaaaactgaactcaattcagtgcttcaaagctgcctcctctggcccaagaccacagacacaaatgatttaactgtgagtcatctcaacctatatccattctcaacagtttgagagcaggttaaaagaaacaaccttcctaattacaaatctggcattcaatgcacgaaggtaaaaactgctgaaaagccctaaa

SEQ ID NO: 28772 - DNA, 3752 bp, Bovine  19866880638203
ttggagggttggcagctttttcttaagagcccacctgcctcaaaaacgctgggcctgagatcaacaggacagaatcaggtatctcaggatggggaagttcagatacttacccagggcagggcaggctcttcagggcaaggttgaggggagaggccactcaaccctcgggcctgggtcagaagtgagatgccatgacttcctgtacccatccatcatcctcttcctcccccagtcctggcctaggcctgtgacctcccctgccctctcttacctgctgaactctggaggctgatgggagcggtgtgaactgggttctggggcgggtggcaagacgccgcaacactgaatatgagatctggggagagacaggggtggctgagcagggacagatcgagacccagcagggatcccagccagactgttctgcccttgcccagcccccagtagctacagatacaaactggagctgaggggccaggggatggtacacgctgagcccgtccaaagggtgatggccgggtgatggcaggtggcactgcttggccaggggagggcatcaggcaggagtcacagccgtcctgtggagaagaaccaggtggaagagtgatccctcccacttggcactgctctgtcttgttctcacttcagcagccagtgtgattctttaagagctaatcaaatcatatccctcccttggtcattcccctctccttggctttccactcattccaagtcatagccaaggtcttatgcttgtttataaatccttacccagcccgattctgtcattgctctaacttcttacttcctctccttattctgctttagccttgcttttttgctaattcttaagcacaccaggtagaccccctgtgtacatctgaagttctcatgtcctggaacgttcttccctcagatatctgcggggctcactccctcaactctttctgctcttcacgtagccacacctcagtgatactcccttgacccctgcaactgcaataccacccactccctccagttctccttcccttatagtaccttgggggcttccctcgtagctgagacagtaaaaaatctgcctgcaatgcaggagacccaggttcgatccctgggttgggaagatcccctggaggagggcatggctacctactccagtattcttgcctggaaaatccaatggacagagtaccctggtgggttgtagtccatggaattgcaaacagttggacatgactggagcaactaacaatttagtaccttttttttttaacagataacttataaccatctgacatactatatattttacatgagtatttattttctatctccccttctagaatgtgaacttatttcgtattgtatatccagaacctagaacagtgcttggcacacagtagctggtcaataaacccctgtgtgtggaggaaatgaacgagctgtcagatctgtctcactctcagcactgacctgacagtgacctaaatacgtatcagactgtgacctctggagacctccaaggggccagtgccactctggagagggcttgggtccatctgggacaaacaaggacccaatgaacatgctgagatccaagcagggactgtttggctctacccacaatcctcagtgctgctggggactccctcgtgtacatcctctgccccttccccaatcccaggagggtcccatctcaccctggtgtgggttttatctcgggtttcttttaatggtatccgctgggccaggccgagggggccacctcctccttcatctgactgagtgacaacttcatgttccccttcagggagagaggaagctaggaggagacaggaaatttgctgtagtgtctgaaacacacatcaaagtctggcacatggttttgcaacctccggaaagggtatgccagtttgacagccaccactgcaccatcaagcctggggacccatccagtacccctttgaactcagaagtcactcattaatctgaataccctgagtgggctaggggtgtggtgatggctctaagccgctgacgtaggacagtgagtcgaaggtaaatcttgcaggaagtggcagagagaggatacaaatgaggaccacctcctctgacacaagtgtaaccgggcaaacctgtggcctgtgaagaagatctcttcctctctgtctcctcctgatctggccttcccgccacagccctcctgagctttctctcggtttgctccctacaagcaggctcccagctgacgttctctccccatggccagacacactcaccaggctgcacagacgtctccggaagggatcctgaggcctggctcactgaagtcctgaggacaacaaggacagtggcaagcagtcactgagtaccagatatgagctgggcactgtgcaaagtgctttacaaacatcatctaattctcacaacaacttcaaatgatgatacaaacattgtcctcatttgacagattaaagaaactgaagcttggcaggtaaggcaagcttgaacaacttgtaagtgctgagagtcaggaatcaaacccaaaccccatttgttcccacagtctgtgctctagccactacacaagggatggcacctctcatttctttccccttccgcccctcacaacctgaagaaactgatgccatattgaggccggactatgaaggcctgaacttcactgcaagggttcaccctgggaattcacagattttcccctccgccccgcctccaggctggtgggaagtcctaaagctaccagagggcccagccctgagggaccctgtatcagatactgaatcattcttttccaaatgaccccctccttacttgctgctgccactggtctctcttcttagttcctggaaacagggaagagcagaggggtgagaggaagatcctgaaggtggaatctgagccacacaggagcaaaagaaaaaggagagtcagaagcaggctccaaaccttcaggtttcaccaccaaccccatcggcctccatacaagccttctgcttaccaggagctaccttccatcccaaggcccagctgtgtccttaggagttcccaggaacacttagtatcagccccttaagaacactcaccagagcctccaacctctggggacacaaggtccgacctctaggccctggtccctccagccttgagaagcaggaagccctgacagggtccagtcgatgggtaggggttctgggggccaaatatgcagacgcccgggcatcctaggaccccaaaagagactctcagtacaggctcaggattccctcctcagcctaccccagcctgatctcctcctatcccggctcattacctgacccctccggatggtgcctccctgggtccctcgaaccagtactctctgagccagactgggctggcgccccaggcgacagctcttcaccccctcacctgacaggatggtggccagggctgcagggtcagccacaaactctatggtccctggagcctctgcaagggaaaaagagaaggaaaggcgaggagggataggaaggaggggaggctgaggggctggggagcctagcattgtcaccttgaggtgcatgagccaaagagactcatatagctgaactcagctcaacaaacattcataggactttaatctgcataagacactattctagacactgccacccagagaagaatacgacaaagcccccatcctcaggaaggtaacatcaaactatagaggggtaacagattcaagtcaaagt

SEQ ID NO: 28773 - DNA, 1964 bp, Bovine  19866880766482
atccctccacccttcacttcactgcggaagagcagggaagaggaaaaggtagggaagaggtacgcccctccccctcgccacgtgccggaggaccccagagctggagttactccctgaccgcttgccacgtgtccaagccaaagctgacgtgtttcagcggggcgccgcccccggggccccgccgctgccccccaggcccctcaccgagtagtgtatgtgaagcgtgtctccaaaggtagcaggctcagcacacggctcggggggctccacctatgatcgcactacacgagtcagggaggttcctgcccctcgacgcggcacccccaattcggtgcttgcactccctcctccccgctcccaggatcctttagaccccgaccttccccgcaaccgggcccgacctccatccacagcgcctgcccgggattctcccctcctcaccagagtctccacttggagggtccggacgggactttcggtttcggacccagcctccgcctgacacaccgcccccctgacagcagcagcagcagcagcagcagtcggagcgggagaagtgaggggcgcagagtcataactgggtgcgggcaaggctctgggcacgcaagacaagccgctggatgacaggggctgggaccgcagttccttcggcgcccaggccagactggatgggacggggcgggtcgcgacgcgccagctcctcctcccgcagcccttcctccacctagtccccacctcctgcagggaggaggccacgggagctctcccggccctctgagatcccgagggtgagactccgacctgtcggttagccgttcgttgggtcccacagcgaggggctgagtcacatcgtagcatacattttcgattacctattgtgttccagacacttgtctgtaatcctcaaaaccaccttgaaaggtagacataattgtttctatttcacagatgaggaactgagtgttcgggttaagtaactttaacttactcaagttaaactagctagtttagcttaactaactaggttaaactaatttaactagctaggtggtgacagaggcaggattcaaccctaggactacctgagtctagtccagtcccctcgctccctgctctttcctcttaagtctcctcacacctatcttggcaggatctgactggctcaccccagcccagcagttgtcaaagatggcagccctctcccacatccagcctttcagcttgcattcctggaggtcatatacccaaaaggaggcagggtgctgtcccataaccccacccttagggacgttagatgaaaagagcactgggctgtttacggtaaggagggggtgcatccctggtcttttcctgtctgtcaaaagggcagctacatacaccccttttgtttgtgcaaggacttcagtttttaggagtttttctattatttcaggtgaccctaccaatccccttctgcatgattcaagtcctcacctgcccacttaggctttaggtatatggattctgcccatcagtgagctcacagtcatcattgtttggggtcacctcttaggccttgtcctccttaacatctctccggtccatgatgcccatgagctctgactgccctcccaattttagacacaacttgtgtactgcaggcctccacctggatgtctgatcagtacctcaaacccacacacacactaccatactcattgctctttctcctccatcccacctgtaacaatctggattttgcacccagcgtcctgtgttctatttgttctgctatcagccttctctatgattcttctctcacttgccccacatccaaccagtctcctctggattctccctctacagcctctccagctctctttccattcccatggctaccaccctaattaatccttcattctttctttctttgggattgctgtgctggggtgtgctctctggttgcagtgagcagtggctactct

SEQ ID NO: 28774 - DNA, 1333 bp, Bovine  19866880771634
ccccaccccgcccccccaggtgaccacgggacctgtaccaggttctagcggccaagggctaccagctggaatgtcgaggggtggtcaaggtgaagggcaagggggagatgaccaccctacttcctcaatgggggccccaggagttagcagggcccagctacagatcaactgaaaggaccaaggtgggcatttgtgtggactctggggcttgctgggggaagctgtggcagggggcactgagcctccagaccctgctgatcacaaagggaacaccccagcaggctgtgttcaactacgtcctcaggctggtgaacgaggggataccaagaggattatgcaagtaactttttaaaactagggtagggttgttttccctcctttcttccagcttttgggagcaggggagggggcagcagcaaaggtggggggatccttcctacctgagagattaaaatggcagcttgtcacacctcccctttccctgtccgtctgggcagccggctcagggctgggcccttcctttccctttttcctgggaatcttttgtacaaagactggggcaggcttgaagagtgcctgttccacgcttgcctttgctgtgcctgcatccccagcatgggtcctgggccctccccacccggtcaggtctccctcagggacacagggccaaggagggagaggctcgggagacccagctctgtccatatttcaggggaacgtttccatttgccaaatcctagtcccacgatctgtccccaaaggggaacaaagggacttctgacagctcagattagccccagttcctgcacagctccagggagaggggcatctggtctcattggtactgtgaaaacacccaggagggagcaggaatgtgcatgagggcattagaagactggaaggtggatgttcgcctgcaggtgccaaagagagcaggccagccagggatggggggtggtgccagactccgaaggtcaggatcaggccgctctgcccccgcgcactcttgctgtctgctgcaagggacacagagcgtctctaccccttctgttgccaaatagaacagggccagggcctggaggaagacgaccctgatcctagacccgtcctcccagacctggcactggggagggccttgtgtgtctgtgtactgtgtgtgcacggtggtctgtgtgtgtgtctgttttccaggtctgtgtgtccttgcgctcctgctcctcgactctccaccctgggttgcctctttcctgtgggcttctgtcttctgggaattaaggcaggatgtctgatttcaagggatggagacagatgcccagtttgcacaggagtggga

SEQ ID NO: 28775 - DNA, 1479 bp, Bovine  19866880771957
taggtcttgggagtagagaaagccaactcccatggttcatacagctcacagttgagaaacaattaattagaatgccagtgtctacaactacccatgattaacccagcctctctcgggttcccatcttagtctcagaaatactattctttacgtaagaatttaaaacgtctgagtattgaatccaagtaatctttatagacagatttacaatataaccaatatctcaaactgctcatttttctcttataaaatcagaactgaccaaccaactatttaaatgtctactgaatacctactaggtgtcaaggcactatgccagggctctgcagacacagtagtgcctatcgagtgaggaagacaggttactcaactacacatacaattataagcgtgctaggaaggcacaaacaggggatgtgacaggaaagccagaaaggctgaggagatcaggaatgagatgtgagctggaatggcgcgggtagggggttgggggggagacggggagaaaggagggaaaagaatgttctgggcaggtgggaaagcatgtgcaacaaccccgacaggagggaacaggtatgcctgtggaaaggagagctagcacagccgaagcactgggaccaagggggaccaatgtgcaaaggatggcagtagggccagaccgtatggagccctacaggccgttaaggattagagactattctgaaagcaatgggaagtctgaagcagggtctgtagtgtgaggaacagatatgaacaggtgaggacggcaaggtggtggccaagtggaaaactggaattagttaagaggctactacagaattcaaagcaagagatcacagtagcttgatcatgatggtagtggtggagacaaagagaaaaggtcagatcggagactgtgcagaaggtcaaatggacagggtctgctgatagatttaattgtgggaaaaggagaaacttcctaaggtttccactttagacactgggtggatgacagtaccatttacagagcaagagaacttggaaaagggccaggtttgggaagaaggggtcatgagttcaatatattaaatatcgccatgaattatggagatttgctactttagtccccgagggtaagaagaaaggcagaaaagagaaggaagttttaccttgatatcagctctgagctcgaccaactgctcttctgacatccgaacagccacatcagtcattttctttagaagttcggctttcttttgacggctaagcaaaatttccactgtagagggaaagggagcatgactcttatggtctgctaaataggacaaagaaggactggaaatataggccttgcagtgtgtacttgcacagccaaaggcttagctgcccacccacccagaaagtgaaaataccaaaggtctagtttccaccttcttgaggaactctgaaggcagtttatatggtaaacaccttttagactcataaagactcataaatcat

SEQ ID NO: 28776 - DNA, 1427 bp, Bovine  19866880799004
tgctaactgtttcccatcataccccaaaagggagctgaaatgaatcagggcccagagtttgagggctttgtgactttgcccctcaagttgtaaagggtttaaccctgaacttagccatgttcatcatcttctagtagacttagggactccagtagagggccctaatgcctcacacagcccccactctcagatgtccccagccctgtgcctcaggtgcttctagttggaccagggtcccctcatccataggttggaatctgcttacccatctagttctggactttggcattgagtaaggtgaagggtaaaggtctgagtagtgtaatgaacttgaccctccttatagctcatggccctgcatcacctctgatttaggtgtccggttccccattgtcaggaggccagacctcatccagagataatgttttgaggaaaaagacaagccttgtccttccatccaattcccaccactactcttttcctctcctgctgttactcaggcaaagaaagggatactgctcccctttcttggtgaggtctgagtgagccaggcaggccttccccgctctcaccacttaactaagctttaatgacagaggtcttcccaactcgatgttatggaaaaggcacaggatataggcatgtaataagtttgagagccctaaataccagtgtgaaattatcctttgtgttcagctacctccctgctgcctcccctggcaatcttccttttcagcccctctcttgctattaaaataatccatcatggttaaggaccagtgcatctgcccttatgaacccttaaactacttcaatcacacattgctttatcaaccccataagctttgaacactacccacataaccctcaaaaccaggtgatgctttcctcctcctgggctcctcagaagtcctgcttagtgaccaaggttgctgataagttaggagcacttgcccaagtgcattatttctatactaacaaatagataacttctagagctacagccctacataagataatggtaatggagaggactttagctggatggcaggccattgggggtctttggacctctgacaacttggggagaggatggtctagtgcctctgtccctcagtagtcagtccaggatgccaggaaagagggggagctctcttgcggcagttgcttgaaacttctagcttttggggggatggaggaggacatggggagatgaaagggagacttaacctggaaggtgaatgtttagcatccagctcttaagacaaaagcaaccttatcttcccagaacacgaatagctccgtattcatggcttggcccaggttaatctgggcaagggagcttctgaagtgagcctagagaaagctagtggaaagccttggatcgggccaggtgggatggagtcagtgacatgcaggataagtgt

SEQ ID NO: 28777 - DNA, 3133 bp, Bovine  19866880857946
cgttacatctgtagtacttattttcttaaaagtggaatttgataccttttgaatacctttatccaattctccctctctccactctcctactttggtaaccacaaagctgatctcttttcttatgagttcatttgtttttgaattataattgacctatgttagttcctgttacacaacataatgttttgttgtttttgtacatttcaaaatgatcacatttaatttagttatgatatatcaccatacagagatattacatagctattgactatattctccatgccctcacaatggtatgtgaccaccaggaagaccatagtgtagagaatatagtctgatgcctctgaactatggtgctggagaagactcctgagagccccttggacagcaaggagatcaaaccagtggtcatgtatggatgtgagaattggactataaagaaagctgagcaccaaagaattgatgcttttgaactgtggtgttggagaagacttcttgagagtcccttggactgcaaggagatccaaccagtcctcctaaaaaaaatcgtcctgaatattcgttggaaggactgatgctgaagttccaatactttggccacctgatgcaaagagccgactcactggaaaagaccctgatgctgggaaagattgagagctggaggagaaggggacgacagaggatgagatggttgaatggcatcaccgactcaatggacatgagtttctgcaaactctgggagatggtgaaggacagggctcttacaccacatacaaaaaccaactcaaaatggattaaagacctaaacataagatctaaaactcctggaagaaaacacagaggaaaagcttcatgatcttgacgttggcagtgatttcttgaatatgacaccaaaagcagccaaaaaaagcaaaaattgacaaactggaccatgtgaaaattaaaaaccttctgtacagcaaaaataatcattggagtgaaaatattagcaaatcatatatctgataagcgttaaataatcaaaatatataaagaatgcctacaacttaacacagaaaaataaatgaccccaagttaaaaatggacaaacaacttgattagacgtttctcaaaagaagataagccaacagtcaacaaacatatgaaaagatgcttgacatcactcatagctagagaaacacaaatcaaaatcatagtgagataccacctcatatcgattaggatggctgcgaacaaaaacaacaacagcaacaaaacaaaacacacacagacacaaaaccagaaagtaagtgttgttgaagatgtagaaaaatgaagatgttgaaacgcttgtgcactcttggttggaatataaaatggtgtggccactgtggaaaatactatgaaggtttctcaaaatttaaaaatagaactactatatcatccagcaatcccacctctgggtatatatccaaaagaaattaaagcaggacatcaaagaagtatttgcacatccatgttcactgtagcattatttataatagacaagagatggaaacaacccaaatgcctatcaacagatgactgggtaaacaagatgtggcatatatacacaatggaatattatttggcttttaaaaagaaggaaatcttaatacatgccacaaaataaatgaaccctgaggatattatgcgaaatgaagtgtcagtcataaaaaagaaaaatattgtatgattccacttacataggctatctaaagtactgaaatccacacaaacagaaaggagaatggtagttagccagagactagagggagagggaaatagaatattgtgattttataggtacaggctcaccctggagagattgcagggttcagttccagatcactgcaacaaagtgaacatcacagtaaagcaagtcacagaaattttttggtttcccagtgcatatacagttatgtttacagtgtagtctatttagtgtgcaatagcattatgtctgtaatgtctagatgtcattatgtctagacttccctgtagctcaaatggtaaagaatctgcctgtgaggcaggagaccaggcttcaatccctgggttgggaagttcctctggagaagggaatggcaatccactccagtattcttgcctggagaatcccatggacagagaagcctggcaggctacagtctgtggggtcgcaaagagtcagacatgactgagtgactaacacacagcattatgtctaaaaaaatgtatgttctttagtttaaaaatacattattgctaaaagaatgctaaccatcatctgacaatgcagggttgccacaaaccttcagtatgttaaaaaaaaaagtaatatctgtgaaatacaataaagtgaaacacaataaagaagagtctgcctataatttcaacgcttgtgtctcagggaatagggaagcctgaggagagggaagagaggtagcggaatggtcagttggtgggtcagtcagaatcaattaaattttcctcacatttgggcatggtttgtggcactctaaaacaatgacagtagtaacatcaaaaatcgctgattacagatcaccataacaaatatagcaacaataaaaacattcaaaatactgggagaattaccaaaatgtgacacagacgcacaaagtgagcaatgctggtagaaaaatggcactgatagatttgcctaacgtctatcagtgggacactagtttgataaattatggtttattcacacaatgagatactacgcaaatatttttgaggaaagagaacatccttttatatactgatataagatatactgttaagtaaatgatggggagaagaataatttatactatcatatatacataaatattgtgtatctgaaaagataaacaagaaagtagccaacagtgatgatccactgaagaatggaaattgaaaaaataggaaacaaggttaagaaagacttttcaatcatcctttttatatgtttcaatcaaccttttatgtatttcttgcactgaaacatataagcatattatctcttcaaaacaattgtaatacttttttaaaaagactaattcccagcaaattaaaccaaagctgaaaactctcagtttaacctaaacaacgtttatttcaacttagaaat

SEQ ID NO: 28778 - DNA, 1261 bp, Bovine  19866880867503
gaggaacctgtctatctgctccacacaatctctgaagcatctagttcagtgcctggcacatggcagatgctaggaaatacccgctaaaatgaatgaatctagcaatagtcaagtttcccatccagcaacagctttttcaagaacctgtcagaagacagatccttgggcaggttctctccttccaaacagtactttcgtctcccctcacagcacccaggtcaaactctttccctctcctaactcctctgtttccttagtcagactgaagggactgaaagctaatcctgcctgaaaccttgctcccttccctttccaactctaaagtgcagagtccccacttccttactgtaattgtgctgtcatgtccccatcaagcaagcaacagcatcatttaccagtttccaggatatttaagggcagggtacggaaaacatccaaaatattctacttttcagtaagaaaggggagaaaacagaagcaggaaaggtaaacaacaggaaacagaacaatgaagtctagttattaaagagctggattaacagctctttttatggtaaaccacttcggccctaagagaagaaaaggagtaacagagctccaactctgcactcccccagcctctacacctgcaccagcagtaaaggacccctttgctctgcagcttcttcccacacctctactctgcatcttcttatactacaacttgcttggaaacatcaagactaatctcattatgatctctaaccctcctttgtatcattcactgcaagaattccagaattctggagccatcctaaatcctccactcacatccccatatggctaagtacatcccctttcatgaactaccccctttcctactaatccctcaattcctgaaatcttttcaccatatcctctggaacttatcaacaaaatctcctatattttgacctcttgtctgaatgatcccttcacctttttgctcaagaggaaatctaatagctgaggccactgctctctctacagtctgatctgtggctgttttctctcccacacccctgacactatgtacctggacggggagggggggggggtagtggggaggagtagaaggaggtactcaccgtgtaccttgtttctgtttccagattattcccttctattcctccctaaaaaagccctctctcagaccatacttccacctccccacccctctgttatattcatctagataaggtgggtcacttcttgagcctcaaagcttttagttcctacctca

SEQ ID NO: 28779 - DNA, 887 bp, Bovine  19866880941799
ccacctcatgcaaagagttgacttattggaaaagactctgatgctgggagggattgggggcaggaggagaaggggacggcagaggatgagatggctggatggcatcactgacttgatggacttgagtgtgagtgaactccgagagttgatgatggacagggaggcctggcgtgctgcgattcatggggtcgcaaagagtcggacacgactgagcgactgaactgaactgaaccccattttaagacaaggaaaatctgtactgctgtaaatgaggagaaagggcatttcaagaaccttctgtgcttagcattactagtgcccttcttgtatgacagctgtgactgttccaaggtaactctccatgtctagaccaggtgcaaaaatgagtgatgaaagtgggagtgggcaggaatagagaaacacaggtgcaaaatccctcactttccttgtaatactaaaattcatattcatctaggtatacttcctcaaaccacacctctgaatactaggcctcaactgtttgtctttcaagttccaacttcctaactggcccagtgaccagttgcttccttcagtctcttaaattcatcactctccctcttccttatgaaaaaaggtctcttgattcagacccccccagcaacctagtcttagcagtgagtagcaacactggtacagtgagggctctcggaggcctgcacctatccctggttaagaaatgaaaatgagagctgaaggagtaaggtccaaagcaagagatattcactcattttctggcttcctgactttgcccaaggagccccagtctccactgcgcccactacgccgcctcaatccttaaataacaggcatagccctggggcttctcacctgttcccactgtctca

SEQ ID NO: 28780 - DNA, 1232 bp, Bovine  19866880964255
cctcccaaccacttgccaagtaagtaccaagccgggcaagagggggcagtgccaccctgggaagctccagctctcctcccccagagccgaacccctcccttctctctcctccctattaatcctcggaagtgaaggggccgtccctggcggcccctcaaggcctattgtggcccctcgccctcctcggctggcgtctaattaactcctcctgcccctggttttatgtgccccccttaccccaccttgtcggccccgcccctccgctcggcccgctccccgccacggacattccagcccggccgggctggtgtgccagggcaaccagggccggaccgaggcctaatccccccgccgcctggcccgactgggagagccccgctcacctccccgctctctgggggctgctcggctctgcggtggcggagacacacaatcgggacaaaggagcagccccccaggggggctaactcagccttcacgcccaggttgtgcggcatttggggagtttaatgaattgtccatcacgcctttcagggcccgcccgtcagcctggattaatcttcggagccctggtggggtaggagacactaagcctgtatttattactctcccattgtcactaattgaggtaattatctgtgactctggcctggccaacaatgcggcattcactcccgggacctcgacgggcctggctcccactctcagcaccagccctccctcctctcctctcccaaacccgccaagggctaactggagccccggagcatgatgggaaagtggacaatgtcccataatgcttcacctccaaaccggtgtggagttgcaactagggagaggtccctctaaagcaggtgagaaaagaaggcagcctgtctggggacaggtttggctggcagagcccccgagccacagaagggcatgcctctggggtctttggttttctggaccctcatctctgtgttggtgatgccagcgtctcccagggtccttctgtgaacccaccttcatgttcctgtagcctccagagttctagggtattaggaggccctatcccataccaggtataatttacggagggccctaaagtttcagggctggcagagtagtgtgggtgggggaggtggggaaaaagaataggcttgggctcaggggaagagcaaaaggagccatcacaggaaggagcaccgagggctcatgctactgggccatgcaatagccttagggagaaa

SEQ ID NO: 28781 - DNA, 855 bp, Bovine  19866881032280
ggagctttgggggcagtaggaaaaggggacaacagaggatgagatggatggaaggcatcaccaactcgatggacatgggtttgggtgaactctgggagttggtgatggacagggaggcctggcatgctgtgattcatggggttggaaagagtcggacacgactgagtgactgaactgaactgaaatcatagtttaatggaaacaagaaaacttcagtctttgtataagcttatttttcagagttagacaattgaggcagaggtggagcttttcagcaaggaaatatccgtatagtccttctgtccaacagaaagatttcttgactcagcctccaatataacaatggccagagggacttgatctcagctctaggccttggagagtgatggtggtctctggagagtccattaagcaggagttctgctctgatctgtatgaattctccagggccaacaattccttccctgtattacttttttcagtgagttgcattatctaagaggtacttgtccatgccaattatttctaaagattaaaatacagagttctaagatttcttagttgtaaatcttggaattccttcccttcttccctctctccttccttttcctctcttatattttaaataatatttgattatagaaagataataataaaggatataacatgaaaactgatattgaaggtattttaaattgagaagtgtattaaagatattttaatgataaaagaaagtacaagtttatcatgttatccaaaattaattgttttatttattgcaacagttagacctggacaggaacagtagacggttacaaatcaggaaaggagtgcgtgaagactgtatattgtcac

SEQ ID NO: 28782 - DNA, 1009 bp, Bovine  19866881035726
ctctcctgaagctgacacccttgccatatcagagtagaaaccctgggccactcccctctgctcccagaggcagaccttgccagggataattaaaccttggcctctgacagagtgtaatagggtacgggtccttgagaggagtgaggaagggttcagccactttcccctattctgcaccaagttaagaggcacccacattctccaactttactttattggaagaggcagcagcagctgtagccccagggcctaacccagatgggggtgatatggagactgtacaggatgagttttaagtgctaagaaagaaccaactggttcccccagttcacaggaagactgccaaagctagagcctgaagcctgaaaatggagatgagggaagaagagatggcagagaagtcatgacaggaccagcgcccaccccgtctcctctccccccacccagatgcgttctcccttccccaaagccagcgtttcccttctgttttctgctttccatgcctctgtgctacagccagtgaaacttccctagctcccggctgaagagagggccatgacctgtgacccgcgccgctctgctgccccggctttcacaggcatgtgcacggatgctggtggtcccttcccgagttgctctgctcctcccaccggcttgctcagctccccagccacgtagttacaccccggagcactaagagtccgcccattaaggccacctcccgtatccggagggtcggtccaccgccaggctctcaaaggatggggcggcgccttgggtggagcaagctgaaggtggtagggaggggagcagaggcgaagggcgagcgagggcgcccgggaacggagtccggctcagtctgggtagatgatgaagccagagaaggtgctgtacttgttggtgttaccgccgtgcaccttcccgccgtccagcttgatgaagacttcgtcgcccacatccaggtgcaggatcacgctgttgctggcgtagtcgtagttcggtcggcatc

SEQ ID NO: 28783 - DNA, 674 bp, Bovine  19866881054520
ggaaggtgatggcccaccactcttgcctgctcgtcccgtgcggccaatgcggtggatgtaatctggggaggggaagaaacatcagtgcaccaggccagatgccctggtgggcagtgtctgaagcctccacttctaaaggcatcctcttctctgccacccccacccagggcagtaaacgcagctcatgctgcctgaccctgcagggcccacggtgctctccccagcagcactgctgatggaggtcaccctctcacactcggacagtgtggcccagctccactcttcacacccagaagacaagggtgctgtcccaggtgctgagacaacacacccaggtgagatgaagggcaggggctcttctcatgggaacaagcaaccccaggctcgaggctaagagagctgacagcagcggccccctcggtggagacatttgagaagaagcaggcagggaatcaccctttacctggagtgaagctctttcccccgcactcaccctcaatgttcttggccatgtcatagttgacgaccatagatacatcttggatgtcgataccacgacccgccacatctgtagccaccaaaatatccttggccccagccttgaggttggacagtgcaaactctcgctgctcctggccttttccaccatgcagcgtacaagcgttgtactgttg

SEQ ID NO: 28784 - DNA, 691 bp, Bovine  19866881096978
cccctcttttttacttgactttgtcttcactctccttcccccctctcaaacacaccaaaaggttgaccttcccattcctgaatcttccaggtctacagggcagagacttgacctgattctgggtctctggtcctctgttttggtcaatgtgtctttgagccactttcccttctcttgctcttctttaaacacaggttgtccctgggaaccctctatatttttgtctctgcacccctccttgtgtctccaggtttaggaatctcttccaatttttcccccctacatttaggggtctctctttgtttttctgaggcttcacctctgggcatacccaacgcaacagtgagacacatggggatgggaaagggagtagaacttccttcctgcccccatccagaggcgcctgcaacctaaggatgggtatgtaatgcagggcccggctatggccgggtcgcttctcattcagggcacaggcacctggtcgatgcccggcttgtccgcccctctccccacccccaagccgccctcctccaagctcccgccccctccgcccgcccggaaaaggcaaatttgacatttttaaatcccgagccttggagggatctgatgcggcccaggggccccgcccggggtcgatattcctgattgggaaacggccgctgagcccgagcgcgtgtaaatcacccggacg

SEQ ID NO: 28785 - DNA, 1089 bp, Bovine  19866881099611
ctgccctgagcctcaccttcttgatgcctttcaagccccatcttggcctttgcaattggatcaatgatatcttctgcagcaaatttgtccaggtctagagacagaagagccaagtgagcctggcattgaggtcaatgttgcaactctttgacttccaccaagccaagcagaacaatggcatggcatagtggaaagaccactggactagaagccaggtagcataggtgactcaattctgttattcacaggacacatagctgtttttacttgcatggtgttaggaaaaggtactcagtaaatatttactgaaccaatgcattaaagtcacttcacccctatgagcctcagtttactcttctatttgacatagatcatgattccttattctgcttatctcatggagctactgagaagatcatatatgaccagaatatgagtttactttatgacctagaaaacaatcttcaaaagtcatgttcttaggacaactaagtgcagcccaagaacccaagatatgggcagggtgccaaagcccaatgccagagttgctttggccacaacacacaccacctacaaaccactattctacctgttcaggacacagggcagaaaaagagaaacaagcagataccaaatcatcctaaaatcttatacactgcatatttctccactactcagaaagcttaactgactccctacttttaagaagattaaccaaacaccttctcctggttattctgaggtggtaaaacagttaaaaggatatgagggccaggcttcaaattccagctgttagttgtatgatattgagcaagttaatctttctgcctcagttttcttttctataatctaagataataatagtacctattacatgtacacactgctgtatttaaaatggataaccaacaaggacctactgtacagcacacagaactctgctcaatgttatgtggtggccaagatgggaggggactttgggtgagaatggatgcatgtatatgtacgcctgagtcccttagctgttcacctgatgctctcccaatacaaaattaaaagttaaaaaaaaaaataatggtacctatttaa

SEQ ID NO: 28786 - DNA, 1825 bp, Bovine  19866881109778
cagttgttctcagcaggggccattgcccccccatttggcaatgtgtggagatatctttgtccgtcatagctctggtgggggtgctgctgacatctagtgggcagaggctgggaatgctgctaataaacattccacagcacacagatagcggtaatgctgatgctggtagtggcagtgctgtgtaactctgttttagagagtttggcaagttctaagaatggattaaaaaaagtaactttcttcaagaggttttatttggcttaaaaattataatgtacattagattttttacctgtaaaaacgtaaccttaaaatttggaggattaaaaattacccatacttgcataatcagtttatagaaaattgggtacaatcaatttatagaaaattgtactttctggttttaaaaatgagcccaaatttgaaatgacaattgtctattaatttagggaaaacaactgtgtagttaggatatcaggaaatgctaaaacttgaggaaaatgtattttgtagactgacttctgaaattttgctatctaatcatgatttcaatgttcgttcatcctacagcgcttctttgccaatttggaaatatagcccctttctgtttctacccataatagaagttgttagggctcctggagtgttcttggagtacttctttccatgggtcctgattaaagcaaagtatttcctgttagagtatgatagctaattacattgctagagcttctgttttccccagtaccctgcttcttttaaacaaatttatgtaataaacattttggaaacaaagttcaaaatgtgtttttaaaaaaataaaaacaactttctgcctatcggcttaacagcagaaacaacgttgtatcttttgactcttggaaggagtcttgcagagataggggcctctgcaagctatttgcttttgctgtgacatgtttcttctggataggtagggatttctaggatcattactgttgacacttagcactatgtttttaaatgtttcatatttgaccctcatggagagaatgagattagtgtctattctaaagtatagatcctgaaatgaaggttggggactagttttacactacttgtagagctagaattactctagtaaatgaaaatttgagaaataactttaaaaattgttacctgcatttgattctgtatcaaatgtaactaataatcttatgtagtccagaccttgaattttacatggcagacaacttttttatgcctcggacagatccattttatttcccttgaccatttttctacagatatttgtcaggacacgaatcaggttctcttcaaatgctgccaggggtctgaagaggtaccctgcaacaaaccagttcctgtaagcctttctgaggatccttgctgcccactgcatttccagttacctcctcagatgtataagcccgagcaggtactgtctgtgccagacgatctggaagccggccccatggatctgtacttgagtgctgccgagcttcagcccactgagagtttacctctggagttcagtgatgtaagttagagaagctctgctctggttggcccttgaggcaaggccttgtttattaatggtgagactaggttagtcatttgtggtttaaaaaagaaaaaaactgataaattttttgaaatgatatgtatggtcgtatttgtatgttaacacattcgtttagagacagtttaaatttacagaagtttttctgagggcatgataagggatattataaactaaaagaagttggaggaaagtctctgtgattggatttacgtagctgggaaatttggtgcccattcacaa

SEQ ID NO: 28787 - DNA, 639 bp, Bovine  19866881180837
aagctctatgagtttgttcacagttttcaggatgagaagcgtcagctggctctccaggtaaggtttcttccctctcattgctgtctaagatggctccagaagttagactaagtctcactggagctggtgtggaggtactgttttcatgtctgctgggtcagaccccagaagggtatcttggcttctttgggctaataaggagtgggaaaagatatatgtatattattttctttttactgaggtataatatgtatataaagtacactaattttgtgtagatacctatgtaaccaccactcagatgaaggtatggaatatttccacgattaagaaggttcctttgggacttcccttccagtccagtcattaagactctgagctccctttgcaggggtcatgggtttgacccctggtcagggaactaagatcctgtatgctgcacagtgcagccaaaaaaaaaacaaaacaaaaaagattccttcatgccccttcccaatctatactcctttcctgggaaagaatctgtattcagacatctattaccgtagattaattttgcccattcttgggcttcatataaatgggatcatccagggtgtactcttttgtgtctgagttctttcattcgacattatgttt

SEQ ID NO: 28788 - DNA, 720 bp, Bovine  19866881191825
aaactcagggtttcttatcagaagttgacattaagaatatttctcctgtgttgtgatacataataaaattgagcttgattatgtaaagcagctgttgtatagtagatgcctaataaataaaccagaaatcatctgtggagacatgaacttccagtaagaaggagaaatggcatctgtttcaaggatgatgtattttattttattttcttgtctagcactgaataaacgtctaccagaggccctgtgattttcttttgatgaccctgaaaatcataggttaatgaaagtaagaaaatcttgacttcttgtattagattatgtttcagagtagacaattgaggcctcagaaagaaaatggatttttaaaaataattcacacatcaggccaacaacagagccaaaactagaatctaggcctactgattctagtacagttcttttcctgctactctgcaatgctctgtttacagagcaagtttccttagtgtgaaaatatcccacatttacattcaaaggtatagcaatgacatacctgaacattcctgaaccataaaaagtggtgaccacaagaaaatgagatgagcaggtagagaagatcttgttccaacctgtggtggagttgatccccagggctgtcaagataatacgggtgtaagaacccaccaatagggcaagagaaccaaggcccaggaccaccatggtggtcaggatggaggcacg

SEQ ID NO: 28789 - DNA, 1143 bp, Bovine  19866881230812
aattagggtactttcacctccccagcctgcctgcggcctggcacataaaggtgattaataaatatccctacagataaaagttattaatctctctcagacggctttgccccctagacagcagtgccccctgcagcccagggcaagacctgcagccacacagactagaggctggctgcccaggaaagctgcatggccactaccaaggaagagatgactgtggctgtgggtttcaaccccgtggctcttcttccccggggggcctgtctctgagtcaacgtgccagcctcgggcgcgcggggccagccgtgccttgggctgcggtctggcaggggcggggggcggctgggaagcctggggcccctctctggcaaaaatagcccacagtggttagagctgggagggtgagtcaggcaggagcgcagtggcgcctaaccccttcgctgccactggaactccctagggtggtttgcctccgtccgtgcaacccacgatcagactctgcctggctgtcctcaggctgggctcagtttgggatccctcctctttccacgtgaagcaagtctgcgagtctggagcaggaatatgggccaccccggagtggcgacttgggatcttaggaagggcaggggacctctgctggcaaggatgtctgtgagccgaaggaagcacaggggcaggctgaagatctccggagctcccggaacctctgccacagccaaactctgaggccagagctgacccctcccaaggggcaggcgtagggctccgaggtgggcggaagccaagccacccagaagggagctactcccgccagctcagattgccctgcagtgcgctctccccaggctctcgcgcggagaccaagccagtcaagccaggcaagttcgatctgagttccgtcttcatctggtcaaaggcaccttccagtcactcagctatcggtgggggaaactgaggcaaagagacatgaccactggggaccagaggcttggctctctagtctgggtcgccacaccctccttgcagccttggcggtcccagagcaggtgagtggaactctggccgcctcccccttcggtggggccaagcctgaaacccaagcgtcgggggagagggtgtggagtacgccgggaggagggggag

SEQ ID NO: 28790 - DNA, 1472 bp, Bovine  19866881319784
tatttcttaatttttatgttttcctgtgtctaatatgatgctacactgtgtatgttcagcaaatcctgatgaagaaaggaaggggagaaaaatctgaattctgggtaataaaaaggtcacagaaacctttaccatctgagccacctgggaagcccccaaagttcacctgaacctcaacacagtgcttctcaactccagtttcccaaaatgccaagaggtcttggcaggatgatcaacaaaatgctctgtaaattctcaaaacaagattacttttaattatacttcagttctaaagcaaacccacatctgtcacatagcactttctgaagaacagaatgttatgaaatcagacaagtaaagaggcaacacaacccctcaaaagtccaggaaccactgataatgctgattctggtagagtggtatggagagaagcagacagtctatagacagcagagcagcaaaggcagcgagaaatagatgcagagcatagaacacttggtagtttccattccagttgggcacatacactgctattgtcaacgatcttgtcaggcagggatcagtaactccaggtctgcctgacttccaagtcatgccctttccctaattctcactgcctattttgttaatgagaaggggtgttgtacttagagatgtcctgtggcccagttgaatatgcctcctggccatcttcatagagatggtgttctttgctgcttgagggaaggtaatggattttattttaggaagctaggagagcctcagaggaaaagaataatgaggaatgagagtgggggtgcgagtgggggaggtgagaggtgagccttcaacctgggaagtagtctataggatgtagtttaagggaaaccaattaattgttgtccccaaatatctcctgcccaacacattaaggtgctaggaatcagcaccattatggctttatggtttaaggccttattttcagcaggtcttttaaatacatgcattatatgaaaagagtagtaaaaacaaggagcccatcaacaacatagaaatttgtaagtttagtcatcacctggagtgacatgacaggagggcatcaggatctgacagaatgagacaagggcaggtttagaaagtaggaaaggtccacagcttggagtgtgtttctgaagtcactctgaaaggggaagagtggtggtaatgggcacttggtgaggacagagggaaatggctgtggaagaatataaaggtaaacttagttgtcgtttagtcgctaacatgggctgtagcctgccaggctccactgtcatgggatttcccaggccagaatactcgagtgggttgctatttgcttctccagagatcttccccacccaggggttgaacttgcttctcctgcttggcaggtgtattctttactactgaacaaaggtaaacttcgcctgtttccaaatgttggttttatcaagcactacctggaaccctaaata

SEQ ID NO: 28791 - DNA, 1534 bp, Bovine  19866881334218
gcatcagccagggcaagtcctcagtaaagggagatctgggcagtgtatcatagagcccaccacactggctacaaaaaatggaatatgatgtatgtcttctgcaacttgctcttcaaaaagattaatgattattttcaaacatattccaaatagagggaagagtataattaacagctatatatccattgggcttccctggtggtcagtgataaaagaacttgcctgccagttcaagagaggcaggtttgatctctgggttgggaagatccctagagaaggaaatagcaacccactccagtattcttgcccagaaaatctcatagacagaggagccaaaagagttggatacagcttaacaactaaacaacacattatttagatacttcgattatcaagattttgcaacacttgcttcatctatccctttctcttttttgattcattactttgaagtagacttcatatcatttcatccttgcaacttcactatccatcgctaacaaatatgaaccttttcttacataacctcaatgccattttcataccaaataaactaataacaattccttggtccatattcagattttcctaattatcttttaaaattcatttttataataagcttgttttaattagaatctatataaggggaacacattattttggttacgtcacatttctttgaatctaaagcccttctttttccctatgcaattgtcttgttgaataattaaaagagtgtgagccattcttatttatttgcttcttaatggttcacttaacttgttcctctatcctccatatttcctgtaattttaagttagctctaaagcttgcttagatccaggttcaaggaccataggtaacaaagagtgaagaagtgccattttgttgcctgaaacagtccatatggaaaagataggctaaagcttaattctttccctttatattgccaattttcagaatatataagaatgtttttcactttctctgtaaaatctcttatgagatcatgatttgaaaaataatgataagtgcattcccgtcgactgctgtaaatgttcttgtgaatgcttatggtgtccagtttttttaccaagaagagtctctttgtgccagctccctatgtccttttgatataatccagttggttttttttgagaacttgcttgctttctagaataacaagatgcttcaggcttttactgtacattttattcctcagaccaggaattagccatttctccaaaaagctctgcttctttttagtgggaaattggctttttaaaacaaactttttgttgtggaatagttttaaagaaaaattgtggggataatacaaagaaaaatctcatatacaccatacagtttccctcattattagcattattagagtggtatatttgtcacaattaatgaaccaatactgctgcatttttaaaaaataattttacttattatttacttatttatagccatgctgggtcttcattgccgtgtgccttttctctggttgctgtgggtgggggctact

SEQ ID NO: 28792 - DNA, 1299 bp, Bovine  19866881360068
cagagcaccatgtccagctctatgagggttttttccccgggagaaaatagtttcagctgaaccctggttggtgcatgggcagagaagactcctagagatgcacatatccacacatctgaaaaaggccacagaaccagagaggatttcttcctagtacataatttgagaaaagcaaatttgaggggaagaaagggatgtcttcattgtgctggcacttcaactccctctccctccactcccaccttgatctaagctccaggagagaataagtaggaattgtgttcctagaccaactcagaacttctactctgtttattcaggggccctaaaagatcaggtctgctctgggccaaaccagagtctctttcatgccctgcccacaatagtaggctttaattggggttccacatctataaagcttctagagctggaatcaaaacctttaaaagctatcaatccatggtccctacctaaagtaatttccagctcccagagtaggtctctcagggtctgtcccatgcccctcatgactagtcctccaatggacagttatggcaggacttgaccaggttatcctacacatgcatacattcccaccctaccccaagtaagctgctattgcccaggggaggagccactggtcaccttggctccacaatcagggtcagagaatcttgagatgctattgtgtttgaagtgggctaagaaggcaggatcagtctcataggtgctccagtccccaagagaagctgaccctacagggaatctgcatacagctatctaggcaaagagagaagacacagaccccaggagaaacatgggtctaggacaaaattgtagcttttaacaatagggaagtagagtagaatgagccacttggatttcagctccaagatttttactgcctagtgctctgccctgggtgggcgtaataagcaggaaggcaggagggctcaaaaggtcaggctggagttccatgcaggtccagcagaggctaggtgattctctagagcaggggactggagccacgtgtgagatgtactagaagccctcaggatgcccttgaccagcgctgatgtcctcagctaatgggactaaaggatgggacgacatccaggaggctgtttctctcttccaagatctcttccctccctggttctctaggaaagtgggtctctggctctccactgtctcaaggcccgggtatgactccaggatatgcccaacccttgccatgtgcaaccccccactaagaaacgtacaaggaaagctttctgaaagcagatcggagttcccacg

SEQ ID NO: 28793 - DNA, 1257 bp, Bovine  19866881539499
cccccagagtcctgcctgggagggggcctgagaaaccgagctctccacccaggagcagcctgaggcatcagggcccagccctccagcagaacctggaccccttcaggcctgcccccaggggcagataggactcccagagccctccactagggtagatccaggggtatcagaagcctgctccctggaactcagaaatccagagtcaagtccacggccccgcaccagtcagtgggctccagcgaccaccagcctgaccttctcctcccagcgcccactttgtgccagcccccctatccgctcactccagtctctgaagccctcaccgggcccggcaggtaaggagttgcttgggtggggttgtgaacaaaggaggttatcatctcttgctgggagcagggcctgccctgcaccagatgatcccatgctttctttcccctgcctgccttgccccagcctagctctcccattggggtgggcgggtgggtggtatggcaccttcagccctgtactcctaattggcttggccctggtggggggtgggataggggcggtatgtggttgggagtcttggacttcagagtccaccctgaactctccatggcccctggccctcaggtgccagccatccggccgctcggaccatggccctgaggcagcgcctcaaagcatgtctgactgccatccacggcttccacgaggcctgcctggacgatgagtgtgccttctacaccagccgagcccctccctcaggcctcaccagggtctgcaccaaccccgtggccatgttgctggaatggcaggacgccctggtgagcctgccgtccacagccagctgtacctgcacagaggcctgtgggaagtgggggcagggggcggcctcggcttctttacagtgggaagagctgggtacagttcaagaatggctgggctgtgacaaagtcttttttctccttagtgttttattccagttggtgatgctgccccacaggattctccgtcatgaggcatctgcgtccactcacccctgtcctgtcttgctccttccttttaaccttatttattttccacaccgtggattggaactgacacccttttgtccttcaataaagtttctcaagtgtccaagtgtcttttcctgtggtcctgcctaggccagctactgctgtgttgttcttgtccacatggtggcagtgttctccaacttagaggtcagccctgggttctccccctcccccagactccctcacctaggaactg

SEQ ID NO: 28794 - DNA, 1744 bp, Bovine  19866880384799
ctgttctttacttgacagagcctacactctggccctgtttgctaaagaacagaccttctctttatttgctgtctatatgatgacatgaaatagtgttatgaacagaagacccaacccatgtaatggaaaattacagtgtccttttttgcccccaccctgatcatttattttttttaaaaaattagagactagcagattttttttctatttctgattgagaacttataggtcatggcccagccttgccatttcttattgaaactctgaatatagtctttgtgcttttactaacgtcatgaatctgattgtattaatatgtttctcaaggcacaacctataaaagcaattttctactctgccataaaatattcatgagaatacaggcttttttgttttgatgccgcattctttaagtagagaaagtctcattgttttcttcggggcactttgggtcaaaagcaccagcagcttctgttgggaactcgtggcatttcggcgagtttttgatacagaaatagtcacgggcatgtctgacgcaccctccagcggcggaatgaatgggggctgtgggtctgatcccacagctggggctccggccgcctgaggggcccgcctggcctcctgaggctgagctcaggcggtgagaagcgcctggcctgggcccgcggccacccccgggctggtgcgtgtgtctcccaaggcaccggaacggccagcgctgggcatggcctgtcgggcggaggtgacgtctggctttgcattctctttgcgtgggactttctttagcagaggatgaagtcttatgtgaaacctcaaaaagggaaatccagcaggcctcgcctccctttctcgcagtaaatggtgaggacagcccatgaccaccccccgcccccggcctgctcccctctgttctctgcagacctgatggtgttgcccgcgggtctccttgccatcccctccctgggcccaccggctctggtgtctggaatgactcggcgggggggaagggggggtcctcctgatgttccctgcagctccagactcaaagggaacccgagggaagggacagtggacacagggaaccacagtcctcccccaccccatccacgccggggcgcctgccacatcctcccttcccgccttcagcccccgcctcgtctctcacacccagcaccctgatgccggcccctctgcatctgaggcctggcctccctctgctgctggcacccccacctgggcctgcagggcccccgaggatctctggatgcaggtcccatgccccaagccagcggtccaggtgcctcctgtgtctccgcccccatgcctgccctcttaacactggccgtctgggtcctggctcgccggccccttcccactcagagctgcggcccctgtgtgggcccttccccggggcgtccctcaagccctctgccctctcctgtccctttgcacggcagatctgctgcaggctggactgggaacaaccccccagcacgcagcacagagcagcaggccctggcgtttttctgcagtgaggggatgcaggcataggaaacatttggcccatcgtatatttgaagttaataaaacggatccctcaaagttgttttatgttcagttttttaagatgttaactattggacatttctgatcatcttcctgacctcgcctgtgaaaaattagaaacggagagatggtatggtacagtgagggcttccctggcggctccgacagtaaagatccg

SEQ ID NO: 28795 - DNA, 2135 bp, Bovine  19866880389021
tttccccataaagaggactggtgtgacaaccagctgcacgtggacagctggagtccattagtgggtcccacagaagaagagaacccatgttgcaagctgttcacagcccaggacaggaagggtcagacgctggagcagagacgggagttaggagctaagaggcttccctgtgtgagggcgagcaccttcagggagcttccttcaatcacttaataatgactcaagttcaggtgcagggaaagcacaggtcagccctgcccggattttggtgggaaccagctggtgggcacatttgatcttgtggagacttctgcagagttaattctgggtttcagaattttgttttgtaaaccgagtgagtctccattaacgatgccgggagttggggacgcacagggagggcaagtccgtggacacacctgggagtgggggacgtgtcgggaagacacggcagcacccccgaggaaggaaaggaagccttgtcctaaggtgggcctcacttttggggggcctgggactgacgtgagtgagccagccccgttctgccatcctcgggtgttgtcccgggctgccctctgcagaggggtccctgctccagcacccgagaagtcttttgagcccagggtgatctcactcgcctgtccagccagccaaactctgacctccagaatcctaggcttaaaaagcagagctgcagtccccggagggaaccggtctcttcttctgcgtctccgaggttcctgaacccacagagaatctgcctggccagcaacgttcacgctgcagctgaaaatcttcccaagatggggcccattgttatgaatgattgagtttcatattgtttcgccaactcccaaacaaacggacagacccgcttggaacttgtttctctttgttgatgtttaataaaacagcaatcatataccaagcgagataatgggacggttgaatgcagactggaattattttcttttatggagtcttaattagatttgttatgcagggctcccaagtaccaaatgtttgcttcaatttaatgagaccggttatgcagagttagagaattgtaattctcccattaactcaacagtgatacatattgcaaagtttagtatatatcaagttacaaaagactggtcttgacccggtgggggtccagtccttaattctcctcatttcttcacagtttcctcttggtgttctttgcatgacccttggggagaaaactttcacctttaaagtttctttattaaagttttttctatgtttttttttttactttttttgagaaatttaaaaattggtttttctttttttttactgtagttgctttacagggctgtgttaatcactgctgcgcagcgatgactcatgtgatacgacctcgtcgttgaagttctaacggtccacgtgagctgtgcctttggtggcaggccggtctgccactgggcatcatggagggtctcagctcaaagtccaggtcttccggtacctgtcacctcctgccccctgccccccagaatgtcacactttccttggaatgcccccccttgcaggtcacaccttcctgggacacccccagaagcgcagacagagcgtcagaacacctgtaggtcaaaaccagtggtgaggcggtttctgtaaatttatcacccagaatatctaaagtactaggtttatgaataatttgctttattatataagcccagtggctattcctacaaccacaccacctcagtggaccccggcgttccaagtaggaggagggcatggagtcagagctgggccccaggggagcgttttgaaagcaggtgagagtttggtggggagggagggggtgttccctgcatttccgggaggggctggggggctctcattccccacgggctccctagcagtggtcttgggggcacagaggccagcagcctcccccgtcgtcttccctcctgtctccgggtgcaggggcacagaacacccaggcgtgccggaactgcagccctgccctcctgaggaagtactgtctccatgggcacaggggcagcgacgccaccctggcaccactggcagcttggccaatggccaggtgggcggggacgcccagcaccatgcttggcctggggtccaaatgacccggc

SEQ ID NO: 28796 - DNA, 1139 bp, Bovine  19866880598828
tcctccctgacccgtctcgcctcaccccccgccttgctgagcacccatgggagggcacagcccagcactgggactgaacggcctgcaccccagcccggctgccctgccagtgaccgctgacctcagccaggtctacctaagcggtccccaggcgtgaacaggatcggcgcaggatggggagcacagcccaggatggacagggagcacaccacaggatgggagaacagcacaggatgggagcacagcacaggacggggagcacggggcaggaaggggagcacggcacaggatgggagcacaggacggggaggacagcacaggacggggaggacagcacaggacagggagcatggcacaggacagggagcacagtacaggatggagagcacagcacaagatggagagcacagcacaggatggagctggggaggcccttgctccacccagcaggagcccacaagcccagcccctggagcaggaatcttcttacctcctatgaggatcacacacgctaagctgtgtaaactggtcgtgagcatgaagtgatactggatggcggcctggtgtcactttcattattaacaatttgaaaaagcagattaacgcaccaggcccggcttaactctcttggggctcccgtgaggctcaggtgaaataacagaacacacagaacatcctaaactctcggtgtgaattaactgcccaagtcctctaaacgccctgccccttccagaggctgttttaaaagaggagctgacccaggagcgtttcccccttgccaggctcctgtgctgaggcccccagagtcaagagccccagggctgctctccatgtctgtggacagcgggtaactgttttctaaactgttgaggattaggaaggacagtgagagcctctgccctcagaggaacaggattccacatgggatcctctaagttagcaaaaaacaaacaaacaaaccaaaaaagccctataaaaatgcaaatgacttcaagccaaagtcttcaaggtaagccccttccctctagcctagcaaagggcatttgggagcggttggctgggggcatgtagaggggtaggacctggcctgcaggccccggtcttagcaagacctgcctgtggggcaaacaaacccactg

SEQ ID NO: 28797 - DNA, 2631 bp, Bovine  19866880741243
gggtaacctgatttatggtagagtgagcacagcccaggcgcagagtgtgggcaggtgaggagggcccggggctgcaggggtgtggccagattgaacccaggtgtcagcagtgactgtctgagcagccaggcaaggtgctgaggactctccagcctggctcgccggtccctgctgggactgcagctgagggccttgggggctgcagggaggctcttttagtaaatgcttgaggatgaaacgctgggctttctgctgttgttcctgtctcactgtccctgcattgtaatcgtgtgtgagttctcgtccactcgcaccgcttccaaagtcacgatggcagagcccccgcaggattcctccgccaggcgcctcctctgggactcacacgtgtcttcgtcggctgcctttatatgtgagaactcagaaacacgtccccccacccccaccccctttttttttttttgcaccgagctggcctgcttctatttttagtttcccggaagcacatttgtgcagttctcgaaagccaagttcccccactgctcgccaggtttttatttacagcctcttgctcaatttgcgcttgcaaatatttcccaaagacagtttctcttcttgggggatgcagaacaaattagaaacaggcaaaggattttctgaagagctttaaggagaagttccgagatagagagtggggagtggggtggggacccgacgcccggcttcatctggactcacagagtgccgagtgcagatggtctgctctgttgatgcactccagattcccggaaaagaacgccacaggcttcagggaggccagaagagtgcagccggccggtggatgtgtccctgcaccagagtcaccgctgccctcctggactgcccggagaggcagggagtcggggtgggggcggtttggggacccagagggctgaacctggagacccacgtgccatctaagtcactttattttctgtagactcaggttcggaatgctttcttcactgttgatagtgtgtttattactcaggagactgttaaagaaagcctgtctcttccgagcggctccccagaggctcagatggtagagtccgcccgcgcttcagtagcttcggcgggtcatctaatccgacccttgaaagacgcgcaccagatgagaatcagacttgggtggcgggtagtacagcggcggctccacgcccgtgcagtccggctgaagatacgattgtccggtttatcgtcggtttgcagcggtgcgtggaacggctcttgttcgctctgacgttttcccatgtcctaccctcgtcactcacggatgggatcgcagagtcggacacgactcagcgactgaacaacagcgatgttgatgtgagaaatctgtttcttttaaaatgactcattgtctgccatcttttatcagtttaatcccgtgcagttaccaaaaaaatggatgttaatagatgaaacaaaatgttgatcattgtacaaagctgtacatgagggtattcccagtaatcatctctggttttgttccacggggaaagggctttttgttttgcttgtaatgttccagcctgcctggttcttcaaaacctcctgtcatttccacagttttgctcccattaagcacaaactttgtccacatggcgtgcttgagcaattctatggattttctgtttcttgagtgagtatttcctttagtttctttaactctttattatcttgttcctcttttttttcttgaatgagatatggcttaattttttggttcctcttcgaactttctgagtccaatgcttgtttcgattcctttttaaaaacattgcctaagtgtgtaagactatgaattactctctgagctcagtgtaatccattcctgaaattttcagtgtatgatgagctcattagatctattttatgagttctcttcactttcctctcagatctggagctttggaaccaggcgtccggctgagctgctgcttctcttccggtctcactcgtctctttttccgtggcagcgtgcacagggcttggggcctgcacgctgggtcctgtgtatgtatgtggaaacattctgtttatgtgccttgctcgtcttaagcgttttgtgggagttcgcgagtcataaattctctgattgcacagcctttccagaggcccgcctgctgcagtgctcactgtgtggctcaggggcccgcttgctgcagcgctcactgtgtggctcagggccttccgtgtccacgttttgtgtccctcgcgtcaggtgcaccggagcaagttcaggtctgtggtcagttctgcgttcctgctcatcccttctgacttttctgcactgtccgtcttggctttctttagaggacacacacacagctccagggcacccttttctcacggtaagctgtgctccaacgggcttccctggtggctcagtagctaaaaaatgcctgcaattcaggagagctgggtttgacccctgggtcagggagattcccggagaagggaatggcaacccactctattattcttgcctggaaaattcaacgttcagaggagcctggtaggctatagtccatggggtcacaaacgatgactgatttacacacacacacacgtgaaatgggcctcgtcttg

SEQ ID NO: 28798 - DNA, 2183 bp, Bovine  19866880885728
gtagtgaaggacagggaagcctggcatgctgcagtccatagagtcacaaagagttggatataacttaacagctgaacaacaaccaagcctgtaaagagggtatgataatttttatattttacagactaggaaactgagggtataaagaggttaagtaacttccccccatgttccacatctaggatattatagagcaagacttctaactcaagactctggctccagaagccttgctgtcaatgattttaactctactgtctttacaaattctctgtagctcaggtttcagctcaatgattactttctcaaggaaccattcattgaccaccctagcatgactaatacacatcccagacccactccagttcctgtttgttatttctattatgttttcctagacttaactcaacataaaatttttttttttgttgtctttgacatttagtttgtctcactatatgagaatgtacactctttgacgactggaaccgcatctgtcttcaattcactgtgttctccctagtacttgtaaaagagtcctgaccattatagaagctctttattttttttaatgaatgagttaccaaagcattcattctctagaaaaaggaatattaggctatattcactttgaaaatggtttaattattatattgaataagtagttattaaaatgtttcatttccttttttctattacctaagtagggtttcatatcaattcatctctgaaaaccatcatattaaaagggaaacctagaaaatattggggatgttatatctgtttctttaattatctatcatcagtcatctctctccctaacttacctatctatacacatatgcagacacatagcctactaaggagctgtttcaccaaaataggaaaaatcttggtcagtggacattaacataacttgagatgcttaaatggagattcaaagcttcctatccatttcttactaagccggtttgcattgtaggagcctctgattgagagtagtgccagctccattatattaatagaaagtaccatgtaatattgtccaaagatatgcataccattgatattccccaaaacttatcccaaaggagcctgaggcttttagccacattagaaaaaagaaaatgacagataattttaaaaaaagaaagaaagaaaaacacagacatttcagggattattagattagattaaacttgatctgaactaatagtatttattggaaacaaattctacatggttcaccagtcagaatggtgaatctgtaggtcaaatgataaatgaagttttagaccaaatccattatgtgcttagtccctcagttgtgtccaactctttgtgaccccatggactgtagttcgccatactcctctgtccatggggattctccaggcaagaatactggagtagattgccataccctcctccaggggatcttctcaaccctgggatcaaactcaggtgtcccacattgcaggcagaatctttaccatctgagccaccaggaaagccctaattttttttctaaacataaccaccccattagatggggcacatttaaaaaaataaaacattactgctgataggaatctgctgcccagcagggccagctctgtgctccatcacactctgagcacccaaagggcagacacatcagggggctggcaacctgctcttgggaaatcaaccagaaggtgtgtctgatgctctggcttccacgcccctggctctgtgagtggacttggtctctgcggccacagcctggcgtgggagggcttgggtgcaggagttctcggggacaggttacccgctctcccccggggagcccaggacggcccgacgcggcccgctcacctgtgacgaggggcgtctgcgtgggcggctgctccaggaggaccacatgctgcaagagggagcccggggctgcccccgcgtcccgctccagaggcgctgcgcccaggtagggggcgaggtgggtaccagggaagagggagatgcgctgctgcagggcggggagggccagtctctcggcctcctgctggccggccgccccctggacagacagacacagccaggtgcccgggtcaggggcctgggggggtggctgccctgcaccaccgcctcacagaccccgggggcgcccacttaccgtggaggggccggtggcgggcagccccagt

SEQ ID NO: 28799 - DNA, 1232 bp, Bovine  19866880374210
aaatcattgcaactgcctacatctcaagtactccactactggttaatggttttctctgaaatttctgaaccaccctaacaggtctaataacaataaaccatttttgctctctttaaattatccagcctatggaatatctgcacacaaaacttcagctttagactttgtctaaacctcttaagtcagcttaaaattattgtggttctcaatgcccagtgcagtgttacaaataaaatctattctgattctttagctccaaacgttaggtgaccatttcagtacagaattggacctcgtgagagatgaattttgaataatgcataacataacattaacacaatatgatctgtgttaaatagaccttggctatgacaagagtgaaagataatcggataatcacaaggggatgtgttttttttgcagtattctgtagttttccattcaaaaccaaaggtgaagaataaatttcaagttactcactcatggattctgtcaacttggccatcgttgaaatttcctctttgtgcttttcctggaggtgagaaaaaaagataattatatataaagcacatcttaaatatgaatcaacacagtgggtctgtaacaacagctctctgtcacacccctttctcttctgttagaatttggtcaccaaagatgaaatgagttttcaaatctcacattattgctctatgatcagccagtcactgacaagagctgtttaggaccctaaaaaatgctagggctcttggaagtgatcttggatatatgtaattggtgacgcacgaccagttttcaaaaacctctttgacactggagttttgacatccttatgccaatctttcgctctctattttctcctgttggagcttttttggtatttttggagctggtatttttgcagttatttggtttctttttttcctaaaagctaagtaaatctgcttacacatttttctttgtcttttttttaactcttggagttttaatttttttttttttgaagtaaatcagttttaatgggtttatgaccctattttggggtgaaaacattttgtttcaactgggatgtaggttataacccactgaatttgagaaccagaatgcccatacataaattatgaaaatgtagtacgcatgcgtgcatgctcagtttctttgtgaatccctggatggtagcccgccaggctcctctgtccatgggatttcccaggcaggactactggtgtggg

SEQ ID NO: 28800 - DNA, 1003 bp, Bovine  19866880404207
tgttaagttttaagccagcttttttactctcctctttcactgtcatcaacaggctctttagtttttctttgctttctgccataagggtggtgtcatctgcatatctgaggttattgatatttctcccggcaatcttgattccagcttgtgcttcctccagcccagcaatttccatgatgttctctccatataagttaaataagcagggtgacaatatacagccttgatgtactcctttcccgatttggaaccaatctcctgttccatgtgtggttctaactcagaggaaatcaaaaagaatatgattattagccctcagtaggaggtgaaatttcccactcatcttaaggtaacttacttacttcccatgacccttactctatatgtctgagaatatggacccctcttcaatcagtctttccagtgggatcacttgatgaaaccattggctccttcaatgtccatctgtatgggcaccatgatggatattgtctgatgccactcaacctcccgaaagggaaggaggggtgctctcacagctccaggacattgctggaacacatttggcagcaagatattaagcaacagagattaggctcaggaatctaatattcaactgtgtgcttactgttgtccaaacattaggaaaccatacccggaattagtggcattagatatgtgctcaagggcacatactgaaatgtgatgctcttcacctgagagctttctccacttgaaacactcgtaggtttactggaaagacgtgttcccaggaagtcaggtccatttagtctgctgccagggaatgccagacttctttcttatccagcctctgtgtgtctgtgtgtgtgtgcacgcatgtgttcctgtgcacacacattgttggaagaaggcagccctgggtacagcctaattttatctggaagcgatgcttagctcttgttcttctggaccatacaaatctggaaacaatcaaaaccgggtataattagaaaataactag

SEQ ID NO: 28801 - DNA, 1220 bp, Bovine  19866880521142
tgaaaagtgaaagtgaagtctctcagttgtgtccgactcttcacgaccccatggactgcagcccaccaggctcccctgtccatgggattttctgagagtactggagtggggtgccattgccttctcctcctgtaaccctactgaatttattatctccaaaacttttctcatggagtctttacggttttccatatataatgttgcatcatgagtatgtagcaaccattttacttctttatttccaatttggatgctttttatttctttttcatgcttaatagtttggatatctgtttttaaaagatcattcttgtgatttggggagtggtttggtaaaaggcaaggggggaagatgggagttgatttagcaggctgttgtgttagtctaggcaagagatggtagtgacctcagatagagtaatgaagagatgccagatgtgagttcttattttggaggtggagttagtgttactcactgattgtttgagtggaggaatggttaggcagctaaatgcatagtagtgggttcagttaaaacaggaaaagatggagaggaggggctttagggtaaagaatgtcttttggactgatcagaaataaccagttttaccctctggccctttccagaagaagtttgctgacccctggcataaacagtgctcccaaggaaggaaagtggccaataaaatatatgaccctgtttatgggtataacttgctaaaaattgcagctttcataataaaatgattttcactcttgaaacatatttgcaagtttgtgttagagagctgtctaaaacattaaaatttcaaacccctctctctaatgtaaatgctaatgtagcttttaattgaagattaaagcttggaaacatcctctgaataaatctttttacaatctgctcttccaggtgcgtcagcagtttcctgctccccttggttggtcaggcactgaagctcctacacaagtcactgttgaaactcatcccgttcaagaaaccacctttcatgtagcccctcaacagaatgcattgcatcaccaccacggaaacagttcccatcaccaccaccaccaccaccaccaccaccaccaccatggacagcaagccttgggcaaccggaccaggccaagggtctacaattctccaacaaatagctcctctacccaggattctatggaggttggccatagtcaccactccatgacatccctgtcttcct

SEQ ID NO: 28802 - DNA, 1716 bp, Bovine  19866880560203
ttgaaaaccatgcgctagtcctatgacttcttttagtagacgggttatcttttactttcatgcatgcaagatttcctcccttccatttatgacaagggacagtagtaataatttacttcaagcaaactcccacctccaaaaccaagtcaggccccaggccttgcctaagctgtgggtgatgtggtcaagcctataggctctggaatcagactgaactagctcaaccccagcgttgagcttcccaattgggcaaactacttaacctcccccagcaccaggttctgctacaattagcaccctcccttacacggtcccttctcagcatggttcctccctggcatggttcccaccaggaccaaacacagcgatgcactccatgtgcttagtagacagcctggcactcagtaagcctctaaggcaagcagctcttgctcccttaaccaaactcatccctccacagcaggtgtgaccaggaagaggtggctttgccctctgtgtctgccaggcgtctcagctaacggctggagatgtggggagaaggccatgactcggtgtgacagataagtcaccttcactgggcagcccctctgattgcatggacctccatgcacagcctacatgtatgaattccttcaaaaaagtgcatgaaataatccgctttgtttgaaaagccatgagaaactaacctctcaaaaaaaaaagaaagaaagtgaagtcgcccagtcgtgtccaactctgtgaccccatgggctgtagcctagcagggttttctgtccatgggattttccaggcaagaatactggagtgggttgccattcccttctccaggggatcttcccaacccagggatcgaacccaggtctcccgtattgcaggcagacactttaccatctgagccaccatgaaagaccaaaaagaagctgttccttaatgaagagggaacattctagaaataacacctaagccatgaagattttctaaccccaaatcccttccagcttctcaggatgaggctaccccatcctgataaatggaaagaaagacttttttccagttttaatggagtacccatggcattgtcagaccttccctagtaaggctcccagtgaccccgaaaggacaagcaaagtcccccaaaggacacctttacctgtgccctttacacctgtaaaggtgactcgtgtactgtgggcaccttcagagaaggggctcacgaccttgcctttgcaccaggcctcatacatcacgggacactgatcagtctactttgtggaactggccaaaccacctggaatccaggagaatttccacagggaaagcaataggaatgagctttagtcgagtgcctcagagtctgcaaatatgcttctttcctgtgttttgtcttacgaaacttgactgataaataccgcttgattaaggtggaaggatattctcaccttcaagaatatgaaaagggtgcaggaagggtaacaagagtaggactctggtgccagagtatgatgatgcagaaattacccaccctggcctgacacatattcctaatctgcaaactgcggcaataacgaaacctgttgtggagattaaacgagatgctgctgttcagtcgctcagtcacgtccagctctttttgacctcaaacactgcagcacgccaggcctccctgtccttcaccatctcccggagttgctcaaactcacgtccatcgagtcgggg

SEQ ID NO: 28803 - DNA, 1163 bp, Bovine  19866880599334
ctatatataaaataaagagccagggcctattgtacagcacagggagttatgtttgatatcttgtaataatctataatggaaaagaatctcacatatacatatatatatataactggaccactctgtggtatatctgaaactaacgcaacattgtaaatcaactacaccataaattttttttttaagttcctagatgaaggaaaaccaagaaaacatgttactggcagacctaccctgaaagaatggctatagaaattcatgaaacagaatgatgataagagaagaaatcacgtaagattaggaaggaagcaagaagagaaagcataagcatacagataaaaataatagaggtcccttctcttgcattttctaaattatgtttagaggtggaagcaaaattataacatattctaatgttgttctcaatatatgtagagaaaatatttaagacaattatatcataaacaggggaaggtaaaggaatgcaaagggaggtaagatttctgcacatcacttgaactggtgcagccaatctggaaaacagcttggcagtttctgaaaaactaaacatatattatacctaccatatgagccagcagtcacattcctgggcatctatcccagagaaattaaaatgtatattcacacaaaaacctgtacacaaagatgtataacagctttatttgtaagagtcaaaaattggaaacaaccaaaatgtctttcaataggtaaagggttaaacaaaccatagtatatcgatagtatcaaatactagtcagatataaagaccaaagtgtacaatttggatggatcttaagagcattatgctgaggggggtaaagatcatttcaaaggtaatgcactacataattccatttatataaaattctcaaaataacacaaatcatagaaatagagacaaaccagcagttgccaggggtcagtgatggtagagatgggctgtaactattaagaagcaggacaaagatgatctttgtggtgatggaacagttctgtaccttgactgcagtggtgttacatgaatttacacagctgataaaatggcacagaactgtactaaggtcaatttcctggttttggaattatactataagtacactgggggaaaccgcatgaagggtacatgcacctcctctgtacta

SEQ ID NO: 28804 - DNA, 1123 bp, Bovine  19866880792758
gagaaggaaatggcagcccactccgtattcttgcctggagaatcccaggggtggcggagcctggtgggccgctgtctgtggggttgcacagagccggacactgctgaagcaacttagcagcagtagcagcagcagcaactcacgtcagaaatgctagctttacctgataagcacgaggttaagttttattagcagactcctgtttaagaaataaagagagaacattatgtttctttagtcctcccaaaataatagaaacaaaaaaattgatgtttaaaggtgtatgattcagatagatttcatttatggaacatccttcactccccattgacataataaatgagcttatactatttttttctttcttattgtctttgtagatatctgatataacccatagtaataacgttgtgtttaaaatcctttcttctcacattcattgcatgtttgttgttcactctcattgtatttagcgtaaggtgggcgcttttccgttcaaggggcataggatgctgggaaggacattctaagggtgcttgacttacggtctttgaacataactcccctcttcttcctcactcttgtgtgtttattttgaagttttgcttaagtagtagagaaaatgttgatagcatcactataattatgtatttctgctttattgaaagaaaacacaaaatattagctacttggttaacttataataattactatttttgtttttaataaactgacttcagtgattgcaggatctgggttatttgctaccagccatggtctagttaaaaaagcattcagtttaggtctaaaacaaaatcctgccaaccctccattttccccaaaaactgaacatacatatttgtatttgagcttcctttgacaatgtctttagtgctcagcacatttattcagtaagtgaatgatgaatcagtggaattgagtggattgatcttccatcagaagaatattctgatcatagcttcttagagggattttcatagtcacatttgaattctgacatcagttaccttttgcatccctttagtggccgctgcttaattggatcaaaactgttacttggaccatgtctctggggtatcttatgtcacgtgggagctgtgtt

SEQ ID NO: 28805 - DNA, 860 bp, Bovine  19866880894981
ttttctttcctcgtcttctttccggtgataaatggtatatttcctgccatatcagttaaacaaaggatgtcaccatcatccaacatgagccagtgactcctgaacaaacgcaaggctgaaaagtatctgccatctagtagccatcagcctgaggctactccctagggtgagccctgaggaaactcaggatgtgaaaacacaggatactggccccaggtatgtgaggtgcatatcaaagaaatgatttcagtgagtccagactcttgcatcttcccacatgtagaaaagctccaagttccttaacttgggatacctggttttctttaatcaaaaatcatttcttaatgttccaactacttgccctttgctgtcaaactcctatacatcctagttccttccctcacctccttggagcaacttctcagagctttctgaaacactgccttccaggctaaagtcctcattttgccccaaataaagcttaacttgcaactctcatattgtgcaaatttttttcaacacacagtaagtagtcttaaagatctgttgactgactggttcaaggcaccatgataatccagggggcagctattaaaggtcaatgtctggaaatacacagatggtcaagagatgttttaaacaaaagcaaatgttacagaactataattattctccccttggttgcacgaaggtttgccatgataagccggctattcagtttttttgtactgtggcttttctccagagtacaccattttaatttcttgatagcgtcttttatttaaaggataatagatgagactattaatttaatgtaagaactaaaacccttctggacggattatctggaattccaaaag

SEQ ID NO: 28806 - DNA, 795 bp, Bovine  19866880966513
ccaaacagcattgcagcagacagaccacaggggcagggaagcgtgagaccatttgcagtctatgggctgttaataagtcagcctcgggagatacacaacaccaaatggggcatcatagttgcccccaagggctgcctgaaaccatggcccatgccagcttctgtggcagcagagaatcagaaagagcttactgtttaaaaaaagcctgatggacttccctggaggtctagtggttaagtctccacgctgccactgcaggggacatgggttcaatccctggtccagaagctaagatcccacatgccacccagcgcagccaaaataaataaagtgaatataaagagcatggtgtggacattgagcatgcacagcgtcaagaaacctccgaagccactgtcccaaacccctccctccacccagcttccctgagagctgaccaggtgcagagtcacatcagcgagaacatttcctcccttttgaccaaaagcaacttccttgagaagcacatctcagccacagagacttccaaacccatccaaatgcagacttgaaaacctaggagcagactggccctccatccccagtcggaaccatgcagggcttcatcagctgtactgtgcagtcatttgcagctggtggcagggcttccctggtggctcagatgatacagaatctgcctgcaatgcaagagacctgggtttgatccctgggttaggaagatcctctggagaatactgggactactccagtattattgcctgggaaatcccaggacagaggagccggcaggctaca

SEQ ID NO: 28807 - DNA, 580 bp, Bovine  19866881023694
acatttggtcctggaaaaatgtgaaaatcggccttcatcacattagctttctgtcctgtccttaaagaaggggtctctccacctgggatggtaatgactcacagataggggcagaagtgttccaaccctattattcttaattaaagtcactacagatggatccatgaccttaagaaaaacatttctgacctttccatgagtaggatcaaactcatcactttattaatattcctcatagttcttctgccagctctttctaactccattttaaatgtgtttgctgtgtttttttttttttttgtagcccagttcccttctgctttcaaaaataatcagtattggattcccctgggcatcaggcaccaccttttctgttttattcccagcatgactgtgttcattaaaattcactgcaaactcccaaagaaatgcattcatgtatttggggattccaaggtagagcagcagatccatcctcttgaaatgttggataaaaattcagtattctccgacatgaaaacatcagcatcctttacaacatccccattagaggacggataagtgcaccctgggggtctac

SEQ ID NO: 28808 - DNA, 1798 bp, Bovine  19866881161438
ctcgatccctgggttggaaagatcccctggggaaggaaatggcaacccactccagtattctttcctaggaaattcccttggacagagcagcctggtggatttacagtccatggggtcacaaagagctggacgtgatttagtgattagataactaaagagaacgtactatatagcacagggaattttatttaattctctgtggtgattaaaatggggaaggaagtccaaaagggaacggatatatgtatatgcatgtgtatactgattcactttgctgtacgcagatacgaacacaacgctgaaaagtaactatactccaataagaattaatttaaaaagaaatacaaatgaccaataattactaaaaataaattttttaaaaacctctaaagcaacaaactttttttttaaataaagccagtgtgtttatttttaagaaagcatagcttctccctgctttctcttttggtttgcttaaaaaaaaaaaagactttcaactacagataaaaagctcccaggcagtatttgaagatttgcaggacttctgtagcaaagaaaaaagtctcagaaaagagccttctatccccagggcactgctttttcttgccttctttgagggcctttgcttggcgtgtttgtgtattttttttattttcaggataccactgaacatgggtatctcagaaataaggaacaagggactataaaagtcagccaagttcttctgatattattcctcctttactgtaatctctgttctttccatgacattcgaaaattctatttagcttgactttcaaccaactaagccagtgacaggtttatgagctttccaggcaggtctcatgtgggtctttgaggaattagacttgcttctcagggagactggtagcctgtacatctgagtgttgaacacatcttagaactggctagattgtcacttcgctacctgttgagaagcatcggttcttcaggacccttcaaagccctaagatacctcatctgctccatcctaacgctgtgtcgctcacacacactcacacgtgccagcctgtggcctgcagctgtataaccctccgtgctgacatggtggctacagacccaaggacagcccccagaaaggaaaccccctgctcccaactccaaaggaagaaatctagctcttcccttcaccatcacacacacggtaagaaaggaaccacagttagcggtgctgacgttaagacaaaaaatgcacaacgtggcagttgcaagttaagctgtattcagggaaaatgaggactatagcccgggaggcagcatttcaggtaactctgagaaattgccccaaagaggtaggggggatgttggtatatctgtgattttggtgaaggaggagtttatgcaatcaagcgtgtatttttgcagaaggtttctgctagtcacgagaagcagatgtcaccatgaaggaatttagtgcttttctagacatgaggagatgcacgaattgggcttacaaaatcggctcctgaaaatatttaactatctgaagacctgttctgccagtttttccagagcatggagcacctcctttctgctatgggtattaaaaatcagcagctgcagcaacagatgatttaacccttatagaggtagatggcaaatggccatggcaagtgccaatttgtagttgtgttgtagccacgcgttctgggaaacaaactccctcagaaggacgatgcagatagtggagtgcagtttattacaccggcgggcccaaggcagagtctcctcttagccaaggagcccgaccagtttt

SEQ ID NO: 28809 - DNA, 797 bp, Bovine  19866881266464
cttctatggggtggccacttaaaccacttaaaaaaaaatctcgattattgccgttaaatgtggtcagtactacttctgtatttgttgcctccatttttatttctcctatctataattctataaagatctcgtgggaagtgaaatgttatattcataaaaacgctttgaattttttgcaggaaaattcacttttctccaaatcagtaagggagctgcactactgtataaatagtggatagcatggattctattttcccagatgacaggacttcaggagagatgatgggggaagcaatgcagatgatctatgatttgctggaaacaaagaattcaagaaacacagatcaggtgcggggctcatctagggcttcctagtcaccagccggtgtcctcttgggaaggtgcagggggaaacaaagtggcagaacccccttgcaaaacctttcccagaagcctctcatgcacttacagaagtaattcaagtgagaaaagtgaagattaaatggttgttggactaaaggccagaaaaaaaaaaaaaaaaaaaccaacaaaaaacctcaagcatcatgggatgggtaatgtatctcttaagcagtgttttccagaataggtttctgagatattcaagactagagacccggcttattgggggtgagtgttatgaggattgcaacagggcggtggggttagggttttgctgagtttcggttatcacacattaggatccaggtttatttgatgcatccttctatggcatgtagtgggcaagaccatgccctgtgatgtccatatcctag

SEQ ID NO: 28810 - DNA, 1603 bp, Bovine  19866881357027
atactgtgattatgtgatcttttggttagtgatggtgggtttttgttctggaggttgtaggattgtagttcttgcttcttctgtttgccctctgatggattcctccttacccattaacaaactttaaaaatacattaaataacccccactttgtaaagaaaagagcacacatttcaaagcctaacatggtatcagaacaacagacctgagcttgaagatgtactggaggtggtgcctgaagactgtgactgttccatagcaggactcgtggatacactattactcgtatttgtaccttcatcagctgttttcttgaaaaaactgtgctgcagggcatagtaaggttgaattcgagatttggggtcatagtcaagcatccttaaaatgaggtctttgaacttcaagtagtcagctactgtatggcccgactccccagcacgccgcccaccaggccctcctgtttctactccgagaatattatgcagtttacgggttcctggtggtttgtactcctaaagagaaaagagacaaaagaagggggggtttctctaaatttgatggaatgtgtaaaagcctacataacatcacatcaaataaggttccttatagggtaaggccgagacctttgttaaaaggagtgcttcatggtctgctcctctggattttcacatgtactactctaaaagcactgcagttaggagaaattcaaaataactctgagcacaaatgaccataaagatcatctagtgtagggatcagcaaactctgccctgtttcagagcctgttttatataaacagcccctactatgaatggttttacatttttaaagatggtaaaaacaaacagaaccaagaatatgcaacaaaatctttactctgtggtcctttacaaagaaagtgtaccaaccagtggctacgaacctcttttctgcccaatacacctgtgaactcaggtgcacttcctaggtaacagtggctcattaaagctttagccatcactcctaataaagaaccatgggtttaacaccgtaccttgcttatatccagtttaaaaaaaaaaaaacaaggaaattatttatgcttcactttagaaaatacgtttaataaactgcctttaacatgtgctgacattttagggaaactcattttaacaggtaatctttaaaatccctatgaacactgaatttcttcagaatagtattagcagattttacttctaggtgcaatgtagcaatttttaagagaccattactcttcaaaatcaagaacaagctaggtaggcaaaccgcaaaatcactgccttttaaaaacctatcagggaccttggtggtctagtggttaagaacccgcctcgtagtgcaggaaaggtgggttctgggcctggtcagggaactaagaccccacatgccacaaagcagcagagcccacgcaccacaactgctgtcctgacgctcaggagctcgcgcaaggcaatgcaagatcccccacgaggcagcaaagaccccacaggctgccactgagacctgaggcaaccaaactaattaattaaaaaagaaacctatcagcaagcagaggactaaagaaaccacagctaactaaatt

SEQ ID NO: 28811 - DNA, 1231 bp, Bovine  19866881407862
aatgtctgcactctctgtgacccttgacgagcctcttcttgagatacaggcagaagtgatggcttgcctccacttaggagctttcttcactgaggcctcccaaaacaccacctgactcagaaggtggtgggtcccacatgccgcggcctctcgtggggtgattgcaaaacaggcaactgagctacacactctatagccactcaggacatggaccagccctcatcccaagggtaagacaagaaagggggcagctaagttccaatagtttgggcacttcatgcaaagagctgattcattggagaagaccgtgatgctgggaaagattgaaggcgggaggagaaggggacgacagaggatgacatggttggatgatatcaccgactcaatggacatgagtttgagcaagctccgggagatggtgatggacagggaggcctggagtgctgcagtccatggtgttgtgaagagtcagacatggcttagcgactgaacagcaaaagccctttagaccttgaattcacagtctgatgtttggaggaaatagggttcccaggtactgcagatcctgaggggggagaggtctctgtgtatgaacacttgtggggcacagtcatgcctgatttggagacaggatttcttctggaaaaaggtggcttctacagacagatcttgccttcttctctgcagcccatggcaccagcaacccacagagaaggcatgcggtgtcttggctaagatgccttgagattctgtcactgtttgtgttacaaataagtagctaagtttcccagcaattattgccatcgatgctaagagagaggaaaaactcatgtgagcacagttttattttttttaataagagacaattgttttcttaagagaaaagaaaaacaagcaaaaaagactaaactcatacttccgcatgtactaagaagagaagacagaagacgaagaggaaaaggaagaaaggagaggaagatgaggggaaggagaaggagaaagaaaaagtacacctgacccctgggtcccctttcccaggatgggagggtcatgtctggaatctcaaaagctggggcttcagaaggcacccctgcatccttgtttcctggaatctactaaaagaaaatggcaaaccagccaagatattcgactgaggtttgttaagaaaacacaccctcggtttgggttgttttctgagaggagggtcggacagatgtggtttaagtacgaa

SEQ ID NO: 28812 - DNA, 765 bp, Bovine  19866882180975
atattgaaaacaagcaaaacgctgtgccaaagggctagttaagagagcatccccaggatattggactttagataagttaatacccacagttacaaaatgtaggtttaactatccatacccttgtgcggattctgaaacaccatgtacaggcatgcactacccccagtcggaatgatacgcatttgattgtaaccacagaaaagtggctcttctcaattttagtcctataatatttcatctttaaaatgggcaaatcttaggaaattctcttcatcttaaaattcaaaacacattgtgagccaaataccctcattgccacaggtatgctaacacagaccgtatctaaacatagcatttgagggagcctgaaatgatgtgaattccctgtctcctggatgggtctcgccatggatcaaatcaccctttcctgcctactaagatcgcagtaaattctttctgtccttcctttccattattctcttccccaggatcaaactttcagcccacacagagcactgctggctccatatttattattttttttgctttatttcaattttcttctttccaaaatacactgtgtgtgtgtttcctatttccactgcgtgggttcacccaactgctgccacagctactggtggcctgcttcttctccctcatacaaatacattttgctctttaataacccccgttaagcaattccaacagccaatctaccactttgcaaatatcattaagggagaaaatgccctagtcaggagtttt

SEQ ID NO: 28813 - DNA, 1049 bp, Bovine  19866880344807
ggggcaggaggagaaggggaaaacagaggatgagatggctggatggcatcactgactcgatggaggtgagtctgagtgaattccgggagttggtgatggacagggaggcctggcgtgctgcgattcatggggttgcaaggagtcggacacgactgagtgactgatctgatctgatctgatacatcttttttggttgcttttcaggggcggttatttgtttatttctggctgttctgggtctttgttgctgcccatgggctttctctaactgcagcgagtgggagctactctatggttgtggtgcacaggctctcattccggtgtggagcttctcttgttgtggagcataggctctagtgtgcaggctcagcaattgtgcccagtggcttagttgcctcaaggcatgtggaatcttccccggttctccggagtcgaacccgtgtcccctgcattggcaggtggattcttaactactgggccaccagggaagtcctccatagatatctatacgcattcatatatatgtgtgtctatatatatcagtacacatatcttagatgtatctcctaggaataaaggtgactgtttccatcactgggcacactctgtcaattggcataaaccaaaatgtcttagatcaaattcgtacccctccggcattatgtgaatgataaagggaagggatctcattttgtcattttcctttcaaatatcaagttgtattaaagaaaacatttttctcaatcacaggtgcagatgggaagagtgagtgacatcttgatgtcctctctttgataagtcttctcccttggcagcttccagtgtacttttaggaacaacctttcatttatcttttacagggtagatctgtgtcttggagccagcagagctacatttaaaagtatgcttcccgcttgagactctcagaggagcaacaaagcaaagaacagaacattgccctgaatgtttggagaactcagatggaggttaagccatcaaatgtagctgtcattatcacaagcccttgcatttaagtttccaaaacactt

SEQ ID NO: 28814 - DNA, 752 bp, Bovine  19866880402346
ctatggaagagcccgagatgccgacatatgagtgatgtcatattggacttccgccaagctcagtagccagctgaatgcatgtgcatgggagactccccaagcaagacaagcagaaaaactgcccatttgagcctcagaaaccttaaagtcagccatggatttatgggaaatcataaattactatctagataactaaaacaacatctatccactttcccctctgctagaccatgagctccttatgcgtaaggatcatatcaaatttacatttgtatcatcagctccagaagcgtcaattaactcatacattaatacactagtggagtatgtgagtggctaaggcagagttgtttgaacagaaagctactgaatgaattattttctatctctttatgaggatactggacatacagaatcaaagcccagggtacaaaaacattaatacaatcttacaacctaagcaagaggaccccatttttgaaagctccaggcgcagcatcttggttaaacatttcccttccaaaacaaccctggatccgtgtcaacttctaagacactggcaacctgggcagcctgaggaaaggaactgggaaacttggatttattgcaccaagttgaaactgcagagggaaacagacgggagataaaacattccttgatgttgacatttttctacccattcaagtagtgattgctgctcaccatctgtcttggctccagagagttgggtctttgagcattgaaagagcttc

SEQ ID NO: 28815 - DNA, 1778 bp, Bovine  19866880491217
tgttggaaggaatgatgctaaagctgaaactccatactttggccacctgatgcgaagagttgactcattggaaaagactctgatgctgggagggattgggggcaggatgaaaaggggatgccagaggatgagatggctggatggcatcaccaacttgatggacgtgaatttgagtgaactccaggagttggtgatggacagggaggcctggcgtgctgcgattcatggggtctcaaagagttggaaacgactgagcaactgaactgaactgaactgaactgaatattactgatgaagatttttcttcttgttgctgttttgtgttttttcaatcttctcttcaaaaatatttatgttaggaatgtgttaaatattaatgtgcctctgataaatttgctagcttttgaaagatttcgctaccctaaatagacttttgtttcttcgacttaccttctctcagatcctctgcctgtatctgtagaaagttgaaaactagcgagaaatcatccatttaaagcaaatgcttttctagagatataatagttacagtgatagaccaggagcaatactcgtatcacatgtgtagaggaagaaaaaagatgcaaaccttacctgacagccacttttaaaaaatgtctttgaatgagttggtgcaaaataaaatccgaggtagatttaatcacaagaggacagttttcagagcttaacattttctttcataaaatgaccaattcatctcattcagaatcttaaaacatttgtcattttgctcagctccaatttacataaagcaaagcttctcaagttagaaagaccaggcatgctggaatgagacccagttgttttagaatcagagctctgttgatggaatatttcttaacctctctgacacttggttttcttgtctgtggaatagatgaatgtgagcgtgcatgcatgctcagtcatgtcccattctgcgaccccatggagcccaccaggtttctctgttcatagagttttccaggcaagaatattggaatgggctgcctttttctactccagagtaatccctatcttctggagagaagaggccttaaataaacagtgtattacaatgggtgttttaagaagtaagagtttcctttctacagtcatcatccagcagaagcctgttgagggcttctcagccaaatcaaaagtagtccaattcatttaaagccaatggggaagctactgaacaagctgacctttgtccagctgtcgtgagtgctctgtatcaaacaagaaatgagtcctataggattacaactctccgactgtgggctttggtttattttctgaggagctgttttattctcctcctgaccaggccaatagggatttaacattatcctagttttcttaaccaagtatatcttacctgatataaatgtccatattggtaaatttgcctgctaatacatgtaatgctaataatagactcagcaatgaaattaaatttgctttattaatttttcaatattaaatttcactaacagatgcattaaaaattaattgtcatttttattatgccaactctaatgaaaagacatacatcattagtgagatgcttacaatataaagtatgtaagaacatttatgagggaaaaatcaataaccttattaaacatgttcatgtttgttccttcagtgtcaattatttccagtagttattagcatattcacattatgacatgaaaccaatgaatagcattttttcatatagttacctggtcttgtctgtctaattttaatta

SEQ ID NO: 28816 - DNA, 2878 bp, Bovine  19866880498482
tctctggaattaacatgcctatgatttgtatatcacagtaagcatattcacactttccttccccgcaagaccgtgagatacttgctataggtgtccctttctctcctcaatgcctggaacatttttgacattaaatagatgtttaaaccatatcctcagtagtaagatggatcaatcaattgcctgttccttaataaaacaagaaaggcacctttaaggaattgtatcagaaatacacattaaggtttgtttatgaggctcattctgtattgccccaatgtgtcgtaggacaaccactaccttctaatctattaagagcagagaattaattgctctgggaggggagaggagagcaggtgaagaggtgctgatgataaagagattatgtccacaagccccaaaacaaatttatctgtagagataaacaaaaagtctagctcacaaactggcaatatgaagcaagaaaaatgaaaagactaaatttttatttgtttgcacttttgcaaagagagagctattcaatcttgattctgggtgctccaaaaagagttattgagaaatagaaactggtcaaaggaacggagagactgctccaaagcagaacataaaggatgctgtgaccctatttgctgatgcagagctgaagtttaaataactgtgtaaacaaatggacatatccttcagttcaaaatgtaaaatgatttattcttcaatagaccttttgttgattgtctaaaaccctgagttggggactttcctgtgggttcaggagctaagattctgcactccccaatgggaatttgctgtatgactcagggaactcaaccagagctctgtgaaactcaaaggggtcggatggggtaggaggtgggagggaggctctagagggagtgggcatatgtatgcctatggctgatgtatgttgatgtatgacagaaaccaacacactattgtaaagcaattatccttcaattaaaaaaaaaaaaaaagattctgcaatcccaatgcagggatcttgggttagatagatccctgatcaagggactagatcctgcatgatgcaactaaggatcccacgtactgcaactaagacccagtgtggtcacaagaataaataaataagtattggggaaaaaaactgatttgaagaaaatatttcttagtttcaggcaaataaccaatcagggtggatcccaatggacactgaaaaccaaagttccaatatgttctatgtgtgaaaaatagacacaggtagatatttgagtagccataaggggcaaactatggtacactgcagtttctccattttctttctattctgtagtaaattttatctgttattagaatgctttcatatgcaaaactacactcatctgttacttcaatcaggctggcctaagccactgttaaatccgtaagtcctaagtcttgatgttcagtaactatatttgccttttagtacgtttcacttgcacttaccatggtcttgtacaagagaataatatttctaacttgattttggaaactcaatataccgtgcacagacagtaacgaagttatagaatagcctacttcctcagtttcagtacaaaaatctacagggagtcaatactgatcactactccttatatgttgcaaggattctcacccaggggtggggcgggagcagtagtgggggaatgaaggagttaggatttatcctttaacagttgcagtaaagtacttttttatttaaatctctttcttccttggcattctatcttaatgggatacagtttaaccatagtagaattaagttctggctttttgccacagtctgttttgtacagttttattttataggatattgtttattaaatttaaaagtattgggtgatatatatttcttttatttgtaagatgtttataaaagtaagtctacaaaataaaaaatagactatcaatgtatgttgggatatgtcactactgtcattgttatataattttaatacaatggaagatgtgtgttaacacattcagtccagaaccttttaagccaaaaagatgctgccaattcagaaacaaagataaatgctgatttgtattatgcatctttgaggccaaagctaatggggcttaaaagccatcagtgttgtatagagaagcaaggatttgcatttcttggggcatttgtgacaagactgcccaatattttgacctcctatggattaatcccgtcaaatttatcattgaaaatcttttttcctaacaatagaaaaattcacaaaccacagaattttaaaaactaagatctgtcttgtttcttcttctgaaaataaaacaattaaataaataaaaagaaatagaaggaaaaacaaaaccaaagttctaaaacaaagccacacagcattgctgttttctctctttcctgtgaagcagcttctatccattgaggttgctttgtgaaaagaaaagtatgagttaggggccaataaattgtgtgttttcccaactcagttcccccgcctttgcagtgggaatttcccctgatagctaaagacttctaacaggtcataattcttgcttttccacccacgtacacttttacataaaacaagaaattctgccactgcatgcacttcagagcagtcaaaatgtggtactgtggaagttattctgtagttttctaactttcctttctctcttctctgccaaatcataaagtactcatgttctgaattgttgatctatcacagcccctgaggcaatgtgggtggaaggggttggccttactttgcatattcacttggtgatcattagcgacataatgcagatgaaatctcatacgatttcttgccgaacaaatgcctttaagaaatgctttggggatatataacaa

SEQ ID NO: 28817 - DNA, 1190 bp, Bovine  19866880509464
ttaaatatgcacaaaatataatcagtatgtatccacctgacccagtcttaacatctaactctgtgtacactcggaccaattatttccatgaggaataagattctgtcaagtttccaatactgacatttgtaatcacacgctaactctggtttcctaaatactcaacatactaaagatttatgtcatatctccaatagtctcttagactcaggaatagttttctggcttaaatcataaaaacttttcaagtctgaaagaaagacaaacaaacaaaaagcatgttggtgatatttttaattctaatccttatttgccatgtactaacccttttatcatattcttaagtgaaaccaagttattattgaaatgggtggacattttacaagagttgtgttgagtaatatgcaaaaaaaatcctctataaatatttcttctgaatcatttgatcatttatacagtatacagtttttctaatgaccgctttgtaccattcaccaggcaacctctgagaatgccgaggtgtgtaagatacccactttttggagttactggagcctcttatttggagataaataagcaaatagttatatgccattgccagaataatagtatagatgcaaacaactgaacctgacatcatagaagaaaaattaaagaactggtgtgagggaagtcaggaaaacataagaaaagaggtgacatttgaggacgtaataggagtattttaggtgcctgtgtcagggagaacaggaagaagtaaatgcaaggttgggggagggaatcctaggggggttaatgatccacctgttgtccagttataagtgaaaaggagagcagagtgaagggacagagctcacagtatccctatccctgcatactggcacctatagacaattattcatcaggttaaaataatccttaaaattaaactgttactctctgtggttaagatgaccggccttttccaaactggaaaagattttctgcttttctctttcctgttattcattatacctcacctttcttgcagctcctccctcacaacagaagcccccaagtcccttctacagtacttgttatgcaggaggctgaatggtgaaaagctattcaaacagcataacacgaactaacaattccaagcgtatctattgactgaagagatttgcattatgaactaagtcagtgcaaaa

SEQ ID NO: 28818 - DNA, 1340 bp, Bovine  19866880521779
acggcggagcctggtgggctgccgtctatggggtcgcacagagtcggacacgactgaagcgacttagcagcagcagcagcagcagcaagagttaggttgaacacttgacatgtatgatcctacatctaactgaaagtctacagtatttatattatcaagctcatcatggtttagaagaggaaactgactaccagatgaaatatcttgttcaagaccatactgggaataagtctagaaaccatagtcaaacccagagaatctaattccagaacatgaactgaagattatctaagattcagactgaaatagttcatgagtgtccaggacagaaatcactctttgttcttactctggggctcacaataataatctcacaaaggaaggcatgttttaaagaacaggaacggtgtcagtgtgtatggaagacaagacaagaattactgttttgtaaaacagaattcagaagatataaacctccttatatggtttctagcaaggagtaagccgattgaccttctggttctatctcctcttacccttaattagcaaatatttgtctgatgtgagcagaaactgaacagtcactggggtttaaacaagttataatccacatgaaaagaaaacagtaatttcttttgaggaagcaatgggatttcattatttgatttgattcttaaggtctcgacctaggcagtggatagccactgaattcacagtggatctcggctaaaaagaaaggccaaactcccgttccttgattagtacaggggtacttcagggagagccagtgtgaatcctgtgggtgtcacaggactgctgagaagggccactcttgtgccactgaaccctccatactcagctttctgtttgctttctatccttgatcgacctttcaaaagttagccatttttcacattcatatacatgtatatttaaataatcccagtcagcacttttcagaagtcttttgtggtggctggtttcatctcccatagaatgagccagcatttaatctcttgatgtttaataatattgattaatttccctgtaatatttcaatattcatcagtaatgaatttttataaggactgatctttgattctctctttgggcacctaggataaatcagtaatgaatttttataaggactgatctttgattctctctttgggcacctaggataaacctgagtcgacatctgtagatggagggtgatgtttgacatttaaggatgctgaaggtcaaacaaaggaggttaccgactgtgttgatatggtgggatgtactgccaataggtgacacagcacactaagaccacttgctatgctaagggctaaaaa

SEQ ID NO: 28819 - DNA, 1294 bp, Bovine  19866880534269
tatagagtatgtacttgatactttcatcattgcttgttcatttatttatcaaaaaactcaaatgaagcaccaactattttccacctatctctacagaatagtaagacgatgtcattagtaagtttcaagagttattttgaatcgttggccagggtttcccttgaaaattaatattatattctaaaactattgtgacttctaataatcctttctaatgtaaaaattaattgcttttgagaaggacaaggtgtggaaaagcccttttcagctctaccttcagggatgatgctcagattctgatgtttttacctgtagaagaagatgaaggtcgaagtgttaattccactatcattaatattatgattctaattattatcattatacatttttatagtgtctttcatcttagagtctcacagtaactaactgctttgtctaggaactgattagctctgccttgagtctgatgaaaatttctagatgaaaaataaaggagattgtcataatggagttcacatatcagtcaatgaagtggaatgaaactaacgtggttggtttcaccttcttttaaatttgatataatcgaagctgaacagagactgactgagaagtcctgaaatcatctcccccagaatgtgaagactgacagtatctgatcctgccgttccagcgagtgcattcgattttgaaaggccagttagataagagaatattggcacaactttccagatatctactccccaattaacaatgtcattttgtgtttttctaagtgaggactgggaaacttgccttggcattaccggcctctgcttggagcttatagttttcatagatggtgactgctccaattctacagctttggaaggatgtggggagaggtgatagaaggcgatgatgggaagaataaaagaatatagagatgaacaccacagctggactattccttcaggccctactatgctcaagtttctaccttacgggaacctatattttagttaagcagacagacctctatctgttcatgctaatagcagtcaactacaggggtttcccttgggattttatttgactttgcactgactaattaatagatatctgaggaaacaaagaggaaaataaaggatcaaaaataaacaagttcatacttggcacagacttcagcaaccatgttgccacttcattttggtcattaacaaacaagttacagacacttggcaaatttttagcttctgcatgaatatccgtgtatgatgagggggatatacatgtgctaaacatttatatgtgtaaa

SEQ ID NO: 28820 - DNA, 1058 bp, Bovine  19866880563913
tcaatattgcttaaggttataagatgaaagctctacaaatcacagtcacgtaacctgtcaggcaccttattaaatttcattcagttctataccaattcttaagggaccatcattgtcttccaactaacgcaaagattgaataaaaactgatcaaaagtttatgggcttgaatggtcatcctaaattggatctgctgttactggagagaaaactaggccaagaaatttagcctattaggcagtggggagccatcaaaggcttgtgaacagaggacggacatgattacctctggcagtgacacaccattgattccttgatcattgcttacattttttccctttattataaaggcataaaaagcattatagcaacccaaagcacacagacttgttggaaagttaaatcactgtggcagacagtccttccatttcttaggtttccttggagttacatagcttgttctggccgacggtctctgagtgacttagcccagtatgtgatgtctgggctgaggtgggaaagacctggaaagtctcctgcatcctttctcccactctgtgacagcactggagttatcggctgagatagtgagtcatgagatggaagctgcctttaccaatcatcgggagagttgccctgtagacttgcccaataagaaaggtataaattttgaattttgccattcatatttcagcatggcctggcttatcctactgcaacaataaacaagtgcaagataagatatacaagctcacaataatgcgaaaaaggcaaatgaaaacaataaaacaccatctcacctattactattttacctactattgttgaaaacacaatgaaacatcaggaaataccaaattttgatgatgttgtggacaaacacatcttttggcattgctggcagagatattaaaaatgataaagtcattttggacagaaatttggaacttagtaatgaaatgacgaatgacatgatctatggactaagaatctaccccattaaaaatgtcacaggggtctgtaaagggtatatggccagcattagcatcctggccctt

SEQ ID NO: 28821 - DNA, 8025 bp, Bovine  19866880599385
tattcttcctgaatagtgtttccttgttagcctgcagaattattcagagaacccagtcacatctggctaggaatcaggggctacctgacccacttaatactgcaaaaccctcttcccacagacccttctgattcatcctgttccagaatgcaacccccacatgttctacattgtcctgtaatgcccgcccttcctgggctacccaatagaggagtcactggatctctgaatctttccccataaccacccagaaggtctggaccattcgtgattaaataaagataaaattcaaaggtgtaaatttgtactgcttgacatctaaaatattgtgagagattttgtacagatagaaaagaccaaaaaaaaaaaaaaaagatttcaatgcaacctaagtggcagcaccataccagaatatggtttcagtagacccctctctggcttggggacccagcaatcttctgctgtgccactctgttacctatgtctcttttgaagtaaaagtcctgatcattctaggtatagtgaaaaaggatcactgcacttttgtgacacagtgatgaaataaattcaaacccaatttaagccagagtgcttaaaacttgttacacaaccattgtcataagggaggccgctatccctaatgaacctgagttgaggctctctgaaggaagaaatgcataaatatgagtagtgtagagaggattccttctccatcacacacacacaaagtatatccagtgacaagcaaaaaggatgagagagaaagaaattagaaaacttgaatacagaaggaggaaagaatttaaactgatacaaaggaccacagtttagtccagttggaaatctagaatttgctagaagaatttctacccaggtaacatctttgtccttggcagacaggtgtcaattactgtgtcttcacacggccttttctttttttagtgttggtagtgagcaagagctctgtgatatcgcttcctcttcttataaggataccctcctgttggattacacctccatgcttatgatgtcatttaatcttaattagccattaaagtccatatctcgaaatatagtcacattgaggattagagtttcagcatacccattttgaaagaataggattcactggctcagggtctctgggtacctttattttgaggatggcccaatatatgggcgatggttgccactctataatcatttgtagtacagggccaagaagtgtagtttttgcactagtgccctatgggcaacttataggtgtcatgggtggtccagagatgctgggaggtgcgtaacagagattactagagcctcaacaatgaagaaatctctggagacactaatggaagtgtccattgatttagatctggacagattctagaggcttttgttgtaagatttgttaatataaatcggtatagtaaattctggttttttaattggattaacttgtaactttatagacagtaatagaaaacaagtttatatattgattgattgatgaaaatattgtgaccagaggctcataggaacctaacccatcatttcccctgggattaatgttttagtagtcactaattcattacttgtattgactttaagaatatatagaatatagagtgaaaagacacaaacacattgcagggactgatattccttggtcatcgtttgtaagtaccataggatcacagtgctgctcagcaactcttcctgtctctctgcccttttggaaaaaacatccctgcttaaggtcagatatcttgggtgagcaggtcagaaagctttggaaaggccaactctctgcagggcttaggctgggtacttgtgtttactcattgaagacatctccagtctcaaagcacatgattaacaagagaaatgcttgcttgcttgctcccagaatgaatgtctttgagaagacaccattgaggcctaagaatctgaaatgattttgctggtaagggccagaaagttctttctcagtgtccagccatttcctggccctaaaaataggtatacaagagcaaggttgatatggatgttacaacaaaatgttagtcccagctcagataacgtgactttgtgctggagaatgtagactggttacctcagctcagcaggacactgagggtggaagattacttttcccatggtaatcagctgcccctggatgaatccccaccaacatggaaagctgtgtccatgctgattccaagatcaggctctttaggggacggacttaatgctttttttctgtggactgccccctgtatgcttcctctattctccacttgcctgaatgcctgctccctgtagcccagcccctcattctggctgttgacatggacccagtccttggataaaagctggggaggaggaggaggcttcctcaccatatgcttctggcgggctcaccgtggggatagaaggggatggggtaaagaatgtgtacaggtatgactagatacgtcaacatctgtgccatagaaggcatgaccctggaaaggtgacagctggggtgttctctgttgtttgttctctgggaaataatgtgacatttactgatgaccagggacttctttgtttcagcaacaactatgcaaatgaaaacgattgtgaaggttttggtcggacagggtgctgacagcacattgtgtccatctgaatccgtatgttggaggtaagctgcttctacacacttgagggttttcctttttattgaagtatagcagtgttatattagtttcaggtatacaacatactgactcggttatacatatttagacatctttttatattcttttccactatggtttaccacacgatattgaatatagttccctgtgctgcaataggaccttgttgtttatccattctgtgtatcatagtttgcatctgctagtccccaaatcccaatccattcctttcctataacctccccctacctccaccttggtatcaagaagtctgttctctgtgatgtgtaatctgtttttgtttcatagatatgttcatttgtagccaggtgaaggtttataaatgaatctttttttatattgaattgttaaatatttgtttaatatatttggttatgttggtcttagttgtggcacgtgtgatcttcattggcacttgcaggaactttagttaaagcacaagggatcatctaattgtggtatgcaggacctttgttcagcatatgggtcttcagttgcagcacgggggatctttgatgcaccatgtgggatctatagttgtggcatggtgatctgttttgcagtatgtatgatctttagtttcagcatgcaagatcctctagttgtggtacgtgggatctttgtagtggtgtgtgggatattttgttgtagcatgtgagttccttagttgtttactcacagcatgcaggatccttcagttggggcatgtgggatcattgttgcagcttgtaggatcattttgttttgacatacaggatccattatttgtggtatgccgggtatttgctgcagtatgaggaatctttgtttcacggttgtgggatcttcagttgtttacataatggaatggggcatcttttagttatggtacgcaggatctttgttgtggcatgtgagatctttgttgaagtacgtaggatcttaattgtggcatgggagatctttaaattgtggcatgggggtcaatgtgagttctttttagttgaggcatgcaggatattttagttgcagcatatgagatcttttttgttgagactttcgtattaagtttaatagagctgaaacacagcaaacaaaccctaccatgtgtacttaccagtggcattacccaagctctacattttgcctcccgagattgcaatttcctgacttgcagagacctgcaattgggtactcccaggttcccaaactctagactttttgctctgatcctgcaatttctcatacttctctggcctcctaggccagaggcctctgttctttctatactcccttgagaagggccaacacctgaagtatacttcctggtgtgactgaaggagcactatccacagaaatgggtgtacaggccagagggcgctatgctgctcaagactgacttttctgctccatcttgcacactccgtggtgagggctcctgagcacacattcactacaccctggcttcttactctattgagtttgctaaaaactgagtcttgtctacctcacattccccaacccagttgacatgacttagtgactaaacaagaacaaaaacaaaaatgtcaggcttttttctctacatgttggggccaaaacgctggagccttagagtggcctcatctccaggggccaattgccctgaagatctgatacactgacctttgccttcttttccccttctatgatggcagccaagaatcctcacttcacctttgcctcccttagctaagggagggggcagtctgagagcccagtttctgtcctgatgaggcgccagagccctatcataaaatgcattgactgacccccttctaccccttccagaggcgagacactctggtttactggaagcccaagggtctggaagtgacccccagccaactatctcctgatctctcaaaggtgtccagatctttcataattcaacctgggcagtcaaatgactcctttcaccacacaaaaaaaattccttgggcataagctgttttaagcataaagcaggttttgcattcttacagacggtaggtgcagggcgagatgccctggtcccccaaccccctgacccctctccagcttccagggagctcaagctgaagctgagccagcaacgactgcaaggaccagaatgagcagagggctgggtagtgcccaaaccatgataggaagcaggatctggcatctttttgaatgaatcttgccacctgcaggatttgcgaacctcactacggcatcacggtggtcgtagccagttgtgcaccaggcttcctcctccctatttggcagccggatgtgcgttagacccattgctcttagaagccaaaggattggttcacagcatgcttcatggcgtcgagctgctgggctgcttctcttctcgccactctcaggcttggtgcccctgatcaattcccaccttccctttccaagatgttctcacctgagaggtgagtctttgtggaagaacaagctccccgtcccacctcgtggttagcctgctcacctcctgctctctgctctgtattccaccaggtttccagcggtgacacctcccccattacagacacacaaggtatatccagtgacaaagaagcaaaaaggatccaagagaaagaaatcagaaaatttgaatacagagggaggaaagaatttaagttgttacaaaggcccacagtttaatccagttggaaatctagaatttggtaaaagaatttatactctggtaagacctttttccttgactgacagctgtcttattactgtgtcctcacatggtatttactttgtttggtgtggggagagagtgagagctctgtggaatctcttactcttcttataaggatgccctccagttggattacagctgcatacttatgacctcatttaatcttagttacaccttaaaggcagtatctcgaaatatagtcacattgggggttagggtttcaacatacccattttgagagaataggattcactggctcagggtctctgagtacctctattttgaggatggcccagtatgtggctgacagttgccactctataatcatatgtaatacagggtcaagaagggtagtttcttgcctcagtggcctgtgagcaacttttaaatgtcatgggtggtcagagatgccactggggcataacagaggtactaattcctcaacaaggaaggaacctctggagatagtaatggaagtgtccattgatttagacttggacagattctagagtcttttgtcagaaagttttatcattttgttaatataaatggttttacaaattctgggtttctgattaaattgtatctttagatggaaacagctataaaacaagttaataaattgattgattgatgaaaatgttgtgaccggaggctcacaggaacctaaccctttatttcctttgggagcaatgttttagtaagtcactaattcattacttgtattgaccttatagaatatagtgtgaacagacgcaagtacattggagggctttgccatcgtctgaaagtactataggatcacagtgatgctcagggactgttcccattcgcatgccctttgggaggaattatccctgctgaaggtctcacgtatcttgggtgagcatgtcagaaagctttggaaaggccaactctctgcagggttcagactgggtacttgcctgtcctcatccaagacacctccagtctgaaagcatgtgattaacaagagaaacgcttgcttccagaatgaatgtctttgagatgacactcttgaggcctcagaatctgaaatgattttgttgctcgatggccagatggctctcagtgtcaagccatttgctagccctaaaaagagttgtataccagatcaaggttgatgtagtgacagtcccagcttaggtgggaaaatgtgactttgtgctggcgaatgtagactggttagctcagctcaggagggcactgaatgtggaagattgctttttccaaggcaatcagctgcccctgtttggatccccaccaaaatggagagctgtgtccacgctgactccaagatggggctctttaggggattgaactaatcttttttctgtgggctgcctgctgcctgcctcccctcctctccacttgccagaatgcctgccccttctactccagcccttcatcctgcttgatagcatggacccagtgtttgtaccccatcgcctggataaaagctggggaagaagaggaggcttcctcaccgcgttcttctggctcactcactgtaggaagagaagggagcaggggaaagaacgtgtacactcactactgtgtgtctacatgtgtgctggagaaggcacagcctcggaaaggtgacagccagggtcttctctgttgtttgtcgtctgcgaaataacgtgacatttactgatgaccagtgacttgtctgtttcagcaaaaactatatgagaatggttctgaaggtttcagacagggtgctgacatcacatcgtgtacatctgatgcttctacacacttgagggttttttaattgaagtatagatgatagagtgttgcgctcgttttaggtgcacagcatagtgactcagttttacatatttagacattctctcttttcttttccattatggtttaccacaggttagtgaatatagttccctgtgctatacagtaagaccttgtttatccgttctgtgtacaatagtttgcatctgctagtcccaaacacccaatccattcctctcctacaacctccccccaacccagcctcagtaaccagaagtttgctgtctgtgcctgtaatctgtttttgtttcaaagatatgttcatttgtagccaggtgaaggtttttaaatgaatctttgtatatttaatatttaaatatttgtttaatttatttggctatgttgggcttagttgtgacacgtgggatcttcattgccacacgcaggaactttagttagagcacaaggggtttttccgttgtggtaggtgggatctttgagttataccatgcgggtctttagttgtttagttgcagcatgtggaatatttggttgtggcatgtgggatctttatttggggcatctgggacctttaattgaggcatgcgaactcttagttgtgattctaaatcatctagatttggattttaggtgcctgaccagggatcaaacctaggcaccctatatagggagtacatactctttttttttttttttttaattttatttttaaactttacagtattgtattagttttgccaaacatcaaaatgaatccgccacaggtatacctgtgctccccatcctgaaccctcctccctcctc

SEQ ID NO: 28822 - DNA, 1733 bp, Bovine  19866880642901
atttagatgttataccctccctactttttgtcccccaaaacttctctggaaccaagaatatggatggatttctaatgtagaggatattagagaattatctcaagaaaaaaatcaagacaacataatagtattaatctacagtggttattctggcctatagatgataccttatcttaaattctaatgatccaccctctcatgctatcaatccatagttcagactgatataacgattaatcagcctacttcaaagcttaccagtcatttgaattctagccaactgtctaccttttcactccctcttttcttgatagatactggaggaacagttacacttcatgcctattctgatctatgagaccatagccagggggcatttttggtggcatggtttttctattctgtagtaagactccacaaagaaacagttggagtgtccaacgtcagaaactttgacatcggtttccatataaatactatacaccagccactgagcctacttttggctcctccaagaaggctggatgctgaaccatccataactgacaacagtgacaagaagatagagctatctgatgagaacctgatagaagctgtcacaagaaggagcttatctttgctgaacacatgcagtgtttctcctgcagaatatgtcttgagtgaaaagtaatcatttccacttgtttaattgatggagagtccatgtattcaaattttatctggacaaactcagaggaaggaatagacattgtctgtatgtttgtgtggcaatgggggttgcagagtaaatatctccaatatcaaacagactgaatttttgggagccaggcaaaagtacgttgaggaggcatttagagacttacaaaatatgcaaacacacaggcatatatatacatttacatttagtacagatttatataaaatagctaagaagtgggaagcaactcaaatgttcataacaggagaatggcatattcatacatgaatatacattgcatgaattattgattgactcatacactgatttaaattgtatgaatagcatattcacacagtttgatatattatggtttattaatgcaaaggaacactattttgcaattttaagaagtggcaaactattgatacatcagcaacacagatgaatctcaaaatttcattttgagaaaaaagtcagagacaaaggagtacaaactgtatgattctatttatactgaattccaagaacaggcaaaatgaatgcagtaaattattgaatagtgctcctacgtgggacacaaatagttgtacccctcattttacacataatgaaaaccgaagttgctgaagcagattggcaaggttacgagaataattaacaacaaaactgagatgtgaattcccagacataaactgtctcctcttggcccttatgtattcagtcactacatgtttatagagccttctctttattccaggtactgtgctaggcatgaaaatcaaataataaaaataaacttgccccatgccctaactgacaatgaagcatagaaggcaaaaaatatattttttccaaaaagatgtactgaattcatagtgtgtagaataaaacttaatattgtgtataggttgctcttctcaccccctttaaaccttgacttgaaacttacccaggaatctacctagcaacaacttcagtccttgggtcataattttttctaggaatacagaggcgacggtctatcctttaaatg

SEQ ID NO: 28823 - DNA, 1907 bp, Bovine  19866880656975
atgaactaacctattttaatcccaaagtggcctgctcaaaagtgtctgtataccacttttgttatagacagtaaataggtttgttagtaaatatgtattagatctctttttgttgtactttgtaaacaatatttacattgtctgtacataaacaatgtaactaaaaaatggactaaaaaaaagaaaacagttaaaaaagaattatgagtttgtggaggtgtgcacaatttgactaggcttcaggaagatctggagcccagaagggaaatgtctcagtgtcttgaacctaattctttaaaattttggctgtaataatagagtgaataagagagcagagcacggtgtatcctgctgactcttaaatgtctctccagaccatccctagctctcatcctctgctaacacactttttgtgccgacctttagatttccaatgggttacaccaatgacctcaaagggaaactgtggccacagcagttcacagcattactattgtagatgcaacctggtttcatagagagtaagattctaagcaaattaagtcccttcccaccccataagaatatcaaaggggttagactaattatggtgcattcagtgatgaaacataatgggcgcttcaaaatcatggatggagagtttgtaatgatataggaaaatgctgatgatataatttcagtagaaattgaagggcaagaaactatataacctgtgtgattccaattacattaaaaactaagacttccctgtggaaaatgaatagaagcttaatagtgataatatctcaactgtagattttgaattatttgtcatttcctctaaacatcttcccacaatttctgtgaggagcatttttaattttataaaaagtaaactgtaagagcaaaaaataaaaatataaaactatgaagttaattaggtataaattttgatacttgtgaggatggtgatagttgtgagggttaataaatttaaaaggattaacagggggattggccagttttaggtgctcagaaagtttccttttctgtttattttctctgttcagtgctgagcctttatatgaaaacagttcatctagatattaaatacaaaggccaaattgacattgaataaaatttaatttaagtcaatagaatcaaagcatatcggagagagaaaataaataagctttgtgggatgaagtaatctctgaggtgactttaaaactctaggttttgtctgattctatgatctactccagaatggtccaattaaacgtagcataattaagggaataaaattcacatctacatgcataatcgtgtacgtgtttacgtattctcaaggctaattgccatctctgaatgccatttaatgtgtcaatgctttttaaagaggacttacaactttatacgtgaacttttcctgttaggacaagaccaaatttttagttttcctggtctaaacttatagatgtaaatttgagagtgaggaaacagtcttcagtgtaaagtagaattgaaatcaagttgcattggaaatacttcctcttcatttttcctttttttctgcttttttttttaagttggaaattctttgctagttcattgttctctcagagtattaaaaaaaaaaatcatccttggcttttgtttaacaagtcttatgtttgtgctgaatcttcccccgcactgctcctccaaacaccattttgctttcttagctgttgagtttgatccagggaaagcctacctcagtgtcccaattacaagcatttaagatgaaaccaggctgcagattatacaaatgaaaggagcaaaaataacagtgttctatataaacaagggcagaaagacaatttgttctagtcaaagataagttaagctgtacccaaattaccacgtgtcaggcaatcagaagaaat

SEQ ID NO: 28824 - DNA, 1996 bp, Bovine  19866880657421
tgactaatggtatatgacaaacacatttaaaatctgcataggccagtgccagtttaaagtgtaacatgaataataaataattttaaagaaatcttagcatgcaaaataagatgtaatctcttcagacataaataacacagagaatattacagttctagaaaggcatttgcaaactgaccaaaacaaagtcaaaagtgcaattcattcagaaagcaactgtagttgatgtttttgcacacaaactgattttcaaagcattgggcagataagtgataaaacagtggtcactggggtataaccaggaaaaatcccaggtctctaatcagttataaatggcagtcagtgagaattctagacagatataaatgcaataagacaggctttctgttttctaagaaacacaattctttgtgagaaaaataagaaaatgctttccttttttttaaaccaagctgagctataaacctaagcatagctggaaggtgggcactgaaggatttaaacataaaattctctttagtttatgggactttggtatttgggaagcaaggaaaatagcactggatttggaaacctcaattggagacatgattcccaattttaccacatctgtttcctcattgacttcatgtaaaataacatgactagtctcacaagacagttgtgatgggcaaataatgaagcctgtagaaaatttattacaagtggtaaaggattattcacacattggtgtgatctattatttgttttaaatctaggattcaaggagtgtgtgtccaaagaaaaaacaatggagtataagtgaagcagagtgttcttgtcttaaaaaaaaaaacaaagctttcataaagtacatagatcagaataatcttgttgaaattaagctcctggaagttttgagaagtatgaaagctatataaaacaggcaattttttaatcatgaaaactaaattttgttaattcgtttttgaaatattacatttagccttcaattaagtgccatttttcacaggtgtgccataatgaactatttttccttgattggattttaatagttgttatcaacaagagtttaaaattttttacaaaattgaaatttccatatattagtttggtgaatagttaatataaaacctccctcattctgaagcagtaggaactagggaacaccaccactaagattgtattttgtcatataaatgaaattaaatgcccctcataattgtgagagcacaaacaagtatactgaatgaaatatataagaagaacataatgtttttaaatatccttgacctcaatctgaccctcacaaaaggcctgagatgtagaatggactacattcatatttcccttcaaaagatgggaaaaatcaatctcgtcaagtaatgaaatgattttttaaatctcccagcaaattcataataacagtggaataaaataataaaaataaaaattcaggtccttccatgcttttctgaactatattttttgtacccatttcaagaatactcaagacagcattctactttgttatctgacaaaaggcacaggttggtaaaaacaacaatgttaaatagttttaaaaattacttttacctcttaaaatattcaaaatgactgaaactggacttataaagtcatttaaagcctactgtggccttaagctacaccttatatttcatgaatatgaatttattttgtaagaaaggtacaaacttaagagtagtttggtagattccagatttctaaattattgtattaggggaaagatactagtggggcttctctagtggcttggtggctagaaatctgcctgacaatacaggagacataggctaattctgggtcagaagttgattctggacgaccctctgaagaaggaaatggcaacccactccagtattcttgccaggaaattccatggacaaaggggcctggcaagctacagaccataaggtcacaaaagagacgaacacaacttagtaacaaaccaaca

SEQ ID NO: 28825 - DNA, 3602 bp, Bovine  19866880688436
ctgggatttctctggagggaatgatgctgaagctgaaactccgtactttggccacctcatgcgaagagttgactcattggaaaagactctgatgctgggagggattgggggcaggaggagaaggggacgccagaggatgagatggctggatggcatcactgactcgatggacgtgagtctgagtgaactccgggagttggtgatagacagggaggcctggagtgctatgattcatggggtcacgaagagtcggacacgactgagtggctgaactgaactgaagagacatgtatcattaccaactcatttgaagataagttgattttcaaaaaaaacaagaaacccatctaaatatacatagagcattgttaaattaggggcttcccttgtagcttagtcggtaaagagtctcctgcaatgcaggagatgtgggttcaatccctgggtcaggtagatcccctgaaggatggcatggcaacccagtccagtattcttgcctgaagaatcccatggacagaggagcctggcaggctacaatctatgcggtcacaagagtcagacacaacttagcaactaaacctccaccattgttaaattgagaggaaaactttatctgccttcaaataaaattttcctgtacaccattcaagttagcaattcaagaatagttaacatatattatggtatgcagagaatgctctactacatctagtagagaaatttgttgccaggattcagagacaaggatttccttagaccaagatttcagagcaaggtgccctaagactgagtctccaactcacgagtgaccattgactcaggcactgaactggataccaacagaaaggaaccatgcagtcatccaacaatagggccagacatccctagattcttgatcacataaccaaggtggtgactaattcgtggttcttgagaattcttctggctctaaatgcatatgccttctggtcattataacatagccctctgcccatttttcatggtctagtctcaatatgtaagccatatctctgcctcaggagaaactggatgagaattaggaagttcacctggaggagaaaagtttatagcagcagaagataaacaaaacaacaggaaaaaggtgagggaggttatctgcatatatacaatacatataatatttactagttgaccttgagacaataaattatatatataataaacaatataaataaatcatatgcatgcaattataaaatttaattgggaatgagatatttcattgcattctaaagctttcctgttgttatcccagcctccattcttcccccatcatcccaacaactgctaaagattaatctttgatagattattaattatcttaggacaaacatcatgacttctctgtttgtatatttcccatggaacatagagctctgtcatgtgtgatctctttaatgaatgtttttagagtgaaaattaaaggttctagaaaatgaaatcatatccacattattgtggaattttaaagttgaaacttccttacagactttttagtacaaattttcatactgtgtgatagtggagaattggaattcaactgatttgcacaagatcacagaaccaagcatcagtagaactaattctgttaacaaatattacaagtacctactatgcaataaggcctgggattataatgaaggtcttccattacctaatttagtactctttccaaaatacccaggaactagttttcaattattcttaatataatataatataagatccatgagagaagggattttgttctattcacttctatatcaccagcaaattgagcactacttggcctctgaatatttaatgaatatttgaagaataagttgatgaaccatcaattttcagactatgcaaatatcatttgatgatctatgagttatttaagaatcttatcagttcacatttggaaatgtcagtgattactgtacaaatcaaagattgtagaattctgatcaagtgtttttccctttctcataaaaaaaatagtcatatgtattagaggaaaggattcagttatatgtgctttgtgattgcattcaatataagcaagagtttatttcttccttttcaaaaaacgttcatgtttctgttggattttttgtgtttccttcccttgtttgggcacagagcaaacacagccagaatctataattggccatactatggctgagccctcacttgcccaatggaacatcagctttatgaaagcaggtttgcttttcatgttcacagtagtatgttgagttttctaaaatgagactctggtaagccattatcaacgagaaataataaaaggctagtggggaccaggtttgcgttacttctttttaaggtgttttacaaaggtattcttgggaatgctgtttttcaaaatcctgtcctgacaagttaagtactagcagttctttgttgaaagaaatatctttcatcttttttttttctatttaggaaagtttccttcctctgagatagcctcctttactctgtaatatgccaattgtatgacaggcagaattcacatattcactccccaccaccctcttttattctgaacataggaaaattgctagctatacatactgcttgagtctgaagaatgccacattcttcctgtttcagtaatattgatttatcattcacaaacatctcctgagtgtctaacatgtgcaaagggtacataggcacctacaaagaggaatcaacccttacaatcatggtatatgtagagcagaaataatttgtactgcctgccttctatattccaaacactgagtgaacccatgacattacataatttaatattttttaaaaaacaccaaattaggcactaaggtatgtatgcatgtgcacatgttcagtcgtgtccaaatctttgtgagcccagggactgtagcccgccaggcttctctgtccatgggatttttcagggaggaatactggagtgggttgccatttcctcctccaggggatcttccggatccagggatcaaaactgcgtttcctgcattgtagatgctttactgctgagccaccgagaaagccccatcgacactaaggtactaagatggttattcttaaaaagagataagtgagactcgataagattaaacagctttccagggaattctctggcagtccagtggttaggactccatacttcctctgcagggaacatgggttcagtccttggtctgggaataaagatctcacaagccaagcagcatggccaaaaaaaaataaaattagctttcaaggtcacacatagatagaagaccttatactctgatttcaaactgtgcttcttgcccctaatcatcatgctcttcctactctaaaaaatattttaaaactttacaaatcaaatttagaaaataaatcataaaattttaattaaatcatttaaataataaatttcatttataaatcacatttatgaattattaatatgatgggaattatttaattgatcctgatcgttaaaactccatggctttgggggcttataaagctacttataaaggttgactaggcaattcggacatactataaaaagagaacac

SEQ ID NO: 28826 - DNA, 1155 bp, Bovine  19866880689607
aaaagaaaaaaatatctcaaagtataaagtttggttgatttagttgatcactataaaaatcagataatatgagaaaggagtagactgctgaagcacattaagaattccatatctgaaattagcagatggcagccactgtaactttctcttcaacaactccatcggcagcagacgcaagtgttatgttagcatatttctgttaaggaataggacaggagcagggttatcgatttgctgtaattgttctatgattcagcagttgagtcacttaatgactcccacgcatataccaactcatataattgaaaagagtctagtgtgtggaccatctgttactataaatccatggtgccttgagatatccacagataataactgtgatgcccctgcttgagtaactgggctgtacctttactgaaggtgaagagtatagagagactgcttgaattatgtgctgaggattgtacatagttcatttcaactcatttatgacacattaacagtaaaaatgaatcctggtactgaccaataaatgtcattaacatttcttaattaagtggagacatggaggcatgggataggaatttttccccggttcaaactcactgcagcctcccttaagcataaaaaagatgtacaaatatgacataaaaaaacataaaggaaagttcaaatgaccaatattaaaaagcagagacattattttgccaacaaagtttcatctagtcaaagctatggtttttccagtagtcgtatatggatgtgagagttggactataaagaaagctgagcaccaaagtattgatgtttttaaactgtggtgttggagaagactcaagagtctcttggactgaaagtagattaaaccagttaatcctaatggaaatcagtcctgaatattcattggaaggactgaagatgaaactccaatactttggccacttaatacaaagaagtgactctttagaaaagaccctgatgttgggaaagactgaaggcaggagaagaaggggacgacagagcataagatggttggatggcattaccaactcaatggacatgagtttaagcaagctcaaggagttggtgatggacagggaagtctggcatgctgcagtcccatggggtctcaaagagtcagatattaccgggcaa

SEQ ID NO: 28827 - DNA, 2678 bp, Bovine  19866880692790
tccatggggttgcaaagagtcagacaggatttaatgactgaacaacaacaacaaaaaagggcgtcttagacctacttttctggaagttctcctttgtatacctgttatgatttataggctttaaagagatgccctcattccctttgttatggactgaatgaacgttcatatgttgaagacctaactcccaaaaaaatgatattaaaaggtagggtctttgagagacaattagatttagataatgccatgagggtagggccctcatgttgggatttgtgtcctcataaaactaagaagtgacaccagagctcagccttctttgactgacaacaatcttcccagaatggagaagctctttaccgcatgacttaatcctaagtagacaaaggctaactgattgatcagcacacaactaactctggagcagcactttaaatgacactttccaaacagaacaaacacaagactgggtattttagatacctcatttaatctacttttcacgaccatctggtgaggcaagtgctccaggaatgctggattgattgatcaattgattttactattttcactactttaagacaaactgctttttaacaacatcagattcttagctgccttcatttatccatggcttacacaacagcataagccactttggtaagtttgaagccttacctgcttcagcttttaagagtcagaagaatggcaggtatgtcttgtaattagatttttacatcagaatggatttgatttttgacatcaaatgaacaaaccccatttgtctatccctgcattgcaggactagaaatccatcataattatttgccagctgttggttcaccccagtcatggtttcttattctgaaatgtttcctaacctctagaaagtcctcactacatttgtagtttgcaggtatctgaacggcttgcatttttaatgaattcctaatgtactcactcaagcaaacaaggaaaattataaccatggaacattacatttcagacattaatcataattgcttaataataccaaacaaggagattttattgcaaactgagacttatttaacttcagaatcagaataattgtcacatttgcacatattctaaatgataccacatatttccaaatgcctacattaaacagtttagtcataaagaaatattttgtcagctaatttaatttaattgcatggcataatcgtttcacctatttctctaaaaacaggtattttaataagagaactaaaaggaggttataaaaatctcactttctcaattgctaggaaaggtctctgcggaaagttgccagacaattacaaattcggggggtttctatagttcttcaatgtatttgttatataccattagtcaccagtgaagcccttcactaatagcaatacccttcaacaatagccccagagaatttaacactgattgatggcaggtcacctggaattggttggcagaatttccaattttctgttgggaaattgcttatttctccaagtctattcccatttttacaagtggacagcaagctgagattatacattattatgtgtctaaatataaaattgtgatggatggtgtcacacatttaaaaagagttaagcatttaatttaaaatttaaaaagtttaaagaagtttaaaatgtatttttaatctttctcagaaattcatgggctgattcatattgggggaaatactaagaaattacctaaggattgtcatttatatggggtattattttcctaaaattatccttttagacctcgaagcagtagaaccatgactttcttgtaaatactatctaaagatctcagtcttatcaaaagactgaaggaataaatagattctttctgtaacagtactaatgccaaatttggcagagtaaacagtaaagtaagcaaccaaaactcaaaagccacattaaaatcagaagacacagtttgctatttatattaaactatcatttatttaaaaacatatactaggtgtaaattttaaaagtgtatatttaggatgcaaaaatatcatatgtgtggtgtgtgtgcttagtcttatccaactcttaatatcgtatatcacaggagtattactatatacttttccacttagaaactctaccaaattcttgagttaagcattaagtccctggctaaacatattaaaggcaacaggtaacaatccaatgacaagtttgaaattttgtcaatatgggtcactctagagagacaaactagcaaaactctcagaatgtgcctgcagtgcaggagacctgggttcaatcaatccctgggttgggaagatcccctggaaaaggaaatggcaacccagtcaagtattcttgtctggagaattcgatggacagaggacctggtaggctacagtccataggatcgaaaagagttaaacccaactgtgtgactaactttcactttcactttcaacataattgggataatttggtggctcaaatggcaaaggatctgcctgccatgtgggagacctgggctcgatccctgggttgggaagatccactggagaagggaatggcaacccaccccagtattcttgcctggagaattccatggacagaggagcttggtaggttacatttcatgagatcacaaagagccagacacgtctgagtgacaaacactttcactca

SEQ ID NO: 28828 - DNA, 919 bp, Bovine  19866880695177
ctgtgttgggtaactttgagcaaatcacctaactgctttaatcgtgtcctttatttgcaagtaagataaaaaagaaaaagaatttctcttacaattttggtgtaaatacaatgtctgcattgaaccttcaaatgttaggttatttctgtatatcagtcatgatgccctctggtcctttgtgaaaagtacatgtgtttaagcaaaaagtaagtaaattgtgtcatcatttcacatatgcttgtcttatccctagagagcttgccagagctctctgggaatagaatttatgttctgtttcttttttctttttctacctcagggttctttgtacaccatggatactcaatatatcttgtttggtgatgattgacaaacaagaataaattcaattgctctgcttcacctttaagaaagatgcttgcctccgcttgaattctgcatccattaactgtctcctcccttctgggagttgtagtgaagctaaaatctaaatagctgtctattttgcaattgcttgccatatttgatttctggaagatataacagtatattttgggggagtggggagaaggtaaggtccttttattctggtacatttttctctcctaactaaccattaagtcataaggactgagttaggttccattgccttaaagatcccttttatgcttttggttcagcttaatggtttagtgaatgttaagtctcagcattctaccttgtactttcttttacctttgctaaaccttagtatttattggacctacccatctgaccactcacttcaccaaagaaaaggtggtttcaaagctgtatgttctctccactgaaattccatgtcctgaatgtgaaaaataatgagaattatataccccaggggatatataattgggaaaaataataccctggataagacaca

SEQ ID NO: 28829 - DNA, 846 bp, Bovine  19866880707512
ttaatgtgaaagtcagactcaaatgagtcccagtggtgttctcggatctctgctgagaagcacatttcaaatacagaagaaatggcaaccagctgagaccccgtgtatcttgtattgtaacaattaatggatatgaacagccctcacaggagagctcaggttacctttctatcaactttggaggtgagagtctgaaacagctcattgaggttaatatgcagtgggtttatgatttgattaatccccaccaattaaaacaatgatgtttctcttttttcacattgtatttttgtaattactctttggggtacatggatgtaacagtgaaatgtcaacaagggtgcaataattgcataggagtttaaagtcagggaagaaatacatttttctgaatgtaatttttaaaaaggagaaagagaatgtaatgcagtattcaatgggaaattagcagtaactcgttgcccttgattcaagaaatcatactggtgatgtgacatgttgacattgtctaaaacactaccctaccacttatttggttcaaattaattcagatcatgtgacagaataattaaaaaaaaatgagcaactattctaggtgtggtagtggtttggttactaagttgtatctgattcttgcgaccccatggactgtggctcctctgtccatgggatttcccaggcaagaatactggagtgggttgccatttccttctccagggaatcttccaaacccagggatcaaaccagcatctcctgcatggcaggaagattctttgccaattgagccaccaaggaactttggactaatatggtgattttttatagatagaagctgaaactccagta

SEQ ID NO: 28830 - DNA, 1949 bp, Bovine  19866880726372
tagtcctgcctacagaatttcatggacagagcagcctggaacgctacagtccataaggtcacaaagagttgggcacgaatgaagcgacttagcacgcacacaaacacacgtagtttatgtcagtttacgcttggacgggctggtatatttattcatatttggaagggctcatatatttattcatatttggagggaccggtatatttattgatatttagctgtcatctattgagggcatgaggagtaaaatacaaagacgtgtggaagtgaggattatttggaaaggcaagctggtataacaggagaaagtaaaggcttgcttagcttctaaaagagaatagtcttttaaaggtcagctagacagatgtgtgtgtgtgtgtgtgtgtgtaaatcatatttgacagaaaggcacactggctcattaacaaaaaaaaaaaaagcacaatcaggatgagtccgcctgccaatgcagggcatgcaggttcaatctctggttggggaatgaagaccctcacatgccgaggagcagctaagcctgcctgcgacgacgagagagaagccagctcaccgcaatgaagatcctgcatgccacaactaagacctgacccagacaaaaacaaattaattttttttaaaaagcacaatctagcatgtggcatatccttctcacagtgcagggaatggggactttagaagctggacagagagccaatacaggtaggcgcctgtcctcacatgcacggacatctaaagtctattcttagttctcatttttctttctcttcccctctccctctctctctctgtctctctttcaatggccatctacctatttctacctattttctgaaagcactcaaacttcatcatatctcagtcctttgtatgctaacaggaaaagtctatccctccttgcgctgagtccagcctggcaactggtgagcatgcacgccacaaccattgaagcctgtgcacccgagagcccttgctctgcaaaaaagagaagccaccgcagtgagaagtccacgcattacaactagagactagcccctgcttactgcaactagagaaggcccacatacagcaatgaagacccagcacagccaaaagtacatcataaataaatcaaaccaatagtactgtgctcatatttgaaaactgctaagagagtagatcttaaagttcttatcacaagaaaaaacatttgtaactatgcatggtgagggatgttgacttattataatgatcattttgtaatataatattgaatcattatattgtatacctaaaactaaagttatatgtcaattatacctcaaggtttagaagtcagtaaaatgtgaccaacagactgaagccaaaactatattgcttaaagccataaaactaagtctaaatcagattatcaaaatagcctgctcattgttacttaactgttacttaactgggcttcacaaaggaatccagaaatatttcctatggccattcccactcatatgttacaaaagaaagaaataacctcctgtcaacctttgcctgtgatgtgacctcttagttgtacttcaagacccaaatcaagaagtacttatttgaaaacatttttatgaatgctctcggaaaaggtgagtcaatcactcctgtgttctaactgtactttgtacttgcctcttaaccagatgggttcaaactcagctttttcactgacttggaggtaatgttgatcatagagctttctacctaaaaacagagaggaaaatagaatttcccagagttgttatatgaaactaatgaatgtttgcttgggtcccccacaatatgaaaacacagctaccagctatggagggtttcctctggctttatttattgcttttccccattaaattaggagctcctctagaaaaagagactgtcttaatcacctatgaatccccactgtctagcaagcagtt

SEQ ID NO: 28831 - DNA, 1076 bp, Bovine  19866880738583
cagctggcagtttaacaggctgaattctaaaacataaactcaagaataataatttcaggtttaattttcttcctagattagtgacacattacacttaattaaattgttaagtttatcttaaaattatattttctttccatggaaaccatttcacttagagaaacaggcacctccagttctacctcatgagttgcccatgcaaagttttatttgttgacttgactgaaattgtaagcatatgaaagccttggctggaactggtcctatgtgaattgagagaaacatagaatgcaaagctttccaaagaagcataatcaattttagaggcaattaatacaattggactagaacttagcctgggaagattgagcaatagcaagacaataattatagctttgtgtactcgcaatgtgtttaagcaatattaaatatattattgctaattatcataaagcccctgaaagttaggtattgttattctcatcatatagataaaaaaatgacctagagggatcaagaattttatttgaggtcacacaattggtaataaatttagctagtagtatatagcttcaaggatcctttactatctcttgtgtttgtctcctcttctttcattggttattaatgggaccatttattttaaaaatagagataatccagtcttaatatttgacataacatatttcagaaacactgagatagactgaggatgagagaatcaattcaatttatcaaaactctgttgaatgtgaaaatggtaaaacaaaaacccagtgatttaatggaacaactagttccattaagacaggtaaagattcaggagagattaaagttgtaatttggcagttgtaacaccaacacagatgaaatctagtctctgtgtaactttatgccttgcattatttgatttgccatctattttgattaaattatatcaaataattgccagatctcctctgcagtgtatgctgcacagacagctcaagagagaagactggacaagtaaagcactgaagataaatgattggattgggtttctaccctgtccatgaagcgatctgattaactgtgta

SEQ ID NO: 28832 - DNA, 1235 bp, Bovine  19866880752173
ttctaactttgagcaagtttcatggggcgaaagttggaaaccatctagaggctcctgttggagggactattaaggacatacggtcactaaccacggggtggccagcgggtgcccaaatgtgacccccaacgtggggacctgcatctgtattgggagcaggtatgggatcccaagccttacttggcttttctgacttttctgcagtgaccttgctttgctttcagtaaggatggagcagagctgggggaggaggcgtaaacggcaacagaaaagaaccccagaattttcaggtgagggggtcttcctcctcctgtttaataaagactcatattcacgaggccaccgggtctggccctgcccagatatttgggggtcagtgcaggtggcagggagcttggtggagccccccacccaccacaccacaccagcactagttggttgggcaggctgtgggctgaccactggacctggtcctcgctccactggctgcagtgaggcagcctgtccttctccgggtcgctttagtgaattggtgggaaggtggacgaccttgtccaaagcctttctgttggtgtcaggactgagaatgctgtcccaacttcctccggctgccacaacaaagggacgcaaactgtggggcctagaaaacacaacagccttgtgtacgctcacggttctggaggctggaaggcagagatcaaggtatcacagggctcagttacctccaggggactcccagggaggatccttcctgcctctttcagcttctgggggctctgggctgtggcggcatctcatggccttctctgtctccatagatcctctttaaaaaataaaatcaagccaaagcaggagtttaattgctaacggattgatgaagtgacattttccactaaaagacgaagatcgttctgagaaataaagtcagaattatatttagggctcatgagaaagaatcgagtaatatcaggaatctttttaaaaacacaaaatattttatttaacatatgaccaaacagttcaaagtatccctactcaagttcagaaatacaattcatgcgtgtgcactcagtcgcctctgactctttgtgaccctgtggattgtaacccaccaggctcctctgtccatgaaatttctcaggcaagaatactggagcaggttgccatttcctcctccagaggatcatctcgacccagggatggaaccccggtctcttgtgtctcctgcattgaca

SEQ ID NO: 28833 - DNA, 1805 bp, Bovine  19866880755880
cttaaaaaaggaaattgttgacttcccttgtggctcagtgataaagaatctgcctgccagtgcagaagatacggatgggttcagtctctggactgggaagatccacatgccaccattcaactaagtctgtgaaccacaactgttgagcccgtgctctagatcctgggagccataactaccaaagtccattccctagagcctgtgctctgcaacaagagaagccactgacatgagaaacatggacaccacatgagagtaggccctgctcaccacaactggagaaaagcccacacagcagtaaagacccagcacggccaaaataaagaaataaatttattttaaaaaatggaattgtgatagatttcatcattaaaggaactctgtgagaagtgcagggcagttactgttataaaaatcatgtgacaaagaaacaggatttcattggttctaagcaactaaccaaaagcacatgctcagttctaagagaagagagagattaatccaaagacactgttttccatgtgggatgttttgattaagtgtgtgttaatattctggccctgctacttgctagcactgcgaacttgtaccacctattatctcttctctgtccttaatttcaaaatgtgtataagtggcaataatgtatatatatcacagttataaatgttaacttaataaaattcctgagcattatcattaataatgatagttgttattaataatgataatgtagttcttttctctgtaagcactggggtttccccatggtagtctcagttgatgtttgagatactggaataatcagtttatatttatctctttctaaaacctgtgagtttcagagagctcagagaacctcgtggttaaaagctcagcctctctggtcacacagagtaagttcaattctttcagccccagctctgcaattactagctgacagaaccttatcaaattgcatataactcccataagctacttatctgtacttatcagtgtactacttatctgtaaaatggaaataatatttatcccctaggcttatttctagtactaagtgaaatacataaaaataattacccctttttgagctctttctaaatgctgggctaattgttgaaggtaaagtaattaataattaccatagtgattattattgtaaactagacaccattgcccataaacaagccaaatatatatatatgaagtgatttagcaagatatttttacacattttaaaggagtatttttcaacttagcatttatggctgccctggtacaaaatgggcatacatctaccagagtgacacacacaaaaatcaaatttcggttgctggtaacacagcttccaatgtcactgaatggtttcagttctgcagaagaattaacagattgggtttctttcatggggcagaggaggtgacataaggccttggttaaatagcacgaaagaatagctcctgatatcagtgtagttggaatctcattactattcatggctcttgctgtccctttgttctctgcagtttctaaggctccaggcatttctttttggatttcattttcattttattaattttcggattttttttttcctcctcggcctggatactggaataaagtttttgccttggtcactcaaaaacaaggggtcagttttctgtctttccaataagatggtggggaatgtctttgtttatttgcctttataaccttgcccacttccaaagagatttttaggcaacttgtagcaagaattgaagatattcataagccatttgcacagatacaggttaaaatcaagt

SEQ ID NO: 28834 - DNA, 867 bp, Bovine  19866880826652
aaggctggcttgctgtggtccatggggtcgcaaacagtcagacacgacgtagggactgaacaacaacagcagatctcccatactatgctccccaaatcttttaagggatagattcacctttgcataaacctaaattacccccattgtggggacctggctcttattatggacttgaccttggttagagattcatagaacatcaactgagaacttccctagactgcacatagaacaaataatttcattttacctaaccttgatgtaaagagctgaactctgttttttgaactaaaggaaaaattcaagggtcaaggtcactactgaattttgaaagttagatctcccattaccactaagcagctttttctatatctgagtcacacataagagtatggtgagtgtctgaacaaggtcaaaataaacatcatcagtctgaatattagtcggactaatttatgttacaccaattatgcttgctacttgaaaagtatattttaagatgatttttcaagtacccaggcaacatttacagagaaagctgtgatggtattagagactgagctgttgattacaaacagggtgaatttttggctttatgtgatttgtctaaagaggcagcaaaataagtagaaacacagggcactatctgagccctgtcctcatggaatttgattgttacactcaaataatagggacatgtttggctgtcattcagtttgtcattacattggctcaagcataggaaatgtaaattattaagaaacttaaaaaaatgtccaattataactgtactcaagaaagtttcttcctaaaaggcacatctactggaattttaatcagagatgacaatcatttgaattctaaata

SEQ ID NO: 28835 - DNA, 1987 bp, Bovine  19866880840183
aacatttctgcagagggctgtggagttctcacctgtaccatatggagagttccagtcaagacctcggaggtcctctttgaaaagacaaaaggtttattgacctgaagagaaaccagaatattgaggtcctggtcagttcctgtattctgtgatccctcggctatatcatcctttgggttgtggggagaaaagaaaaaaaaaaaaagaatgaatcttcaaatgtatactattggtcatattaatataatatcagtaatagccataactacaactataattattaattagaatattcctttgaaatatataaagcatgttactttccattctgtcatttcatgttgaccaggtaaccattattatcttcagtttggataatagtaatgataggcatttgttgaatgtgcactgtgtttccaggactttgccaagctctttgaggcatgggtgtgttggtttgtatttgtcaatgctttgtccatatggcctgtaacagtgcttggcatgtggtgactaatcaatatatactggttaagtgaatgaatgaaatgattgaaagagtgaagaaaatatttgtggttttttacaggatattgagtgtagttccctgtgctatgtagtaggattgttgtttatctattgggttggccaaaaagttcgtttaggtttttctgtaagatgttacctgaatgaacttggccagcccagtgtttattttcaatatatctgtcttatctcttcctggccagattgaagactactaaaggcagtgaaaagaaaagagtgaaggagagatggatacttttgtttcatttactcatcatgagtaactgattgtagtagatattttatcttcattttatagatggtgaaactaaaatttagagagattaagtagagtagaatatatgtggtaggaaggatatggctgagttagaaccttagtcactctctgctctttctgtgttaacacaaaacagagatgctgattctgagaacagtagatcatagtgtatgatctactggctgtatgtttcaatcacctagagttctttttaaatttttgcttgcttatctattttacagttctttataaaaccgcccatgcctggatcccaccccagcccaattaaatcagaattcctgtcatgttggacctgggcttatgtatttttaaagcacccttcccacttctttcctctcctttcttctttcctcccttccactaatctttactgtactaatctgggaggaaagacataaaacgttgtgctcaaaaaacttatagtttagtacaattgctactgagcagtcaaatagagaaatgctaaatctaagaatgccatcaatttgttcttcacctgtatcaaccattatcctcaaaccataattatacgaaatctgtcagtttagagctgctctttgctcttgacaactcaaaagctccaacatgcctgtctataaataccttgagagtttgtgaaaactagagatttactgaatggaaattcacaaggaaagggggtatgaaattgtgccttttcctcctcaggcactcccaggtaattcttaaaaacgggccagtgtgggaaatattaacataacctgaaagttcctaaaaatgtgatcccctgtagcatcagcatcaacttgggagcttgttttaaaatgtgtattttctgagcctttttggatctactgaatcatcaactctccagtgtggccctgtaatctgtattttgacaagctctccaggtgtgcactaacatttgagagtcactgatagaaggaggctgtttagtgttgggccctaaggagatgggagcatgtccaatgccttgttcagtagttaagttcatgtctaactctttgcagccccatggactgcggcatgccaggctttctctgtccttcacagtctcctagagtttgctcaaactcatgtccattggagtcaagtgatgttatctagcacattgtctgccgt

SEQ ID NO: 28836 - DNA, 1452 bp, Bovine  19866880882968
tctattaacctagttaatcctaaaaggaaatcaacccctgaatattcattggaaggactgatgctgaagctccaatactttggccacctgatgcgaagagtcaactcaatggaaaagaccctgatgctgggaagagaagggagcgacagaggatgagatggttggatggcatcaccgactcaatggacatgagtttaagcaaactccaggagacagtggaggacaggatagctggcatctgtagtccatggagtcgaaaagagttggatgcaatttagagactgaacaacaatagcttctactagtttcttgcaaaaaagtaagttggggggaagaaaaaaaacttttgagagcaactcacaatatctgaaaatgacttaaaaaaaaaattatttgacggtgctgggtcttagttgcagtgtgtgggatctagtttcctgaccagggattgaacctgggccctttgctttggcagcacagggtcttagccacaggatcaccagggaagtccctgaaaatgtcttaattttaccttcacagtaggtttagtttggcaggtacagaagtctaagttaaaagccattttattaacacctcaggatttggaagcctcaatcctgtcctccagcttctgatccgccactgagatctggtgtcatgctgatgcctggtccttacgtgcactctgtttcttttgtcgttgttcagtcgctcagtcatgtctgactctttgtgaccccatggactgcagcatgccaggctgccctgtcctggcaggttgccctgccaatcatctcatcctctgtcgcccccttctcctcctgtcctcaatctttcccagcatcagggtcttttccaatgagtcggctctttgaatcaggtggccaaagtatctaattctttactctgcaaattttggggatcttgctttagtgtttcaaaattttacaaagaaccttgattaggtctttttctctgagctagaatttcagaggctctttcaattaataagagtttttaggtccttccctggtagttcagatggtaaagcatctgcctacaatgtgggagacgtgggttcgatccctgggtcaggaagattccttggagaaggaaaaggcaacccactccagtattcatgcctggagaatcctaaggatagaggaacccggtgggctacactccagggggtcacaaggagtcagacactactgagcacatgcacagattttctgcttaaaaccctccagtggattctattgcacttgtaataaaatctgtataccctgtcatggatgtgcagagtcctgtgttatctgctcatggcctgccacccctgcctccctgtatactcttctccttcctctcttggttctggatgccttggtcttggtgttgttaagcagccttgggaccttggcatgagcttttctctcctgcttgtatgcgttc

SEQ ID NO: 28837 - DNA, 3127 bp, Bovine  19866880976592
ttttacaatttgccttacaggagctctgaagatatctctgtagacagatatttaagatacagaaattctaagattgtatctgattatatatttgtattacagcttctctgagttacctgtttgctacatcttatccatgtgacactatgctttatcacactttaattcatattcagcttttctggcccagcctcaacacagtctgaatcgatatgccatctgatgatagagtattaaaaacggccatggttcaaacatagctataggattttgaaattatattatatatcagttaatgatatttcagtacagataaaaaactgtttagaagcctactagctacataatcatttagtgtgggaatactggaaatttagagaaggatctgatagtcagaaatcctgattttgctggagtttgttatattgaacagctttaagtgacattgtagattatagttgatttgtatagatagtagagttatgcatttacaaaggaaccataaccatctgaaagtcagttaatggagaatcaaatccagaacaaaggaagaggtaatggaatgaaacagttacagaaaaagaaaaataattaaaaagtacaaaaacaaacactttaaaaaatctgctttttgccaattaaattcaaagaagtaaatggagaggaaaacaaggagagaaaaagagactactttgtgggaatacttcatgccatttaattaaccatagagggaagatgctttgcttcattatttcattggtactttatcgtaaaagaaagtgttccttttctaagtaaactggtaattcccctttaattacactataggttggctaggaagagactccctgctctccttaagggccacagaatatactcaaatcatctttatattatttagtgaagacctgaaaactgaatgtcaccttcttagacactgtatgccctcactgataatagtttcatttggcatgactcagttgacggccccaaaagccctcacttttcagtaacaaggtagagaatttttaaattatcatataacatgttgaattattcaataaataaccatgaataattaatgccaagaagtataacaaaagtcatcacagctggctttcctgagagtttccctcagaagataggtgttattgattttcaaaagagagattcagaatggggagcccaaaagctgtaagtgaagcaatttgtataagaagtctacacatgaataaataatagcataacaaatgagtcacctcgctaaagaaatacttcatagcaggaattgaaataatgttactgtgaatatacttgctcaaatgtgtggagtaatcatggaaccaagatgagcgtccagctagaaataccttggagaggacctttgcatcagagacatgaatgttgacatagcatctaccagttggattcctatgactcgataattgggtctgccttgggaatgtaattctattcttccttgtactctgaacaattcctctttgttattctcaaagataatttattatgggtgtggcttggcagggcaggaatatagaagataaatcccatgagcttcagttaatattttacaactgtattctataatatgacaatcatgcaaagtgagaccagttatcaaacattttgccccacaaagcattaaaggtccacctgcctagtcaagaggtttacaatatattcactcttaatgaaattctaagatataacagggagacagacatctgaatcggatatatgcttgcactttacaaccacatgaatactcttcagttcatttccatttagcctctatattaggagatattcatgctaaatttcaagccaaagtattattctaacttagaaaatggatcaataataataataggcaacaatttatagcatttactttatatcaatgttacaagccagagtttgacagttttttcagtttctataactagccagataataaacatattagattttaaaagccatatacagtctcagtcacaactactcaaactactcaactctgcctttgctgagtgaggtagctatagacaatacgcaagcaaatgagcatgactgggatacttacagacactgactaaatggatactggatttcatataattttcatgtatgaaaaaagatcctattccttttcatttttttccaatcattatagtgtgtaaaaactattcttagttcctgggccatgcaaaaacagtatgtatgtatgctcagtcatgtccaactctttgcaaccccatggactgtagccaccagtctcccctgtccatgagattatcctagcaagaatactggagtaggttgtcatttcctcctccaggggatctgcccaacccagggatcaaacctgagtcttctgtggcttctgcattgcaagcagattctttaccactaagccacctgggaagccctaggtatcagactaaatgtgaactacagtctagtttgtcaatctcttttgcaagtgcaggtgtacacacacacacagcaggtaatcctcacaataaccctaaaaagtagttcttttattattcccaatcagaagacgaggaaattatgttacaaggatattaagcaatttgttcagtgctatagcaaataaatcgaggaggcagtatatgaactgacttcagagctaagttcttaaacactccactagggtttctcctccctggaatgtgcagacagcactctatttctttcatctgtgagaagtattggaaatatgttacactcacttgatgtattcttgtggttagatctgtgagtaaccagagttgggacttaacttccccctttaacctttgcctgtattttccctaaataacaagtcaacagtaccaccacttgacagaacctgaaatatagtgggcacctcaaaatatttattgaattaaaaacttagagtgcatgagaaacaatgtcgtgtagagtgaagggtaataagaaatttattttatgccctaactgattagctttactcaaaaccaaattacagggacttccttggtggtccagtggttaagacttcaccctccaatgcaaggggtacaggttgattccggtcaggaagctaagatcccacatg

SEQ ID NO: 28838 - DNA, 1312 bp, Bovine  19866881014584
catacaaagacctatgggtaagaaaaagcatgacaatctggaaaaactacaagcaatttagtacatctggaacactggtttcttgagaagttggggccagatcatgaaaagacttttcgaaaatcttaaggagtttgttccttatggtgaaggcagtaaaagtctttaacatgttttaattgagagcaacataattagaaatgcattgtgaaagatgactggtggctttgtggagactccattggtggaacaaagtagacagagaagctaactgagaaattatttccatgatacaaagtatagatgatggtatagttggacctaggtagtaggagagtgggaatttggatgtagaaaatgaattttttaagaaattaatattgaaaagatgatgactgtactcagcaactaagggagaagaagcagtcatggatggtgttcattggagaaatcatgctgccatatgcttgaacaggtaacatgcaagaagccagcctagaaaggagtaatggtttaaatgtgtgggtattcctgaagaacaggcaggtggttatgtgaagtttaaaagagagatttgaatgggggtaaaatagagacttgagagtgagagatatgtcggctctcattatttgattagaagagaattctggaagtgaaattattcatcactgattattggtgcatttgacacagtgatatttggaaaagtcacagatgttggcctactgacacaataacttggacttttgacctgtcactgtagttttagagaccttttgtactatggggtttagtgcctgagaccaggatgtctcttttcctccatttcactgttgtagaccagaatgtctgcaggaggaccactttacatcataactcatttctctggtccccgtggggcaggaggatgttaaatgcatgacatctttgaagtgttgttttagcattctgagcctcagctggaatatttttaccagcagtaaataacacaatggaagagagacctttttcagtatttggcttccattcaaattgtagactcagctgtgatccctaaatattttaattaatgtctctcaaagggaggttttactgaagcaaactagaggcaccttggtacatatccatctatgtactgaggcttatgagcaggggactcttgacattccctaaagatcatacctcttggaatagataatgctcaccactctgatggtagaactgtattccttctactatatcactccattccagaagaaaaggaaaagactaaagccattaatcagatagtagagccactgagtgctagaga

SEQ ID NO: 28839 - DNA, 1364 bp, Bovine  19866881036673
tatatgtatatgtgtgtatatatatatatatatgtatatataaatatatatatatgtatatataattccatttacttgcttttaaacaattcttgactgaataatgtcaagtgttctacagttaggtcttaggctctattttaacataagagaagcaatctataagtggaaggatatatatgcatgcgagagagagagccaaaggcagtcaatattcaaaaaatagaaataaggaataaaaatggttaatgggaatgtgtcatttaccaggtaggcagaaggtaatgtataagtgactgacaatccaattagagaattctttgtaggtggaaaagtgtggcagagcagaaagttatgaactacataacacaccgtgacacaaattcccagggcaaccagtaccattctattttcaaatatatgtatgagaaaagccatggatgatgaatttcataacatccttcctatgcgttacttaaaatatttgtgctgactgaatgtgatcatatatatatttttcactacagttttttttttatatggttattattttctgcctgtggtattagtataggttcatgatactggacatgttgtttaaaagcctacaacagattatcagaatttagatggcataataagcatttggaaaaaaaaatccactgcaacagattttttaaaagctattcagaaagaatgatgtaaaaataaaaaggatgggtgtatgctaaattatggggttggttaattttctgattcagtgttgtgattattcagcatttcacatctcagcaaaatcttaggaaaaggctcttttttcccctcccacctatctccaacatggtagaagttatccaggcaaagtagagttagatggaaaataacttattacctgaaaatatcagactccagccaatatacatatatttaagccttaagttttcagtaggaaatgttaatgttagaatgtccattttggaagctcagagtttatcaagactcaattcattttcttacaaaagaggatgctgatggatattggaaatcaagctaaggcaccatcatgctgtttttcagtgcaaacttcttacagttgcttaacagcatttgcaatgctgatcatgttctaggcttcatgctatgatgtataaagaataataacatgagacataagttatcaatgtagtagagtaatgtcagggatcatttttttgtgggcttactggaactaaatttattgacaatcatatatatatatataaatatgtattatactttaaatcatcatgtgtgttaatacatcacatacatgttacattatgtatattatttgtgttatatatttatatgtatatataatataa

SEQ ID NO: 28840 - DNA, 932 bp, Bovine  19866881044151
cagtttagccaaggagtagggtcttagtgtcagcccaagtccttgttccttatttttggctctgaggatatattcagctttcagtatgggattcagggtcatgtcctggtttatagggctccaattccatggacaaagagctctacaaacacttcacagacatactttgccacagggtctgcttttttccaacacttcagtgattgtatgatttaagatgcccttttagggtttttttttgctttcaagattgtcttatggatagatgttacagatacctacctatattttaaatataactgagatcacgtagtttggtagcagttagcattccagttttagactgtggcatatttcatatttatgcaagaaatcctccaacattctcaaccaagagctaacttcaaagtatagtaatgggaaactttctatttaattaaaatacattcttcctgactaaagaataaagttccttatatttctttttcttttttttttcataggttctaagataatatagatagcacgtaatttcccctgtattcagtccattgtaacttaacaaagagaaactttgcctttgaatttgaggaatatacttcctccagagataaacttttataatatttgcttcagaacctaagagtttaatttgtaattctccattatattctgccattgtcagactggaagcatttggaagagtaaggggaggaatgtgaaaacctgacgttggtattagacttttaaacctttttacaggtatttttgcacaatttatattagaatgtggtatggaggcatttcaggttttcttagaggctctatcttttgggcagtgggtagtagtgtaaggaaattagtctaaactctatcttgactgaggattacctcccatttttcagaaagtttttaagatagatagctttacc

SEQ ID NO: 28841 - DNA, 1710 bp, Bovine  19866881050715
tgagatatgttttgttcatttcataattggtgtatttttgcaaagctgccctaatttctacatgcattgatatatccacatatataagtatctaatttatcaataaggtctattcatgccacactacactggaccaagaacacatgcagaagtcatgtaaatgtatccttgtattattttcaaccatttctctctaatgctcattttcatataattctgtccctgttgaaattttccacgataaactctaggtgggattatcatcccatctcaggaagggaaaaatataagggaattgaactcactttctttctcaaacttttctttgtagagtaaaatgaggtcacaagtgttgaacaatacatatacaagttcatacagttaacttgataagaagtgctgcagatgatgttgaaaactcacttactttctataactaatggttttggtcactcagccagattgttggttgaggtttttaaaacagagtcagctccaaaagcgaactatttgtatcttgtctgtcaaactgtcaagaagaaagtcaatgaatagtatatgaagacttcctttatctgaatctttttctctatttagtggagacaaatctcctccatgatagagtctgtttgcattttatgagcaatactactatatcttctttcaaatctcagagtttaattagttccagtcctacaagttatcccttgacccaaactctttaggttctgtcctgggtaagcaacatgtccttttcatttgcatttggaccatgaagtaagacatttctgaacatagaacattgtagttccacaagccatgctaataacaccagtctttttatttccagatccagattattgtgatgcaaaggctgaggccaggtgtgagggtaagtgtgcatttcagatttaacagggccaactttacactgcctctttccctccctgaccccatctgatctgacttgctccccccaaattgtcatttttggaaaatagcatatccatccttctttcccatcccaatttcatgcagtaacgagtcatctgacatctcatatttgttcactccttacttacacccaatgacaaatcctgtcatttcttgttccaaagtattcctctttcttcatgatcaacacaccagtcaaagacgcccttatgcctcctctccttcggtggcctgtggtaccagttctcccttttgtatcaaattcccacctcacagctggatagagtgttgctgttgtttttgtatatttatattaatatttggctgcaccggatcttagttgtggtgtgcgggatcttcgatcttccttgtgacatgtgaactcttacttactggatgtgggatctagttttcctgatcagggatggaatccgggcccctgcattgggagtgcagactcttagccactggagcaccaaggaagtccctagagagcgtgttttaataagcagtttcaatcatgtcaccatactgctgaaaaccctctgaaggcttcttcatgtcatgaaaaaaagatcccatatccttaacatgactcagaggatcccacatgatgatccccatctatttctagagactcattttctgcccttgtggatggattcatttttctgttgccttgctcgctgcattccatccatgctggccttctccaggccgtttagcttggcaaattcacctactcgtccctcaatg

SEQ ID NO: 28842 - DNA, 1475 bp, Bovine  19866881063868
cacatatgcactcacacacacacacgaccagtagacaggaatgtcaagatggagatccaggttctaacatcataaatgctatggtgaactgaagaaaacttgacattttctgtctttataaaaggcccatcctaggcttcaagaaatagttgaaattctattcttcattctacacgctccttccttccacataagaggcttcctaccttgtcctcatcatagctagagacgcaaataaaaatatttcgttttaaattattgtcctgtgatgtatttaattactttgccctcaaagtccttgttcatattttaaaaaaaaaaaaacactaatgcccaattactttgtgtaaagtacgtaattatttcatgttaagtaccaaaaactaggctggcatctagtatgtacttaatacaaattagctccactttttcctagaggaattattctcatttcttcacttaaggctcaaatatttctattatgtaatcataactcttacagtattaagggtatcatattctatacctatccttctcaattccaggtatgggatctattttgttaatattcgtgacatctgatttataaataaaattgatgtaagttaatgcgatcacagtaatggaaaaggatatgaaaagaatatatatatgcataactaaatcactttgctataaatagaaactaacatagcattgtaaatcaactatacttcaataaaatttttttaaaaggaagttgatatgtacatgtacctgtgaaggtgtatacataggtgtacatacacatgtatagaataagatggattcatatgcttttcacactcaagaatatataacaaattatttactcgattcagttgtacagtatttcagctaggttttatttatcatctccatcccccaaacctttccctctgttcatcctgacacttttgtctgtaatagtttttcctttgtatcagccttctgttttcccttgtggccaaagaatcaagtaatcattaccttaggtgtaattttgccagagaaagacagagaatatccaagtcatctttgctatattcttggatttttctttataaaaactgatctgaagttcaatgtctgttcctagatttttttttttttttttttttgcttcaattactcttgggggcagaaatcataatgtcagctctcacgagcacctcctgatgacttccggagcagtaggatttgtcagaagggcaatctgtattgctcctgactctccacctttgccctggccatatttccaccttccctgttctgaagatgtgagtgacactgctgactgcggtcctgagccggccaattcaggctacgcctttcctcatgtcagcacaaccgctccctgacagcagcctgtcctctgacggggcgctgcagagtgtgcaaccctcacctcagctcctcagctgtagctccacctcctcgcgaacaaaggaaaacaa

SEQ ID NO: 28843 - DNA, 1324 bp, Bovine  19866881111563
ctaatgaattgaatctgtttcttcccaccagtgtctaggaatggctgaatttactgtccaggggccgcagggacctggttgttctttggtccccactccattgctgtgatcacactgtctgcctttgtctcttgctgttatcagacacaccactgcagaccaagctggatatgggaagcaggcagcactgtctggttagactcaaacatccctgggagttgtactcgcccattctttgctgtaaattgaagcttcttttcttggcatgaggaaccctagacctggaatatgagagcagcacattgagagatatggaaaagagggccaaatgtgtgtctttgtccagagaagaaccatttgtctatgcattctgcagttatcacaggtctcagctctgtggtttcgatttgtttagggacagagcacacttggttatagtctacatctaactttaaatcctgcttttcaaaagcgatgaggatttggcagccagagtagtaattgagtcggatttaatgttttggtgtttgataaacatattctctggcttaatgatgtccctggttgagtggatattactgcttgacactaatttaatcaaataattatttagcttgaaaagatcctacagatggcctactccagtctcttcttgatcttcccatgaatatacctcagtttactcatttgtgcactaacccctgcccccaggagttgccaaatttcacacggcagagagagaatctgtggaggaatttggtattcagtgggaggtgtccacattatcctgcatataggaatgattatttttcatgaccttcaaaatagattttaagtagatgtccttttgtgtgttagggacagagacaaggagtggaagtggattgggaagtgaacccagagccctgatcttgagtagttctctgcttggtttgactgtggggtcatggcttgaatgacctagagatgctgaaattctttattctgggactcagaccacaaagagagtttttattgtaactcttctcttctggtaataatgaaaatgaaatattaagagctcttcattacaggccttagggaaatacgcaaatatgttacaactttctaaaatatgtcctgattaaatatctcatttctccacttccataatcgggagataatagaccaactgattgtgctaaatagattccagcaagcctcactgtcttgttccatcaggagagaatactgatttcttctctgcgtcatctttgtctacaaaggagaactcattcctactattcaatgtaaatttctttaaaaactaaacagaaaaaaaaaa

SEQ ID NO: 28844 - DNA, 1206 bp, Bovine  19866881112938
agtctaatggagcaattaaaagtcagaatttgaatttcaaaaacacatgttctaatatgtacggctaagtccccttgctattcacctgaaattaccacaatattgataatctgtgatactacaatataaaatgaaaatgtttaaaaaaaataaaacaaaacacatgttccagtcttagtgctatcacttaactaagccattatatcttgggtaagtttattgatctctttaaatctcagttcctcagctgtaaagctggaataataatatatacatacataataggactaattcaatggttaaatgtgaggatgtatactagagcacctatttgagtggctggcaccaagttcatatctaaaactcattattgctataatattcctattattctgtgtatcataaatggaaattaagaatcctgtcagcaaaacctcaatcatgttttctgattatccaaaaggaccattcatagtcactggggcattctcccgtaagtttctggagaaactcagtttctaaaatttggtatcaaaaactggcagaaattcagctgagtgtcccactgcaggcctccaaaacacatctacatcggaatctgtctcatttgattttccaaagtagatcactggcatatgatacccttaactgttgtataaagaaaagcagcaaaactgccgttgcttttgcatcagatcagatcagtcactcagtcgtgtccgactctttgcgaccccatgaatcgcagcacctcaggcctccctgtccaacaccaattcccggagttcactgagactcacatccatcgagtcagtgatgccatccagccatctcatcctctgttgtccccttctcctcctgcccccaatccctcccagcatcagagtcttttccaatgagtcaactcttcacatgaggtgcccaaagtactggagtttcagctttagcatcattccttccaaagatatcccagggctgatctccttcagaatggactgggttggatctccttttgcataaatagctttttttcttctcttttagcatttttcttcactttctttagatctacaccttaacagaatttatttaggaaggttttttgttttgttttgttttgttttcaaaaatgtaataaggcaagtgaaacattgttaccagatgaccctgaacattatttaaacttttatattcttttagaccatc

SEQ ID NO: 28845 - DNA, 870 bp, Bovine  19866881118137
catgggctcgtgacacgggggcaaagagcatgagctttgcaaacacacagacatcaggtcaaaatacaattatgcttttactacattgttgttgtttagtcattaagtcatgtccaacttttttgtgaccccccccatggactgtagctctccaggctcctctgtccatgggatttctcaggcaagaatactggagtgggttaccatttcctactccaagggatctttctgacccagggatcaaaagcacatttcctgcttgacaggcagattctttaccactgagccacctgggtgcaacatggcgtgatttctttgtgtttcaactttcccatttgtaatttgagagttgtcctgagggtcaaatgagaaaacatatttgatgtgtttaatatggttcttggaaaatggtaagtgtgcattataaatgtagctagggtttgagttttttaaagatctggggcatgcatctgttcattcattaaaagtttactggccctccaggagcaattgagcctgtgctgtagaacccaggagccacaactactgagcccatgcaccccaactgctgaagcccgtgtgcccttgagcccatgctccacagcaagagaagccactacaatgagaagcccgctcaccataactagagagtagcccccgcttgctgcaactagagaaaaagcctgtgaagcaacgaagacccagcacagccaaagataaataaatacatgaaattatggggggggaaagtttactggctctcaaagttggcctcatctattcaaccatcagcattacagaggctagagattttcacaatattcaagcaaacggtgaactcagtgatggcatccaaataaaaaggaacac

SEQ ID NO: 28846 - DNA, 1360 bp, Bovine  19866881202417
taagtgatgtatcttctgatacttcccacataaacagttcctaaacatgctcttgactcctgtacctacaattttgcccaaagttcccctgttcttctaacaccattctgctttattatctcaggataatcctacccatttgggggcggctctgtgcaacttctcctgttccaaggtgaaataaaatggaacagacaaagaattagattcagactcactaagcacatgtgctgtaaaatgaaagttttaattcccttctcctgcaggatcaaaagacagccttacgtgagcgagttggactttcctggccccttcattagccaggttgattctttacaaactaactacactgaccctctggctctttttgcagttttaagacagcttcaagttggttcttccaagtggctcatcagactgagctgagttagtgcagagcttccagccaagtaaggcctctcagcacgaagtgtcaaacataagacagctaaggctaggagccaaaggaagaaggctcttcttgaccctgctcagagactagcgcattcacagagaagtggctggcaggctcccttttgatgcagtgaacaatgaacagcagggataaagtctcaccatatccacctcatgctttctctgtgtgtatgtgtgtgtgtgtgtgtgtgtgtgtgtgtgtgtgtgacatgtgcactctagcaaaagacaatgtggaaagtctatgacctattatttggaaataatccacccaggatcacagtgagggaaagagatcccacaagtcagatcccatataccattgataaatggtatagcacgactgagcgacttcactttcacttttcactttcatgcattggagaaggaaatggcaacccactccatgttcttgcctggagaatcccagggatgggggagcctggtgggctgccgtctatggggtcacacagagtcggacacgactgaagtgacttagcagcagtagcagtatccttagagtccattttacacatgaggaaattgagagtaaataaagggtcctagttttacatttgtttgtttttgatctgttttctcagttttgtacgctgtggacatttgggtagcagtttcacaagccatgactgcattttgcatcttcattgagttcttcctgagtgaaataatagtggtgctcattcaaacccagatcgtcaatatgaacataatccttcttttctcagtttctataattcagagttctttttggacagagtttctcattctatactgggagtcacatgtttagagatatatagtcacatatttagatatatagaggtatagagatacagcatcagcacagcgttaaagaccaaaaaaa

SEQ ID NO: 28847 - DNA, 941 bp, Bovine  19866881321632
atgcttagtgtcaagtggtaagactattatctttgcgtgtaagtcttgtttcgtgcaatagcagtaaaaatatagatgaggttttggagatggagaaatcacctttatttgggacatgcaaaataacctggatggggttttatgggctcatcattcacggctttaaagtttatcatccagcaatagtgaaggtggtcattccatagtgggaacagcatgtgcaaaggaaggaaagccttttaaaaggttgcatcatgtgttgtaagggcaagagaagtccattaggattgctggagtataagagtgggacagcatgggggcaaaaagaccagtgtagctcagatcatgtaaattcatgaagactggtcaaggaatctaacctttgtcttttcagaaatgcggaacgaatgaaggggagctagaaaaaaaggttactcctgagaccttcgttttcctcctgtccagagctttgctacttagtcacaggaatatgggtgatcgtacctcagaaggtatctgccagcattcattaagaccaatgcttaatctcaactgacaacatcaatgtcaaaatcagagcttggagctggcagtatttcagcagaggagtctttggaacttccacgaactggttcaataaacaatcttgctgtgaaacacaaagcttggaatttagaagggttttagctggcacatccacaaagtcgcagcgtcctgtccactgactaattccactgtgaaatgttgaaatatagctcttagctccaagaaagcatgtaggcccccatttgcatgcaaatcgctgccattcatgtgtgaactacagcaggtaacagctctgccagatggaacaatttggggtagggccatcctccttgctaaaggccacaggtatccacacatgtggcagtgtacctcattcctattttccacatcacccc

SEQ ID NO: 28848 - DNA, 998 bp, Bovine  19866881384766
cagtgattttctagcccaggaattggcaaaccactacttgtgggtcagatccaggtcacttggtttaccattttaccttttcactgtgacctggtagcttgtggtatctttctctactgccaatggaaactcactgggcaatcgctatttaatgtgcatcttttgctcttctaccatattttgagttgagccttcttcacacttgtatttttaagaacaggcaccatatgaatatttgtaaatgaataatgaaatatgaacaagtttttaaaatttcctttatttatcttcagttactatcctgtttatacactggaccctgccagttccaactgaatagacttttctcgagcagatcaagtcctttcagaccttcttggtattctccctacatgattgaatcttactgtcttgttttcttagaaagtttctattccaagaaactgcctgcacatcatggccctttccgtgaagacctcctcactgctcccaagactttctccccacatatgaggagaataaaactcttggatgaattggtgttatatagtagtctgtttaatgtggattctagggaacactaaccattattggaacactatcttcaaagatacatcttctggcttacttcactctgtataataggctccagtttcatccacctcattagaactgattcaaatgaattctttttaatggctgagtaatactccattgtgtatatgtaccactgctttcttatccattcatctgctgatggacatctaggttgcttccatgtcctggctattataaacaataaccctgtgtacgagacagcaaaagagacattgatgtatggaacagtcttatggactctgtgggagagggagagggtgggaagatttgggagaatggcattgaaacatgtaaaatatcatgtatgaaacgagatgccagtccaggttcaatgcacgatactggatgcttggggctagtgcactgggacaacccagagg

SEQ ID NO: 28849 - DNA, 697 bp, Bovine  19866881418017
attttcttagatatctacatatgaatgaatataaaaataaactatgaaagacaggacagcaaactattgattagctcaattagtatgttgattattccatacaggacaccattacacatatattaagagatttagagaataaactaagacaaactgtgaccacttggatcttatgatctagagagtaacacaagacaatacataactctaattgccaaatacagataactactgttattgcaatattaaaatatactgagcgaataaggagaaaaaaataattccaataaggtctaaagtatagtttatagagaaagtagtacttgattagtttttataaaacagactgaagtgaaaaaaaaaagggggggggaccagaggtacaaatgtaagaaaacgcagggtatgtttagttgtacttggggaagtttctgcttcaaagaattgttgattatagtcaatgtattataaagtatatttttcccttatgacctgtattcactcagaattagattaaggactttataggtcagaagtcgttcgaaatcagtattggatggagcagttggctaaagttaataacttgcatggattacttatgatccctggtgaagtttctttaattaagccaactttcataatccctttctaatgccttatcaactttgatttttatctatgtaagtgctggctgcct

SEQ ID NO: 28850 - DNA, 765 bp, Bovine  19866881435275
tatatttgtgctaatactctggggtctgggacaccgagagcaaaaaccatgctcttccaacccagagttcttatctaactaaagggctttctcataatttgagtggatcatgctggcccaaagaccaatggattcagtgagttctttgcacatgaaaaaaagacctatttgaatttgaaatgaggatcagccttgtaaccctggatacagtcagagagacaaaaaaaatctttagggccataaggaaaggagactgcattcataatacaagaggagatggtttagattgtttaaagacagaatatatttttgataacagaagtgtgaagaagcatttatacaccatcctgcatttttaagcaactggagaacaaacaaaaccaggggaaattatcattggcaagtgccattctttccactcagacattccgttcaagtacctgagggagggtcctataattcagatttaactgctccactctctagctcaatgatcccccattccctgcaagataaagttcagagtcttagacataacaaaagagctaggctaaaacctttagagactgtaagcgctgaaaatattgtagtatatacttcatatgtaataaaaggtgaaaacaatactatgatttttcatagtattctgagttttcccatggtcacttcttgtggatttggtttgcatctgtaataacaatttttttctctctctttcctctcctgagtgctatagcatatgccaagtctctctgtaaggttggt

SEQ ID NO: 28851 - DNA, 1472 bp, Bovine  19866881520762
taggagtgactgcttttgtaaaggattttttttctctatgtgttggtttcttcttattcaaagaagaaaaagctgaaataaagtcactaatttagtgtattagaaaaagaaaagggttatactaggagaataactttatactgggacaatgttagtacacaaagagatatgcttgctagaattgggaagaatgtttttatttaagcttcctgttgggaaatgtaaaaagggaagcttgctgaattgcaacattttcagggtccataaatttaatgttatctatagttgctcctccattccctaagcattatttaatacagtgcctgaaatatagaagttcctcaatgaatattttctgaattattcagtttctttggctgtgaacatgacaatataaaaactccttgtaaagctacaaatcacttttcagatgcatagtcaaatatgccaattctgtatttatgcgtctgcttttctagatgtttcttttcccactttctgtgcttcagctcacatgcatgagtgtacatacacatgaacagtctagaatcattctgataggtaaacataacaaatcaaactctaaacttggcatccaatgctaataactcataattagtacatagtatgtactgttttaagcatttatatttgtcaattgagtcttacaataagtctatgatataagagttacatattctctgttaagatgtgaaaactgaaaaacaaatgtcagaaccttaccacactcatccaaatactttgactgggatttaatttatggttataagatgctccatatgtgtaacaatgtccacaaagagcttccaacattaactgtgctatagttctttcaatttctgattctccttaaaggaccatatcagaagccatccatttacagaagaagaaaaaaaatcctattctcctagctataggagttattttcctctctcttcttaattaaaatttgtgggaaagatgttgaaagtatcagataaattttcttgtataaatgtcaacccctgaacttaattgcttaaagcagccactaaatattagcttttggtttcgtgagttagcaattcgaactgtgctcagctagatggccctttggtcttggctatgtttacgcatgcatctgtggctctgttttggctggttgttggctggggttataggggcaactgggctctgtgtctctcatcatccagcaagctagccaattaattaatggccactaagctagtttccaagaacaggctgatataccagctcagaactggcacaacatcatttatgtcccattctacttgtcaaaagaagacacagggataaggcagatttaaggtggtaggagataaactatacctcttgattagaggagccacactgttccacatcaaaaggtcctgtacacaggtaaaagaaaaattgggccaaaattgcagttatctacccagcccccaaaa

SEQ ID NO: 28852 - DNA, 1345 bp, Bovine  19866881544962
gtggcagtcatccttgtagagtccaaaaaatgtcagagccttaatctaaggctgtcttcaaagattacagggtttattggtggagaacattctccaaagcaacagcaaaagctttttcagggaagttccttggaaagaaggatctaattaactggtggacgttattgaaggagctctggtataaaggcagtggggtggggtggaaattacactcggtggtggaggagccagagacctgattctaatacggtctctgccgccaaccagctgtggattaagtcacttgtcctcagggagcctcaggttccccatctgtaaaaggaatttaaggtgtattttgagattttgaggagagaagtggcattacgtttaagtaatcagttgctttacaaatatggatgattatatgtattttgagagaacgcagtactttgaagtattagtgtaggaagctttgggtcgtcagatgttcctctgacattaaataccacttccttaattctctacatctctgcctttctcttccccaccctacccttcctcatgtcccttctctccctagctgaacttccttgttttctggttctttaccagttgctgagaatcacactattgtctgcttacccacctttggccaacctaatgacttttttctcaaagaaaatgattactcacccaattaaagtgagcacttggaggaaataatagctgaaatgctcagtaatttttcgttatggtggggaaaaatgatttgagtttttcttcaggtcatgtatttgaaaaggaataatgcttaatgggttcagtcaatgtcagcgtggcaatttttttttacaatctattgtcagacagtaaattacagaagtagttgatcatcacacagattcatcagcttaccaatgcagagaaaccaatgacaatttagagtgaaagtaaccaaaatatatatcacatttattctattcagaacaaaatcgttttttaacatttattttcttccccctagttaagtttcaatttatctgagagtctgtcaggatgacagaaactcatttacaatctaggaaaacagctgacagaatgtgcattaaaaattagatttttgaattcaaagaatgaaagcttttaaatcactacagtcaagtcagtgggacaagattgataccatatgctattttgctcatgttgttaaggaagtattccagccttgaagagaccttgtcactacatagcttctgtctgtgtaaataagaacaaagggaatatatctgttgtcaatgatttaaaaaaaaaaaatccagttcttcagagcaataagcggatcatataaggaggacaccgaatg

SEQ ID NO: 28853 - DNA, 1335 bp, Bovine  19866881573434
cacttatgtgtgtgtgtgtgtgtgtgtgttcgtgatgtgtggttaataaaaggttgacagaatatgtgaaattaatgcaaatgctgatgcagtccttattcctaagctctatatttgcacttattaacacacttaatcttgagagtaactcttagaggcaggtaaaattgacatcccccctttttttttgccatccctttttaaggaaaaaataagaaaactgaggctcagggaggttaagtaaactgttcatggtcatccagatcataagcggcagagacgaaattcaaacacaagcagtctggttccaaaaatgagggcatctctgaatagtaattctctaattaagaattcttaattgcataattaataattctataatagcaacaaattaatacataaatatgtgtgttttatatacatacatatatgtacatttgtacctatgtgtacatgtgtgttggtttgttggttgtatgaaaaataaatatgtaccaaggtagagagagatgcagataaagttagatttgcaagtacaggtgtgactgttaggatacattccctttgcttccatgaccttagtgtactgtggtaacttagaatagacatttgaaatagatcactggaccagaagatttttaatgatattttattggccatatacatttaatgtgccccatgagtcaagcaatgaattagttcaagcttgaagtaaagacaaaataaagaaaacattttacagagatttgatagtctctgggatgaaaataaatttccatcattttactctagttgcccctcctttcaccctatcaatcatttagaaaaatacaagagaagatcctgaggctacctactttgatctctttttcaagatttacaccactgccagtaagttcagcattatgatttatagaagaaagcttcctaatgtttatacatctctgacattcattcctctcatagggtcataaaatgctatggttagttaactggcatgtccatatactctgcatgaaggcagtgatgccagacagtcatagagggagggcatggggagagagtaaacataaaaattttccatttgatttgttctgcttctttgggacctatttctttaaaataatcaacagtatagtacaactgatactgttaaaaaaaaaattccttagcatcgttccacttgaggggagaggaattgggaatatttgtacatcaactctctactggatgaagggtagtctctgggagatcagaatccgtcatcctggtgtccctgtcaccagccaggcatgccagagaatttccttttgggcttgctttaaggaagttaca

SEQ ID NO: 28854 - DNA, 710 bp, Bovine  19866881818312
tgaaggaagacagcataatcctaactgcactaaatattaaaggaataatgtatcattttaagataaagtacataagtgatatacagttcaagtaaagcatctttttttaagtactttaccacttaataaaaaacaaattataagtacttctatttaatgattacatggtatgtacaacataatgcaccattactgtttctagtatctttatcattacaaaggattattattgttaacattaataatattattaactatcatcacagatcatttcatacagcactttttctgtgccaagcatttcacagtattactgaagttagtccacacaaccccagagttagatattcttcatttcttgttgaaggaactgaagctaagagaatttaaagatctaagtatcaatcaggtagttaactagaagacctgcctaggaattaaatttcaatgtctgcttgtctccatgtgtctggtccttcccacactaccaccagctatgagagtcaaagataacacacttgatataataggtttcagcactcaatgacaggaggtgtttctctatatgtcctagcccaaaatgtcacttgagggcaagacaattttgcaattcaatatcttctaccctgagtttcttattttcctttttcacttactagaagtagtatgttcctacttctatatcctaattcctgtttctctcaattttg

SEQ ID NO: 28855 - DNA, 859 bp, Bovine  19866882239619
aatatttccagatattgtcaaatgtcccctaggtgcagaacctctgatttaaggaattaactatttggcaaaatgtttattaagagtttgcttcatttatttgtttattgacaatacttttggcaacagcatggaataagctaagactctaaatgacctcacagctgacaatgagtaaacatatgaaattacaaagtatgttgatgactttccaaattttaaaatatagaaacaaactgtccccagaatgaccaagcttacaaacagtgggaagtatatttcccttttaaaaaaacatgcatgtctcattatttactatgtcaacaagaaaaaaaatcttatttagcaaatggtggaaagaaccatatatttttattgaagattttcttttatttacaaaatacccataattcaattctgctgagctatttcacttcatgtgcaataacaccattttgttaatataacagatgtctttcaaactgtcaaacattaattacaattaactagagtgtttttaaaataagattaaattgagacttattttgaattatagttcaacaagctaatatttttttttcaaagactgaatatcgactgatcatggtaaatagcaattacaagataaatttaaaaaaaagaaaaaaaaagaaagaaaatccttagggggggaaatgtgatattttgtgtgctgtctttgaagcagttctgtcttttgcatggaatgaagtatatatttgctacttccaaagtataaacctgtagtatttaatactggttgaacaaaatgtcaattttcaaatctctattaagacttaccaagggttctaaaatcatttggtataataattttaataaa

SEQ ID NO: 28856 - DNA, 2626 bp, Bovine  19866880479970
tgaccccccaaccccctttatgcttaggaacgtttatgctattgcagagcccatagttttcacttcctgtaaacccactgattattcaagactgtcacctcttagaagggagtggtaaggtaacactccaggttgcaaatagcaacagcataatcccctttagtcagaaaatacgtgaatattaatacaccacagtatggatgcttaggcacttaaatgctaacatgtctaattggtgggattgtaggtgattggttcttataaatttcaagtgataaatgtgtcattttagggcagtgatctgggctcatctatttacatattcctgattatattaatcagctaggcttggcataacaaaatactgtagactaggcggcataaacaacagaagttcattttctcacagttctggaggatagaagtgccaaaatcaagatctagcagtgtcagtttctagagaaacctctctttctgtattactagtggtcatcttcttgttgggtcctcacatgtaggggaaagatctggtatctcttcctcttccttatggccacagtcctatccaattatgcccctgctcccatctcaattaattacctaaataccctatctccagatccagtcacacttggggttagggctccaacatattaattttttggaggggagccaattcggttcatagcacctgtgctcaccacaaacaccaaaagtacttggttcataaaacagtgaattctgttcaggacaagaaccagaccagaagttctgtgctgcagctcattaacaggtattagatatctgagctgatgcccaatgaaagaagtgatgtgcttagcaaagcgggtgttagcaagagactcttgtccctccccatccaaccccagcctttcatgtcccctgaccttagttgaaaagcactttccaaaaagcaagaagagtccatctaaaattccagcccttatacaccttagaagatcaagtcagaccctttgttttcatttcctcatttctgagacaaaggggctagtctacgtgacctcttctcccaaggctctctatctttataattccaactttcaggaaaagcacttagcatccctgttgggaggcacatatactgaataatatcctgcaaactgagatggaactttgggaccaaaaaaaacagagggagcaatgccatggagtgcaattatgaagttcactgtgggtaaatcacattcaagcacaaaggatagagtcgacagataattcagaggcattcgaagctgcactgcacactgactgccaaaaagggtacaaaagaatttaaagggaccagagctagaagtagaatctgactaccaagacagaagcacaggtgcagcaactggaatcggggttcctcccctcaggggtttcatgaccattaaccatttacgtcagcaaaagcactcttgcaggtctcacatcagatgaaggcaagggcaaaagttgatagggtactcatctggcctggactcacttcttgtaaattaagctaaagctcaatcatgcgaaaagaggggaggttaggactgtgtgaattaagatggaactgaaaaaatggagttggtgtggttcagccacacaatccccaagtcaggacccacttgatctggacagaaggggcctttcctgagagccaaatctgctaaaatagctttcctgcactcattttattcggctgaaaagtagccttgtgtactttcattccttagaagaccaccagaaatgaaccacaggagcccatgataaacatattggttatattattattgtgctgcttcattagaagtgaaaataaattgtgagaagatgcaaaaccatgcaactcaatgattataaacaacagaggaaatcgttgtagaaagtgaaaagcagcttatcctatgggggagtacagactacacacacaaagatcgtcaattgagagcttattgacagcatctgcctggtggaatttatgcatcaatggaagttttaagatgaggggaggggacattggctacccctgacctcttagccaggggttatgggtgagaagacatcagaagatacctaaaatcgctataaagatttgccaaaagcaagacactcaatgttgaaatttgctcttgcaaggaggtccccattttatgatgtttgagcacacacgttctcctgctggatagctgggggaaaatcaaacgcaaaaaagttattatgagggtattttcttaagattaagttcaatttcttccaaaagagctcattgccaaatcattggactccgccataagaaagaaaatgttggtcactcagtcgtgtccaactgtttgcaatcccatggcctgtagctctccaggctcttctgaacatgggatttcccaggcaagaatactggagtggattgccattcccttctccaggggatcatcttaaaccagagatcgaacctgagtctccccattgcaggcggcttctttactgtctgagccaccaggaaggtggccataccttctttaaatttagaatgccaaggcactaaccacaaatcctcagtgaggtatgtgtgtgtgcaatgtaagaacagaacgttgttagactcaactgtagacat

SEQ ID NO: 28857 - DNA, 969 bp, Bovine  19866880599394
ctgaagggaaaagatcatctagttcaaaggtataagtctacacgtattaaaaccaaggcatacatttaagtcagatgaagaaccaaggctagaactcagggcctcaaatgcaacttcttggttcttatttctagaaggagagcttttttggaacttgaggaatccttctgagagaaattgatcagagcctttgcatctgagactaaactcagtgtattcaactctgctaaagtctaaacatagctccttccctatcaacataatggtctttcatgattttatttatttatttttgtgtgtgtgtgtttatttatttatttatttttattcaattttaattaaaaaaaaattatacatgtgttccccatcctgaaccctcctccctcctccctccccatacggtgtttgggatttaggagattaggatcctttatcaactctttgggtaaagagcaagttgttcatttaaccatcttatagtctggaaggcaggattatggagacaatgtacaaggctttttgggaccatctgaaagtccagctatcaagtactccagctgacttcacttctgcacttgaactcctaaaagaagttaaggaggtgagtaaccaacttcccatttgtggatattaaatcttagttgtggcatgggggatctttcattgtggtacgtgggcttctctctagttgtgatgcacaggctcagcacttgtatcttgtgggcttaattgccctgcagcatgtgggatcttagtttctcttagcagggatcaaacccatgtcccctgtattgcaaggtgaattcttaaatactggaccacaggaaagtccttttttttttttttttaaatcccagaccttttaattgttgataaataggaattattttgggccttcccaagtgatgctagtggtaaagagcccacctgccaatgcaggagacgtaagagactcgagtttgatccctg

SEQ ID NO: 28858 - DNA, 830 bp, Bovine  19866880709005
aaacttcgggagatggtgaaggacggggaggcttggtgtgctgcagtccgtggggttgcaaagagtcagacttgactgggcaactgaacaaggatgatattaaagaaacatatctgtaatgattaataggtttgtgcttctaaataagagatccagagataatataagatttatgtctttaaattgtgtctcaaatatttattgtctccattccctttataatctgattggtaagttctttgattatattttttttgacacatgtataattattttgggaaaataagaaaaaaacagctaatcaagaaaataaaaagacacattcagatctctctctctctgtgtgtgtgtatatatatatatatatatatatatatatatatatatataatgcatgctttaaaatgagatagtgtatctactgactgctttttgaactgctttattagctttacaatatgtaatagacatcttttcatgcaagttcataaaagctcccctgcttttctgcaagttgacagaaatccttacaaagtcaaaagtgaaaatgaaatcactaatctgaaaaatgacagaacataaaaggttcagagtaaagggtacatcaagaaaatgcaagtttgcacagcagggggtttatgattattaacctcagcattcaaggcataaggcaaaattcatcatgatggtcatggtgaggaggatctccaataagaatgcgcagactgtaccttagctgaagctccctaattttcctccttagctctctcatctcctccatgaacctctccatatcatcagcatctccatctatgatgtcaatgttattg

SEQ ID NO: 28859 - DNA, 4870 bp, Bovine  19866880796135
tacaactgtaatccagagctactgactccaagatctgtgctttggccattatctgctatatcaccgtgtgctctgtttactgttaccgctcattactgatcgctctgagcagtatttactgttattgtggccttacagtggctgctcggtggaatctaaggtctgcactttctaacagggcatcagtacagccatgctcgtcacttccctgaggctttttttccacttaattccagtttatggactttaaattggtccaacttttctgggtggaaggtggggaattaaattaagcatgtgtatacaatttgaggcagcaattccatgtcttgaaatgtaccctaaggaaatagttaaggatgttcacgactgtatagaaacaataacattcatcaacttgaatacttaattttgttttttaccacagacataaatttactgaaggataagaagaacacaaaggatatctatcaatgaaggggtacatggaaacacacataagtgttccagaaacacacaaacacacactcacagtatcggggtttattcccaaaagcctaaaaagtgcccacaggggttttatgggggaataaagacaaactcataaatgagctaaatctattctaaatgcaaatgtgaaacacctttatttcacaacagaaactgacaagatgactttcatttcaccattgtttattataagaaaaatgtattagttgtgtggtaggattatgaaagatttatgttatttttatcttttgtattagtttttttttcataggtgttatgagataaaacataaaattaaagaatgaaggcctatcaataaaaattgaaggttctcatcagtataagtcccttgacagcaagtagatcaaaccagtcagtcctaaaggaaatcaaccctgaatattcattggaaggactgatggtaaagctgaagatccaatacttaggctacctgatgtgaagagccgactcattggaaaagacgctgatgctgggaaagattgagagcaggaagagaaaggggcgacgggggatgagatggttgaatggcatcaccaaatcaatgggcatgagtttgagcaagcttggagagatagtgaaggatggggggcctggcatgcttcagtccatggagtctcaaagagtcagacacgacttagtgagtgaacaacaacaacaacatcagtataggtacacaaacttctggaattttaacagcatgtggaaacatttggcatgacttaaattataatgaaactgcaaaagagcaaggacactcttttgtatagcaaaaatcatcactaagaatccacattacttttgaacttcagtaaaaatataagagcttccctggtggctcagatggtaaggaatctgcttctccagtggctcagcaggtaaagaatctgcctgcagtgcaggagacacagggagacttaggttctattcctaggtcgggaagatcccctggaagagagcacggcagcccattccagtattcttgctgggaaaatcccatggacagaggagcccagtaggctactgtgcatggggctgcaaataatcagacatgactgaagtagctgagcacaaaaatatatgaacatgaagccttagaggtgtaacacgttacaatggtgaaaacaaacaaaacaaaacacagacatcgtccttgccctctttgaacttacagtctaaaaccagcaaaaatgatagagtgtcgtagctgctctgatagaggaagtcagagtgttgtgggaacaaaacagatagcacaagtacctgactggtcctgggtgtgttggtgaggcttcctacaggaagtgatgtttaaactgggactggagggataagaaggcattagctgagtaaagaaagggcaaggctaatctgagaccttagtcagatataacactcaggaaatactctctgacctggttcatccctggggaaatcctgtgtggaaattcattacccacagttgcgcatgttcggaaaactgtgaaacttaacaatacaattgtagaaattgcctgaactctgcagttcatgcctccctgatagctcaattggtaaagaatctgcctgcgatgcaggaaaccctggtttgattcctgcgttgggaagatttgctggagaagggataggctacccactccagtattcttgggcttctcttgtagctcagctggtaaagaatctgcctgaaatgtgggagacctgggttcaatccctgggttgggaagatcctctggaaaagggaaagggtacccacgccagtattctggcctggagaattccacggacagtccatggggttgcaaagaatcggacatgactgagcgactttcacttgcagtttctgcaattcatccatgagagaaaccaagaacgagacttcccaagagttgtctcatctttaactctttctgcaccattttggcagtgagctccaaccaggagaaatatacaaatcattaatatgttttttagaaagtgaatgcatgggtagctaaaatggtcagagcaacaggatatctctagggttcctcttccaaggttcctggattctttggtttacgctcgtgggttatcatgtctgagcccggccatgcatgtagaggtaaacgttaacactagacagatctagtggagaacagatattacagttctggagctcaggaaagaggaggtcagggcacagagatttaagctggcagtggctggcacactggagacactcaaacactatgtaacaaatggaaggatggatgaatgaatgaatgaatgacagatttttggaaacagcagaaaacgaaattgtttatctcttcaaagagtttccatccatatttattttttgaaatggactgggattgtattatatatttccactctgatttttaaaatattattgattttcataattagaaagtcattttaccctttcaataaaatatagaaaatatcttttgagatgaacctattcacagggcagcaatggatatgcagacacagagaacagacttgtggacacagtgggggagagagaaggtgggaaaaattgagagagtagcatggaaacatatatatgtgtgtgtgtgtgtgtgtgtgtgtaaaatagatagtgggaatttgctgtatgatgcagggagctcaaatcaggtgctctgtgacagcctggaagggtgggatgaggtgggaaatgggagggaggtgtaagagagaggggacatatgtatacctatggctgattcatgttgatgtatggcagaaaccaacacaatattgtaaagcgattatcctccaattaaaaatgtgtgtgaatgtgaagtcactcagtcgtgttcgactctttgcgaccccatggactgtagcccaccaggctcctccatccatggaattctccaggcaagagtactggagtggccatttaattaaaaataaattaattcaaaaaaagaaaatgcctattgacgttagtgagggttgcagtttgaatatcataaaccaggaagttgagaaatgagggagctgcctattctctatcaagcagacagagctttctggaagtcttctggaaccagaatattgctaaggaactcagctgctgcctcagacttgagagaggatgaatagaaagctctagatccatcttaggaggagattgtgtgtgtgtgtgtctctgtgtgtgtgtgtgtgtgtgtgtaaatatttgaggctatagattttaacatacttcacaaatacattgatttattttgaaataataggatcttactgcatagtttataattatattttttcctattgaagagtatattgtaaacaactttcaatatcaatacatgtattttacattaacagttttgtgattcaatttaaaactagatgttttctgtgttttgaaaatatataagccatatcacatgatatttgtttttctctgtctgacttatttcacttagtatgataatctctagggccatccatgttacggcaaatggcatcctttcattcttttttatggccaagtaatattccattatatataattgctaaagtcttggtcaatgataatgtcagtgtacaagtatatgattcatgggactagaggtctattttgaagagcaatcctggtctgcattttacattctgatgttgttgggaaaagacagaggtatatgtcattactccatcatcccttgagtatagaaaagggccctccactttagaagaaaacactatagataatgtgagagaacagctagatggtatatcttagagcaaaggacatactgcaatttgatggggagttaagtgacttctgaatacagtgtttaacttggtttcatcttgcagtaaaatgataaccaaagcctaattcaggggcctttaaagtagtttcatatctttctctgaaagctagaatgaatctaagataataagtccacgacctgtgtcattagcagtgaaaagctccaagctaatatacattgattccctacagtctcagatacttgattgcaatatatatctcatttttctcctgcaaaactttgtgtggttgagaggcaagacaggtgaaattcagatgggcagagttacaaagaggtgaaggtgtctatcaaaagttgttacatagctactgggttaagtctgtcactgggatccagagaggtttccttacttaggtggactctccagaagccaaagtactggcttgcttcttaagggacaaaaaactgggactcccttggcagtccagtggttaacactttgcctttcaatgcaggaggtgtgggttccatcccggtcagagagactaagatcccacatgcttggggcaaaaaaaccaaaa

SEQ ID NO: 28860 - DNA, 1700 bp, Bovine  19866880937368
cctgtggaaaaaaatgaaaatagcatatatctacctctcaaatgggggaaaaaaaaaaaaaaaaactacagttgagtctaacaaacgttttgttcattacattgcacacacacatacctcactgaggatttgtggttagtgccttggcattctaaatttaaagaaggtatggcagcctccccggtggctcagacagtaaagaatccgcctgcaatggggagactcaggttcgatccctggtttgggaacgtcccctggagaaggaaatggcaattcactccagtattcttgcctgggaaatcccatggacagaagagcctggagagctacaggtcatgggattgcagagttgaagatggctgagcaactaacactttctttcttatggcagactccagtgatttggcaatgagctcttttggaagaaattgaacttaatcttggggaaatatcctcataataatttgtgtgtgtgtgtgtgtgtgtgtgtgtgtgtgtatttgttttctcccccagctattcagcaggagaaagagtgtgctgaaatgcaaaatggggacctccttgcaagagcaaattccagcattgcttgagtgttttgcttttggcaaatctttgtagagattttaggtatcttctgatgtcttttcacccatagcccctggctaagaggtcaggggtagccaaagtccccgcatcttgacagttccattggtgcataaattccagcaggcagatgctgtcaataatctcacaattgatgatctttgtgtctagtctttgaactcccataagataagctgcttttaactttctacaatgattccctccattgcttcataatccttaggttccatggtttcgccccttctcacaatttttttttttttcatttctaatgaagcagtaaaataataaatacgaccaataggtttagtatgggctcctgtggttcatttctggtggtcttctaaggaatgaaagtacacaagggtacttttcagcaaaataaaatgagtgcaggaaagctattgtagcagatttggcacacgggagaggccgcttctgtccagatcacgtgggtcctgacttggggattgtgtggctgaaccacatcaactccattttgtcaattccatcttaattcgcacagtcctaagctcccctcttttcacatgattgagctttagcctaatttacaagaagtgagtccaagccagatgagtaccctgtcaacttttgcccttgccttcatctgatacgaaacctgcaagaatggattttgctgacatagatagctaatggtcaggaaacccctgaggggaggaaccccgattccagtcgctgcacctgtgcttctgtcttggtaatcagattctacttttagctttggcccctgtgaattctcttgtaccctttttggaggtcagtgtgcagtgcagctgtgaatgtctctggattatctgtccactctctcctttgttcctttatgtaagttacccacagtgaacttcataattgcactttatggcattgctccctctgtttttttggtgtcaaattccttctcagtttgcaggatattattcaacatgtgtgccctcctacatggatactaagtgctcttcctggaagttggaatcatagagatagagagccttgggagaagaggtcatgtgcactagcccccttgtctcaga

SEQ ID NO: 28861 - DNA, 752 bp, Bovine  19866881204947
aacccaggtctcctgcattgcaggcagactctttaccatctgagccacagttgttgacttaggaatggctaagtggatccaaataaagttagacttttcacaaaaagtttgactctaactttgatttagagaagagttactaagtaatcctggtgataaagtgaaaagttaagtcattcaatcgtgtccgactctttgcgaccccatggactgtagcctaccaggcttctccgtccgtgggattttccaggcaagggtactggagtgggttgccatttccttctccaggggatcttcctgacccagggatcaaacccaggtctcctgcattgcgggcagatgctgtactgtctgagccactagggaagcctaaagcccagtgataaatatactctattgtcaatcaagttttttaaatcatgtacatttgataagatattctcaatgtcccaaaaagctgttggaagacaatcaaaactgtcttcaattccagtgaatgaagtacaaggccctagatattgaaaaactaattcctcttcttcaaaaatataagttgagaactaaatattagttctatggatagcctttgctactggaaattttattcctgcaaaaatctcttgaatgaaatggatggtctttgagatattccaaactgtgatagaaataatgcattgaatttgagtaggccccttcttcagtcatcattcacttatcagacaaacttcagattcaaaagaaccaattcaaat

SEQ ID NO: 28862 - DNA, 1264 bp, Bovine  19866881297123
ggtggttctctatgtctgtgagtcagtttctgctttgtagataagttcatttgtgttgtattttaaattccacatagaaatgatatcatatggtatttgtctttctctttctgacttactttgcttaacatgataatctttaggtccatccatgttgctacaaatggcattatttcattctttgtaatgggtatagactatatttatttgattttcataggcaaacatgtaagtaagcatcactttctcctacttcctgttttacaatgaggaaactgatgctccgcattctgcatgtggttccatagcctgggagataccaaagctcatgtttttcttgcatcaagctgcctgcaataagccaagacaccatatttacaggagaacactgtttagaaaaaattcttattggtagagacagtcctctcaatcttagaacataatcaccatcagtttgataggtcctctttgaaaatgaagacaatatgtcctctcaagcttgatttggagggtcactcactatttctgattacttgcaaaattctttactatcatctgattacttcatatagagaaaaatgattcctaatagaagagataattttagtaatttaagtaaattagctctttaaaaagtatgcaatttatgggtgggtctcaagtacacttgtattgagtctagagaaggtaagtatcctgttcttcccagtgcagaaaggacccctactttatataaccgcaggatctcaggctcataggtttttttttcccccataattgagatttttattggttgttttgaggatcagtacacagacatttcaatttgtacacaattcttcacatacataccaaaaatctaaaaaatcatgtagttgtgattcttctcttaacagttattccagtgactttctagcttaaaatttggaggtgaaatttccttaacagggtatcaagtaccaatatcttcaaatattgatatgctgttacatcataagtcccactgattcacagtttagtatcatatacactacatactcaagctgcaatcattcacagcacatcaacaaggttactaggaaaactagactaccaggaccagatgttatagagtgcacaaaattctagccaggagaaccaagatcaaggagtgagtggtttgctgtaggaaataattctaccaaaacaatacggaaagagaagtaatttaaagtgttccaaaaaaaatatagaagtgttcaaaacattaaacgtgcaacgactc

SEQ ID NO: 28863 - DNA, 766 bp, Bovine  19866881421347
cgttatgcattgactttctaatatattttaacattctgacactcaaaagaatactagaggatcctaagctacacatatgcatcatgttaatctataaggtccagatgcatcaggaaaagcacaaggattgaattctatcagccaacttattccacgacatagaaacagaattgggtcacattcataatgtaaacatatgtttaattttcttttaaccgtgacaattctggatgttttctatgatttacagttatgcaatgggcttcccaggtggcattaaatggtaaagaacccgactgccaatgcaggagacataggaaatgtgggttcaatctgtgagtggggaagatcccctggaggagggcatctcaacccattccagtattcttgcctggagaatcctatgtatggaggagcctggtgagctacagtccatggggtcacaaagagtcagacacgactgagcatgcatgcagctgaaatcatttcacagtcatttctgctaagaaagggaagagatggagtaagaaaaacttaaaatgttgagttgccagacagaatgactgggcacactgcattcataggctatctttcttttttcttccgaataggctttcttttgaaacacggataacaatccccttgtacagatcaggaagttaagttttagagttgctaagtggttttagaaaaggcagaggaaccagagatcaaattaccaacatccactggatcatcgaaaaggcaagagagttccagaaaaaca

SEQ ID NO: 28864 - DNA, 1792 bp, Bovine  19866880350261
tgtttaaagtgccttgtaacttcttagaagagattatttctctgtagggtctctcagatggaagaaaccaaatgtgacatttcacaatctgggaagggggaggcatcttgctaattgagaaaacatttctattcacagtctttagactgagatttagactatactatcccccaactaacatctgttcttggtaaagatagcatggctaaattcaacccgtccattatttaaaggatgaggcatgtctccattttaccttggtgggtctatggagaaggaaatatcaggaatttttacaacctcatgacacaccaactattctttttatgtataataacttattcttccatacctcctgaaggaaatctgaaagactgagcattaatcttaaaatactgagtaattaataagaatttgagacttagaaaccaacatttggtaagtttgcatgtttcacctacagcagtctctccccaccaactccctgcaatatcaggctcaagagaaacattcataagcattataaaacacaaagaaactattctcttcgcacatctgcataataagttgttaattttcaacccagttatatctaaatgctgactttgttgttgtcgtttggtcgctaagtcattgtctgactcttttgtgacgctgtggactgttgccttccaggctcatctgtccacgggatttcccaggcaagaatactggagtgccatttctttctccaggggatcttcctggcccaaggattgaacctgagtctcctgcattggcaggtggattctttaccactgagctacctgggaagcccaaatgatgactaccacatatgaaatacttcctttctttcagtcaaatattgcccatcttttaaagcccaaattaagttctgcacatttgccctccctaccttctctcacccaaagcttattaaattttctaagtcacagtagcatcctcttttttaacctctttttttaaaagcattgttatctgtattttatatctatctatttgacaatggctcacggacacagtgggagaagtactcagtgggagaagtactccagtactctcgcctggaaaatcccatggatggaggagcctggtgggctacagcccatggggtcgtgaagagttggacacgactgagcgacttcactttcacttttcactttcatgcattggagaaggaaatggcaacccattccagtgttcttgcctggagaatcccagggacagtggagcctggtgggctaacgtctatggggtcgcacagagtcggacacaaaactgcagtgacttagcagcagcaacagcagcatggacacagtatgtgactggttagtctttcattaaaagcttagttaccttaatcactgatttgtccatacttgattggtttagacatactgtagtcccaggagctaggaacttgggagctctagtctacagaaaatttcaggatagtttttagaaaggaataaatgaacacttggcaggagatgcctgtcattaacactgtacacatcaaaacacattctagtgggtatttttcaatggtgcacattaatttctagtgtttttacatggaattccacataaatatgtaaagctttatgtttatttgtttcttattaaattagttaatgttcattgttgaaattttgaaaagtgtgaaaaggcataaatgagtacaagaaagtcacttaatatcctactactcattttagcatactccaacattttttggtacatatttgagactttacacataatttcatat

SEQ ID NO: 28865 - DNA, 1946 bp, Bovine  19866880362488
tttggccttggagtcaaatgaagtagggcaaaggctaacagagttttgccaagagaacacactgtgtggcttagttccctcatataactgtggttggaaaagggatgtatagttgggcaggaaagtaaaattaaacattgaaaaagtaaaacaaaaggagaaggaaccaaatggcatttttcaaaagcttggctgttaagagcagatgagagagaagttctgatagaggcacaaagttcctcgaggaggtggcaaagcttagttttaaataagaggagaggctcttcttccttcataattgataaagaaagaaggaaatggaatagattcccataaattttaggtgcatagcagggaattgaagaaactcacacatgataaagaaagaaggaaatggaatagattcccataaattttaggtgcatagcagggaattgaagaaactcacacatgataactcatattttctctgtgaaagataagaaattttgcacaattatatttcattccccactctgttatggctgtcacctataaaatgaagccattaagatacctcataggatgactttcttttttagagtaatccaacttcaacttggtatttgagttaacatcagctaataatcactttctgaaatgttctattcaatttacatctctcgcctcctagaaggaagaatgttagtgatgagaaaagctgtcaagtctctgattactgcctacaaatgttatcacttgctactgttcaaaatattctgatgaaaatattactactaatggaacaacatgcatatgttcttaagacagaaatagtataactacattctgtttgcttacaagtaaagtaaattagcactgaacagaggtgaagagtaattccttgagcaaagttctcatgaaattttaactctgaatgcacacatctcatagataagattgcaaaagagttcaggcttgagtactttctaaataaaacttcatttctcagtagatactagtacagaatgaaaccagttaatgccctttttgaagactgagttcatattgtcaggtatgctatattgtgtttattgtcataaactttcccaagggggctgacaaaggacaaagtgccaaaaaataccatcatatcaatctataagcaaatttcacacacagtagccacctatacagtggtctttctggaattcaaattgacaaaatcatgtccaatatcttcagtgaaaatgacagaactgcaaatttaaatggaaaaggctttaggatatgagtttaaaaactaaagggtaggtaatgcaagaattttagatgaaataaggaacagcaaagaaattcttaaaactatagaaagtttatagtatttatcaggaatcttaagcttacttgaatcaataatttcaacagtggggctctactaaggaaataattttgtgtggacactctttatgggaaaagacattcatcacaatattatttttaatttagaattacttttaaaggttaagaaaacaatgtctccatcaatgggagagtgggcaatgcagcaaggagatgttaagtatactatatacacctattcaatggaattttatataatcattacaacttttaccatataataccatgtagctgtttaatgaagtaaagcataaacatgtaaatgatagtaaaatatttttaaatgtattaagtgacaaacataggctgcccaactatataccaagtgtgatctcagggttgcatgtttatgtatatacattttatctgtatttatgcatacaagtttatgtttaaatgcaagggcaaaattctggaaggatatacactaaatttcactgtatttattactgttgccctatacacttatgcattattttaaatttctatagctagcatgaattattcatataatgagataggaaacatacatttttgcttttaaa

SEQ ID NO: 28866 - DNA, 1820 bp, Bovine  19866880412598
ggtctacttttatatgtttctgttagagaaggccattaacacagtgacatggactaatttatcagattaatgataaacctggaagctagacatctgggctctaagagatactggccaaagcaggtaagtgtgggtaatctggaaacatctgaaaaaatggtatgctgaatggagtagcttaggctagagggtggcaggtgcatcaccatgggaatatcaaagatgaacttggcttctttcataatatttcaagctcttctaggataaaactgaaatatccttagttactgtgggacaagcagaaattcaatacttttgcttagcttttggttgcttatattctctcattcaaggatatggttacaaactttacactccacccctaacatgggccttttaataaatggtgagttacaatctgataatagaaaggatgttatagctgaaatcagagtgcataataagtccattccatgctgtttccttggaaggcatagacactgtgtcacatgcctctaatattaaaattcttagaaaatacagcaagcagtagtgtttgagtaagtcttagaggcaaaactgatctgaccaagcaatgtatgttggttaagtgaaatgtgaaagactgtctgttctatctcagctgaggatgtttgccatcgaaaatgtttgttatggcacagtagagagactgaagctaccggtttcttgctacccaaatttgtcttggttaaatttgtcttctgtcttctagaccctagggagctgtcagtctcctgaagaactgggcagtagagtgtaggaaacaggaagagagtttgaggagtttagccagtttaccagaaacatttactgggaaaatctacttggacactaaatagacactggaaagtctgactgtctaatttggatttctccatatacctgtcatggtgaagtgaaatatctgttgggctggagtaagtgtgtcagtattttggtcatacctctatacaaattaacattaggactgggagctttgtggtaataactttcttcatgtgtcagagctgtggagtttttagattccctttaacttcccccaaattccttctcaacctacaaaagactgtagaggtcatattgagaatgcattttatcaagtgttgatcaacccattggatgtttgccatgaccttgccttgcttgccatcttggccaccaaagaacattttcatgggtaatatataggaagttcaaaatgcaagtaataccacagttttgtttttttttttaatctggaaaccaaaatctaatggataatgataatgttgactgctaccattaagtgattaagcatttgttatgggccagataattcgctgacactccatagggaaaggctttgccctcccagggatatttggcaatatctggagacattataggttatcacagcagaagagaggagtgctactggcatctagtgggtagaggccaaagatactgctaaacgtcctgcagtgtacaggacagcccccacagcagaggctatctgactcagattgccagtagtgccgaggctgcttcagagtcagtatcttatttaacttgtatacatgataatcatagaagattcaaacctgtcttacagcccgaggttcaaaacggttaatttttcacttttcattaaccagcattctgtttcagtctctactgctcgatcttcttaaactaagagatggcactcacacagaaatcttttcctcccttcccccattgtggaaaatgtccaccctcagtctcttcatccctaatatgagaatattttctgtccttta

SEQ ID NO: 28867 - DNA, 1745 bp, Bovine  19866880460668
aggagcagactgagattatctttttatacaagcaccaaaccacttgttttaacctctgagataaaagcagaagctaaaagtaaaaggaaatagttcgtatttggtacactaataatctacaagttcaaaactcaaagtatttgatttaatctgatggaagtaattccaccagagaacattttttcatatttaaaagtgtcgtcatatctccctgaaaaagttctgtatattctgtggtattatttcagaatactgtaaactggagatggtatttcgctcctttgtgacagcatactattctaatgatggtagcataggcgattaactcctcttattacaaaccagattttaatgtttttataacagtaaaaataacatgtacatcaatgcctccatgtgaacttgctgacatccaacaaggacagtcttattactctgtgatgcttcacaaactactcaaaaaccaaggtgaggagtgggcttggaattacaggaatccactggatgtcaaatcagggtaaggtctggcttctgatgggtgaagacgggtggcaggctcagtgttacgcatgctatttaattcagctggatacgtttcatttaaaattgctccgttctgaaactgcaaacagcaacttattagaacagatccttcatatatattaagccattagatatgtgaaaatgtagttctaaaatctttatcctccgagttgttattgtaactcattcagtgaagtcatattgaacacaggtattagttgcacttacaatctttcagtttctccattagatagtataggtgagtgatattgtctcacttcagatgtggcactccatacattgactctttgatcaatgaaatgcctttggtttgggcaggaaccactggatcagaaagtaccagtcacgaaccacaggtactattctctgtcataagtaagtctgctttgaccagattgtatctcagtaagttttaggtatcagtaaactaactaccttcaagattactacactggattacagataacccagaactttctgaaaagaggcaagttatgatttgcaagaggtttcttaatatgtcttacatactatataccatgggtatgatttctagaaccaattttattcataatatgctttttttttcttttttttaaaattttattttatttttaaactttacaaattgtggcggattcattttgatatttggcataatatgcttttaaagtactactaaaattattgtcctaactgtggaaataaaaattaccaaagtaaagtgcttgctcttgccttttaacaatgaaatttagtctcatttccgtaagtgctactggaaaaaaaggagggagggggaggaccctgagacacacagttctgtggaattacaggaataattcctgttacttataattagttggtgatgaacagggaatcctggcgtgctgcagtccatggggttgcaaagagttggacacgtgtgagcgactgacctgaataattcctaatagttctgtaggtttttatagattacagaactttttgaatcttagtaataattagtgaaagtaatggactataatcataccttcaattgcttcaaatgaaatttacctttctaaagcctatgtaacatgaggtttctgtccttctaaactttatcaagttttcaaagggaaggtaataattgctcagcaaaaggtaggttttggataaattactttcatcactcaata

SEQ ID NO: 28868 - DNA, 1477 bp, Bovine  19866880464945
attcaagttccactgcctggaacgaaaagcatgttgaatcatgtatccacccttgaaagatcacccattccctgccttagccatcatcctgccatagtcttcaccataggttacaggcactatagacaggatcataagaaaaaaacgctggttctcactgccaagatggcaggcggactttaagtgcccagctctactccagtgaagctctagtctattccaagccaaactccaaatgcctttataataatagaaatattattatatatgttgtgtgggccccatgatgattttagagaagaaactgtacaatatggtttaaataggcttttgtgggttggcctggaaacctaacattgtttctatggaaaaatgctttaaactccaaatgactctgttcgaactgaactttggaatgcaacctgttttaaattgggagattgtgtacgtgtttacaattaaaatacacaggaatgaaagtgagttatcaactgcaaaaatcacatttggactgtggatttaaattgatcaataacccattgtcattttggataaaatagccctaaataaaaaggggtcgtgactttcagcagtaccaaataacaatacaaaatcagactccattttaaagtaattttctgttggaggaggaagttactttacaaactaaatagtgcccaccctaccaaaacctgtcaccataaccagtgtgtttttaaacccactgggaaatatttcatgcagtaatttgaatgagtacatgaaaatccatccccttgctgcaagggaaaaaaacaaaaatagcagagatctttgtatctaaggatgaatccaaatccttagaagttctgcgttcaagtcaaccaacaactataacttgactccctctccccctacatctccattttttgatccaggtactagggatgaatcagggtatagtagaaacagtacttcctaattattgtggtttatatctctatttcctcaaattgtaaagtgaaaataataccatacaggtccctgggctatagtgacatttacacatagcatcacccaacactatgcctgaaaccacaaagtcctcagagtcagttcactacctttctgtccgttcttctccccctacaagaatattgccctcacataagatatccaaactctctccaacctacacacataactgacaaccagagtttattctactggtaaatatgcatatggtgtctaaagaaaatcaaatctaacataatctttcaactgtatgtgaaaatgaattaacatttctctctgccttacataaaatattatgattgaatgctatggggacttttcaatactgcaatgactgtaacttgtatttaaattctgctgaaaccatggctttctgagaattagcatattgaaaaaacacaggggtagctttgtttcataaaagggcaaaaaagaagcaattaacaatatcagttcaaatcag

SEQ ID NO: 28869 - DNA, 675 bp, Bovine  19866880487760
attcagaaaatagtgtgaaaatatcatcctaggagttgatagtggcaaatttcaaactggtgtgtcagtgtgcatgcctatggaatatgagagaggcatcagataatacggaagaagagaaattcatggagaaagtgaacaatagtttgtaagactgcaaagtgagaaaaggtctgatgccttcattttatttaggacttacgatgtcattagtgacctgaacaaggcagattctacaaaatgctaagggcaaaccttggttacaggaaggtgaagagtagacagaaacttccttttccaacaatattggcagagtaaatatcctgaaaaatgatcctgctgcttatcctagctcccaaaagtagtagatacaaaattaaaaacatattttaatgcatggccaagttggcaagagtaaaagaaactacctaagtcataagaggccaaaagttctgggaagaatcaactcaaagagttataagcaccaaaagcatctgttaatttcagaaacctaattaatttcagagctctggttttgaccttgacaaaatcagatctgcattgacaggagagctggaattcagttctgggatctgtgaagaattgcatcttcagtgaaagtgtaaattagaaaaaaaatgcccaaataaattaaatctgccttgaatgaagaaa

SEQ ID NO: 28870 - DNA, 4490 bp, Bovine  19866880533401
tcctattcctcagattatctgctctctttactggacttgagtgaaccaaaagggcccagagtagaaaggacttgggagaactggggtgtggatatatacaggacggtgccttaccactcctataaagaagtgggtgagactgtgaggaggttcaaagtgcttcttttataggtggggtcaaattgaaacttgaatcattactcacaggctggtgagaaaactcaagttgttgttcaatctctaagtcgtgtctcttttgtgaccccccatggactgtacccgccaggctcctctgtctatgggatttcccaggcaagaatactagagtgggttgcatttccttctccaagagatcttcctgacccaataactgaatgcacagctcctgtattggcaggtggattctttaccactgagccacctgggaagcccctttcttttataggtggggttatattgaaacttgagtcgttactcataggttgatgtgaaaacgcaagttgtgcatttaaaaagtgagaaaacggaaaggtacagggcctcttcaggtaacaggcagcagtgagagcagaatctcaactctgcatctctgaattaagaacacataaaaaaatcttctaacaggcactatgcaagtgttttgctatgatgactgaagctaggctgtctcattgactttatatccccagggggtgaatatcatagttccaattttacacacaatgaaactattttaaaaagcaatcaaaacaaccaggatgatggtggtagataaaataatggtgcccccaaagatgtgcatattataatcccagattggatggcaagaaggtcttcacagatgttactagggaagaaccttgagatggaatgcttgtcctctcttaccttggtggactcatgtgatcacaagagtccttataagaagaagggaggagggtcagagtcaaaagaggagaggtgatgacagaaggagagagaaatttgagtatactctgctgttggcctgaagatagaggaccacaggccaaggaatgcaggcaatctctagaagctggaataggcaaggaaaccaattctcctctcatgccttcagaagggaggcagccctgtccacagcttgattttagggcttctgacctccaggactttaagataattaatttgtattgttttaagccactaagtttgtggtaatctgtaacaacatcaacaggaaactaatacagtggttatggattttaagaaggcaaagaaggcctttgggaagaaaacaattactcccccattattatcatgtctgattataattagggcttccctggtggctcagacagtaaataatctgcctgcaatgcaggagacccaggttcaatccctgggttgggaagatcccctggagaagggaatgactatcccactccaggattcttgcctggagaatcccatggatagaggaacctaatgggctatagttcatggggtggtaaagagtcggacacaactgaatgactaacactatacttatgatcacgtctagaaacaaacagaagagccattctctgcccctctcctgctactctgcagtagtccccatccctccgctccacctcagctacatctgggcctggaaaaaggacctcccctttctggatgatggtgttgcctggtaagctccagtcttgcctgggcatggcaaagaaacatgggagaacacagccaacacagtttcattacagctttgccttttccagatatttagctcatgtcagaggccaggaaatatgttgcttatagcctgcattttgtttctaaagaagggtcctgataaatgtgtctagtctttgcaaataacctgaaaaattggccagattcctaggagaagaatggctttactccagtaatttagatattatataagcaatatcagatatacagctaagtgttggttcttcttttacaattaataaagcctttttgataatgcaattttcaactatgcatctatggtgctatggggaaaaaacacgtttttacctagaccatgatgttatcacacagataggttgaagaaaagactattcaaagagaataagtgacccagaactgtctgaaagcttttctttgctgaatgcaggccagtgtatttggacacacagtgctgtatttggacaccaatctcacaaccattatcagaattgccaataactatataaggtgagcttttttggaaaaagaagaattcaagaagattatgtaaccctacaccgccagtaactggtaggatcaaaaactgtgtggaagtcaccttacctccaagttcaaaaaattttttaaaataattcagattggtcttcaataagatacaacaggaattgaatcactggtttaactacatgcatcaagcaattcaagtttatcttgaagttgagctgctacactgtgggttaaacttcagatagcaaggcaggaacatttgtgtggaatctgctaaggaaagactagtgaggaatccctacagttgaggaaactgaagctagaatgtgagataattaatgctaatgtgggggcactagtggtaaagaacccacctgccaatgcaggagacatcagagatgcaggttcgatccctaggtcaggaagatcccctagagaagagcatggcaacccactccattattcttgcctggaaaatcccatggattgaggagcctagtgggctacaatccacggggtcacaaagagttgacacgactgaagcaacttagcacacatgcagtcactacccaaaatgaccttctgtcatgtaaattgttataaccagacttaagaatcatcttggagaaggcaatggcaccccactccagtactcttgcctggaaaatcccatggacggaggagcctcgtaggctgcggttcatggggtcgctacgagttggacacgactgagcgacttcactttcacttttcactttcatgcattggagaaggaaatggcaacccactccagtgttcttgcctggagaatcccagggatgggggagcctggtgggctgtctatggggtcgcacagagtaggacacgactgactcgacttagcagcagcagcagcagcaagaatcatctggccatctgactgaccaatctttcaagaggtctctctgcttgattctagtgagatatgaaacaaatgtctcccactcaacattcacaacagctagaatattcaagatggctctttgctcttgacagaacttcatggttcctagaaaattaacatgtgcctctgcactaaggccattgacaaaatgtcatcttgaatttgatatatagatagatagatagatatagatatcaaggaaaaatcctaaattgccaactggacttaaaaatcttgagaatacgtcactttaaaaatatgacaacactaagataatagattcccatattttccctgaattcactaactaccgcatttgaaaattcatttaaaaatcaagttaccaaaaagattttatcgtatagaaagaattttgacttctcactaccttccatgttctaaatatccattatataaattttcattagccttctggggttttgaggaagccctgtgtccattttatacttgtttgaagtaaatatactagaatcccattctggctgctggtatgcaggagccctgcatcagtgtctactgttttgtttcctagaatgttcttcacaatgatgttttttaaagtggttttaatcctaataatacattgagttaatgtcatcagaaactatgagatgtttttcagggtctgttttatagaatattagtcacaccaaatattaacatgtggatttgataatcaaataagtttgggaaacactcagcaaagaaaagttaatcagattgcttcattatggttctctaatgtattactgtgctgtgtagtatttttgtgtgtgtgtagtactatcaggcattactactactacttttccaagaaatggaactgacgtgcaatattcaccaaacttatttgacactggagccattttcagacctcattattacatgatgttagtatgtcaagtaaagtactccgagaaaactatgatctatggcaaaagattccaggttcttctcttggattgtacctatggctcagagtccttattttacaaatacaacttggaagacctatgacgcacccatcaacatgaagttatctgtcatttctctaagcacacagattcattaaatccagctttttactatgtgaaaagttgaaatgttatttctaatctcaagtattcactataggagctcttctgtatatcacctataaaaataccgcaaacttttcttttgatccagcttgaccatcaaaaaaactctgtagtttagccttattactttgaaccatatgcagaaagagtttcactgagcttatcttgggaggtttttaggttttttgagaggtagtaggagaagcagt

SEQ ID NO: 28871 - DNA, 948 bp, Bovine  19866880574271
cattcaaatctgtgttgttcaagggtcaactgtacttgttttatccctactattccagagttctaatcctggccctctaatacactaaaaatagaggagctttgtttttaattaaattaggctttgactatatatcacaatttatggtaaaccactcaccttgaatagacaaacagatgactgaatggataaataatgaacaaaatattgactgagtacattattaaatgtgtcagttcattttgggttccgttcttaactgttcatttataccctgctcttcatcatctgtgcctttgtgtaatcggtaatcagtatctgagttttactgagtcacattttccgttttatctcaatggaatttcagtttcacagtaatcagatcacattttcagtttaaaggaaatatttcacccattctttccaggcccactgttttctcagtctggctctgtgcccagaagactggcctctgcggactgcatcacctggtctttcttgcctttgcactactggctggcttttgcttgtgggaagctcagagagagaagtcacaccatacttagtccgaccacttcctctctgcctaaggagccataatttggcagggatcgcattcttctgtagccagcagctcccacagatgcagctctcatagggttctgctcaaatgctttcacccctcaacacctcaggctgtgggacattaaggactgttgctatttctgagctgtatgtacttctctacaatttgctgcctcctctcacacggtccacatctctataagaagagtgacttaatccctcttttctcctttggttgtgccacctgttttccagcgtgggctgtaatataggctaacaaccacctgtactaagaataagggttttaaactggtcgactacaaaatgctctggtttccagctaccatatagctattttcatca

SEQ ID NO: 28872 - DNA, 3772 bp, Bovine  19866880600244
tttctagtcaacacatccatgcatcatatattaccagcatttttttccagtggcctgtgtttacgaatctttttaaagctaccattttagttttcagagaaatggtatatactgtgttttcaattcacgtttcatggatttacataaaatgtcattacttgtacgtggttaaaataatggcatcagaatttgcaattttgagaactgagagcaagtgacaacacagcacttaggagtgaacgtgtgcaaggataccagaggggacaacagcagtaagtgatcaggatcccatggacgtcagcaggcattaggtgatctcgtggcttgattaagagaagattggctaagagagctgtaataactgtgaataacacttatgcaaggtttattctgggccaagccctgtgttattacttaatgtagtctctcatctaacctttaaggtaactatgaaagttaggcattagtacccccatttatgcaagggaaaactatttctgccaagtagcttgtccaagatcaaatgctagaaagtaactgagttaaaaactcctctagctctctccagagacctgatttttaaccatcttgctatatcatagtaattttttgactaacaactcaaaaatattattaaaatttttgagttgactaacaactcaaaaatattatacttacagagagaatgcagatatcactaaaaaggctccattttactaaaggactcattttttcgacttggtgtccattgttgttcctcctgttacagggagtcacaggaaaagttttgttgaaggagcctggaaaaatacaagcagtgactttggagttctgtataaatgagggccaatagaccaaatgtctcctcctgctctgagttatttattagaacgtttcccaattgagtagcgagtgatgccacatttaataaagcctcaggacttccatgaggtctattagcttgcactttgctgagttaggaacacaaagactttatgacagacatttgttttcttgtggttctttgtactgttgctctgctctgttagtttaagtccttcagttttgatgaaagctttgatgtttgattagagaggataattagaataattagggaaggtttctggcttttattggtgatttagacagtgacatgtttatggctaagctatggcatcaaccagatttcatatttatatacatatatttttttccacatctcttatgtttaggaaagaatattctgaaaataagttgaaagtagaaaattgaccttgattttatgacgtaagtcttggagtaagccaaccatttgttttgggaggtttctagagctgatgaagaaaactgtctaaaagtcctcatccttcgtgaatcagctggtgctgttgctctgcattctgtttaatcaagtcaaaataattttgggtttaatagatttttggaatctcctgtacctaaatggaatgcttttgccttaagtgaatttgacactcaactccctagagtgcctttattatcagcatgttttcttcacaccttttgcatattttcatgtattaggaagtcacttctcttgtgactttgagcgttgacatagatcatgtggtttatccaaatcagcctctccttcccctggtgctgtgctgctaaaggtctaataacgggctctcagtgggaagagacttggccctgattaatagcatttggtgatgtacatggtaaaaaaaatcttcccttctggcctatgtgaggcaccactgtggttgggttgggaagagatgtgaacagtcagttctcacgaggtaatctgagcaggcaatctgtctcttatcaagtagcacaattctgtgagttcacttctgatgttgactgatgggaatgcaatgcaaagttcctctgggggaattccctgggtgtccagtggttaagactctaggctttcactgctggggccttacggtccatccttggtcagggaactaagatcctgcaaatgtagcatggttaaaaaaaaaaaaaaatttcctctggcagggcatccttactgagttttcaagctatttcttctcaagtcttttacttacacgttaagtcaaagatttcattttagagcttatctgtgtgtaagtgtgtatatgtttttttggggggtgtgtgtgtatatacacataaattggtggtggtgtttaatcaccaagttatgtctgactctgcgaccccacggactgtaacccgccaggctcctctgtccatggcatgtcccaggcaggaatactggagttgggttgccatttccttctccaaaggatcttcccaacccaggatcgattctgtctcacctgcattggcagattctttaccactgagcccacctggaaagcccgcacatatataaacatacacatgcgatttatatgtattaaaattgatattctgtttcaggttttcattttgggttttgtcataccacattttcttaatgttttcaagagtcttgagtcccgtctctttaacttgttttgctcagcctcctgagtaataaaatcagtaatcaatcagtaataaaattgttttaggcgtgagcccctcactttcaactcttccttccagtataccctcacagatttccctaatgcaaacttactgtggtgggatagacttttcttttctttttttttttcaagaagggaaacaataacgcaaatgtgacaccagccagtttcatgcaacctcttcataacctttgaacaggattccaagtgcaagtaagatgattccattgatcttttaatgaaagaatgaaagggggttaatttctctggaaacatctctggcttttcatggctatcttggtctgaagttccctgtattacactggataccctcagcaggatgaaacatggaaaaatactaccacccactggtccttcctcctcaagacaagatttccagatgttagataggttggctcttcttggataaggttttggtccctttacagttggtacaagtagtgaccgcagtagtcaaaatggagcagagggtcaaacttggaaaatcccttctgcctcacacatatagaaatgatagatgacataccatcaaagctcagaaaacaaacaaacaaggacaagtggccccaaaacaaaatacatattgtggggggctcagaatgttgtagaaatgcctgagagtgagcagtgttagtgctgctgtctctgaagtcttcctctcatgtcaccttcccaactcggcttccctgaacaccacgctaaagcaacttctctttctctacccagacaagcactcacccccttctctgcttcatttttatcctttattgttgttcagtggttcagtcatgtctgtctttttgtgaccccatggactgcagcatgccaggcttccctgtcgctcacaatctcccagagtttgttcaaactcatgtccattgagtcggtgatgccatccaaccatctcattctctgtcacccccttctcctccattgctcgatctttcctaggatcagggtcttttccagtcagctggctcttcacatcaggtgaatgaagcattagagcttcagcttcagcattagtccttccaatgaatattcagggttgatttccttcaggattgactggtttgatctctttgctgtccaagggactctcaagagtcttttccagcaccacagtttgaagttcatttttatccttagtactgattatcccttaacatactgtgtgccttattaatttatcttat

SEQ ID NO: 28873 - DNA, 1190 bp, Bovine  19866880675215
tcaattgaaaaaaataagggctgtagattttaatggtggaaaactaatagaactgaggccagcataagcaaaatgttattcatttctttgattgaagcatatatataaatatgagtgtgttaaaagcaagaatccaagtgaaaaagtcataaattataacgctgaaaaaagtcatgttccaaaataaatcttgttttcttcagcagtctggataacattttaccttgtgttcaaactatccatgcatgcaatgaatgcagttttgtcaacctcaaattattccccatatctgatcgtcttgtagaaattcaacccgtgtccacggaaatgtagcactacgctgcagagctcagtaaaacaaatactacttggcatttaaatacatcaagtccctttaaatggtctctcaattttattcaaatatttccacctggaaaaacagactaaaaatacaacacaatatttcagagattaaatcagtataaaaacttgccctggtcaatcacagtattaacctcttattccataatttattcataaattaacagatacctttctgagtttcttcctgcctacttcttatattacaattcattgatgtaaaagattttaaggtccttgtacttgaatttaccacatcttgcatgatcattcctcatccttacaggaataggcatccaccgtgtgctcaaggctaattttcccccagtagtctgcatcttatttcctaccatttctttgccacattcttccaacatttacttttaccttcttctgcaccatcaatctctccttctctactggctcatctctttagggctataaatcttttgaagtaaagacacaaaaagaacaaaagcataaaagtccccaaacctgcaaatgtcttctgggtacctataacctagtaacaagagaacaccttttctctgccatgcttttcaaaagagtggttccatccatggaatccaatcatctgattccattcatatcctccatatatagccattatgtgctagtaagtgttcagcaattagctctcataacacaaatacatttgtatgtatgtacgtatgaagcaaaaggcaaaggaaaaaaggaaagatatacccatttgaacgcagagttccaaagaatggcaaggagagataagaaagccttcctcagtgatcagtgcaaagaaatagagg

SEQ ID NO: 28874 - DNA, 1624 bp, Bovine  19866880708736
ttaaatccctttaagcaaaatgatgattgaagaataaaaatgatcaattttccccttatcataaaatatcagcaagtaacataaaaatgtaacttttcctatcaggtataatttttcattgttgctaaattttcatgtccaattttctcaccctggaatcttcctaatataaattgagctaattttgagtttaaaaaatttactcagtcacctaaaaatgaattaatctgagctctggtcacatgtgcaagacataataatctatatcaaatttttattaacatacaccagaaaaatagctaaaacagctaccaaacttgatctggcagaagaaagttgtctctccacatgaagccactgagaaataccagaagggttttctggaattttataatgtagatgaaattttctttttagaaataaaaattgcattttatagaaaactacacagatacaaatcaaatacatgactaacttcatacaagcagtgtggtgaagaatttagggttcacatggagtcaggtcagacggcctgggttggaaaccatgccttggaagctgtgaaaaattaagacagctactgaatctctcaatgttctcatctgtaaaacagggatgatgatactagtactaacgtctaggattttaatgaataataggagaaatgactataaaatctttggcatagtgcctaattgttattgttattaagatcacagattcacacctggcaggtatggcaaactgcctggttttgaatcacagctgctgttaattactggcattgaaacctcgggcaagtaacctaacctctatgagcatcagattcttcaaaaggagaaaataatagtaacaacgtacttcaaggatataaaataacacacgaatcacttagcccaatactggaagacaataagatctcagaaaaatatatatgtctcatgatatcctcatagtggaattcatctttgcaaataatttaatatttggcttttcatttatgtgcactgaaaacttttgtcatttaaaaatttttctcacaaatccaaaataaagaattattctacagcttgagggtcagaaatattttatttttgcaggggtgaatagttcgggattgatctagacaggggttttagaagtatattcactacagaaccattcattctcagtgctcccaagtagtccacagatagacagtttacttaaacttcattcttttctaatatttttagctgcaatgagagaaactaacacttcaaacaagaagtcttgatgtacagtcccacaccgaccagaaaataacccagcaacgtatgcagctatacttgtttaaatcattcagatgcccaaaagtattatcaggcagattctcagattattttcttccttgctggtctttttttcacagcagccttcccggcagccatgcttggtactgaaatacgcttaacattggtaccctttcaatttcaaggttgtatcctatttcctggactgccctctccagactgacattgaaagatggatcctctctttcagaatgactatctcataacctacattccagctaaaagtagactcaagatgaaggccaacaaaagttcttccaggcctggaggga

SEQ ID NO: 28875 - DNA, 1266 bp, Bovine  19866880743178
aaatcttgagtcaatgttaaaaaataaccttttcatggaactttctccctgcttccacaagtatcaagtaattatagcaaaaaagtttttcttcagaatccccccaaattatttgctgtttaagtttaccttcccttgtgtcagcctggtacatagtaaaataaaaaattactttttgcatataattcaaactgccatctctttggtattctagaaaaattagagtcaaaaaccaatgtaatgtcacccttttgacataattacatcccaaaggcccccaagtcctaatgccatcacattgagagtcagaattttaatatatgaatgtgggggaagcacattttatctactgcgattgtatataaataaaccagaaccaataataataataataacaacaacaacaaccagaaaagtaaaaatcaccaaacctgggtaggattatttcactggaaatcaaaataagctctatgttttagagctaaggaaatggaactgcagaatgattcaatgagttgcccaaatttattttttattcaacatctgctgatgtagtaccttttagaaaattaactcattgaatcctcttaacaatcctgatgtcaatgccactgtgatcatcattttacagatgaggaaactggggtacagagaagttaggagccttcgcctgttcaatggcaaagccaggatcagctcccagactcgccttttatagaccccacatgtcatgtaaataaccactgcctcactcaaccagttagtggcagagtcaaggccagaacacaagagtcctgaccctaaatgtttttttctactctaaaatttctgtctccacacagtcaagacaggttttcctcgtcccagtcactgaggctcttggctatctctacatcaaaaatacttccttttctccagaaacttcagagttggttgtgtttctcaatttcacagatggaattttttttctctcctcagctacactcatctcacatctccctacaaccaaaccatgactaggtaaaccacaacaaaaaaagcctcggcatcatgcattgttttaaacaaccaaccagggagaaagagcaaaaactaactacatgaaggtcctacttttatttgtcctggaaatgaaggagtagaaatgcctgcactcatctagacaggtcaatcgcaacacaaacacttgttgagctttatggtcacctccctttcaggggccacagctggagaaagcagtgagccctttgtttcacttcactttct

SEQ ID NO: 28876 - DNA, 1960 bp, Bovine  19866880805980
aaggtctctggccagtacgtaccatcaatgcacgtcaattcatagccactgaacttttatgtaaaatattctgcctcccacctactgaagtcggggtgtgcctcctcttgactggcacttggatctgctctctgtaggagcattccttgcctccctggttacctgcatcatgtgtaactgaacccatgaccaaacacccaccttggtgggctaggacagtaaacagtctgcctgccatgagggagacccaggtttgataccttggtcgggaagatcccttgaagaagggaatggctacccactgtagtattcttgcctggagaattccatggacagaggagcctggagggctgcagtccatggggtcgcaaagagtcagacagaactgagcgactaacacttttacttcaagtagcagccttgtctgtacaagcaggctctgcctggttgtgccacgtgggcccctgtgcaatgcctacttgttcctggtcacgccacttaaatcccaaagcagaagtcacccagctgctttcttccagcctgttgcacttgaaaacaggaagccggggtttaggaagatcttgcaagacaactcacaaagaagaaaagtgtttgcaatcaggcttctttcaagagctgttcctagagtgtgattttggagatgctagtttggctttttggttttgcacaatccaagagaccataaggtcacagacaccagcccaaccacaacaccaccacacctctgaagcacaggcagggcactcagagttctttttcctctggaaaagattgaataattaagcagagaagtgagatttcttctgactataaaccagagtatagaaaaatataatggttttttattgtctaggtagccagtgcaaactgctccatgatctagagttggaaataatgtcacatttcttcatttcccaaggcaaattagaaccgggcctacctactagccattagatgagcaaaacatccacaattaatgtcctcgcccaggggtatttaagaactcagagagcctttgcaggtggtgagctgggaggcttggaggggtgggcatctggactgtggctcctgcagacctaatggtggtcctcacgctaggctttgctcacacacagtccacctagccttgtagccacattcatgtgcagctttctgcctgggcctgtggaatctcctcagatgggataacctgcttccactgtcccttagaaagacattagacgttaaagaagccaagctcttccacacctcaagcaggagaaaatgtatctttccttcattccttgacatgtcccagtctgctttctctcataataggtaggaattataaaattattattaatatttggtgcacttttgaacactgaagtaggatttacattgctataatattttcagagggaagtttggctattatctctcagtattttaaatgtaaatatatattatgttagatattccaatatgaagattttaataaatatctcaaagtatacaaagatatacatataaagatgagtattccttccttgtttgtaaaatagttagaaaaaattgtaaacaacctaagcttccattaataggggatagttggataatttgtggcatgtgcatacactaaatcactacccaaactcctagtaagaaaaaaactgaatcattccatagaaaatatgttaagtgaaaaagcttcatacacccacacacaaatgaaacagtgaaatgattgcatatagagtatgatagtatatacatcaatgcagcaggccattaaatttttacaatttaaaaatggtaaattctggaaaatggtttgaaaaaaatgaaactttgactttttgtttcatgcatgtctttactctatacactttgcaacagcagaaactacatttgcaaatataggtttaaatttggctctttacattgaaaatatattaca

SEQ ID NO: 28877 - DNA, 1764 bp, Bovine  19866880841409
ttctaattgtttctacattcagtgattctttttcttcgatgcatagatgactttctattgaggcatagcacatagaaaagaaatcatgtgaactaattgcatgcacaggatcatatgatactatcaggacgtttttcatgactttgcacagattatgttaaacgtaccagatggaactctgcactttgaaactggaacagcaaggccaaacactgactgctctccccacccccggggcctctctggcgctgcttgaacctcttctttccctgaggttcatcgaccttaaatatttggttaaagtggcaacaccgctcccatttttcagttttggagagaggtacacatgtcaacactaatgatcagtgtttctcttaatctcagatgccagccagtatgttaaacctctatccatcaattctgagtgagctaggattgtatgatgaatacttacagattttctaccctgctgggttcttgaagaactttagtaggaaaaaaaaaaaagttggctcctcgcctctgccttgaattgtaaaaatattcctctgaattagcatacttctctgaaatgtccccatatgttgattttttttttaaggtgtgcattaaatgacaaaaactattagagcctgctctgagtcaatattgatagccatcagatcaggaactttctcaaggaaattagatttaacatgaaccatcagagaagaaaaatattattcaccaagcattcagccctcaacctctaacaaatgttatcccaacaagcaatttattctccagagaatgaacataacttcaatttaattcatcattatttattattaatatggagaaatatacattaaaagaaaaaagaccctttaaatttctccaaggccttagagagagctgatttttcgatacttaatgcaaacattccacattcactggttaaatgaaaagcaacattaaatgccactctatctatagcacattttttgtttattgcatggagctggcctgaggcttgtttaaaaaaataccagatgtgtttttgagaaatttatttgtctttgtgtgatgacagatgctctttgaaatgacaaagtatgtaatagcagttggctatttgaaatcaggaaattcagttttttccccaagtcacatctaaaagacaaagctcactaaggttttttgtttttttttaatgtgatcgcattacaagactgccactttaaattattgttccctggcttggaggactaattaattctaaaaggcaaagggttcatttaagaaccattttcctattttgatttaggtgttgtgtggtattaacataaattattcatctatgccatagtctcccagagaaggcaatggcaccccactccagtactcttgcctggaaaatcccatggacagaggagcctggaaggctgcagtccatggggttgctgaaggtcggacatgactgagcgacttcagtttcacttttcactttcatgcgttggagaaggaaatggcaacccactccagtgttcttacctggagaatcccagggacgggggagcctggtgggctgccgtctatggggtcgcacagagttggacacgactgaagcgacttagcaatagcagcatagtctccagtctaagccaagttctttttctctgttccttaaaactgaggataacacacaggtagaatgtgacaaatttttcacctttttaagtgtgagaaaaaggttagcattcataagaggggaaagtctctgca

SEQ ID NO: 28878 - DNA, 1341 bp, Bovine  19866880866790
actccttgggcatagctctgtctctcttatttttctggctatacatgtaaatcctagtaattctccatagaagtatttagcaaaatttgaataaatgaatggacatgctcaatgacatcaaatgggagaagacagcttgtatttgcattactgaagattagagatctgagcactgtttaaagatgccttcattaaacacaacctgatcttttcttctttctctcttctctacccaaatatcctccctccttccctcctccccccctgcccccctgccccttacacacacacaccctttatacagctatttcaaaaatagtaaaaaaagcaagtgtgagaattttcacttttctcaacctatgcacctaaggagggtgttagatttaaggcctaaatggggggggcggttattacaatggcactttccccaacagatttaagagtgttttctgtactttaccttttcatgtcagaaaatcaatatgttaaaattcatgtaatgtcaatttccagtatggatattttcaccatgcagtagcaaatagtggctggttaatgttttcttttcgaaaatgtgattatacttaattatttataaatgatcccttgctttttaacctttagtttttaaaattgaaaattctttcctgtcctatagtgtcttgtttctcagaccctgagacaaaggtttgagagctggtagcttatttaggaaaaagagaacacatgagtcggagtacgtaagtccatgtttttcagtagcccagtcatgtcctactctttgcgaccccatggactgtagcatgccaggcatccctgtccctcaccgccacccggagtttgcccaagttcatgttcactgcattggtgatgccatccagtcatctcatcctctgacagcctcttcagtagagggttgtattaaaaccttaaagtcagtaagtcaatagagggttgtattaaactgtctacagtttggggcaactgaaacctaattcttcttgaggaaattgtagaaagtcccccttggaattatctatccagaaagcaagggagctgcatgtcacactatagggctccttggtggagggcagcttccagcctgctgcgtgggttcagtgaaaaccccaggcaacaaaatagcagtgttggcagatggaagcctgtgggcatacagttgagtagtaagggccaggggaaagtgggtgggcattagtagagtccgctatatatggagatagtacaccactctgtgaggagtgctcaagtgtgaaaaatatcagaatttaagtggcctaacacaagcatttactcagccattagattatgtgctaagtactg

SEQ ID NO: 28879 - DNA, 1297 bp, Bovine  19866880901601
taaatataaattaatttttttaaaaacccacacaaaataaggtgaaggcttctggctgccttgtaaatcaaaaacatggtccccaaaggaacaaaataaatccacaaaaaatccaaaatatatgagagaatttgctttatgataagcagggcatcacatatcagtggggcaaagaaggcaatttaataatgggtgttgtgaaaatatcttgttcattcctcacctgtatatcatgataaacttaaaatacattaaaaatcctggatgtaaaaagaaaccataaaaacatcaaggagatattgggagaatttaattatatccttgaagtgagagagctctttctggtgatgactccaaatccaaaagatatgaaaggaaggattaattcaagtacataagagaaaaataacttttcatggcaaattacaccataaccatatcaaaaatcaaatgatcaattggaaagaaaattgttataacaaaggctgaatgcacagcacataagatccctcaaaagtcattttgaaaaatatttattctacacataaaggcagtacattatacacaggcttttagctcagtgatagcttcttcatattttttcatctgttcttcattgtttggggaatatgtgatttcttaacccagtcccctattgatggacatatggatttgtgttctttaatcttttgctttaaatcattttttaaagagaaacaattttgatgttcaagagcttaaactgcctgtgggttccaattttggctattttcaattttaagctgcttaaccttgaccttgggcctctctgtttccttagcagcattgtgggttgtaaggtaatagtatcaataagatgagatgtttgtgaggattccatgtgttaacatctaggtgaaggacttagaatagtacctggtctattagttattacttgttgatattattatcactatgtgtcaaacaatatatgctttgtgtgtgtgtgtgcacatgtgcactcagtcactcagttgtgtctgactctttgcaaccccatggattgtagcccaccaggctcctacatccatggaattgcccaggcaagaaaactggagtgggttaccatttccttctcgaggggatcttcctgacccagggatcaaacctgggtctcctgtattgctccgatatgcttttaattggctttaaataaacctgtgtttttataatgtttagaacccatagtaaaagagaacttcagggggagatgctatttcttaaaggcaaaaaagtgggatccagcaacgaggaagta

SEQ ID NO: 28880 - DNA, 1575 bp, Bovine  19866880942349
taaccaagcacgcacacacacatgcacattagagaaagaaggctacttaatagcacactctgttttaacaggatcaggtgctctaagctctcagaggatgtgtgggtgtgtgttagtcgctcagtcgtgtccgactctttgtgatcccgtggactgcagcccaccaggctcctctgtccatgagattttccaggcaagggtactggagtgggttgccatttcctactccacgggatcttcccaacccagggatcgaacccgggtctcctgaactgcaggcagatcctttactgactaagctacaagggaagaccctctcagaggatacaaaagagcaatttgagttgacagtatgggacagagactcctcagttttcaagtgagagagaaagggcagcttacaacaaaccttaagccaagagcaaagctggagagatgccatggtcagctagtagcagctaataagttgactaaaaacaattcggacaggagaaagtttgccaaggagtcccacttttatgacttaaactttattgctttgatttcctaagcttagagaagtcaaattttgctattgcacctggattagcattagttctaagttcaggaaggaggagaggaaacatttactgttcctgaaatagaaaatatacaagtatggttttaaaacagaaatgctatgatatgctatggtatggccacttgtattaattagattaatcttcctgctgaaaatcactatataaactaagtaaactacaaacaccgggagtgtgaagttatcacaaaacagttacagcagccagaaggtgaagaagccaagactgagaggtaaaaggaaccccaaagaggtcagcctgtatacctgtgggggattcattttgatatttggcaaaactaatacaattatgtaaagtttaaaaataaaataaaatttaaataaataaataaagacattaagaaacatggaaaaaaaaaaagaggtcagcctgaagtctctgcccctgttggccttaaagcaggtgctgattcttcaattataaaatcaccatgtacgacagaccaaggaagagctcatggagctacgacattttacgacaacacccaagggaagaagctcaggaaggaccaatgaaatattttgctcttgaggtcaggtagtcctgtgaataggataatcagaaacagtagatgttcctttataaagcaaatcatctctcaagcaaaaccagattattgggccctgaacaaattgcaaacataaactacgattgtcagtagattctgagctactccgtaaaccacagcatatttttatccctttgagtgattcctccctgctaataaatgtgaaatatttggaaaagagcattctttgaagttgaagccaatctcattgatcttctctcagaaatggacctgctacacaaacagctttctcaactccaaggaaatccgcaataaagcaaacattttaccttgttaaaagaatttttcaagtcctgataattaatgtctcttcacatttacatgaaagacttttgcagaaaatcagttacttctcttctgcaagtt

SEQ ID NO: 28881 - DNA, 1385 bp, Bovine  19866881007629
gaagtcactatgcacagcctacacgtaaggagtggggagtcagtcctgcctcctttagggtagagtatctatgtaactttctggaatttttacttttacttttttctccagatatcagcattgtgcccacaccaccataggctgttatggattgcaaaactaagtctaaacaaaaattttccctctaggaaattttttcaataaaagtaaaagctttatgataaatctccattctttaaaaatgttagacacagagggaagataaatgaggtatttgtgatggtggtggtgatgatgatgctagatgttgtatagttttctttctagggaaaagtattgcataaattttatttctgtttgaaatgtttgtggcagccccccaggggcccagacctcccactacgcttgtacccttctgacttactttagccaatgaaatatttgcagaagtgatgtgccactttcaagtgcaatctctaacaaccttcctgttgctcctctatttgtctttgccctcagccactagattagcatttttgcaaataaggacagccccttccagaaatgaaggacacacagagccctctgccatatcacagaggacataaacgtcagcaaggaataaaccactaagatttgggggtttgctgttatcacacctttgcctgacctatccagtcagactgcagagtccttcctgagttcctaaaattggagtaccaagtgctatgcttgattcagttctcttcagtgatcacctctgaggtgtagcctttcaggacctgtttgtgtttggttatgatatagtatgtttgaaaatgacttcctattaggtttaaaaaaataacattttttatgagtgaaaaaaaaaaaaatcccatcctttagttattacactgtcaacaaaattaattgaatacccactaaatttttttctgaatattagttttagggtgatgccattctaaaagatataatatttagaagtaatggagaaagacatttaactagaataatataccagaggtagaataatataccagaagcttccacttcagagaccctcatttgcaaagatgccttctaaggctctgtatttataatttagtattattttatttagtagggccccaaatatgtctcagcttcagatgcaccaaacctggctcttcccttgcatactacaatatatgaaaggatgaaacaaagagctataagagttataagaataacaggcaacattcccagtctttgtatgtgacttcccagaaagtgttctgtgcaaggtggccctaaagtttgggttccttggtcagatttaaaactgagtcagcatgtgcatctttaataagagaagaggatatatccaacgtcaggcagagcct

SEQ ID NO: 28882 - DNA, 1339 bp, Bovine  19866881011687
ttggtgtgttttgtttgttgagacagttcctgctgacccttcttggctgtcttggttctgtaaatgttggtgtgtgtgtgcatcttctgaggagtgggtctatggttttcatcagcttctcaaagcagttcttgatgccaaggttaaaaacctctgctttgtagaataggtgttcttgtgatttggagaatcaaaataataaagttagaagggactagaggaaaccacctggcagctaggcaattagaccgtctaggagatagagtgagttatccttttctgggagtggctcgtccgtgactaaagcacacagctcttcacctgtcaaaaccactaggcttcaagtctgcctctgggctcgagagcagttaggcgttctgatgaagagccctctgttgttccttatcacactgcttctgcaacctccttacagcttcaagctgttgaaaatgattacgggacaactgaacagggcctggaacatatgtccagtacagcttaccaaggatgaccttaacaaataaaacccaccaaataggttcttctgccaaccaacttggtgagcgtcctccatgttgtggatcacacaagctacaacctgcacaggtgggcatctctcactgcatgtcaagctgggtttctggtaagtgtgtgggatggtgacaaaatgcatcagaagagaaggcagaatatttggatttagtcctattctgcctaaaattaccatgtccctcacatgcaacctaagggaattgaggagggaaggaaccagaattttcctctctttagtactcaaaaagagccaatagagataataaatagttatgttcagcgaaacttctcaacactggtatggggcttattattattttcattttttagactaaaaacctaagattcagacaacttaatattacgcaaatagtaagtcacagagctgtaattctaacttatccctttgttttttattagtaaactttattttttaagagtagttttggttcacagcaaaattgagtggaaacgagagagagttcctgtttatccccagttctcacatatacacctcccacgctattaacatccaccagccctttttttaaacacacacaaaaaacaatcttctttttccatcataactcggagattctaaacacattcacgtagtacctaatgtgttggagaaaaatcacatttaaaaggccttgttattaatctttgtaagcaaaaaatgtttttgtaaagtaaataataaccacttcatctgttttctgagtaaatacagagttttgcaattaagagctttccttagagtagggtaacactaccaaaatctagt

SEQ ID NO: 28883 - DNA, 2562 bp, Bovine  19866881074566
ttttgaaaggaactgagatcctagttttatcacacacacacacatacacagacagaggaatcttcttccttttagataaaatgaaggaaaggagacatgaattctgttagatatattctgactcaagacaaagagtctaaatatgatggtcatctcagactcaccctttgtccaaaccttagaaagacagattgttttccgtggtcttcggttcatcactgctggtcctcacacatctttgagatttcggatgtatatgtgcttcaaaaaaattgtacatcacactttactcccctgcctagaacagtctgtgaaaatgacttatttgaatcacaaacttaccgttcaccaggcaggggactttgaacgagttgcttaactcctctaagaatgagttcagtcatctctaaaatgaagataactctatggctgtaggaattaaagtgagataatgtatgtaaagcatctagtacaaattctgggacatggtaattattcaataaaagtaatctgtcttgtcttttccttccctttccctctatcaaaatatattctcaggaagaaactgaggtcagttgtttatacataagtgagaacttgtccattttttcattttttaggatactctaaagaagtagatgtctactgacagtggtggtggtagtaatacagttatgcttactgtatcctttactatgaaagttattgattagctggcttatcctctttacagaaacttaataccgaagaagtcattccatgcaggcagctttctactctgcgtgcagaagaagacttacgccaagtcacattcagtgatatgcttgttcgggtagcactgaatggctatctcagaatgacctgtcctcagagctgtatcccagctgactcaggataagagtaatcgtgaaagtgaagaactaaagagggcgggtgtgggaaagcaattaggctggacttctgtgaaaattcttacaaagaagtcacagtaattagcagaatggaaaatatgatcttcagccacttggagccccactggacatacatatctgggcttcccaggtggcgctagtaattaagaacctgcctgccaatgcaggagacataagagatgtgggttcagtcactgggtcgagaagatcccctggaagagggcatggcaactcactccaggattcttgcttggagaatcccatggacagaggagcctggcgggctacagtccagggggtcacaaagagtcagacacaactgaggccacttagcatgcacacaaacaggcacacaacagcctagcccacttcaggctggagggtgtgagaaactgtgtaagggaggcttgaactgcctttcaaatatttctcagacactccttgctgggatacttgtcagaagtgccctaagtctgtttttctagagacatgaaacccttattcaaggacttgtggagagaaggcagacatggcttcagactctgttctcaatttttactggagggcatacctcatttacaaaaggagagttagattatgtgatcctgtaaaacttggcatagagaaactgaaagcaaatatttaccctacaaggactggttagccatgttaaggtattgagacttaccttgtatgattgtaaggaagtttattgagttattaatgcaatgatgttatctctgattaataaatgttaggaaactgctgtcagatttctggtaaatatttaacaatacttgtgaatcagacagcagaaatggagtaaaatccgcccaccccatcccccctcccttaaaaaaaaaaaccacatttttcttttggctcaaatcaaagtaaaatactttgtcctatgcaattggcctctctgtcactgtgcatcttttaagtttctgggtcagcactgtggggaaattgacacagtttccaaaggaccctcagataagtttgctccattttgttgattcgtatgaagaaacacaatacctaatttttactgagaatatcctaaaatgccttaatcctgactttgaccaaggaaagtaagaggtcttttggcttcttcattgctctctgtctgtggtacgtacatgtgtctgtgtgtgcacatctgtggtttcgtctgtatgaatgtgttcagaaagaatatttgcaacagtattgagatcctgaacgccaagacaaagtttccgtcaacaaatgacagtgttgtctggaaacttctttttggtgtcaattctacctaatacatttcagctccttcatagcctgggggttgtgatagttgatgccatgggagtccagaatattggcatgtgacttcaaagaagagatcaaagagagaaattctaggggagttccaagtgtgttctgtagctgttggtggagagtagcaaacatttataattcactagtagtgtctacactacatcgaatggagtagagatttggtactcattctgttattcatcggttgtctccctacgttgatagcacacaccaattagaataattagctaattgaccgagctctactttgtcttttgttttatagacagtcctagactataga

SEQ ID NO: 28884 - DNA, 739 bp, Bovine  19866881238471
ctgttgtatttttttttttttccctttggaaaaagtatcaagtgttcccacgaattttagagaacagcaaatatcaattaggaaacaccttttgaactatatgtcaccaatttaaaaactaacgatgcctcaattctggaagtgacaaccaaatgaaaggtattttcaggtccttggaaacacaacaccatgagagggagggaaggaaaatagcttctttgggaaaacacaggcacacccacacacacggacatctacacagtaatccatgacaatccactcatgttccttcacacatgtgtgtatttgtgcctctgaatgttctcattgctaagtttagctatgtattttctatgggcctattcatttagctatttttctaagtcaataatttctgcaaagcatttcactctgtctctaacacccagaccaaacctctagagcacagaacattcacaattaatgggcttcatgtacttttgtttccaagcattgagttgtgtcttgactgaggttcattttcacttgtttcaaacctgtaattataaatttacaagtgaagtaagtgtaacaaggaagaaatttgctgtgtctatgaaaattcagtttaaagttctaatatgttttaagaaggggtatcattaaaaaatgcttttgaattaattgtgggcagaaaagttgttacaagagatcagggaataaaatgttaacattttatggacattcagcactctgcttt

SEQ ID NO: 28885 - DNA, 2907 bp, Bovine  19866881249361
tactaatccccagccctaatccccagtggtggtggaaggtggggcctttgggaggtaattaggctgagattaggatgtgagggtgggacctgcatgatgggattaacaacctgataaaaagagggggagatacaaactctctctccatgttgtgaggatgcagtaagaaggctgcaagctaagaaggatgcgctcatcagacatcatgctggccagcactttgatcttagactctttagcctccaggactgtgaaaaacatttgtttaagcacccagtctatagtatgttgttataacagcctaaactgattaacacagattgctattgaggaaaaaaacaaaaacaaaaccccaaattcttctcataagaatcttctagggtctctatcaaaagaaaaagacattttataatactgaagcagggaccaagccattgatttttttttaagccttcacttaagacaatagttaggaccaagtgaactcacaggaaacttccaaagtctgctcaagattgctatatgaaataatattatttgttataggacagattattttaagaacagaaaaatggatgggaagcatttctatatattctgcaacattgggttatctgcctccaaagataacttgaagattaggacttagtcttttcagaacattctttcactggtcttattttaataaaagcaattaggcctttttcaataaggggttcactccctgccacctcaggagactgaataatatgagagaatttacaagcctcatgttgatttcggaaagctctcacagtaaccgtcctaaacttgtatgtaagagtgtcctggactggccccttcctgcccactggacctgttgtgcacatgcttcccaatttcatgttcagtgaggacatgttggtagcttgaatttggcaggagtacgtatttcatgaaaatatgcaaacagtgccagttaggacctaagttttccagaaagctggttgttaaacctttaccagcatcccactgtttataatccaggtcagcgtcttcaggcatggctcttgtaccatgtctttttggattaaactcttcactgattcatagaagaagaatctttatatccattcctttccggagaggtttccacagttatgacaactgtttcttcttttctgaggcacagccaccttgtgttctctctgacattcagatggcttcgacagaggaaaagatcacatgactgaatcactggatcgtgcacaactgaatcacaactgagtgaccagtgtgtttttagtggaaacagatttgccaaagggcactttttattccaaatgaacatttttttttccagtttatttcatgcttactattactgtcttaagcactataagggatacaatggtcgtttcttacagaatcctttcaaacttcctaggaaattcactgaatttctaataatcagagaaatttattagccaggactaatgaaatatacaaaacaaataggaaaggcaggtagtaagagccaatcatttaaccttctgaaatttgcaccaaatgatccatattttgaacaagtatacatgcttgaggggcagaggaagcagagaagttgggaaaatttgagaggtatttgcattcaacttcagtaaaatgttgaattactattgtctccagagattgtattcttctgattcatttaggaaaatttttctggacttcttacacttattttttatattcttcttatattttttatatttatttttatatttattcttatatttatttttcctagattcattgaacttttctgattcttcatggtagtagagcacatacaatgtaatattactttaaaaattggagattgcatagaactcagccattattctttcctgatgaagcagaaaacatagttttggacaatttattaactccaggacccatatttttgtaaatgaggccccaatttgagcttatcttttttatcatttgcttgtaggaattcagtatattctactaatgacgttgagggtactatttaattctaagggagtatgattccatggttttcttacaagtctagggcatatacctatacactaaaaaggttaactgaggattttgcttgtttgaatatgtgtaagttatcaaactttgaataaataacattttagagtatttcttaagatttccacattatactatccaaattctgttaccaaatagaggaacacaggaaacagtctcctaagcaagtctattaatagaaggagatttctgtttcaagcaaagggaaggaggaaatctaggctttatttcatgtacacaccatgtgaccaaaactgttctagctgtttcacacatgttcatcttgaatcacagcgattgtgtaagaaattttgtctccattatggagatgaggaatcagagattcaaagacatgtattaactgagtggtaatatagttggtaagcagtatacacaagaatggaaattaaggtttatctaattctagagctaatttttattttcattgccccttgctccagaaatatgtctatatatataaacttttataaaagaaatttcaaaatccattttttttcagattctgaagcagtaaagtctgtatcaatatatttctgagtccaaaaaccaaaattatccttacagatcaatccccaaacagaaatacattttttatgtattaattcaatattgctcaaaataaaaatcacctgagacatctgcttggtctagagataaccctaaaagagggatgtcatgtaagtttcatttcctatgtcagatcttatcccttggtagtggctttgaattcctgcgtggagaagaaatctgaagttatctctggagtcaaggaagtaccttgggattcatcagagatgagga

SEQ ID NO: 28886 - DNA, 763 bp, Bovine  19866881365389
aatagccagtttttctttgcttatttactgtagaaatgtggaaaatccctgtgctgggttatttactttgaatctggctgaagtgacagatacagattctagaattttatgaatagatgatatataaataacagattcatttattttaatatgtgctttgagtctttatttggatttgtttcttagaaaacactgctttgtagagcattatgtataactgctgtcatgtgacttgttttgcagtaggactctcttcagtataatttagatgctagaggggccagaaaaatatcactagttgtgacatagtcttattactgacatcttataaatatggagcctataattcattacagtaatacctctgtctaccttttgttgaaatcttattattggaaattagtacattatttgtattaatgattgaatatcttgatttatttcaataaggtgtatgaattgatgcttcgagatgaaagattttatccttccttcagacagaatgcactttatgtgcgcatgttagctgagctggatatgttaaaagatcctagtttcagaggatcagatgacggtgatggaggtaaggtagtgcacattgtacatttatccattatatatgtatattcctgtatatattctgcttaccaaatagcataaaaatgttcttaaagctgaaatataaattgtaatatattttaaaatccatgaataaatgatgaagtttacttacttaaactaaattaaaatgttaaaatctgat

SEQ ID NO: 28887 - DNA, 1571 bp, Bovine  19866881394062
ataaatgtgctaaatttgatacagtgagtgggaaatttttctcaccacatggaaccactaatgagcttgggaagtaaacatggttaagtagacatagttgcctttttgttactgtaattctgaattggcccattagcatgaatatcatttcagtacactttgcaattgtagctttgggactgacccccaaaccccaagccaaaaaagaaaattgtctataaatgacagagctattgtgggttagattatgttcccctaaaagatacattcaagccctaacccctggtacctgtgaaagtgaccttatttagaaagagggtcattgtagatataatcaagttaagatgaggtcatgctgaagtagggtgggccgttaatccaatgtgattgatgcccttatccggggaacagaggtagacacacagggagaacacctgtgacaacagaggtagagatgatgtgatgcagcagcaagccaaggaatgcaaaggattgccaatcaccaggagaaggagaggcgaggaaggagtccacccagagtctcagagggagcatgaccttgctgacaccctgatttcagacttctggcttctagaactatgagagaagaaatctctcttgtcgtcagccacttagtctatagtagttatggcagccctcagaaactgacattagaggtaacagtgggagcagtgatgaagagaggcagtggtagtgctctgtggatttgcattctcctgtagcttcatgtcttcctgcctctcccctgtgatcttaatataaacatcagaaaattggggttttgtttcttcctgcatcacatgcctttgcagcactacttaatctctctgggtctcatttgcttcattgctgaagagaggatctcgcacccttctgagtaacactagccatcatttaggggaattttgcctatccagacccagggctcactgcttaacacgcatgattttatttactttttataagaattctatgaggaatgtattattatccctactttacaaatggatcaaataatgagatttctctgtgactccccatgttttcttgtcctctcagagacttgaacatgagagtcagagctgaaaaagtgttagtatttatgtttccttgatgggaaaggtaacaacagatatgtaacttgacttaatctgcgtagaagggggttaaaggcattggaaagggatgttacaatcactttggtcatttcacactttctccatgtgcagaacagagagtaaatattttttaaacttctctttgatatatttgactcctttttattttgaacaaaatattagtataatttccttattttctgacttacttgaaagtttatttatttattttttttcaggaaacctaaattttcaatgatttttttttgtctaaaaatgatagtaataaacaattttttaaaaaccaacagctgcaaaataaggcacaacaaggcattatatactgacaatgcatatttaaaacagcataattcattgtggaatagctctgtaacatatttaatttgcttaatttgctcttcaatgtatcta

SEQ ID NO: 28888 - DNA, 1142 bp, Bovine  19866881403486
cagcagcagcagctgcagcagcagcagcaatgggctcctagctgcctaaggttacttgaggaagctcctgtggttagtttgtatccactgtgtgcctagggcacacctgcaggagttggaaaaaatctctgtggttatttttgtagcctatctgtgagctcacccatatctctcctggatgtgtctgggatgggctttagagatcagcttacatccctttccactaggctaccccttgttgctcatgcctaacttcctacctaacacttggattttcccagcttcacctcttgctcagcagatggtatttccactgagcccctttggtataggagcaggaaaaaacccaaaactcagttggctctgggaccagagaacactcacctcttaagtcagaagtgtctttattctatttctggatctcaaattagcaccttttgtttagtggttctcctccaggggtttgctttcttggaacagtccatccacttgcagcaagtttgaaataagagctttcagggttataggtcatgtggtatcagcccagttgatctcaacacctctgataaacagcagcaaaagaaaggactctttccacgtgagtttcttgtctgtccctgaatcttagggaggatattattccttaccccgaaaagctatcatcttgttctacaaaggccaaataaatataattaaccccaaatttgtgtttggctgaccaatcagcacagtcataaaaagataacgttcatgaaataaatgacgagacctccttgacaagtcaataaggaaaaaatcttgagataaatcaagatgaatgggaaatcagctggaagacatcaaacaggcaaagcaggtgcgttggcctgtgtttgggaagatgaagcacagcatgaggcatcgtgcacttacacaaaagtgagatctgtaacctttgtcaggctttgaactgagctaaatgcatgacttatttaagaagagctggtcgctgggaactggttgaactaagagtgtcaagaccaattctgaagatgttttctcttccttagcctgtttttctgtgctctgaggactgccaagcagccagtggcagatggcccttctgctaagtgtgttttaagtgatgtgagggatggcatgat

SEQ ID NO: 28889 - DNA, 973 bp, Bovine  19866881418104
tgaatactacagtcctatgtgatcctggttggttaaatccaaagatgtagaactatggatgtaggaggccaactgtaagttagacttggatgtatactctggctgcagagggtcagcacccctaagacctctttattgttcaagggtcaactgtggttccttgactcctgagaattccaccaagctgtggaaaggaggctaaccctggaagaaagataggtataagcttattcccactttagaataaagcccagtgaactgacttgaaggaaagtcatgcagacgaactccaaggcaagtgctcttttgataactatgctgcctttcctgcacacttcagaaatgaactgaacagtaaaagtgccgaaatctaaagaatattctagaagtccatgtgaaacctcttcagaagtagatttgacctctaatgtagggtgggggtgaccttttaaatagtttagaaatctaatgtttatgttacatcaaatttttcatagacctcacctcctctgaagacacagaacttcctgccagctcccgaaacagccttgggagtggtgggcatcatgactcacggtcaggtaaacattcctttgagacacatatcagcagatttgttattccattactgtccaaacagcagaaaacctcaggaggtaaaattggattagtgttgaagaattcagtctcacctgttctcttttattcaaatcaaacttttaaaacattctctgtggggagttcatttttgctcctaaaaagggataagggaaagatgtgtggcaagtctcagtctttggagtcaagccttattctggaactgtttcatttggaaaccacacctaactcccagcagggaaatcatctgacataaaccacgacctgcttgcaggtgtggaaaaggaaggagttggcatcaaacagcacagtgtataagggtaatccacagaattctataaaagcccatagcact

SEQ ID NO: 28890 - DNA, 602 bp, Bovine  19866881511892
ttcgtggaggacacctgcattccacaggcttccaagggctcttttgaagtatctccaggagctaaacagcctttccagaaggccgtgctcgtaaagtgtgatggatgctctcccagatggccccattttgctcatccagtgctgtcatccaggtagagagaggacagcctcctgccagtttgccctaaaacaaggtcactgatcgtgcagtgaggccacttataaatatttcctatataagtgacatctgatgtcaatacactactcttttaaacactgatctttttggttggctagggaaaaaaaaaagacactctgtttctaggtttatgtagctagaatttcccgtatgcaattttagcagaatcaaatccatgaacagcccatcttatgccaggctgtggttacagcaaagggcctgaatgggactgtttccttgtacagtatgaaaagcaaaataatttagtcattgatgttgttaattaactttataaatagaaagaattctttatagccctctgtgttctggtttcttccttttgaaagccctttactcagtctcaatgtaggtatttatgaaacattttgcctagttcaacata

SEQ ID NO: 28891 - DNA, 1245 bp, Bovine  19866881865416
cctctgaaactagagtcttttaacatatgcagctcagctaacatgtgcacataaaatgcagtctgactgaaggaaggataaaatctttcatctcaagtactcagaaaggctcaacaaaagataacagaaaaagatgatcaagtgaaaggtacagaagaagatctcgtagataccttctttgaagctgaaatgcaaaaggacatttgtcatgacctactgtgctgtgcacttctctcaaagatgaagaaggattcctaagggcttagtgtgaggtcttcttgtatttattgctacctcctggagatttccagaacaagatcatgtgatctttgtcaggaaaatccttgcatgggaaatccttcttccattaataaatcaactcaatgtcctgattatattaatcaatatatcttatggatgatctgtgattctgattgaaagtatgaggactttattaacatcattaaattgagcaacaatattggagagctagaagctgtcagaagtaaagcagcagaagaattacagtatcttcgatctctagatacagctggtaatgatatcaacaccatgaaaaatcaaataaatagcttattatttgtaaagaagtatgtggttcaaaaatacaatggttgcagtcagacaaagaaatgaatgttgaaactggcagcagattttgggaaactttgcatagttcccctggacagcattcttttttattttatgttattattattatttttttactttacaatattgtattggttttgccatacatcaacatacattcttataggcagtgtgaactccaattttttaaagattacatgcagcaaactggaggtcaggcacatctcttcttctgaatgacagtgaaaggataccaggttatagaccagtagcagctagaagttttatcaagtcaacagagagatggaaaacatcaaaaccaaccacaccaaagattttaatgtgcagcttctgttggaatttatgaacaatatttattagaaaggcatctccaagagttactgttgatgattatttggtgggaaatgttagtaaacactttgaatcatgaagatcaaacccatgaaatctctaatcacattcaaaggaaagtttatgaattgatcccacctccttctttttgttccttactcttccaaaacctatgtagccaattccttgtgttaaattcatgttttgaaactattactgggtagggagagggtcaaagaagat

SEQ ID NO: 28892 - DNA, 631 bp, Bovine  19866882037319
accccacgtagcctgcctacaggtttgaatatcaagtgtgtttaggcaacaccctggtcttgtgggaatggatctcagcctccagctgaaaggtatgcaagacttcccactgagaattcattctgtcctggtaatggtaaggagttcccatcagaaaattattttgctgtgcctaaggtaaatggaatttcttgtgagtgctcttttcagaaaaaaagtaaaattaaggggatggatgcatttaaatgtcttctatctgtgtaagtatccaaattgtacttctgaatgtccttggcagaggaacctcataattcagaaagttcacggctgtttctcccactcagttggagcatgctttgcttcctcttaagtaataatcaacattgcaaaacttgcaactatgcaactagcaaactgttcccaggaaatacaactgtgagcttttgctcataacaaattgtgttccctgtctcctgcagactcttgttcatgggtttcttggcttcagcacacctgccatttggggactgatggatcttgattgtggggagctgtcctgtgccctgcagaattcttcagcagcatctctgggctcaggtcatgtctcagctcaggcgctagaatagaacat

SEQ ID NO: 28893 - DNA, 752 bp, Bovine  19866880415482
ctagcactaccaaaagtgacagttccaagactgcgatgcactgggaggtcacgtgctaagctgaaggctctccactctgctccacaggagagcgcgctcccagcccctgacaaacagaaagcacaagaggacataccagacatataggagcggccattgcagtcttctatgtccatcttagagagactctgctggaagagaaaacagctactattagaagccagatctggaaagggagtagtttttctaacatcctggagttagcaagaaccctaaaggactacttaagtgtgctctgaccctattctaacaaagcaaaacctcagactttgtcctgatgacaaagacgatgtaccctgacttccaaaaccccagggtctcctccaacccccaacttctgcaggcttccccagtctctcaggtggaaacgctgtctcattccgaactggtccctgattgtgttgtttggagagtagaccctctctctgtaagtgaagctgatggtgtaggaaaggagacacgttacagctcagtgctcatcaggcaaagaaacaaccccacagagtcgctacactttgttaagaagggagtagtaatctaagaagtttagatccagtcattcaagggaaacatgtttgggtgggcggaggaagggggacgggaaagtagaagatagaggagagtggcccatctcaggttcagaaaggggacattaaatccttaagtgggttcttcttactttttgtcaatta

SEQ ID NO: 28894 - DNA, 2253 bp, Bovine  19866880430289
tcagtgtcaggcatggtcggggaagaagacccaggtggagggtggaggtcatgggaggacacggggtagggagaagtcttgggggagagtcagcacttgaggtttgcatcctccttgccctaccctatctcaaccccagtcccttcagggttctggagggagctggggaccagtcccagaggaggcctggggtggcaaggggaggaagcagcccacagggcacccttaccagcagcatgcaggggtgtccacttgcgtttgcgctccttgatgagggcagaggcgccgtgggtcgttagcacctccacacactcagtagagcctcgctcagtggccaggaagagcgcggtccggcccttgtggtccctcacgtccaggttcaccagcgtctcagccagtgtcttcagggcttcacagtgaccgttgtaggcctggaggggtgtgggaaatccatggataaagctccagacatggccccactctgctcttggggcccacggggagactctgggcagcaggcctccccgtgagctccttgggcccctctcagaccactgcctgcttgccacatccccacgagaaggcagaagcaaggacggattcacacgtgctggtacctgtgagccggcctggggcgggtggggacagggaaggcaagaggaaaagacctgggactcacagctaagtgcaaagggctgactggaatggtgctctctacatcctccaggcagttaaaggacatttctaagagctgcaatggacagaacaggaggtgctgaggttctggtattcccaagacatcacccttgactccacccacagcaatccccgaagtccctggatctagagaccacactggattcaaccaccccttggcctgagaatccagacacagaagcagactgcgtgctgggccctgccctgctcccattccccaaaccaggtcccacacgtaccagttcgaggttctgtctattgccataggcggctgcatagtgcacagctgtgtagccctgcctgtcccgcagggaggggtctgcaccgttatccagtaagaattccaaacagctgtgggacaggagcagatggtgaggaagggacaggcctagccagggagggtacagtttgggaggagcagaggatagggcaaaggagcccctccaggctgaggtggcccacgctcacccctcactcttaggaggctaactccggcccgtttgacccagacccaccacctccaggtctgccctgaaccactctagctcctcgaccctttgaatgtgctcctagagaccctggagcacaaccacagttaccaatctgctgattgaaacactcttccccacctccaggcacactgaccctgccttctcctcctagcccattgggaaaaggcctgcttgtctcacactcactcccagcaccctcttctgtgcgaggccctccccagccttcccaacaggtgcctccttccctggcaccactctcacagatcagtagcaactctactagtagtaatagtaatactgcatttaacatttacaacgtgtccaacaccgttttgtgtagtaagtgtgtggtaaatcacttaatcctcacaatgatcctttgaggtagatactgttcttatcccaactgtgtctgaggaaactgaggcccagagattaagttacttgccagaagtcacacagttacaagttaggcctcccagattttaaatatctttttgttgttgttgttagataaataaaccctttaaaacagtcataaagaaaaattacaaggataatagagttcccatatattagtcacccaatttcctctattattaacatcttacactagaaggtgtaatcttggggtattaccccaagaataagaatctcggggtaattcatcttttatccttaccacctacaacagtacttggtgtacctattaagtaaatactcatttaatgcttgaggaataaatgaatttgtgtttagcttttctgatcctctcaagaagaccatccatttcttgaaggaagtatctctcccacttctgcctgtacccatggtgcttggtccaggattaaactcagggtgtaaggcagcagaagacagtggtggagaataacaggatgggaatctgccctgctgggggaggtgcagcccaagggtcttctctgctactcacaagaaggcctcctttctgcggggactccttcaggggctcatcctcttcagcatcatggctggaaggtgagtg

SEQ ID NO: 28895 - DNA, 1139 bp, Bovine  19866880523105
cagatggtgactgcagccatgaaattaaaaggcgcttactccttggaaggaaagttatgaccaacctagatagcttattgaaaagcagagacattactttgcctacaaaggttcatctagtcaaggctatggtttttcctgtggtcatgtatggatgtgagagttggactgtgaagaaggctgagcgccgaagaattgatgcttttgaagtgtggtgttggagaagactcttgagagtcccttggactgcaaggagatccaaccagtccattctgaaggaaatcagccctgggatttctttggaaggaatgatgctaaagctgaaactccagtaccttggacatctcatgcgaagagccaactcattggaaaagactctgacgctgggagggattgggggcaggaggagaaggggacgacagaggatgagatggctggatggcatcactgactcgatggacgtgactctgagtgaactccgggagttggtgatggacagggaggcctggtgtgctgtgattcatggggtcgcaaagagtcggacatgactgagcgactgatctgatctggtctgatctgaaattgactggaggtgctaacttaggaagaattggtgtgaccaagaatttagttcttttggtgtggttcgtgtcaaaaatgccaatgtcagcagcttttacacccagctgtccaacatttttgttatttacagagacaacacaccatggatttctcttgcccaaggaaaagatattcacctcactcttgccaaagtgaacaacaggaaactgattatcaagcagagcatcaggtgaaattatctcaaggtgacaaaatctgtggagtctttgtacttaattaacaataatactgcatcatatagttagttgttaaagtatgtccaattagtgtaacatctaactgttgctcaaaatgactctttcatcagccttagtgacccagttgccagtgacagaggtagaaataggcagaagaagtgtgtccaatcagtgagttattggccatcacttgctgtatatctgtcatctgtataataaatttaactttttctgatggggaaattaactctaaatttccttgaaatttcaaagtcttaaacttacaccattgatcctatg

SEQ ID NO: 28896 - DNA, 864 bp, Bovine  19866880523952
atttctgtgactgctggaattcagttcaacccgtttggctcaggaagtttaagtagggtgattttggggttggaaacttccacgtcagccctcttgccctctactcccattctcaaccctggaagctttaaacaagtgcttaagtaggtgagtattgagggagaacagggtttggggaataaggtacaaatggggcacagtgggcaggggcccatctatttaagtaaagccaaataccaaaaaatgaaataccaaaaaatgaaaagtcataataaataaataaataaaattcccagatcctcacttttgcccctgccctcacttcccttcccccagccactgctggaaggagaaagagaagaagctaagaatggattttgatttcctctcttactgagaatggtagtcaggggacctccccagccataccaagcccctcaccttgccagtggaagaaaggaggcttggcgtggggctttctcttagtactccatttctgtctctttctcgtggttatctctgcctagtctctgtctctcctgcatctctatccctttgccttctcactgctgctttttgttcctctgtctctatccctctgctctacctctgtctctagtctctctgtcttcttgccaaaccttctcacctcagacattccccacctgaccatgcccctcctctcccccctttcccccaaacccctcatccctcaatcccctacctgcctccctcggttgtattgcacaccgtgtgggcagggaacaaggtgtgatgttacatctgaagaggtggagggagctctagggcctggggagcagggggtcagggctggggggagtctaggggcagggtctgttgggg

SEQ ID NO: 28897 - DNA, 1877 bp, Bovine  19866880532940
acccgagtcccctcgcccacctgccctccagtccaccccgtggagccctctcccgccccttgccccctccaggacccttctcacctggcagtgggctggcactgggcaggaggttgccctgaacagctgccacaatggcagggctctgggctgcggcggatccgagccccggcccaagaggcaaagaagatggcatggtggtggtcgccggcaggttaggatgtagagggttcgccatggacacaggcaggttaggtggggggagagtggccggggcaaacgggagatggtggtgatgcccatgcaggttaggaggaggggggaggttaatactgatggagtcggctaggctaccaaatgggatgatggatggagcaggagggggagccggcatgccaaaaggcaaacccaaaggagcattacccgccacgcctgggtgcccgctgcctggcactgcccctggcatcattgagggaggagtttgttggttggggaacggtgaggggcctgggaatgaagaggagagatggagaaggttggaggcatacaatctcactcaccaactcactctcacagtgaggataacccagtcactcctaggccaccttcccttttcctgatactagaactgagtgataaatccttggaacaaaattccaaaaatctggctctggggagggagccctgctgacttagggaatagccatggtgaaggaggatctgtagaaactgaggtcaatccttatctccagtcctatcacacactgcctctgaggggaactggaacgtgcccccggaaccctccactcagccagagttccagaagccatcactcaccatggggtccagggggggggtactcctggtgggacggccccaggctggggggcgccagctggtggctgctgctgtggccccacagttgaccctgcctgcccaagctgttcggagggccccaagcttccaggaggggccccactgcccgcaggagccggggccacagaggctggagccatggccaagccatggacagtgggtggcccagcagcgcctggtggtgggataggctgggagcccgggggcagggctggtggtggctgctgctgctgttggtgcatctgctggaagtgctgctgccgggcccgcatctctgcgtacttcagctgctccatgtggaaggcttgtctgtcggccaagagctgctgcctctggtactccagctgccagggccaatggagagctgtcacccgggggcaggaaaccccaaaggcacacaccttgccccctgctttgtcttctgacaagcccagcctcccattctggtgatccccacaccaaacctcagccttgtgcttggcttctgctgttctcgcctcccctcccctctccagttccccccaccaggtcttctggctgcctgcatggcttctcactgcagtggacaagtagacttaatctggtggcagcccttgttcattttcagctccaaagctttgaatttgtcattactttcatctggaaactgaccacccacccccaaccaagttcctctagtcaaatcatgttctttccctccttcaaaactgaagaaaaactcacaattcctaggaagccctcccaaatcacctcactagcttctgagctttggcctctattctgctctcactcagggcttttatacttgattggaaatctcttaattttcatttgtcagatacttgaagcattagccaactttgctgtctccatattggatatatgatatcttcaattgaggagttcaggatcagagtccttgtcttctacttcttttatatcttctaagaatcaaaaagattcgacaccatgtccatcctatttcctttccaactttaacc

SEQ ID NO: 28898 - DNA, 877 bp, Bovine  19866880533529
aatatcacatcctttgtgaataatcactacttctcgttcttacagcatagattaatttgctgtgtttttataatttatataaatggaagcatattgaatatacccttatatgcctgactacttaaactaaggattacgtatgtgagctctattcgttgtatgtggttgtagaaatttcaatccaggctagggtcgggagttaaagtgagagttcggctgtcttccagtgcctggccacggcggcggccctgggagcagaggtggagcatccccattgcgtcaaagatgaaaggctgaggttggctggccctgcttctgggggcccacaaaataaaaaaaagaaatttcagtccatatgcttgttgtataatattcaacttaattaacatgtagcaatatatcaattctactgttgatatttgggtaatatatttttagtcaattattaatagttccgtgttgaatattttcctcagtgaatttcagtgaataattgtgtgccttcatcttgggtatacatctaggaggagactttgctgggtcatagaaaaatgtgtatgtttggctttcaaaaacattgccacagttttcaagaatgcttctgccaatttacactgtcatcagtaatgtaagaggattctgtttattttacatcctagctgacaattgacatttccaatctgatcattttgtggtagtatttctttgtggttttaatttacattcatttaatttctaataaagttgatcttttttcatatttttatttccatgttgacagtatcttttgtgaaatatttgctcaagtctcctaccatttaaaaaattgctttgtctgcttttgattagtgatttagaattccttaatgttttctta

SEQ ID NO: 28899 - DNA, 639 bp, Bovine  19866880548004
ccctatcctggggagggtccttctcagacccagcttcacccccactcccattctgtttattgtctggctgtctccggtcctctagacaagagtcagatcacccctctgttccttctcccactcccatgccagctaagcccccctctttggggtgtctccggggcggtggacacctgaggggtgctggggatgctggcactggaggagttctgttgatttcttcccctcccccccagatctcagcttgaggtttggcactgtcagggccccttccccagggtgggagtgggagaaacacctgtgcttccctcacagttgctgggcctaaatttagaccctgggatcttgggatgtgaacactcccagctggtagagggcgggggtctggggattggagtgggagagatggagtaaagtgactgtctcactgttccgctcagacccctggaatcttcagccgggaacccaggagtcccggatcctggccgccttccctgagggagacaggaggcaggcatggttgggtctctttaccctttatctggctcctgcagcctctgggcatccggccccgtctcagtccttctatagcccctttgtcctggtggtgatgggggcgggggacttgggggagaaggc

SEQ ID NO: 28900 - DNA, 1329 bp, Bovine  19866880568656
agtcagtgcacataatggaaggtgtctactctgagttgcacagtgtggtggctgaagtgggtgtgcctgtctccgtctcccactttgacttgcacgaggagatgctgtgggtgggaagccatggggtaagaactgtacccctttgaaagggctgaaaggagatattgggggtctcttacctggttttagcccaagaacaactgctttgcagggagccagaactgagttgaggtgatggagttagctgggtttctaaatcaagccaagaggaagggaggggagggagaaggagggagtcatagaatgtagagatggattacatcggtgttcttattcagaaggtatcccacttcttccacaatttgtccattccatgctttgattaatcttgataactacgcattcagttagtctatagccatctgaatacagtctctaatgctcttcctctgttttccatttttataattataggatgttttctttttgaccatgccagccgctttggggatcttagtacccctgaccagagatcaaacccgggcctgggcagtgaaagcatggagtcctaaccactggacaggcagggaattccctaattacagaatgtttaactactgtttctgcacatattacatggaatcattttgtctttggctgactttaatctctccaggagcagttatcattgttcatttttaaaaatgtatccatattgccaatatactcgggagcccaaagattttggaagaaataacatggtgtccgtggtttatttactttccataggatgtgaattgtttttctgttggaaagagtgaattttttggtaatacattcatttcagtaggcactgtctactgctagactaggctcagggaataaagcttaataaaacataatctttgccctcaaggaggtcacaggacaatgaaggaaaaaacccaagtatatgaatgtaattttatggcattttattttattttttattttttttaaattttatggcattttaaaagaaactaaaaagtgtttaacttaataattatgaatttgggatatgaacttaataaatgccagtgtgaaaatacgtactggatgttggtgagcaaagaagagaattagaggatctccagaaggaagtgacacctgagctcagtcttgagagatgcgtaggagccagatgaaaaagggggaaattccgttttgggaaaagcaatggaataaacaatgattcccaagctagtacacagcttggtgattgcacagtgcaggaactacaagcaggtagggtttactggaatggaagatgaagctgaagagttaaag

SEQ ID NO: 28901 - DNA, 1883 bp, Bovine  19866880572637
tccttgctccctatctggaccctgggttatccattccctgaggttgtctgttttgggggggcctgtgccgggctatacctggccaccagacaaaatagagcagaaatggggcaaggtgacctgaggacagcaggtgtggtatgaagtttggcttttatggggagcatcaaaggttcagaaaaagttggagccctgtatgctgaaaaagttggaggaagggaagactgcggatgaagaattccccaataactacttttgcagcttacctggtagaaaggaacctatgcattaagacaaacatttaaggaaggggcgcagattagtaaggcctgacagaaccattatcttacaaggagagcagggggtgctgttctaggtaccagtgatacaacaatgaagaagacaggcaggggagaagggtaaagaactggaaaacacagaccgaggagtctgagcagtcaatgccaccagggctgctaacctcctccacaaacactctttgctgatactgtgccccccttctctcttatcagccgaccctgcggtgcagacagatggcagccctctttgctgccatttccacttcagccccaaggtgatgttcacaaaggtactgaaggcccagctgtgggtgtatctccggcctgtgccccgcccagccacagtctacttgcagatcttacgactgaaaccactaactggggaagggactgcagggggagggggcggaggcccggcgtcacatccgtatccgctcactcaaaattgacctgcactcacgttccggccactggcaaagcattgacttcaagcaagtactacacagctggttccgccagccacagagcaactggggcatcgagatcaacgccttcgatcctagtggcacagacctggctgtcacgtccctggggccgggagctgaagggctggtgagcagggagcctgagatactggcagatatgaataacctggccctgaggaggtggggtgttggaagtggtaaagcaggaatgtaaagggggttagggaccagcatgatttttctaggcctggagctgactctagaggggttaggtggtggtggtgatggtggtaatagggtgataccagttttcagagatccaaggcaggccaacagttgaaaactgtatttggggtgaaggtgtgagttaatagattcacgggacaacaaagatgggctgttgttgagaccttgggccaaggggctgatgagggtcaggttgccaagagagagagaattagggaaggtgagtttagggagacatggctagctggcaagaaaagtgggtagaaaacaggggttggggaggggagcactggagaagactcagaaatcacttggtctctgttctcctgcccctactgaggggcaggtgagaagaaacagggagtaggagctcctcgaggctctattacatctctttctcctctccctcacccccagcatccttttatggagcttcgagtcctagagaacacaaaacgggtcccggcggaacctgggcctggactgcgatgaacattcaagtgagtcccgctgttgccgctaccccctcactgtggactttgaggcttttggctgggactggatcatcgctcctaaacgctacaaggccaactactgctccggccagtgcgagtacatgtttatgcaaaagtatccgcacacccacttggtgcaacaggctaacccaagaggctctgcggggccctgctgcacacccaccaagatgtccccaatcaacatgctctacttcaatgacaagcagcagattatctacggcaagatccctggcatggtggtggatcgctgtggctgctcctaaggtgggggacagcggatgcctccccaacagacc

SEQ ID NO: 28902 - DNA, 1916 bp, Bovine  19866880573383
aacataatgttgcattgaacaggaatgggcaggaacaggtattcccttctagacagaagatttcccaccacacttcctgacaagcagcaactgagaccagtccaaggtctgacttccaaggtcaggcttcagctaccatccccatctccacaaaaaacatacccacagctctaactattggtgacaaaaatatcagaaagtcaagttttctctatgtactggctctgaaagcctgaaataaggtggacatcacaagtaatgaaagctcttcaaatcctccaaagaatcctgtttgacccagtgatactccaaaattggaatttaaaacacactccatgtggcttcatgggtagaaaggtagtgacaaggatgttgctgaaaaatgcaggtggaagtggagagagggctaagtctccatgtcatccttttggttgcagtagggagaaggggaatttttttcctttggtctcacttaggatctgaagtgaagcccagggatcattattatttttaaaatatttatttatttggctgcaccaggtcttagttgtggtatgtgggatccttgatcttccttgcagcatgtggaatatagttctctgaccaggggtcaaacccaggcccccttgggagcgttgagccatagccactggaccaccagggaggtccctccccagtgatgatgatgatgatgattttaatttttatggaggtttagttgatttacaatgttgtgttagtttcgagtgtacagcaaagtgaatctcttacacatatatccactcagtgggcagcaaagtcattatgttttgtgcttgagaagtcaacatctgttgagtagaacaagatataattctgaagctgccaaattgagggcatctcccaccatcctggggcccaccccagaaggtccactgagacctcttctgattcccaatggtaaggctattttcttttataaagactttatctcaggagccactagtttgacggttcttgtgatccagggagctgtctggattctctgaattaggctgtaagtggggaaggccgaataccgcataccgcataccccaaagaaagattcactgacctactggcagacccatgaggagatgaggaattcctggctggacatttcacataccctaccaaataagatgccacacccagagtgtctaatttggccttttatctggtcttgtcctcagaatttgagttatcttaagtggaaatattctaggtagtcagacacctgttgttaattcttcctaaagtggctcagatagtaaagaatctgcctgcaatgcaggagacccatgtacaatccctgggtcaggaagatcccctggagaagggaatggctacacactccagtattcttgcctggagaattccatgggaagaggaacctggcaagctacagtccatgtagccacagagctagacaagactgagcgacatttttttttttttttttcctcccaaggaaaagtagcagtaaggggaaacagtcaggcctcaatagtcttctgtttggtcatgatattggaaggcctagagttgatctgtgagcaagtcacaaccacaccaggctcaccactgatgctctgagggctcagactggagagactagggtaagctggagctctcaaacatgtaagtgggggtgtttaagtcacaacagtagacagttttggagaaggaaatggcaacccactgcagtattactgcctggaaaatcccatggatagaagaatctggcacgctacaatccatggggtagcaaagagtcagacaaaactgagggattttcacttttttttttcccccaaggatatgaacatgtaccttcacacaggcaaggtgaacaagtagcagtaaggggaagtagccaggcctcaaaagacttctgt

SEQ ID NO: 28903 - DNA, 635 bp, Bovine  19866880590159
tcccccactcggtcatacagctcgaaggcctccttgaactctgaagtgtaaggagaggtcagtgttgacaaggggttcccatcaccaccaggagaaaggaaattcagaaacagtgtgctttgagctgggcagaagagaggacacaaggagcactagtgtgggaggtttcaaggtcgggaatagaggtaggggaatagaaagaggatctgactggggacttgggatggacactgggctcaggggcgtctcctcaccctccagctggtccttgttaaactcgatctgtggaagagaacagcatgtgaggagagatgacaggactcactcaatccctctccagcactcctcccgaccaactggcagccacttcgggggaggggcccatagggaccaggctgggaacccagccacctcagtcccattcccagctccagaacttgggagaatcccaagaggaggaattattggggggagggtttcctgggaacagggttaatcccatgccacctgttcccctccctctactgccctgagccctgcatccctcacataactgggggctgaacaaaggctaaatttacccctggcccccagctgtgattgtctaacaagtctgtcctcttcagccttccctc

SEQ ID NO: 28904 - DNA, 946 bp, Bovine  19866880593291
tggtggcaggacgatgattagagcaatcatgtaacagccaatgaggaacttaatgcagaccgtgttgttcatgatggtcgtgtaatgcaggggtttgcagatggccacgtagcggtcataggacatggccgtcagaataaaaaactcagtcacagccaggataacaacaaaaaataattgagtggcacatgcattgtaggtaacagtgttgtccccagatgccattgtgtagaggaatctgggaatgcagacggttgtgaatgacacttccaagatggagaaattccggaggaaaaaatacatgggtgttttgaggtgaggatctaccagagtgagagtgatgatgatcaggttcccagcaacactcaaaaggtaggttagaagcaaaaagatgaacagcagaatctttagattcgggtcatcggttagtcccacaaggatgaactttgttattgctgtgtaatttttcatccctgattcctgacagtggttgtgtctgtgtgttaaaaaaaaagagagaaattagatcagagaactagactgttacatgagttagcagagggatgacatgaaattcctagctaatgttaacttagttacataagccaaggttttattttatttacctgtgaatcaagaatgctattttatttacctgttaataaagaatgctaatggagcaggggttaattaatcattattgctactggattctcactgctgagcattgtactggatactagtcagaaggctctactaaagattcttattactatatcaatgtagtattaattcaatagtaaaggaattatttggttaacaacttaatggaaaggaagctaggctttattatcagtgttaatgaacagaaaaacactgtcataaaaatacacatggtttgtaatttcctgacaataaaacctcaagctgtgctgtcatcttggtt

SEQ ID NO: 28905 - DNA, 1162 bp, Bovine  19866880600464
atggactgagtttgataattttgtttagtgtgaattaacattgtgtttatttaagaaaaaaaaaatatttttttacagaaaccctactgaatttgtagggttttaaaataacatgatgtctgggatttgcttttgaatgcttcagccaaaaaacaaacgaacaacaaaaataaaggatagataaagcaaatgtgacaaaatgctgatagttgttggaccttggggagacacatgcagagccatcacatcactttttttcagacatctttcttggtcagttataatcattttgtttgtccccactcccaatttctacttgcctctagtccatcctcctcactgcttgccaaagtgatccttctaaaacacaaatctgatcatattcaaaaagcttttgaagggtaagttttatggtatatgccatatatcagtacaacaaacaaaatcgtctgaggtgccgttgcctacaggataaagtccaaactcctttgcctggcactcaaagcccccactctatcttcttggcctcatctctcatgatgtacatcagccacattgctagtgtctgctcatggccttctgcctagaatgctttatgccccagccaactatttactgtcttcttcagtcgaccagagtgcaatttacctgtttaaaatctatcattttgttatacattgtgcatgtctattatggctcatattaagcaatgccttggattatagtaatttatgtatatgtctatttcatatactttaacctgaaccccttcagaaccatttctttttcatttcttaagttctttgcacctagcccagtgcctggtacgtcgtgggtattcagtagattaaaatgcactttaaggaacttcccttgttgtccatcaagtggctaaggctctgtgctcccaatgcaggggaccagggttcaatctcaggtcagggaactagatcccacaggtcacaactaagagtttgcaagccacaactacctgacctcacatgccacaactaatcgaagatccctcgtgctgcaactaagtcctagtgcagttaaatatatttttttaatgcactttgaatgtgagaatgaatgatgtgtcacagacactgttgtcccctgagaagggagtgagtaagatttgagggccctcatagtatat

SEQ ID NO: 28906 - DNA, 2503 bp, Bovine  19866880602068
tttaagaacttctacattaatttccctcccctgtctcaatattcctaagttttcccaatcttctccagggagcatggaacttcctttctcgggaaactctctgagaggtctcactgtttctttccctaggttatcatggttctttactaaaaccttgcagatacattcttaacttcattttacagatctggaaactgaggcccagagagtcagagggtgttatcatgagccccacagctgactggcatcggaataagcagaccggtttccagagtccctttccacgcgtctctcccaagtgcttctctggggcaatgcttcagtttagtgacaattcccaagtatctaacctgggattcaaggggtatttggaggtgccttttgtgtggagggagtcagatctgctgtgagtcttggacttagtgtactcagggttcgttctacactatgggctttgggatcctgggcaagttattttacctctttagtcttcaatttatgaatgtgtaaaatgaagattaaaactacagtgtcatagggttgctgtgagaattattcataattaagataatgtgtcaattgttttcaaaaacaatattctgacagccaccaagtactgtagaactgtctcttggctgattcccaccagggagaagaaaggtatagagatgtgggtagatttacattgagagaaatattttgtattcagggaagaaacactcattgagcagcttactatatgttctattcatcagcatgttctgtctacagacatcaatcagtatacactgaagctgaaggaaaagtacattttagtgattgctttcttaaagggattctgcttcctggttctattccaattgactcccccagggagctagagagaacccctgactttgagttcaagtcttcctggttctgcgcagaaaggttagagggtctcccctggaggccagcactaccactggcgttaggagctgatcctgaagtccaaagctggtggtactttttcattttgtcttagttttcctttggttacatatcaaaggcaaagatgagctggacttaacggtcaaaacagatagagatgagaaaggaagacaccatttggctgggggtgttgagggaggtaggccctcctcaatccctccaccccaaaacacatgtgggggtgggcagtctcagtcttacctctcccacctcccacagcaccaaaggcctcctaccccaggggctgctcccaccgcaacctgggctgtacatgcagcggtttccagcagtcccaaggtcagggggtgtggcacccttttggatcccttatcaccacctccgcgggggctgtagagtgacagcatggaggacgtgaagggcaggctaaatcgctagcgaatcaggtgaggccctcggtgaacccccccttaaaaagtacttacacgtggagtttgtataaatgctgcccttacgcatcctgcatgtgccatttccatgtgcaatactgcgctcgcgacaccctgtctgcctcagcgtccgcgcttcccacgtattccagctggaaactctgctgcatgtctctgttcagcctgggaccctgagtgagggaaactccactgacatgcctgtctcaatatctgtgtgtagagtgggctgaatttcttatcactacggaattttgaaaactgaaatgaagaggagagccaatcagtttacacagagagaagaaaggttcttaaaacattttcaagaaaacagatgcagagtgtcatcaggttgtcgtcaagcctggaacctggaggtcagtagaacaatgttttctgaaggagaatcatttcctgcctagactcctacacggagaccaccaaaggagaaaaaaaaaaaaaaaaaaactactagaaaagaaccaaacactttcacacatgtaaagtttttaaaggcacttccttctcctctcaagaagctgctaaaggatgtgcttcaccaaaacgagggaggagaccgagagaaagatgtaagatcgaagaagccaggatgccaaccccaggaaaggaaaggggactcaccaagatgacagcaaaggaacatcccagggacagctataggccaggcagagaaaccgccccgttcagactgaagccaatcaaagactccaggaaaggttggtcaagatgaccctgagaagactgtgttttggaatattgaaagaggtttacagactgggagcgaattagggatgggactcgtgatcagtaccacaaatatagctaaataaatggggaggggaggcaatcttattccagtgaaatataaaaaactatggaggaaaagggaacaaagtcatgattaccttaggagactcagttgtgaacaacgtgagcacagtcatgataatatgaacactgaacttgaaatgatcaaatttgaccaaaatgatcaaagtgtatcaggaggatgggggaacaggaagtgggtacatgcatgtggtggagatgagggtggggtagcagag

SEQ ID NO: 28907 - DNA, 1971 bp, Bovine  19866880619139
cccatgcacagcaacaaagacccaggctcaattaaaaattaattaattttttaaaaactaaaaaaaaagaaatagtcataaaggtgctggtagactcaatgaaatgaaatggagaagaggtcaaggaccagagaaactaaagagggcaaaaagctgattctatgggtgtgtggaagtaaaaaaggtgactgagtaaggaagctaaagtaagtgatggggagccctgtcactggtggtgttctgtgtagtaggatatgtagtaggtgcagactgcagtggttctgatgtgtagctggcttgaaaattcaaaggaaaatcaataatctcatgttgaggaattataaaagtattgcagggacttccctgttggtctaggggttaaaagtccaccttgcaatgcagaggacacaggttcaatccctggtaggggaactaagaccacacatgccctagggcaactaagtctgtgtgacccaatggaagattccacatgacacaaccaaaatcccctgtgtggatgcagccaaataaataataaatatgtatctttaagtattccatagatgctgagtggagacactgagaaacagaatgaaatgatatgatacgtcttgtccttgtgggcagtggatgttgaccctgaagttttagagaaaatgctacaattgcatggcaacatcttccaggagaattacagtgacagtggtagatcaatgatctggaagcagcaagggaaagcaaaaaagcagtgtgattccttctcttctacacggtcacatgagaacagaagatacctcttgggagggtaaggtgagatgtcatatctgaattttcattaaatcagtttaaaaaaaacagttaataagtagaaatgtactggacaatgagtaatattttcaaagcacacatcaaaagaggcaaattgaagaagtacctactatgtagagagcaagagaacttgtaccactttgaaaggtgatgttgcagagaagtagcagagacttgggttgtcattagataccatatgagaggtgggttgagaagtaacatggaaaacaagaaaagcaagaggcataaacgtatattttaaaacagactgcatgtaccaaagtacacacacacactcactgctattacaaatacacaatgaggactacaaaaaaacagtaactccttgccttgcacagcattttataaattgctttcacatatactatcttattcgactgtcactgaatagatacgcacatttttcctaaagatgaggcaattaggatggggcatagccaaaatgaaaatcttgattcccaattttcaacatatcaacctcacatacacagcagacacttcagcatctcaatcagccaagatggaaaatcttctctgactagaagaaatagtgggttctataaacttgtcagaggacttgagaggccactagacaccttctcgtttaccttctaccacctcagatccctcaactcttatcaccatcaccagagaaggtaccgaagggtgatgggtggtgttatcaaggagagaactccagctgaaagttgtattaggttcctcttctcctcacacctctggacctcagtgaactaacaattaagatgaggaagagtggaaaaagaactatgtagcaatgaggaggtctccaacagatacagttttgataaatagtatttaaaaggggctccggtagggtagaaagcaggtacactgagagatgggggaggggaaaagggggggatcaggaattggagggaattgagagtggaggcgcccccaagctgaagaacccaaaagagatatgggagctccaagtgctagagaaaagctaagggctcgtgagggtcctggatcaaggaccagcattgaaggaccccagggcttgggtaaccggaagcggagacccccgaacaagagaccagaagggggcgcaggtgacacccccgtaggagagaatga

SEQ ID NO: 28908 - DNA, 1451 bp, Bovine  19866880632548
ttatttaaagtgatagaaatatcaaacataatttataagtaggtattgcaaaaagtagggtgtaaaatgacatgtagtatcattgccattatgtaaaaacaaaataataggggaaaaaattgtagaaaaaagttactggagaaaacatatattgaatgtcacagtgcttgtgttaggatgatttctttatatttttgaaacgttttataatcatttttattactatatagtgaaaagaatcccaatattaattggaaaaaacaatcatacccaacaaaccatacaaaaattaacccaacaacccgattttttttgtaaatggaaaaagtaaaaggtttgccctttatttttccacaactctatcccattgattgtgcttcacgctcaatttcccatggcagttatgacacatggatcccagccagtgaaattgaagcgtctgtggaagacgctccaactcctgagaaacctaggaaggtgagctttgcttgtccgccctccctcccccaagaatactggggccagaccgctcttggaggtgaacagagaggctcctgggcccttgggttcctctgttaagggtccccagacagaacgaaggcttccaggcctctccccaggacagtctgcctttgtacttcaggttcatgcaaaatggattctggacacagacaccttcaatgagtggatgaatgaggaagactacgaagtaaatgatgacaaaaaccctgtctcccgccgaaagaagatttcagccaagacgctgacagatgaggtgaaaactctttttcgtttctcctgagcccttagtacaagtctcagaacaatcttcgctggagattgttggctgacatctgccccaattgttcaacgggcaggtgaacagcccagattcagaccgacgggacaagaagggggggaactataagaagaggaagcgctccccctcaccttcaccaaccccagaagccaagaagaagaatgctaagaaagggtaggccagcccctaaccggcccctgccttcactgctctgtccattccctggttaaggaaggaaggactaatcccctcccataactaccaggcgctggcctacaagggaagaggagatctttagctatccagtgtctacttccggtcctggccactcaaagagagcttaatctgcagatgaaaggtcttcgcctcttccacttactttgtagtgatcagtttcttctttgctcagttctgctgtcgggttttctctcccttttttcttccttgcagttgtttttcttaattaatttatttttggctgcatctggtcttggttgcagtgctcgaggttgctcaagatcttccttgcagctcgtgggctctctagttacagcacacgagctctagggcattcaggcttagtatttgtggcatgggcttagttgccctgccacatgtgggatcttagttc

SEQ ID NO: 28909 - DNA, 1067 bp, Bovine  19866880678691
catgggattttccaggcaagagtactggagtggattgccatttccttctccaggggatcttcctgacccagggatcaaaccccagatctcccacattgtaggcagacgctttacctactgtctgagccaccagggaagtcctaagaaagtacctaagtcctaaggaagcacatggacagtacctaagacatggttctgtaattgttactttttatgtaaagatttggtttagaagaaattatatgtgcaaagtatcaagcagaatacttgagtcaatctaactgcctgataaaattctagtttcctttatcctgcagatattgccatgacctcctaaatggttgttctacctctgtctctctgttccggtttgacacactgttaccagattactgctcaagtgcaatttaattatgtaaagttgttcagtataatttgtcaactgttaaatttggcatatacccttctgatctttatttttctgtgcactttaagaacattttttaatcagacggtatttacgtttttatgtgttgccttttcatttaacctcatgacataaatatttttccttgctattaaaaactctttgtaaacatcttttaaaatactggcagagtgttttatttgagcatgcaccctgttaccttttttctgttattggacttccagattgtttctagaattttgttataaaaactcgatgaatgtttttgtctgcatttaggattttttcttaggatagatttctcagaaatagacttactggattggagggtacaaacttttatttatttttaattaattataaaattcatattgtttatagaaaacttagaaaatattttcataactagtgtaaagtataagtcacatgcatgtttggtaattccagagcccaaagatgactacagttaatgtttccttttagtttttctttctatgcacatatacagcattatctatttaacataattcggatcatactgaatggctgtgctttccaggatgtaactctcagaacacttagtagtcctgtgagatgtgctataaaataaaaggctaaa

SEQ ID NO: 28910 - DNA, 1435 bp, Bovine  19866880711238
aaattggttttcctctaaacctaacacactgggacacttttttacaccaccttattaattgaatttgtccttactggctttagaagccctgtgatgtgcccagcctttgtacagtgcccttggaaaccttgattgttgtccctccagaagcttttgttttctcttctacaaagccagtcctagagaaaattgtgtagatgtgtatgtgttttaaatcctcactaggctttgccatttcctacatcctgatggtatcctgtccctttttttttttttttgtcactttcttctatacatctcttcttatcttttctaccttccccttaatcaaagcctactttcaagaaaaatggtctaaaattgctccacattagggtgtaaataacgaagtcatttaaagtattaatcctcccaagaattcttgctttttaaagagggagttaaagaatggaaattatcagtatagaatttcaaacatagatctggagttacaaaaatatatttggagaagaggagtttcccattgctcttgaaatcatacctcatcccttctttttgcccaggagcaaggattgctcttttacagtttgcttgtttgtgctcactgatacgaatttgacttaggaggggacataggtatgagaagcaagtgcctgctccctaatcctatggcatttcagattggtaagtaataaccaaagtgtgagacagtgtatttaaattaaggaaatgcaacagcctggttggaggagggataccttaaaaccctacacaatacactcccacttcccaaaagagtgttttaggaaagatttagtcattgactgaacagtaactgagctgagtaaggagccacccaggtgagcaaagtgtgcatattctaggtcaggttgtagtttctgttgaggggcagaaaccttttcagatgtatgattttttatttttcctttttttaaacttgtgtttcttaagtttaagaattaatggagatattgaaccaaagttttttttagcacttaacattaactgaagattcagaaaactttgtttttaaccatagttgcctcagtgttacagtgggagggctgcatatttggtgtgattaggccatctgaagcatagtaaagtaacgggtgacaggaaaagcagttagcccatgtgagttgcaacagtaccttgtgggctgggtcccaagagggccctctatccaggggagatgacaaacaggcgagagagcaatttggcctattaaaaacgttcccaaatggaaataagattctgtccagaaggggaggagtagatggaggaagcaagcaggattgctttgacattaatgaatacctactaggggacgacagaaaatgagatggctggatggcatcaccgacttgatggacgtgagtttgagtaactccgggagttgtaggacagggag

SEQ ID NO: 28911 - DNA, 1005 bp, Bovine  19866880738702
cctctgggcttaaggcactttcgggagacaggtccttggggtcccattatacagactgagtgggaaagggaggggctagggtcccttctcccccacttttgaatcaggacaccgcttgcccttctcaccctcccccacgacccatccctgatttaccccctttcatctcacagcatcataaggggaagtttggcaggggggtggtcctcatgggggacagagatctgtgccccagaggaaagagatcctgccaaatctggatgggacaccagtaacccattctaccctcgtcatccccaggagccatatctggggaaggggtgcaaggggcctatgggccaggccaggtggagaaggctaagctgtgcctggcactgtgtgcccatcagagcccagctctgggtgcccatccccagccaagatagggtgggcgtctgggccctcccgccgggggctgccccagttgttcctcaggatggtacccgtcttctcctccttgaactgctgccggtcttcccgcgggatcttcaccgcatggtactggggtacggtggcttcggggtaccgcgctcgcttgaagaatcccatctggaagaacagcaggccagacatgaggagcctgtggggcacagccctggagcacaggcccggcacagcccagttgctgtcccaccatccctgggacagaaagaaccaacagcagcctgtgccagaagcagcccacacaggtgccaaccatcatggctgggttcccccggtcctcatgcacagcaagagaaagaccaggaagggcctgagctgcaggaccgaggacgtctcccttggcgcctgaaagaggggttgaaggtagaacttcaggactgctgtcccaaagatttcaacacccctaagctttttaagagatgcaacagcatccctgagaacacaaacaagatctaagggaaaatatggcttcctagactcctgcgaattccagaatgattcttctcaagcctcatacacaca

SEQ ID NO: 28912 - DNA, 1230 bp, Bovine  19866880797796
caatggtcatgtatggatgtgagaattggactgtgaagaaagctgagtgccaaagaattgatgcttttgaactgtggtattggagaagactcttgagagtcccttggactgcaaggagatccaaccagtccattctaaaggagatcagtcctgggtgttctttggaagtaatgatgctaaagctgaaactccagtactttggccacctcatgcgaagagttgactcattggaaaagactctgatgctgggagggattgggggcaggaggagaaggggacaacagaggatgagatggctgaatagcatcactgactcgatgaacgtgagtctgagtgaactccgggagttggacagggaggcctggcatgctgcaattcatggggtcacagaaagtcggacacaactgagtgactgaactgaactgaatgttcctatgttgatttttctttggattttcatagcctgagttttactggctggatttctggggtttaagggaaaaacacagactttggaataagactccatgttctcgggttcaaatatgggttctgtcacttattgataagtcttagacaagttatttattctctcttggtttttaattcttcactagtaatgaattattttataggttgtctctacctattcatttccctaagttaaatgaatacttggcacagtgctttgcatttatggattgctcaagaactggtagacttactatcatcatatcatcatcatacataactattcatgttatgtgtcttgtatctccctcggtgtatagtatgtcttacatgtagtaggtactcaacaaatgtttgatgaatctctgctttgtatgcatgggcaggttgggctttctctcctatcctgaaggcactcctggtgggaaaatctcctccacttcccattctagtttgaaaattcttctgttctgtagtaacatcttgagcattcttgtttggtttcctctcagtcttaagacttgttcatcttcaaaaatgtgcgaaagtgaaagtgaatgctaagttgtgtccgactctttgcaaccccatggattatatagtccatggaattttccaggccagaatactggagtatgtagcctttcccttctccaggggatcttcccaacccaggtctcccacgttgcaggcagattctttaccagctgagcctcaaaacatttagtagtaggtataatacgctacaaggaggccccc

SEQ ID NO: 28913 - DNA, 1825 bp, Bovine  19866880811840
atgctggggactcgcttcccagcagggtaggatcccaaacactccaaccccacctccaaccttcgggggcctcaggttcatttactcgctactctctgccttctccccgccccttctccccggcttcccgcttctcgccccaaatcccgctcatcctctcggccccaggccccaccatcttgacgctcagctctgcgggaccttttcctgcagtaatggctccggttcctggcccaaccctagtcttagtacgtgctaatgacgtcaccccagctgacccagccaatggggatcctggcccgggtttatgcagatgatgctactatattagtaataaggtgggcgggggccagctggtgttcaagtctccagaatagccctacctggggcacagaaactgcagaacaaggtggaatggggcgcaaggaatctgctcctccgagcagcgagaaagtcagaggaggtcgcattggtgggtgcgggtggggaagaggagccctccctttccctcccccacctctaaagaaagcaagagtcggaagctaagggaggaaacgtctctttattttgaaacaatagcctcctagtggcaggaacgtgcttttgcctggtgggggcccagcgtccgacccccctgcacctgtggaaaaagatgaacgttgccaaatcctgccgctgtcgcgcagcaagacacggaaatgcacttccctgcttttgtacgcaggcagagggacaggaaggaggcttgcctctcaaggcgcagtgagagtgccctacctgcattgctcagacgcttaggatgtgcttcaggaaggctgcagagagaagaggccagaggggcttcagaagctggcctgatgataacccatctactttagataattcaggctccaggatgcctccacccacatacctcgggcctcctgcctccctcctccctagtcgtttctgctcctctggcccctcaccttcgtagttgatgcagccactgctgtcctcatgtcctgccaaaacagactccacctcctcttcagtcatcctctctcctgggcccagacacagtgttttagcccctgccttccctccctcatcaacccacgcctctttcttctggtggtacctcctcttctcccagcctggagagttgcccatagcaacagtcccccaagagaattccctctttgtagtgggcatgccttgagtgtgtctctgaatcttgctttccatttcacctcagttataggtggtgaaagctttgatagacaaggaaactgaattccagagggttaagaaacagaccatatcatagagtacagccatctcttcccaagactgaaactcagatttcccacctcgttccctttcctctgcccctttgggaggcagctgcagcccactcactagactgaagggggaagaccttcagatcctgtccctaaggctctgaccttctcagtctccttcccatgacccacaggacaggaatccctcattggctctgcctacttggctaaccttcttagttcatcccctcctctcaacacccccaggagttctggtccctgcctcacccagggtggtgaggacatgtctgagctcagctcccatgactttgccattctgctctttgtcaaacacccgaagcccctccaggtagtcctggtatgagcctcggtccggcaacttggcgactgcctggagcatgggcaggaaagtctcaaagtccacacggcgcgacttcagctctggagatagagaggtgaaggaaaggttactacagtgtcacctaggacccaactcccatccccaccatgaagggtttcat

SEQ ID NO: 28914 - DNA, 739 bp, Bovine  19866880814970
gttctggtgttttattgattgattttggttacactggatctttgttgctgcggccagctttctctacttgctgtggtctggggtgaggggggcctcctctctagttgtggtgctctgggttctcattgaggtggattctcttgttgtaaaacacaggctctagagtccttgggcttcagcagttgtggcttccagactctagagggagggctcaatagatgtagcacacaggcataattgctttgtggcatgtagaaacttctcagaccagggatcaaacatgtgcaagccgattactagccagggtgccaccaggaaagtctgacatttgtttttttccattgcaaaactgacacttttatccaaaaaataaaactcattaaaccacctgagcctggccaaaaaaaaaaaaaatctgatttttatagtggaggaaagcaaaattcagatcagctaagagttttgcccttggcaagtgggactgagatttgaacccaggtcttctgactctgaacgctagtggctagggtttttagttcaacaaacatctgtattatgtttcattatatactaggtaacaagaaccaggaattcatatatgaataagactagccttatttctactgccataaggagctccaaatctagtaggaataaatatgtacaaagtgcaaaaaatgtttataccaagggcagaaacaaatgggagcagaaaactctataccttgcattgggcatt

SEQ ID NO: 28915 - DNA, 1914 bp, Bovine  19866880830137
cttcatgtgtggggtaaataggggtaatacaagctctgcaaatcttgggaaccctgacttctcaaagacttgggaccagtttcccacctttgtccaactagctgcataactttaagcaaatcccttaacctttttgttcatcaatccccctgtgtttattagtgcattaattcatttaataaatctttagctgaacacttggcatgtgcagcgtaccatactagttgttctggtgattaaattagcctctaagacagttgataacttagtgatcaagagcacaggagctggagttagacagaactccaaactctaggatttgagcccaaactctctgttatagatgtgtgactttgagaaagatactgtctgagctttcatgtgctcatctgtaaatcagagaaaaaaaggtttctatgtcatagtgtgtttgtgaatatccaagggtttcatgaatattaaatcttttagcatagtgcctggtggggacccagcactggttccccagctaatgtgaaaacagacaggccccctacaaacttcccccaacctacccttactgtaggaccttacagtagagactcttctctaaaaagtgctgaaactgagatacaagtaatgtctcacgagagcattggcaaaggttctttcttcaaatatttgaaagttttctggtacaaaagggctttgacattctacaagatatgcgaatttggccaagaccaatgaatgaagacttgtcctacaggcagaggaggccagtgctaaagggggctacctaaatagatggtgagttccccatgactgaagatgctcagagacactacacaacatccttctaagatgttttagataacatctgagcactgtcatgctgaaatatatgacccttgaaagtgaaagtcgctcagccatgtccaactctttgcaaccccgtggactataccatccatgaaattctccaggctagaatactggagtgggtagcctttcctttctccaggggatctttccaacccagggatcaaagccaggtctcccacattgcaggcagattctttaccaagcgagccacaaaggaagtccaagaatactggagtgggtagcctatctcagttgattcaagagggactgtatgaaaagtgctttactaaattacataaaggccaattgtttctatattaacatctcttttttggttgtgccataggctccagcctgaacttatggctaaagaaaatcagactttgcctgaattcctccttctgggattctccgacctcagggcactgcaaggccccctgttctggggggtgttgctggtctacctggtgaccttgctgggtaactctctgatcatcctcctcacacaggccagccccaccctacacgctcccatgtacttctttctgcgccacctctccctggtggagctactctacaccaccgacattgtgcccaggacactggctgacctggccttcccgcacccccgtgccatctccttctggggctgtgcagcccagatgtatgtcttcattgtcctgggcatttcagagtgctgcctgctcacagccatggcctatgaccgctacgctgccatctgccagcccctgcactactccaccctcatgagctggcgggcctgcatggccatggtgggcatctcctggctcatgggcatcatcacagccaccacccattcctccctcatcttcaccctgcctttccccagccgcccagtcatccctcacttcctctgcgacattctgccagtactgagattggcaagtgctgggaagcacaggagcgaggtctctgtgatgatggccactgtggtcttcatcatggtccacttctctctgattgtcacctcttatgcccacatcctgagtgccatcctggcaatggcct

SEQ ID NO: 28916 - DNA, 1589 bp, Bovine  19866880854078
tccttccccctcacctgtcatctctttagcacccccaggggaatacctggtgggttcccttctccttccttctggatcttccattttctttcctcactctttcttcctcccttcccttctactctagatctgagccccaagcactgggtgagttttaggtgacgtgggtgtgttaaacaacttgatcactaatgcctgctgtgtgtggggcttggggacggtgtattaagctgtttgtgctcctctgttccttaatcagccacttctgcctcttttcctcctgtgataactaccctctccctcagcttgtaattgtgaaggctgtaaacagcagtgacgtttttttgtgaaagtgcaacaggggagtttgctgaggatacttctttgtagcagtaccctctgaaatgaccctgtactggagaggtgagaagtggcaggctgggatgaccccagtcccaggccgctgctcccacttccttataaggacagggcccagacagggcggtggcgaattcctgccctgagtcgtgtaatgaggaggctgggcaggcttgctgcaggcggagagggtatgtaaatggccgttaccactctgctaagggttgaggaaggccaggtctttatgtgagacacctgagttgggaggaagggacactggatccctcttagagggcttgggtttacagtgttgtaaatatctgatttcctcagcatgatcaaagttgaatgggcagtggggactgtggaggagggtttgggttaacacctgtgtgtcccatactgatgtttatctggatcctcagagttcaaggaggccttccagctgtttgaccgaacgggggatggcaagatcctgtacagtcagtgtggggacgtgatgagggccctgggccagaatcccaccaacgccgaggtgctcaaagtcctggggaaccccaagagtgatggtgagggtccttaagaacaactccgcagtgtggtggtgggcctgcagtcttcaaatagcttccttttatcttcctaggccccaaacacaagcgggtcttgtctggcaaatcccacagatttctcctgcctggagtgggagccccttaaccctagtcctaagaacacatatgacttagcttccacctccttttcggcagagatgaacgtgaaggtactggactttgagcacttcctacccatgctgcagactgtggccaagaacaaggaccagggcacctacgaggactatgtcgaaggccttcgggtgtttgacaaggaagggaacggcactgtcatgggtgctgagatccggcacgttctcgtcacactgggtgaggctctgcccttccttcttgagatgccacttgatagacctcagtgtcacccaactccagaacactcgctcttccttcccctctgaaggtgagaagatgacagaggaagaagtagagatgctggtggcagggcatgaggacagcaatggctgtatcaactatgaaggtgagggacgaaccagggtctcggaggaagcagccatacggggcaggtcatgcacagcactgagggcttttcctgtccctggattcaggctcctaaaagtg

SEQ ID NO: 28917 - DNA, 979 bp, Bovine  19866880861701
aactgcaagggtggatgcctgttctgcttctcaaaggacttactattttaggacagaattagtaaaaattgtagggatcctgaaactagtcatgctcagaaagtatatatggaatgattatagcgagacaggaagaggaggatttggtgatcaggcttggaagtgagagacttctgaccaacataagaacagctgctggaataggatgaaaaaggctagtaaaaaacccacacaaacctgatgagcaattctgggcttccctggtagctcagctggtaaagaacccacctgcaatcctggaaacctgagttttatccctgggttgggaagattccctggaaaagggaatggctaccgactccagtattttcgcctggaaaattccatggactgtatagtccatggagttgcaaaaagtcagacatgactgagcgactttcacacacagctgtgtcaaaaatatggggaaagtgagttaagtatggagaagaatgattaggcttcaggaagagaatccaggggacagaggatgggggtgcggagtctgaatacccttctggaacattacagaggataaggaaacaaagtgaagaaaacttctgaaggacttagtgctccactcttctttatgagtgtctgctctattcttttatctcttattttgggtagaaaacccttactgaatctataatctctgtaaagatacaaaactgaactaattctctctctggttccattttcagagtgaaagaggaaaagctagctttaggatcagggcctaaagaaaagggaagcagacagtagagcccaagagagaagaggaggaagtttaatcaaccttcccttttgcacatttctccaaagtcttagaatggggcaaaattcacaacaaatgcgcagtctttgcatctgctccccaagacaccgtttttcctaaagcatctaaacttaggtccccgtcctccaggaactaaagaga

SEQ ID NO: 28918 - DNA, 1470 bp, Bovine  19866880889219
ttttggaaagaccttttttctttgatgggatggtctccttcttcccaaacatgagcagtcagggagagaggaaaggctaaccatgcacgctgagcgcctcctggaccacttcatgcagcaagtgtaccaacccaaccccacatccccttccgtacccacttcctccagcctgtcccaaagatgacacctgctgtgttgactcaggccagccagtctctggatggctctgggaagagattcatcaaagccttcaggtggccagtgttggtcacggtgtgagcctctagctggggcatacagagggctctggaggactcaggacagcatggtcaatatttgtccaggcgcctcggctattcagtcactgtctagaactgaatctcctaattttgtcccaactctgccaatccaacgtctcttacattaaaccttatactcaaaccagctggggctcttttccttaagggcagagaatcccacctacccatcaggtgtttattccaagtgtcaaaagcctttgttcagttcacaaatcaggtctgtttgtttatatttttaactgattatcagttattaaaaaagctgatttaagcatctgcagtggtgacatcaacctcgactcctggctcaatactggcggctctgtcttattaacagtctcagaaaggaccctgcacggccatgagttgcttgtggatcctcatcagaaaaacgattccaagttgtagaaccttgtagttattttccttgtagttactctcagagttttggggggcctcccaaccaggctttgagagtgtttccctttgcatctctgatcaagtcagcatgtactttctccaaagacgttacgctgcagctgcttagaatcggagttagattcctagaacctctggttcctggagtctaaatccaggccgtggggcagcttctgactgacatgttcctccgtgagagtgaggagtggggaggtaggcaggtgggccggagctccctgcagctgagactgtgtcttccttggagatcaaggcagaacccactgtggttgcagccaagattgctggtagtgctgagggtgctcatgtgacctgtgtgaattcactgaatttctggtgagattcattcccagtcacggtgatgatgtctattacacattctaatcttctgagctttccagggaaaggattcctaaggctggtgaacctgggagctctgtgccacggcacagagtcaaagatgttcagccacatccaaaagggcttaaggcccacgtggtgggcagctacaggagaaatattttatacgcattcaaagctgctcacccttggggctcttcctggaatgcaagtacagaagctgtgccctattccctctaactaccatgtgaagggaaagtgaagtggaagaagaaggaattactgaaaactgggtcactaaataggaactggagattccataacgcttcagggg

SEQ ID NO: 28919 - DNA, 1907 bp, Bovine  19866880960195
taacaaaatgcttccctgctccctcagaaacccagagtatacacttgactggcagcagggtaaaggccagaaacttaaggtcttcattccctgtacttaccgcactgggtagggagaggaaggtatagggtgacagctcttttccgttccctacctctcatgccaagcccccaaactcaagacacagtcacattcactcacagtcatacgcacaatcatgcacacacagccacacacagcggcgaagagaagggggatggggaggaagggaagtttgcaccaaacagctcatgaatgcaacttgaaagatttcacacggcaaaaggcaaaaaaaaaaaacacacataaatttaaaaataaagaagtacatgcccctccccacagtctctttcttcatccgggggctggctcagcccctccatgtaaacccagaagcttcctactccctctatccggctggagcttttacagggcctgggtcttcagttcaacaggttcccctgtgacctctggttgtccattggactcactgggcctggaacccttgagaatagacagtctctcagaaacactcttgagccgagggaagaggagaaagtcataaaggagactgcccaagcctgctccaatgaccgggcccacccagtacacctgtaggaagaggaaaaaaacaatcaggtttgggcagcagatgaagagtaaggttgctctttttccaatcccgttgttgtaaaacagacatcttgcacttagcacatacaattgggtgctatttaagcagaagtcagtgttcgttttaaaactcctagattgctccatagcctgcacttcagaattcatttcttttctgacttattaagttattcctttatcccataccttcttagcacatgtatattctatttttttgctatcaatttgtactagtttccatattgctttttgttttgtcttttaatatgtatttatttggctgcccaaggtctttgttgcagcgtggaggatctagttccctgacatgggaccaaacctggacccctgcattgggagctcagagtcttagccctgggccgccagggaagtccctccatattgcttttaaaatttctttttaactgtagtaaattacacataacataaaatttaccatcttaaccatttctaattgtacagttcagtagtgttcatatattcatgttgttgtataacccatctccagaaacttttttatcttacaaaactgaaactcaacacctattaaacaacttcccatatcccccactccctagcccctgttacctaccattttgcttgtttcaatgaatgtgaccattctaaatacctcatataggtagaattatatgagtctttttctgattggcttatttgagcataatgtcctgaaggttcctccatgttttatttaccatgtatagaatttccttcttttttaagactgaatactatttcattgtatgtatatactacatttcgtttatcttttcatctgtgtggggcacttggattgcttccaccttttggctattgtgaataatgctaccttgaaaatgagtgtaccagctttgaaaaattttttgaattatttacatatgcttgactggcatagggccagacaatacaagaatagccaatttttattgaggacttactctgtatcagattctgtgctaaatattccatacatatgattttcacatttatttctcataatatcccgttttgtacttaaggaaaccaaggtgcagaaggattgagttatttgtcatggtcacacatgaggctagtgacgtgcagaacagggacgaggctgaggccattcgtgcttgtacacatcccagcctcttggagagtagaagcttttgtcttcctgtttagtagtctgtcct

SEQ ID NO: 28920 - DNA, 1496 bp, Bovine  19866881031360
gaatatgctcaataaatgtaatctattatctttgttgaaagggacattttaagaggagaagggggagagataaagaccatgagttttatttgcgacatagtccatgtgaatgttcaaatagatatgtcaaatttcatctgagaatcaagttttacaagacaaagatatcgatttagaaatgaccatctgaaagacatagcaaaacataagaattaatgaaaataaaaaggggatattagtatggtgagacatgaaagaagtgaagagaatactaacagacagataaaagccagagaaatacatcatctgtactatcttttgaagtttatttaccagggcatttcatgaaaatataaatgtatattgtgcataagtacaactatattgcactttaagacattctatattttgcatcactgtggattataagtgattacttagggacagagaaaccttgacagaagcagtgtcaggtggggagctgaagaagttttgtgtgtttgtgtgtgtgagtgtgtgtgtgtacacatgatagtttaggggtgttgaggggacttgtatgcaatgaacaaaaacagaaaacaaaattctttaaccatagagctcagagacttcaagtgactacagagtatgtgcacagtgaacccaaatgatcttacacgtcttaatactttaataaagaatgaaatatcaagcaacaacagcaaccagagaactcttgaatatcacaagacatctttgctcctacaaaatgacatacccaccacagtcaaaagtagtcctttacaaaatgaatatttaaattgtaaatattttaaataatgataaataaggaaaaacttgaatatggtaccttccatactgctaaaataatcctaaatgaagcatttcaatgttaacagcatatttaacagaactcagcagtcagcaatgagaaacagtacggtaacaacattcattctgctgggactgacagatgaccctcaactgcagattttgcttcttatctttctctttctcacctacatgctaagcataactgggaatctgaccatcatcttcctcatcttcctggattcccaccttaagacagccatgtattatttcctacaaaatttctcctttttggagatctcattcatatcagcttgtattcccagatacctgtataacattgtgacaggtgacaaggtcattacctacaatgcctgtgccagccaagtattttttactgacctctttggtgtaaccgaattttttctcctagctgctatgtcctatgatcgctatgtggccatctgcaaacccctgcattatgtgaccatcatgagtagcatggtctgcagaagacttgtcttttgttgttgggtagctggtctgtttattataatccccccacttagcctaggcctagaattggaattttgtgattctaataccattgatcattttatctgtgatgcatctcccctccgaaaatttcgtgttcaaatact

SEQ ID NO: 28921 - DNA, 776 bp, Bovine  19866881070097
ggcactaaaggaatggggtagagtaggtgcaggcacttcctttcagctgccttcttttggatatcaagatcttaacaggcagggaggggacttggcttggggagtccctggggctcctctcctcaattcttggaagtctggggaccctattcaaggagagattggggagggggtgttaactactcaccaccctgtcagggctgaggaaaggagggggtagacgtgcttccctagacccccagctgcatccctgcccagagtcttaggcgtccgggtggctgtcaggcgtgggcacccctacagccactctgttctttgctccctaaactcttgcaagtcgtatcgcagcccaagccccagtgagctaaaagcaaccagcttggggggtggaggaaggggacagggtgtgtgtgtgtgtggggggggggtgacatcacggggcgggaccctccaaatcttttccctgtgtgtgtgtgggggggacccaatttgcctactgctctaggctgggatcatgagacccccagccatagccgggaggggtttttggggaaccgcaagagagttggggaatggtctctgaatacctatgtgctgactcagcaactcgaaactttcaaatcccttactggtgtcccagcgcccccctactccggcttggtttcttccacttcccagagaattggagtattgtctcctggagaacttggtggtccggatcggggaccccaagaaggggctcttactgatctggggcgccggcgaggggttcatgg

SEQ ID NO: 28922 - DNA, 1046 bp, Bovine  19866881078763
gctatactgacgctcagttcacagagctcatgcgcttgtccctcacccatccacaggtgagggagacccagccaccaggttgctggattggtggtgaatattaagagaaactccttgggacttccctgttagtccagtggttaagactccgcacgtccactgcagagggtgtgggttcaatccctggtcagggaattgagatcctgcatgctacacagtgcaccaagagaaaaaaaagaaaaagctccttaacattctcgtcttttgggaacaggtggtaggcagcaaggagatggaagcacagagtatggaatgatacaaagcatgaaaggggtctggtaaaggcacaagaggtctagtgaaattactataaccacacagagtaagctagtgcttctagctaggaaaaggaactagctgttcgcgttaggtgagccctttggctttccaggagctccctcttctggccattgctattaaagcttgagtgaaagtcagggagcatggcacacaggctgggcatcatcaaccagtaacctttccagttctgtggattagtgaacaaaggctgatgatacattgggacatctcttacaagagcttatgtataaatgactggctctaggctggtgtgaacccatagctaggcaagtatgtgacagtaagagaacagcaaggtccctgttagcatagtctcctccttttttcccctttctctgggcctttattctcctttcttccccacagtgaccatgaaggtggcaacgtaagtgcccacaccagccacttggtgggcagtgccctttcagacccctatttgtcctttgcagcagccatgaatgggctggcagggcccctgcatggactggcaaatcaggtaagactcttcttctcctgctccatgtttttctcactggcatgcttttgtttctgatcctggcattctctcctggcatatacattgacactcttattctctaaaccttccccataggaagtgcttgtttggctgacacaacttcagaaggaagttggcaaagatgtgt

SEQ ID NO: 28923 - DNA, 1360 bp, Bovine  19866881120423
catccacacaccacacacacacaatgtcccagacccccgaggaattgatttacctgcacaggaggaagtcaaggcaccaagtcccccagccccactcagccaaccattaccgtgttaagtgctaggtttcctcggacggcaggtggggtaacactgtagagcacggcggccccagccacggctcccaggagttgggcgaccatgtagcagatggcacgaagcagggacatctgggagcccacaaggaaggcgaaagtgactgcagggttgacatgggctccactgatgtggcccacagcctgcaccagtgtagccagggccaggccaaaggccagagccacctgcaagacatgcagaggtccaggggcccagcgcagcgaggcccccagtccaaagaagacatagaagaggctggcaaagaactcagcacatatggccctccagaaggaggctgaccgcagttcccacatggcaggggggatgggcacaacgcctgggtccctgacacccccctggcctgatctgggtggacagtcccctttatagaggacttttaatccctgggaggggcaggctgaggtgactggcccagcctcttaaccccttcacagctgcagcgggcaggcctgctctcgtgcctcagataaagctgcagcatttccccctcctcctcaactgggagatgagcagagccacgggtgtgagggtgggaatggggtcagggctagtgtgaggctccaagaagaaaggaccgagaacagggggcctgaggagtctgcctttctcttcacgtcaaagttggggttcatagtcctgactgacatctgtattagagctttcctcaactctgctgggaaggttagtgaagctgagttcacttcacagagcatgaggctatgctcctgggggcctctaggcgcctctgaactggccaggggtaagggtgggggtgggggtcaggagtggagtctggcagggaagctggataactgaagagaattccttagttctctgggattagggggccttctcccattggctggtttgggctggaatctgtggaccctgcagccctgggacagaatagttctgctgcgtctggctttctctgagcccgggctccctacccctgacgcatgccagcacctctctttccaagccctcagcctggccttttacttttattatttatttatttgctatatcacatggcttgcggggttttacttccccgaccagggatcgaacccatgcccccaacagtggcagcacggagttctaacccctggaccaccaggaaagtcccagcctggccttttaaaccacagggaaaaacctattttccatgggataggttggg

SEQ ID NO: 28924 - DNA, 775 bp, Bovine  19866881149856
agccaacaaaagaggcagcgctgtcatccgaggcgagagagggagccggagagagccgaggaaaagagagggagggagcgaggactcagagagaggcagagacagagatcctggggcgagggagaggaagggagagaaagtcagagtcagagagaccaaggggatcctgagagataatgggagaagtagacaccgaccaggggcacagagatagagagagcaggaggaagagatgagagagacaaaggcaggggtaagagggtcgggggaggagggaagacactgggaggagagacttaactagaaagacagagaaggaaagtgacaggcataaccagtggaggacttagagtgaggggagccagagaagatgggggagagagctaccagggaggagagggggtatggctagaccggggcagatccatgcacagacatgggagcaggaccagaagcccgggaatgaaagagggaatgaaatctggaggaggaatgcggccggggcagagacttccaggagataccaagggagccccacagaggaggcagacacagaggatcagagtaaagcagagatggggagacagcccagcaataagagtcagctttggtgggagcactgagagttcagggggaggaggtggagaatttgagcccagaggagccccagctataagaaggaccccaggaccagaagggggcctggagagaagcttcaagctgtctctcaaggggatcaagagatggagaacggacaggaggttagcaagggagg

SEQ ID NO: 28925 - DNA, 1400 bp, Bovine  19866881174740
cccatcactccagagtggactggctaagaggggcaggtgagtgctaaggcatccagacaagatcagtgagctaagtgcccgggctgagccagatcacactcgcactggaggagagggtgatactgggggtaggggcttgagaaggccatcagagtcgaaggtgaggtactggcttggtcacatcctggaagaaagggtgaaccagagctgccttggctgaaacccacttgttaggcttgtagtgcagcatttgcaataacaagctccatccatcttcatccggggtggcaccactttgctaaaatcttgcctggccctcttggggaaacttggcttataatccgacatagaaataactcctggccaaaccacctcgtctggggtctccagggaagaaagatctggaagagttggttgatctcagagtctccaggaaatagggcccagtgggtcaccatctcagcaaagatgcaaccgaggctccagatgtccacagctatggagtagtatttgcagcccagaaggatttccagtgctcagtaccacagagtcaccacctcgtcggtataagtatgaacagggaccccaaaagctctggctagtccgaagtctgctagcttgatggacccatctgcgttgataagcagattctgaggtttgaggtctcggtgcaggacccaatgagagtggcagaaagtgaggccctggagcagctggaacaagtagctctttatgaggggaagaggaatgccagtgagcacagaggcatccatgaatttcttgagatcctagtgcagaaactcaaaaaccaggtagagtttgttttctgtgtgaatgacatccagcagtttgacaatattagggtgattaaactccttaagccgagagatctctcatacggcaactgggtgcagcctctgtctcagtgtccaggcggattcttttaagcgccaccacttctcccgtcaacttgtttttggctttgtacacaactctgtacgtgccctctctgatttttttccactttttggaagttttcatgaagcctagcaagtcaggtcagcctggccctggagcaggggcctggaaaccctgcagaaaagggcacccagctcttgggggctgaggagggaaacagggcccagcactgcaactggcgttcgggatggaacgcagtgtatctctcgctcttgtcaatttatccaacttgaaacaatattgcgacctccaacccctcctcccttacccagttccctcctttcaggatgttaatggtagttctatttaattttctgaggaacttccatatcgtttccacagtggcaccatcaatttacgttcccaacaacttttttctccatatccttcccaacacttattaaggtctttttgataatagc

SEQ ID NO: 28926 - DNA, 2967 bp, Bovine  19866881184633
tggggctgccgctgtattggcttggggggttggtatgaggagtgcaggctcatggcaggagccccagccccttcctccttgttcttccagggcacagtcctcaggatgttccaccagggggaatagaagccggaaccagagcctctaagcctgtccccccagtgatggggcccccaatgagtcatctgctggctggcctgtgtgtgtgggtggccttgggccaggtggagggctcagccccctacctgggccctgctgagcaggaacagaaccattacctcgcccagctgtttggtctgtatggggaaaatgggacgctgactgcagcgggcctagccaggctcctccacagcctgggactaggccgagttcaggcccttcgcctgggacaccacgggcctcctgctggtcggggtgcgcccccagcgggagacaattccacacacaggtactaacccatctccccccacctaaagtgtcacaccccagctcttccctactgagaaaagtctcctctggctgcctagctctgccttcctaacattagattcctggagttacacgttttccagaccctgatttgttgtatcctttcaaggcccctttgtaagagaacacaagggagcctgacttgccatcccatccactctaggccacaggaccccgagctgagtgtggatgtctggacagggctgcctctggacccctcggggtggggtgacctggcggagacagaggccccaggaccaccccatgggccaggcccctcgggcctgggcctctttcacaggcttctgctgctggaccattcactggctgaccatctgaatgaggatgtgagtgatgatccctcaagggaataggagccacgggatttagatggtctgaaatgtttgaagagtcagtaatttaaaatggctacttaaaaaaattccaggtgtgatcttagggtacattattccagtagagaaatatgttcccctgtgctcacagtaggtaaacccatggcccaagctctaagactgggtttaggggccacacttggcaaagcagagaatccagaggagcagcccagggtgggatctggggctggttacctggagaggaggcttgcagcgggtagatggctatcatcatctagaaagtcagtgaacatgttccatgtacaccggagggcagccaaacccagccctgaaacagacctggtgaggctgagcgccccatcatgggaagcactcgatccaaggctggtggaataagtgtcagggctgttgagaggaggtttgcatggcattttagggttcttctcccttctaagattctggaagggagggctctagttatctgaccatcatcaccaaattaatgagacaccagagctccagagggagggagatggtggcagtgctcactagcacccaatttgcactgaattgaattattagctttggtttgaatatttactgataattaaatgctgattataactgtcctgagtccctgatgcacctggcaatgtgagtgaaggggaccctggaagagacccaggagttcatgcaatggaagggccaacatttaagatctgagtcacaggtctcagcaattccctggtgcctaacctccaattctacctccccagtgtctgaatggctcccagctgctggtcaattttggcttgagccctgctgctcctctcactcctcgtcagtttgctctgctgtgtccagccctgctgtatcagattgacagccgtgtctgcatccgggccccagctccgaccccctcaggggatctactatctggtcagtgggtgagagcgggagttgggggtgggacacgtgaatgctgggggaagtgggtctcaagccaaggaagggggttcatttcactggggtcctgcctccccttgcagcatttctctgccccatcccacctttaaggtgtccctccagctccgcctgactccagcccctgattttgtgcagccctgattcatagcaccctggcagtcctgctgctcagcctgcctgcgcccctctccctgctgctgctgcggctcctgggacctcgtctgctgcggcccctgctgggcttcctgggggccgtggctgtgggcactctttgtggggatgcgctgctgcacctgctgccgcacgtacgtgaagccccttccctgccccctgcccgtgtccgcagtcacaggacatcctctctccaccccagcctcagcccacatttgccttctggtagggagtgtgggtgaaggcttgccagccccctccaccacctcaggagaggggtgttgtcgggcgcagggggcttttggagtctgcccttgaccgcctctccatcaggcacaaggagggcagcacactggagctggtgggcagccagaggaggacctgggcccaggactttcggtgcttggaggtctcttcctgctcttcatcctggagaatgtgctagggctcttgcggcgtcgagggcgcaagccagtgagtgacaccctgatgtcctcttcctgccgagcccagagtcctagccgagaactggccactggagccaggaggtgaggggccgagcgctcctggctctgacgtctgcctgactgtgcggggcctgatggccagcagggagcgggtttgggctcctcagcacagacccaggacttctggccaaacgggctcctctcctgagtttggggcaacgagaaacagaggggtgccaacctgggaagagagcagaggccagggaacatccccaagtgccagaggtggaaccagtgtcattttcgcagccggcagcccgggctctccctgccccctggctctgctgcttcctccatcaggaaggatgccctcccatttcagagatgctgcgggcagaaaagaaaggacctcagaactccacacctagacctggaggatggcagtggggtggcccttcagccactgcaggcagctccag

SEQ ID NO: 28927 - DNA, 734 bp, Bovine  19866881195881
ccccattctttggtatttcctcactttgtaggccccggcagcaggatcgctgagcagacgattgaagaggtagaagagggaaagctggaaaagcagggcttccattttgagatcatgggccagccggtgcagcatcttgaccacacagtggttggtgtgggcgctgttctgcttgtagctccgcagcagcagcaggtaggctcggaggacggttgagtttgcgaagctgcaccgagacaaggagcgagaggatgcaggcatgagaaagatatagctcatccgcatggcaccccggtctgcaccctgacaccaactccatcctctgggcgcgcaccgtttcaggtagtccaaaaagttaaattctctctccgacacctggaccacttctaactcttcctcctcctcctcttcttcgtcttcttcctccgccccttgttcctccagaccctgctggcctacagaaagagtgaggattaccgggtatctgtgacgttggcgctagagaagcatgggaaggagagtgatgagaaggaaatggagactcacggggaagcggggccaagaggatttgcttcagtagctggatctcctcctctgggggagatgtcctgagcaccaaacacatctctttctggccacacctccctggaacacagaaagaaaaaaaaaaggctttttgccagagggaatttgggcttctctggtggctcagatggtaaagaatctgcctgcaa

SEQ ID NO: 28928 - DNA, 2106 bp, Bovine  19866881378213
tagtctcccactgcagagggccagtgttaactctcactatcctgcttgtctgatggcatagagtcagggaaggagatgccgatccttaatacttagaattattagaaaagaccctgatgctgggaaagattgagggcaggaggagaagggggcaacagaggatgagatgattggatggtgtcactaacccaatggacctgagtttgaagatagtgagatagtgaaggacagggaagcctggcatgctgcagtccatggggtcacagagagtgggacatgacttagcaactaaacaatacttagaatcatggttgcaaagacaaggattggagcccgggaagtgattcttactcctgggccagcctcaggactgacacccccgcgtcacccacaggcagtgaccggctgtgaggactgcctggctgccctgctggaccacgatgcatttgtgctgtgccgagacttcaagggccgcacgcccattcacctggcctcagcctgtggccacaccgcagtgctgcggaccctgctgcaggccgccctgtctacagaccccctggataccggggtggattacagcggatactcgcccatgcactgggcctcctacactggtgtggctctggggcctttgtggggacagctgagatgggggtggagggaggcagacaaggactcgtgggttgctctggatctggaagtagaatggggtgtcaagagatgggacagaccaatgaaaggggtcgtggtgttatttctctccatcaccactcttccctcctcgtcctcaggacacgaagattgtctggagttgttacttgaacacagcccgttttcatatctggaaggaaaccccttcactcctttgcactgtgcagtgtaagtcccttcctcagccccagctccacccaagggtctgtgatgtgggcataggacagaccgtctgtttccccatgcccctcctgctgacccttcctcttcctccagtattaataaccaggacagcaccacagagatgctgctgggagctctgggtgccaagattgtgaacagccgagatgccaaaggacggtgagtggcaggagccttgggagacgcctccgctgcccctggcttcctctctgctcaggagaaagggtctcccggttcactctgccctgactcctccccacaggacccctcttcacgccgctgccttcgcggacaacgtctctgggctccggatgctgctgcagcaccaagccgaggtgaacgccacggaccacactggccgcaccgcgctcatgacagcagctgagaacgggcagactgcagctgtgggtgtgtaggggccccatgtggatgggaggtactccccctgggttttcatgagatgagtcaaccctgccggtgggggttaggaggcaggaggcttgtctttggatgtttcactctctgcagaggggatgcaaaacatgtgcagacaagagcaaggagagccagactagcccagctctggaagggagcatcacccctctctgcctcccttcccttgtagaatttctgctgtatcgagggaaggcagaccttactgtgctagatgagaacaagaacactgccctccacttggcctgtagcaaggtaccgtctgtggtgctggtgggggtctctgtatggggcagggcctgatgaaagacctgggtctggtgagagggctcaggggaagtcaggattgtcctgtctgcttggtgggacagctttgtgtacccctgccaccctcctcagctcctgtggtcaggcttccatttctccagccctcactctctgcccccctccctcagggccatgagaagtgtgccctcatgatcctggcagaaacccaagaccttggccttatcaatgctacaaacagcgcgctgcagatgtgagtgcctggggtagggggctcttggctgaggggtgggggctggggaggtggaaaggaggctgctgcccattccaggggctccagctgtctggaactcacagtattcgcccggcagtgtggctgctctggctgagggtggaagggcagcttgccacccccttacttcacactccccttttcttcctttcttccaaggccac

SEQ ID NO: 28929 - DNA, 2202 bp, Bovine  19866881419163
atcctctttatttatagactctataaaagctttttaagtctcctctttcccaagagatctcaggaatgtcagtccactgccctggttctagccctctcctttccccacccccaacaagactaggagtccctgctaccacgtgtctgacctcctaagcctttcctaagcagtgttcaggctccccctgctgttcaaataggaaaacttcatattgtttccccttgagtataaggaatctttacaacttctttggccttgatggcccccaaccacccagtctgttatcttgactttgctttcaaggcaaaatgatcccgaaaatataccaactggatcacaggccagaattgcaagagaatctgtaaaaaagaggtcctctttctccaaagggaggtagtcccagaatagtaaaagcaatcaaggaaaagagtgggaaaagaaaagatacaaacttttactaaaagggaactgacctgctgaataataaatggcatctatccaagcctgacccatgttacaagtcccaccagaagcagatctcttccccacccaactttcccaggattgcgtgatacctgaggtagctcaggtgaagtccggggctcctgtgggtctccacctccacatcactgctgggttctgagcaggagaaaaacagagacttgggtgtgagaaggggtaagaatggagaactacagggtggttgctgctgcaagaatgaagtctgacaaaatggaaagagctctaggcactccaagatttccttcggattcaaattgaacttcccctgtcaaggggagaagctgccagtaagaagagtagtatgggacagaactaatttggagagcctaggagaaagagttggaaaactagctctgagtgaacaaagggtaagggacgcttctggagatgaaggagaatgtagggatcaaagcccggagtcgggttggggttaggaactccgaatagggggccgtgcaagggctgcgactgacagtgcaataggatggcgggttagacttaggggtggtgattatgacgcttctcaacaccccagagtctggggggaaaaaagtcctaagagtttcccggagcaagtctttggcctggcaggttctgtgcagtgccgccggagctctgccggggaccacatgaataggacactagggagcacgaagtgaagcggggaagggaactccaggtgacatcaagcagaggggatgggcaagggtgtgacgtcacggagctggcgtttgctcgcgaagcggggtcagtcagaaaaggggttcggccctacgacgtgaggaacagccaactcggtcctggggggccttgtgtagcccggccgagcccagccgctgggccggccccgaactcctcccctccgggcgcggcctccacctaagtctcccgcctccctcacctgccgccgccgccgtagttgctgctgccgcctgccggtcctctagcttcgacaaagagccgcctaccctaccgcccttccgcttcctgcggaagaaatgacgctctagctaccagacccggaaccacactctgtggtgtgcgaaatacttgcgcgactagcagcaggaagttcccagcaagctttgcgtgtcaccatggcaacccgacccaatggcaaaacgccttaaagcggaattctgtaacgtgaacctagataagagcggacctggttactcctatgcccgcgaaatcaacttgaaaaccgtccgtggcgtttacgccctttccaggaagtaaaggccacccaatactctagcagctcgtaagaccggaacccacacctccccgccccccgacttgtagatataaagcttgactttttctacagcagggagtagagacagactgtactgatagagaatccccagctagtgtaaccataaaaaaccacataacacacaaaatttttcttccgctaagacagcaaaagagatgatttattgtacacgttacattcagccacaactgagaagagaactagtccatagttatcacaggtccagggcaatggaccaaaagggacggctttgatatgagcaaggtaggtctcgcaaaggtggtcaaggtgatcagaatggccatagatgttccagatccattgataagttctagatagtaggcatgcagtccacactttgtaccagcgtccctggcctctggcttcccttgtttctgctt

SEQ ID NO: 28930 - DNA, 1246 bp, Bovine  19866881661732
tccaagattcctctacaatatatcaactggggacagagtgattacctataaggcatgtttcatacaactatttttaaccgatctctggggtagctgaactttttctcttggcacccatgtcatatgatcattacgtggccatctgcaaacccttgcattatatgacgatcatgagcaacaaactgtgcaaaacaatggtcatctgctgctggatggcagcacttatgactatcctcccaccattcagcttagattttcatctggaattctgtgattcaaacatcattgaccattttgcctgtgatgtatcacctctcctgaagatctcatgctcagacacatggttaattgagcagatagttatagcctgttccgtactcatcctcatcatcactcttctttgtgtagttctctcctacatttacatcataaggacaattctaaaattcccttctcttcaacaaagaaaaaaagctttttttacatgttcttcccacatgattgtactttccatatcttatggcagttgcatcttcatctatatcaaatcatctgcaaaagaagaggtaagcattagcaaaggtgtatcactgcttatttcttccatatcaccaatgttgaatctttttatatatactctgaggaataagcaagttaaacaagcctttgatggctcactcaaaaaaattgcatttctcttaagatagtaaaaagtatctgtcaataggccagctcaaaaagtgcatatctatctcattttcacaaatttaagatagaacttcatattttttttagcttgtagaccaatcaggttgacttcagagccacttaatcattaattttcccttccattcacatactgaataactaattattgaacactgctctatgaagaacaaaatatatcacttttaattctttaaccgacctaccatgtttaagtcattccttttgcttctttaaaatcatattcccaggtattttatattattggcatagagaagtctttcctgttttagaattataattgatatactctatttatttccttcaaatgcacagtgactccatatttttatacatgataaaatcatcaccacaatatgtctagttattgtcagtctgttgagcttccacatattaacatatcaataagagatgattattggcaatgttaaaccaatatttttaacatcttagatgaaatataaaagttacttgaaagataaatattacaaacctaact

SEQ ID NO: 28931 - DNA, 941 bp, Bovine  19866880683061
ttcactcagactcacgtccgtcgagtcagtgatgccatccagccatctcatcctctgtcgtccccttctcctcctgcccccaatccctcccagcatcagagtcttttccaatgagtcaactcttggcatgagtggccaaagtactggagtttcagctttagcatcattccttccaaagaaatcccagggctgatctccctcagaaggactgttggatctccttgcagtccaagggactctcaagagtcttctcccaacaccacagttcaaaagcatcaattcttcggcgctcagctttcttcacagtccaactctcacattcatacatgaccactggaaaaaccatagccttggctagacgaacctttgttggtaaagtaatgtctctgcttttcaatatgctattagacaatataaaattgatttgaaatatgctaggatctagtgcttattcttcctgtgaaaacaaaagaaaatttcttttgttctcttgtggttataatgagtagaatttattatactcagaaagaacacatgttcacagaaattatgccctttataattttgttgcacattttattaccatgccttcagtggtatttatcatttcatggacaattggcagcttaaaaggttcaaacactaatattttaattcatctacagacttatttcagaaatgagctatatacaatgtgggttccctattacatcttcccctgagcaaatatcagtgtcaacatgtaactatcttttacagttttacctcttcttgagaatggatatttggcatttgattatttcaacagagagattttatttgaaaaattagagctgtcggtattgacatcatcaaaggagtgaattaaattaggttttgaacatgagtttagtcacactaattttaggatgtcaaaaattttattcactattgcatttaaa

SEQ ID NO: 28932 - DNA, 2752 bp, Bovine  19866880733527
tcagtgatgccatccagacatctcatctctggcgtcccctcctcctcctgccctcaatccctcccagcatcagagtcttttccaatgagtcaactcttcgcacgaggtggccaaagtactggagtttcagcttcaacatcattccttccaaagaaatcccagggctgatctccttcagaatggactggttggatctccttgcagtccaagggactctcaagagtcttctcccaacaccgcagttcaaaagcatcaattcttcagcactcagccttcttcacagtccaactctcacatccaaacatgaccacaggaaaaaccatagacggttttcttgactagatggacctttgctggcaaagtaatgtctctgcttttgaatatgctctctaggttggtcataactttccttccaaggagtaagtgtcttttaatttcatggctgcagtcaccatctgcagtgattttggagcccaaaaaaataaggtctgacactgggctcatagaaatcagaaacttgctcaaggtcaccagaaagcagcagattcccttcaacgcctaaacgcttcctctaagacccagctgaaacacagaaggaactaaaatgtttgctctggcgtttctttacataacaaaggtgatttattcctatcttatcttgcgtttgtctcctttctcacctttagcacagtactaagtgtaaaggtctttccccacaaataaggcatttctttccaggtgagtgcagcagttgggactgttttcagtatgcttttatttgcagtttgtctttggttagatcaaatttaaacttgtgtctcaccttacctgccttcttctgcatcaccactggaatagaccaggagctgcaatcagtgccacagtgatgggagtgttgggggtggagaccagggggcattgtgggagggtgaaaacaacttcctgggtggggtttcaaggcactgatgagtgtttttagttataaggaaaaagaaaagggagtcctcccctttcctctggttttccttggatcacctcttcagtgaagcctgtaagccgttgttcctgcaaattttgtttaaataggcactcaggtcaaaattgctctgtggtgcttgtgccttgatctagttgtgtcatgaagaggaatctgtattctgctgtcatatagcattgctagatatgaataagactatatggttcttcccttgaattgcatttataaactaaagggtactagagattacctagtccagtgattttctcacattttttttttaaatagcacaaaaaccttttcaaacttatttgtaagcctacaaacaaaacaaagaagaggtgctgctctgatgtagctcttaggcttactcaattctctctttttttaaattttattttaggtatgactgacaaatatatttctttttattgttttctctaatgtatttcagaaacggaagtgttttattttgttccactgttggccatagtttgagccctacacactctcttttatttcacctcaaagggagtgcctttgtatgtagccactcattcatcattagtgtaaagatcaggctggatctgctccgaaatcttcttcttaggattcagctccttgtcatggtaggcaaccgccgccctgaagctgaccaacagagttctgcggagcttccgcatcgccaaggtgttctgtgaaaactcttcgacttcagccccagcggcgagatggtcatctcgaggagtggcgacgactccatcgtgctctatgactgtcatgagggcaaaccaaagagaaccctgtacagtaagaaatacggcgtggatctcatcagatacactcgtgcagcaaatacagtagtctacagctctaacaaaagagacgatattgttattacctgtccttgcatgacaacaaatatatcaggtgctttcctagacatagcaaaagggtggtggccttgtccacgtcacctgtggatgacactttcatttctaggtctcttgataagaccattcggctctgggatctctgctctcctaacttccagggtctcatgcatctacagggcaagccagtttgttcttttgatccagaaggattaatttttgctgcaggtgtcaattctggaatggtcaaactttatgatcttcgctcttttgataaggggccatttgcaacatttaagatgcagtatgattggatttgtgagtggacagggcttaagttcagcagtgatggcaagctcatcctcatctccaccaaggcagcttcatccatctgattgatgcattcaagggagtggtgatacatgtttgggggttatgctaacagcaaggaggtctcgtttaccccagactcccagtttattatgatttgttcagaggatggcaagatccatgctggaatagagagagtggtataaaagtagctgtattggatggcaaacacacaggccccattatctgtttgcagttcaaccccaagttcatgacctttgccagcgcttgttctaacatagccttctggttccccaccattgatgactgacctgcatggtgcttggctgttttctgtacagcgaggggtagaaagtaggaaaaaactcagaggggactaagataatagtgggattggatcatttgactggactagagagcatccttccacatgggcttcccaagcatgtgctatacatctgctcaaaagaaaagttactttgctgagcttcttacaaaagtaattctgtct

SEQ ID NO: 28933 - DNA, 857 bp, Bovine  19866880774697
aaaagcttcaagagcatcttttctatttatcttataatcaggcacccctttctctactatgacccattaggaatccaagaccttgtatttgaatggatattctctttggaacgggcatagtcatgcaagtgacttacaatgaggtacttgtgggaataattcctgtaaaagaatgaacaaagcaagattggtcagagaaagaagttaaactgtagtgaagttacaaaagtgaactcagctaacctctcagggatgtctgaggctgagatttttagagatattccaaattaaagagagggcttttttctttgtacctatacatcaatccattattggaagctgaattcccctaaggaagggagggctttatccttggacaaagtagtcatggagagtgcctcagttatggaattgggggaaatgagttccaggatctgagggagcgatctggattgtgtaccaaaacgtttgcttctaaataggtgtagaataaacatcatcatctatatttggtatttttctcttctttctattgaatttttaaagttctgcatagtgaagcctatgtaaaggcttcagtagtttcatctttcaaatatccaaacttttgaccacacttttaaagaaatttcttcctagagaaaatagaggagaatatagcaagcaggacaagaaagggaaagaagcccagcaagactgtgggtcaggcacagttccacagaggtttgcttctcctgatcctggagggtgactctagtgtgaattacacttcagatgatggaattgcagtttcaaagttccaaacccctgaagtcattggttaactgggtcataactcccaggcttctagctctgta

SEQ ID NO: 28934 - DNA, 682 bp, Bovine  19866881124598
ttataatatctaagggagaattacacattttataggctgtattctcaaactggttaggtggcatcctgttgctaatgtcattaacatttattattttctttctaatatcctacaaatctcttaggttccagtattgtttatttttctagtaactgctttagcagaaactagcttatatgtacttaatttattttaaccaaagattattcaaaatgagatactttctcagaatcagtattttcagttataaatttttatcaggaaataagaatgtctttacagtttaatgaaagtatcgagttagtttcatttgcaaaagcaaatcaaacggtagttataatcttaggaacatagtacttttcttagtgtatacttcttctagaagacccgtgctttctatatattatataactatcagtagcctcattagagctaacatagttccattactgaaataatttacattttcctttttcagtctatttccatcattcacacaacctttagaagtaaagtatctcatagcatcatctggctcattttccaaattcccacactctggcaatgaaattacccaagactctgactcctcatctcattttagagtcatccaaaagcaaggatttcccaagcttgataagattgtatatcatccagcttaaagccctacaaatctttacag

SEQ ID NO: 28935 - DNA, 1491 bp, Bovine  19866881568018
ttagaatgaaaccttatggcatatcttgacaatagatgcttacttacacctaacaggttcttgaattttttttactcccttgtttccatcattaagtattcccagctctgttttctgtgagtatcacaagatacaagaactagggcattttttttttcagtgaacagcatagactactccctgtctcttgacctttccctgcattaaactgtcaaccttctgaacagagagtgacttgggttttcacaagtgtagtcaagaaaactcctgtgatggataagggattagcactagtgacaagttgatggtaacatactccttgtcctggaatattatgtttagtgcctcactgagtcataataagctgaaaatctccttcaacccttcccccatcatctgccaaaactgaggtataatcactcacccattgcttaggctgctgctgctgctgctaagttgcatcagtcgtgtctgactctgtgcgaccccatagacagcagcccaccaggctcccccatccttgggggagcctgggtgttctccagcaagaacactggagtgggttgccatttctttctccaatgcatgaaagtgaaaagtgaaagggaagttgctcagtcctgtccaactcttcgcgaccccatggactgcagcctaccaggctcctccatccatgggattttccaggcaagagtattggagtggggtgccattgccttctcccattgcttaggcagtgacaggtaattaaaatggtatcatacaaataggatgagaaagtgtgaattcctgtcaaagaaaaacaacttgcaaaatacttcagagcacatcttgttttaaatttcaatcaagcttgatagaacaaatgtttacaagagaactaagctatccatgttaaaagacgaatatcagcaaatgtttataagcaaatatataacctatttatattcattagtgttcaaatacagaaaatgtattttgaatgtttactgagcaataagcactgaatagggtttctgtggtggcttaggagtaaagaatctgcctgccaatgcaggagacatgagttcaatccctgggtcaggaagatcccctggagaaggaaatggcaacccacttcagcattcttgcctgggaaatccccatgaatagaggagcgtagcaggctaaagtccacgggctagcaaagaatcagacacgacttagggactaaaaaacaacaaagcactgtatacatcctatcagttcagttcagtcactcagtcctgtccgactcttcttgaccctataaatcgcagcgcaccaggcctccctgtccatcaccaactcccggagttcacccaaacccgtgtccatcgagtcagtgatgccatccaaccatctcatcctctgtcgtccccttctcctcctgccctcatctttcctagcaacagggtcttttccattgagtcagatcttcccatcaggggccaaagtatggagtttcagctt

SEQ ID NO: 28936 - DNA, 3148 bp, Bovine  19866880433916
ttagactttgtcacaactaccctttaaagctaggaaatagtggagttatgtctatctgcttttgagggataaagttatggtccaagaaatatatattaaaccaacttctaggtcatagaagaacattttaatgcatacatagccaatatcctaggatcctagggtaatgcaattgaaaagatttctttataaaaaattaaagtcttaataaatacacaaaacctacattgtttgccttagacataatgtaaaggatggttcagaatttgaaaagatgcattttttgtttattgtattttaaaccaaccacttgtcttcagcgaaatggcaagcaacatttagatactatcagtactgctatcagtcctctatcaaatgagagactttcaaatatttttggcaaccaactatctgagatcattttaataaataagtgaacaaagagagatttatttgtaattgatagataaggtctgagctaaggctgggaacctgtttcaaattggatagtattttgatcaatttttgtgttaattcttgagacagaaatggtagtctccaggcatcacatacttctaattggattggatttattgttaatgtcttattacaacctacctgtctcatatagaaaattaagtgaagcattgtactctacttctaattttatatatatatatatgcatactatacacacatgcatgctatatatatatagaacatatacacatataggtatatatatgaaaatcttaacttcagaattttaacattattattattcttttctttgtaataatatttgaaagaaacatagatatttgtgtattttatgtaacacttactcctagtttatgaatcatacatttccccaaggacaaaaataaaagtcattatttggatggcaagtgataagagacatccaggcccatagagagaaatttgaccatctccattaatacaaattccaagtctagactgttttctgagcttcatctgtaaatatcaaaccagctattcaaaatctccacttacatacctgaaactgaacatgttaaactggatttactatcttcttctaaatcttccccacatccaaagttcagtttaaattaaatgtcatcatcacttacccagttgctcaagcttgagtcatgcatgatttctcctactacatcagtccaagagctcacaaaactgcttattacagtccatctttattgccacaactcttgtccaagttaccatcattcttgatttattgttaatcttctaacatccatttgctgagactggtccttcaatctagtctctacagtgcagagaataaccatttaaatatttgataatgctatgtctttactaagaaacttgcttcccactttctcctgaataaaagatagctttcttcaggtggtagaagaccctgcctaaacaaggccacctatctttccaggatcaccttaagttacactgtcaaagtcatctccattctaatactggggctttacagtttttcaaatgctcattgttccagttttgcatcttagctaaagctactgtctgttcaaaatgatcttttattctgctttatatctattctattgatccttcctatctcagctcatttttttctctgagaagttttcacaaatcagacccttcttttcatatatgggtaggtacatttgttataagttctcctgtacttgaactattgataatattgataatattttgaatacttaaaatattttaataccataaattaaaaaaaaaagctcaccatagtgcattacctctactgttctcataatgtcagttatacaattcacataaactgaattcacataaaatatactttacttattatacaagtcattgactggtcaaactctcttctacaattaagtttctaaaacaggaccaagtgttacactttttgttgatgtttgtcatagaaaattttaagaactagaaataaatatgtaaagaaggagataaaggaaaacacctacttatattctcatctcagaaataacccatcattaacattcttccttacatatatgccagtaacgaattttgtatatatgttcatgcatttgcattttgcacttgagtgggagctgatattttataaatgtaataaaaaagttgtcattttatttctcattataatataagcaatttctccatgtagttaacagtcccttctacctaggtgacatgtggtaaagaatctgcctgtcaagcaggatatacaagagacttgggttcgatccttcggttgggaagatactctggaggaggaaatggcaacccactccagtattctcacctggaaaattccatggtcagaggtgcctgatgggctacagtccatggggtagaaaagagttgcacatgactaagcatgcatgcatgcaaaacatgaatacttacagctgcatggttccttatatgaatacactgtatttaatcattccactatcattgtatatttagcaatatatacataaatacatccatttttcactttagaaatactactgatatgtagctgaccatattggcacataaattttcttatacatctctgatcctatccttgatataagattctaagaattgactacccacatcaaagaacatgattttattttttaggttacaagtttatttataaatggactaaatttcatctcaataatttcaaagagattttacacaaaatgtaagcattctaagagaattctaaacacatgtagcaataaaattctccacaaaattaatattggtaatcatatgaatgtatgaaagaaaaaccattaattattagaatattacttagagatataattttgagataaatttttaaagaaacagcctttgtaagtagatctggaataacacacacaaatataaggtatttataactctataaagtatttgtgattatcattattgtctacaagttatatttacaacttaatatatgatggcaatgctctaataggttttgaaatgtttcctatattgtaccactgatctagagtggacattgaaaatgaatcttttctaaaagggtatggattctaaaaagagcatgcaaatgtctgaattttcgaaggaagcaaaatgatct

SEQ ID NO: 28937 - DNA, 1048 bp, Bovine  19866880465955
agatttgccttagttactttgcactttggcttccctggtggttcagacagtaaagaatttgcctgcaatgcaggagacccgggttcagtccctggctctggaagatcccctggagaagggaagggcaacccactccagtattcttgcctggagaatttcatggacagaagaaccaggtgggctacatacagtccatggggttgcaaagagttggccatgactgagcaagtaacacaaacacacactttgcaacttagtggatttaacttttgcttgaactacttgctgatgatattgataggtgagaatgccaacactcactcatgttgttttcttgcatactcactcccattctatcaggttatggatgaaaataatgaagtcaaagaactattgataatttgtggcctgaaatatctgtgtaaatgaaaaaaaaagtcttttcctctacattttaataagatgatttaaaaatcatctcatctctgctctttggaaacctcaccttcattaattagcattccaggcagtgctattcccatcttctccatgtacatgagggaatcagattgccatttgcttttattctgtttaaacatctatgaggaacaagagtaaaatgataaatatgctaaacttatttgaactgtgtttagtacaatgcctagattttgttatttgaagactattcctccagcaataaaattattttttttaaaagtgtggaaataatacatcattttcagcatttctctcttctggtttctaagagctgcttttcttcttccttctgggcatgaagagaagataagccactctgactttctccttctgctcacttttcgcttctggttatgtttgttcctcaagggaatagaaagtgtcagtaggcttaggaagcagcttaagggttatctaggctggtttgtccattctctgcctgcttagtaaggaactaaggtgtatttgttagcctcctcagtattgttagggacttctggacaaaggagaaaaggtaaggtaatagagagtataattaaaaaaaaaa

SEQ ID NO: 28938 - DNA, 2703 bp, Bovine  19866880601952
ttgggtgtctgaagttccatctatctataacatttaaagttacatagatctaagacaatttacatagatctaagacaatttactcaggacaaataactttgtgttttatagcatttgttttggtggaatctttaagttatatttataagctatcattataattaataataataaagttcatcatatttggtaatgcttaggcatatgtgagacaaagaaaacacttcagatttttctttgtttacctatatttaactactaaaatcaatattaatataccaaagtgttctggataatagtttttttccttgcctatcacaacacgcctacaatttctgctattttccttcctaaagattaaaagttctaaaggcctcagcgtctctggtgtgtccactcactgtctcagtatctatagcaaataatcaacaataaattgtgtatactgcaacaggagaatagtagatgcatccttttcctttaagaccttcattaaccagctgaaacttagtattgtacatctgttgagctaccactctggggttatttaatataaaatataaaattatatttaactttaggacaaaagagcatacataatgatatattcacccctatgtgtgtgtgtttagttgctcagtcgtgtctgactctgcaaccggatggacttagcccaccaggctcctctgtccatggggattcttcaggcaagaatactggaatgggttgccatccccttctccaggagatcttcccaacccagagatcgaacccaggtcttctgcattgcaggcacattctttaccatctgagccacaagggaagcccattcagccctgtatcttgtgtattatcattactatacaatttactataataaagtaaatattgaaatttagttctttgtgtttataaaacattgttatgcacataacaagaagaataagaattgaaagctgatggaggttaaactatatctcttaaatagatgtttaaaaagactgaaaaaataaatcttcaaagctgtaatgtctaaattgagagctggaatttctatactttccctctattactcagaaccatgcagtaaaggatccttgtccctgtgacctttcatctaatgaaaaactgtgtaagtgaagtactgctatgtgtttgtttgtgtttaatataacggcctactcagagcagcaagggaaatacgttgttcagttgctaagccgtgtccattctttgtgatcccatggactgttgtctgccaggctcctctgcccatgaactttacaggcaagaatactggagtgagttacgttttcttactccatgggatcttctcaacccagggattggccctgcatctcttgcattggcaggcagattttttacctctgcacaacgtgggaagctcacaggagaaaggatagacctatccatagaagtgctatgggattcagccttctcacatcatcccagaaagcttattaatgggtgaactccagcggccagttgtatgaaaaattgctcatcaatcatttataaaacttaaaattaggctgctttaaaaaaagacatggttttgcatcaaccaatttgctactgctttgttttactttgaaaatacatcaaagggagaaggtaaaattattttatcttctatgatatgaataaaaaaaaatctgatcctagtgccaatagaaaaatcaaatagaatattctttgtattcttcacaaatatctttaaatatgagactttggggctgataatgatgaattagatattattacaataagaaaataagtacagagagtaaatgctggttagttttaaaaccctgatggaactggctttttatattctttctgtgtaagtgaaatcattattaaacaaacagagcatgcatagctcttattgtttagatggctgagccaggtttaaatgtcatttaggagtgcttacaacatatggcattgatagatgaaaaagaaaattgccatttcaagttgacctcttttatccaaaccagagttatcttaagtgagtttagataactacctaaattagtcatcattaaagactcacaagctctaaaaaatttgactttaagtcgtcttacttttagaaactttgttttgtaagaaaatgtaaaattcaccaaaatatagaaaaatgattttaatattttttcagttttcttttttagatgcgattcaaatttattcataaattttatttaaataatctgctctatctaatcactaataatagaaaagaatacctctctggcagcttgtattcatcattgctgaaaacccataggacatatttaacagtagaatgatcttgtgtttccccactatttatgagatgaaattctgccaaaagaaaaattatggttgtaataagagagatcctatattttcataatatatatacaacttattttagcaagttgaactaacagttaaatcttatactggattcactttttaaaaaataaaaaaagaagcaaaccagtatttctactctttcatgtttaggtatttgttatattctttgatacatttaattttgtccaagttgataattttctttatagtcttgtaatatctactacatttttaaacattttgcactatattgagaaagaaataaggagggaatgtagaaaaacatatctacgaacatcaactatgtgccagtat

SEQ ID NO: 28939 - DNA, 2204 bp, Bovine  19866880684723
tcatcctctgtcattccctatgtcaggcttccatgacaaattattataccatagacgaggtggattaaataacagaagtttttttcttacagttctagaggctactaagaaagccaagatttggaaacccaagatctccaacccaaacttggacacccaagatcaagatacagcaaataggtttcatctgaggactcttctcttggtttgtcggtggctaccatcttgcactgtgttcacataacctctactttctgcactgggtaaagagaaagagatggttctgttcttcttcctataagattatctatctgattagagtttctaagattacagtttcacttttaagatctcatttaacctcacttaaaaaaccttttattttcaaatacaaccccattgggggtggtgatttcaatctaatttgagaggaaaaccatctatttcttagcatttaaattgggcttttactgcgaatatgtagtggaagattcagtcattgcaacagtaagagtctattttaatacttcatatccttgaaaatgtttattggtgagatttcttagtcctgatgtagtttaatacttgacctctctttccttatagaatggttgccaaatggtctataacctctgctatgactaattttatagtcactttcatagcaaagccattatcttttagcagtttctgaatgattttgcaagcatatttcacgtgtgaaacctgtaaacattccaatgtgatatttgcttccaatttcattgtagcattttcaaatatgccataaaatagattgacaaagattgaatttaatatagagcttcaatttttgcttgggtaatagatcacaaataatcagaaattattattaaaatgacctggattaaaatatttaacttgattctaacataatttacatgtgcaaaatgtcaaatattttaatgatgatactaaatgcaagttgaattgttactcttttcctctaaactactacaactgatattcactagaaatatcaacatgaaattttagctaactgtttcattaagagggttttattaccactgctaggatagaaataaaactaagcaataaaaagacagcatggtaaaaagatgcaaggagatcaaacagtttcaagagagtttgggggtaaactaatttatagataaagataatttacagattaagataataaatctgagttttgatcactgtaattagtaaattttttcattaaagattgactacatttcttgggtattaaatagtcacaactgaaatatttagtagtatctataaatttaagattttaatacataagagtttttccttaactaaatttatgatcgtaattaagaagttattatttttcaagtgcgttatcttgaattacaaatatttttgacaatataattagtgttacttatctaagataagtgacagctctttagttttgccatttattatatcaaaatgcattcagcttcataaaagatatctattttaactttactttgcaattacaacttaaaaccttcacggcaacaaatcaaatgtatattttaatgttagaagtagaaacattttcacataatttgatgtttctatgcattaatatttttagtgttctttttttgtatactatttcttcttaatttggctagtgaatatgacaagcataagtagaatttgttctgtattggaatattcaaagaagcatagataacctgttcttattaaactaaattgaaggagttgatgatggacagggaggcctggtgtgctgtggcccatggggtcacaaagagttggacatgactgagcaattgaactgaactgaactgaaattgaaggaaaacatttctgcttactctaaatcatgtatctccagaagttccctttcattcaaactgtataatttcttatttttaccttcaatgaaagagaaacgtgaatcgggacctagttgctaacacttactttttgtggtccacattctacctacctacccaggttaagggtaggaggcacataaagtctatcttgagacatatccctgactcttgggtcttgattgaaactgctacagttgattcagaataagagaaaaacataaaggagataaaactaactcatataggaaggaaaattaaaggtctaaccctcctatttcttcatatatggaagaagtcagcaag

SEQ ID NO: 28940 - DNA, 1540 bp, Bovine  19866880732242
tccaaaaaaaatgttccatctttaggcaagaaatgacccaataacaactgtaagcaccagataagcataaataataattacccagttgaatgttatcagtccattggttggacagtattatttatttctttttttggcagactcatgcttttactgctgtagggctgagaaatcttcccactgtctgagtcccagtctttaaatttccttcaattcatcatggcttctagaatctgaactctgccatccctaattagcatgcatgtcaaaagccaatgtgcactacaggctatctcaattgaaagtgagaataccaggagggaaaagtgaaaaccctagcagctaccatcaaaacagcttaatgtttttaagaagaggcaatactaaagatgactggcttgttaggatcaaagagtactgatgagagtctccacctgagcttatacagtgttctctcgcctgggaagcaaacctgcttgtgacatctcaagacattataaaggcactttcacatgaacatgctggattgaaaataaataactatcataatctggagcttttgttttaaagaaacaacaaaatagtgcagcaggcatatagagcatgcctattgaggtagaattgttaccttaatttttaataaattatgtttattatttaccttttatttttttttcaaaattcaagtgcattctgaggcaaactacaaagttattcttttattttgttttgaaaatctactaaggaaaggcatgctttttaatgcctgattctcacacaaccacacaaacacacagacacacacacatccctttactacactactgcaggcacaatcatcacactcttcgctgctgcaaactgtgtttacctctttgcagaagaataacttcagagaacttacctaatattcaaaaaatctaagttttattggccttaattaccattctagagagtttttgtttttaattgatgtctatagaaaatctcccagaatttggaaaggtgagaagaatatctttctctctgaaatgtagtattcaaccacccgaaactgtaactgacagtgcagcagattgaaacgaactgtcaagaaaaaaggactagagttctgctggttgtgctgttcaccaacatttcaggaaggatgcttctgtcagagcaaaatggatttaaaggagggcttggcttagtgattatcattcattttattaaagaaaaaaaaaaaaaaactggtatgctatttaattcttacacttgactgatcagtttagattggagatctgggttgttactgtctttctactggaatttgtattttagccattaaatatttcattagcttaattcacaagtgaaagaagaaagagggaagaaaagaaaagccaaagctccaatcaatcaaatgtgccatttcaccgctcttccagtaaatggtttgatgggaagggagactgcacttattagctaatctccaaactgcatttcatttctgaatctaatttattatccccttacatgaataatcaagatttgacta

SEQ ID NO: 28941 - DNA, 1093 bp, Bovine  19866880769306
cagtcatctgtatttgtcaaaataaattatttagtttatacaaacctatatatttggaatgatcacaaaaactacttttctggcaagagatagtgtttagaattaattatgtacctaaagtggcctatttgctagtaaggattcagaaagcaaaaagcaattgaataaattaaaaaaaaaaaactgaaaggtaaaatgatactcctcgaatataagtagatcatgccctttaagcaattggtcagaatcagttttgattgttggtggagcctactactaagatactgctgttttgtttgctgtggagtaaaactgttagtgtttgaggaaactgtctctatcttagactttcaggaccataaaagataatgggcaggttgaattttaggatgacatgtgcatttttacagaagtttcttgtcaggaagccctgtgttttctacagatgtcagaaagagaacctaacagcactgttggatgcaatattttcccaaagtcatatggcattatctgatcgtaatgccataatgattgataatatgcacacaaaaatattttaagtttacttcttgacattttcttttccaaaatcaaagttaattaaaaataaattattttgaaaaataagcatctaccctagaacatttttttcctcttccaatatgctaaattaaattcccttaacttgatttatgtcatctcaaagatactgtgatggttcacaaaaattgctgaggctcctgtttttagtgttttttcatggattcaaaaatataactttccctgacagtgtaagacaagcaatattatatttcgtgttcaaaatagctagaattcaagtggtgatggtaaaattatagagaaaagatagtattgtaaaagtactttaaatttaggtgaatttcaactttccttaaggatttcatatttatgcacatattattacattttaacatttacagtgtattatcaggcttagttgggtggcaaatttaaaaactgacattctttcttcaatatttctgaatagaaatcagagagtagttaatgcctctgttaatcaaaatgtgatcttttgttgaaaaatttggga

SEQ ID NO: 28942 - DNA, 1566 bp, Bovine  19866880831088
cttgccgtgtgtttgtcttggactggatttatatatatatatattttttaatctcttgattttttaagttaaaaattaaatttatttaataggtatagggctagtcaggttatttacttctttggtgagttttggaagtttgcccttatcaaggaattggctcactgtagctaaattgtcaaatttactagaatagatttgttaacagtatttcctgtctttctttgaagttgtatagtcatctggttgttgacattgattatatataatctaaaattgatgagtagtcataaattgatgggatgctgctaaactaaaggttagtgaagtcattgtgaaggggctatgtgaccagcaaaggaatgccagtgatgatcattccctaaagagaggaatgtctggtccacttggctgcgcctctcttgatcacatatgtctaggtgccaagtgagagccagaagtttgttattctgctttgtataccctattggctgtcttttctcttttattaaactaaatgaacttgttttattgtgtcccaggagtgtgttcatctactcgagcccaagactacttctgctggcagacaacagtgggtatctcaacacacatatcttttaatcctgaaggtgtttatagtaaattttagacaaaatatacattgaaaaaatgctccctcatctctaaatctattgtcttttattatatactataaactctaaaattaattaaaactacacatacaataaagtccccaaactacaagcatttgtttcaacaccaatctgctagactaatatagaattttataatatatttttgaagatgaaaataacttctctggtacactttcattggagctttatataggcctttttaaaaaataaaaatatatattatttatagaagtattatgtgtaaaatagttcagaaaatattctatacatttaaagactataactttccattttaaaatggctagttccagttttttctattttgtggatggttaaaatggacaagcattttaaaagactatggaaaatagcatattaattcttgatttatttgcagcatttttctctttcagtataagagtcataaaaataacaagtaacatataaatatttgtatagctgttccatctatctcttcaggagtataataattgacagtggtgctagcatcctagcagttgcctggggccctgtcaaagattaaggtgttgaaggataaactatctttaatacattgctctttcataatctcttagatttctgtgatattacattgtattataacccctacttcaaagatctcagagtgcttcacagattttatatattttattctcaaactccctccaaggtcaaactgacaaaggattactccctccctccctcctttttttttttagttatggaactactctaaacatacagcaatcataatgacgtgttcagtgcaagtaaccctcaatccacagtaacagttatgtggaggacaagaaaagtaaaataatcacacctggatttctagttacagtgaatttttcattttaaatca

SEQ ID NO: 28943 - DNA, 627 bp, Bovine  19866880878378
ctgaaatacactgatagaaaaaatgaattagaatgaagaactaatactaattgggtttctacccttatcctatccaaagttgatcaaatactggcaaacctttcaatgtttctgaatatgcatgcaaaacatgtacaataaggattaatcatcagtgattaacagtagttagcattcatctgctgaaagttattctttacacaataaacagtgagtataactttcagctgctgccttttgtaatcaataaaatcaataaatgtttattgagtatccatcatttaaaagaaaataccctgatttaggaaaatggtgcatctcctaagcaccttttaatctaattgaaaatacagaacttgtacaggaaaatgcaaactaataatacaaattttcatggaagtgcctaagaaataagttgtacagataaaaggaccattaggtgtgcccattaaagggacataaaaatgtctcaaagtagtcagataaatcatcctagagaaaagggcagcagaaaaatggactgtacaatgagtataaattagataaatgtggagaagaaaaagttgttctcaggtggtgcagtggtaaataattctcctgccaatgcaagcaacacaagagacacag

SEQ ID NO: 28944 - DNA, 1737 bp, Bovine  19866880905898
ataaagaagaattcacctgcaatgctgggaatgtgtgtttgttgttaggtcagaaagatcccctggagaaggaaatagcaacccactccagtattcctacctggaaaatcccatggacagaggaccttggcgggctacaatctgtggttttgcaaagtcggatatgatttagcaactaaacaacaacaacaatgagatatttgcaatcggtgtgtcttgtcagcattgtccaacattaggattgaccttgtgaattcatctttggatatgagccacacaggaaaagcatggtcttgggtgaagtgcacctccattaaaccctaattcagattccaagaggagtaagtactccttattcaaagaagaatctgggtggtgcttcacacctatacctgtatattgaatatgagataaagctaaaaactcagttgctgagtcctgtctgatgctttgagaccccatggactatcccccaccaggctactcctcctacacatggaattttccaagcaataatactgggatgggttgtcatttcctattccaggagatattcccaaaccaggggttgaacctgcatctcttatgtctcctgcattggtaggtggatcctttaccactagtgccacctgggaaaacccctaaaattagaatattaatttctaactctcagtctaactgtgattcaccatggtgttccaggtagagaaatagagcaatatctgcctgcagttgagaactagttaaaatatgcttattatttttttctgtgacttttttcttaaactgatactattctcagtaatacctttcctctgtgttttgtttttttttttttttaagtgttactgctgctcaatttgcaatgtgcacatgtgtgtttttcttttccacttgtgtgtgttttatattcctaatgtttaactgtttacatcggatttcctattatagtgtctatacaaatcatccatactaaactataaagtaacccaggaagaagaaaaacattaaagtaggactgtaattttttccctctgtggtatataagatatattcattctgaataattcgagaaataactttcaaatatattttaaaaataaacctgctctttagaaataatttatttttcataggtatcactggcttttctgtttatgtgcttgtctctttccttaggttcgtatctatttttccttatgtgtcaaactgaattttggatttggagaagttggcattgcaattttatggttaagaaataggacagtttgcagagaatttgtttctagtcagtaagatatgtagagactaaggagtaaaaaaataaaagacctctatcaaaaatgcagaatagtgttgtaaaagaaataacatgcaattctgattttcttgcaatttccaatatctatatcatgaaataccaaaataagactaaaatatgtgggatgtatacaaatttagatttaaacaggtgacaaatgttttttttttttttttaacatggatacatttatcaacataaatgtccttaaatatatgcaatccatctgatagtcatttattatttattgttttacagcctttataatgtcactttgatgcatgtagtaaatttttctccaggttgaataatatctccatgtatatatatatcagatgcttttctatagcaagtaatttttaatatttgcacatgaaacaaatagtcattttggaattggatgcatgcaattggaa

SEQ ID NO: 28945 - DNA, 952 bp, Bovine  19866880914902
cagaattgttccatatattcatgactgttcctataaatcttaacttaatttctggtcatagacaacaagggaataagtgcgatatgagtctcatgtttgagaagaaattcaaaattggtaagttacaattggggaagtaggtagtgctgtgcagcttaaaaggggatgagggtctggacctagttttacagttagaaatgatatcccttatgatatgatatttaggatgagttaaaagagtgaataggaataaaacatggaacagcaaaattcatgttacccttaaaaggtacacagtgattgcagaattgaactttacattaacgtataattataaaccaaataggggtatgacggatatcctttagaaagtctaagcaaatactatttccagagtgtggtactttatttcatctcttaatatctcttgaatcaagatctttagtttttaaataatgttttataaagcttgaaaaaatatatacaattcaaattcctcaagtagtttacaaatgcatgaagaaggttaagttagctaggctataattaaacaagacagaatgtgatggccaggtcctgtctagttttttctatgtttagatttcatcttgcaaaccatgttgaaaaacatgttcaatttgttttagcaaagaaaaagaataaagaatataatcattgagtgtggaattataatacaaaatcttttaaagaaaatagctcctataactaagattcacacatctctgttgacttggcagtttgtataataaaatgaaaatagtttaccaaaattcatgtttacattatgcaagtgaattaacactgtgaaatgactgaattcatttttctgccaacttaaaatacagctgttataatacttacccagaactcattgaaagcttttatgcaaggagttgagtacatatatctagatttccagaaataggcagag

SEQ ID NO: 28946 - DNA, 1534 bp, Bovine  19866881064113
tagttgtttaaggtcttttcctgctttctgaactcaaaatattcactgttgttacagaagcccataacaactttactcttctgtgttaaaggaccgtattctaatatgcagtatatttatttaaaaaaagcatcatatattcctaagcatattaccaattatttgagaatagattttttttttttttttttttttgcatcacagcatccaaaccaaggcattggtataaaatacttgctgagctgagtgcattcaaaaaggaacaaagtgtactccagttgtatggtaaagtaagcaaaatgaacctgttcatttttaaaattgtgatcatgatggtctgttttttgcaccatctccctcaaccaacagaaaagacaatctgacataagtaagaaattctatgaggtgctaatactgaatataatcaaatacttgaaggaagatttgtgtcccgcttgttacaagatgagaattataaatgagctatgtgataccctgggtttatttcagaatttcagtgttcatttggttgtttcagaaaagcttaagaaatctctctctgtgtcagaaatctttaaaatcccatgtatttttggtgttttcacaccatggatatagtaggattttcagagatgtaacaaataacatttcaatatcattaggcttgaaagcaactgaacccttctttgcaagattactgaagtacatttatatatatatatatatatatatgtatgtaaataaagaacttattataaactttggaagttggtcaaagaaaatacttaagtttttgaaatttatactgcttcatttgctggactattagccttagagccttataaatttttgtgagagtctgtttttcaagctctgcattagaaaattcttagaatattacattcaaaatgttcagctacattattaacatttctccctcaagtactaatgttaattcagatgtatatatcagcttacaaaagtgatacattatgcttttaaccaacagtttcccataatcactcatatgccaactaccaggagcatttgtttttgtctgatggcttggtacctcaaatgtgaatgccacagacatgcgcctggtgtctgttttctatgattcctttaatcttgctggtcatagactatcagaactctgaaacattcctaaagtgaagaaagaacaataatgaaatagagaattaaatgcaagagaaatgtcaactattggcttcaataaaaggtttcactaattttaaggatatgttaagtactaaacatttaaagaatatttctattactcattttctgctcataattttacatgtaattttatctccacatgcatcttctccacagcattcaatcttttcctgtttctttgagttagtattatacatttgaaagcctaaaggctttttagaactgaaaacagaatgttcaagttaaaaagtttactagaaatagatgaaaacaagaggattcaggcttctgcatgacaaaatgctcaatgctggaaaggtgctgtataagc

SEQ ID NO: 28947 - DNA, 742 bp, Bovine  19866881520724
aaaaaataatttgaaatatttttgcttaataatgcctgttaaaaccaatatattccaatggtaatcagaatcaactaaggatcctgaaatttagttttgtaatgaagtaactgtgtgactttgccagtatctctaatctctcaggatttgttttctcatctgcaaaatttctgcttgaactagacaaccttagtctctaaagtggaaaggaacagtgaggaaactcccactttttaaatatatatagtgttaaatagatttaaaaaaacacaacttctttttattaagaatagtagatatttgaaagggcataaatattcagcaaaaatggtggccagattcctgacaagcaaactctggtgtgttttctcattaacctaaattaaactatgatcgtaccccaaacagccttatatgtctgtgggttcctgccaatatgcagttggatttctcctctgcagctgtctgtgatgctccaaagagacaagtgaatactgttgtaaaataaaaagtggagaaatggaatcattaaagcagaatgaataaattacaatgaccttatacaagcagctttaacaaatgaacatgaataagagttaaagtatacacttttgattttgcaggagttcagcatcgaagatttttagaagtagacattttaattagataatatataattttattttgagtcttcccagttggcacttgtagtaaagaaccgatgcgggagccggcatatgca

SEQ ID NO: 28948 - DNA, 3326 bp, Bovine  19866880378854
attgtgaggggctgatgtggagttatttatgataaaggagactggaaaaggccctctctgtaattgctttgtttaggttttgggggtcagaccacaattctgcagattgtagagggagttttgcctaaagaaaaagttgttccccaaactttggacccagagagaggatgaaatcctcccttccagcccagggtccctgccccaggatgaccagcactggggctccatggtaggaaggtacctggcgattcctaatgacaagactcactatgatgccggctcctggaatgcccaagagccgttgtactgcaggcctcttggctacccttggaaaccactgtgaggccatctctgcattatacttctgtcatcccaatatcttcaaaaatgcatcagtaaaattacttccattctttgagaaactaagggagaatcctggggggatatagtgaaagcaagtgggatatcttggagaaactagttaagagaatgttagaggtggtaagccaagctctagagcagcctggccaagatgactgctggtgatgatgggggtgtggtgatgggggtgctgtctgtggaacaaaacgttatactgtagggattcctagggaaatacagacttttgacaacaacttacacatagataatcatatgttttttagtagacctccgtggctttaaaaaatttgttattagagttacattgtatccacattcctctgtattttgttgtggatcagaaagaatgctgagaaatacctctctttaagcaattcatactttgctcaataacagttactctttttttttttttaatagtgaaagcttttatatttggaattagccagctggactcagtttaaatgatcccaattttgttggcaacatgcaaagcagcatgtcaggagccagtcaaacatgcaccttctcctctccatcaggcctgcgtagggtatcgtgcttagccatgtcaatgtcatagagctcctgtttagtttgtcacagtctgtttagtttggtgctgggtggcctcgacagccgcagtgaactccagcgtgttgctgtcctctcttttcttcacagctgactgggtggtgagtggtcagcgttgtttctcctgggggcgctcttccaaggatatttgggctgcctcctgagccgcagtgttttgggccgttggaagcggggtgacctccagatcttcttttgtttgtggctgtggacgcctttcaacactgctttcctggcctttgctttggcttcagctttgagaggggcaggggcgtccttctttgccttcggcaccatttttgggaaaaggcaacagttatctttgaattgtgttctgtggaatactagttctgtagcatgttaagtattatataaaagaggtttccatagttaaatagatttgacaaataaaaagataagcaagttaaacaagtttaccacaggatttcccagaacctttatctactgatgtgaattgtgaagctctcagaagggtatataaaaatacagcttttccacagcatatttgagtgtgaagctttattttgttgagcacatagccaaaggttagtgctccaaaaaatacaatttgtaaaacactgacctagtataattgtctttgaaatatcaatatttaccaataattaaaacaataagacaaccaagttagttttcattggaactaacagagctgaaacttgtttttactttttctaatatcaccaatttgatgtccctatgtagaactatataatttattatttaatttaaaaatcttgcaaataagtaaagtcaaccaatctggtatgctaaagacattttcttaaaaaaatacataacagatatatgtcaatttaaatatttaggtaactttattttctttattcattttaaagccattattactataaaccagttaatttttaaaaaccaacgtaaactttatttatctatttatcttattatttatttcacattcacacacagggctatggtgtgctgtttcatgacatgagtagttgatgttatctgtgtaaagagagcttgtgaaaagcaatctccactgaaatgttaaattaaatcaaaactacacctaaccttccctggagtaggaaatggcaacccactgcagtgttcttgcctggaaaattccatggacagaggagcctggtgggctacaggtccatggcgtcacagagtcagacatgactgagtatgcatgcacactactcaatatgaaacaaatatttaccacgtgaatagaaacaaaggtcaggtaggcagacagacaagctgtaagcatcacatggtcaaaagtccagtcctcattcacttgatttgagatggagagtgaagaaccaggttcctctccgccaagaagaagaatgaacaggtaggtgaacgatagtatcgaaaggtcttggattcactatattcatcctttcgctactgcagtcccccattcattattaagggaaatggaagaaaatgggcaagtacaggtcacgcaaatagaaacaaaggtcaagcaggcagagagagaagccttcagcatcacgtggtcgtaagtccagtcttcattcataataattctgaatctgtgctgcccattctacctcttgcctactgatctaaaaccagtaagaagtcatctatgtgtcactgaagttaactttcaaacttcactcaatgtcactgatgaaaaaatgtttaaaaatgatttcttcatctacaacagtgataggttctatctgagatgaactcccaaatgtaacacatactgatttagattaaaaagaacacaaccacaatgctatgctctgccacagagactactcactaaatattaatcgcattaaaatgactactcaggagaaaagcactcttaataacttgatttgggaataaacatacttctgttcaaacaatgatagaaaactatcctctcattatttattcactaactattgttagttaacaattttattgttcatttattttcgatcccaggcctattttttaaaactatatctgattaataattaaaatactgtattatgtagtagcatttggatattatattaaagcattaaggaaagctctagaggtaaaatagcaatgttctcatttctaccacccccgtgctatattctagtattttgatcacagtatgagcaaagggatgcactgaaaacacctagatgagaattttatagttattgcaaggatgttataaacaaccttgtcatctgtatcactgtctatgagaatacaaaggaataaagtctcttggatcacaaggaggaaggact

SEQ ID NO: 28949 - DNA, 686 bp, Bovine  19866880459425
cttctccctggcaagctttctgaatggcactttccgtataaacaggaagagtgcatgtggtcaccactgaagtgtgcaggtgttgatagaggatgtgaaagtgtggaggcgagtgactaaaccagccaatggcgtttccccaccaggcatgcagccagcctcctctcacccacagcagagcaagggcaaccagaaggctggaaccagcagcccgggcccccttctggggggccatttgacacacagcagaagaacatggtcagggaggccaagggagaagttctcagttgctctgctcctctccctaactctaaataaaccctttaaaagaatcccaggaacagctttgaatcccttaaatataatatattcttatcaggtatgctgacttagatgggctacttaacacaaagtctgctggtttccctaaacttcctgggcatccaagagaccacaccaaaagctgtatcctgcctctggactggaataagccttctagaactttctagggcccagatgcactggcagaggagaaagaaccctggatgaggaatcagacaccccgaggctgtgtgcgtggagggcttgtgcctcctcacctcccccaggagggctccctgctctgtgcccttgcctctctccctgcccccgccccatctctaaagtcactttcactaatgtcacca

SEQ ID NO: 28950 - DNA, 1514 bp, Bovine  19866880480243
ggcggaggaagggaggagagcttttggaccttgctcagcaacgcctatcactgtcatagataattggagagcgtttctcacatgctgggagatcgtctgtcctacacacctgggaagtaccagtgtcattttaaggcctgccctttgcaactcacctctgaattatgtgaaatatacagttatagacatctctggaccatgaagggattattcattttttgagtttacaaacgcagttgtaaagagataacaaagggctctttttaagcacattcttcattccacatttcgtctttctcctctcaatactcaagcaatcgaaaaacgttcggatgattaatttgatgcccagtttatgtgccaaagtttacataacttacgcgctaacaaattattttggctgaataggaattaataacaggttttttccttaaaaatcattatttttatcatttctgaagagttaaatgtgatttcttattataagacagttttgtggatatatctatatttggaccagtgctcttcttactaagcatttaaagtgctttctagccatcagaaatgacagcttgtgatataacattattgagtgtatttgtccaagatgtgtttctcagtctaggaagagtctttggcttgcataggatgactatttatttcataaagattgtgattatttgctggtctttcttaagatattatcctaaaagttgtaagtggttctattatcatgatttctaatgatataatgattgtgactggtttcaaattgttaaagtattactaatttttaaattttttactatataaaataggaaaagggttttaatgccatctggaggcattctagagaactgaaaagggtagagtcacttttaaagatttagttcttttgagcaacgtttgagactagagaagaatttacgcaactaaaatattaactatttgagagtaagttttatttttataattaattttataaaagtgttaattattatagaagtaaccatttttcaacaaaatcattttaaaagcatacaaaatatgttggaaagcagctagcatcctacatttaattttttcaaatttaaaatcacatacaatgggaattccctggctgtccagcgggtaagacaccatactttcactgcccagagcccaggttcagctcctggttgggcaactaagatcccacaaacctcacagaacaaccgaaaaagaaaaatcacattcaatagactcaaattttgttaatacagtttgatgtgccactaaagctctccttcccttatacgtttctgaaaagccttagtttctataactcaataccttaacaaaatcaatatgttgtctgagaagttactttaaaaccctccagagatttgtgaatagtgaaagcttgaagcatgaccccacattcctgaacaaagcagttccttattcatctgctcacatcctgcctcttgaactagaaagtagcagaaatcaagtctgaggttggacctgtatta

SEQ ID NO: 28951 - DNA, 1590 bp, Bovine  19866880513254
gcccgctgagtatttccttctgcttctgaaccctcccactcacccccatacagcaggcaatgctgactatctcttctggaggaagctcactgctcttggattgttggggcttaatagcagaatctgctatcacaggacccacaaaaagatccgtcattccacagcccatctcagtcctccctgttcagaaagaggagcacacgcgttccctcttactccttgcatgtgcgtcctcagtcgctcagttatgtctgcgggactccatggactatgcagcctgctacgcctctctgtccatggatgagggaggtcataagatgtttcaagaaagagcaggaaaatccaggcagagcccatgtgatgcctctgaggcaggtgcagaaggctgctagtgaagagctagtgaggtcgccgacacctgggtaaacccgcagctgggcagcctgtaacgatggcctccaaacccactgcacttgcacatccccaaatggacaagtttctggggtcttccgcctccagaaaaggaaagaactgggatgaggcaaggcttgtaggagagacaagagaccagtagtgaccctgtctgggcagcagcatctccccaccccctctctgccaggctgttaagaagtgaaaaactaacctgactcctgatctgttgtttatatagagtcaaagttgaaacccagggtgctggacaggcacagactgcacgcgtgtgtctgcatgtgtgttcacttccaagttcacgcatgtactacatacgctgcactgtgtacttcaggaagtaacaaccccttaaggagaggctgctcaagcaggtaagcttcagtcagacgtaaccttcaccttagaaaccaggaactggagtaattagattaccatctttccaacactgtgggagagatgtgatcaattggagccaagatcagttacattatttggtttacctaagtaatggacccttaaatgcaatcaatacttctccaggctgtgaggcttcaagacctgagatgcattcaagaggaatgctgatgcattttcaaagagccttaggaagttcagtcatgtgggaggggactgcagagactagggcgagagaaggaaaaggtcatctaaatgtagggtctgcctctctttccctcgttcatgtgctcttttcatgtctgtttgtatggacagttcacatatgagctatgtgaattacattagatataattatatcacatcttttactgatgatcctaatcttgggaagagcagccatttcactcagtttcttctgaaagtttcagcattgaaacttctttacaggatcaagaataaaattaagatcgctactgatgttcaaagaaattcgcaaactttagtaaactgtgaagttatgaagaaaatggcagatgcagcttcacatcttccatctcaccccaccttccctccatgaatggatcaagggacaggcagtgtggatatcacaccaagtttgtgtggggaccacccagggcctgttgtcctgccttccaggacaactcttgcttgggctggatctgtaatgtccgtgtgtgtgtgtgtgtgtgtgtgtgtgtgtgt

SEQ ID NO: 28952 - DNA, 792 bp, Bovine  19866880532990
tttttttttaataaaagtaatctttaactggacactactttaattctctaaacaatgttatagtagttgtccacattttgaaattgtcttgtttggtacttgaatggcatgaaaaatttccctctgcttccctcccttctcccaagggtcattttccccactcttttctcttccctgcctggcctctgacctgcccagctctgctgtttccacagacttctgaatctaattaatgtcttagtagatatataagtgaattatgtaggcaggaggatgttggaaactttgaggaaggtacgttccttagggaaaacatggtttgttaaaaaaaagtccagaaggctgctcagggagggggtagaatgtcagttaaaggtaaactatcagtaacattgttacactcattacgtatctgctgcctgatgagcagagacaagcttaggcgcatctcttttgacatctgggcaataatcagcccttatggaatccagctaaagggacagatagtctgaatatgcccccattgcaaactggcttcagccacacaactggggaactggcctcccctctcctcccgtcccttttctagccagttcttaaccattcctgggggagtatgtccttacatgatctcagaaatgaccctggcagaaggttctcaaactctccagaacgtgggcaggcaagggggaggggccagaggatactgccagagagcccaaggcagagatggtccctatgccccaggtttccatggaaacataggaggagtgatgacagccagcacagcca

SEQ ID NO: 28953 - DNA, 1591 bp, Bovine  19866880536383
ctctgcatgtaaatgctcactgctagtggtccccaacctcgttggcaccagggaccggtttcgtggaagacagtctttccttaaaccagaaggtgatggttttggcatgagtcaagggcatttcatttcttgtgcacttcatttctgttattattacatcagttccacctcagatcatcaggcatcagaccctggaggttggggacccctgatttactggatgctggaagacagaaggaccatggtgggagcctggggtcggggaaggcacatgccttatgctgatcgtcttctcagaaggacacacgaggaagccagctgcaggcgccgacccaagagctcgcatggaccccagggtctgggtggctgcttggcgggggggccgacatggaggggtttggaggatgtgtacagtggtggggcacgcagatggaaacatgagtttcctagggtgaaagtgcaggacacggagaccccagcgataagcttccattaaaaaaaaatgttttgctaacatctcactgtaatggagaagaagctttgagagtcacctggtcctgcaagtctagccccacaatactctcacaggtcaagatttatctgaaatgctcagaggaggccgtcatagatgttgatgcatgtttcatcgtgtctggcacactgctaatctcacaaacagatttatgaaagcataatatttgttgtatcatatccatgcatgcctgctgtcacttcagtcgtgtctgactctttgtgactccatggactgtagcctgccaggctcctgtgtccatggggattctctaggcaagaaaaccgtagtgggtagccaggggatctttcctcctccaggggatcttcccaatccagggatcgaacccaggtctcttatgtctcctgcattggcgagaaggttctttaccactagcgccacctgggaagcctttgtgccatatccatgtcttagtaaatgtggttacactgcgaggtagagggaggtcatggccacagcctcacttttgggatgaagccgaattcccgagatgcagggaccagacgaggttggcctggccccgtcaataaccaccctccttggtctgtaaccttgaggtcccccttgctggggaagcccctgcctgttctgactctgcagggagagaatagctatctctcctttccgcctgggcaggcagcagagcaagccgagtattaataacatggttggagacggcggcctcaatcttatctgagcacgagaggagtctggctcgttatcctgtctgccgccctcaacttatctgaggaaccacacagtgcggattcatccttcagccccagcgacccttccctccttggaaacctgagagtcttcgcttcaaacacggccctccgggccaggcatccgatgggcctggctcccctctgatctcccggagcctgggagccgggggtcccggcagctggagtaattctatgcctgcaatctggcttcttttcttttcctggacaagatttataaggcagggtatagtcttaccgcagtcattcccaggagagggccctgaacccctagtctccacagccccttcag

SEQ ID NO: 28954 - DNA, 1236 bp, Bovine  19866880548022
ctgacattgcggttgtgtgtgtggacagctttcaaaatcagaacaaaacaacatgtagataaatatgggcgcatgttctaaaagtcatgaaaaatgtcctgagtctcaatccctatgtttttaaaatacttatatctcactgcctccaacgattattaaaaaaaacaagaactgcacaactataaatcaaatatgtcagaatttacaagacaacatatacatgaaattgcaaaaaaaaaatcagggtttttttttttttaatgttataatgtctacatgggcttcccaagtggcacagtggtagagaatctgcatgccaagcaggggactcaggttcaacccctgagttgggaagatcccctggaggagggaatggcaacctgttacagtatccctgcatgaaaaatcctgtggacagaggaacctcgtgggttacagtccatggggtcacaaagaataggacatgactgagtgactgagcacacacagcaatgtctaaataattacgagtgtaagaactacaggtaattatctcttatttaaaagacgatggacttgaaaacactttgtaagagaaagaagccagccacaaaagaccacatactgtgtgattccatttctatgcaatgtccagaataagcaaatttatagagacaaaaggcgggtcaatggttgcctagggctggagcggatgggcaaggaagagaggtgatggctgagaggtgggggttatttttttgggggtaatgaaaagtcctaaagttaactgtggtgaaggacacacaattatatgaatgtactaaaagccactggattgtaaaagttcaatgggtatgtgaattattctcaaaaatttgtttaaaaaacaaactatgattaatatctagatagatgttctaattttccaggcctgtatcctgtcaatcctcgaatgatcatttttgatcttagaaattactcaaaactgtcctgtgagcacgtaatagtaacgtgcagcacatcagtgtaatatcacaacactccaggcgaaaaaaacaaagaaacctgcgtgtgattttcccgatagtaagtacagtcttaaaatgtacttcttgagttgataactttgggtagatgtgctttaattgttccaagaatggctttagacagagcatattagtcatggaaatagctttgacttctctctcccaattccatgatcaacatcgtaattgaattatccctgcaaatttaaca

SEQ ID NO: 28955 - DNA, 1850 bp, Bovine  19866880602310
gcgtgggtagccattccctcctccagggtatattctcaacccagggaatgaacccaggtctcctgcattgcaggtgggttctttattgtctgagccacccggacattaaggcttccaaggaattttgactcaagtccaggaaaagtgggaaccccacaaagtgcgtataacataccatgagaacttaaactggcaagatactactgcagttgtatgaaggcagcattaccatcatgtgatggaacaagctgatgatgatcaaagtacacaagttgacgcagtcatttcagcccagtcacgacttcggtcaaacccatcccccagggagatgcgcagctcttagaatgcggagactgattacgaacctggtttcagtgtcctcagaaaaggctctcccaactcaactttccaatccaaatctctcagatttgagcctgctctgcttctcttcttattagtactgagaccccttcaagaatgcctgatttttttcctttccttcacacagaccgtggctgtcttcaaagactcctgcctagaaagaggcttttcagggtcccattagagaaaagcccattcagcattgggcgaggtagctaaaaacagggtccctcccctggggggctggtgtgatgcccaacagcacacagtgggcgctgcatacaatgctatttcctgagggcgagtgtctcgatggccagaccaggcctgggattccctgagggccacaggatgttggcaagctggttctaacagctgcgcaagccaccgcaggcaaggacagagtgggggccatgggtacagtcaaaggggggaaaggccctcacccagaggctgtctggaggcctggatgctctccatgaaataggcctggcacattctcatgatggcaggtcactagaaagagtccatggagtgtacagcgctgctcagtttccatctcctaaacagttgaaagtataggatcagcgccagacttgcagaaatgcacatctctgtccaacagcagcatcgctcctggtcatttgaaggaacaggatatgtgtgtgcatgtgtgtgtacctgcgcaagcatgcttgggtgtacacgcacacatgccatccagctataaatttactgcagtaaatctccctggtatgacggcactaaagaaataaggaagatattctttagtggcagatttcttctctcttctcctccttcccaagtccctctgaggcatactggacatgtcttcccaatgcattacagcaagaccccgacatttgaaccttcaaagatgcaaatgtacgtttgcatgtccaatcacataagttagctcacaagttcacatctggcgtacactattacatacctggagaaggcaatggcaccccactccagtactcttgcctggaaaatcccatgggcggaggagcctgggaggctacagtccatggggtcactaagagtcggacacgactgagcgacttcactttcacttttcactttcatgcattggagaaggagatggcagcccactccagtgttcttgcctggagaatcccagggacgggggagcctggtgggctgtcgtctatggggtcgcacagagtcggacacgactgaagcgacttagcagcagcagcagcagcagcacgagcctgcatcctccacaagccgttgtgcttttgtgcactttactgtacagtacagtgtggaggacagtgctacggtgtctttatttcaagtccaggatgtccagaagcaagcacaaaatccgcagtgatgtagctggcactgctaagaagtgccaagtgataacaatggaaacaaaagtgaacccaatgaaagagtaaaggaggaaaaaa

SEQ ID NO: 28956 - DNA, 1584 bp, Bovine  19866880657939
ggctctgtggccaatggggctgtccactttgtccgtcttggtcccctgccttcatctgcttttcttcgtgtatttagttcctcaacgaatgacacccgcccacccttctgactgctcaagctggagccccggaagtcagcctcaacttctgtcctcatttcacccacaactgatacgttacaaactcttcctgaggcctctgtcctctgcacgttcctctccatttctgcagtatttagtctgttcctgcttccaatctttttagtctggctgcacagctgcctcccgacacatcttctggggtcctgtcccactccagtggcttctcctactgcagctgtagtgatctttctaaagcagcaccagagccaagtcactgggaaagaccctgatgctgggaaagattgaggggaggaggagaagggggtgacagaggatgagatggttggactcatcaccgactcaatggacatgagtctgagatagtgaaggagacagtaatggacagggaagcctggcgggctgcagtccatgaagccacagagttggacacgactgagtgactgaacaacgtctgcctgagacactttgatggttgtgcccttagaagcgaaggccaactgctcatcccagctgggagggcatttcacgatctggcatacaagcatctgctcaatttcttccgcagttcctccttccggcctcgctcagcctcacctacacgtgtaggctttgcaaatctgtttcccccatccctctgcatcacccacttctcggcttggatgtaattttctcctcaaaccggaaagggaggtccctcctgggcgttcccacaaaactctgtgtgtggtggccattaatattgctcatgaaatcaagattttacacatatatggaactgtatttgcacatgactgtttaaactgtaagctcatgcactaaaaaagtataaactttaataaacagtataagtaatttatagtcccataaatttttaaaatctgaaagtcacgtgctgtaattaatactgacttgttctgcatatacaatgaaggaaatatttctctttctacagtcagagaaatcaaacatttatttaaaatcagtaagcaataaattctaattcccagtgggggacttttctgaataatggttaactacacacatatgcaacatactatgtgtctgagtatagttagctgaattctgttgactcagctcaacaacgcaggtgtagctcattttacatgatggggcatcctttgataactgtgtgcaaactgaacttctgtgaatcaaagtttattttaaatgttccaatgagcaaattctatgtaattccatgttcaaagggaagaatcatgtcctaatttaactttcttgaataatccagacttttataaattggatctacttatagcaatattataaagtaattaaactgattatcatcacagaataaaacacgaagaataaacccagtaatataagatatgaggctacctattaccaacatcctacataataccaacactgagatgattaagctgtcttaaaagcctctcatgcataatgaaggaagaa

SEQ ID NO: 28957 - DNA, 1039 bp, Bovine  19866880669111
cactcccccgcacctacctgccactccttggcttcaatttaaccttgcctaatgaggcctggaaaagagccagttccagaactagccagagacctgacttgtccaggtggccctcagaccaccccccaaagccaacctggacctctgcccccaagtgaaacttgtcataaagcaagagccatgtttctcctctcagacacatactcctgaaattaacttgtcaccaccctcgccagggtccctgcctgatggaaggcaaagctatgtcgactcatgtacttatatctgatttttttaaaagaagaaaaatgcttccacttgtagcactgcgtgtatttctttataatttctgaagattagtgtttgagtaccatgttgctctcatagcacttggccgaaacgtcattaagcctgcttttgctaagcttcacacttccaagtgtgaataacgtaactcgttcaaccccacttttagaaaaagaggaaacatgcaaagctcattagaggttttcaggcattctttcaggatttaattgccagattttataccccattagagcctttccagctctctttaggagccattcctaaaatcaagactttattaacacttttgaacacatttgctctgtgacagcatctatgagaggaaaaattccttcccttaaattttcctacctgcagaagaatattgtggactatatagtatgaatggaaacttggagagggctgtgatcggtgaggagagattgtgttgcaagtgactgaaaattcattgaggagtcaggaaatggtatggttagatacactggaataactcagccaggggaggaaagagcctgatgagtgacttaaaagaagaaagctaaattctttcttttataaacctttcaaacttttaataattggtgagcatttccttgcagttctgtgtacatttaaaatttccctttgaaactccatttttgaccagtagatttttaaaaataaggatttgttgatttatttctttttggctgtgctgggtctttgttgctgt

SEQ ID NO: 28958 - DNA, 951 bp, Bovine  19866880714069
aggagaagagagctctaactgggtttaaagtgcgtttgtgtgtgctgtgtatgtgtgtgtacacatgagagtgtgtgagcatgtgagacctctgtgtgtgtgtagattgtgagtgtgtgagaccaggtatatatgtgtgattgctagtggtgtgctgtgtgtgtgtccatgagtgtgtggaagcgtgtgagagccgtgtgtgtgcgagtgtgtgagaccaggtgtatgtgtctgctctatgtatacatgagtgtgtgagcatgtgagagctgtgtgtgtgtagactgtttggggaccaggtgtacgtgtgtgattgtgagtgtatatgtgagtgaattgtgagaatgtgtatgtaaacctgagattatgtatccgagtgtgtgaggctggtatgtgaacatgagtatgtgtgtaagtgtgtgagctcggggcagtcagccagggcccaagcgcagccctccaaggggctcctcacagctccttggacttgccagcccaggacacccacaccatgcccaggacctagcggagtcctgcgcccaggggctccgagcctggctcagtgccaagcctcgcctcgcctcacgcctcctccacagagcccaggcacagcaccaaacagtcaaatattttccttttctgtcatcgctaacgatagctccataagttcccagatcactgccttctctcattgccataattagcaattttctgatatcatacaagcactggttaattatttcctaggagacaaagcaaagtcgtgggatgttgctgcgcagtggatacattctgctcccgagagaagcccagcacttatgtgtcagtcacaccgcagggtgggccccagaagggcaccgtgaccccagggggtcccagccctgctgctcaccgatgtgtcacgtgggtccacaacatcccggccagggtcccagtaggacgagaggacat

SEQ ID NO: 28959 - DNA, 1796 bp, Bovine  19866880719070
atctcagcagccagctgtgcctggcggctcctggactgggcagtgcagccctagattccccaggggcctccgggttgggcggggggcccgggccctactcccagctctgtgctgggtgagtctccctggtggggctctcacagactcaatgcttctagcgctggacaatctgactccagtaattcatcagcctcccatcaaccaggggatttaggccaggtaccctatctataagcacaaacatgttcttctctagttagatcttttgagaaaggctggaagcgtgccctgaaactgcaagggaaaatcgggagtacgactttctccgtaaaaactctgattttacatgcgtgcccatagcttcaaggcatggagcaggtgggactatccctgccccactcttttaattatcaatgaacacgtgtagttttgacaactgtaataaagagatttctcacactaacaatacagccctacattttgacttgtttttactggtcagagattggatttcatttgtaatgattaatcctgagactccatgaaacttatacacacttgaatgccataaaataagggagctgatgaagaagccaaaataaagtatctgcaaaaataaacatcacagggtcatttttctctggctaaagaacgctccagaatctctgaaaagatgacttatgtgtgtggggacagcccaaaccatgccaacaaggcactcactaaacatgagtcatccagaacttagccccgccgtggatgcacccactcctcacagcctggtgccccctgcacccaccccagcagtgagccatccaagcccatttaaacaaaactgattgttttttgtagtgaggggtgtggataaaattctgaaatggattgcctgagaagtcaatttgacatatgatcacctaaaatctcactttctcagaagaactataaaaaatttcattaacatcacaccaacctccaaggtcctcctaccagcatcccgtcatttaacagcatcgagtctcaggtggtttatacacaggaagctaaaatgactgcatcgcagccaaatagtgagcaattacacgccaagtgtatcgtgtgctgctgtcatttaaacttaagctgcgttccacaggaaaggtattatgcattgcataatccaggggagtgccagcaacatgcagttatatctacccccactttgttttctacaaaagaaagagaatcaagtttgcttgttactcttctacactgttctcccttacgcaccacacacgtggtctctggaagcccagagcttggactaacggaaggtctgcgcatggtatgacacagcgtgtaatttctatgttctggtgggattactgatggccacggagagggaggcggccagcctctctgctctctttgctcttctcttccaccgtctatttcttctgagatccctgccctgccgtggagatttgaaggtgttaggtctctcaactcaattttccttcccacctctaggaaataaagcccacccggctctttctaagtagagactggaaaaaggaggggaaagcgggtgaggggcacgtttcacaagagttcaggtcaggttcctgcagatctgcgaattcttagtgctacatggggtcctgccgcacatacagctaagcagacctgtctgtggcacgagatggccttctgcccatccctgacctgggagtgggggtcgtgtgtgtgtgtgtgtgtttggaattgtggatattctaccttgaaacagactctccaactcaaagaccaactgttaagag

SEQ ID NO: 28960 - DNA, 1252 bp, Bovine  19866880726766
atttaataacatgaagtcaaacataactattttagatttaagatggttacaattatgggaatttttttttcctctggtattgtatttcagaaagaaactcttaggtcatgtctctggggtcctggaaatacttgctttgtaattttttcatactcaaatctcagcagtgtttatgctgcagaactcgggaacccggtggaatacttctttgcattgtggggtcaattacaagctccaattaaagcaaatctggctttgcctacatgtaaggttcaaaagtatacctgcacgcagagatgtatgagctttctgcttatgtgtctacgtttctacaactgctccaattgtttttatgcctctaccagttagttccctcttcacccacaggtaaggccaaaggcacattagcaaaaagtccctatgatgaccctctggggccctgttgttctagccctacttttcaaccacttggccttgttttatatgtctagagattagctactcttcgggagactattcctgccaattctgcctgttgggcacttgaaagcaggttcatttaaacatcaataactaggagtcctcattgacctcatgctgcttaattcctaacctagtcttgacccccagaacaaaatcttgtgaaaagtcaataaaagtagcaaacagtgttatgttatccttggcagactttgcaaaacaatgatagggtttaacaatagttcatcacaggcttaatagttgccagcaagtattgagtgtttacatgcacatatgcgcttgcggatgcacagaacaaccaaatgaggtaggcactgtcattatccctgttttacaggggaggaactatggtaaggagatccaactggtccatcctagaggaaatcagtcctgaatagtcattggaaggactgatgctgaagctgaaactccagtactttggccacctggtgcaaaaaactgactcaccggaaaagaccctgatgctgggaaagattgagggcaggaggagaaagggacaacagaggatgagatggttggatggcatcattgattcaatggacatgagtttgagtaaactccaggagttggtgatggacagggaggcctggtgtgctgcagtccatggggtcacaaagtcggacacgactgagcaactgaactgaactgtactatggtttaccggggcagagtatttaacctgaggccacaaaccatcaaccaggctcccatcagcaactccggagtctag

SEQ ID NO: 28961 - DNA, 1018 bp, Bovine  19866880739178
acttgcttgtaataacatcctaaaaattccaaaggttattttccctcatccacagttaaaaagccatctcctacagaacactgtcatgtctgtgacgtgtccaggattaaggcaagagagttcttggttatagtaatttgtctggttagagattaaagaaaaaaaaaactggacttgagctgtcagttaatatttttcacttaacaacaacaacaaaaaaagccattttcatgcttcacggcagaactgtgtgatttttaagcaggtaaattctcctccgtgtctggcatctgatagtttttttgcatgtcagcgtaagcaagcaagcaaaacacgaccgatgaagtttcaaacgcgtcttagttacataaacggaagttagctttctttgatatagaattaccgaagcatctcactgaaaaagcaaaatcctccttgcaattaataaagaattggggtattctaactgagctgaaaactaagaaccttcaaattccaaatgtttccattcctggatgagctttggtattcacatgttaataggatgcctgcttttttttttttttttcttttggccaatgttcagcccaaagagtctgtgaaacagactttttccatcttatgacctgttttagaatttctttcttgcaaaatgttagttattttgcttggcagattgcctgaattcattcttattttctctctctcctactattttacctctctcctgtctctcttctctcccatctttcccctctttttcttctattctttgataaattatatatttaaattagagttcacttggacctacagtcaatgtgtgacttggcagggttgctagagttagcaaataaaaatacataatccccagtgaaatttgaatttcaggtaaaaaatatgcccccccacccagttttttttttaagtgtaaatatatctcaaatggggctttcttgatagctcagctggtagaaaatccgcctgcaatcctggagaccatggttcgattcctggg

SEQ ID NO: 28962 - DNA, 1073 bp, Bovine  19866880799519
ctcccggggaagccttctctgccgactgctctggatggccccaaaccccaatcagagtattttggatcatctgtttctgcaaattttgctctcgccaacttctgagagccattctaggatgaaagccttggtgagatgatgacagtaccagcagaggtgctttgaatcagctgtgaagccaaagccttaagaaggacctcattatcgctggaattgaggcagaaggagctggagcccacccggggtttcctgaccagtaagcagaaggtcacaggcgcacatctgcccctcaggaggatgtagtacagtcgggtaacttcctgaaggtggcagctggagaagggggtctccggagagccagagggactgggattggtggcatgcgagctcccccaagattacctgtgctttggtgtgtccatctgtgacacacctctgtctagcttctttcctggaaagggagtaaaaagggacttaggcatctgtgctgtccccaggcgattcagagcagagacagccaggtggcacggtccagcttcaccctcactctttcgttgccactgtgtccgccctgccgcagctatagattcagaagaccaggccttcagggtccctgagagagggtcactggccttttagcccgttaggaaaccatggctggtcatgctcttctcatggaaacgattcctgtattcctgacgctctggtattctgagaactttcagcatgcggatgggtggtcctttcttttcctggacagacgatggcattgtaacacttctgtaggcagcaaagccccagcagcatcttccctggtttaattgaatccaacatcctggaagagcctgaggttttgcctttgagtcctgggtaaagcagatgaatgccatcctttctgtgttttctaaaagggagacaggagagtcttgcatctctactaaaaagtattcccacctcattgaaattcaggcttgaactctccaccctgaacacatccagaagccctttctctaattttggaagcagtgatctcgggaaaaaaagttttccatctgtttccttatgatgctaag

SEQ ID NO: 28963 - DNA, 1562 bp, Bovine  19866880824017
accatgatttaatcatcgtgcctacaaaatgaagcctctagaaaaccccagagggacggggttcagggaccttccaggtgggtgaacgagaacctgtccatgtgctgggagggtggttcaccccaatcccctcctcaggatcttctggacctcaccctatgcacctgttcatctggctgttcatttgtgtccattcattcgtggctcttgatttgtggacctgtgtttccgtttatcttgggtaaatacctagggaatctctgggttgtctgtttatcagccctggcactgttgacatttggggccagaggactctttgttctgagggcccattgcatcataggatgttcagcagcgccccctgcaggccagtagcaccccctcagttgtgacaaccaaaaaatgcctgcagaccttgttccgggttgaaaactactatagaatttggcagcgacttagtggaggttgataattaaaattctaaaagcaaacagtgctccctaaaggaaacattttatcctcagatgagtatttcttagagttcctttaccagggagaagcagatctttggtgtctcgttcattcacagaagattctatttagtgtgttttattcaaaaattccaaagcattaggcccattgtgtctagatggtgaagagaagatggtaatatgcttattaataggttttcagaggttttgctttgcaacttttggacaccatggttaccatgtttacctggttcttagtcaatttcaaccagctctggtgacatttcctttatgtattggctttcacacagttcaagactctgatgttgctgtcacatttcttctcttttctgtgctgtgtactcatttttggacaagaaacattagcttgcagtatttttcaaagcaggttgaaaatgcttgagtagtcattttgttggaggagtttatcacaggcgagagagttttgcatgggaaagtatgtattttctgatgagcaatcgctttgcatttatttttgcaggagctgcccccaagaatctaattttaggtatcatcaccagggtccatgtgtgtgtaattttgacgggatctacattcctttcattgttgaaattagttgaatgattctgtaattggctttaaaatgcaaaggagatcctcttgtagctgtattttaatttgccgagcttgggcttctgccactgatgtttatttttcctgacaagactgtaaaacgtgtgggcaggccccagcgctgcaactttcccattgaggcagccagagtccttgggcagtttcctctctggcttctcccccaggacccattctcggtgctgatttgcaggatttccaaaatgagtctttcctgattccagaggcaagaacaatgcagctgccacccactgcttgttaattccagctggtatcagagaggcctgatggaagttccaagagaaggcaaccaggttgtcattctggacacactttctaggatttctagggtctctagaaaacaaagcaaccagatcgtcattcttgacacgctttccagggtttctagagtctcta

SEQ ID NO: 28964 - DNA, 1713 bp, Bovine  19866880828980
cataagccaggaggtgcaggccagactcagctgcttgcccttctctagtgacttgctgttcatttcatccttgaaaacacgttcgcatctgcctcatcaacctcattctcgctgacatgaagatagcatcagggcttttagcggacaagccagagtcagttacactaacttagaaatccatatttatttattttccccttcagtgtatccaataagtcctaataaaaagagatgaaggagtcatgtgggtactctttcacactccagacgggtgtgagcaaatctcccagcctggggagggcaactcctcagttgttgcccgattctgttcctccctggaggcaggaaagtcctctccattggccaggccctccttccttcccagggtgcaacaatcaccattgcttttgtctgacttctacctgcagaatgatcattttacatcggattccagcaccaagcctgggagccatagatcaacagcaaaacatacagattagctacagagagagagaggcaccaggtggacaaagccatgcagtgtcccaacagcaggatgaacgcttttccacctgtttgactcacctctgccctctgacatctcccctggctgtgggcaagagctgctgtctttccttcggtcctaggcatctcgggctgcatcaagtagcagcttcaaccacagacaactactcctcacagttctggagactggggcccaacataaagatgctggccagttgcttacctgttgagggctctcttcctggcttgccgacagctgccttctcaccatgtcctcacatggtagagaagagattttctttctcctgtctttccttacaagggcaccaaagtctccatcctcacaacctaattccctaccccaggccccatctccaaatactatcacatgggggttagggttccaatgtctgaatttaggggggaacccaattgttcaatccatagtaccttcctcggcccaaaggccatgaatgagcccttcaggttctctcatcatggataaatttgtgtagacattttattttaaagccaagcagaaggtaaaaggttttactacttaataacaccaattttatcatcacttagcacaacttccttctgacaattttatcatcacttacaataacttccattagggtaataaggcattaagtagatgttgattgcaaataatctgcttacattcactaattatatggagactgatttttttcctcctgtttaaaatgtaattttaaaacatcaatacttcctaaaaacaagacttatcaaagtgaggagacactttggcctcagagatagaaaatgagatttttatatatctggcaagtgcccgattacaggatgaacataaatgaaggattcatcctcagcaataatgtaaatgactcactatagctgatttgctctcaccttctctcccttggggtcaaattaatatgtttactcccgacaagccattttatacagcagaaaatattgatgcctcgctgccatctcaccgggtggggaagggggcaatttcgcatgtggtctttatagagattaagtataaattgccaggctctgaattttacgagacttccatagctgcgaagtgctagtttaagtgaggtatagaggggctctggctacattatatttttatttaaggctgctaaaagtttgtaaggccgtccatacaac

SEQ ID NO: 28965 - DNA, 1158 bp, Bovine  19866880830646
cccatgtcttaatcgatggggaggtggagacctcccaaggaatgactatgacccaggattgcaggtttccaggctgccccactcccccctgaacctcaaacgggactgatcccatcaagctcaccttgatggacatgtggcaggtatctgggaagttaggatcacacggatagtgccggcattctggatgatggtcttcacttccttacaaagagaacccctctattcacttcaccttacactgagccgcaggttcttcaggcgaagtgggttaggcgccagccctaagaaatgtctgttgattggtccaacccaatctttgtgatcttacccttactgtggaactggtttagccatggtcacatgatgcagttcaagccagcttgacgtgaggggtagtctgtgcaatgagggaaataagataggcccatcccttttcctggacacgggcagctatgtgtgatgactgcagcagccatctgagagcagtgaggagcatcagcctgcagacgctcaagtcaaggatggcagtgagaggatatggaaggaaactgagtccctgctgaggccccagagtctctgagtttgccggtcctggaaactcccctctttgggggcttcttactgtgaggcccacatgtccttccttgctaggcttctgcttattttaattgctgtccatgttccctgtcaccagacacggtctgtcagctctgcgctattacacagcctttcaaaaggcccttctgaagagcgcttcctgcagaaacacctgaataatacttgatgcgtttgccctgagagtcctcatctggggagcaaatccagcctggttgacaacggctcatgagatcacagcttgagtgggcacagccacaagtctgggttcacattctgtcatttggtttccatgaaaatcgcttgtgcttgtcattcttaagctcttgtattccgggggtgagatgcaaattaaacaccacgtcatgctgacattaagacgcttggtttatttgctttaaacacaggagagaaatgggattgatgtattcagacggagatgagggtaggaggagggttttcaggagacatactcgattccaactgggtgctgccaatctctctgggccccaccagcctcccttgggagctgcctttgac

SEQ ID NO: 28966 - DNA, 829 bp, Bovine  19866880853733
atttagagcaaaatctttgagagaagtagaactgcctgaattactgctcttttatatgtttttaaatgagaatgtaaaggccaagggcattttttcccatttaataccattaaatccatcattaaatctctcgctgaacactggctgattttaatgatgccctcaagggccgatcctggtgcttggctgtgttaatattgttgtctatatagatacaataaataatgcttagctaagatggtatgagatgcattgctgtgcgtatcaataaaaatagtcgtgctaatgagaccaagtgtcaggaacagatggtgtggtgggaatctagccactggagctaaaagcaccagaaaggacagagttccaccgacacgttaaatctatcacgaaagccagcctgaatcctgtaaatattttacagcaagttggcataaaaggattaatttggagttagcgtttatatttttattatcttcctttatagcactgtggcataaaaaccacagatgctttccagtatctgttctgtttgctggctccagcacccccaatttctaggcagcatcagagacttacctgcctgattcttgatcacagggcagagttacactcatgtttttatcccagaggaccaagaaacagggtgtggggaagcttaaaaaattttttagaacatttgtgattttgaagatgaaacattttttaatctgactgtccaatactatatccttcactttatgagtattattattctatgatatattgtttttatccttaatgataatttcaaggataaagaagatgcaacacatatatacaataaatatta

SEQ ID NO: 28967 - DNA, 703 bp, Bovine  19866880902393
ccttgcatccccagcgtcatacattaaccttgtctcactgatacatgtcattagttcagcagaggtgagatatatgtgccctgcctcgtgaaatgtgctgcattatccatggatgaaggttatcaaatgcatgaactcatcattatcattgtgcattttaaatcacactgtcatgaatattcagagttatatttctcgcttattttacacaaaggagctactcagcatgaacacaaaggcagaaagtaagactcaaagaagcaagtcattgaaagggaatcacaccttctgggcttctttcttcactgagttacattcaagatttagagcaaggcagtagagaaactccctcaacgtctccttacttcttcccagtccagagagagcctcggctttcacatgatgcccctggatgcatccaaagacaaacatttgaaaaaaacagtgtgatgatacacttgtgtacaaacagccctgaaaaaaaatcactgcaacagttttactttcatattaaatagaataaacacaagcccagagagtatggcttcagattgaccactttataaatcgggcaaacgggaatgtcccacaagtatgatccatgatcagaacaccagagtccacacttggagtctgatcccaaagcagatccaagggaccggctgagagagaactgggcgcccaacacctttaactcgctcag

SEQ ID NO: 28968 - DNA, 1767 bp, Bovine  19866880916375
ccatgggcattctccaggcatgaatcttggaggggattgccatgacctcctccaggggatcttctgaacccagggatcaaacccacatctcctgtattgctttaccatatgagccatgagggaagcccttttaatgtctgagtgaagttgctcagtcgtgtccgactctttgcgacccccatggactgtagcctaccaggctcctctgtccatggtattttccaggcaatagtcctggagtggattgccatttcctcctccaggggatcttcccaacccagggatcgaacccaggtctcccgcattgtagacagatgctttaccgtctgagccaccagggaagtctttaatgtctagtgggtatttcaactataaataaatttaatcctctattttttgattaatcaacttctgacagtaccttttcttttatactatgtgaagtgaagaagccccccatttatgcttccctcctgctctcccctccctctatcaatcctactctgcacagctatatctttcttcctgcatagccgagatttaaaatatttatactctgttcagtaattattgagtcatctcattaatattaatttaattaataatttaattttgggaagtacctataggccaatgagaaaaattatatatgaataatggaatttacaatattgtaacaatataaatataatctctaagaaacagtagaaagactggacctgtgtagagggactgccactaaacttgaatgaagacaagggttcccagcatttacgtcaaatggattctcattcttatatctcactgtggcatagattaatctgtctcagacaaaggctatgcttttcctagaaagaagttcaataaagcatgcatgtaatgtgtgtaaaaatgtgtgtgtgtgtgtgtatatacataggcttcctgggtggtgctagtggtaaagaacaaaccttccaatcctgggtcaggaagatcccctggaggagggcatggcaacccactcctgtactcttgcctgggaaatcccatggacagaggaacctggtggggctacagtccatgggagttgcgaagagtcggacacaactgaagcgactgaacacacacacacacacacacacacacacacacacacacacagtttttaaaaagcaaattaggttaattgtgaaaacaccttgcaagcccagaaatgggacactgacaaataaataacccagaatcctcttaggcctgcatcctattgagttccagttagcaagtaatggaatcttgtgttaatcttccatcttttcttgatagttttggctgccctgtatttatttgtaaacaaaatagtcttcagtttttcctgattttaaatttcacatcaatggactcgtactgtatgcattcttctggaacttacttctgtcattcagtagtatggtttttagattcagccaacatgatgcacctagctttggttcattcatcctcactgctgtgcagcatccccttatttagttcagctcagtcgctcagtcgtgtctgactctttgcaaccccatggactgcagcacgccaggcttccctgtccattaccaactcctggagcttactcaaactcatgtccatcgagctggtgatgccatccaaccatctcatcctctgttgtccccttctcctcctgccttcaatctttcccagcatcagggtcttttccagtgagtcagttcttcgcatcaggggccaaaatattggagtttcaacttcagcaccagt

SEQ ID NO: 28969 - DNA, 1192 bp, Bovine  19866880922593
taatgtaactggtaggtggtcataacacgcgctgagttaggagtttacaattcacctattccatttccagtcagcctaagatggaaaagtagcttccagacttggctttaatatcttcagagaccctgtagtcattgtatattccagccaatttctgggaagatctgagtgctggggagatgtaccttatcttgcagctccactgcccagcacaatgcctgacacgtagtaggagttcaacaaatactagttgagtgaatgaactgtgcgcccatcattggctttcatttccccttcagaaatgtgagggttatataatatccttgactttttcagtgacatcatatgttcctcttctctgggcacctttctaatgaatggcttctggaacatagcacagggcactttatttggcaatagcaaggttgtcctttttcctgcaaaaaaaataataatttattagtcaactttgcttcactgccgactcccaccagtaactccaaatttgtacacacaggaggctgcttaagctccagctcgtatgttcctggagttgtatctttggccctaaatataatattcatttatctctattaaattccattctgttagaatggcccatccagcttaatgagctctttctgaatctaattctggcgtcaaacatatggagtatgtgtggctaaaataagcaatgtgacagccaggaccttctgtgctcatataaataattctttggtttactctttaatcactctgtttccatagttcattgctcatgggttgaagctgcctgcccagtcgtgtgtgtgtctttttttttcctcaaaggcttccaaagagtcaacccagagaagcgctccccattcctccagctgggacggtccctgttgctgtctccgccggcacctggtggctggcccgagccatcagttctgccacgtgtccttccagcactcacctccccacagctcgtgttgactgccgttcagcagctcatgcagctggcgcctgaggtcatcagtgcccacgtgttctcagcagtgttgccaaattgactctcagcatctcttctttctatttaacgctgaagaaggttcctataggacactgattaaaatgcctcaaaagcaacatgtgacctcactgtcacctctgagtatccagctgcacagaaggcataactcttggg

SEQ ID NO: 28970 - DNA, 898 bp, Bovine  19866880946366
acatggcgagatccaagtaggaaggtcgaggagtcctgggggttttctgtgtcccaagattcatattgaaatttactgattaacactttgaatataaaaacagattctaagtgatgtgtcatgtattactgcaaaatgtttctttaagaaataagctgctttacccggcagcagctgccattatccccctgaatggattctgagtggtacccaaatggggtcagctgagtcagggcagccaaggggctggaagtggagacctgtatacctgtggcaatgtggcaccaccaagacaaaacccaacacccaggctaggcggtgaaggacccccgttgtgagcgctgggaggtgagattccaagaagccccgggtatctgaaagcaatttaacattttaaaagctctgaatggtaaaggttaacctctccattgattcaccagtcctgtcttgttgagatgctagaatttacaagcgcaacgggctgagccccagtgaaagagagggacagaattcatctgcagcaaggactggagcctcagacacaatattccatggcacacggaagtagttcagaggtaacaggacaacagattgctcttcaggaccaaggagagcaaggctacatccatatcactgaggaacagcgagcctggtttctccgagtgattggcctataaaaggaagactgctctatttattaatgtaagaatctagcatcatgagaggcttagggcaaaatcctactgtgtcccatgggaaaatgtttgcccaggaaacaaacaatcaatagttctatattatatttagctgaagttttatgcatgatgacaaacacagtccataaatgtcacttggtaatttgcacgggcaaaaatatagccaaaagtcacacatgggg

SEQ ID NO: 28971 - DNA, 1930 bp, Bovine  19866880960688
aggattttgtgcgctacctgggtgaccccaaccacaggtggctggatctccagttcggggaccacatcatccactgggtgacatacgtggagctgtgcgcaccctgtgagatcacgtacagcgtcgtcgggcaccacgagaccctggaggacgacgccccccatacatcctcagagaggcgggcatcgaccacctggtggcctaccccaccatccccctgggcatcaccgcgtacaacaggaccaaggtcgagcagtacttcctgggcatcagcaaacgagacatccggcgcctgtatgcgcggtttgagggggactttaagctctttgggtaccagaaaccagagtttttgctaaactaatgtgtaggaccatgagttcagatatcttcgttagaccagaggctaaccaggtggagctcaggcacagaaatgacacttcttcatctcactcctcttgaagactgccactccctgaggaccggggtgcatcttgcccagttaagctggaccctgacagttacgaagtagtctgcatataagatgcatggagggtcctggcccccaccctccagtgccactgagcctctgctctcctcagggtagtggggagagcattaaacacttgcagtcaaacagcagggggggtatcagacggccttgatcatctccctcagttgtcagacacctgcagggcagggcagtcctgactgtccccaggggacagcaggcatggcacccagcactttgaagagaggtggacaagccggtaccctgcagacatcccagggccggagacaggatcagatctgagtgataaagtcactcttctggctctcatctcagccgccgctgtcattgcagaggcaaacccttctctccatggctctctagttcccgagaagttcaggaatgacccaagggtgttcctcagctgctcaccttttcagaatacaggctgtgtgctcctcggccagatttccacacctttacctgccaagtgattctctcattcagtccaagagatccagttttgggaagtgaggggagtgtccattcttcccaccgaggaagggagcctctttgggggccttaaggggagtgtggcctggggagaggcagggctggccaggtgccagaagtcaggccgccctggacttgggcacatccttcccagtggctgtctgcctcttgttgctgatggactcgcgtgggtgggcacagaggtcttcacccatctcctccaggaccagtcccccctgggggctgaaggcaggcacaggcagcatgccagcatcgccagatcagtgcactgtacacattttagtctcctttcatctcagcaaaacgtgtcccaccaggcccacttctgatgatgccatcatcctgacccaagttggataatcaaattcaccagcaataaaaccctgggccgaggcagcccacgtaacgcatcttccaggcactgaggagcagcgggccacactaaccacttcctgtgccgtccgacagtgtggcccctcgaggtctgggacggtctccctgcagaaagtcccaagtgtccaaccaggccgcacagggctctggagcccaactcttcctccaggcagcccccgctgtccctttctcagtgtgacttcctgagtttgtaaatgtgaaagtaacatgaaataaaaaacacgtgccaacctgatgtgcggtgtggctcccagggaggtgccgccctgactgtgtcctgagggctggcaacagtgaggggcatgcgcccgcccgcagcgctgacgggggtgggaggcgggcagcccacgaggtgccctgtcacctgcagaggctgcagcaccatttttctatcaagttttagcaaagtcttgttggaattgtctcacgcctgatgcacagaatgattgttgttgagttgctaaggcgtatctg

SEQ ID NO: 28972 - DNA, 1085 bp, Bovine  19866880987221
tacttcgatgtgtaacaggagccactagagattaccaacatcatcttaaattgttctccaagaaaaatgatgcatttaattataagccccctcctctttttaatcttttggctgcaccacacagcatgttcacaattaacagtgttagtcgctcagtcctgtccaactctttgtgaccccatggactggaccgccaggctcctctgtccatgggattttccaggcaagagtactggagtgagcagctgttcccctgtcaagtggaatcttgccaaccagggatcaaaaccagatctccatgttgcaggcagattatttacaatttgagccaccagggaagccctgccactcagcatgtgggatcttgtttccccaaccaggaatcaaacccatatcccctgcattggaagcgtgaactcttaccctgcgtgctcagcagataaacacatgccactccgtctggtgcccatttccaggcatcttcgtatcataagccaatagcagggctcaaagacgtggagtgggcagggcacggtggggaaggccatggcgcacacaaagatgggcacatctctggtcagactgcagggtaagaggaatgttaattagatgtgggagctgtcagatacggaagggtatgacaaccgtagttctcttaatgacaaaacccacgggtttgcctaagccttaggcgggaaaagaaagtcaacactcacagcgtgagaaagcactcagcaagccctcttatttaatctgatgagagaatgtgcttaagatcactatgaacacattctcatgaccttgagggcacagtgctaagtgacgtaagtcagagaaagacagaaactatatgacctcatttgtatatgcatctaaaaacgaacaaaaccaagttcatagacagaggacagacagggttaccagcagagagagagagagagtgtgtgtgtgtgtgtgtgcgtgtgcgtgtgcgtatgtgtgtgcatctgcttgtgtgtgtatccgtgtgtgcaatgggtggagggggtcaaaaagcacaaagctccagttataaaataagtcctggagatgcaacgcacagcatg

SEQ ID NO: 28973 - DNA, 899 bp, Bovine  19866881037688
taaaaaatctaacagattttttttttcctgcaaaggaaatggaaccacagaattcaaaacgaatccatctaccttgctcaataaagactctgctgttcatttactgtggtcattgattttttgcaggtaataacagaggttgagaagaagtaagcttttaaaaacgtggatgtttttgtctttcaaaaaggagcctttgctccttttctagagacaaaaaaggataaaattgcctatttcagacaaaaaaaaaagtttaacatgtatcttgtgccaaaaggataactatttcagagtaaaagtaacacttttgtgctatgaaaatgactatttcagtgtaaatatactatgttctcatgggctatgaagttagctgatgactgatttaaactatataaacatcagagtcagactgttctatttattttgtctccagttaaaaaaaaatttcaggaaagaattcacacaaccctaaccctaatcctttagcctccaaataaagtatcttaaataaatacaactatgatttagagacactggaaaatatctgagttcctccactgatttatgtctcttacatgccatgttatagagaccacttataaaaatcaactagtaatatacgtattatgcttttatccaatgatagaaaaatatgatttagtggagactaattcatccacacagtagacccattcttgacaaggtgacacagaggtttgggggctgagtgtggccagggtgtgtgagttagtcaacagcatcctaattgagcagctctgagccagagggggacggaagcactgcatgaaaagtaacacgacaggttcatgatcaattttcatctgaaatccacatgccacaaagatgttgcttctttcccaagggtggagcaaaca

SEQ ID NO: 28974 - DNA, 1095 bp, Bovine  19866881077643
acaagaacataattccccagaactggtggtgttagaaagagacgggagagagccgtgatgtagcaggagctgttggttacccagtcccctggccgcaactataccttagactatgccaatccgacagccacctgccaaggcctgtacttcccacacctgaggattttctctagctttcaaacctcattttgctttcatctgtggcagactgaaggtctcagccaactagtccctccagcaagcagctttcaaccaatgacagataggagtcattgtgtaaatactccagtccctagctcctgagttgtatgttctacgtgggttcctatttaattttcccagaaggttaaattccagttggccacagtggcttgataatgccctcttttggatgccttccctttcttgtctctctctacccaactaccctattgatgttttctttgtctcccaaagaaacgatttgcactagaacccttgtctcaagagcctatttctgggggactgtacctaagacgtggcttagactcacgtagatactgtaggtcctggctcccagacagtagccagaggagataacgagcctccagagatgaaacactgaggattcacgagggctgtggaccatgaggcatgatcagccttgcagaatgtttgttgaagtagtgttaaattgaaaggaatcttctacactagtgaatggtctgtctcctagttgggtagatagtagctacgttttggacgtaagtaaatgactcaccagctcgaaacaagtgcttgtgtctgcaagtgtagcctggacaaagctttttatcaggatgaggtattctgttccttctgcctttatttgccctgtgttaaccatcagcatgttcaaaaacaggacaattattctgaatgtatagaagcaaatagattttaatgattattctagatgacattcatttcagatctgaaagtgttcaaaaaggggccaggagtaactttgcatttcaaatttttcttaagtcattcaaaatatgatacaatatggagtgatttccctcttaattcctttctaaaacttccattgctcattaaacctataatcaagta

SEQ ID NO: 28975 - DNA, 1038 bp, Bovine  19866881168632
gatgaaaataagagaaaaaaacaggtcctagtaaggatccaaagtcctgataactgttttcagggttaggcagctctgccacatgttcagagctgatgactggtagatttgaggatctgaattctcctcctggttctgatgttaattatttagccataaacttccttgtggcttctttacagtgggaataaagaacccaattcccaatcttctttataggttgttgctgaagaaaatgtgataaagtgctttggaagacattattttattaacataataaatattatgttaatattaacatattaacataaatgcagtagtaaacctgactatgaatttgcatgccatcaatatatctactgcctgtttgacaaggtctcatctctaacattctatgtatgatttttttcctctaaaacttctctgtatattcccagcctgttcaaaatagaattccaagtatgtatcatctgcaggactgggcaatgctatgttgtttctgaacctaacccaaagttccaagaaccagaccatctctaaacttctttccagtttgaaaactcatctaatctaagcaacaacaatctctagccaggaacctctcctctttgcctttggactattattttagcagcttattatttactttttttaaagctcatttccccatcccagggctacgtgtctcctgacaccactaatgatggagtgctggggccagcctgggcatctcttccctgctgactgtccaagagtcagcctgtgactcacgccttgggctctccagcactggggtgctgggtggctgtcaccatcatgtttacaggatttggaaattccacctcaagctctactccaagggtgttgatcctggctagctgctttcatgaaaaacaatccaagcaccctggctcacttggggaatctggcattcttgagcttttgatactgagacagtggaaaactttatcagtatccatgctgccagtaatttttatccattgagcacttatcttttacacattacccagcaatttc

SEQ ID NO: 28976 - DNA, 1315 bp, Bovine  19866881192070
ggcctgaaggtactgtggggggcaaaattcccctcctgacgtcaggcaagaccgcatccaagccatcccaagcttttaaagaatctgtcctattcagaaagtctccaaaaacagtcctaagtctctccgtttaatgttatgaactctttatgtcaggaaatttaacttcagagcaaaactcagattcttcatagtttagttcaaaaaccatttccttgggccatcatcctccatctgagtacccttcatgtatttgaaaaccaatattaaattggctttcagctttctcttctccccaggtggaataatttcagttccagtcacttgaattcagaagaaaaaagctcgctaggaaaattcaagtcaagtaaatataagcctttcttttttaatgtaaaaagactaggagataagggggttaaaaagggaaagaaatggtttctctgctgacactatccaatctgaaattcaggctacctgaaatgaagtaaaaagttgtatattaaattttcatcactgcagaattcatcagttcctgcccgtttcccttccagggagagctggagttgacttttctttgtaggtcttacggatttcctttgtgaatttaaaagcaattgcgcgaatcaaagagatttagaagctattgagagaaacaagattccggagtgtggattccttacttttgccaaaacctcagccctctctggaacagaagttattcatctttggggaaagtcctagatccatttgaaaatctgataaatgctaagaacattttcctggaaaaatacgtgtgtgtacatccaggaactagtccctaccatttcgttgaatccctggacctcagattctaatccccaaacctattttaataggctgcattttaatcagagatgaaaatgaatcatttttcacagaactcttaatttatgagcagaaagagaaaagcgaattttttttttttttataaaagggtgaagtaaaacattcctattgaggtatgaattcctggagacataattagatatttaatttaaattgaaaatcctttttaatttctaaagtattcccaccagaaatccgtatctaatagaattttattttgaagaagagttggtattaacctcctcttacagtgcagtgaactgtgtgcaaaaactctgagtgggcaccggaatagtaaaatatcctgcctcagccctgggctggttgtgtggacctgggtccatctgtcaccttcttggtccttcttaccagtagaatactgctttcagaatctgtttcttagcttcgttttctatattttagctct

SEQ ID NO: 28977 - DNA, 1509 bp, Bovine  19866881198933
ctgaagttagcaactgatgctgtaaagtgaaaatgaaatttaaccgagcatttggtgaaggaagagtaatttatgggctctaatatgagaagccctgggagtaggcatcctgcttagcatggacacctgtgatggatgccggctctgtgcctggggctgcagtggactctttgaaatggcatagtaggggctttgcaggtgggcctcatttggttaagttacagcttttgcgaggctctgccatgtctttatagtctaccaaggagaagatggtaaatcagtgtaattgcttcatcccaaggcacttttatattataaagcaaagaggtcctgttaagaaactcaaattaacttggggtgtggatactatacggagagcctctttgaaagctgcttgtcatccagcccggtggtttatcatggaacaattccattagaacctgacacttgctctcgtggcaccaagactgaggatccctcgggaaaagcatttaacccttggctatgcaaagctgtcatttatctgtcatctctctgaacgctcactggagcatgtttacgagagagatttggagcagttgtcatttccatcgagttagaaatggagtcaagattcagtaaatagttgggaaacagtcagtgtccaggcccatcctgcagcagtgacctggccctgctggccccgttagaaaacacactcactgtggtattgtgtaattctcaaggagctcgctgtacagaattcatcagctggagtattagttaattgctagtgctgactcatttgaattgcttatcccagttctattttataggctttagaagaatttttatggttcatgcatatccaccaagggggcttagcagatcttggaagaatgaactgaaattgtcacgatctgaaaatgaacacccttctgcctgacatttactaacaaaagatgggggcaccatttgtcaaagtctgtcagtgagtaagttccctggggagccacgcaagctgagtcgaagaagtcagtctctggtgccagactgcctggcttcagacccaggcattgtcgctcgctggctatgggtattgagcctcttgtttcttcgtgggtggatggagaattctcttcgggttctaaagactatgaaatgaaataatgcatgtgaagtccttcctacagtggctgcatagagtaataaaggggaattggtattagcaaaatttaatctgggcctaatgggtctgagatgatggtacaggtcatcccaaaaggctagtttttttaaaaatatccactagctaaatttttctgtgggtgttcgttacgttctgattctcttcaattttctagtttcacaaaagctgtggtgcagaagagattatggcacagactagccctaattctcttccccttctcatagaacaggctggcagccctaaagcagagatttgtaaattttctgagttccaagatgaattaagattgagacagcctttgggtcagaaacacacaagta

SEQ ID NO: 28978 - DNA, 635 bp, Bovine  19866881208418
gccacttgccagcctggggtgctgtgaggttgcctagaagcctcttagccccgggtgctctggtgctgggagcgatggagcagatcagccggtgcttcctggtcctgcttctttgatgtttgccccggtttcagaggaccggaagtgttcaggtttcaggcatcctgcttgcaggccgtgagctttcgtacatggcagattgagcctcattcaggtgctcctgcctgtaggcctaactccctctgcctgactcctctgtttcctcccgttggctcctggatcaccaaaagcttctcttcagtctcaccctgccacaggagcagttgaagttctgagttgagacctaaacatggatacggggggatggtttgtggggagtgtggacctgcattctgagatgggcatctctctttaagggcagcggtggccaacttaagaggcgaccagaccaacacacctcccccaaccccaccccctgtttgcttcccaggagctttcccttccattgaggagatccctgaaaacgtggtgcatgaccacgagaagaacggcctcccacgcctctcctccttcagcgaggccgagatccagaagcggtaggagtggggcaggggtgggggaggggctgggggatg

SEQ ID NO: 28979 - DNA, 804 bp, Bovine  19866881343478
tcaattgaatgatttttcccctactgacaatgctttaataacatgtatgaggtcttatcactgtccccgttcctgtgctttcagcatctcatttgtatgcaaattctcgtggaggcaacttatttctccggtaaacggtgccagccgattgagtggctctgtaattatgttccatccctgtctaccctatttgtttcctattttatccctgccgcagcgcctgcttcatgttccagtcatgaattactgagtggctccatggcaatttttcttctgtgtgatgggatgctttacctccctccccctgatgtgtttgttacccgtttgccatcactttctaaacccgtgtgtgagacttgttccttctgcctttggattgtgtccttctgttgtttaatctagaaacctttggttctaatacagataagttgttccactaactaagttggctgcatccctcttctccctcagtttgatatatgtgctactgaaatttactactaccagtaaaatgattttgtatacatgtgtacatttggggttggtcaggaaggctgagaaatctaatgaaaatttcacgtgggacagtcatgccaggaataaacattatgcatttagatttacatatgaatacagtatgtaggcttgattttacacatatgtacaaaagtatgtgaataaagtgtgtgcgtacatgtgtgtgtgtgtgtagaaactgtatgtgccctgaaacagtaatacttggtgtttgaactctatatcaatcattgattattttgtgtgaccttgggacagtttcttaca

SEQ ID NO: 28980 - DNA, 1909 bp, Bovine  19866881427417
ctatcttttaaatttaaggctccaaatatttattttccattttaaaaggaggcatattttaatttctaatctaaggttattgtggcctactaaatatatccactaaatattttattttatttttacttctgctagatacttaatctgtataatacagctcagggaaaaaatgcagtcataaaacctgttggtataaagataagcagtttatttaatatctaattaaatgtagtcaccagagaaatcacagcttatgaaactttatcagaaaaagattaatccatttcaggcttaacccaaatgtcagaagagaactcatgaatttagataggaatccacatattaggcaaagaaattttcatattgagtagaaagaacctatattactgactatatttatacttacttcaatcaaatttatatactttgtaactatcactgatgtcaggggcaattatcatatataataacttaatagggagcctctctctatttgtcaaaaatgtctacaatgtccttaaacactttatgaatttatagatcccatccatccagaaactcagaaaattacatagactgtgtcatcctaattcaaaaataacaattcaacaaaaaacgttggactcaaacactggagaagtgagaaaggagaaaatgattccttcctttgaaaggctcatggaaaccatgagagctaaacctttaaacgagcagccacggatataaagtagtgactaccgtacagaagggactgcctgctttccccccgtctctattcatgtcttcttccagaatataaaatttttctcagggcacaagatgacccagcataaagactggacaattttctcagccttctttgactctcagagagctgggtgactaattcgggccaatggaatatgaaagaaagtggtctgcactccttccaagttgaacctctaaagggcaggacacgctccccccacatttccccttccatctgtccagtctggaaaggaacacagagcatcttggatcacatgcatgagcctaacagtcctactgatcacagaacaggataaaggagcctgagtccatgactggatatcaccaagcagaaccagcatgccatctcagatttaaaatgaaagagaaattaacttttgtcttgtttttaagctgctgtttttggaacctattataacaatgtgctctaatttatttataatagagatgcttctttttctgaggattatgttactggaaaaatgcccattaaaaggaagaaccaaaatttaatagtgtgagtaaaggagagtatgatttataactttttcatgaaaaataaaaccctgaactatggcaataaattaatcttataattagtaagacagaaatgagaagcagaattttataaattcttgggaaaatatgacaagggaggggcataatctctttttttttcccactaaggtatacaatcatgtgatacaactaatgacaaaaaatcagatactgtaagaaacagaatggaaactgtttctgaatcactgacacagagaaaaggattaagaaaaataacagtgatttcaggtgaaaaaatacagatcaaagcaattagaaagaaattaatattaatagaactgcaaaaaagaccaatctgactcaacataaggataattgaattaaaaggcaaatcaaaaccaatatgtgcaaacacttaatataaaagaaattccctgaactagacaaatgaactaatcttaaaagattgaaagaacaccctatgtttcaggaaatgctcagtactgaaacattttcattaagccacagaattttaaagaagtaattcttcaggtatttaagcagaaagaacaaaacatctataagaaataacagatgggcatatcagaggaacatatgacag

SEQ ID NO: 28981 - DNA, 727 bp, Bovine  19866881627933
aggactgactgtgctccccaggggagaagcaggcaggggaggcccccggaggcccgcaggtactcacctcgggactggagtagtggggaggcttgctgccctcgctctcgctggaactgctctctgtctccgagtcggaccccgagctgctctccgagtcgctggaggagctgctcccactgctgctgctgccgctgctgctgcccttgctcgagggtgcggaggccctgcagtcggccggctggagtccggcactgcccacccgcgaggaaagagagggaagggaagccgagtgagcaaacacggaagcgccgctgagcgggctggcgggcaccggaggcgcgcagccagcacatctgccagccgtcacctggatggagctggcagacccaccagcaaggtcacagcagcctcctggttaagacaatggggcacagaaattaaactgggagcgaaggctgctgccccctggccatcgggcaccggctggtgtgactggtctatgtgaccatttcagaaaaggaggtgacgtcgctgcaggaggactgtccctgttttgctgctgtttctgggaatggcttttcaaatgcatccccgattccaatcattgaccaaaaaagccaggaaatccaaaatgcttgaaatattttgcaaagaacgaaaaggtctgtttgctttattttaagaagtgggctgtgaaggaagggcacagtgtccttgctctgtg

SEQ ID NO: 28982 - DNA, 935 bp, Bovine  19866881648856
cctgggttgggaagatcccctggaggagggcgtggcaacacattttagtattcttgcctggagaatccccatggacagagatcttggtgggctacagtccatggggtcgcaaagagttggacatgactaagtaactaagcacagcataagggactaaaagcaacagtgagcatgtgcagttggagcaaattatgaaccacaagatacaaaaagaccaaaaacccaactgccaattttgaggaaccgggagcaaaagcaggtcctgtgcacgcgccgtgcacacaagaccaacaaagcgggtgggcagaccacctaagtccgcctccggcgtgacccctggacccacaacttccctcctcacatttaaggaatgcgcttgcccccatcagagagcgagcaagggaaactgttactttttcctcactccttcaagctgcagcctgagccccaaggaagccttggctgaatttctcctctggcctcttatcaatttctattgattaaggagtccaagaaccctggtctggacacccagagcagagaaatcattaaaaaaaatctgactctccccctgcaaacacgtgcctctcagacccaggcacgcctccaccaacccttgcttttgcaggagcgcacgtacctgttgatgttcatgctgcaatgatttgcagacaaagtactgttggcagaggcgctcagtcgtgaggcgctctccctctctcccggggccttcttgatctccctgtaatcgtcttcgttgtcacactgtatggaaagaagcaaaaaccaatcagcttcggacttcgagggatcgcggtgagctcccatctcaccagctcgcggcttctttggacaagctcctgagcaccaacacgatggcagcactctcggccccggcctggttccccgtcagctcctcctgaataaggacgaaa

SEQ ID NO: 28983 - DNA, 1083 bp, Bovine  19866882080081
ctgggaagacccgcgctaaggggtcagagctgcctgatttcagctacaccatcaccatgcacaaacttagcagcatcaaccacttaaccaaaccaaaggattcattttgatgagattctaaaacaagaatccctaatgattccccccacttagagtcacaggaaaatgtggcaggaatgtcatcatatcatttgaatgtgtacccacttgccaattactctgggttgatgcttcctgatgtaaacaatcaactgaacataaaatccaaatcatacatttgacactttatccaagaccaaaaaagattggttatttgggcaaaaacatcagcctcatagttttcctggcaaatgtgctattactaagtggatatatatacagttgacattatgagcaagtaatggtcaggccattccaatgggcaatttactctccaggaaagcgacagagctggtgctatatgcacgctcttttccaggctactcagaatcatttagaaaattactattattattcacaaaatgctccaccaatgtgaggaattaaccctctttcccaacatgaatcaattacttgttcttcaagtaataagcatgttaaagcagaggtgagtccagagtctaaatagtaaaaaaaaaaaaaaaaaaaagttacttttcactgagtacttggtatgtcccaggcactgtgcatttgtgaacagggactaaaatccagcctcatgaagtcttcacagcaacccagatgcattatgtccctattttaaatgaagagtaagctgaggctcagaaatgaaagtcacttgccgcccataacagccatcaaaaagtctacaaacaataaactctggaacgagttggggagaaacaggagccctcctgcactgttggtgggagtgtgaattggtgcagccactgtggaggacagtttgggaggttccttaaaaaactaaaaatagaactactgcacaatccagaagtcccactcctaggcatatacccagacaaaactataatttgaaaagatacctgcacctctatattcatagcagcactgttcacaatggccaagacatggaggcaa

SEQ ID NO: 28984 - DNA, 765 bp, Bovine  19866882158955
accctgccttgagtggaagcccccaacggcagggtctcaatccgtccgacagtgcacagagcaaataaataccaaatgaaagaatggttggatccaatttcaagggcattcaaataaaaaaccactcttacaacagcccacgtcctttctctgggtgatggtgtacagagggactcctcccacacaaccccctttgtgtataggaaactcgagtggggtgtagcactgtggtcacaatttcttggggcactcaatgacaaatcaagagactaggagcattttgactttaaaaacagacaaaataaaatggaggttccaatagaaagtcatttggagtaattgttcaaaagtacaaatgtctctctgccgtggccaacaaaaacaagtgtttactctgttttgctttttacatgaaactgtcagccaagttgaaaagcccttttcatccctggctgccacctacggggacacctgatgctgtgcatctgtgcagacgctccctcggcaaggccgaagccccgcccgaggaggctgctaggatctcgggttctcgcaaagacagggagacatgagaagctgattactattcagatcagcagccaggcctggccgtctggaactgacatcgccaggtaaataaaaggcattcactgcagatggagcacgctgtcacctcccaccgtggaaggggagacgcctgcgcccacggcatttgtagtccccatgtgggatgtgtctccagctcctcaaacgcaggggtcatgc

SEQ ID NO: 28985 - DNA, 2003 bp, Bovine  19866880352104
ttagcaaagaacttagcttctgagaaatgttacctcactgctttccatccaatgatcccaaaggatgttttcctggcacaaaacatgccagggagagagactggcatccaatgagagcaaaatgccaaagtgactttccaagggaagaattttcatggtccctttttgaactaatcctttcagggacttcaggtattaccttctcctggcctataccatggttccagagggaagatatttagatgaaaaaagggaaagcaggctatgacaccccaggcgaaaccattgagcctggctttctttgtctaagaaatgagtagtaagtatcttgcaaggtctttgcagagggacaggagaaaataaatgtgaaagcattattataaaatggtaaagtaccataaatatctgaattattttattagaaccagtttgtataaccccaaatttctgttattactcactcttcacaagtggctgaaatttaacattagttggagtgctctgtatgagtgttcacaactctaacatttgtgtaatgtcttgggttttcaggtggagtgtatatgtgtaggggtggcgtgcatcacttttcataactgattcacaccaaaatgctagctttcaagaggcagagcgatgtatgtaggcagttgttgtttcgacagtacacagttacttggatgacaagcaagctttctgcaggaacagaacactctcccgtcaccttcctccagatgaaggccagaatattccagaaataacagatggagacaagctgggacctaattgaagatctacctattgagagtagcaaatgcctgagagctccaaggtcagactttcctcgccaaccaggcagcatgcagaacccgggacatacagagcaaaagagacttacttctcactgggtggggagaatcttttccacctacatgaccccaaggggtaaagggtttatgatgaggaatataagcaggttaaggagtatgatgagaacacggccctgccaaagtgtcccagcatgtaattcttctgtggttatcggatggctcctgagatttctgagattttttttctatatcctaattcctggtatttcacaacagtattagtgctcagactctgggagcaggactctatagatcttttgaacactttggtttgtcttttacagtcttcatttttgcctttctatcctaagaatttctttatacttaccctgtatactttaacatcctaggattttgtcaatcaactccaataaagctggaaataaacttcttgtttgtaatttggctaagtaagcatggacagcccctggagaagacagtacagtcagaactctgttgagggttccccatgcagggattcaaacaaccatggatcactactgatagtatgtataaaatatagatactatgcataaaatagataactaatgagaatctactgtaggccacagggatctctacttagagctctgcggtaacctaaatgggaaagaaatcccgaagagaggggatatatgcaggcatataattgatgtagtttgctgcacagtagtaatgaacacatcactgtaaagcaactgtactccaataaaaattaattaaaaaaaaaaccatggatcaaaagtatttttttaattccaggaagttcctaaaagtaaaacttcagttgcaccagcaagtatctacacagcatttctattgaattaggtattagaactagagatgatttaaagtatacgggcggatgtgcataggttatacacaaatattacatcaccttttataagggcttgagcatctgtggattttggtatcccctgaggtcctggccacctgatgagaagaactggtcatttgggaaaagaccctgctgctgggaaagattgaaggcaggaggagaaggggacagcagaggatgagatggttggatggcatcaccaactcaatggatttgagtttgagtaaactccgggagttggtgctggacagggg

SEQ ID NO: 28986 - DNA, 1542 bp, Bovine  19866880406588
gtcatgagcctggatactggaatgtgagacgatttcacagtgaccccctgattgtacccaaaggtgaggggtttcttgtccccacttaagggtgctgagttctgtgacagggtgtttcatgccttgtttgccatctaaatgacaacactgccatcaaggcccaggggtgacttattcttcttggagcccagactgaacgtaactcatggattagcagtttcgcagaccaagaaatagcccctttccaaagcaggagaagtttgttcagaaatatgaggtttctgttaaacccttgatagaaagctgatatttttaacctattcatttctaagatccaagatctaatcacataaaccagaaatcaaagcagcatcttcgtagcgatcatactttctgagattactgaataaagggcacacgggaccaataagaaaaagcaagaaactagatcgtcttcttaagaaacgtgaaagactgaagtttacaaatgtaggggagtctttttactattcataacattttatgttagtatttagctgaaacggagtggaagagggggtgatttggggctttcaaaataattcctctcactttttcaatagcaacactcagttttgaaaataccttcccaagatgtatgtttaggcttcctcttgcccctctccttctttcagatacactcagactatcagcggtactccctgaaacagattcagtggcctgtttcaatgaaaaggccctcctttctggatattgacgggcagagaacattctgtgagcacagcagcaaaatgcaaagctaaacaacatatgggaaagaaagaactggaatattttcttggagggcagatgactggtgtcccccttcccttagaaagatcattcatatgtttcattcaagcttgaacacattgtgtctgtaggagattagccttcttctgtttcagttattccctcatacaaagctgttttccaagcttctatcagcagccaagaccgaaaagatcctcagtaacagctaagccttggcaggttaggagaaattagaggaacacttggcaccaacacaagataaaataaaagataaacatttatagttttccaatatgaaatattttgattttgtacatgctaatatttttttttccaaattcatcccagaatatttacaagttctgaggggtaaaaacagtatcttctataatagtctttctaatgtctcataagatttaggatttaagtaaaattaaacatgaactttgcatataaatttggactttaccatgatcttaaataaatgtggcattttctccacctaaggaaacttttttaaaaaataaacttttgctttttccctcacattaaaaataaaaaagactccctcatatagacctggcttgggcatacattttactttgcctaggatgattttacctgttgacatggtaggattatttatagcatccctgttgacgctcaaaatcatcctgatttaaatcataaattatactttcagcctacttataggggaccttttaggag

SEQ ID NO: 28987 - DNA, 520 bp, Bovine  19866880492657
tttgtttgaatgaaacatttcaaaattaaataaagaccacttagcgccactgagcccatggatgctgagtgatcaggtttattcattaagttcctgcatttcctgctgtcaatgggactgattaaaattctatatgaccgaaaagcataactattcagactgtttgagaaaatgtcaaattgtgaatgttaaattctgaaatggcaagggccaactccagacatgcaaaaccaaccgaggactaaaaggatacaaattaaaataaaataaatgctgtttgataatagagttcagaagattctgtattctctccttccctcctaaaatcagactagagaattggcgttcgccctcctgaaggattatctgtctatatgagtggctgccagcctgaaataccctgcagggtaatataaaccagaataaagcaaaacctgctcatgtgaagggaaaagaatactccacaaaatggttacaccttcccagatacatccttcagctccccaaacagcttttccat

SEQ ID NO: 28988 - DNA, 3082 bp, Bovine  19866880506148
ttgagagtctgtcctcaactcgaccagagtagctgtgcattaaatgtaaagttacacatattttacaatatatatacttttaaaataatgattgccaaaattggaaacatttgttgacaatctgtcctataccaaatgtgttacatcctagctcatttattcttcactagagccctatggcaatggcaccccactccagtactcttgcctggaaaatcccatggatggaggagcctggtgggctgctgtctatggggtcacacagagtcggacacaactgagcaagttcactttcacttttcactttcatgcattggaaaaggaaatggcaacccactccagtgttcttgcctggagaatcccagggaggggggaccctggtgggctgctgtctatggggtcgcacagagtcagacatgactggagcgatttagagccctgtgaggggcttccctatcacagctcagttggtaaagaatctgcctgcaatgcaggagacccaggttcaattcctgggtcagaaagatccgctggagaaggaataggctacccactctggtattctcgggcttcctttgtggctcagctggtaaagaatctgcctgcaatgcgggagacctgggtttgatccttggattgggaagatcccctgtagaagggaaaggctacccactccattattctgacctggagaattccatggactgtatggtccatggggtcgcaaaaagtcagacacaactgagctactttcactttcagagccctatgaggtagatctgttatccttcttataagaaaccctgggttatccatcctagattaggatggatttgctaatttgtctgttaaatgatagagtcgggactctagtcagatattatggcaaaggggagaaaatggagacatacatgaacttgagatccatctctatacaatgtcgtaggcaacagaatgagcaggtaggttcttactgagctgagaatttctcttctagaatgatgacagcaacagaagtgcttgcagacacctgacttacaaccaggagtttcacacccaaaagaaacctaccgacttggctactttggcccacgctattgtaacagtgagctaatttatagccgttgttaattataaaaccatcgcatgttaaataacaataccatagcaacagagatgaaccatgccataccaggaagaaatagactcatgcagtcaactccaggctttcactctcagaacacaggcatgttaacaatgatggatgtgtaagcaaagaggtataaatctggaggcagagactcttgaacatcaactagcaggaattgggatgatcaagtgctctgcttcgccagataccatttcacatattcactaaaatagtccatcacccgctctgtggcaatgaagttgtttaagttcctatgcctgccctgccttttttcagttgcactcagctggaaaaataatttaatttcaaggtactaaataggaatctattcttctgtatcttcctacaaaataaagacaggcattatggtatattcctgtatctatttttaaatgccatccccaaactcctttttctgagcaacacaattcttgctactttccagcagcaaaaatgactttgctaggaatatctctacaccaaaatcataaaaatttaaaataaagttatgcctcacacttcctgttgacactaatcccatagaggtcttctaagaatcattctgaatttggattctgctcagggtaaggtttgttatccattttcattgtttcctcccatttgaagagatgctgcacataaacaacattcctggcaggcccccagagaaagagctggggcttcagtctgcctaattctgaagtgtaatatcaacaagcctacttagctgtgagatctgagcttcaccctataacaccgtcttcatgggtatggactcaagcactgacatataaagattggactggcttgtaagagccaaatgtgtaaatctctgcccagtttcaaactcagtgacatcatattggcagcttgaagctgaccacggggagagaacttcaccccagaaatctataaacactaaaaatcagaccctcccctacaaatgttaaacatttactagtataccactgagtgaaaacattatatatatatatatatatatattttttttttttttcctggttccccaaccagggatcaaggtcttgtcctctgcagtgggagcacagtgtcttaaaccactagaccaccagggaagtcctggaaaacacatttaatcgtttaatctttacctatctaacccctgtgctcatctcaactgataatgaactcagtaggcggtactatctactgccctgtccccatctccagcagtctcccgaggactgtctacttcctttttctactaatcatcaggaaaaaaaagtttgtttttttcttaaagggtatctgtctagttctatatgtatcagctcaaaaagagactaaatacaaaaccttgaagaatagccaaattgtaaagcattaaaacatacaaccacttaataatttttagaaacggttcatgaaactcgtgtccttgaaatatgtaatacaagagaaaaatgctagttttcttaactttctcattcttgcctataacattttatgtgactttatactttaatgcgtagcctccttttttttttttttttataaaagctttattcacccctgaacaatctgaagctgcaattttagcagacttgacacagcggtggtggtatttcagtcacaagatctaaattacagagtacctgctcggcctgtaatgctcaaggctttcctactcggcctcctacagagctgtaacccaaagttcccatcaccttatttacaaaataataataataataacattttaattaaaatacctgcatagaaacacccactggtgttaataatcatatagttctaaggcactgaaagcaaagcttgaccaaaatacagatagttatcttactttttaccattcttctgttaagcttttgttaaaacaaggcatcaaatgttaacctgtatgcaaatgca

SEQ ID NO: 28989 - DNA, 1412 bp, Bovine  19866880568724
tgattttgtaatttgtaattttttattctaccttcagaatttgttaaatccagagtctgtcgttagactcttgagcggacacgtggcttagaacttaccccctcacagggaatcttcccttttttttttttttttaagtaatgtatttattttaattggaggctaattactttacaatattgtagtggaatcttccctttctaatgactccatgtcaggctctcctctctgttgatctagttatggcttctcacagaaaataacaaaatgaagagaagcatcagaaactgctaaagcattttgtagctatgacacattacctcacaggcctcttacggccctgtgaaaggagacacgttacctgtaagtcttcgacgtgaagaatgttaaccattgtccaaggtcacacagccggcaggggaggagctggactcagactgtacttactgaggcgggacgtccgtgaccttgacctctgccttgtgctgccaactgagtccaacatcggatttaatgaagatatgagcatttattaagcaccgctacaactaggtgctggttcagatttttaaagctgtaatgcatatgttttgctgataagatatttgaggtttactcaaaacagtaagacccgtgcttactgaaaggtaacaaggttgaatgttttgagtgacagatgagttgagtagacgctcctcaggaaggaaaatcaccaccaaccagagtcatcagttgcatgaagggtcgagggggaagtaatatagagaaagtaggatatgggagtctgtgactgccccagacgcaaggtgctttcccagggcttcttatttatttacacagggtagaaatgtcacacaataacaagattacccccaggtttatctagaaactgcacaatcctgaaagctgaagagaaaaagctcatttcgttattatctattgtcaaaggattatgttggggtagggaatgaatctttgtccgttgctggtcatatgtaaactgctctgcacacaggtataaagtcaaaaggctttactgggatttgttgtcaatgctgttccaccccaaggcccctgacattggcttttcaccactctgtttcgtctggcccacatactccagaggatgtcccccagagtcctgacttcagacaccgtccactgacctgggtcggaacagtgatgctctgtcatcaagtcacaggcctgtgagtcacagtcctataagacgatctggtttttttttttttttttattgagattgtcctatatgtagacacgtagaggattacagacacttcaaaaacaagagaaaagaaaggccgtgtggtaaatctgctcttccgcccaggagaaacagaaccacaaggccatctgggaaccgtggggaacaaactcacactcccagattc

SEQ ID NO: 28990 - DNA, 1527 bp, Bovine  19866880599993
cagctcagcagatgtcacaggaaaggagaagacatgaggagggatgagactcttagatgtgaaaaatcgtgaaagagagaactggggtatgaagtggcctggggagagagaaggatggtgctctccctgtctgcccgtattttcctagataagagattgattggtgttaacttagggatttgtaaggaaggagtttcagcctccaaatggaaaccagtaatatgtttctttaaaactctccttcagatgacaaataaaataataaatgagcacatgctatgtatcaggaagcatattgttttcagtgaagtataacgtagatagagatgagagctcaagtcatcaatgtgcagccctgttgatgctttttcccaaactaagcaccgtggacaatgtcactcttatccagaaacagaactacttcacctgctttgccatcttccactcattgattccctgagagtaaccactattctgacatatatcagtagaggatgatttctttgcctcgattcgttccttgtataaatggaacacgtaggatatacgctcttctgtgaggcgcatccatgtgactatctggacataggaccaggcattctcagggctgtatggcattttgcatgaataaacaacaatttactaattcagtctactgcggatgaacatgggttttttttctaggtttcaggtattatgactagtgttgttatgaaaatttttgtgcatgacttgggttggacatacataagcatttctgtgggtattggaattgtggagtcccaggaggggaattgtggagtcatgggacagaaatatttagctttagtagctgctgccatgcaattttcaggaagtagttatactgctatacattttaaagtttaataaagtccaaaactaccctacaagataggtattatcattctctctccttctctctctctctctgatgaataaacaaagactcagagagtggcccaaggctaaatagctatggtaatgacagtctgagtttaaatccaactctgtctggtgccaaagcccatgttcttcatcactaccctgaattactttgatgtcttggagagaattcatgccttcacctcccccacttcctgcagtagagcctctgctgtagaattaagatcgagggtaccaagtgtgaggggctggcctagtggtgtcgtgtcaagagggacgtagtttggttgacagtgaatctctgacgtcgttgtgcaaaaatgagcctgcaacccccttcaaagcacctgcggatagagcatgcccacatcctctgcctttgccaaggacatgggcacagtgggtgtagaacattggtggtaggggtgagaaatctgacacgtctcccaagttacagggattcctcacaggcatgggtggccatgtgaaatggaagcttctcttgatatgtcatgatagatttttaaggtctagcgttaggaatgtgttattcagaactcccagtcacaacccaaccccaaattgcttaagcaaaaaagaaaa

SEQ ID NO: 28991 - DNA, 2178 bp, Bovine  19866880608298
aacagctctccacaggaccaggggtccacagagcccaacatggtatcccacggggacccagactctctttcaagaccatattctagaccctgggggactataatttgctacccaaagagccccaagtgtgttcccagggcttgtgcaggcctcttctctggatcaattttctgaaggcaaatcatgcttgtcagtggactagccctggggactatttgtacaggtctacacagaccttggccatgtgggtggaggaacccatgtgcatttgtaccagaccccgtgataagcgatggagctgaggagggataagggccacagagccaaccagaggggctagctctgcctatgctgatattccccaaagcagaactcccaggaatctggaaatgctacatgagaacctgacttaaccgagtagtttagacaatctatttttaaggcaagaggatagaaagtatttgacttaattatttgttgatttataacttagacactctgcatgcacactcccatctgtcctcttgtcaggcaaccccacttagagtagatggcttgcctggtggcccagtggtaaagcatctgcctaccaaggcaagagactagagttcgatctctgggtggggaagatcccctggagaaggtaatggccacctgcttcaggattcttgcctgggaaatcccatggacagaggaccctggtaggctacagttcatgggctcgcaaagtgtgggatacgacttagccactatacaacaacttcgtatcagggttggtcaaaagtacctctcgataaaaggaaatgagcgataaaacaatttagagatgcagtttccctttaaagaggggtagggtggggtggggctacaaaataaagttgaggaaattctatttttccttctagacctaaccaaagccaatccaccttaactcaaatccttatcaaccatcatagcctttggtaagctccttaaggaaaatcaaataaatattttcttatcatgagataatcatcactctcataatgtgaagagatgaccacccaatatatagtattaagttcatcatagcatcaccacatcattaaaacgtaaacctcaacatcacagtccaaagaatgaaaaaagagataaagtatgtcctgtatcttccagagggcctcagggacatgtatacacccgcacatgtctgtttgcacacacactgctataagcaaaagggactcgtccccctctaagtgaccacggtgttgcttacacaggtaagtagtgagtactcctcagcacgtaccatgccagatgtattttaccaaaatgagtccccccaaaatcagagtagatatttggcactacatctttgaaacaggtccatccatccaatcccctagtgccctactttaattagctctcttcccatttctgcagaaatagttttgtcagaattcaactggacaagctcttttgtacagtagaccggaggtgaccctgatttacagcagaagatggcaaacccaatgcagttatcaccgctaagctctcttcctaacaacacggatgtgcgtacaaccagctactatgcctgtccttggcgcccaacatggtgtagtagtgggtgtcttccataaacattttagttacaccttgtgtgcccagtgaaccgagacagacgagcaaggaaaggagggcttctaaagagaagcttcaattaatcatcgagtacccttcaaaggggaaaggcctgacaaaggacagcaaggccccaggatattatttaatatactatgtggcgcttaatatttttcacataattagaccaaggagtctgtcaaaataataaattttagagctataaaggattttagagattgcctgacttaaaacattcttttttcattaaggtagaaactgatgaccaggaataagtgagttgcccaagacgagacagtttgtcctactctgggcttctgctgcctctaaacttttctccaaataccagtttcctttcgcccttcattctggatataccacctgcccttattttgctgcttaaagggaaggaatggttccactgagccatgtgttgatttacaaaccatcccaaattttgaataaactaagccagaggcctattcctcctacccccatgtaaatcacacttcctcaccaaaagaaatattt

SEQ ID NO: 28992 - DNA, 1111 bp, Bovine  19866880609414
tctacagctaggcctgtgtgcagcctgagaatgtgtgggtcagtactttgaggccgcgtgtcacagctgctcagcagtgtgacacatctgctgttggctgggattctgtcagatgcagagatatacacggcgggtcacttacattgccacttcatacctttattactgcctttgctaaaagctgcttaactgccagaagacatctgcccattatggaagcaataaattgagatgtcacaaaattatgagaaacaggtgcttcaaaatacaacacaaggggattgtcatagacttttctttttttttttttctttttagcatctctggtttcatgtgtcttttcacagatagatgaatccttccttgctccagtctgataaaaggaaaggaaaattaaccttattgagagagattattaatatatgcctgctctgtattcttaatatatactgggccatttaaccctcacatccattctgcaagctgcataatctcaacctcattttctcaatgaagaaaataaggaaggccccaagtcattcattcagaggcatccattgagtacagtatgccagtgacttcatggatcactagagatacgagaattgatcgtaatatatttttcataaacatatcaataatgcaaggagaaatattatgcaccgtgttagagattgggcgacacttgtgctgaggcttggtggtgtagcaggaatctcctaggaagattaggcagggtaagtattctaggcagaaggaacatatatgtagggatgacttctggaaacagtacattttcctcatggatgaaatctaagacttagggagtgaagagaagggatttgaggggatgttttagaaggtgtggctgaaggagtggcaagaccagttgtaaagtagcttgttttgttctcctcacaaatttggaccttacattatagtgggcatgccatttttagcaatcagataactaagacctggagaaaaaaatggcaacccattccagtattcttgcctgtgaaattgcatggacacaggagcctggcaggctgcagtccaccaggtcacaaaagagttggacacaacttagcaactaaacaacaaagtcaga

SEQ ID NO: 28993 - DNA, 2485 bp, Bovine  19866880616023
aaaaacatctacttctgcttattgattatgctaaagcctttgactgtgtggatcacaacaaattatggaaaattcttaaagagatgggaataccagatcaccttacctttcttctgagaaacctgtatgcaggttaagaagcaacagttagaaccagacttggaacaacagactggttcaaaatgaggaaaggagtacataaaggctgtatactgtcaccctgcttatttaacttatatgcagagtatatcatgtaaaatgccaagctgaatgaatcacaagctggaatcaagactgccaggagaaacatcaacaaccttagacatgcagattataccattctaatggcataaggggcttctttggtggcttagatggtaaagcatctgcctgcaaagtgggagacctgggttcgattcctggcttgggaagatcccctggggaaggaaatggcaatccactccagcactcttgtctggaaaatcccatggacagaggagcctgataggctacagtccatggggtcgcaaagagtaggacacgactgagtgacttcattttcactttcactggcagaaaacaaagtggactaaagagccttttggtaagggtaaaagaggagagtgaaaaggctggcttaaaactcaacattcagaaaactaagatcatggaatctggtcccatcacttcaaggcaaaagaaggcgtaaaagtagaaacagtgattttattttcttgggctcaaaaatcactgtggatggtgacagcagtcatccaattaaaagacacttgttcctcaaaaggaaagctatgacaaatctaggcaccatattaaaaagcagagacacccttttgccgataaaagttcatatagtcaaggctatgatttttttccacatggatgtgagagttggacaataaagaaggctgagtgctgaagaattgatgcctttgaactgtggtgttggggaagactcttgacagtcccctggactgcagggagatcaaaccagtccatcctaaaggaaatcaaccttgactattcatttgaaggactattgctgaagctgaagctccaatactttggctacctgatgtgaagagctgactccctggaaaagaccctgatgctgggaaagaaagagggcaggagaagaaggtggcaacagaggatgagatggctggatggcatcactgtctccatggacatgagtctgagcaaactctgggagacagagaagggcagggaagcctcgcgtgctgcagtccatggggtcacaacgagtcagacacaacttagcggctaaagaacaagaaaacctgtacagacacatgacttttgctcatccatcctttctctttccacctctactctcaacatagacttgactggtggatttccacaagaggcttcatattacagtagctggagaaactgagttgcttgtgaaatatgattcatgaaagcctgagaaatgagacaaggggagcagagacagtcagctggagatgaggtggctgtcagcaacagcctgccactacatgtggtaagactaagagtgagccactatcacatttaaaatgggtaaccaacaaggacctcctgtacagcacatggaactctactcaaggttatgtggcagcctaaatgggaggggagcctggggaaaagaggatacatgtgtatgtacgggctgaggccctttgctgttcacctgaaattatcacagaatggtttgttcatcggctataccctaaaacaaaataaaaagtttgttgtttttttttttaaatgagtgagccactattttcagatccagaaaggaagacttcaggagtagggagaattcaactaagcaaatatcagagcagttatctttcctttaccatgttgctgatggagataaaaaatgtgctagccttagctggtgtcagtctgagaccctcggaggccatatgaaaacaatattcaaataccactgggccccagcaggaagctccagacaaggggctggcagagaagattgaaatctgaaaggcacagggctttctttccctggaggaaaaaaagagagggggcatgctaatcccacagatttcatgaggtttctgatttactagtctctcagatggctctgtgggggtttgtcattttgatgagaaagtcttgttgtaaaggttaaacatgctaagcagcatgaagtgatctctaagaaagattatatcttcttgccagggagacagctgcccaatagcccacagaagggggcctttaaagagctgcacacccagggttttggccccaagtcccagttgcacttgtcacttcaaaactctcactgttgagctggatttatttgtcatatggggtaatgtggattggttgatgaaagaagagaaatgtacatgccttttctctccatatttctttcctccaaatcaattgccaacattctaaataaatttagcaacaggaataagacgga

SEQ ID NO: 28994 - DNA, 1610 bp, Bovine  19866880650534
aaatatggatctatgggcttcagatcgagcagacgattgacttctctccctggaggatttgaatgggtaaaggagagaaggtccatgtgtcattccaaatgactgccttctggagagtcccttctgaaggcatgggacaggaaaatggagttccctctataagagagagtgtgttgttgtgttcaatgatggtctgacccacaattaaaatgagaagccggtagtgaaagaagtgtagatacagtttaactcatgtagatctggtggttatgggaagtataaggcacaacatatcacataaattattatcagtgggcggccagcagggagatgcaacacaattgcttcaggccagggcccctcagtcatctcattctctcttggcagcgtctccaggattcctctttacctctctaggccttagtccatccactggacctgctgatgcaatgcactcacgagctgaagctctcctctgcaggttctccatccccatgccccaggaatatgactcataaggctcctgcctgcagcttgagcctcatgcacctgctactctacccacactgaatttctcaccatcccctgggcaccccatgcttttctaatgatcctaccagtgaatgcattgtttcttttaagtagaacgtcatcccttcttttgtatggtgaactcttactcatacgtcaagacccgtatcacctcttaaacgtttacgacacttgtaatcacttttttatatgtgcattatcaacaacaacagcgatagctaatgtatctagtgtgggacctgggccaggagctttatctgattcatgtctcgcagtgaatctgtgaaatatgtactgtggtttttctcattctgtagactaggaaagtaggaattagagaagttaagtagtaagctgaggttccacagagttaggtaaattccagggttggctataaaacccaggtctgtccatttcaaagccttatttttaaattccatgttatcaagtccacggttcccctgcactgtgagctacaggagggtgccctgagtaatgtgagtccatggcaggtctggcattctagtttcttcagctttataatttctcttcttcagtaaaatggaggtgaattattcctactcacatggtacctcacctgatgcataataggtacctggaaatacttattccttgaatgaataaacagaaatttaacttttattataatacaattgagagccatgcggtcttcaggatgctgttagctttctagtgatttcagtacagcgtgattttctaggccattcttttgggaagaagatttctgcttttccctcattttttgcagatatggtcctctcatagcccaaccgctaacttgggtgtctacacatagcttgtaagaagcccttaggggtggaagttgttctgtatgttggatgcttagcaggttgcatggaaaacagccccgtgtgtgaacagactcacacccatccaccttaacttattcctttgccagcaaatgactcagacgggcattttccctcagggtgactttaaaatggagtggagatgtagcccctatagtaacgagtagaacggttgtggaatcgtgg

SEQ ID NO: 28995 - DNA, 1154 bp, Bovine  19866880662761
aacatttgccaagtacttaagagttaggcttggcaagcgctcatcaacatcagaggttagagaagtgcttcatggtgggtcatacagagtggatactcatgccctgaaagtccgtgccaagaagtcacaggtaatgagcagtgaaaacaaagcaacaaaccctccaggttggaggagagacagcgggtaggcagctggcagccagcagcaaaaatgaccttactgactcaaggacaccctagtcaagtgggtgaagagcaaagaggaatcagaaagccttaataagaggatctcacttctttactaagaaagaggatgcttttggcccaagtcagtagagaccaattcaacctctctcgtgcactagctgtggcctcaagccatgccccagccaactggctctctgaagctcacatatcactagactctgtccttggagaaacaacaaaaaggcctccctcatgagtgttcagcaccaccacaatcccaccgtgaacactgtatcctttcatcattttggagggtcttgtaagctgttaaccaagtccaacatcgtgtacggatcccaggaagaatcccgactttggattcaccttatagcccacaaaatgaggctgtaatttttatggacacatttaattctttttcacaagagcaccaggagagatagggaagtggttgatatcgtgcattgccctcaccatgactagacaactcaaaattctttccttctcaatagtaagccctgctcatgcataatgatatgaacaacatccccattaggaacaggttgtgtctgaagggttctcatgtatgccctttgaaaaagatagggtcaatcctcctcggtaaaaggaaaggtgttaattatttaattaaacaaagtagttattgactttttagaagcaataggcaaattttccataaaaaaagagactcttttaagtatatatttctctagttcctgaagataaaatagctgaaaatttaaccccagagtgaaaaatacaggtgtttatgaaagaggtaatgtgcaagtagaacctagaatttcttcctacagttttgacttggcctttgaaaagtatctcaattcaatttctatgatagtatgaatcccagggtttcacaaacaggggaggatttcaggaagt

SEQ ID NO: 28996 - DNA, 1639 bp, Bovine  19866880713931
atatattagactatgaaactcacattatcagtttatgttcagagatgtcaccaataattcaagaatgtgttttttcaatgcatattttaagctacttactgattcttaacagaaacaagcagcaactggtcacagtaatacaccaagttcagtttaaatatttcaagaaaatgggttgagagatttttccgacctttgatacacctttcattttgtttggggagaagtgtaatacacacacacacaccacacaagcacaagtatttgaggactgagatttatttttggacagattcaagccaaagtactgactcgcatttcaataatggatctgccggcatttgcaagaaacagtcattagcttatctttaagtaaatattttgattgtcagacagttcattgcaaacaaggttcttttccaaacactcgctcttgatgcatccaagcccgcttgcacatcattcattcaggaatctgcgtctgtgctaaaatataaaatcatcctaaggaagtccaagtacagacaaaaagcatgttttgcaggcttttcatttaaaagggctcccgagcatgtgggacctggttctctttcagttctctgttctttgctgtgccacattaccataaagctgaggaaatgagctattacacaccatcatccctcctaacggctatcacagaaaatcatacactcacaaaacactattaattgtcagaattagcaaccatttaaaaggcagctgttctttcactcttaaacaggctccaaatttcagatctctctccctgtattggctgctattacacgcttacacatgcacacatacacaggcactcacaatggattcttagacaaatgaatttttttaatgccctatattcaaaggatccaagaaaatattgtttactcagtgacattttccacaccagtgcttgccaatattggtccaactagctggaaagcttccaacctgcacagaagcacatgtcacagctccaggtaaaaggagctgttctgtgcagcgttgggggagaaaaaaagagcagtatctctttaagagtcaatagtaaattaacttgcccaaaagagtgaaataattagcagttagtagcttattaaaagggtggcaaaggccaagctgccatctgggatctccagttccttgtgattgttattatgtcaggatgggcaagttgcattagctttcatgtcaccgcgcctgcccttactttatatgtaaattttaatgaaagatgtggcacttctaaaaatcagacgtccatcaaaaagtgctattagtctggctttttacaaagcatatggtcttttctacctctgctgttctattcaccactaaatgccttaggaaaaaaaagagaaaaaccccaatgatatcaattagattttctctttgtgcagagggaaacctgcgtatcatcaaaaacagggcaaagctccacctcaccagagggcaaggtttctgcctctatttacacacagggaaaaccacaatacctccttgtcttgcaagggtaacccttgttaatggaaattaaagcacctggagactgcctgctgatcactacatggatacatagttttaaagggagtatggagaataaaatttattcattaaa

SEQ ID NO: 28997 - DNA, 1121 bp, Bovine  19866880716946
tggccaaagtatttgagcttcagcatcagtccttccaatgaatattcaggactgattttctttaggattgactggtttggtctccttgcaagtccaagggactctccaacagtcttctccaacgccacagttcaaaagcatcaattctttcatggtcagctttctttctttatgaaagttattataaaaaattgtgtagtccaaaaagaggttactatttcatcttagtgcaattccactccatgaattttgtttcgtatcattgaaacatttaagttgaaattagaataagctaataagtagaatgataaaacttttcaaaaatctttgtggagtgctaggttatgttctcatggtttatttttataacagtctctcagttagatattatttccccagcaagtaggcgttatttattgctccatttataacaatgatgaaaactgagatacaagaattgagatgtctggtccgtaagccacagagctagaaagtagaaggttgtgaatcaaatccaggtttgtctcttaggagcccatgctcttaatgtctataccatattgtttttccacatgctgaggtacagaacagaactttggtctcaccaccttcccagagagggaccccagacaaagtccagagaagatatagatggccaggtactccgactgtggggatgctagctagttgctataagaggatacttggcaaacacatcacacccagatggtgtgcagcccacacatctctatttacgtcgggccccgagtgtttgtgttaacaggtttgagggataataaaagaagttgttgtttgttctgtctttacaagtctgcaattaatttttagcataaaatcaaaagggaagaatttgtaaattcactagacactgaaagactggcgcatccaagaaaacatttgttgagtttaaaaaggagagccagtgcaagagcagttgtttttcatttttcccactaggtggtgctttagtcctgtgggtcaaatgtaatgagcttggctttctttgctttatttttcctttccttttttttctttttccctcctagatgtctgttggtccaggaaaatagcccaacacaaggctgattaagggggattgt

SEQ ID NO: 28998 - DNA, 1513 bp, Bovine  19866880824573
aattattgttgttataataattttgatgtcattatgacagatctatcaattaatatttattgagtagctgggcaatggagattgagtggtaagacaagacacatttcctgattcatggtggttttttctttttaagtcagaaaagacccaggaccctggccccagtgccctcccaactcagtctaggatgcttagctgcacagctggcacctcctttattcagatatcactttaaatatcccttccctggagaggaattcccccaactagagtaggctactttctgatttctgcaggtcggggtgcagagataagaccggtgtgactataaacctgaggagattgggaacctggttaaaggaattaggagaaaaataaccttctttcatagctatgactttgaaagccaatataactccttagaaaactatttttctttccagttaaatcatgcttggttcttccatcagagataggtataacatctaaatccattgatttgtaatatgaatttcctcctgtaattagttctctttgctccagcaccccctgagaaaatccaaaatgcaggacaaacattattctaataaaacttcatcaagtagtataattaaaaaaatatcatacagcaatgtacagcaagttattaagtgtattgactcaggtagtaactgggaatttgtggttaatattagtctgcagatccatttgtcttctgaaatacctttgatatggagcttctttgcttggctgtgtgtttgagatcttggggtgtactttctctgtgactagcatcctgggctaccagacctttggagcatccagggaagtgctctctgccctcagctgtctgcttctgcatcctgggtgctgccgtctctccattcctgtctaagcagtagatgtatgtacccatctagggtgcatgcatcgcttaaattctctctggtgtctctacggaggaagacagtactttttgtaggcgatcatatttttcctttctctgttgctattcccgtgctgtctagagaaacactctccgtaccactgggtcctcttttccccagttaatcatagaagatattctgctcactcatcctctacatttcacacatctctaaagctccattctatttacactggttatagaagtaaatgtgaagaccgaggggatagattgtgtttgcatagaaatttacttacatgctaagaatgcaatgaaaatctttaatgtaaagctcactgtatatttgagtgcaatgtatacttatttcccaaaatatatttagtaactttcccattatgaatcaccaagccttatgcttccccaaagaaggaagcgtggtttctcaaaaatacagtattgtttttagaatgaaaatttaatatgcttcataaccaattcagatcagctttgaaattcggcactacctcagccttgaccagctttaaaatgcaaatgccacccataaggaacaaatgtcttttcaattataaaacttaatttcaagat

SEQ ID NO: 28999 - DNA, 938 bp, Bovine  19866880839126
tctcaaaggaatttctcatttcaaggccgaggtaagtgaaaagttatttcgtagttgttattcagttggtaagccacgtccggactctttgtgacccccatggactacagcatgccaggcttccctatgagccatgctgtgcaggccacccacgatggatgggtcatgggggagagacctccactggagaagggaaacaccaaacccacttccagtgttcttgccttgagaaccccataaacagtatgaaaagcggtcctgcagaaaaacaattccatgaagttctgaacaaaggcaaagaatgaaacacaacaattttacctacataagtgacagtttcactatttgcgaaacaataacatgtagaatgtgaatgatacttattttttgcgcacgattactaaagcataagaaaaagtgatctgtgaagatgctagcatcccaaatcacatgacttcaggacatgtggtgaatatgctgatattcacccatgaaaactctgctaaaactgcaaataactgaaaatgttagtgtcctgtccatttgcaatgagaactgaggcttgctttacctgctttccaataatttcttggtatatatcgaaaagcagaagtctaagccttattaacagctttagccacaaaagtaggtcacctaccctggcaaatggtttagaggaaaaataattgtttttactttttttttttttttctatagaaagttatcaggccacttggtaaagttatcagcctattcgagtacaatgtcatgtatatttttcagttttcattgcattaaagttcccaaaccaagaattattcttcaatatgtgatttctggttgtaagaataggtgaaatgctttaaatatttgctaagcatttgaggatattcaataaaaccccatagatgactgaagtagcattatttcatcgttgt

SEQ ID NO: 29000 - DNA, 1375 bp, Bovine  19866880844773
ggagcggagagcctctttatatgtcaccagctattgcatgccattgctgctttctttcttgtccttttcattttccttcaccagcatggttctcagatttattaacagccttttcatgacttctgcagccatcaggatgagcaataaagagaatccagtcttctcatgcttgcccctcctcactgtgttggcttatcttttgtttcccctctgttttttcttttaaagaaagttatgtgttgctgctctgcatcaggctagagtctctttgcccctccttcattctctttcgccgcttttaattgttttggtgcttttgtttttccctggacttgagcgcaatgggaaaggtcagctgtcagaagaggggctgaacacggctgataaggctttcaggagattgcagggaagtcattcagcagtgttccctccctgaagtcctagagtctccactgatgcagggggaaaagaaaaggaagctcagagtagcagaggtaacccacatcgagggcgtggcttagccatgtgagctctgggcagagcgctgcttacccagagccctgcttacccagagcccttttccagggaaaggcgttgcccagtgccagccttggggactctgggacatgaatgtaatgtgtatctggatgtgccacatgtgcaggaggccttggagaaagaactcaagtaagaactaggcatccagcatcttagagatcaaacttctggagttggcccttcagttactgtgttcacgtgtccaccccgttgttattttgcaactaactcacttacataaaaaccagaaagcctgggttttggtcttgcctcaactgctaattcatttggacaaatgctgagctgtgctaggcttgtataaagaagtagaaaatgattttcaaagtaccttccatcactaatggctaaatttcactttaccaactctacctgcaaggcatcagtgagacgcatatccttcaccggacatggatatgaaaacgtgttaattcctttttccctcagtgccttgaggtaaaccctaaatcatggttcttgggattcgtccgtgtagcctgtccattacgatattcatggtgagcatttaaggaaatggtacacatcttctgcaatggaaaaaaagagaataaattatatgaatagtaatatcatcaggttgcaataattctctgtgttttttcaaaacctggtcacagttcaggatgacccagtttgaggatactctccactttagcctcccctagaaatgtgatagggctcttctgttttcactcttaacctcccacatgactagtgctctcaaaatgtggtgtctgaatggaggctaaggatcaagtgagtacttacaggcttcagg

SEQ ID NO: 29001 - DNA, 1042 bp, Bovine  19866880853746
ttgctagaatttgcagttgggctttttgctgctgcttctcttagtgttctgccaagacgcacaaactaatgacagctgccattcgagggtgcggaactttccatatttatagcttaaaatataagcacatttcccaagcatacacaatagggaaagcaactaactattcagtggttccaccagatgcttttaactgtgtgattcttcagttttctatattcttgtctcctcacttattgtcaagcagaatgaatgtagaggcttctttttgccttacagtcctctttgacttagaggcattgggatatagactatgattttccttgcccttctttctctccattcttccccatcctcctaaaatatatatactgactttgtgccaggcactggaacagaccttgggaaacacaggaaaaacaccaggtcttccacctgagaaactcccagtctactggggatagacagacagttacagcacagcatgataaattctataatagcagaagatggagctatgggagcagagggaagggaatcagctgtgggtggaagtggaatgggcaagaatgttgggaaaggcttctgaagtaggtgatactctaactgtgcctctcatgtgagcagtagttattcagatggagaatctaggtgaggcttatgccaggggattgtttattggaagaaccacagaactttggcaaggttggtgatgatgaagatggactatgatcaggaagactttaatgcttagaagtctgcatttgattctgaagttggtacagaagaaccattgaagagtttcaagcaggaaaggacattttatccccagagaaaacagtaagatgatcagagttatttctagtccttggaataaaaataacagtagattcctagtgattcaggaaggcacattttaaattttgtcacctttctaatcaaactgctaaaggcttcctttctaccctaatggttccttttcccccaactgcataatgactgtatttttagagcttttcataatgaagtaccacctactcat

SEQ ID NO: 29002 - DNA, 2305 bp, Bovine  19866880910045
ttatttgttttatgaaaattctaagctagagagagaacctagacccaaggattcaatatccatctcccagcccatagcaaatatgagtaactaaaaaagggagaatgcaaccattctgcaaagggcaagaaataccaagctagaatatcaggctaatggtgaggtttcaggccctgtggcagtagaatagagcttccctgagggactggtggaggtaacaagatatgatcttctttgtcttacctctttccagaaagaggctgactcctcactggtcattttctttcttcttcttagagacacaccctgagctatatgactacacaggagctggcaaaacacaaagaaaacttatttctttgttttgccagtgaatttatcagtttgtttgattttctgttcactgctttgtattttattaggccttagggtgcctcagtaaattaagatgatatagtcgaaatgtatgattaaaagactgagcaacaataataacagcataatcatactgtgcattcatatcctactcagcatctgttatatcatttactcacacaaaatcagcagcactgcaaaacaggaaagacagaatgtagcaatccagatttaccagcaggaaagctgaaacagaaaggctaggtggtttgcctggggccacacagcaagttattagaactttactcagatcctgcaattcccaagccagcctgctcttcacagtagttcagtctctgagctcaggcaggctatggagatgagtggtaccatgtggtaccatctgcttctgcctccctggagctgtgatttcagcaccatggacagaggcgcccaggctgggagctattctttaatggcatacaatgctagtttccaaagttcacaaactgaattctggaatgttgaaccatgtcatgcaccacaggaatattgcatgggtgcctaaaagtgatggcaataataatcacttagaaacaagtcagagtctgtaacagagatctttaaaggcttacctaggttgaagcaaatgcaacctttaaacagagcagctactcattcctcataaagcctgaaattaattaataatcagtaacatttaccctagtatccaaataccaaacttcctccaattaagtaactctgttttccctcttcacaacccaaactatcaaatgtgaaaataatagcaatatcaataatgtctacagagttatttttttatgtcagggcatgggctaggcacctaaatactatgtcaccatttgatccttttagtggtatgcatgaaatatatctaggatatagaggctgtaaggaaagtatttgggaaaataaagatgctagattgaaagacagaccaagtctggagtcacacagtcctgcttcaagtcccagatctgcctttcactagctgtgtgatcttggacacttgtttcattgtcctgagtctaagcctctgcctacgtaaaattagagaatcatactctcttcatagggtctctttatgtgcataaataatatgcataacacccagagcactaagctgggcacatagtaactattcaacagacactactgtataagttctttccctctttctatcttgtatgtgtacctttggtttatctttagactcctcttcccagggattacctccaactccttgagttggtatcaagataaaaataaaatttgggaaaggggagagagtatgttaaatgaaattcagctcacagatctgaagagagtaggacttgtattgagttaaaaaatgataatgcctctaatgggagtctctgagggtataaggaagggaaagacagtgggtgcaatgtgtatgatggttataagtcagttatatatacactgtcaaacctaccgtgtctgaccacagactagcaatggaaacagagactataacaaagctataagccagtgaacatcattcctgcctttgcctcccactcatatcattttcaatgtaacttcacaacctaagcagggaaggggctaaaaatgaggacttttttttttttttttttgccagaaccataggcacaacttccaacattcacccatatctgcaaacctcaactcatcttcaccgacccttcctaatataagctttagaatctactgtcccattgagaagaagagattcttccaaacaaaactgatgcaagaaggaaatatctctggagaaatggaatctaaaagagctttagctgttgcatccattctttccaccaccactcactgatcatcacaagaaatagttaaaaggtctacccacacatcaaaaaatttg

SEQ ID NO: 29003 - DNA, 868 bp, Bovine  19866880929104
ttcaggtttcctgcaagcttttggaagaaggggatcataaccaaagaacacgagtgagtacagtgtactctgtacacacaggaatttaataagtgtgccccgattcttcacttactggtcacttatgtgtgttgggtgctgtcatttctgaaacatgcaactggaagaaacacagcttctgccttctaagaatttatttctaagtagaacaactccagggtatggttgctaaaaggtcagaagccaggtagcctctgccatgttcctggaaccacacacctgactgcgggagctgtcattccgtaactttctccgcactctgcactgctctgcagcgccgcggggatgcttgtctccatattcatctggacacccttgcggtttgcttgccaccctcctcccccgccctgtgcagttggtcactgcctccctgatggatgggctgcggccacatttggtgttgcttggatgaggtgatggatgcctctctccggctgcttggagccagaacacagaagtgctggttagaaggtgattaatcttccctaatggtgccgtgcacagcaaaccgggtttcggcccccgtgtcttcattagccttgatcagagtctacattacctcagattaggtaatcggttatttgttatcaagccgaggatacgggcttttggagaaaatgccaattgcatgaagtctaggaaaggaaagggaaaagagtgggacccctgttgcttaggggtccatagggcagaatgaaagctggtgtgtggtccccaccaccactttgctcagcactccagtggatgcagggccgcaggaagctctgatgcagtcagcgtggacccccaggaacgacctcggccattt

SEQ ID NO: 29004 - DNA, 1526 bp, Bovine  19866880948659
tacccttcaaatttgtctcccaaatttacctgccccaccaactgccacacagcagccagagccatactttaagataaatactacattaatgtattgccttttttgaaactttctaataacttactctcctgaaagttctgcactgcccagctcccacacactccatcttcatctcctgtcttcccatttgcttccttctctccagacacactaatctccttgacatccctctaacacatcactctgacctcagggcctttgcacgggcaccttgcttcagactgaatgcccccccttagatatatacacaggttgatcatttcttttattttgccctttactcaaagccacctcctaaaagatgcctgcttaagcatcttatctaaaatatatatgtgcttcctcctatcctatcactctgtaaccctgtaccatgagtcagttacctttacaccgactatcgtgagtttatattatttgatacggtatcataaatactgtttgttctttcctacttacatgaagctccccaagggcagatatttttgtctacttatgcaccccatgtacctggaactgggacaacatagatgctccctcagcatttgttagcaagtgaatgaatgcatgaacgtaaaacctctgacaaagcaaagggtaaagacacgttacaatggtgacgcgtttgcaaatactgtctgacagcctgcttatattaccattattattattaaaagtaagaaaatgcatgcaagatgtgtgcaatagctacagattaactgtaggctccttgtgactcctgggacaagttagacatcacaagttcattcaacttaaatatatcagatatagattaatgtgctagatccttcatcccttcttctcttgtcccctgtgtccttccttcttccacttttttgcttgcttccctgctcgcctgctgttttgtcttctcgccttctttccaccacatgtattcttctttcttcctctgccatcttcccgtagggacctcccagcttggctgagcatcactccatgctcacccctcatgctgtctctctgggggagatggctgcacctgcctggactggacccagagttatgtttgagtggatgaaggcagtgagaaaagatggagagaactagactcctttacagttccttccatctatggcacaaaactgtggatcaacgggctaattgaaaagtcttctccatgcacttttcatccccctgaaacgcccaccagtgactcccccgctgccagtcaacacctcagtcaaccatgactctcttccactgcagaaacctggaaatcatttacatctgtacgtgtgttccctctcatctgtcatttcccaaacaccagtcatttatactgcagtaaacagtacattagccaccagacagttcctaatctgtcatcccttttgttagatccactctatctgttcaacagaggagctgcttaaagagacttccccttgctaatgaagagtcagacttctaaccttgttcaccat

SEQ ID NO: 29005 - DNA, 1096 bp, Bovine  19866880993781
tgaaggattttgtaagtaattccaaggttcatttaggaaaatgaacacaaaggtattcatgctttgtcaatatgtagtattgagctaagagttcgatataaaaagaaacatttgcttacccagagaaaccaccatcaaaatcttggcataagaaaaatggactttgctagtattgactattcattctttccttgtgaaatgtctgaatgtgctcattttcatactttaagtcatcatcaattacagagttgcaggcgcttttcttgtgggctacctccagcagctgtcagtgaaaccgagcagctgctcggtagatagtgaagaggttccctcctcgcacgtcctcctgttttcgtctcctggcacaggtggaggtatttatgcgcagggaaggaaatgaagggcatgcatccagtttcctttctctctgtcgtcttcgaaagcgctgcattttggacagtcctcaaagcatgacacagaggcggctaggtacagatgcatgcgcagtgtcatatttatctgccggttgcttccttctggcagttccttggcaggagaaatcaaattcttttctctaaacatcatcaccaactcttttcttttgttgtgcagtcgctaagtcgtgtccaactctttgcaccccatggactgcagcacaccaggctcctctgtcctccactgtctcctggagtttgctctaattcctgtccattacaattttattttctctttgctaaatgtttgggcattatagattctgagagcgatggttgcttttatggttcaaagactggaaatattttcttccttgacatttgatggttgacgtggggaagtggtgataactaggtggaactggacaagaaattaggatattgtaattctcattagtaataacttttcctgaaacattttgtaatacttgaacatggaataccctgtaggttgggaacctaattttatagtgctctgcttttggagcgtcttgtttgatctatttatcagtttttacttttcaatgcttattaatgttgaggtattttaacgtagacctaaaacttttaattctagagttaaaagcccctaccacagagat

SEQ ID NO: 29006 - DNA, 944 bp, Bovine  19866881014136
ctcacaaggcagaaatatcctgatgggcatatctttgacacatagtgataatttgaattgattttagtagtatcccatttagaaagattgaaaagacaaatgtagctgtatgtgtggtaaagaatgtgcagtttgtattttgaaatatctttaaaatcacaaggatgtagatgataccattaactcactgctgaaatcctctcagttgaacaaagaccagtatttgctgtgttctgggatacattccatgtgtgatttaaggtggcaaagctaagcctcaggttgatagcccatctctacattgtgagtcaaagagctgtccatggtactgaatgacttgagccttgatgagaatggacacaggatgcaaaggaaaatgactggaatcccttgacctgtcctgaaataatggcactgaactaatatagtaataaaggcactgggataatgggatcccatgggatttagcaaaataagagtagagacagttggtaaagagtagcctatagttcaaagtccaggaacatctaagtttcaggttcagctgtacaatttgagccctgtggtttatctcgaggcagtaattgtcaaagatagttttgaataatcgtacccaatgcaactgcattatctgaggtgatgagtttgcctctccttttaaggcaagcagttttgggcttgatcattacttcaattaccaaatcaaaagacaaagccaggtgctgaggtaccgagactgtggctccttgcctattcttttctctccccttctctccttacctcacctcccttccctttctcccttcttttcgctctcccttctacccctcccatcctttcccactgtcttcctttctctcttcctttcttcctttcttcatctgtctgctggtctctgtctgactctctttgaatattgactcttaagtcaatattcaaacttg

SEQ ID NO: 29007 - DNA, 948 bp, Bovine  19866881017397
gagaccttgtgtaattttacgtaattaacaagacattagtaaacagggccatccattcagctatagtctaaatgcctactcaaaggacaaaaaagaaatctaatatctggatcacttaaaaactagactggatatacgacttctaaagtcctggactaagtaaattcatacccctaagaagtccaaaaccgtggaaacaaggatcctggagtgttagatgaaatgtgcttcaaaagactcaacaatttcgccatgaattcttgcaattccattacaaatgtgggagggatagatggaatggtcccaggaaagcctaaaataaaagggcctttccacagatgaggtcaatgaaatccagattctggcctttgagactcaatcgctgcccagctctaacaccgtgaatcacagctattcacacagtgggttttcaccttcttcaatcaacagcagacccagcatggactccctcaccaccggcacaatggatacacaaagagattagtctttagacagagaacaagctgctgaaccaaagaccaactacagattggtgcaataaaagagagaggaaattttttttttttttcagagtaataaaccgattcatccacctgctcttgcaaagcggaggatcaattatgccaacaaaagaagacacaatgaggactgtaaagagaaagccagtgaatgaatgagctcatccagggtgtggatggattgaaatatacaggctgacccggggaaggagaaaagatgacgtaagtggataaggaagaaaaggaaggtgggtggccaagcaggtgcccacaataccggacaaatagaagtaatcaggaatagggacaaaattatttcccttccagagaactctcttgtgatgctggttgagatgctggaattagtatcggaagaggccacctgcaccacttcagagcacagtcaccc

SEQ ID NO: 29008 - DNA, 1329 bp, Bovine  19866881055625
caagtatgagtttctaaactgaactataggaacatcatctcatttattttccaagtactttataatatcttccaaatgaagataatccagcaataaaattgtttcaaatgaccattcccacaatttatgtagtaataacaatcaagtgatttctacctaatgtttgcaaagattttttaaataaatgcatacttgatctagcattttactgttgcaattaataaaatttgatttcaggccaaaacagagtatgtggaaaacctgaaataaaggtgcacactataattattaagtagtaagtggttgattgttttcttataccttctccattatttattttgaatggctttttgttttgaatgctttgtgattcctttagcaagaatgatgacttttgacctaaaagtttgaaatataaagagagcgactcaaatatatcataccacattattatgtgtttacccccatgtattttaccccaaagagttatacctccctctccattaacacagtcctttcttttgttctgagaattagcacacgtttatacttaaaagattattttgttaaaaacaagtgaagttatatctagatttttaatcacattttccaaaggaaggtcccaattagggcactgatctccttttaattaagataaaaatttggtctctctcttaaatggttttgttctcaatggctttttttcctaaatcaattgtcttgtgataaaaaggatttctgatattgttgtgctctgctgctgctgctgctgctaagtcgcttcagtcgtgtccgactctgtgcaaccccatagacggcagcccaccaggctcccctgtccctgggattctccaggcaagaacactggagtgggttgccatttccttctccaatgcatgaaagtgaaaagtgaaagggaagttgctcagtcgtgtccaacttctagtgaccccatggactacagcccaccaggcccctccgtccatgggattttccaggcaagagtactggggtgccattgccttctccgtgttgtgctctaagaagcatcaatttaagaaaaagctaatatatgtgctttgggtcactccatgaaagaaaaaagaatgacttctaaaaacgtcactgaactcctattaaaattaaaagcatgactctgttttccatgatattttagaccatccaaacccaagagtgagttgactttactatctagatcagatgtcaatgataaaaggccttggaccaaatctggccagacacctgttttgtatgtaaagttttactggaacacagagacactcatttgtttatacattatctatgact

SEQ ID NO: 29009 - DNA, 956 bp, Bovine  19866881060575
gcgaccccatggactgtagccctgccggctcctctgtccataggattttccaggcaagagtactggagtgtgttgccatttccttcttcaggggatctccccaacccagggatcgaacccgggtctcccacattatgggcagatgctttaccatctgggccaccagggaagcccagaattacaattactaccatctgtgaggatattttcacttctgcagaatgacttcacatccattacttcatttgatgccattggcgagtcggtgagcatggtagagcagggaccaaggctaccagatgtcctttgcaaaagaggaaatagaccctcagcatttaaggggcctgcatctagcttaaaagtggcaatggagattgagcaaatgcaagcccatgttagttcctcagtcgtgcccgcctctttgtgacctatggactgcagcctgccaggctcctctgtccatgggattttccaggcaaggagtactggagtgggttgccatttccttctccaggggatcttcccaacccagggattgaactggggtctcctgcaatgcaggtggattctttaccaactgacctaccagggaagctcccaaacacaagctacctgtctacaaagttggtgcatctccatactgtcctgcttaccctggaagtgaaggcaaatgttgaaatgcttcctcctaaccatctcttcctttcttctctgcagaggcgtccatcctgagctacgacggcagcatgtacatgaagatcattatgcccatggtcatgcacaccgaggcagaggacgtgtccttccgcttcatgtcccagcgagcttacgggctgctggtggccaccacctccagggactctgccgacaccctgcgtttggagctcgatggggggcgtgtcaagctcatggttaacttaggtatcgtatgaaagtaccctctgccactccgtttg

SEQ ID NO: 29010 - DNA, 1512 bp, Bovine  19866881069047
ctctctgggtatgatggggtcaggtgagaagacccaatttagccatcaacacttaatgatctggaagaacgactaagctcctggtaatgacgttcatacatgatgctaaattgggaggtgtcaccacgatggcttgtggaagaagcacagaataaggggatggcagtcaaggtcaggaggccacagtgatgcaggctggaaaaatgggggaggatgcaggcaaggacaagtggagggaatttccttgaggacagtctgcaaatgtttaaaatacatatatatatctagtaacatcaggacaggaatgagctggagatcttaagctgtccagagatttatccttccatgatttaagctgaacacgagcttaaatcatacaggagctgaatcacacaggaggtattttggggatcagcaaggtacctgagccatggtgggtattttaacagccgtgacctgccaggtagagttccttccttcctctttgatgtgatgatcttagaggcagaactactggcttttacagtgtcattacctgcttgggagttagtgttctcatgtcccactgtgcatatctgtatcctggctctatcgcttaacctgcaaaacgggaaaataacctgtaaaataggaaagtaagatgcttcaggagttttatgagaactaaataaatggaataggtagcaccatgcctggtatgtgctaagtgcttagtaaatattacctattcttatcattactatttttatcatcatcatcatggcctggagtgcacagtctatacctgtggtggaatataccagctgaacagataatggcctttctggttaaagtgggggaagaaacatccagagaatatgatttgaaaaccactcatagagtaaaaagagcataagttcaggcatccagatttttttccaaactctgctatggtggtggtggtggtttaggtgctaagtcatgtccaactctcttgaccccatggactgtagcctgccgggttcctctgtccgtgggattctgcaggcaagaatactgagtgggttgccagttccttctccaaaactctgctacaggtgaccttgaatgagtcactttacctctttgttcctgtttccacctttacaaacatctggggatgaacctggccatctctgaggccccttccagctcaaaagttcaaatacaaagttagtagggttttatattgtacaaactgtcaggttttaagcatattttctgaacatacattactctgcagacctatgccagcagttgccacccatgggaaagttgactcctacactcttagcactgagcgtcttacatccccaaacctcctctgtccccttagtcctgggcaaacagggatggttggtcagcctacccatggaataattgtccaactgtaggagtgttggatgacagtctaaatacacatctgcaggaactgagtagttctgttgagccacgggaagcatccttaggaagccattcaacatttttcatggg

SEQ ID NO: 29011 - DNA, 776 bp, Bovine  19866881071057
atctgcaatctgcccccgtctgccctttgcacagaacctaagcggctcctcctaaaggcaacactgctcgtctccgccatccctccagctctgggaggatgcggaagagccatccgcgcatgcccagccatccctggctacagcggggaacctactgctttctattgttggccaaatgtacccagaaaagaaatgtccaaaaggaaggcatttttgtgttcaccaggagagtaaaaccttcaaaatatggcaaacagagcagagacatttcttgagtatgatactacctaaatggagaatccggaaataaatgtgaaattcaaatgctctaattattactcagggtgaaatgtcctttctgatggcacaggatgtgaccttcaatgccacatgtccacagaaagcaggcagactgttcaggcattgcaaagcctcagcttctctatgtgtgtttccccactcccatcctttgttactattccagggtggctatgtactgcctggggctagcttgtttgatccatggctgcagaaacaaagccatttgaagcaaatgcagaaggttatgaagaggaagggagagttagtgaggtctgagcaaacagtgaaatatataggctttcacaccaaaggaaggctttaaattgaacatgacttcaggaaaaatcaatttgtcttttcctttcttgtcataatttcccctgcaatatgactcctgacaattattgaagggtgcatcgttgcataaacccttgcacagtgcggcttattctcca

SEQ ID NO: 29012 - DNA, 1134 bp, Bovine  19866881082102
tgcatgtcagggagtggggttggaacactgagcttgaggaggcctggggtctgggcgtggggctgtgggttgagggtggagacaggaggtgagaggtgtcgtctcggccacggtccagcaagctcgacactgagctggcttgcatttctctttctcatctgcaccagagaaagccagctgccacccattattaaacctgcattctctcgctcagagaatgggatatttccctcctcgtgcttttaaaataaggtagagagcagggggtggggaattaattaatgtcagtaaatgaagcatggggtgcttgtccgggtatgataatgactgtgaattagtgcagaagaaacagaatagtatagaaaatgaactgcactggcacactgctttgggacagactcggccaccctgacaatgccttaacccttcccttgccgcatcctttgtcactctgggaaagcccgcaccgcagtctcaaggctacagtattctagctagacgttcctcagtggagccctgccggctagtgatggtacacttttaggacgtaaataaaacaactccgtgtttacttattaaattaatgaggccctccagaaaagaagcaattgctttgtattggctggttaggggaattgcacaatgattcaagaaggctgtatgcccaccagaggaaagaaaggggaatagtttctcaaaataggttgctccctcctcccaatgccaaggtttaccttaagactgcgaatgactaacctcattccccacctctgctttttcatatgtgctccaggctgtatgttgtttgaaattgactggacattcccgtgtacaatgccctaaggagtggacatagctgaatagtacctctatgttccaggagattcctcctcaagggcatggtatagtgcttggtatgtagtaaacatgcaacagatcattgctatcatcaggatcatttcactgaatttaattcatagtggatttttcttcgggacagaagtttcagaggttcagagagtccttgaccactgtccttgctttttgtttctttttttccctttcttttctttcttccttctcctctctgctttaaagttcttggcacactgataaaatgaagaaacgaaataa

SEQ ID NO: 29013 - DNA, 1175 bp, Bovine  19866881088671
aaaatatgtgaatgtaactactgccttcatcaacatcctatttcacatttggggacaatcagccgctaaagattaaaacgcaatatgttttctcaaaaagaatcagagatttatgttggaagtctgtcttaaaagaaggcctcgcattactgagcataattaggaagaagaaaaaaaagaagaaacagtggccttatttcaacttatttcaaaggacacaaaatctaaggcagtggttttcagtcaggagcgattatgccccccaggggacaactagcaatgtctgagatattttgtgttgtcacaactcggggagggtactactggcatctagcgggtagagtgcagaggatgctaaaaatcctacaaggcccaagacagccccacaacaaagaatcatccagtccaaaatgtcaggagggccaagatggaggcctcctatagtgatgctgtaagcagaaaagatctttcaggcagtagcttgaaatttctctcagtggaaatgaatgggctctcagcctcacactgccatgctgtcggaggcagaaaagaccttttgactacgctttacagaactgggatctgcaggtgaggcagccagcacatcgtcacaaagagccacgccaggctctgtcgcctgtgtgagagagcagccgtccatccccggcggcagcctcaggagagacctgcccgcccgtggccaacacagcaggggctgtcccagcccacagctccccagacggcaggaccgagtgaacttcatcaagtctcctgccatatctccaagccctggtacctctcagaaataaaggatttgggaaaactggatacgtgtgcgatttcaaatcctgcacgtttctctagcaggaatccttgccaggtggcataccacagagggtcacaatgcaaactggcttcgttcagtcaagcaaatagtcacccactaaaatctgtgatcctaatccatcttaacccacacccttccagactccttggctcacgctacagtcttgctttgttctcaactctacaggctactcccagtatctaaggtggatatttgtcaaggattgtaggccagcagtgttgaggggagcaaatcgatgaaccgtaaagatgtcggtgaaaacagaacccagggagcaagagattttaggtgcttattaaccaattca

SEQ ID NO: 29014 - DNA, 962 bp, Bovine  19866881101890
aaattagagccaaatctttcagggtaattgatttttatttattggtcaataaaaggtacctggagctaaaggacgctctgtcagaacagttaattatccattctaaaccagcccttttacaggcatttaaaagccgatattgatgcaaaagcaacaaaagcctcactttactgttttgcatgaattttccctttaggtttttctctgggaaaatttgaaggcaaggcagcaagccttcctgcatcatcgtttcagtcttctgcccttgtgtgaacacacagcttctcagctagtttccctggcccttagatacaagcctgtggaagaggtgcacggagtgtggtgctggcatcaggcccctggcagggccagtgccctgtagttgtgtgtgttctccttggtatttgacttggctcctgccagtcaagtgttgaccgctctccccttttctttccctgcagctcgagaggagaatgtggccactttccgaggctcagagtacctgtgctacgacctgtctcagaacccgatccagagcagcagtgatgaaatcaccctgtcctttaagacctggcagcggaatggccttatcctgcacacgggcaagtcagctgactatgtcaacctggctctgaaggatggtgcggtctccttggtcattaacctggggtccggggccttcgaggccattgtggagccagtgaatggaaaattcaatgacaacgcctggcacgatgtcaaagtgacgcgcaacctccggcaggtaatggctgagggcagagagcgcctggaggctcctcttagggggctggggagggggtgtgaagtaggtgatgggctaggttacatggagaagggtagaggtaccatatgggtgagcatttgtcaagctttctcccagcctttacaatttcacaaggatcagattaaaatatgtttctcctctacttcaattctccatg

SEQ ID NO: 29015 - DNA, 1212 bp, Bovine  19866881108300
gtatttctcgggctgtccccagagtgggctttgctgtcggctgtggccagttggcttcagaaggtatagagccaggaggattcctgtctccagcataactatagagtgagcctggtgcatcactgggacttcaaactagagtacagcgctgccagacaggagctatgacctcactgaccgcacagtaattctacttgagggatttatttttccttccatgagctgctgccaagactcctggttagagttaatggggctcccctgccagcaagtgtctcctagtgatgtgcgtaagcagtgccaggcaggaaatagctttcctgttcttaatgggcttgttaaacctcttattgagtggggtttaaatggctttattatgaataataataatagtaagtaagcattattagtcgtagtagagaaaaaatgatgatgtcagctctgactgccccttcgtttttcaaccttgccagcctgcaggtccttttgccaacagtgtccagagatgggtggccggtgagactgggaccggtaatcggggtagatggcaggcttcgtttcctgcagcttcccaattctgagcccctgtccactcttgtagagtcattcctgctcgctgtgtctttcagggtttttaggctcttaccctatcagatgaaatagaaccacaaactcctctctcttaattttaatttgggttgaaagccgtggaccaaggttccaaagttaagtctgggcatcacatagaagagattttcgaaagggtagtgggtcctgttctccgtgctagtttacagctgggactggagctatgaagtgtatcctagactgtagttgtttatttatcaggttcactgatcttaccgtaactttctgcaactgtattggttttctgtatactgatgctcttatttgccttaaggagatttgacatctccttaagcaatatgtctgtgaaatcaggggtttaatgtgtgggctgttttgttctttttttttttttttttaaccaatccatattaaaatggatacgtcgcagttacctttttaaaaagttcatccatgtggcaaatgtgtcataccctcaagggaaatcgtgccacgcttctgcagacactgctgtttgaggtgtgggtctcatgctttagtggaagtcagaagcacaggcacagctggtttaactacacgttgcttctcccctccctctgagat

SEQ ID NO: 29016 - DNA, 762 bp, Bovine  19866881166573
acagttcttctgattcatttctcattaaaaagtacatcctcactagcaagaccactctctcagaccctatgaacaagggcctggggtagatttttcttcccaagtatgtgtttcaagtaaggtaacaaaatcattctctacttctcaactgaacatacccagctgtttgctgtcttgaaagctccaagtcctcatgttgacttaaagacaccattcagttcatgggaccatgtggatgaacccagaaagatgagcccgacccagcacctctgcctagatcagatccttgacagagacgagagcctcagctgcacagaaacccaagcagaaaaccacttctcctttaaagttcttgggtttcttgctttaggttccctctttccctttccttctctgaagtgtgcccgcacacctgcttcccctccttcttgcatccacgagggatgggcatttctccagcagctgagaccttgcttctcccctcccccagccctcccctccccgtccccaccaggggcatagcctcctctgtccggcgatcgtaccagatgctccagggctgtttgctcccacttttctgttgcggttgacgacacatgacaaacctaaccgcatgaaaccaaacccagatttttctcaagagatgttctggggaacaaattagcttcccgcccccaccttcctcagaatgtttgggtgttataaattgctcctgtctggattcacgtagttttattctgccccgtcactcgccactcattt

SEQ ID NO: 29017 - DNA, 1107 bp, Bovine  19866881223835
atatttttcttcagcatttatcaagatgttttgattgtgcaatttgacccctgaaaaccttttaactctatgtcagtataatcaggattatacaaacactaaaacagttttattaagggagtgttttttagaagtaaatgagtttgtgcaattcttcatttttttttcttcagcatagttaaaccatttcttaattttctaattcatttttatttcacttaactatttcttacaagatcagttctgctccacgtgtcttctgtagcatagatttgattcatcgatcagttacttttttgtgtgcctatcaaattttgcccatgtagctcctaccactgtgaacattcttttatggtcatcatttctaccatacccagttttctcacatcagatctgctggtttaaattttgtcaagaatgtttgattcctccttcaatttttcagtcaataaccaattttgccacgtgaatttttagccgctgtcagttccattttgtgttgatttttttctgacaggtctaatttttttccaggtcagtttttccagttcaaagtactatatcttcttcctaaaactaaagtcagtctccttcctgacaggtgttttttttttttttttaaagcagttgcacaacatactcgaggggtcctaacacccgggtcaaaatatcctttgtcattcattgagaccactgacctagatgaattaagaaacttaccccaaatcatatataaggcagagttctactggcccgttttagaatatatagcacctctagttcagaaaagggcagagtaagaatgtaaaattgggctgaccttgatggtgtgcctctctccttccaccttccactccccacccttttgaggttctcagacttctgtgaccctccgccctgaggaacagcagctgggaccacggttcgaagcttggcgtctccgggcttcctagccaggccccgccttaagctgtgtgcgcactcgggtggcatgatttacaaacaagcaggaccaaaaaggaaaaaatcctctcgtggagaattaggtcagtggcggggctggggaggggagggaacacagaccatcagttctcccatccttcagtt

SEQ ID NO: 29018 - DNA, 1038 bp, Bovine  19866881230963
aaatacctttgataatgggattgacaaggatgctaatttctcatcttctgtgagagaaatcaagggttttaactatagcagaattcagaaggtatagtcaaaattcatcttccagattcacaaagggcactgtgagaccatcgacccagagcttcaggccatgtggctaagatcacacacagtgtgctctgccttccagcgactgaacttccaggtgagaccagattagacagagaaggtcggaggaaatttaattcttatcatctactgtggaaggctggcaacagcaatccctgcacgaaagaagaggctcctaattatgattaaaaggataattcaggcaaggtgactctagatcagcttcagttagtccttatttttgaatttcatatttaaatccattcccttgacagcaactgaagaagtgaaacacaggaagaaaattgtctacaaaggataacatcaaacactaatctccatgtaacggagactctacagaatttcaaaggcatgttggtacttgagtgactgctatgtaccaggcaatgtagggggtgatgggacacaggatacaatgatgctctattcggaggcagttcctgtggtatatgactcctcagtaagccctgcagtgcaggcttgctcatatccatttcacgctatttacgcctgctgaaggcggtgtgcaacatggatgccagtcatccccattcctagtagccatgcccttatgtcaccattggtgcctgctcagtcactcagtcatgtccaactctttgcaaccacatggactgtagcctgccaggctcctctgtcaatggaattctccagacaagaatactggagtcggtagccattcccctatccaggggatctttccaacccagggattgaacctctggattggtaggtggattctttacttctgagcaactggggaagtctctccccttaaatatgcactggatgcatcacatctaagggatggatggaatatagcagggagtgatggaatcactttcaaagtcagattgaaaa

SEQ ID NO: 29019 - DNA, 1273 bp, Bovine  19866881319849
ttctacctcagtttccttgtctgtaaagtaagggagaaggcaatggcaccccactccagtactcttgcctggaaaatcccatggatggaggagcctggtaggctgcagtccatggggttgcgaagagttggacttgactgagcgactttcctttcacttttcactttcatgcattggagaaggaaatggcaacccactccagtgttcttgcctggagaatcccagggacggaggagcctggtgggctgctgtctacggggtcgcacagagtctgatatgactgatgggacttagcagcagcaaagtaatggaaagggaggaactgctctccactgttctttacaatgtgagattctatccttctaatgcacacaaagctttatgcctctgttcatgtattcactctttctttctaccaatacttatttgtagatgcatatttctaccaatactcactgtgctcgcaatgtcgcaaaaagtagaggtaaattctttaaacacattatcttttcacaaatacaacggggtttcaagagcatttttaggaaaaatctcacactattgagaataaagcacatttttacatttcttctttagctcttttattgggaaatgttttaaaatgggctgaggaatgatattcaaatggaaaacccaaggcctttaaaatcctttttacagatgctcaaactagagtctcacatattcttccatttctcatcttacagtctaaggaaaaacaaaaacaaacaaataaaaaacttgacttccaaagtatatctttaataataacagtgcacacttaaagtttaagaactatagaatatttttaaagttgatgtagactatatctcagaggccactttataccatattcaagaaactaccatgctgttatttttgtcttcagagcaagctgctactttagcaattagcagtccataaaaatgtgggcaattggcttcctctagactaattagcaagtttgctatgttgctgtcccagctggtcatgctatgtcttttaacttagctcaggcctagttggttttgccagttctagaaccttttaaagtttgtcgtaataacagatatctcaattggcttaaactcttcagcaaaacaatgttatctgaactgggtcaggattctcagctcctatctcctgttctcaacaaaagctcaggcaactccctactctgtgcaaacctcctccaactgtgttcaccctgtccctctaccccaatgctcaagtctctgttttctgaagtcta

SEQ ID NO: 29020 - DNA, 568 bp, Bovine  19866881343574
aagccccttgtaaacacatggtcaggagctagataagaaatgacccctagttgactgtctcctctgaaagtaagcctcagcttcactgagaactggaacattaaattgctaatatgcttgagcttagagaagatttattgagcacccaggacatctcattagactactggaatacagactggaacaagccatggccatacccctctggggctcgtagttagcagccttatgggagagacagtaagtattcatttaaatataatgtcatctgagaatacagagccggcaaacacagcaaggctaaagaggagggtcaagacagacggggtggtaaaacagctgagctagtctggaagagcggtaaaaattggctagtgaggaaagaaagagagtctccaggcaagggaaaacagcatgatcaaagaaaacttaggttggtatttcttaactaaaaatgtcagatgagggtatggccttgtcataagaccacaaaggaatcagaggggaaaataattccaaagatatgcattggagacagcttgtatttaaagcgcaaatctatttttta

SEQ ID NO: 29021 - DNA, 648 bp, Bovine  19866881373916
cgagacccctggactgcagcctaccggctcctctgtcctgggattttccggcaagagtactggagtgggctgtgccccctccaccggtcagccaactgctcccctatcctgagccataggagggcccagacagccacaggggcagggaatttgctccaatgcctatgtggaaggcccaggctggtgcagaagctcaaaatgcttgtctgctgtctgagaaccaagcaggagagggaaagtgaatgacattatctaattgccagctaatctacataattatcgaacggcatacttcttacgtggggttagcatctttgcaaatgtctcatgatccggctgcttgggagacagaagggcccccacacgactccaacacatgggctatttaccactggcacaactcgaaagatccggctgccacgtacccttccactgcctccctatagttcctctgcttccctgagacagattcaaaggaaagtggggcctgtgttgagaaccacagacggtgggaaggcgtgatgaaggctgtcctcaaagcctcagactgggctcatcagttcctcctctggaacctcccatcagcatccctctgaagtcccgatgatggctctctgttggttctacccgcctccctttcaccatagc

SEQ ID NO: 29022 - DNA, 891 bp, Bovine  19866881431123
tctgagttattttagatcctgtttttaggttaaaagcagtaaattgcagatggcaagttttttttttttttctcccttgatattactgaaagctggggtaattttgtcatgagtcacattaaaaaaagaacaagtgatgttatccagcacctactcaacatgaatatgtgcaaagaacagctaactacccagtcatccattgagcaaggagagaaggcttttgctttgctttaaggtgacagattttggagtgagagagtgtgtgtagttcagtgtgccctgtaagcactatcagaaactatgtgtgaaaatgtgagtgaaaaaaacaacagaattggtggagtacctccagcgtgctgacttatactaggccctatgtagaaccgactcattaaaaaagctggggaggggagatccaagtcaaaggaaaggcttgaggtcaatatggcaaaacacttttactcagggtctaagattaagaatttatttaagaagtttttttttttgtttgtttgtttttgttttttttttacccttatatatgtttatttcaaagttctgggcttaaaaagtccagctttgacttaactgcttaattttaagaagacttgaactgtttcactctttgaaatgaaaccaatttcacaagcaccctcaaaggaatactactgcaccagaagttaaagttgacaaagaaaagcgttgggtaatgctggagcccaagaaaggaagctgttgcctcaacctcttttaaccagcgatgggaatttactccaagtcatttcactccactgagtctcaacaggttctaaagaggtccgtgctgacagcacttaggattcctgggagcattatagcctataatctatctctttttaagggattttattt

SEQ ID NO: 29023 - DNA, 1001 bp, Bovine  19866881489337
tcggatgtgaaaaataaaagtccccaaagtacgggtattttagctctatttatcgatttaccgaagttcaatgataaactttgggggtcttttctttcaggagaggtggattgtatatgtgctgagggtgggaagggcgtgggggcagtgttcattcagaagagcccttggaaagtaagtatgatgctacttccgacctgggtgaggtcccgtctggtggtgtttgggagaagcgggagttacggacgacaaggtgggctgcagctcctttcctggctgcgagcctggcgccaaggttttccatagagtcctggtctcattgtcttcccccactctctttttctgtgtcgggtgccttttttttgaaaaactaacccaagatcattcatgcgatgtgtcattttactaaccgactaatgtactaacaccctaacgactcatctttgtttttagtttttttaattaacaatcgttctgttcacaattttttaatttcctttcttcccccttttccgcaaagcactcaggcatcggacacgctatggtaaacaaactacattgtctggtagatatcattcttattgtctctttttttgggtttgccgtgtgttgccccccttttcctccccaaaccccccttttatcctctttagacttgtttcttttttaaattttttgttgttggtgttgaatgaaatacaagcctttctttttctttaaaaagaaaatggaaggggatgcatctgtcctgacaacatttggatgactttggttgggacagtttccttttctccactatttttttttttttcctaaaaaaattttttttctaaataaatattctttgtttagctaaattcattttgttttcttattttgcaacttccaagttacagactagggacaactgagatttctattgaggactttcttctctccgtgtcttcctaccccctcactcttccaactttcttcctcccccaccaacccccaaactcctg

SEQ ID NO: 29024 - DNA, 736 bp, Bovine  19866881556620
tggtgggaacccaaaacagaaaatatgcctgttagagtccttaaaatataacacagtaactctcctgctattattaaaatgctaagcaatcaatgtaaaggctttaagaacctacaccccataggttgttcctcctgtgtcttcttcccagccctttttctggaatctcccatcaacttgaatagcataactgagaatccagctgaaaaataggcaatgctgaataattcttcattggagtatgtgtatttggatatactctcactgtgcatgtgtgttctgaatattattaaactacatatttattggtatgcaccattctttcttctttgtcatttcattttaaacgacccaacaactataacacaaataaaacaaacacacggaataaaacatctggtccccccaggaaattaaatgctaaattactatgttaattcaaccaagaagtagagactttaaatgtgaagaagtcaacaaaaatcaaatttatgctccccactgtccccataacagctaggctgcacatgcacattttattaagacataaatataaggtagcagacagtaattgagacttaaacaagcaacttagaaagcagtactgtctctgactcagcagtgcgactatgaccaaagtgctatcaatgtcgagagtttcatttttttcttctcctcaatttttctttttcaggaagatattaaactcagaaatggtagcagttagaaaaccgtt

SEQ ID NO: 29025 - DNA, 875 bp, Bovine  19866881596658
gaaacagcgggatttgcttggtatctaaatgtatccatttcccacatcttctttcccctaacagctcatgtcttatttctgttcctatccttgattcccatacaaaggtgattgaggaattctccttttgcatttttacagagcaacatttcagggtagctattttgtcacatttcaacagggaaagactaattaagccagaccaagcttccccgcacccccatccctgaaaggcagaaaactgctaaaccaacacactaactccgcagttatcgggaaccgtttccttttttatttcatgcttctaagttcagggaggcgtctcctgatctttgtttgtgtttaagatgacacctttgcaataatcatcagaggcatttctgcatccacgtctttcctgtgtttccctggacccacagtgaaacgctgaagctaaagtgccactggcgtttcatggttcttttccagtcactcctacctctggcccttcctgccttctgaattctgcaagtcttaataaccccatttcatgcgtgagctgaagaaaagaggcaaagctgcttcctaaaggtctcagggcctctaactgtgctgggcacatggtcggcactggctaaatgggtgttgattgatttcttgattgattggcccgattagaatacaaagccttagctctcccgcatgttgaatcatatactctttcccagaaaaaaaaaaaaaagaaagaaagaaagaaagaaatagtacagtgacctctgctaggaagctttctctcaagaccatcatccctccaatccacctcaaaatcctagatctgtcttcctaccagctgattcaaacctttgcatgcaagagtgtatttattcattaatgaa

SEQ ID NO: 29026 - DNA, 784 bp, Bovine  19866881692584
gcttgaggttcgggactctggaaataccctgacctctctgagctccaacgtgtctccttaggcagtgttctgccaattcttgatgagctcccaaggtttttgtaagaatcgcaggaagtaatacagagacacttgtgaaattacagtgcattattataaaacatatatgtgaggctttcatctgctaatgtggcaaggtcagggaaaatacggaacaggatgtggggattgagaacagtggatttggagcttctcgtgttttacttgtaaggtaccaacttctgcacttcatatagtgaagcaaaggtggcatctggacagcaaaggcgacttcctccctggtcacatcaaaaaagtcatctctgctacctgtctcctgaagatggacagggaaaagcatctaacacaaaacaacatacgtctctgcatctgaagtcttctgcgtcactttgcagcaaccgtccctcttaattctgtttgaaaaggcatttattaaccaagtgataaaagagagaagattcagagcagtaagtcttcacaacaaaccaggttcacaacgtatagaagtgtctttcctcctgtctagaactgagcaaaattacattagggtgctgcagaaacaggcttttccaagttcttttcccagagtcaatccccacaacctttacaactccgcttccgaacccctgcaatgatggaatgcagtcagttgactattaagatatccttcatctgttaacagaaaagctgctaaattgcaactctgagcaaatttacatgggaa

SEQ ID NO: 29027 - DNA, 1347 bp, Bovine  19866881831167
tgactgtcatggggaggtggctgagagccagactagcctcatcccctttagggtgcaggaggggatttgcttggcaggtttccagtccgtgccaatgcaggagcaacatcttctagccctgcctaatcctctccctgggagacttcttcccaacagtgccaaaaacatgggacacccaaggcagcctggcagagtcggaaacatttctgaatagggcatatgcttccaaggccagtttccaggaatagctactcaatgctacatcgaatcatacccttgtctttttttctttttttttaaagcatcctactaggcttttaagcaaaatcttgatgtgtgttggggcgtctgatcctggctgccacgatagacttgtcaagcaagtccaatccaattccattttcctctattccatagcattctggaacttctcaccttatttctgagccattacatatttccagggggctccttggaaattcagagatgctgaaaagcttgctgaatatggaggaagatgggacattttaggggggatcaaattaggcacagataatagagccagagatggggctaagcatgaatccttcagagtgcaagctccccaggaacgaaatgactggagcatgaatcacctgcttacatcaggatttcttcccacatcaatccctcccatgtcatttaagattaatcacaagcagttaattctaaataactcagtggtgtgtatactgttagtgctatattagagaatcccttatgaattctactttgtgcaagggttaattcctccaaagcatcatccagaaatgttatgacctacccattagccccacccacatggcccatcacaacggtcagattgctttaattaaaatgaggaccagtgaggaaatgtctgagaagcagactttggcctgatgaaggaagagctccacaatactctgtaatcagagatatatcaggatgctttggaaagtaccaagcccctgccgttgccactgcccgggattttttagtcagggagagatgtcttacacagttgagaagaggatgtgaaatgaataattagacccaatgacctttatagtcccctccagtaacgtacagcccgtggtaactatactattaataatacagtattacatgtttaaaagttgctaagagagctgatcttaaaagttctcataataagaaaaagcatgttgtaactatgtagcatattaaaaagtagagacattactttgccaacaaagtcctgtctagtcaaagctatggtttttcaagtagttatgtatagatataagagttgaactataaagaaagctgagagctgaagaattgatg

SEQ ID NO: 29028 - DNA, 1204 bp, Bovine  19866881950112
ttttatctaacacacaaaactgattcactgttgaaggaaacaggtaatcttgtgtgcttcctttataacttctacaatccctagcatattcctgacatacaccaggctatcaagaaatgcttcctgctcgagtgaggctctgaatattcgtttatgtatgtaaagattcattcacttactccttgccctcctagaatgtaaattccaccagacccaggacttgcctaattgcccaccaccacattcccagcaccgtctaagcaggacttgggacacagtaggcagtcaattaataatgactaaataaatcattaaataaatgaataattattcatttatttaatgtactaagtgtcatgtactgcttttgatacttacttgtacctataaagttttgactttcttgtttacccatctccctctactagagagtgactcattcagaagggaagggactagcacttgggatgcctaagaagtgggttttgagtaactgaacaatagaaggatctcaagaacttcatgttctttctccagacacacactccatgcctaaggagagagccccatcaatatgtaaccacagtagtggagacgttgggcaatatagatcagtgaaaagggattctgaaaatagagaagcagatgttcttagtcttacctgagcttgtcaatagagaacaagacatgtgacttctgtttagcaaaatacaagattttcaaaacaaaaaaccctttactcactgaatgaccgagaagagtctgagagaagagagagacaaagttccgcagagcttactcaccctcggctacatcgtcatccacagttaacttaaggctttttcctctccgcaccacccggacggtgtgccattcattgtcgttgagcttctgccccgcgtacagggtctctgggcctttgcctaagggcagtggtaagtgccaaagttaggatcagtcttaaaagtagtgttcatggcatcagagttgtcaaagccacactggtgcatatgacccagcaatactcaggcagtcaaccccctccagagcccatgtgagtctcagggacattctgcagaagtccccaatgcaaaatttcaactgaatcataatggacagtaacaaataagtatcctcttttatctgtaggtacaagacattttaaatggcaatgcaatatttacaggaaatagtagtcagctgt

SEQ ID NO: 29029 - DNA, 831 bp, Bovine  19866881997445
cctccctgaaacccagtttaattatctctaaaatgatgatgatgagatgattcctttatatctccttcaaaaagatcatttgaaaatgggggaaaattataaattgcctggaattttctacacacaagcagcacagaattcaagctactgctccctctctaaagcctcaaagcagctgcaatttctctgcgggaatgaggaggaaggtattatgtaacactgcatctgccctgatggtccatttctaaaaagagctccactgaaggacctagctagcctccttccaaacactggcagggctttgttcttccttttaactgaaattaaattgctgcctgaagaacagaggatatatttagaagacagattcttcccattttttttatctgctttaaaattttctaattgagactcatattccataaaattacatagcagtataaagaattggggaaagaggcaggaataatttttttttaagtctttctgaccttttccccattttctcatcataacaaatacatagcctaccttttaggtttcctgacagtacgcattcacccccattctattcagatattctctttcagatcctccacggctaacactcacagtcaattcattaaatcctttttaatgtccaaaaatatgcaacacaactgaatttatatccaaatttccagtaaagacttccattttctatttctttactcctgaaaggtatgatacctttcataccaggatatgatagtacatgctttcactgaggatgtggataaaaaatatggatatgactggtgtcatacatatttttattctttcagtaaatac

SEQ ID NO: 29030 - DNA, 2145 bp, Bovine  19866880197928
gttcatctagtaaggctatggtttttcctgtggtcatgtatggatgtgagagttggactgtgaagaaggctgaacgccgaagaattgatgcttttgaactgtggtgttggagaagactcttgagagtcccttggactgcaaggagatccaaccagtccattctgaaggagatcagccctgggatttctttggaaggaatgatgctaaagttgaaactccagtactttggccacctcatgcgaagagttgattcattggaaaagactctgatgctgggagggattggggacaggaggagaaggggacgacagaggatgagatggctggatggcaccactgactcgatggacgtgagtctgagtgaactctgggagttggtgatggacagggaggcctggcgtgctgcaattcatggggtcgcaaagagtcggacacaactgagcgactgatctgatctgatctgatctgatattctaggtaccatatatgttaaccatctcacaaatattctcacaataaaagtgaaatttcatgaattccattttacgtgaggaaagtgtgactctgagagatgaagcaacatgcccacattttgcaggtgtaaaaatctagcacttttgtatattctactcactgataattagcaatgccaccaaacctgatcaatccttatatttgatctgtttcatcttgagggaaataactgtcaaagaagctctaaacatcattatttccaaataggctaagattccattacagggagccaggaggtagggagctatgtgataatacatcttgatggatatttgagtacattggttttccaaagctgcactttctgctaccacaaattctcatcaatgaaatagtgttggtggttcagagggaacctctctgttttgcttcatcctactctgagataatgcgtgattccttgaaagcagcatagcatttaaaactctgacgttgagggaattccctagctgtccagtggttaagactctgatctgccaatgcagggagcatgggttttatccctagtcaagaaactaagaactataagggcttccctcatagctcagttgggtaaaagaatctgcctgcaatacaggaagaccagggttcgattcctgggtcggaaggatcctctggagaaagaaatggcaacccactccagtattcttgcctggagaatcccacatacagaggagcctggcaggctatagtccgtgggttcgcaaagagtaggacatgacttagtgagtaaaccacgaccaccaagtacttagaaataacactggttaggagaaatgaaaaggaagtgaacagtagtccactggtgcaaaaccataggctactgaactccacgctcaagtgagggaatcatctagaaggcatcgccctacgcttcattaactggagcaattccaggcataggacagaaaatgaaatttaaggaaaaggaacagaaaccagtacctctaagaaagactgcacctgacctcagctgaatccttccccatcacacacagaatagagagagggagagagaacacaggccttgagcctttcagctatagctggaagataagtcaagtctcaggtaatggtggaaagagggtggggagaatcctctcaggctgtagacagtctacagagcagctcttttaagcaacagtcaggcaacatggattgaggttttaatgtgaaaatatctaagaaaatacagcatgagaaagaagttaaaaagattaatatctcaatctcacagaaaacatgccccaaggatcattcccaggtgctttgtccagaaggaaaagattaatgagaataagattatttgaaagcaataaacagaaaataaaacctctcaaagtcccaccaataaatctacagaattaaatataaagggatatggccaatggaagaaaagaaattaataacctaactaaaataatactattttagaactaatgagtaaattagaaacagcaagaaagagaatgggtaaaaattgaaagagaaattcaggacatagaagaaagacaaggtaatcatagtagatatggaggggggaaatgaagtttatgaagagcagatattatataaagagaaagctctttttatattctttttagagtatag

SEQ ID NO: 29031 - DNA, 850 bp, Bovine  19866880473107
tgtacagtacagtctcatttctgctcttgagtctcacaaaagtagcagcctggctgtgcttctgtgtgactgtgcccgtgcgtatctatgtgcatgctctcactcacagagaacaggtccatggtgggccctgtgggcaggaggctttcattcttttactcattatactttggtattgctacaagtttcacaatgagtatgcattgcttttgcaattaaaaaaccacaagcaagaaaaaaatagcagctgcctcctacagggtatacagagtacaagtcaggcactacgctggcccctatctcattttgtcctccccatggctctaagtgtggaactcagatatattatatcccagataaggaaactgaggcttgaaaaggacatacagttagtaagtggcagggtcaggatcccacatggaagccacattcagattatccttgtgatgtcactcttttccacctgcaatctgtaggagaaagggtgtgtgtcccccgtgggaatgtcggccgtttatcctgagcggcttcacagtggaaaaaggctgccgccggccacgctatggaactgaggcaccttggggcgtctgctgcctgagctgaagacccatttgctatcctggttcctggcccaagccccacactcctgcatcctcaccattgttggcaatctctccacgtgtgaattccattaaaggctggctcacagctattttgggccacgcattagcacttggactttgattaaatgagagaaggccagacacctcgggatgatgagaaagaaatgagaaatgtcctctccctgccctcacagttccaggagtccttgtccactgctcctgggagg

SEQ ID NO: 29032 - DNA, 1738 bp, Bovine  19866880482074
aactggtaatgataaaggtgtaatttctcaacttcccctgaaggcagggagctatgactgctgggcagagtctcccagactcctacagggcacagcccaggactcctaactcagccgtcccattccacagcagttattgagtcacttaggatgtgactggtctgccacctaaggtttgtccaaacttgcaccttcatacatttccccccactttccaccaccctgtctggctttcaaaccctaattctttaggttggatggagaagtagtgagctttctgtttataatcccctaagtcaggttttgatccctgtctcagctagagtgatcacattcatcacctgctttcaaagggcagacccaggtcattctctatgagcagagaggcaggagtctgcaaactggaaactcacttggggagaagtagaccctttgggaatgtctgtctaaccccctgcctgtcagtctagactatccacaactactctgggaaagacagctccatggaccatttggtacctggaaaatcgatgactgtggctgtttctttatttgataattaacactttctagttgttgttcagtcactaagtcatgtctgactctgtgacaccagagactacagcatgccaggcttctctgtcctcaccatctcccagagtttgctcagattcatgtccactgagtcaatgatgtcatccaactagctcatcctgttgcttccttctcctctttgcccttaatcttttccagcaacgcagtcttctccaatgagtaggctctttgcatcaggtggccaaagtattggagcttcagcttcagcaccagtcctttcaatgaatattcagagttgatttcctttaggattgactggtttgatctccttgctgccccactttttagaacttactttaatcatacagaccaatcattggtctgagatatctttaaccgtgcttaggctagaagccaagagacctctagaacaagaaggcgccatatgaccctggactctaggccatctccttatctttaaaatgagaggatttggtcaggatggtctgggcctgacctttagatgagattctgcagggagaaagcgtaaggatcgggattgtaatgaatgctggtctgggattctgtgaacgggtgaacaccgaatgaagctgtctccacccacattcatttgggctggagatggtgggtcagagccactgtgacctcttctcacccttcatttcctagtggctgctggggaagttgccaacttcggggcctacgcgttcgctcctgccacagtcgtcacccctctgggagcgctgagtatcctcattaggttagtcacctctcctgctctctctgactccttcatgttttcagttgatgtcggaaactgccatatggggtcaatcgctacttgcagtcagggacctgggtcagtcccaactcccggaaagaggctctgcactggggattgcgtgctgcccattgttctagcatcccttcgaccgcctgggcagtgaaggggcaggccaagccccatccagggaaagggctgtccctgccaccaggctgaaggtctcatgccagtgttttggtgccatagtagaagcagcacacacattgaaaggacaagccctagattaactgtcctgagttctaaccttatctctgccactttgtagttacagtacacagcaggtcacttaactactctaagcgtcaatttcccatctcc

SEQ ID NO: 29033 - DNA, 1849 bp, Bovine  19866880485782
aatcgtaagaggaaaaagcatttacccatctgtcaacattgaaggctccatgagagcttctccttcagcctctcagaagattccattaccagtgcagctagaattagccacaggatgttaatcctgagggctttgtgcgtgcagaagatggctataaggagccttagtcaattagtagaaaatctctcccaaaagggaagcagaaaaaataaaatagttgagacgaatccttaggcacatagcaaagtgcagtgcacgcagcaggtactcaataaatgtttattgctgtctacatagcatctgtagtcatgcccacatgaaccccagtggaaattagcctgagccatattttccatcctgtaatcagcccttctcctcgtgcttttaaatttatcctcataaaggtacacagtaggcccttgcttgggttgggcaggcgggggcaccctggtgactctgaactgcatgataggatggatgcaggaagaacctcagggtgagattcaggatgtcagcattgcatgggctgccagagcttatcacaagcctcttcctgcagtctgaatgcaccatattttttttcagctttttatattttaaacctacaggatagttgaaacaataagacagtgaatacacatgtgtactttatagtcagattcatgattattcatgtttaatcatatttgcttcactttatttttctcatgtatgtattatttctcatacagtaaatgtactttatgtatttatagaatatataatttataaaaacatatttatatgtaagtaatgtattaaattatatattttaatatacataatttttcttagccatttgagaggaagttgcagacatcataacactttacccctgatacctcagctcgtatctcctaagaacaaggatatcctcttatcatccaaatagtactatcatactcaggaaatttaacaatactgttttctgcatagattccctatttgtcttggttatgttctttatatttttaggacaatttactaaatcagtgcattgcatttagttgtcatgtgcctgtgtaaaatttaagtaactttctgtctcttccatgcagctgttgggtagatccattgacttgaacagactcattacccagcgcatctctgctgccatgtataaatccttggaccaggccattagccgctttgagagtgaggacctgacctcaatcgtggtaagagatggaggccgttgggagttctgctgtgggactcctcaaactagaagccttgttggggagttgttggtagcctggtactgagctggttaaaaagatgcgatgagtctctttctcatctgaataagcagggcaaaaagaaagacttaaaaggaatgagaaaaattttaccttcctgattgcctggagagagggagtggagggaggtcttgaaatctctagagatggcctatcccgggacatagcttctcatcctttaggattctacagatacagcaagtagctagatggtcctgagaaaggagggaagatttcacaatggggtcggcttcattggtgtgcagtaggttagaggccagagaggctgttgactggtttaatgctgcgttgtcaccatctttgaatttacaagcattttctgatgaaagccccaccttttcattttgtgctgggacttggaaactgtatagttgttcctgatgcacaagtacggaacaggcgtgcactcttcttttatcaatcagctatttgaactactctctgctaattctcctcaagagttagaataaacttggttggtcagtctttaggtgataaaggaagattttaaagcttcaagagcagataca

SEQ ID NO: 29034 - DNA, 1418 bp, Bovine  19866880515707
gttatcctttatttattgcactccttcatggaaagggctgaaatcttgcttcggattctcaaataaatcctccatggagagaaaggggaaaaaaaaaaaaacattatgtggtggttaatatttcttagttcatagaaagttaatgtacaggtgatgttctcagggggcagaatgtatgtgcatgggcctgtgggggtctggatccagctggaatcagactcatgggcggcagcttgatgctcagaccccccagctgattccgccctggctctcctcccaggcacccctttcccagagtgttcaacagatgcaacaggagggagctggacaggtatctgcagtcaggcggggggatgtgtctctccaacatgccagacaccaggacgctgtatggaggccggagatgcggaaatgggtaccttggaagatggggaagagtgtgactgtggggaggaggaggtaaggtgtcatgccatgttagtgggaggggaagaatttacagtgacttcaaatctcaaggtcaaagagcatgtatctgaaaattagtcataggcatttcctacatacatgtggaggtcaaagaccccatcacaaataacatgtggggagtaagccttaaatatggaccatttatgtagattctcccagtttgaggttgacagtatctgtgtccaaaatgcaggggagttctccttgtgagcatctgatctatacagaaaccacagtcttggccagtggagctacagatggcttccttggctgtccacagctggatacgtgaacttgaacctgggcattatgaggatacttaaaataacaagctcatgctctttgacctgtagaagaaatgactgaaaggggcttctaggaggaagaaagagcagaattgatggtgtacaagccctttccttccttctgatcttcaggatgaatatagtaggcatatcatagctctgtcacttctgacagatgctcgcggttctacaaaaagcagaactggatagtttcatatctattttatgaagcatgaaaatatgaacgttaacgtgcagaacagtttgtgggagaatgtgtcagtagtctatgcattcagaataaactctggggatgagattgagggtctgtatatgtgggtaaagactatttgcttttttaatcttctctatggtttgacttttttaaaatgccagcacataactttaataaaagaagaaccatttaaaggcttcccacctgcaccagcatgagttcagagagatcggcccagacccttcagaaaggagagagttgtattatcatggagggcccagtgaggttaaggggcccactcctgagtgggcttggccaatggcttatattcagagcagtttctccttcaacaaatgagtatgtgatctagggtcatgtgccagggatag

SEQ ID NO: 29035 - DNA, 1595 bp, Bovine  19866880526237
ccaggggttgaactcacgtcttttatgtctcctgcattggcaggcaggctctttactgttagtgccacctggaaaggccccttccctctctagatgcaccccaaggagctggtcacagagacattcaggtggttgtccaagaactcgaaacaacacaaccaaccacaacaaaaggtgcctcccagccgagctctgctggccaagccccgagtttcattccgcctcgctctaagagaacagcagttcacgactcttaaaagcaggctggttgtcaaatagaatgcactttccttttcctcaaggagtaaaccacaatatgatttggggagatggggagaagagtgaggagcagagtcaggatttgtcagagagcagacacaagctctctggaaaccagaggctaacctgtgtttactctggtggctgaccaagaacccaggcggcaaaggtaacctctgggtgtgtgtgtgtatttaaaatgcagcatgcaggatcttagttcccagaccagggattgaacccatgccccttgcagtggaagcacggagtcttaatcactggaccacagggaagtccccttcggcagtggaagctcaaagtcttaaccactgggctgctagggaagtctcctctgggtaacttctgggctgaagccttaaaggcttggccagtgggatcagctttgaacttcagtgaccaagttggggtgtaagctaggtaccaggtgtcattctggccatggaccagattgccaccaagtccccagtccactgatgagctgcccaccctgggaggcggtgtgccacaactgctgcaccaccacctgctttggggactgcctgtggtcccccaacatttggctggaggcagtcaaaaaaccaagagcagctggagagagagaattaatatcgtttcccttcctgtcttctttctagcagtgagaatgtgacagttgattcaaggatcattgatacggaggtaagggagtcagtatatttgtcaagaaggaagccctggccctcagccccccgagctggtgtagagcccccctgtgtaactgcatacctgtgcctgtgtttatgtcccgggccctcagtacagccaagcccaggccaaactcctgctggccttagagcaccaatgaacaggctggctttctgcacgcactccagcctcaaagccccaattttgaacgactgtggatttctctaactaaaatcaatgcaacccgttggatgttgagaatggccgtgatctgagggccctgagagtgtggtctgcagggtcagtaataaagacctctgagtgtgtttacttgatgcttacatctcggccctccttggacatggactaattaaactggttcttctagtgctagtggacggagcagtggggggtggggggtagggttggggtcgggggccaggccaggccccaatctctggagagttgtggctatcaaggaggtcctgtccctccagtgtcttctgcagtccagccttcactagagagggaaaggttgtctggggaatacagtccgctaaagactttgcacatcccttgtttttttgttggtttgtttttaccatcccttg

SEQ ID NO: 29036 - DNA, 1717 bp, Bovine  19866880562311
aaaataaaaaattcagttcctcagccacattaggcagctttcgagtgcccagtagctacatgtgactactctgatggaccacaaagagagcattcccatcactgcaggaagtcctttgtgcagagttcagctaaactaacggtcaagagactttctgtaaagggtcagatagaaaatatcttagcatctgcagaccacatggtctctgtcaccagtactgaactctgccattattgcttgaaaacagccatagaaagttcaagaacaaataggttccccaaaaacattattgttggacagtgatatctaaattttaaatgattttcatttcattacatgttattcttctttagatttcagtttaaccatttaaaacttaaagcctattcttagcttgtgtgtcacacaaatacaggtgtcaagtcagagtgcagcaataggctgcagtttactgccatctagactagagctgtgtggatctcagcaacaggagctgcatgtgcctgagcatctgtgtgttctggataggccggacaaaactaaaagtagaaaatgaatatatgttagcactgagcttcatctgctcttcatcatccatatagataatgcaagtaagataaaaatactcatcaaaattgcatgagctgtgttgcaaggttaaaaggaaggctgttaatgtaaaatgatgaaaaggaaattttgatgtgtggaattgacattaatatgctagaactgcaacttgtgactaggtaactagatctgtagctgtatgaaaatcaatgagacactcactgtaaaaaaagaaatcctcatattcagcccaatttcctgaaataccaatatttgtaatcctaaacacatcatcctaagactctacaaggtcctacagaaaatgcagttaaatgcaatgatgacctttctggtttacaagacactgatagtaaagagttttcttctcatctagtaacttctttattgacagtagctgcccagagtcctgagaggaggaatgtcatgattgatcattaatgtttgcatgagtgagagtatggggactcatggcacaagtgctagaaatttgttctccctgtacctgcagcacgacacaatggcagaagggtgggggatagattttgaaacaacttgaagagcagaatccatgatacgtaggctttttttttccttttattatggaatattctagacatttattaaagagtttacaatgagcccctacgtacctattgcctcgcttcagcaattatcaactcatagccaatctttactttcccttccccactttattaagaagaaaatcccagcatcatagcattaatgagccattttacaagttgtttgtttatttcggctgtaataggtctttgttgctacgagtggactttttctagttatggcgcgcagggcttcctctccagtggcggtgtgcaggctgctcattgcagtgacttctcttgttgtagagcatgggctttagagtgcaagcttcagtagttgtggcacgtgggctcatgagccatttttggaccagtttctgaccttgcctaggatgcctccgttgttatacaatacttttaaattgttcagtgtttttcagtgtgcagtattaaggcacaaacagaccgagctctttattaaagggtctaaaaatggttgattaaaacaaaaccttcagttaactacaggcagtctaataagc

SEQ ID NO: 29037 - DNA, 1087 bp, Bovine  19866880580250
gaggggaatactgtgtccctaggaatagccgctacacgcatggagaaaattgcaaaatggaaacagattcaaaggatttcagaattggaaaggggtttagagaatatttcaccttaagacccctaaaatttcccattccattttagtgatgaggacatcacggtccttgttagccaagtgacccatccaagggcctacagcaaggttctggcaggaatttggagacaactttgactttggaaagagctttcagtcactggcaagcccatgccatcctgtccttgtggttgattccacccacataaaacctatttctttttcattagatattggcttctgtatggtccatagagctaatgtagggaatcattgacttctaaaactaggcaaatgcttttctgggccaagggactggtaactctgaactttctctcccaaggtggagggtgagaagtagtggtttttaaagtggcactaagaggggctacaactcaggaagccgcagaaaacccagccacgtgttacatttagcacatccgccttgggctgtcaatctgaggtactgggttttagtgcaaaaaagaaactgacagatgagaaaagttaagtagggtaagagaggctgagaggaaagggcgatggaagaaaacaatccatatgatccgtcgttcctagtcaaccatgtctctgcagcacgcttcctcactgtgtaacctcgagggtactggagtgctcaagcctcctctttcttctacatcacaccatctaccctagatggtggtgataagtgggagtgttttgtatgtaagtgtgcatcagagtggagttgcccttcatcagggattctgggcccaaagtcatcgtgcatgcatgcttagtcactcagtcatgtccagctctttgtgacccgccaggctcctctatccgtgggatcttctaggcaggaatactggagtgggttgctattcccatcttcatgggatcttcccgacccagggactgaacccgcatctcctgcattggcaagcagattctttaccactgagctatctgggatgcgccccttccaaattcaatacataaatta

SEQ ID NO: 29038 - DNA, 1326 bp, Bovine  19866880609793
gggaaaggaaaagaaacatccttacggcctttattcatttcgtcaatcggacacacaaggcagcatctttctctataatctgatctctccgatgacctgaattttctctttgttgttcattctgtccaatacaattgttgctgtcatcagcgtccattggttcagtttttactctcatccctgcttctgaatgaggcaaatcatcaggcagagaagccaagcaattctgaatcatctcaatgactcgttccagatgcttttgaaacctctcggctgtctcaagacgttgacgtttctgcacctccatcatgactctcaaggtctctcttgcttggtggggtcggtattcatttatgagatgatgtacatgcacaaaaagcagcttaagatcttctagcttctcttctcgttttatactcccagggctccgtatcaagatatctaagaggtctaagaaattaataaggatagacatattgagttttctcagttctttcttgtgatcaaactgcataggatgaagtcgttcaataccctgactttctaaagggcggatgataagatcatcacactggaactggttgccaaacatcatgtaactgtcctttattggaggtggaggcttgggagcgaggccttcctgaatattttcatctgtatactccttgatgtactgcatcggagggggtgggagggcactcacttgctgtggctcacccattgtggaagatcaagaacctacagaaataaaccatcaaacaaaaaataagaggaaaacaaaacgtaacacacacacacacacacacacacacacaaatagaccaaagattgagagtggagctacaaaacaaacctatcacattcagtgattaatgacagaatcatttcccttttctcccatggccatttggtgcccaagacaaaatgatctccctcgtctctaaaactaacatttacaacagggtaaacctgctatctttttctaattagcattatatactcaatcattcaggtatttttccagctctacttaacatttccatcggcacaaaaaactactgtagtatacagctgaccttcaaagctatggtttttccagtggtcatgtatggatgtgagagttggactataaagaaagctgagcgccaaagaattgatgcttttgaactgtggtgttggagcagacttttgagagtcccttggactgcaaggagatccaaccagtccatccaaggaaattagtcctgaatattcattggaaggactgatgctgaagctgaaattccaatactttggccacctgatgtgaagaactgactcatttga

SEQ ID NO: 29039 - DNA, 1478 bp, Bovine  19866880628395
cctacttataaacattctgctgacacctaaactttatttcaagccattctttatgatttgtatctttgtatgacttttaaactacgactggctctcacaagacgctaagtccggcgaagtctggactccactcactgttgtgtcttagggagggcctagccccgggcccggcacatcgcagcgtgtagccaggaggaatccagctgggttgggaagaccagatggccgtgacatatgccctggtgagagcacagcagcagacctgcaagtgtccatggacacaggtgcaaaatcaggtctgtccaggtgtgcaggggattcaagggaggcagggaagatgcgtgagagatcagtttcgtagggccgctgagcaaagtactgtaaacttggaggtttaagacaattagaaatgtgttctttcacgtctctgaaggctagaagttcaaaaccaaggccatgctctcactgtagtctctagggagggatccttcgtaggctcttgcagcttctagtggctcctggccgtccttggcacccactggcttctagtttcatgactctaacctctgccttcaaatggccttcttcttggtgtgtgtgtatcagtgtccttttctctttttgtaaggcttctagttaagtattgcctcatcttgatttaattacatctgcaaagactctgttccaagtaacgtcacattctgaggttttgagtagatgtggatattttttgtctgtaccacatggcccgtgggatcttagttccctgataaggatcaaatctgtaccccctgcactggaaatgcagagtgggtagacgtgaagtttggtgggaacacagttcagctctcacagggggtggtcacagaggtgactctagtggtgaggcaagcttttcggaagccagtgtttcctgtgaccagcatcatgttatagaaagagatctgaaatcctggcttcttcaaccagcagagagactttcagcaaatccctttgcttctctgagccttggcttcttcatcgattcagtggggatgatggcatctgccctgtccctcctcccaggaatatcatgaggatcaaataaaacagtggctgggaaagctctttacagatctaaggttatgtacacctaaggtaggtgtacagtcatccctgactgtctcaggatgccagcatggctgacttgtcagtgtcctgtggtctgactgccgctctctccttgctaggatcactgcttttaccacgggacagtgaggaaggcggagcagtccagtgtcatgctcagcacctgccggggaatgaggtaagaggccctgacagtgcgaggggcacctggctctctccccaggaatggagtgtttaggacaagtggggctggctttgagcagggactttgagaagctgtccatagagaatgtgtgcaagccagctctgagaaaggctgagctcgggagggataagggaaatatatcctt

SEQ ID NO: 29040 - DNA, 1475 bp, Bovine  19866880706540
ttcttcattcattggtgatgccatctctaacatgtgctatgtaaaatattagacagataaagtttgtgaacgtatgtgtgttctatgttgtttactctgggtacgctggggactcttgttgttcttgtacattattttattataacagctttgcatcaggacttaatattaagaagggcgactctaaactcttcccacttcctttggttctctttttaaaaaatttaaagctatttagattttataattttatgaaaattctatattcaattcttgagtgctttaaaagatcctgttaggacagatggtaggcaaaatctgtaaaggtggtcagaaggtcaaaactttcagttataagataaatcagttctgaggatataatatacaacatggtgacaaaagttaataatctcatatcgtatatgtgacagtttctataagggagtaaatctttaaaagttctcatcacaaggataaactgtaactgtaagatgatgacggttagctagacttattgtggtgatcattttacaatgtatataaatatctaggtataatattataagttaattatctctcaataatactggaggaaaaaagatcctgttatgtttctattaaattagcttttgtgatctgattcattaaggaagctgatatatttacaaatgctaagtctgatggattaagaaagaaatgatatctttacaaatgttgtcattcagtctatgaacttagtacatcaggttttcctctgttctataacatactttaaattttttcttcataaagcttttgtgtctccttgcttaggttacttactacatattttatgtttcctatagctaacatgatttctatctcatattttctcgacaattattgctgagagagtgattgctgttggcatcttaactaccttatattttgtattcaattaaaatggattacatttatttaaaaattttatgaaaatttatgatgggtttgaacatcatctcttgagaatgaaaatgcttttctattagaaaaacccaagtcagtcattgtgagtcagagttactagggcaacaactcctttcaagaagagatatataatataagaactgaaaaactaaaacttaagagtgaaaaagaaaacaaagatcataatggaaactaaataatatattctccacctacttcctcatctataaaatgaggagactgtactaaatgttacctaaacttccttctacctcaagtctctgaagatattccttttagaaaatgaaaaagtcggagtgaaaaaaattctaagtgtaaattaatctcttccattgactttccagttctattgagtttttagcaaagaggctttgagaggaattattctttgtgggaactcaagaagagtaagtttagtgcgtatgacctcacagagacaattgagaatggatgctttgggagaggaactggattatttttatcactgt

SEQ ID NO: 29041 - DNA, 3223 bp, Bovine  19866880708099
tctgtccatgggaattcccagcaagaatactggtgtgggctgccatttcctcctccaagggatcttttccagaccagaagatcaaaaccctttgctcctgcattgcaggtggaatctttactgctgggccaccaggtgaagcctaagatcctgcatgacgggcagcaactaaacccacgcaccacaactgagagagcccaaacactgctaccaaggacccaacgcagctaaaaataaatgaattaaaaaaaatttttttcccttaaatttctgtactaacacccagattcaactttgagggagaaaaatagccaatatgaaaatagcagcaaaataagaaaatcttcacatcctaaactcacactgacaaagcagatcacaaaactttacctacccatatgaaaaagcaactaacacctgactgggaaatcatttcttttacttatatttttgttaggaagtgggtaatacagtgatttgtatcaattttaatcagatgcaataagcttaaaatatggtttatttcacctttttagccagcaaagcgttataaatccatgaaacaacaaattcgtatgttgtttttcctgctcattccctggatctcaatcagggaatcagttccttaagaggaggcattgtctccactgagcttctctcctggcttcctaggggtggggttgggacagggaagctgcctgggagataaagtgttgatctgaacttacctcggatttcagggtggtggtttgagcatcgccacttggagtataacacgtttctgtgtaggctggagcaaaaaggtgcctgaatagaataaaaaaagacatttgtctccttagaagatagactttaccctcctgtgaacagtagccagagattctaactgaacctggtagaaccacccccaagcatctccatgcagaaggaatagggcagcgttatggaagggcttaaggaataaaaagataaacagaatgaagtttgttatgaattttgtgttcactgggatcatcagttaattcagccacaaccagatgctgctgaccaccaaagcagtgatattagatcttaatttgttctgggtcctgggaagatcacgtgcaaacacactcacagaatttcccagggtctatggaccctactgtataccttaattgattattttcccagcacatccactaacttttggtatcagcacaccaaccattctttaagggaatccctcctccctgttgcaggttttgttaagactgacaatcaaggaatcttacctagccttggcccattgtgcaagccaagccaatggagtaatgctgcaagaacgtaacagatgggagctatttatctgctccttgttcctgctacaaggattctggaagtttcctttgcccatcttttatgagacctaatggttcagatttcctgtgacctggtactatgtgttgccttttcaatatttctttttttttcctttctaaaactggatgttggtttctctcctgttacagacctctagaagccgaggttaagaatccctcgcccaaggcaaggtgacccccgaatgaggctttagaatttctctgaaagttaaaagagaactaaaaatgccaaatgaattcttcaactagttcagccacattaaaagcagaatgaatctaaagaaaatcgaggtcaggaagcaaaatggtttttaatggaaggcatcattaaaaattggagtctaacaaaaaagaattaagtggatctatatcttttactatggaaagatgtttaaaatggagtcagataaagaaaaatttcaggaaagtatgtacttttaaaatccctttaaatgaaaaactaatagcagtataccctagggcatgcattgacaatagctggaggaggacatgcctatcggtagtggtagtgatctcaggggattacagaagatgttcacaatgtaagctgtatatttctgaaaaactggttgatttaaaaaaataattatcatgtgtttattttgaaaatggaaaatctaatttgaaactgccttttaaaaaagaaaaaaatacaagctgatgccagcacagaaagccaaaggaatcctcagggaccaccctggttttgtaagaggtgacatttcccacaagacagggtcactgaagagggtttctagggtcactccagagtcacttccagctctaagttctgggactccagactctcagattcccctccgcccccagagcatagtcagaaggcaaatgccacaaagatcttctcctgcacaatatcaggcccttcaacatccagccttgaacaagaagaaaagaaacccaacagggagatgtaaaaacaaagcaaagcagaaaacctagtttgtgtagagaaactccaatttacatggcaagtttgggtcagtagctaaatcgccagattctttcttcctctttctccttaacatctaaccagccaaggatctaagggaagagtcactcatttgtctgaaggagataaactctaagccccaggaggacacaggccaagctgtttgctcaccggtatataccgatgcttaacatttactcaaaggaaggatgtgttaactaattactgaatgaatgaatgagtgattgaaggaggtagtcactgagcatgctaagagcttagggcatggtgtggaatctgagagactaagcttcagcccctgctcttacatttactatctctatagccaggagggagttactttacctctctgaacctctgtttcctcttctgcaaaaacccttctgctcaacagacttgtcatcagagtaaaatgacataatgcatgaaaagaacttaaaatcaggcctggctcagagtggagctcaggaaacgttagtgattatcacaattgctttcaacagggattgtgatgggaagaactgagaaaaactggcggaatttacctatttccttccaactccccccagccattaactccccagtgtatcacttgaaagaggcgagaaaacaatgagctcattcctgcagctcatttctgtggtctacttcacagactgcataatggacggccagtcaggagttcagaatctaatggttcattccgggtgccagacgtgaatgttcccacagtaagtgcactcctggaaacacatcctcagcctcttctacatcttcggagttgaggggtgggggggggaaatgttcatctagtaacaccaggatgatc

SEQ ID NO: 29042 - DNA, 2301 bp, Bovine  19866880712562
tgaactgaaaagagcccttggtgtggttggttgtttagcttctactgctttctgagcctggatctttgagtattggaggggatgttgatgacagggggagggaatgaaagaatacagggcagctgtggatgggctgaatccaggcgatcagcccctgccccactgcagccccagtgagtcccacaatcttcctccagctcaggactgggctccttgccagaagtgtttcagaaatgccccaaccaggggctctttgatatccccctttcatgttggtctgaaactccagaaggcagaaatccctgggctttattctaactaatgagggtggagcctagggaccgtatatttttagctctgatagcatctcacaacatactttcccagggaaaccctctgctttccccattctgccggaagctctgggcgagccagacagcacatctgggaatatggagaaaaggctgagaggggagtgcagactgagaaaatcagagtaaatcaaaccagatgggggaggtggagactggctctcctcctcacccagagggaagtgtgtctttgtccttttcccacctctggcttattcactgtaggggaactgaaggcagaatctgacctggagggtcaggggcaaaaataccacataccagatgtctttaaataagtaagaattcttaaactgttataaaatatgctctgtcatcctgaagataaaacaaacttttataacacaaaataaggtatatataaagtcatgggttttatatgactgcaagttggtaaaaataccaaagatgactgaatttaattatcactgcatatttctgggcattttgttgttggacagtgatgtttgcttggtgaaaataaagacatgatattcttaaattaatatgcatttattctataagatttatttttcttgccttcattttaacattgttatgtttttatagtcaagattcccacactcatgcacctataatcaattaatctaaacaaaggaggtaagaatacacaatgtcacttcaataagtggtgctggaaaaactggacatgagattagaacatttcctcacaccacatacaatgggttaaagagctaaatataatacctgaaaccataaaactcctagaagagaacataggcagaacactgtgacataaatcgaagcaatatttttttttgatccatctccaaaagcaaaggaaatgaaggcaaaataaacaaatggggcctaattgaacttaaatgcttttgtacagcaaaggaaaccattgacataatgaaaagacaacctatggaatggaagaaaatatttacaaacagtatgaccagtaggggttaatatctaaaatacataaatagctcaaactactcaatataaacaactcaatcaaaaaatgaacagaagacttgaatagacatttctccaaagaagacacatagatgacttaacaggtacatgacaagatgctcaatatcaataattattaaagaaatgaaaacccaaaccacagagatatcaccttacacctgtcagaatggctatcgttaaaaagtctaaaaataacaagtgttggtgggaatgtggagaaaagagaaccctgtacactgtaggtggaaatgtaaattggtgcagacgcgagacaaaacagtatgcaggttcctcaaaaacaatgaaaatagaactaccagcagttccacgtctgagtttaaaagatacatgcacccccaatgttcatagcagcactatttaaaaagccaagatatgccagcaacccaaagtgtccatcaacagatggataaaacaggcacggtgtgcacacacatgcacacaacacacacacgcatacacataatggaatgttactcagccataaaaaggacgaaaccctgccatttgcagcaacatggatgtaccaaaagaacattatgcttagtgaagtcagacagaaaaagacaaatactgtatgatatcatttacatgtagaatctaaaactgaaaacaaagaactgtgtgtgttcagtcgtgactgactctttgtgaccccatggactgtagcccgccaggcttctctgtccatgggcttctccaggcaagaatactggagtgggttgccatttcttcctccacagaatcttccccacccagggattgaacccacttctctttcatctcctgcattggcaggtggattctttaccactttagccacgtgggaagttcaaacaactgtatatagccaaacaaaaaacagactcacaggtacagaaaaagaaaaaaaaaaaacaaa

SEQ ID NO: 29043 - DNA, 851 bp, Bovine  19866880715840
atgctcctttttcccatctcctctcaatttcctcatctgtaaaatgtagtgttggaagagatgcttataaattcccataaaaatcagtgattcatcttacccttccatatccctgagagtcatatcttagcatatccaattttcagatgaggaaactcaacattaacaaggctgaaagggtttttcaggtcacacagctggttaaagccaagactaaaaccctggcttcagaccccaaactctgcaacttgttctagtggaacacaccattcccctagtgacctgacctagatcagggctggaacccacgggcctggcaatgagcaggatcaggttcccagaactcccactacccccagccaagttttgcgggagagtgtggtctacaacacttgggtcagctgaagctaagtggtttattccattcccatttctctttgagtcttcagctcccaaataagaatactgactggtagcccccgggactgggtgggggctttgcaagagcccaggaggaggggatgtactgaacaagaaaacagagtcacccctactttagctgggatgcactctggtcaacgagacctttgggaaggagggggctgtctgggagggagggggaagttctctcactgccctctgtcaaaggccctcacaacatctctgcccaatccagagagcacaaagaacaagcacatgaacacaagagccatgaagtcatcgcattccttctcagtttctcggcctgagggggccaccctgagggggctttcgtagcaggaagcatgagctcatggcaaactcatgcactgagacccattcttccgctctgggtacagaagtacaagagc

SEQ ID NO: 29044 - DNA, 1823 bp, Bovine  19866880736945
tgcagttttattcgaattctaccaatgttaaatgttggctcaaattttcaaatatgctctgcagcctaaacaaaacacagactgcaggctgccagctctcaactctggcatcagatcccttcgggaatctatttgctcagctgcagaggaggagggtgactaactgatgaaatcgctacaatcctcccagctgggcatcaaggtggagggaagggctgaggggaacacattcctttctttgtttctcagaagaggcagaagcttctcagccaaggcagtgggggcctcctgacgccccaggagacagcatccctggctctcctcttcatgggcttcagggactggggctactctcttggcggctgtggccctcacctgataaactcaggctttcactgcttgttttgattttgttcccagctaaaagaacattcagtgcctttcaaggactgggaagaggccgtggacaccccgcccacactaaaaccagttttgccatagggtatgctcattcatttctggaaaactacaagatagagataaacaatgaagagaaaagcaaaaatcccacctcttggacataatcactgctaacatttggcaaaaaaacaccccatgtcttaaagtagatctcctagaagaacttgtgctgtatcacagtctctcaaagtccgtgacccaggacagagctgcggcagctgggtcaagtcctcttaggaaatgctgctgagaatcgaccctgagagtgcctcatttgcagctcaaaatttcttttcttttttttttttttaatattcattttatttatttggctgcactgggtcttagttgtggcagctcaaaatttctatattcctctctttcttcataagctattttcatcaagtggaagggactatgcaaagctctttccaggcagtatctcatttcatccttgaacacggctatgaggtgggttctaatgtttcctccatgtactacaggtttttatacaagataagtgactcacccaagatcacccagctagtaagtggcgaggccagaactgggaccccaaggtctttctgatgctagaatcctagttcttaatcctttttttaaaaactgctttgtccattaaaaaataccttttattttgaaataactttagacttacagaaaagctgttactgtagacctcctgcacattcctgatctagtttgtccaatgttaacctcttacataatcatagtataattgcctaaagttggaaactatcattgatacaattctatgaactaaatgacagactttattcaaatttcaccagtttttccgtgaaagtcttatcccacatttctctgagtggtcatgtctccttgtcttttcaaatctctaatagttttcagttttccctttgtcttttatgttctgggtgcttttgaaaagcattgttcatttttgaaagccattcgatttagatatataatcacaattagattgagattatgtatttttcattatgcatacatattcagggactgtgtgctgtgctatgcttagtcactcagttgtgtccgactctttatgaccccatggactgtggcccgccaggctcttctgtccgtggggattctcctggcaagaatagtggagtgggttccatgccaatccagggattgaacccaggtctcttgcattgcaggcagattctttaccgtctgagccaccagggaagccaattcaggggatacatgaatatattttcttactggtgatactaaccttcatgctggttaagaggatactcccaggtttcccactgtaaagttattattcttcc

SEQ ID NO: 29045 - DNA, 1329 bp, Bovine  19866880764329
atttttcttctctcctttctcctactttccaagtatttagcagagaacagtattagagtaatttagagggtatatgttttccctgaactattatgtaaagtttaccaacccagctaaaagaaatcaaagaaacagagagcaacttatttttgtctttacttaaacccactccctcatttatgcaagggaaattatcattagctgaatgcatttcaaagttttcatgggaagatgttttgatatcaaaaaacctctgtgcccaaggaaggcagcacttccaactttatagaaaagggaactgaggcacaaaaaaattttggtgatttactcagacttttctactctttaacttgtgacatactaagcctgggccatgtatttctaatattcatttgtctttggttagttttctgtgttcttctttttaaatattttgctttatacaagaatataatttttatacaaaaattttaaatgtggatttttgaagaaaaaaggaacccaaagtcgcctgttgtctctgctcagaagaggttattgttaacatctctcatattacttcaagcttgagtttatgtaggtttcttcttacaaaatgggttaagattgtgcatgatcatttgtatctagattgtcacactcaaccacgagtcatcttcctcacttctattgtggagaacagtaaggacacacttgtaaaaatccttttaaatggttgatgaatctttatacagatgattcagtctgacccttcatatttatggcacatgccactcaggttattttaagttttatgttattatttgtaatagtcttatatttacttttaataatttatttgtgtctccacttatttctaaaccatatttttacattttgagatggtcacatgatttaacttttcctgttcttcagaagtgtaactttggtttctttccaagttatcttggagatttggaaagggaactggacctgatatagaaaggaggaaaggagaaatggagctcatccaggtgaaaaaaacatctgttcttcaagacacttcagtgatgggctttttactttgtcacactacttttttatttgaatatgggaggcggcggggagtcttacctcaccaaagaggaactttgagtaagaatttgatagcaaagtgtctgaaagaatgagcactttctttagcaatgcaactccagaagtttcacttcctcttcctcttctcttcccaagctagaaaactcttaaaatacatggaccctgttgaaaagatcttcagtaatagagtaggggtacagctaatgacagaaaagaagccagttggtaaccagc

SEQ ID NO: 29046 - DNA, 1470 bp, Bovine  19866880769048
acctgaaggtagcttacccgttaaaaaaaattctgaagtactagcctcataaacatacctgttatttttcccctgttattttctccctgttagtatcaacccaaggaaccaaatctgatgtgaaagttgagatagattggaagaagagaaatgacatttttattcttcattgaagggctttgatttataataatccatgcattgtaaggattcagcaaactttttaaaaaaacttctatatatcaaatgctagtagatatttctcttctcacaagataaaattccagtttctaaatagagccaccttttgttataataattttagcataggttgctaaagaaatccgcttgtgataatagaaataaagattgttgttgttcataattgttgtttagtcactaagtcgtgtccaactctttgtaaccccatagactgcagcatgccaggcttccctgtccttcactatctcccagagtttgctcaaactcatgtgaattgatttggtgatgccatccagctatctcatttccaggatatgtagggtaacttgtatattgtaaaagagacttgtctcccttccctggagatttacactgccttgcgcttgtcaagaatcacatgatttgcactgaacaatgaagagtgagaaaaatgacaaatgctacttctgagcagaaactttcagagccattgcttgattctgccattttctctcttccctcttgccacaagatcaacagattgtcttttttagccattgaaattctggatccttgttactgcggcatagttcagcctgaacccacggatacaaacccaaggctttattaaagggatatcgcagcacctgaagtgtgattatcctctcagtttaaagatagtcttgtgagcccctcccacctgaaggtcagagaaattcagccagtgctaattaggaaaaactcaatatttggagtgttggcaatgagctgtgtgtgactagcttgcatcgattctgtgtagacactgcatacctctcaaagaagatgagttcctttgtcatgactccatgatcacaggtattgactagtgccttattactttactttaaagaactttaatatttgattttgtgtcttggccagtcctttaataatgatgtgacttagatcttgcccttcaccactgttttgtagggccttgtttctattcacagtgattttaaatgtgtttactaaaatatcccaatcaacctggagcaatcatattcaattttgtcagtgattctaaagtaaaagtcagttgaagggtatatttaaacccttattttcccccatttctatgaaagatactacagtatagtgtatcatttgtcttctgggtgtataatctcaaattatccatggcatccggtcccaccacttcatgggaaatagatggggaaacagtggaaacagtgtcagactttatttttctgggctccaaaatca

SEQ ID NO: 29047 - DNA, 1914 bp, Bovine  19866880788194
ttagtgtttccttatcattttagccatgcttcaacatgtttttcaccaatgcatcttgaatggtgacttctctgacttcattctctttgatttaggtttctttggtaagttttccccaaaaaggaaaccatgtactaaaattactgcaccccacttgtgagaaaaattttccctgtagcattttaccttttgaggattctgcagtgttgcttcagcatcatttgtagtcaggagcttaatttgacgggaggtgtaacctatgatgaaagtataatggggaatgcatatgggttctgtcatgtattggatatgtaaaataaaattagtcttagattttctagatgagaaaatgacctctctaccttaacatgtaattgtgagaatctattcatatgtcattactccattataaactttaaaaatgaatataagcattctagggtctcaagctgataggtaaatcacaatacaacataggattatgaaataaattagaacaaattaacaggggacttcagaatgataagggcagagaaaagatgacatggggatgggatcctgaaggatgatatctgtgatagggtggtgcgacttggaagggcaccaccttccaaggtggatagaatagtatgttcaaaaatgtggtactctggcaggccaggagagtgagatgctgaaatggaggattgactgtggtgtgtgatgccatgatatccttctgtcatacgttgtccccatttgggaagcagggttagggtattctgtggaaaaggataaaaattggaccagggatgggcaactggcttacaggtggctgatccataggctgaccaggaatgctaaggtatcctgattaaaaatgcagatcaagcagactggcttcttcactgatttagggataggagtggtaaactacagcagaaggagcctgtccaggtctttaggaaaatggtagaggatggctgttcccttaccttctccaggtcctggggactccccagttctaggcaggtgttaccttatattaagctctctttcaaaaagcagcctgtgtgaatctcttcctaaaaacaaaaatgacttaataacatgttaggccactgatcaaagagaagaagagaagttaaccttaaaatttatttctgtggcagagtcaacaggagtaactgttttatcaactgtgcaagtggaattccctaaagaagtggacaagggtgctttccttcttaccaatcattatttttattaatatattttacaagactgcagatgaaataatattaaatacaaaatttttatacagaaagtgtaataaagttaaaatagttccttgtaattcatagcattattgcaatgcttacaaaatttttgcatagagtgtgcaaggattgatgttattcaaaacaaaactaaaaagctcttcttacatcacacccaaatcgagagaaaaacaaaaaaaaacaagttaaaaaaaaataatccaaaggctgaactcaattgcttaaggaaatggggttcctttttcaaaatctccaagcaaataggacttttatgaccttatctttactgtgaaagcaccagaatctggcttctccaggagtgggtttagccagcatagtgatggatggttccctgcttttcctttctcaaacctgatctcctaaagaagtgttcctctgctttaatgtggcctcaaaaagagagaaacttgactgggtaggcggttaacagatggcaaactctattactgcctcacaaaacactacctataaattaggttagttttgtgtccatcccaaattcaggtttgcagactcttccttctactttgccaagatctcctgtgtctgctagggaacttgactgctggctctggtgatgttagttccatgagaccctttaaagatacctttt

SEQ ID NO: 29048 - DNA, 1310 bp, Bovine  19866880790206
cgaatacgcagagctcaagactgacgtgttccagagcctgagggaggtgggcaatgccatcctgttctgcttgcttatcgagcaagctctggtgagttctgagccccaaggaattggcgtgtctccaggctggaagggtacccccaccccaacagatgcccaaggcccctcgagcacatcccacctgggagccctgccgctcagctgtgtgctcttccagggcgggcacgcgctcctctccattccactcagacctctctgacacccagatactgggagaagcaggtcctggagtcagaggggcctggccttcccccccaactgcccaccttccgctagcagcagggccccggcagtctgtcagagtccgggtttccattcacccgtcagacacaagataactcctggcaaccacaggccaggcactgcgctgggaggtgcagtgcagtgtcctgggtggtggagaggagacctgtcctgaaaagtgtctacacggaaacgatgtgtttaccgtcggagcaagtgctgtgagggacgattgccaggtctggagggaacacctgtggtgtggtcttgagggtgggggaggacctccctgagaagggggcctgaaaactgatcaggaactgtcctcatggagaatcagggacagctgttccgggctgaggggagagcacatagtgctttcttcatttgttgtcatggtagacagggattctcaccctgcaaggcagtttagaggctgaaaggaggtaagacatgaaagtgaaagttgctcagtcatgtccgactctttgcgaccccatggactatacagtccatgaaattctccagaccagaacactggagtgggtagcctttcccttctccaggggatcttcccaacccagggatcaaacccaggtctcctgcattgcaggcggattctttaccggctgagccacaagggaagccccaagacatgtaaagtaagagctaaataattggtttgaattatgctaatgggcaaaaacatgagtccctgtgcttctgcatcttgggaccacacagaacttgtttgtggcttgctcatggagtcagcattctccacaccctcccagtgctctccactcggctctggttccataaggcgtccgcaggtgggcctggccgtctaggcacagggtaatgggcagcactgtggaaggaaaggcatggtcttcaggacgcagcaggaacatctttcagcatccattcctgccgtcctctgtccacacacacattcagcagaagggtattgagaacctgctcactgccgggtgcatccctaa

SEQ ID NO: 29049 - DNA, 1413 bp, Bovine  19866880790556
atctgccctgagtgaggcatcttattggtttattttctctcttttccttcctgggccgggaaaaaataccaaattgtctcattttatatgttcttataagctcaggctcacagattccctttgatgataaggtgctctgtaagcacattcatttcccaaaggcttctgtccttctgaacagcttccccatgctcagtaagagattctgcaaggaattttgattcattctgggaaatggaagtaggcttggttggatggcatcgctgactcaatagacatgagtttgagcaaactctgggagatgatgaagaacagggaagcccagcgtgctgcagtccatggggtcgcaaatagtcggacatgactgagcaactgaacaacaatgtccctgtgagatatgacccatatctcaaaatctaagttaaggaacatcaaagaacagaagccaaaggtcaaatgtctccagaatctttcagcttctaggacaataaaagtcctcattcattagaacagggttcctctttgggtgtattttagtattaaaagaggcttcccaggtggtgctagtggttaagaatctgcctgcccatgagggagatgcaagagacgtgggtttgatccctgggttggttggtattaaaagctcattgacaagtattatttacactccttacctccttgaccccaaggcgtttctggattctgttaaaataaccctttaatattttctttcttgtgagggtttttcttgatgagagattctgtgccaagaagtggcccctaatttggttgctggctaatgctgtgggcagtgcatgtctggccagtagtacagtgctcactctctgggggacttggtgctaagtatttgttcaataaataaaggaccctctcaccatcaagccgatgcagtgttctaacagctttctgttttggactatggaattcctggctgtgttcataaatactgcttctacacagcaggcctgaccatcttcctactccatttccactcacccattccagctgtgaatgcatttctgagttctccctaggagtgccctgagaggggagtcaggatgtggttttaagagtccatggaaggccaaaggcaacatctcaacaccatctaccatggtactgataccaggaagctcgtcgcccattcaccatggctctcagtgcttggtccaggagtacacttggtggttgaatccctggcatctggagcaggacaagatgacaccatgggaagtggggggagggagccaaaggaggcgaagatgctaggaagtggaagcatgcctgtcaagccaggctgacatcttggggcatggccacactcttttctccatctctaagacttcagtcctggggttgcatgtgggcactgggcaggaggtcacaatcggg

SEQ ID NO: 29050 - DNA, 822 bp, Bovine  19866880807813
tatgcctgaatatggacatcattaaaatgaaacagcttccttaatttgctaggcagatgatacaaaggttgaatcaataattcatcttggcaaagaaactcattactcagccaaggctatgatgaaaatcctgttaggaagtcttactttggctaaacaagacaagtaaattaagagcaaagtgaataacccaactctctataaatcattcatttcaggattaaacattatggatttctccattaaatatgcatcccaggcctaggtatgtattaacttctatattagccagccttgagagatagctaatacagtcttctgggagtctctatgaaactaccagcctactgagtagaacaaaagcaaataatggaaagttttggagaagccagggactgaaaaccaaaagtcgtcaaagccaacctttcacacaacctgggcgccctttccaacttactccgaaggctggtcatcctcttcagcataaatgctgtgagtgggggctttactacccatttttgataaagctctttctatttcaagtggcagaaaactcaactcaagctagcttaagcaaaatggggatttattgcatcatggctcagaacatgaataatctaacttcatactttcagtcttggcataatcaaggctccatcaatgtcaccagggtttaatctttattcccatatttgctctgagctctcctcttcttctcaaggagactccccttgtggtgccccaacggcagctgcagccctctgttttgtccttcagagccagtaggtaaagatccacacctcgataattcaaagaaaccca

SEQ ID NO: 29051 - DNA, 1090 bp, Bovine  19866880855278
tcacttgagaaagaatctccaaatgcgaggaatatggagatggtagggtgcagaactagagagagtttctctggaaagagcaattatgatgtctgtagttttacatgcagtcaacttggaaacctcaggttgtgagaaacaggatttcctgcaaaatccaaaccatctaatcaccattcagaagcccatgttagactcctaatgcacaacatttgtgatcagtttttacctctggcagaagtaactgacaaattctacccaaaacctgtcaagagttttcccctctcaaagtcatcaacattttagtaaatcttaaaacagtaaaaatagagtatggaagaaaaatggacttctgagtaactcacctttgaaatttttgacatccaagcttttttcaaagtctgcatggggccactatgtaaaccaggatgtctcctatggataatgaaatgttaagaaacccagaggggtttaggagagggaaaaacggaaaaggaatcatctgttctaaccagtttgggagtggaaatgaataggtatttcatttttatctggataaatacagtaatataaactatcacctatcaccacatcctatgtacttgatgaaaacttcatcatctatatttccacatttcagcttcctaacagtcttgggagggagatactcttatccctacagaatatgagaaactgctaagcctcaaaaaggcttagttggggacttccttggcagtccagtgaagacttttgctgggcagcggtcgctggtttgacctctggtggaggagcctaagatcccacatgcttcagggtcaaaaaaaaaaacataaaacagaagcagtattataacaaattcaataaaaactttggaaaagtaggtaagcctttttttgttttaagtcaaacacccatcagatggaggtgcttggactcaaaatcgtgattctaaagctcaagctttaaacattatcctctattcctatccaagaaagattgaaacatttaagagggaggtctatggccttcatggacaaactaaaaggaacatattacataaaccaactacaaccctaatagaacaagtcag

SEQ ID NO: 29052 - DNA, 2387 bp, Bovine  19866880855642
aattatttccaaccacaggtcacaaaagatactgtcagtcaaccatgtaaacttttaattcaaggcctccctaatgttttttgttatttgtgctccttcaaacataaatgataaaacatgataaaaacaaaataaaactatgttggatttgggtttaggagtttcttttgagcaggaataaattgtgtataaacaaagacatatggatcaagagactggtaagaacatcaaaatactttacacttgtgtagatacttttcaaaacactatcacattcactgtcacatttaatactacaaggtgagagcagtgtctcctccactttctaggcctctgattctgtacttgtaaaatgaaggacctaaactagtttacacataaaatccccctagactgtgcattctgtgaaaagatgtctcctaacttcttgctctttactccattaagtgtttgaatttttttcaatctagtgatttctgtttaatgggaaatgtgtaatctatttcacagaattgtttggaggagtgaagaaatgaagaatggtaataccaaatacctgatatcttgtatcttatacccacggttagtcagtcatggtattatgctttctttggagaactgaacatccagcctcagaatccttcttaagccagcactcaaggtagtcaattccaactgataggagtcaacttgttctcagatatgctgtcttttatgtctttcttttggatttccttttaattatgtctgtttttgccacaccatatgtttacaattatattactaggtcaaatactattttgctttcatataaaataacagttttaatatcccaaccaaaactggattatctactaaatgatgataattctcttgtgtgtggatatagaatttacaaatctctttcactttctttatctcagtgattttctcaacactctgagatggaaagctgatattatcatctgcattttacaggtaaggaaatagattcagaaaagttaagtgacttttccaaaggccctgtataacaaaagcagctgatattcaagtccgagtcttctgtctctgcatcttgtgtactttccgctgtaccacactattacaaagcacactagggaaattcccagacaccctgattggcctctggggtgtcttctgcgatgccctttgaagtacagagctgagcctttctgcgggccattgaacaaagtgtaaactgtcatttggggaagtgaaacctaggagaagaaatttcctggcacataaggtgtactaaagaaatgtcagttggttgaagggatgaatttcttagtaagttcctctggtgtttgtggagccaggcaatcttgaacctgtttctgaaatgagcctccccataataggcaaagaaaaggtgatgtgactggtcttgtttgtttccccaagttaactagacagggaggttccaggtgagggggcttttgggtctgttctcagcaagcaagtgacactgcctctgagaccacagtttttgatctaaccctcctttacttcccttgcaatggaattgataagggtacttaaagagaaggtgccttgagaatgtaagttatgacatatgtaaaaagtaaagtctttaccctaaaaatgtttgtacttctttttctactcatcaggttggcccctctttttaaagtttaatgatacccaatgttgggcttcgctggtggtttagatggaaaagaatccgcctgcaatgcaagagacccaggtttgatccctggatccagaagatcccctggagaaggcaatggctaccccatccagtattcttgcctcgagaattctatggacagagaagcctggtgggctacagtccatggggtcacaaagagttggacacgattgagcaactaacactttcacttcggtgttggcactccaataccctgttggtggggaatgtaaaatttggcaagctttttgagggatttatcttctaaaattaagatgtcacatagtctgactcaccagttccatagttagaaatgtgagttatgtattttttcccaaagaaaaaatatgttttcaaaagtatatgtatttcagaagatttctaagttacatgagcgtgcacaatgcaagatcttcattgcagccttgtgtgaaacaacaaagaaagcaacctggaaactaaatgtcccactataaaatattatttaaatatttataatacaatcatacattctagaactatatgtttacctaaaaaataaggtagatttgtatgcactgatatgaaaatatctttaagatatatcattaaaagttaaaagcaaggtgaagatcaaaatgaatcaccttaatgcaaatgaaaattaggatgcatttctatatgtataact

SEQ ID NO: 29053 - DNA, 1543 bp, Bovine  19866880859442
cctgcgtcccattcctgagactttgctgctaccatatccctaaattaccttgtcatcccaaagtcggacaccttgataacttggttttccccaactaaacaattccgggcagcctggagcagagacaggcaaacaaaaggaaagagaaaacttggtgagtaatcagtaattatggagtctcctataatcacagtgctttgcttatatgggagcaataaggagcttcacaaatgttaattaagcatcactagtgcatgatggaaactgaatgcgtaaggtctttttatcagggtgagtaaatctcatctttcatcttcattcctgggatcctaatcaaaaagaaatccatggtgttgtgtaaccaattataagctccagtgcaacccgatgttaaccttagggatggtatgaagaagctgtcatccatttgactaaagtgagaatgtattgaggttgctaattctcttaaaactattcctcaatagggagatgacatggtccctaattcacatcacagagtgttggatttgaagatcccttactgataaaagatccagtgagtcttaaattctaatgtgcctgcaaattccatggagtggacatgttaaaatgaatattcctgagcctcaaccaccagaaattctgaggttggttctaggatcactccaatgtgattctgatagatgcttggataacattttaagaaagcatgtacttgtcagcttctctcattttaccaagaggatgtggaggcatagagaggttaagaaggagccgctgttagcttcattttggaagaatgtaaactccaactcagagagtgaaagttagaggtggggctgggaatagagcccagaactgagtcccatgaggacctcccacagtgggtggaggaaagaagaagttgcaacgggaaggaagaaagcttgtgcctttttattgattcttgcgttcccagtgttggtagttctgcatttcattggcacatgccccttcaccctgaacttataaggttttgccctgcatcctcttaccaagtctctgtggatgacacacgcctcttccaggtaggccatgccctcacatacgtccagacacatgcccagcagggtctccgcagcaaagagccccctctggctacgcaggtaatctgacaggcagccgtgttccatgaattcaaacaccaggcagatgggggcctgttccaggcatactccatagagctggactagtttggggtgagagagtttcctggagaaaaatggcaagagttgagatggtctaaattcagtttcccaaaatacactccctccctcaaacaaaaatgtctcattgagctgaagaatggcacggactcagctggtgtgtgtgaggacaacaaaggtcagtgtgactggcatgcatggaaccagaggagagatgggtaggagatgaaattaaggagtgggcagggccagaccatggcaggccttctagaccacaatgaggagcttggtgttattctccatgccataggaagccattgcggactcgggcagggagg

SEQ ID NO: 29054 - DNA, 1135 bp, Bovine  19866880883442
ctatgcataagttaggaaaggagagtcagagagggtgcaactcacctgaagtcacacagcacatcagtagcagaggtgaaagaacaaaagcatgggtttccagtactgaccgtcggccttaggggaatgtgagtgggaggagacatagcaacagtcagggctcggggcttccctggtggtccagtggttaggacccttcacgcttccactttgaggacacagattcaactcctagtgggaactaagatcccatgagccacatgggaggctgtgagctctgctttctacttagacagctggagaaatccccaagataagacagtgctttctgagattagaatgaggcaggagcttttgggaactttttaatttatgaagccggaataaatatttaaatgacatattgattattcttattaagtaggaggactaataacaaaaaaaaaaagaaaggaggaggaagggaggaaggagattatgtccgtagaggaaaggcatttaaactggaatgtccgtccagtggaggactgtgtaacagtcaaaaagaataaagtatgacggtgtctttgcacatacaacatagaaaatggtgaaagacataacaatgaatagaaagaaagtgagttccatgataagacacattatgccatacaagcaaaataaacaaacaaagcccacaaaataaccctgcgttgggggaaaaaaatctgggaaaatcatcctatagttcagtcatttttctctaggtattacagagggagctaggattagagggcaacagagacgtttgctgtatctgaaatgttgaattttttataaggaatatatattcatgtattatcattgactaaaagttaattaaaaagatacaagtagtatatcattggagaaggaaatggcaacccactccagtgttctttcctggagaatcccagggacggcagagcctggtgagctgccgtctatggggtcgcacagagtcggacacgactgaagcgacttagcagcagcagcagcagcagtatatcatagtttcaggaaaattggaaggatacagaaaagtataagatgagaagccttttgcccactggtctcttgtattctaatagctttatagagttttgtcctgttgtgg

SEQ ID NO: 29055 - DNA, 1396 bp, Bovine  19866880899109
cgggccgcaccccccaccaggtggggccatgggtccttcattgaaggaatgcccacctcatgtggatatttcaaatggaaaaccatctttcaaaacataccccccagtctcattttatagattctgtggccaatatagaaagtgacataaaggtcacatattaatgatttcctcaccaaatatttctttgcacagaaaccactgtgccctccacaaagtgcacacttgatcaagctactcccttatttaaaacattccatggctttccatcactctaaggccagaaatcaaaatcctttaaatggactacaaagctttgtacggcctggcccctgctgtgttccccagcatctcatcacactcgctctgccagccatgacactgctttcaatattttgaggcaccttgtttcttcccactatcacacatctttcttctgtctgaaagactccacttgatcacgacaatcctgtgaatgattgtacttactttgctgtaggcaaaacactctagtatgtacatgtgttgctagacttgaagtttgggaagccagttagtcagtaaccaatcatccattgcctaattgcaccagcagcagccaaattgttaccatggagatgaatattgctgtcaaaaatattggcctttatctgatagggtttattgacttgatgccccaattgatagctccctccagaggaagatgcctgttgcattgaaatatgtatgtatctgaacatgcatctcttgatgaactgtcaaaatagaaaaggaaatgcagagaaagtgccaggcagggcatgttgtggtggcaagtcctcacctgcactttcttagatggtatttgtgtacattctgcatctgctcaattaatgtcctgcataatggacaaactaggttgacattagagaagccctttggagtgagagagtgagaatgcataaaacaggatacaaagaaccaaaggtaaagccagggtatacagaatcatgagactgaattttgactaggctgatttggcctctggcatggtgaaaatttggggctctgaggaaaggctttgcaaagagttcctctcctctggcacattgcccctcacatttccagaaggcctcccccaaatccctctcaggtcttagagaacatgcctcttggtttcttcctcccaagacccactgtttcaagagttaattccaaggacacattgatccccagaattgattgatcttatttatcggaaatcccaaggtgggattttccagccgcccaccagagcaactgagaagggcttcccctcatcctcccaagccaccactcctccctatcttgtttctcacctcctccacctctatcacatacatgtgctttgcagaaaaagtccctaagttttactgga

SEQ ID NO: 29056 - DNA, 2426 bp, Bovine  19866880940758
gaaatgtctttgtactgccgagtcctgtactgggagatgcctgctggcccatttctcctccactgagctgggtcttcccactatcatccttggagacatttggggctcagtctacacacaccctcaaaactaagctgagatgaccacaggctgattgctataaagctgaactgcttttagttcagccagataaagcatttctaaccatgagaactgccaggaaatacaacagaagcccctaaggggcaagcccctgccctcggtgatgtgcagcagctctgaccaaccactgtagacactgaggagaggttgcaggctcccctccacctgatgtggtcggcaaggccgtgcactgccccagggcccagcagtgagccatcctgggtgctgtaggtgaggaggatgcaggacaggggctaaccagaggggggcgctgctgtttagtgtctccaccagcaactggaagtgatcccaggctacgaggagctgctggccgacattgtcaacatctgcgtggattactacgagaacaagatgtatctgacccccagtgagaagcacatgctcctcaaggtacagctccctcggtcataccccctcacctccttcttatttaaaatcattttaaaaggttgtttctttcttcttgcttaagcatgagtgcagatcttactatacaaaaggttttgtaaccaattttttccatttgatatgctgtgtacacctttctagacagcattaaggctatgtctacaatgtgacttttaaaggctacctagtatttcattatatggggacattattatttaacaaatcccctatcacttggtatttgtttgttaaagtgcattgaaactctgtggcgttttatgtccatactcttgttaagtcagacatcctagaggaaaattgccaacctaaaggggaaggcaaaatcttatagcttttactatattttgtcaaaacggtcatgtttgtctcatcagtttacacatttcatttttaaattatcaagtgatgtttatcattgtggacattctgaacagaaaagcattaaaaaatcgaatctcttttaatctttccacccagagataacacttttagcattttgatgtctatctttctctttttttctgtgctgatgtattttcaacatatgcggtttacataaattatgtatgtgtattatttatcccatttcattaagtgcatttggaataacatgcagcccttaaataatgttgtatggatgagttcccatttctttagccattagtctatccttagctgcttaggttacttctaacttctctctgaaaacaatagtactgaaatgaataacgttctccatactctttatacacactgcatcacctctttaatttctttcttccctttcagagttcccctggtgatttgactttttcttcccctccatgttgcctcttatttccagaataccaaccctgttggtgttcccttctttacatttccatagcatctcgaagaaggttgcaggagagtgtggctttgtgactcattcactctggcttcctctgcacagtcagaaattcagagaagtcacccagagttcagcagcctttctcacaccagtgctatgtccaggcaattaccacagctctgcccagaattgttgcttccacaaactaggttactaaaccccacttcaccaatcatccttacatgctgctatcagattctcaggctcttcatttctcttgcctgcttttaatcctcccacatctcggcttcccaaccttctccctctcaattctcaacctggcctcttggagttttgcagtttctctacagtgtgttagtaaactcagatgccagcagggggcgcctttcaccttaaatggaaaagtctggcacaccccctgcagagccataagtacccatcctctagcccagtcccttaggtgtcagtcatgactaatcccccgtcacatagcaactgcgagccgaggatgctgctttcagcctagttgttcaggctccctcgggcttgctgtacatttgacaaaagaagcaaagtaagccagcgtgcaggaaactatttgggttggccagaatgttcatgctagtttttccgttacattgtatggaaaaacccaaatgaacttattggccaacccaatattatatggactggaatgtttagaatcagcctgtcaacctgcctatagggcactgtcagcaaaaacgtgttctttttgttaatgaaatcaccgatgagattccttgggaatctttgttgtagtttccttgggaaaaggggtgaagggtttcacattcctttaccatctagtgagtatgcatcaagtgcccgcagtgtttgccagggcctggggatgcaacagcagcaccactcagtctttctcgaggatctaagtgcatacatg

SEQ ID NO: 29057 - DNA, 909 bp, Bovine  19866881051232
tatctaaatggtaaaaagatgagtggatgtatatatgcatgtatatatagacatagtttcagggaaatttttatttgttatattttgctgtatggcttataataaaaagatatctacataattaaaaatttactgtgggttagacaatgtgaataaaccaacttgatgagttgaaccttcaggcatgtgcttaataaatcaagccattgaatgaaattagaaatatactatgcatttattcttagtctcatttagcagtcccagaactttcaaaaggtcaaatacagcaagaaagctaaaaatttacaattaacttactcttccttaacatggtgtacttgcccagcacactcagacaaggggctatttgcaaggctgactccggctgcaccaatacccttcccaccatgcccggtgggatcacggttttgagcaacctgatcacggtttgtcacgagcttgcctcttttgggcaaaagcaaacaactgtgaccagcttccccgagccattatgggctgtggggagttgaagatctcttctcacatacacgaagaaaaagtaattacccaggcaggctctaggggttttttaatggtgatatttaattcatgaggtcagagctgccaaaaccttggttggtgccacagcaagaatagccaggaaggtattttggggtcagaacagaccaacaagcctttccctgggaagagaaatggcgctggtatatgtttactagctaatctatttcttacactcagctccaccactgcaccggggactccatcagttcacgacctttcaccttctagattcaggcagcccccttccctctgcccgcagggcaaaccctctccgggggtccccagaattcctgagcccctcatcctggtcccggtgctctgggagga

SEQ ID NO: 29058 - DNA, 909 bp, Bovine  19866881063612
cctcagttaagctcctttcctccccatcagaacctgagcatggacttgccctcggccagagccggcatcagcccctcccccaaaggctgaccacaaagtctgtccctgaatgtggttctttccagccatgctcactccttcctataaaaggcctcttccttctgagctgtgagatgctttacagatcttgcagccactcagctcacccgagcagtctcctaaagcaactgcccgggtgcccctgactcaacattcccttcccctgtcttgcagtaatccctgtgagtaaagtccttccttccctaaatccatactgggtttcatcacctcaaagcagcacatggacacaggaggggaaaagcaggccacagtagccagtcttgtccccccgggcagcctccctggccttccagaatggtgcctcctgcctccctgaacagaaccaggagagaaacagtaaatagaacaggttgccaaaagtcttaccagattttaaaaattcgaccatcttccagttcacagtacaatttttatcacgtggaggtggtactaaaataatggaaaacaacacacaagaaagcaacaacccaggtctctttctggtttggttccagggagggtggatttcagattcaagaggctcacacctcacagccttccacctcctgatgtggcggaggaaagctggacggaaccacaggatcattggtgaggcatggggttgggcttaagggtgattttggtgggggaagtgttttagcctttcattttctgggacccagccgtgaggcctggggcatctagagtagcatgcttaaatggaaggctgtcccctgaccccaccaggaagtgaggatgatggacactgggtgtggggcgcaaccaggacccttgtcagcaagacagagg

SEQ ID NO: 29059 - DNA, 1255 bp, Bovine  19866881070868
ttttgtaataaagaaattgatttaagtatgatccacaacgctttcctgtccaccttcctccttcacagaaagaaatgaagactttggataagctcaggtcacagccagcatagtgtgcagcatcactctggacgtgtcaagagtggttccagcaggaattcggaccctggttttcagggtaggatcaactctgtatcagtgatttgtaatgaggaagatggcagaaagataacaaactatcaaggaacccccaaagggtctgggtgatgacaagtggttacttaattaaaaacaacataggaagagtgaatgtgtgatttttctcttacaagtgctttagaaatttttcttctagatctctgccatagacaccccacagggcccgtagaggctccctgatcatttcagactgaaaatttaaaatcttgccatgttttatctgcctatcacttttagtgttagaattcccaaggcagaaattccaagcagtttgactagtcattcatttatttgggaacatccccttatgcttatttccatttaaatttaattttcacataagtttttttgaactgaatacaaattaattttatctccagatttctactgagaaagtctttccagaggtaagtagagatgccctagatctgtaattttaaagattttcattattcttttctggaactcagcaggcaaggggaaaaggagaggggcagctgggacacttgtttgtagagttctcaagcttaaggggagctcagattttaaccagttttcagtggaaaagctgtgcagtagagaatgcatcagaaatgtgactttcaagattctagatcctctacatctttttttcagttgtattgcctgtaattataaaggtcactcatttacatagtagcaattttctttcgtaattcttagtcaagctccttctgcttatggtgtgactctttttccagagaaagtaatgatgttttaaaaaattgtttaagctatgcaagtgtggttgtggtggtagaatgtttaaatacccacattatttttaatgtaattgttttgtgggtgggtcacctttggaaagtattttgttgcaggtttatagtctatacttaacaacatgccttatgacaatctgacatgttgtcctttgtaatttctacatttcatgccttttaaacctacttcatgtaaaatgaaagtattttacactccaatgcagtgtttaaaattagtcttcatttggccagttctgaaa

SEQ ID NO: 29060 - DNA, 1120 bp, Bovine  19866881088102
cacacgactgcagtgttttaggacacgtgacatcatgttgcagtgaagcagttcagtggtttagaacaatacagtgctgtttgtgtttctgtttgcttccatggagggtcatagtggaggagttcatgcttgatgtcattctcaccctgggacccaggcttgtggagcttccactgtttggagccagttcctctgtcaggggagggaggatagtgaattgtacaccagttctcacacttctacctgcatgtgactcatgacacttctgcctacatgcacaggccagatcaagcctggtggccatctgacatcatgggggtggggaatgctccttcaccatgagcctaaagttagctgaaacatttgtaaaggcaactatcaccaagttctctgatatcaagttgcgcttaattgccacaggcaaccagttacattcatctgccattccacaatttaatatatcctggaagtagtgatctcactacatttgggccaattaggatatccccaggggaactgaatgctgtactttttctttcttacgtctaatacttgcactttcaagtttttaatccaagttatgaacttgccagagttgtgtttccaagatttcagcacttcctgtattattcagatggaaaccatcttaaatctacagaaggtaagtttagactaacaatgactctttgaaataaccagaacatgtatccacacaggctccatttctccttttctatttgtggattgcccccacccctcaacccaccctagccaaggacaatttccaaggcctattgactcatgcctatttcctcccatttttatttcctttgcttgtaaattgaaacagtgtttcctaattctttatggtttcaaataatttacccattaatagtttcatttaatcctccccaagtcaaatttatagtgaatggtttattctttttttttttttttttttttacagatgaaaaaaatgaggtttagagaggtgagataagatctcaggagattagtttctctttttcatgaaccaaaacattctttcatttattcactcagcaaaaaattattatctattggaagtatttggccagctgcagagagagcatattcaggg

SEQ ID NO: 29061 - DNA, 1158 bp, Bovine  19866881089478
ctgaaaatgcaactccaggacccaactgtcagggattgtgttttggtaagtgctgggttggggccgggagtcaatacttttcataagcatcctaggtaacttgaatgcccaccgaagtttgaggaccagcaacataaaagatacaacatgaaagttacatcagccttctcctcagccagcacggtttggatcagggtatgttggcatccccaaatgccttcagattccaggcagaaagtacaaggaggtgaagtggtttcatagggaaggaaggaaaagtaaggcccatggccctggagatgtataccctgcctaaaagcattcaaaaatttttaacactgctatgcggacacacacttctggatgctgctagcttatagcacctgcaatggactgatagccaataaactagatgatacagaagttctagaagataggccagaacacagtggtataccattggtttctcacggcattagtggaatgctctgtacagagtaggtggccagcaaacacttcattgatatgacctagataaaagtgcatctgtctatctatctatttattttacacacattgtaaatgttcatttgtgtataccatctcgagatacatctccagatatacttgtttaatgatcattttaagtctggggaagtccattcacaatttgccccagacctttatgtgagttagtgcaaatgaataccattcccaaatgcactcttaccgtatctcagccctgcggtgacgggggctttctgcctccaggagcaaactggatacccggagtctagtgaccaggcctgggttgattaaaaagtgaaaggcagttgttagagctttactgaagcaaccatctgagtcaaatcaccaggaagaaaaaagtgtaattcaatgcaagagctatttttattctggaaaacaaattccaaagccacaatcactgatattacaccttccctgagaggacctgtaatatcttcaggtgggtaggtgggttggtgaaatctcatggttccagcagcaaaatttgctaatgggaaagtatactgccttatgacccagcaatcctactgctgggcatacacactgaggaaaccagaattgaaagagacacgtgtgcccccagtgttcttcgcagcactgtttataata

SEQ ID NO: 29062 - DNA, 771 bp, Bovine  19866881097074
ttgggaagcccaaaactttattacttgtgtaattttttctagaattttattgtcaaagtttcaaacactccaaaaatttcttctgtaatttttaaaaaaataattgatgattcttatgctgtatttcaaaaaagttttttaaatagataataaaacttaagctatagtatgatcccatttggataaatttacatggaaatatatacagggttaaaaaaaactatgtaaaatagtatgctcatggtaaatgttcactcattggatgtcagctatcgttatcttaaggtaaacagctgatggtcaagggttcctcaaactcaagaatcaactcccgacttcctccaaatacacagcttccctttgctctgacaaaggtccatctaaggccaacagggcagttgacagcttcccttccattcattttaccctgtgctcctgctgaagggccgccaggagaaataagcttgagacaaaagaaaaccatggacatccttcctggctacacaggcagccctggctgcaggtccctggaaggagatagagccggaaatggtgaacaaattctacctgcttatcagacagttcagagcctcgcctagggagggcacagattctgcaggcagagacaagaggtacagtttggccgactggacaaccctgcaaagctgtattctggagatacagttaggtcaaacagggcacagcaggggagcagaagtgagtttcctcccaagggcaatggactttaaggtcatcttcctaattacattt

SEQ ID NO: 29063 - DNA, 1256 bp, Bovine  19866881108110
tgtatacttgaaagctgttgagagagtacatcttaaatgttcacaccagtaagaccaaaagtggtaattgtgtgaggtgaagaaagcgtcaactaagcttattgtggtaatcattttgcaatatatatatatatcaattattgtgtcatacaccttaaacttacacaatgtagtatgtcaattatatctgtgtatctgaggaaaaaagctgtgaatgctaaattaatagtttttcaaaggaaaaccttttcctagaggctgaattaaatattgggtgcatttccagaagaaaatgacaaatgtccaatcaaatagcacatggaaagtggttaaaatgtcattgctgttgatggctcttggaaatcaaggataacaaatctgtaacctaagtgccagtgcccttattctaacctaaggcagatattcatgggccatcctgctgagtctggtgtcagaatcctctccaggaacacccactgcctctcagccatggtcagtacttgagatgaccccggggccatcactagcacacatgttgccttcaggcaaatcatgaaaagatatcttttctctagatcttatgccttcttcttttgcaatattaatgtattgatttttttggagaccaaaatatatctgttggaaaatcattataaacagcccatatctgatgtctaccatatatttgaaaccccctaggattggagaaggaaatggcaacccactccagtgttcttgcctggagaatcccagggatggcggagcctggtgggctgccatctatggggtcacacagagtcggacatgactgaaggcaacttagtagcagcagcagcagggatgggatatccttggatagtatactgtcttcataaaccattcacagcaaccctgggtgatactttttttgtcatctctactggagatgcaccccctcccctaaaataaatccttctcactctcccccagaaagagtggtctgagccccctggaaatggcccagttgtcctgacatgccagcactggagtttgtcctgctttggtatctatgaggcaactgaactgcccccctcctcttggtcagttgtacagtccatagaagaaggcaatatggcaagacataggatgctaactaggtgttattagccagtcagctatttccattttccaggcaacacgatggaaggcaaactatgggttctttgttccaattaaaactcagacttcattccattttttcccagtccctgaatttg

SEQ ID NO: 29064 - DNA, 763 bp, Bovine  19866881113040
cacgcttctgggggttgagtcagagaaggcgacttctccctaatcatcatccttctagaaaacagaagtgctgagtgctgattcctaagagaactttccagcatgaagcagagtctgtccatgccttggttcaatggaaccaaactcccaagaggggtgttgacattcctaaagtcctacaaaaagttcagctgccacccagctttgcccactggctagcagacatggatactatggcaaacaccagcatctggctgccagcagtctggctatctggggaaaggggcagtctggagggctttagtgcatctcaagttaacctcactaatctaccctcacttccacagagaacagcatactgtattcagcgatctcagcaacagctgtgccttccaaatcaagacactgttcagaaagatgatccaaatgtgggctatgtgtttcagcaggatttggtgggactttcctactcaaacggtcttttgtgtgcttctcaaagacaggatattgacttcacgcatggctaaagcatgatggatgacttggagttctcaatttacatttggcttgtggtcagaactgactgtcaaaatgcatggtatctgatggacagtgcctggcttgttcagacttgtttctgatggagtgagtggatcctaaggcttttgctccatccaggtttgataagctaaacatggctggaatgttacaaagttcctcttgaggcagaagaattcagtgtccgaatggcagtctcttttac

SEQ ID NO: 29065 - DNA, 2004 bp, Bovine  19866881153867
ctgtggttagcagaacctgacttgtgactgggactctgtggaacagtgggacagagtactgagctcagagacaggtgatacaagaattggtcagcaagccagttggccctgctgggcttccaccttctcatctgttgttggaggggttttgtcccatttaggctctacgagcctttcctgcactacctgtttaaaggacactggataagtggaaaatgaaaaagaagtccctgcctcagggcatttgcttccccagttctggagacattcctggaaagagggggcagtgagataaaggcaaatacccccaaaaccacagaagctgaggatgaactgctaactcaggacccattgtttaagcaacataaacacaaggaagaaaattacagggaagaaattacaggctgctattttcataacccacaattttgaggcataaatccataatatttgtcttccgtgtaatttcccccagacactgaggactgcctcatcaatccagaaaccatactggacaacagcttgtttgctgaaatcaaatggagtctttctttcactgtaggcatctggacatctggatgcctccaggaagatataggccctgactctctcccttctcactttttccccaaaggagggcacactgaactgttgaacctgctcgcaggatgctcaaggtcatcttcaaaagcagataagcagcccaaccagtgggcgctatgcctagaggaccttcggccacctacttctctctgctcatcccttaaacacgttctggaactgtcatctcttcatcagacttcctcccttcagtctaaatgatgctaagatttagattttggcttgggaaagggagagatcccttggtctcaccacagccctgttagcgaaagagaaacagagtttgaacaagcctgacttataagagtggatatttgttgtcttttgtgtgtatatctacctccagacctcaaggggaatagtaattgtcaaggcagaatttaggtatttggaggtttactggttattgtacctactactacttctgactttcatctctccttgtatctctaacttcttttcagttcctcggagatatcttagggatggagactttttgttatcctggaaatcaagctgcagcctggaaaatgaatagctgttcactgctaatggagtgatccagctccttgtctctttttcttcaaccctatttgagttgtatttaatactggagaacccaagaaggggagaaaggcagaagaggagttttctcagcaataggttgggtgggttagtcaccactgcttaccattgcacttctcttccaaggaggcctggtggtaatactgatacatagttgatctggagcaaaactctgcataccagccagaccacggacctcttcccggctccctgcttccttgtgggtgaggaatagagtttaacatcttatctaggataaaggacagctctctttgaccttctcttgtcaggagcttcatttattgttggcagaattcaatttcctggatcaaagagaagcttaagaaaggcttaggcatatcccagcactctcggtaaaccatgcttcactgaagtgcatttaaatgagtcacagacatatggcttacatttcacttaaaatacacatggcttaagaaattggaggatatcgttctttaaccaagtatttggcagatccaaagtattcaaaatgtttttccaaactcagcatacagctgggctccccattccctgcagctgagatcctataattccgttagaccagtgctgaggaaaccgttagatagatgggtggggacatcagaatttgcagagagctgcctccaagtggctgaaattttcttcaaatatatatatatatatttttgaagtaccaggaactggaattaaccctgctgcattgactctgaggcagtgaaggcataagtggatttaaattctaagtgctaggttaggcaccttgccccagagagacca

SEQ ID NO: 29066 - DNA, 789 bp, Bovine  19866881177672
ctgattctcttgttctatggcagaaaccaacacaacattgtaaagcaattatcctccaattaaaaaaatgaaggcaagatcactggatcctcacagccacccagtgaaacaggtatattattctcgagaaaacagaaaaacaaaaagagctgaaagactttgctcatagtcctacccctgtgacagagctggtctggaaccgggcctgaaggactccatgctctaaccgctaccccatccttcaccatgacagcccttgtaagatttcacacatttaaaactgaggcattgaccggagttggtctgaattagactttagttgactcagatccagggcaacctgagagttatgatggttctccagtgccaacccctttatagctcagtcttccccagtccccatattatttactcagagtctatttgcatttgcggaggaagctgctagtggagaagctggcaggaaccttaatgaagccaggtgggacccattgaaatgggaatgtgtcgaactaagttatgaagaaatgaagccagctgtcagcaggcttaatgaaaggttaacagaaatcctgcaatgggtggctggggagactctgtctctctaaagaaaacaaaaagttgagaagtgggttccctgcttggaggcaagacccgaaggaggaagccgcttgtaacccgaaaggctgggtctgagatagagtttcatttagatttgtaaacatgttagagtctcaagaaaaaaaaagaaataaagaactgtagttctcagctctctagcatcaaagg

SEQ ID NO: 29067 - DNA, 2027 bp, Bovine  19866881178325
atccccttcttctcctgccttcaatctttcccaacatcaggatcttctccaataagtcagttcttttcatcaggtggccaaagtattggagcttcagcttcagcatcagtccttccaatgaatatacagggctgatttcttttaggattgactaaatctagcttactatatataaaaaataaactttaatccctacctcataccatatatatgatgaaatccagaggaattaaagacaaatttcaaaagtaaaactataaacaatagaaaaaaaaaacaggcaaatatagtagtaactttggaaaaggaactctcaaataagaccttcaaagcagaagtcttgaagataaagtttggtggattttaatacatcgttattaagtatttcagttcattgaagtagtcaatggacaatgccggcagaggaatgacgtagcagaagaaattacttgtaaatttcagatatgacattacaaacacacacactcagattgagagacagaaaggaaacaatttgaaaaatgggcaaagataagagaagtcagttcactgaaagggaaacgcaagcaaatgctggtaggtgaggagactattaaagtcaaaagtaggcagagaaatccaaatggaacaaatacatttgtcagcttggcaaaaattatagagggattatattgctaacaagataatagagaaaccactttcatacacagctggtataagtgaaactatgagtcattacagagagagcttcatcaatacatgttgaaattaagtgtggtactgctgctgctgctgctaagtcgcttcagtcgtgtccgactctgtgcgaccccatagaaggcagcccactagtctataatttaacaattctttgtctggttacctacctctaagaagctatttctcaagtccatgtcaggccatatatgagtttgtttattgaaattttttttgtgttgcagggagttggaggtaaactatgtgttccatcattaagaaaattgatggctctaatatggaatatactataatgatatacagcagttagaaacaatgaggaaaatgtacatatgataacatagttatagctcaagaacatcagactgagtaagcaaagaagctgaatgagatctatggcaaaatattttgtgggtttaaaacataatatacaaagaaatactatatatctttcaaggatacttatatgtccaatgacatttacacaatgcattaaataaaaactgggatccatgtggagataaaagggaggagctgactcattggctaagaccctgatgctgggaaagattgaaggcaggaggaggagtgggcgacaaacaatgaatgattggatggcatcactgcctcaatggagatgagtttgagcaaactctgggagaagcctggtgtgctgcaatctataggatcacaaagagtcatacacgacttagcaactgaaccaataacaacagcagacctaagatgatattatgccttaaactgtactatgaaatcaactctgtggcagtgggaaccatacacacatttactcacactgagaacacttattcattcaacagcacttactgagcacctatttgaagacaaaatcaccaaatctcaccacataaaattaaccatgtttaacattttgtatacctgtgcttttttctccacctccttctcctatttctgaattcttgactaacaaagattatactattctgctgaaacacattttttcctattgagtgatatcattcccaatgctacaaaactagctttattcccatcctgaaaaatgacccattctcttgaccactatcatctgcctttctacttctggtatcaagacaacattttcaaataacttactttcacattcacttctcaagttaggacagttgctacttcttccaaacttccatgaaagctgtttttttcagaagttgccaatttttttttaattttaagaaagcggtattttctctgtttaaagtagacacagtttagtagtagtaccctgg

SEQ ID NO: 29068 - DNA, 1529 bp, Bovine  19866881316579
tcttgaaggctctgtcctttttcacctttgtacaatattgatggatcaggcgtgcgtgagggtgagggggagtccaagacacatgacatgaggcaggtttttccttcctgttgccagtgactctgttgtagtagaaaagcgagatgcaaatacccactctttaatgaagcatacttctttccctttctgtttcctcttctcgaatctagtaatggggtgggatatggggagccataaacaggcaagggatgagaagatttcactgtcatatattattattgctagggtgtcccagatggctcagtagtaaagaatctgcctgcagtgcaggagacctgcgtttgatccctggatcctgaagatcccctggagaagggaatggtaactcactcctgtactcttgcctggagaattctcttgagagcacagagcaagaattagaatcctgctttcagattctgataggttactccttgtccggtaaccagtacaggtatgatgagcttacggtaatgaaaacctgatgaggatgaaaaaaattgctgaactacgttgtaagtgtatcagtgcaatcaaaggataagtgggggttaatggttggtattggcattaatagtaataacttggttctcagttgtctaacagcttcagcaaattgaaacccactgctattagagatgggttaagtaatataaagataactaggattggatggtcaaaacatgcagcttcagaatcattccttagtcttgtgtgaccttggaaatcctgtcactttcccatgtctgggcctcagtgaacccatttgttaaatggacttgaaaagtgcttgttccagtccccctcaggttgttagaaatgcagagaggtatttttgactgtcacaatggtagggcactacatggctggcgtgtagctaagaaggcaggcaaacatcttgcgatacaggggacttgagtgcacagaaagagtctcatataaaatgctaatggcaccccagctgagagacactgcaatggtctaatctgagttgtattcagaatagtccatgaataacagctcaggagaaatggggctaagggttggaaacaagaaaccattgccagagaacttcttgatctgatttgattttttaaataaggcacttttataggaaataagaaaacaacactttcggccagctttaaaattcctcatgggttatactggcctctaagacatttgtaaatcccctttttgtacttccttgttctgtttctcaagaagcacttggactatttcatgagacacacataaccacgataaaaacaaagtgctctcatttcccctagcctgtccccgggtgtgtggagatcgccccagccgtaaagtgctctcatttcccctagcctgtccccgggtgtgtgaagactgccccagccagagcagagtgaggagtccaatgtaaatagcagacccctgcctctgcatgtggctaggagattacatttttcagaacaaaatcaaataatgttctagaaagcagtcac

SEQ ID NO: 29069 - DNA, 981 bp, Bovine  19866881428796
aatgtgcagatgggaaaatagaccttaactcatatattcccttattaactatgtgtgtgtatgtgtgtatatgtgtgtgtgtgtgtgtgtgtgtgtgtatgtgtgtatgaagaagcgtccctaccctagtccagactgacactaatttactgtctaaatttggcccagtttactcccctgtagcacaaaggggatggatcagatattctttaaaaggaattctagctctaacaatttataattctgtgaattacagatgtttccagattcaatgtatgagcttcagttttctcagttgtaaaatgacttttgcaagatggttgggagagttaaagtgcatagaacagttcctggagtataataccagaacaaggactattaggactatcatcagccattattatcacatgccatggtatgccatccattagaagtattaataccattgtctgctttcttctgagatatgttgactgtgttaggaacgtccttctttctttctgtccatatgatttgaaggggaccttacagaagataatcttgacacacagggtaggttattatgaaaaatattgactgataacttgtatctttgttatgctgcattagaatttgagtgtctctgacatataactacttttcgttttggaggtggttcgtttcttcccttaaaacaattcttctgtggactcaatatcgattgcatctttaactagtaacaccttagaatcatggaaatatcattaacaatgtcttagaaaaggctcctgccccaaattcaggtcactcaatatgtgccatgctataaggtatcaagtacctgcttgcaaggatttcaccctctacctaaacgggttacacagaagacagactttgaggtccatggctgagtgaaaagagagctactggagatgtcatgacattgcaacatgagagttcaaaggtggggaaaaaccacattccacagtttgtgagagggaa

SEQ ID NO: 29070 - DNA, 758 bp, Bovine  19866881690503
atctttggatttaccaggttgttttttatgcatgcattagtaattggagtttcaatgattggaaaaatacgtgttactccttttactttcagtactaaaaattccaacttgtggaggtcacttttctagtaggaaaaaagttcgttcctatgccatattgaaaatgaaatattaactcctcagattgacaaacatgaatggtaaccccaggatgcgtaagaagatacccactctttcagaaccataaatatcaagagtggtaacaagatttagacaatgtcatgacctaaagactaaagatactctccatcagctctgctcaatagaactttctgcagtgatggaaatttaaaatcttggctgtccaataaattagccactagcccatggctattgaagatgtgaaatgtttactcattcactgtggtttagtgtgactcagagctgattaatgttgtgcaatttgaattaatttacatttaaatgtaagcattcacatgtggctagtggctactgtattggacagcacaactccagataattctcagattataaaatctgagtctttttattctataacttccaatcaatttataaccaaggagtgtaatctattgtccgaaattctaagtaaactgtgcttacagaatgttaggcttggggctcttgattattttttttccttcccctaggaatagagtaattaggactttctttgaggtagggaaagacatgagggaaagggaaatgagggatga

SEQ ID NO: 29071 - DNA, 1384 bp, Bovine  19866881978114
gtgatacctgcagaagatttttaagaataaaatacgtttttctgttttttctacttagccattccagttcccacatccctaaaacctggagaagcaatcaattaacagtgtattttctaaagataattttatctctaccttctagatacaattcttgtgtatcttctagagataatctatccaataaggaatggccacatagtctattcacatttttttttttttacttagtacatagagagctgcgtccttttattcagcttatggagtcccaatgtatttgggtgcacgagatttaccttaactgataggatttattgaagtatttatgggttgttattgctctaacagtgctgtaataaatatccttgtaaatctacttggccaaatacaaacataggacacattcctaagcagtagtatggatgggtccaatgacaggtacacttaaaattctggtatctccaaacggctttccattggggttgtacacatctgtttccccacatgtataatatggttttctccacaactatactattattcttgttacagtattatcatgccaacttatcatattaatttttcactcttttccaatatgatatatgggaaaaaaatcccatctcatggttgatactttgctcacagctccatcgtccacctgttgtgttggattgttcttatccattcactcactgtgagaatttaaagcatcaaggaactaggaggaatactgtctactgcctcctgctgaaagtccgccttgaggcaaggcgataaaaaaaggtaatatctggagatgctcttgtaaagcctgatcctaagcaatccagagtgtctgaagggggaggctggctaggaagcatcggggtggaaggagggtggtccgctcgctggagagtgccttaccagggccccacagctgctggcactgctcctggtaggtgaggcacatgccattgtagcagtaggcctggccgtcctcgcaaggggtgccgtccatctggtagaagttggtggggcactggggggacttgcccgtgcagaactccgggaggtcgcactgccgggcctgtttacggcacagcgtgcccggggccaacagctgagccgaggaacaagaagcgggggataaagtcaatctcccacctgtcctcaatcctcccagcaagggctcatgagcatcactcccatggaacagaaaatccctcaccattatttcagagcactttttacatgacctcattagcttaaaccaccataaatcatctaacatgaaacatctaacacttagtttcaaggtggttttacacatgttaactctacatagcagtcttaagatcaggtaagaaataatatttatgcaactatttacagttca

SEQ ID NO: 29072 - DNA, 743 bp, Bovine  19866880609927
tgacttgatcacttgacttattagcccacatcaatccaaataaagtgtcttctgttttttggcgtaaatttaattcaattcttattcatgcttgttcaaatctaatggagcttctctattaagatggattatagcaatatacaatttctaaattttcccattttgagcctgattttttcccatttctatcagggagaatgccagggggaaaaatgagttaaatataaacattttaaatgggcatgaactaattttctctgatagagaagaaatagttctacttaaagagaacaagacctcacctgcaatatcttgcagttcttctgttcctcacctctgttctcttctagtcatttttccgagactctactttttgctcatcctgtcacccttactcttctacttttcctgatatatcacaatcactcttactccacacactttgattttatttgttcatgtctctaccactgtaataattgagcatttcccccatacatcttatattaacttaatatgttttctattgctgcataacaaattaccaaaaatctaatggcttaaaatcataccgatgtattagttcacagttttgtaggtcagaaatccaggggcttcacctggattctctgtttaaggtcttgaaaggctgaagtcaatgtgtctgctgggcagtggaagctctggagaaggatctgcttccaggttcattcagattgttggcagaaaccggttccttaggg

SEQ ID NO: 29073 - DNA, 699 bp, Bovine  19866881286144
attgcctgattcacctaagatggcaaagtaattagaaacatgaatctaactcaagcagtctggttccatagcccatgctgtcaaccgttacactatgctgtatctttaactgtttgattaactcagaaacaattttatgcatacatattaagaaagcattcatgaatctggatttcactaagaaaatgatgcaatatgggggccccagtaaataggggctcctatagagtatatttgttggaaaatcatgcatataaggatgactggatgttcaagcaatttagattccagcctactcagatttaaaatacaagaacagtaaaagcttcatcagctcgaaattactttttaaatgatgtgagggcgtttcaagtcaatttgaaaagattaggggataatatggatttgccaagtactttgacgtaccaaggaactgtgagggcacttgaaagattacacaagatatttaacagctttaaatcttcaagtttttaattctttgccttatttttttccccagcatttcaccttctttattgacttgtgcctgcagtccttctggttagccatttagccaggtaatacctacagtgaaaattaacattaatacagtgccaatacatttattatgagctgtcctcttacatcaatattttccattggctgtcttttttaaaattaattaatttactttaattg

SEQ ID NO: 29074 - DNA, 2046 bp, Bovine  19866880341515
ctcacaggttattgaaggattcaaggagttattatacataaaatccttagaacgaagcctggcacatatatttgctattattcctgtttctgatattctttagtggactggatttcaaagccattttagaaaacgcatttcaaacttctctaagccaggactatttgaaatggggtctgcggactggtagccatcctgtttgttactgatctgtgaaaatataagcagattctcccaggatataaaccaactattcggttgatttttttttctccccaatgcaagattctcaatgaaggaagtactatgttgattaacattctattgtaagttccttattttactgcaaacaagcaattgtctgcattatacatacagatgaataacacatatatatatataatgtagaaccatagcttacatataaggtaagtatatataatttgtctgcattatgaaaagaaaaagatgcagtactaccaattccggagtaaagtctctttctccaaaccaattattcagatattccaagacactggttactgttgcctaaaaaaggggggaggggtaagagatggaagaacatcattagtaataaaacactgacaagttcaagctgagttacattaagttcagtgagaaagcaactctgtttaaaatggacttcttctttagacttaaagagaaacctttaactctatttaataatttgattagatggaacactcagtgagatgaggctgttttgagaaatatttttatatattttctattatcaacacggtttaaatcctaggatttagttagtaactactaatgtagttcagaactatttttttaaaattccccactctcttaaaaaaatgtctttgcataaattcagcttatttgcattaaatcaaagtacaaatctaaacacaaagttagctagagaaaattaattttaaagctatatatcgatagactttatcaaattctctagcttattctagtaaagatgctgctgctgctaagtcgcttcagtcgtgtccgactctgtgtgaccccatagacggcagcccacgaggctcccccgtccctgggattctccaggcaagaacactggagtgggttgccatttccttctccaatgcatgaaagtgaaagtgaagtcgctgagtcttgttcgactcttagcgaccccatggactgcggcccaccaggctcctccgtccatgggattttccaggcaagagtactggagtggggtgccattgccttctccattgtgaagatacatggcccttaaaggtcatcatggaaactttgagtaatacattggtatccatagtaaattggcagaggtcttatcctctagcagtttcatcagttgagtttagtatctattgatggtctttgtctgaaatagttatttctttgacttaagataagggtgtcttccttctgagaattaagactctttggcttttacctaagaacatttggaagccactgaggatgtaggttcagtggaagattgaggaagtgttggtgccttgattagattttaagaggtcactctgaatgaagtgtggggatcaagacagactagaatggtcataggtagatgggctaggctttccctctgggagtcccagtgaaaaatgatgaccaattatccaagtgggtggggccagagatggacagaagtagatggttttataataagaagactttgcctatggaatgcattgatggctcttattagagctgttcccttattatatggaacatcttgtgtacaatctaactaaaaatgcagcaggaatggattgatataaaatgatgaaattttcacaaaacgtgtattaaatcctccaactcctcttgtcaacttggagatggcagttgtaatagcctgttcagcctcatcagccattccagcaaatacactggtggggaccaccgccatggctggtaatttattcagaccaacagggaaagccttgaaaaacctcatctcccacaatctgcagcatttgttgatcagcaaagtaccaacattta

SEQ ID NO: 29075 - DNA, 1718 bp, Bovine  19866880366524
tgtaagatgctgctgctgctgctgctaagtcgcttcagtcgtgtccgactctgtgcgaccccatagatggcagcccaccaggctcccccgtccctgggattctccaggcaagaacactggagtgggttgccatttccttctccaatgcataaaagtgaaaagtgaaagggaagttgctcggtcgtgtctgactcttagcgaccccatggactgcagcctaccaggctcctccgtccatgggattttccaggcaggagtactggagtggggtgccgctgccgtctcccaagtgtaagctgaggtggatgataatagtagttccacctcatagggttgttatgaagttgttatgtgtggcacataataaataaaatcctgggaagcttacgtcactctcctgacttggaatctatcacagatctgttgtttgtaccttcactctgctgtggaacttactctcacagttacaccttggatccagtcaccgctaggaacccatctgcttttggaccactacctttctcttttccactgtcctacttcccaagttccatcatcttcagctcctgaagatttgtggagatttccaatgttttgacattttcttttgcctcctgctgagttaactttctcctctctttcacctgaatcttctagacttctacagccagcacattcagttttcttgccccatgtgttgtacaatgtcaaatcctgggtcaatccaacagaaagtcttccctggttttattcctgggcttctgaaccttgatagaaaccaggaacatggtggctagatgtcactataaaaagttagcatgtccaatcctaagctgacccacacagtccctgggtgatcctcatggtgcctgtctcagctccctcttctacttactgtatcaagttttcccagcatttatgacttttctcagcctcctaagccagacctttttctttaccagtgccaggaggtatgaacacttcacttctaccattaatttttcaaaatagtcttcttcagcatatattttttagctccctcctttttccagagcccaaggttagttccaccactgatcctgtctgctttcattgcctttggctgtccagtcctgcagtggccttttttaagtcttctgcatgttgagtctcttacttaatacaccctaatactatgccgtatggtttcgttcatcttacgaacctaacctcatgactctctgtttccctctagttgatgcttccttgtgaagcatggctgaactgtcttcagttcctcacctcgtgtgaatccctcagcttcctgcatctgcttccctcttattttactagtggccatctgtttgctgattccattgaacccttatcctccattttacttgaccactttactggatagttagagatttcctattcaaaactccttcttgcgttttcctgttctggccgctcattttaaaactcctctgtggactcatttctcttcctgcttcttaaatgctcaaaagggttactttcccagtttctcttctgactcacaagctctatttacacactgtattccactttaaaatcagcctgtaaaccaaagactcctgattttatactctagctccatatccaaattgatcatgtgatttcctagaccattaataaacccagactgattcctatttagaattcagagctctttggatcggcctctgcttaccgtttaa

SEQ ID NO: 29076 - DNA, 1135 bp, Bovine  19866880381155
cagaaagtgaagaggaactcaaaagtcctcttgatgaaagtgaaagtggagagtgaaaaagatggcttaaagctcaacattcagaaaactaagatcatggcatctggtcccatcacttcatgggaaatagatggggaaacagtggaaacagtgtcagactttatttttttgggctccaaaatcactgcagatggtgactgcagccatgaaattaaaagacgcttactccttggaaggaaagttatgaccaacctagatagcatattcaaaagcagagacattactttgccaacaaatgtctaactagtcaaggctatagtttttcctgtggtcatgtatggatgtgagagttggactgtgaagaaagctgagcgccgaagaattgatgcttttgaagtgtggtgttggagaagactcttgagagtcccctggactgcatggaggtccaaccagtccatcctaaaagagattcagtcctgggtgttcattggaaggactgatgttaaagctgaaactccagtactttggccacctcatgcaaagagttgactccttggaaaagaccctgatgctgggagggattgatggcaggaagagaaggggatgacagaggatgagatggctggatggcatcactgactcgatggacttgagtctgagtgaactccaggagttggtgatggtcagggaggcctggcatgctgtgattcatggggtcgcaaggagtcggacacgactgagcggctgaactgaactgatagggaagtactctggtattaaatcaatctgtgcagttaggccagataattctcctttctaagttgattttgtggctgaacttttattatattttgaatgtggtttgtaagtaagacaaatgaaagataagttcggagaaggatagtatttggcgttatgttcattgtacggagttagatattttttctattttgaagttctattctctttgttctaacatttattttccatcttaaaaattttattaggaaacatttaaaaagagtttgttttaccatgacatatcggccaaggcagtgtttctaactgtggtcagatgcagtgtggagtaattcttcacagtaataacgatacttgactctcccaatcatattcg

SEQ ID NO: 29077 - DNA, 3502 bp, Bovine  19866880396444
cgtgtctgactctttgcgaccccatggacttacagtcctggaattctccggccagaatactggagtgggtagcctttcccttctccaggggatcttccaaacccagggttctaactcaggtctcccacattgcagtctgattctttaccagctaagccacaagctgaattaattcctttctttactattattctatctaggagatgtataaggtgctttgaaatggtagaatcatgtagctgtgaagaaaatgatgggataaaatacaaagtgtgcaatcatctttgaaatgacactttaaaaattaattttaagcagtttgcatggtaaaaatttatatctaagatgttttcttggaaattagatggcttaaattacacagttctgatccgaagaacctgtattcatatatgcgtatgttaaatcactatctctttaagtggattaaatcattggatagaaggataatgttagttgtaattacttcattaaattgagtatacttgtaatgtctccaatatgagaaacttatgctaatacttttataatttacttagcaaggatttgaattaattttatttgtgtgaaaactgcttaattttatttcatggcatatttatatgatcttaaaaaaatcttagacatttgacatttattaaattagttagaaacctgaagtaaattttttctcactggttttttttcctacgtttccacctttatatatatatgcatatatgtgtgtgtgtgtgtgtgtgtgtgtgtgtgtgtataagtaagtaaatgttagtcgctcagtcgtgcccgactttgcgaccccatgggactgcagcccactaggctcctgtgtccatgagattttccaggcaaggatactggagtgggttgccatttccttctccagggaatcttcccaacccagggaccaaacccaggtctcctgcactgcaggcagattctttaccgactgagctacaaaggaagcccatatatatatacacacacacatatatatagtggtaaattcccactccagtactcttgcctggagaatcccatggacagaggagcctggcaggctacagtccgtggggttacaagaatcagacatgacttattggactaaaccaccaccaccaccaccaccaccaccagagataaattatattctctagctttcaaatatgctgtgttttatttttacaggagataggaacaggtggcacttgtcagtggaagatatgtggactcagtcccactacaaccttagccatatattttgaagttgtcaatcaggtatgacttttatatttgaatattgaaatgtatatttgaaaacgtaatttaggccatgagtatttccagagctatgatcaaaagcttgttctgttttgaaatttttctttgtcattttctgtttctcaaggctacactccttggtgagaggacatactgtataataagagatgtcagggagagctgcaaatacccaaccttggacaacccagcttttagtcttttgttttaaagctgtagcataaataaaatcttaaattctgctctagttatgcatttttgtaggtgggtatctagttcctcctaggtgtcgcaaggtatatactgatatatgagtccttttgaaagaaagtttaagatatcaaaatttatagaaaaagattggaaggtaaaagatgccagtatttggaacgatattttcttctgctgcaggagaacattatcatattaaagaatgatataacgtataaatattgatataccagtagttattgggcataaaatgaactatgaagtattagtagtgagcctgcctaaaatatatgcagtaattttcttttttaactattaaaatttgtgaaaaagatagtggctcttattgacagacagtaacaacaacaacaaagcaagaatggctgttgtcaaagggcatgaagaaagtttcccttttgaccgtcttgtttctttctgaggatgattatcatatattactgttggtctcttctcattaatggttttctgttggtcatctgttcatcatgtgattatcttcctaaaatctgtgttttcatcttatgtacgtaggggaggaaacttagctctttttcttttattgaattgtagtcaatttgaaatgttgtgttagtttcaggtgtacagcaaagttatacatatatatttttctattctttttcagattcttttcccttataggttattacaaaatattgagtatagttccctgtgctatacagtaggtccttgttggttatctgttttatatatagtagtgtgtatatgttaatccccaaatcctaatcccccaccccagccttcccctttggtaaccataaatttgttttctatgtctgtgaatttatttctgttttgtaaataagttcatttgtatcttttttttagatcctacatataaatgataccgtatgatatacgtatttctctgtctctcttacttggtatgattatatctcagtccatccatattactgtaagaggcattatttcattctttcttatgttagttccatttctttttatccagttactgttaggcagaattgcctcacatatgctttttttatcttttaatttctttacacttctcctttcattttgctttttcatgtttctctgaattatattacttgaaattggtttactagcttgactcagtcccctcttatccttcataattttgctcctctccccaatacatttctccttcatgtggtaaatcaccattgttctgtatgcccttgaaataagcatccttctgatagattttagaatgaattgttagtgctagaatatgcaatccatgagtatatgaaaacattgtaatagactttgcttagattctgctcttttatttttatgcagcataatgctccaattcctcaaggagggcgtggtgcaatccagtttgtgactcagtatcagcattcaagtgggcagagacgcatacgagtgaccaccattgctaggaagtaagttgtatttgttagagatttaatttatgtgtcatgctccccaaactggcttcctattttgagtgacattttggagtgaagttagtctggaaaggattcttagatgaggtgagtctagacgtgaacagacttttggtctatttttgtttgtcttggacttgattgtctgggtaggaagtattggtcagtataaacttaacctgatctaggtatggtttagaaaatgcacactgaaggaaggcatcatagctctccttttattgaaatgtatttaaattccagcttcatttctaaaatcatgagactattttggtgagtgatggacacggcctaacgtttcaacagagtgttgtgttggatggcctgttaaatagtagagggcattagatatattgtcctgctataactttgctctgacttaaaatccttgaatgaatgttaagggagtatattactcttttgaagaaaaagtgcca

SEQ ID NO: 29078 - DNA, 1685 bp, Bovine  19866880487098
gagaaaaaaaataagattatcttaatttatcgttggtatttgctatacattaaaagttacaatatattcattttggtgagcttgtatgtgttaaaagtatgaattaaatattggcaacacctaaaaataaatggcttttaaagattgctttcactgtcaatttgaattgattcattttcagaaagaagttaattttattgaaattggaattactgcacagtttagctaaatcatgagctattgtatcttttcttaaaacagtcaagtggattatcgagcaaaactctgggcttgcaacttttgttatcagaggaatcaggtaagaaagcccccaatgtagatgttaatgctgtaatactaatactgtaggaaaatacatatttgaaaataaagattacttttttataggattaaataaataagtgattaaagtatctatttttaagtaattaagtgatcaggaaataatttgtttcagtttaaaagttcattacttggtaataatttgttaaaatattttgcttttttctgcctgtagtttccaccgacttacgctggtatatctgaactgaatcagcctgctgaacttttacctcagttttctagcattgaatatgtagttctggtaagaacataaaagtaactttttaaggaagtttaaaatatccagtaatatagcaatactttataccaaaataattattcaattgagctgacttaaaaggcatcattcttcattctcacattgaattgattgagcatttcaaaggtaagaactgtcaaggtcagtttgagcaaggtaatttctattatagttatttgaaaggtggccaggattttgggtggggaggtttgatttgctatatcgagtaggttaataaatagtaaagtatcaattttgctttgtagttggaaggttagttacagatacttggtcaatatgaaactggagcctaatgatatatcccaaagtctaataatgaaattactcttgaattggttcttgttaggaaaataatttttcttccctttctgaacagctttatataatttattttaatattaagtattaaggtaatgtcttttatgaatgttgtagagatagcagaatatgactcacttgagtctgtcactgatttgtccattcggactagtttctagttcccttacaatgcaattcagattagatgattattttataaaaatcacctaattttgctgttaagctttaaagttactgtgttcttgttttaaaaaaagtgcttgttgtaagaaatgaaacttcatgcagttaagtaaaattgaaagtgaaactccccttcttgtaacataactaatgttcataaacttaatttttcacttgatgatgtattagatatataatgtttcatttgtaaaatggcttttttagaattccattgttaaacatataataaattatttaattagtcctctattgattatcctatgtattgagctgaagtgttaaacttttaaaacaacattttttttaatcacaatcttttttaaaagcgtggtcctcagatgcctttgatattcctctatgtggttgatacttgcatggaagatgaagatttacaagccctgaaagaatctatgcagatgtcactaagccttttaccacctacagctttggttggcttaattacttttgggagaatggt

SEQ ID NO: 29079 - DNA, 992 bp, Bovine  19866880499748
gtttgctcatgcgcagttacgcccccttaggccggcctcttgctcaactccgcgcctaatccgcctctacgtgcgcctgcgctgtgaccccagctctggcgcatgcgctgggtgggacgctcgtcattgaaaactatggcgtgggtacctgcggagtctgcggtggaggagttgatgccacggcttttgccggtggagccctgcgacttgacggaaagtttcgatcccagcgtacctccgaggactccccaggaatacctgaggcgggtccagtgagtgttggaccctgtgcgggtgggccggttgtccttacgcccttgggcagagcgcccgtaccccgctcgaccccaaagtgcgataaagccccagtactgtcccgtccccatactctgtcagaacaaaatcccttgattacatctttgtgtgagcgagtttctgtgaacttcattttattaaacctgattactcgtgacaagatacatgctcttaaattgctttcagtccagataattttagaaatttattgtttagagcttccattgcaattctgaagtttgtaattttatgttgaactgtagaagttggatcgcttgttaacactacacgtgaacaatagtaatcacgtttttttgcatttattacttgtttgtaggatcgaagcagctcaatgtccagatgttgtggtagctcaaattgacccaaagaagttgaaaaggaagcaaagtgtgaatatttctgtgagtgttattatatgtcaggggatttttttttttttttttccttccccgcaaattaaaagatggaggctcaccctaagaaagtatgagacaggttaagttacaatgtaagatttgacttatgtatgttcagttagacaattgcttgtactttttcccccaaaaggacaactggcgtttactacctccagagaggctttcagtaaccctgacattcctggagattgctcataacattttaggagcagatccggt

SEQ ID NO: 29080 - DNA, 1251 bp, Bovine  19866880516437
gagggtgcagctgttggtttgtttacttttattaaacccactcctcttattgatttcccacactgagaataactaacgcactttaaaacggtaatcaagtcatcacttcctagttgaatccaacccttcatctactccacacctgaacccacacagctgaatgtgactggagaaaaacatacaactgtgctgaatgatcttactttaaattcatgaccaccactttcctaacaagcctgaaccctccatttgaacactagatccaattccgtctctcctgctcataaacagcactctcacaatccctcttccctaccacatcgttaatttgtccactgggacttgtcatgcagtatttctatcatctttttttttttaaagaaacactcatgattccacttccctcctctactatggccccatttcaacaccttgaaacagaagaatatacttgctctctccaatttctttcttcctgtttaaacttactccagattatgctcatgccaaagtgcttttgccaagctctccaatgatacccacaaggaaaatccatgttcctcttcttacctgaattagcaacttttgacatggttgagcgctatttcctcctttaaacactttttttgcttgactttcagggcacatcttcccaaagcttcttctcagtctcttagctgctgcttcctaatcacccaacctttaaatgatggagtactttcaggcttacttgctctggaactgctctttcctatacttgtctatatgtatatccacatctatctacctatctaccataactcctatttaggtcatgccattgtaaccaaaccattctaaatctcagtagtttaataaattgttctcattcacgttacctgtcaacagtaggttgcctaggggctctaccccatgatgtcccttctctgggaaacaagctgatagagcagctaccatctgaagcattgccaatcaccctggtaaattgtgcactcatctcaagagcttccacccaagagtaagacatatcactcccactctactttaattggacagagcagtcatatgaccaccaggactaaaaaagtacagttgtaagatgaaaccatattaaaagggaaaatggaaattgtggtgaatagcattaataattaccaaaactcccaagttcataccttctgcctagactcccacttaaactcttgatttatgtattgaacctcctgctcaacatctccactaagatatcta

SEQ ID NO: 29081 - DNA, 1986 bp, Bovine  19866880535014
ttcaacatgatgattcaaggtgatttattagtattgatggtatttattcacctataacctgctaataaacagaacgatgagtcattactgtcagtgtatgagcttcctcagagagtttttgttaatggccagtgacatttactgtgttttgaggtggttgttcacaagatttggaagaatttgttgactgcaaagtgtaaaataataaactttttcagatgattgcaatgggcaaatctagttaattttgaagtatacacttggtatttaatgtcatggattaatttttatgtgcaagcagttattaggtttaaaagctattctcaataaaatttactcattttaacaattttctttattttaaaaatatactattctcttttgatcagatatacaaagcacgtattttataaacatcaatatctttccaaagtgattggctgtttttctcaaggttcagtagaagattatgaaatccataacttatccaatgactaaggataaaaattgccatcaattttagatttattctttggatattatgtctgtatctctaccctaatggctagacagtccagaaatgagttgcctccatcctggcttgggagttatactcaggtggaggagagggaaagggatgggtcgggaccctgggatctgtaagtattgagctaaaatgtaaaatcctgctttccatttctttttcagaatgtgatagatactattgggataaaaataattctctgggatgaaataaaatgaaaattattctagcattagtactaaacttctgattagttaaatatggcagtgattgatgaaaatatctagtattggtaggagtgttagtaatggaaaaatgttttcaacctgtctgtgagacagcattgcattattacctagaagtcatttcattaaaggtaaacttttattttattctctagattcatatttcacttaaagtcaaaattgaaaagtatggtgattaatctcagtggaatttgtgtctctgttcccataaatgttgtctaaatttccccagatgttatgattaattttcattattgcttttagcttatctttctttctagttccccattttcttttttctgatctcaccctgttctataagaacaaattccatttcttatgtaagaaacaaggaaggactcaaattacttgtaattgtagagtttgttttgaaccttgttccccagtcctttttttggctgtgtgtctccattttctggggcttctcaagtggtgctggtggtaaagaacctgcctgccagtgcaggagatgtaatatatgcaggtttgatccctaggtcaggaaaatctcctggagaagggcatggcaacccattccagtattcttgcctagagaatcttatagacggaggaatctggcagattatggtacataaggtcgcagagagtcagacctgactgaaatgacttagcatgcactgatgcaaggggtaagaaagcatctatctcaagaaactaatgtaaatagagtttaagataaggtcactgtctccagaggggaattacaaacatataaatggtaaaagaaaagagtcttttcatatgcaataagagagttcattgaaactactgaatgtggttagactcagggttccctaattaactagagcaaacatgtaacattcttcaggttagattaattaaacatttgtggaatagagttcttacagatttcacaacactgggctaaatacctggtataccaatcaaaacacatattttccacctcttaccacctcatttaagacacaacaagagtgtgaaattatttttgtacattaaaaaaaaaattttattgtacattaaaatgaattaattaaattcagttcatcaaattttattcacattgcattaaaattttttattgttataacataatttccattgttcctggtaaagacaaatagacacttaaaaaaaaaatcatagttattg

SEQ ID NO: 29082 - DNA, 1651 bp, Bovine  19866880610372
catgtcacttaggaactaaacacttggtgtttggcaaggggagatattttaaggcttgagagttaataggtgaactgtgaatatatatattttttcatacactgggatatttttgtctttgaagcaaattaaagccttgtcttccaaggcagggagttatgtgcaacatactaggattatcttggtatatttttcaaaatctttttctgtctagatattttgatagatgatgagagatattcatgttactttaaatatgttcatcgattggaagatagttgacagggcagagaatgttcatataagtcagagaattaagaagcataggcatgcaagatgtttattactttataataataaccccccttgtataacccccctttatacaattgcttattatctctccctcatatttattattacacttatttagctaatgcttcaacttttgttggtttcaccagatttaaattttcatacagtcagggactatttatatttttcaccattacattcctggcccataacagatacttgaactatatagctgctgatgaatacaagctaagaatacagacatccaagttacacagtaatctgttttgactattaattagaagtgaagtattctaggctagtttccccctactttgctcacatagcactttgtactttgctctcttatgatgtctatttcattatatcactgttgacctcatagtcttcccaactggaagttttgctttcaagggaagagattttgtgttctttatttttgtgtttctaatgtctatggaagcaccttccatgccataaatagttaatacatctttgtaggagtaattaaacagacatcacagaaataatctctttacaggaaatgctggggctctctaaagtaccagttactcaagcaacacgtggtcctcaggtacagcagccacctccttccaataggtaataaatatgtcaaaaagaacttcacagttttacagttgatacatctgtcttcacccttaacttgaacacaggccttcagtgatccaataccgttaaatatttttaggaatataaatactgaattagtatactttttaaagagttgtggtaacatcacattgctgaaatggttggtttttcatcatgacaatgtaaggagttacttcagttttgatatagtctttaaaatttttttttaaatattggagtatagttgtttttttttttaactttatgtggggcattttatttatttatttgtttgaatggtactgggtctttgttgtcgcacggacttttctctagttgctgtgagcgggggttcctcttcagtttcggtgcaagggcttctcactgtagtggcctctcccattgccgagcacaggccctagagtgtacgggctcagaagttgcggaacacgggctcagtagttgagactcacagtagttgagactcgcaggctccagggcacaggctcagtagttgtggcataggggtttagttgctgtacagcatgtgggatcttcctggattcgaaatcaaacctgtgtctcctgcatcggcaggcagattctttaccactgagacaccaggaaggcccctggaatatagttttgatatattcctgattttctgtttttaagttcaaaa

SEQ ID NO: 29083 - DNA, 1723 bp, Bovine  19866880613235
ttttaaagatcctcccccatctaacgtttattaatcataaagggaagagaaatgagagtaattttacagtggagacttctgcccagacacattgttaatgaatgatcaaaagtgatcatcatcaataatggggcaaatgaaaatcatgtgtcacctgataggctataaaaagaacagagcattacttctgtgatcttcctgccaatgatgcaagacctcaatctaattgtgagtctaccatcaagacaaacctaatttgagagacattctatatactggcctgaattttccaacatgccaaggtcatgaaagcaaaggaaggctgaggaaatgtactcgggtgaaggagactaaacagacataatcactacatgtgcgtgcatgcatgctgagttgcttcagtcgtgtccaactctttatgaccgcatggactgtagcccaccaggctcctctatccacgggattctccaggcaagaacactggagaaggttgccatgcccttctccaggggatctgcccgacccagggatcaaacctgcatctcttatgtcttgcgcattggcaagcaggttcgttaccactagcgtcacctgtgaagcccaatcactacatgcctctgaattaaaccttttaagcaaaaaaaattattgagataatcagtgaaactcgaatgagttctgagaattagatggcagtaatatatctgtgttatgtattgtataattcaatggatatgaattttagcaaactcttggagacagtgaaggacagggaagcctggtgtgctgcagtccatggggtcgcaaagagtcagatgcaacttacaaaatgaacaacaacaacacaacaatacatcagtgtcatgtattgtataaaacatcagtgtatatatatatatactgatatatatatatcacatattttaaaacctgattttaaaagttgtattgtggttatataggagaatatcttagtttatagaaaatatagctaaagtattcaaggagttaggaacatcacttaatcacaaatagttcagagaaaaaagtcctttgaaacttttctagtaacatttcaaactttaaaaaaaaaacttttttttacaaaaactcttctaattattaatataaagctaagatacgtcaagtttaaaattttcaaattgtatttcataaaattctccttatcctgccactcttaatatttgggtaaacatcattccagaagcttctctacacacaaaaggatacaccacagatcaaactttaaataaaatcatgtatgtcctatcctgtaacctgatttttccacccagcatcatcttgtgcacaccagtccatacatacatgtacgtatttacattccaaaataaagttactgtcactacctcaaggagtcctacagctatggaaagtgccaccccagaggaacgcaaaggtctctttccctgtggtacaggccaggggtctcgctgaagctctcccagaaggtctgtgagattcatgtctatcttctgtactggctgtaagaatctacaaaacagaacaaaataaaaagccattgataaatgtttgtgggtgaaggtttaagaaacaaattgtccactttcttaaaaacagaaaaagaagctgaatacaaggcagaccaaatggttctcaaacttttgtgtatatcagaatcggtgagaggggtttgtactgacacagattgctggttccaggg

SEQ ID NO: 29084 - DNA, 1042 bp, Bovine  19866880676210
tgttaactgaaaaatgccagctcagtggagctgtaagtaatgttttgattttaagtgagtttccgcatcttctcatataagaacaatttgtatttccttcctgtgaaatgtctctttacatcctttgcttgttttttttttttaaattggggtcttggtcttttttagtgattttcagcgcgttttacatttagggggtaaactacttttaaatgagaaaaacaaaacgtgacaccaaagaggaaacaataaatacctattcaacagaacagacaacatggtatagggagttaccagtaatgcagatgtatgaacatctgcaagcttgggggcaggtgaatcctgaaggacaagtaacagctggccacatactttattattaaagtcatatgaaatataaataatctttatatttataaaatataaattaaatatagcctcaacatttcactgccagaaaatgcaatttattaagcatttttaagcacctgagtcaagttttcctttgtttctctgactactcagaactcattgtttgacccttgcctaatcattaaaaaaaagtcctatctagctcaaaaaattattaaacagctaaagcacatactgttttagaaaatacgctgatataaaccagtcatatattatttgctttttaaaacttttttacaaccttggaaaacaaaaaagctattatgcttctacgtttagcaaatgggcttacaaaaagtcaggagactggatttggcctaagctatattctgctaagtctctatactgaatcttgcaccaaaactatggcctgttttttgtttgtttagtcacagtatcacttacttgtacataatcgattccaggactttcacttgcaggtggtccaatagccccttcagcacataacctttcacctagacaaaattttttccagccttcttcatcttcagatcttggctaaaagaaaaaaaaaaatgaatttacttatgtattttctttaatactgaacaatgaaaaacaagcgaggattccttcatattcccaccag

SEQ ID NO: 29085 - DNA, 1766 bp, Bovine  19866880685014
catagtcaataaagcagaaatagatgtttttctggaactctcttgctttttccatgatccagcagatgttggcaatttgacctctggttcctctgccttttgtaaaaccagcttgaacatcaggaagttcacggttcatgtattgctgaagcctggcttggagaattttgagcattactttactagcatgtgagatgagtgcaattgtgcggtagtttgagcattctttggcattgcctttctttgggattggaatgaaaactgaccttttccagtcctgtggccactgctgagttttccaaatttgctggcatattgcaaagaccttaggcaatggcaaagatgctggtggacagtgtatcctggcctgaaggtacccaaatccattgacaagaaaccatgcacactacgttagccaaaccccaaacccaaaacacttctaaatgcagagcagaattctgctccacctgtcagtctgcaactgctgacagcatacaaattctatgataaagtaattgtaatcctcctaattacttttataaatgtaaacatgtggtataaatcacagaaactgcactgaacaggaaaggtgtttagcctttagggttctagaagattctcattgacacctctgtgattctggactaattaactgttgagggattcaagtcattcatgtagataaaaatgtctctccttcaggtacaaacagatttatgtttttaattccctggtattcaggtgccttttaaagttaaaagtaattaatatgatattttaaagcactgggacttagaaaaaagtctctttttgcatgtattttatttttcctccttatttctgcctaaagaaacataggcacggtttcagcctcattgctcattttaatccatgtgctgtccataggaaatgcataatgaatgtattgatgaattaccatgcaagccgagaagcagcatgctggtttgcttgaggattcaattaaaattgaacaatgttattttgaataataaaatgctgttttgaataagaaattcaagtaaacaatgcaattagtaaaaagtgatgttgatgaagctgagttaggtctacctttatatatttatattaaatatagttcttatatatatcacaaataaaatttcagaattgaaaaaataatagcttgtgggaatggaaaatttatattggaattaataatatatttctgaataacagccaagatgtctttttagtttgcagtaagtatataactttccttgataatacaggcttaataaaattttaacgtttttatagtgctatgtttggtgataattttgaagattatccctgcccagtaggctgctgtgttaaatgtatatctgtaaataaataacatgtatgtcactctctgtcgtctccataagactattatactatacatatgatctgatttttttttcaaatgggaaatttttgagctaagacctgaagattagaattcacagatgtaagaaatatggatgttggcacgtttgtgaaaagcagaaatggacattttcataggatttgcctagaaatgtggccagggaagggtagtcagtaatacttcaaggcagagactcccagacagagagtacttgaatggaagggaagggctgctcctgtcatgaggcagcctttgaagtcacctcactgtcctgctgctttctgctcacctttgctctcttctaaccccctgcccatcttcactctcttacagtccctgcccagccacctcccta

SEQ ID NO: 29086 - DNA, 2028 bp, Bovine  19866880734002
catatatatgctatctggaagaactttcagttcttcttttattttttactagtgattgattgattatagggaaaaaacctcactctttcctcttattctcagcaaaaagtgtcagccgcgtgatttagaaaaaaaaagtaaacttatttggtgtgatcaaacaggaaatcagcatctgcggtttcaggcagatctctcaggcttcagtattcactgtctatacttatcttcctctgttcttcctctttttgaactgttagctacccacccacgcccccctcaagatctctggcccataattttgctctaacaactaccatattgggatcgtaacatttctgcatattataagctttattgacatacaatattgtgtaagtttaaggtgcatgatgtgatgatgtgatacttatatattctgaaatgatggagttaaaagcttcttatatactactttggttcaggcatttacagtctaattctcaaaccagaacagcagttactataggaaacggattctttctttcctgtccattttggtattttcagagcctggcacaatattagtacttaaaaaacaatcgttgactggctggctgagtattctaagagctccaaatgacttggatggagaagccaattttaagtcttcgaaaatccatgatacatgtacacattcagactgtctcaagacagaagcttaattgatggtttttcttccctttttctggtacaagaggatgtctgcatatcctttcaccacatagaaaaatttaagatcaagacagttacctagcaagaaagcttgttttgaagtgtctaataatcggggttccaggtttaatgggcaattagctcacatgctaaagaactagacaattgaatgtgaggagacagtagaaataagtacctcttagagaaacaagatctaccccacattaaaaggaagagataggatgtgaatggtaacagaaggatgaggtaagtataaggggccctcagaagtctggaaacagtccgagggaagttgtccaagaaagataaagggccacagtctcataaaagttgagcaggtgtaattaatggactttaagaaaactacttcctttgcattttatctctgtaaaacaagtattatatttccctttcataaacactccttaaaagttttcctgaaaatatatgaatataagactagaggaaaattttcttattccactctactattcaattttcccctcttctccctaaaatgaaaagggagcaattgtgagaggacataacaaactgaagaccctgtccaattatggcaaatattttctagaaatcctaggaaatagaacattcataaccatgagagtgattggtgatgaccaaactagaaagcaatagaagagattgatgtctgataatcagtattgaaaaggcagtgctgagatttaaaggcagagttctagagagaaatgagaactgcctgctacatctggatccatgtagctcctgctacagagtacaaatattcaaaaccatgaatctcaaaaaatcccataagttatatcactattacaaaatgcaattttgtagaaacatctattttatgtgacagtatccttaaagctcataaaatatttgcgttgcgggcagacatttttttgaaaactgaaactaacttcataactctgagcaaccttctggtaggaaggaagtaaaacatctaactttaggacaaaacatctgccctgtccttatcccgagggaaagctttcttcctagccaagtgttcttcacaggaacacactaaaagctgtgagttcttaaaagtccaacacatctcactgcaccacatccatgctgcaatggtctagagaaaagatcaaaggagttatgagactagaaaatctaacctgaaagaaacacatagcagctttaatgtgcttatgaaagggtgcaaatgagggaaaaggatgggtcaatagagaacacaaggaaatctgaatctctgagttccaatattaactccattactat

SEQ ID NO: 29087 - DNA, 596 bp, Bovine  19866880842642
ctaacatgactgaagcgacttagcatgcatgcatgcattggagaaggaaatggcaacccactccaggattcttgcctggagaatcccagggacgggggagcctggtgggctgccgtctatggggtcacacagattcggacacaactgaagcaacttagcagcagcagcagaaacatgtgtataacatgtataacgtataccatgtgtaacatataccactttcaagtggaaggacacatttctaccctattttgttccagctcccgtattactgtttttctttcaccatgtgattaatagtacttcacaaaaatggcatttgaaattatctaagaaaacatacatattcacctacaacagatgtatttcttcttcttaaaaacataacacagaaggaagaagaaagtatgatttctttcatgctcactgcctcatcttctagattcttggtatcaacatcttaatttgtacaacattttttaaatgatggttctgttggttgaaaagtgctcttttctggcaggcctttcatctgaatgtgaactatttttcatttggacagagttccttttataagttagaagaatatattactt

SEQ ID NO: 29088 - DNA, 932 bp, Bovine  19866880861528
tattctttgattttataaaaccaaaaattcagtaactaatgagaaaaatcatatttgacattgttctttacatttccaaggtaaattttacagtgcttttgccttattatttctaccagtttataggtagaagaggaggatatgaacctaccaagtcacaaactttatgcttcctgcctttatgttgaattttatacaattcaaacttttattttgctgtgtttcagttattttcttgtctctgagttaaagaactaaaaccataaccttgaattgtgggaacttttcaagggtactgttctgagagaataattggcattttgcttaattcctgggtatgcacatgtactctcagagtgattgtagccaccttaccaatttcttaggtgttagggacaactgatgagtatcaaagaggtacagaaatgcctcccagagggtaaaatacagtcttctgtcttcagagttcacttctccagagagggctaggatacctgccttcttgatcaacagtaagaacgtaaataaaaaattattattcaaaatactaaaaaagaaaaaaaataagtacacattcaactgtattgtaggttaaattggctgaatttcttctataggaaattgtacttagaagttcaaaacaacaaatataaatatgcatttttagactttaacgtggttgtcaagttgagtactacctattaaaaatgctgtatttcatactccttaggaaaaatgagacttcagggacaataagattatgataatagctaatagactcagtcactaaaaatacttaatcagtaagcataggtacattgtcaacatctgatttacactttcctggactatataaatattttgcatgaggcttttttgggttgagggcagtacttttcccaaagatgcaagccagagagactttgtacaag

SEQ ID NO: 29089 - DNA, 778 bp, Bovine  19866880876684
ttccctgtccatcaccaatctaaaatttatagcctgaaaacatgatttattcactccttacaacttttcatatttagcaacatagagcagaagtggaagcttttaatgaagctattagacactgttgtcagttctaacaaaacaaattaacagagatggcgtgcgggagcccttctcttatcttaccaacttcgccacttagcacacagagaaatccttcctcctatcggcgccagcggttcaccccaggcaaggaactctgtgaccatagagctggcggaatgccggggtagaggggaccggatgttgttttttcacctcccggcctaggggccggatcgggtttccacgggctgggtttggttcccgttgctgtcagactttctcgttctgccgtagggctgagtggccctggggtgagctcgccccgggaccagactcgctccattaccaaccttcaggaagctgcgtggattcctggtctcctagcaacgagggcccagccgcggactgggcccggccgcggactgagccagccgcgtagctgtccaagcgtttggggcgctatccagaatccctaagccggacccaaacgggagccgaaaccccgagcttggaaaaataagcaggaaatggcggacgaggcgttgtttttgcttctgcataacgagatggtgtctggagtgtacaagtccgcggagcagggggaggtggtgagtgctgccacacgccctgacactccttgtttccactcagttcttttcttcaacccctgtcc

SEQ ID NO: 29090 - DNA, 884 bp, Bovine  19866880978387
gcttgacatggactctacataaatgatgcaattacagtttattcctctcccagtgacctgaactagaaaccttctatgagcctactcatagtttggttcactctaaggtggactcattatagtttcaagaaatcctcaggccagatactttttactaaatcatatagcccagagcttctaacagtgtggccaatgactgtatcacagtcatctgaggatcgttttatcattcagagttctgaggactacacctcagcccactgagtcataacctgggaaagtgtaatcctggactctgcattcttaatgaactgcccaggggactgctgagcactcttaaacttaggaatccttgagggggcatcttctgtcttttaaaaaaatgagttgcatgcatggcgcatgatccctaccttttcctttcacatcttccttcttttctacctggcatgggagctataaggagctcctcaccttttctccatttatctcttgctttttctgctctctttttttgctgcctcctttctgcctctcatgtaaggaagaaccagagttacgcaggaaagagctatttgctcctgaatatgtgcagagtttctatagcacttgcataactttcaacttggtaattgtccagtacagtcattgaagaggtgctgtgcatacttcacaggctgctgagtttcaattccacagaaatcatcagtcattcccccttctgggctggatactggcatctctgtcagtgagagtcaccagaccttgaatgtgaacattcagggaagatggtgttcccgtcagttgccaggtaaggtacagatctacagccttttgagcctcattcagactggcctctcactctttctccacttatttaattt

SEQ ID NO: 29091 - DNA, 1742 bp, Bovine  19866880983914
tttctaaaagataacacacatgaatatcttcatattcttgagtagaccaaaaaaaaattttttttttaaataggaaacagacagcagtcatcataaagaaaagattgacaaattaaactgttacaaataagaacttctgcttaccaagacaccacttgaaatataaaggcaaaccaagatatttgtaatacatgtatctgacaaaggacttgtatccaaaatataggaaaaatatatataccaaaaggaaaaagataaccaaagattttcaaaagataaaagataattttcaaaatgtgaaaaaaaattaactaggcaacatgaaacaaaaaggatatatccaaatggccaataaaacatcaaagggtgctcaacctcatcggtcagggaaacaaaacccgaaatcataatgagacatcactatgcaccgaccacaatggttacaatttagactggtaatatgaaagcaactctcatactttgcaaacaaagcattaataatcttaaacttacacagaaaacctgcactgaaaagtaaggatcctagaggatcctaacatggatgtccacattttcaaaaatgtcttacctccttttgaacaatgctaaatttttcaagcagtttacatttttcttcaatcagtgtagaaagttctatagcaagctttttctctctccctaaaaaagagttaatgttatcatgtttttaagcttatttaattacaaacaacaatgatgtgaactaaaatagaaaaaaagagcttacccacataaagccggcttctaacctgaaacaaatttttaacaaaaattacattaaaacaaacatacattcaggcaaatataacttatttaattgctactgacaacttaaagtgtttcttattacctttagtataaacgtaagctagccaaaaagtgttgtatttccattgagaaaataatactacatattaaagtccccccattgaagattcacattatttattagcataataaaggctctgaaataactctaccttaaaaatacctgtttcatttcatttagcccactgctcctcaaacatatttgaccccaaaacaaactacttaaagaagcccctatcatctcccctagtactaatatctaaaataacacaatttgaaaaatgttacgatggggccatggatctgctgactataaagtaaaaaaacttttttcttctttaacctctctttcaaacaatgaagggaaaatttcaatttataaaggggtcaggcttaggactaaaaaacaatggggacatgcctgctcccccttcactccccaaatgggccacaagggccagaataaataagtgctgctgctgctgctaagtcgcttcagtcgcgtcggactctgtgcgaccccatacacggcagcccaccaggctcccccgccctgggattctccaggcaagaacactggagtgggttgccatttcagtactgagaaaaaaaagcaattgggacttagataatctacacaagatatacaggaataaaattaaatgaaacaagatttaaaagtcaaggtacagtataattagttagataaggaacaactagtgaactgaaacagattcagaaactatctcaaaaagtaacaggaggaggaggaggcggcagcaacgaatctcttataaatggtgccgaagcaggacccgaagcctaaattccaagaggtgagagagtgttgtgctttcatgggcttcttctttatg

SEQ ID NO: 29092 - DNA, 1373 bp, Bovine  19866881030590
gagttaaaggattacctttccttgtaaggagaatgctgccttaagaattgcatgttgtaaaaaattttttggaaaatacagactgtttgtttaccagacactcttgtacttttgcataattttgtaagagttatttatcaaaattatgtgaggttccaaaatatgtaaaaacaataataataaaaaaagattaacatcccttgtcatcttttttaaatatcctatactcttcagtaagaatctgtatattttaataggtaaatctttaagtctgttcccttctgtatcatacattgcttttgtagaaataaatgtgcatttatttcattagctttgggatgtcctcgttgacgcttgtataataaataccctcatgataccattttcagcttttatcactagatactaaacatgattagaatgtttttgaagatttcatcacttttatttgccttagacaattattttgagttgtcaaagtcagatctttccagctttgatgggaacatagtttgttcttcagaatcacttagcacatttttctaatctcccttgttgttttaatctaagcatttccccatttttcctgttttctcgtatttaaaccatatatttggtagataaaacagtatggcattttctttatgattatgggagcatctttgtctccatggttacttctgtgatacagcatatacatctgttaaagaaaataatcactttctaggggaaggaggtagaaaagtatttctaaacttggattttaagtttgtggtcttgtcttaacttttgtgttggccctatctgaaacatgccaatatgtgttttcaagaatttttgtttaagtatttgtgtgaaagtttacaaaatgaaggaacttcatctacacttgaatctgtaagcaagataacacgcaagtggtaccaaatgattatttgttgttttataaatttgtatgaatttggagtatctgttgcccattactatatgtgtgcaaataaatgtggcttagacttgtgtgactgcttaagactagtacttgtattaactttttgatgctttatacaagagagcacttaaattgcagatggtctttttttgagttcataattttttgtcgtgactgtagctttaggcttaattttgaatatttattatgccatctcttgacaagaaaacggtaagagttaaaatgtcaacgcatttccagcattgtataaatgttagttaacgtggtaaaagaaagatctctttaaaaaatcctttcttggagcaattattaaatagtaaacgtgtagatcttctcaagctgcaaagctagatacctgcatccctgggccagttgtttctaccaagagtcactttacctagga

SEQ ID NO: 29093 - DNA, 1514 bp, Bovine  19866881037768
agagaagatgcacagagggaaagcagagccaaagggatggagaaggaggcagagagtccagtgacactgactgaccctctggacacagctaggccttaattccttttctttcctgccttaggaaccagtgcagttcgtttattagacttcttcttcttttttttttatattagacttcttgccagcaaaagagaagagaatgtgggcctgagtgccaaatgagttttataaacagaaagagtcagggagtcagagattaagatcagagggagctgtgcaaactggggaagttgattttgaagaagtggacttatctgggctgggaagaataaaggtgtaggctgagaaaaggagggatggaagggcagaggagaagtgtatggaaagaaaaatttcttccattaatgaaatactgcaagcaataacatgtgagagggagtagattaaagcaatctcaaagcctagttaagtcttgcagaagtggaagttaactagacttcttatcccaaatcttcatgccttcaaacagttctttttcatagcaaaggcagcctaaattttctctttgaacagtatttggaaagaaaaatgaagtggagaaagacagtagttattaactaattcttccaaagagtggtctggataataacaacaaaatggtttgcatccatctaggttgaacagggcacctcttctgggttcagtccagcaagtctcacagacacaataacatcaggtacaataatgtcaaatctggcctttagcatttaaaagggaaatttgacctttaaattttaaaggaaatgagaaacaaagggattacataattaaaaatctgtttctgtctcttaaaagcaattcaatttaggtcaggagccaacagactcctttccctctaattgttttgtcttggctcctggtacccagttcttgtttctcctgtgaatagctcattaatgttgggcagatgttctcattgggtgccccatattaaggggaaataatagaggcaggattgtcatccaagagacgttaatactgactccaaaatagaatgatgaacgagaacatggcctctttcatgcctcttagcggctaacccccagctagggtttgttttctatttgacttctttggtaaacctgctattaagaaacactgggcagggacttccctctcagtcctgtggttaacactcgatgcttccaacacagaggataagagttctgcccctggtcggggaactaaaagcccacatgccacgtgccccaccccaccccccaaaaaagaaaagcatggggcaaaaatattcagtcctattcagttggtaggatgctgagactgtccccacctacccaggtcatctaatctttaacattcagaaagagagaaagtagaaatattaaaaaatatcatggagatggacatttgaatataattaatattaaatcaagagcaaaccactaagccaatcacttataattctgacgatacatgacaagtcattggaaaag

SEQ ID NO: 29094 - DNA, 947 bp, Bovine  19866881111070
gacacgaatcataaaaaaggaacagaactagggcttccagagtaaatcatactatttcctctacaagttttatcctgtcttttatttagaacttggataagccatcagatatttctagaatagtagagtcatagcactaagcagacttaaggaaaggaggctttattaacttcatcttgctttttgtttcctttgtagaccttgatcataattcccttttccttgaaatgtcttttggacattattctatactttttggaaaatcactaaagaattgttccagagaatcataggaataacctcatgaaccctcagcaagacagttttaaggtgaataataccaaactctctgcttcaacaacaacgttttatcttctgttgaatcttcatctcagtgatttgcaatggtactcatcaaataatatgatggaaaaagggatgtggctggagatgaggccaaagaaggatggatcttgacagatggaactaacttcaaagagaggagaaaattgattttggtttgtgctaagtgtacttggaaatagaaggttgtagtctttatcccttgagtgtattagtcttcatatatcactaagtcccttgggtaaaatggctactaccactgaggtgcttgtcacatcagatttatctaatgcatttgctgcagagttttattcttctcggtcaatgtggcatatgaatccatcttttttgtgtgtttttaaggccttatctcggtcaaaaaaatctgtattaaagtcacaaagtctctagagcaaaccttggagaaaggtgtgtgcatattgttccaggttgattgttattgaaatgtagatgcaggacttactattgtgagattaatgaagaaaattacccaccattgcccacattacttggcaatttattctctccataaggagagaagtaaaattcaaagaacagcaaag

SEQ ID NO: 29095 - DNA, 1565 bp, Bovine  19866881231313
ctttacaaactgcatttcttaaactgaaaataccagtatcaatagtgtacactgagcctgtggcagctttctctctacttcctaatgggatagacattgaattccaaagtcctgcatcacctgctgagaagttttattctgggaaccttgtatttactactgactggttcaatttgattagattttcattcataatgtttacaattccatagaagaaataaatgaagtaatctcagagatcctatcaaacatttatgtagttctctaaaagatgggtttaacttgtgcgctgtagtttttgaagaagcattttgaaaggaaatatgtaaaagcatacctctaaagtttagctaatagagattttgatgttgtgatgacaaggagcagataaggagcagactggaaccatggagacttaaacccagtttttaaaaaaattttgttaaggtgtcttttcttctcttgggttattatgtatttgctcagtgtttaacacacatgtattgtgcatccactgtgagcactgacatggattccaggtacgcagatagacacaaaacagagctcctgacctcatggacgttaaccctggggggaaggtggatatacagaggaagtagacacacaaatctgtgtatgagtgtttaatacagtaagtgctatgaaagaaagtctccctgtagagtcctagggtcaagagaacgttcatcatatttgagaaattaaagaagccatgtctcctggggtgtgaaaccaatcaggataacattaaaaatgcttttataatgctcttaacacactagacccagtgccaagagttttactgaccttaagtttttactaccaccttgtgagatcagtacatttattgtcttcttttcatagatcagaggcacagaggcgataagcaagttgtccggtgtttcatgggtagagggtttgaacacagaagatcttcatcactgccttacaagaggaagagggcagggcccaggcaggtcacacaggctggtggcttggtcttcccttcgctttttatcataacctgtggcttcaaagttttaatcactgtgtgaaagaacaggaagttacctgacttaattagataaaaatagtagtgaaataaaagaataattttttataagacagcgtgtaagtgaactttcaaaatgcacagccatattgtcatttgcaaagatttctccatgaagggttgcatatggaagaaaatagccacaaagtattttcacatcttggcatggatgattctttttctgatcatggtattaatatgcccttcctataatccatgaaggatgtgtaacatacaacccaatgaggagacctagctcttttgtattttctaaggcaagaaagctgtgcaggtgagtttaaatgtcatagcaagttgtgaagaaatgggcgtgttgtattttttttttttttttggtcatccagtgtagattagtttttctgtgaatttatttcaagctttaaataattaattattataaacatatatttaaaatgtttagatttaatttcctacttatgccacatgcatt

SEQ ID NO: 29096 - DNA, 746 bp, Bovine  19866881295410
attttgatttaattagcctgatatgccccattcacctcctctgcacattctcattaaaaaaagcaaatgccccaggtgtttttaatattcagtgcttctcaaactttaacttcatcagaattacctggagggcttgttaagcctttgctaactgggcccttccttgagatattctgattcactagatctgggaagggggtgagaatttatagtttttcagaagttctcaggtaatactgatcgtttgcagatctactgccgagccagtacatgcgttcaatttcattgcaatgctgttttatgcagtacacatatgtattttttctggctgaagaaagtgggtgtacacaaaagtccatccattggtcaattggtaggaatggtttcagaggtgggaaaatcaacactgtgaccaagtgcagagaatatcacttgataaagagataaacctgctaggagaaaaatgtcttcatacaaaggatgctcacttacagatttactagtttgaaattgtcctctaggaagagaagggatgatttaggggtacctggtaagcaatgatatgttcaataaaggacatttagaaagaaagttttagatttggaagggagttcagcttctttttctctggaaatatctccctaagcaacagaatgaatgattcacctttccaattccttgggtatcagaatagctaaagcaacatagcataattttcagaaatagaaccctattaaactttcaca

SEQ ID NO: 29097 - DNA, 2370 bp, Bovine  19866881378819
aaggcaaaaataatttgaagtatataattcatcacatcaaatgtaaatggaataaagactataactcccaattttttaagaattcagttatattcttttgaatagagatgtaactgtaatataaagactaaaagaatgaggtaaagagaattgctatatattattaaaaattcttattcaccagaaagcattacaaatctaatcttgtaggcactgaaaacatagctcaaaatacataaagcaatattgtaagagttttaaagagggatttgctaattcactattacaatgagaggtttttaacatactcttctcaaaacattgataggacagccaaaaatcagcaagcaatataatttacaagcttcatctaataaataactaatagaatattgcactcaacatttggataatatgcattcttctaatatattcatgaaacagtgatggaaatttatcgtgtatatgactaaaaagctaccttcaaaatgtttagagaattggtacatacagacagtgctctctgggcacaaattcagttataaattaaagaaaaaagataaattttagaattgcataatgaattttaaaacccatagatagtcttcccaaagataaaaaatataaacctgatcaaatctctatatccatctaccaatgtcctggaaatattagcatagaagaacatgctaaattatatgacaattcaatcactaaaactcagaccgtgatgaaatctacaggacagacaacccagctcttgagacacagaaatttctagaggtgggagtacagaatggaggagaaaatataaatttaaaagacattccaactagtatcaatgtatggatttaatttgaatcctaattcatacaatccatacaatacttttgccacctgatgcaaagaactgacttattggaaaagactctgatgctgggaaagattgaaggcaggaggagaaggggatgacagaggatgagatgtttggatggcatctcagactcaatggatgtgagtttgagtaaactgtaggagttggcgatggacaaggaggcctggcgtgttgcagtccatggggtcacaaagagtcagagatgactgagcaactgaactgaactgaatccatacaaactgttgggggagggcattgagagaaagttagatatccaaatacttactggattttgatgctccctaggttcgatccctgggttgggaagatcccctggagaaggaaacggctacccactccaatattctggcctggagaattccatggactttgtagtccatagggtcacaaagagtcagacaggactcagtgactttcactttcacttcactttttcattagtattactaaatgatatgatgtatggtatctgcttcaaaaaaagagagaagatagtatggtatataagcaaaacaagattgcttatgagccgaccattgccaactagctggtagaagcatgagaagtcattaaattattctactttgtacatgttcgaaattatcagtaatgaaacatttaaaagaaactaacgaatttattttttgttgtgtgtgtgtgtgtgttttgtctcccccttgttttatttttattgtatcggagtatagcagattagaaactaacaaatgtagcataagaatgaaaattacaagccagtctccctcatgaccatgtgtgccattgattcactcatgtttctcaactccatgcctgcccttttataccgtgttctgtactgctggggcttgaagtctacaaaccacatttcccagcttccattgccagctggctctcctttagaatcagctactgggaatctaaagctactgttggaaaatcagaaaggacaagctgaaagattctttctttgggctccaacagtgtggagcgagaattttaactcctgaagcctggaccaaagcaccatcttttttcctggtcccaatcctggtcaagacagcaccttttgaccaaccaccagttggtccagaaccacctgagacagcttctccaatagcactgtggcaggtgtgtaatgggtttcaactcaggggcatccaaagcttcttatgcttagatatcacccccttcttcctctatactcctccaggacctctacttctccttctgcacctttaacaaatgttcagccagttccctaagttgaattccctttattcaaaatacctagaagtggtttctttatttctctttcttaggaagagcgcttcagtaatgaagttttggaattgagttgctggcctgttggtgcttaagtgcaatcataatctcttacagtagtctcttactgtaaatccacaacttgcaattccattacaatttcttcagatcat

SEQ ID NO: 29098 - DNA, 1825 bp, Bovine  19866881484873
tcatttctttctttcttttttttttttcattccaagtcattttcattgattcttgtgggttctaaagttagggaaaattccctgacttctattttaataaaaactgtgttgatgaaatgatcttaataatccaatccactaataatgaaattttattgtagcaagaaagtttcctggagtattttatatctggatttttaaattcttcacctgatatccactttcttatttagaggtatatataaaagcctaaaataaggaaattcagtaattttcagaggatatcagcaaattagtggcaaacatgagataagaattcacagctcttgtggttcttctctggcatagccacagacatgccataacctctcctgaaaaggacaatcaattttattacatgttttcacaggtgaattcataagaacttgaaaaactacataatgaagggagacaacagcactggaattaagagcttagagactggagccaggcagactgagctcaaatcctgactctgccgcttactgcctatgtgactttgaagaagtgactttagctctttgagtcttagtttcctcatttgtaaaatacagataagaacagaacctattgcacacatggctgtcatactgattaaatgagttaaattgtgtaaagcaaatagaacaatacctgacacacgcaggtggcctataacattagtatctattttagaaaatctattcttttataggctacatatatagttttattatattttattctatattttattctacattcacagttaacataggaagtaaggtatcaaaaatgtgacttaaactagtaataagccaatagctcctttttttcttcctataattatacctgattttttttccactttacacattctccacctcaattcacccaatcccagatctatttctcctagtaaagacaaaatatatatgggttttctaatttatatactgcgaccttatttgaaatgataaatactaaatgctcaactcaatcttatcaaaaatttccagttgactgatctcaatttttcaactgtaccctttttctctttaacatacacccaggattgggcagagagggccacgttttatatcatttagcatatgaagcactacagcatcagaggcctccagcaccatcacagaagcagtgctgcagcggcgcccccttcaggtcatccatggataatacttatactggactctcgatttctgacaaaaagaaaactaaggtattagattccataatttttagcaaaatgcttgggtatcatgttaactccctaaatttcaatcatcaatttagcttaatggttaaaagttcagattctggagttagaatgacataggatcaaatccaaacccttgtcacagtttatgtgacttggggaaagttaatctacgtaagcatcaatttactcttctgaaaaataagattaacagtactcacctcacaagtgttttaataaataagagtttatgaaaatcttagtataatgactaaaacagtgcagattcagcttattattatctataaaaatattaacataatttctcttataaaagtcatatgtcaagaaaaaccttaggctcttggtttctttcttactcctaattatcacatttatttaattttgacatttcaaacaccattacaaaaaagggatgctttcaaatttaacaaaatataaagactgagaaacactgatttaaatacatcagaccaaaatttcattgtttttagacacatgaactaattcaacatagactgaaagatctttgaaatagttttaaaccaa

SEQ ID NO: 29099 - DNA, 704 bp, Bovine  19866881718809
cgccagcagtactataactcattcctgaatgaagcttatctaacacaagtatttcctgggtaacatacatcatagcttcctgtgcttaggacgctagataacattgcagtactatgctagctggccatttaaaatagcaaaaacaccaatgaaaagcaaaaaaaataagagaagtgtggcactggatagaccatacagagggtacctgtttacagtatgagagctgaaacaggacagcagagtgtccctttgtttgacctcagctgggaacatgcgcactgggtgactcaaatgtttccctctctacacatatccacaaaggactgcaaaaatgctgcacgtattgatttggagttataaataaattttagtgagtcggcagattttctagtaaagcatccatgagtaatgaggatcagctgtattcctttacaagacattagccagaactgggtaacatggtctgttctcagaacaaccagtgtccatgggcatgagatttttaccagtttagaccagtgatgatttatccccctggagttggcaacctgcatgctctgaaatcaaaagatctcttgttatttcaacaaatcacagttcccttggcagggaagagtgaagtggttgttgggtaagcaatggacgatgtctgctgtatgccctaacaagtgcttggcgtctggaagggacccagtacatttttg

SEQ ID NO: 29100 - DNA, 2565 bp, Bovine  19866880473169
tgggtatatctttccttttctcctttgcctttagcttctcttcttttctcagctatttgtaagccctcctcagacaaccattttgcctttttgcatttcttttttcttgggaatggtcttgatccctgcctcctgtacaatgtcacagacctccgtccatagttcttcaggcactctgtctgtcagatctagtcccttgaatctacttgtcacttctactgtgtgactgtaagggattttatttaggtcatacctgaatggctagtggttttctctactttcttcagtttaagtctgaatttggcaataaggagttcatgatcagagccacagtcagctcctggtcttgtttttgctgactgtatagagcatttccatctttggctgcaaagaatataatcaatctgatttcagtattgaccatctgctgatgaccacttaccaactgaacaacagcaaaaggaagcttcaataccccacttctattaaatcttaaaattgtattttttaaaagaaaagcaaactcaaaaactgttagataaagaaaaaagatatataaacaaatttagaaatgaaaaaggaaacattacaatcgataatacagaaataaaaaagaataaactaaagacttcaccataatacctgatactataaaactcctgggagaaaacatagggaaaaaacttcttgacactggtcttgacaataatattttggatataattcaaaatatgatatatgttatgaaagcataggcaataaaaaccaaaacagacgagtggtagtacattaaattaaaatgatttgcatagcaaaaaaaatttttttaagcatttttagtaatgtgaaaaaaatttttgcaaaccatgcatccaataataagttaatttccaaaatatataaggaactcatactactcaataccaaaatacaaatattacagttaaaatgagcaagggtctaatagacacttctctaaaaaagaaatgtaaatagctatcaaatacataaaaatttgctcaatatttctaaatctcagggtaacacaattcaaaaacacagtcagatatcaccttacaccaacttggtgtatcttgcaactatcaacaaaaggatggaagataataatttaggcaaagataagaagaaaggaaacccttgtgaatctctggtgggaatgtaaattggtaccactcttatagaaatcagtatgaggattcctctaaagaggtaaatagggggtgccagcaattatccagcaatcccacttctggatatttttccaaattaattgaaatttatatcttgaaaatatatcagtttcccttatgcaagatttgtggtgattgttcagttgctaagtcgtgtccgagtctttgcaaccccatggactgcaggactccaggcttccctgtcctccactacctctcagagtttgctcaagttatacaaaattaatagagaccttggagaaggcaatgacaccccactccagtactcttgcctggaaaatcccacggatggaggagcctggtaggctgcagtccatggggtcgctaagagtcagacacaactgagcgacttcactttcacttttcaccttcatgcattggagaaggaaatggcaacccactccagtgttcttgcctggagagtcccagggacgggggagcctgatgggctgccgtctatgggatcgcacagagtcaggcacgactgaagcacatatctatctatctaatagagacctaatgggtaatgcggtgatggtaggtaatgatatgaaatacttgacatttgcggcaaggataggtaatcagtaaagcacccctagcatccactctagtagttatagaggttgtggtatatgaattagtttgactgtggtgtgctttttacagtgcatacatttatcagaacatcaactcatgcaccttaaacacataggtttatatgtctaagatatcatcaaaaagctgtattaaaaaaaactgatgaaatggtttagtaaagggactcagttcttgctaaatgtgataagacaacagctttaaataagacatactctcatagtatataatatatcccaggttacaaggcaaatacattaaagccagagcttatttcttatttcacaagagatattgtttgtttggggaatgtgattgagttgctgtgcatattacaagtttaaaagttctaaatagtatttaaattttcattgtgaaaagtcttagaaatacttaaaaaggacaagagttggggaaatatactttattttttgtttttgttgttttatggctatacaaagacaatgttataataccaaaactggttatatttttttctctgaaagtagaaattcataaattctcacttcattactcagaaaacttagtaaatttgccatcagtttttcaaagcctcattaaacttcccagaactttcctagtagaacaaaggggttctgttgaagtcatgagcaatattgcagtaatttgataattaatttaaaagctcattttattgttcctgggtactttttttaaagtgctgtttttatga

SEQ ID NO: 29101 - DNA, 795 bp, Bovine  19866880610988
aactttgtttacatggaatgctgggtttgagaaatgcttgatttattactgtgaaaaagtattcatcctaatacagatgtagaattactgctagaaatcagcaatgtggagaagctttaaaagcacaggggagatcttgtgcatagctctttaaggtaagtgttaatgttctataatattaacacacgcttcacactgctgtcctgatgactctccgtaaagaattactttattcattcctctaaaactcttgtttatgatttacttttattgcctaatactttataaattataattcacttctttgcacatttgaagttgcttttaaagataaatagaatactataaatgttatatattttatacatattaaaacgcaatgaaaataccagaagtatgaaatgtaaatatatttatttcatttttaattgttttggtgggatgtttgtaaaatgtaaattaatatctgtgacaacaacttgtcactttgttctttaagttcattaatgtactactaataaaactgtacctttttttaatgacacatacaggaaaataaaaacatagtttttactacatctgtgttttcacttcctgggtttgatttgtagagttcacagatgtttagagcatgtccttagaagacttggctgccatgaacagggccggtggtgagctgcttcccttgggtgcataaccctaagaagacaatttctggcccaccagtatgaaatggagcaggaccctatggcccttccctccgtgtcttttgcctgcctttcatctgtggaaaca

SEQ ID NO: 29102 - DNA, 983 bp, Bovine  19866880715700
tggcaatagactcaagtattcttgtgtggagaatcccaaggacaaagaaacctgacgggctacagtccataacgtcacaaagactcagaaaggaccgagcaactgagaatgtataagctttcaaagatttgcaaagatttagaggtatatttcacctagagatatgcttagtggacatgctctggtagtggtttagtcactaagtcatgtccgactgttgcgacactgtggactgtagcccatcaggctcctctgtccatgggattctctacacaagaatactggagtgggttgcgatttccttctccaggggatcttcctgattcaggaattgaacccaggtctcctgcattgcaggcagattctttactgactgagctacaagggaaagctgtggggattaattgggaaacatagcaaatagccctcctttagtatttcttgaattacattttgttccaggtgatagtcactgatctgtttctaatatgaaaaataaaacaagtaagagattatttgaaaatctgatatcacacaggactagtttcatatgttcctaatgaaaaaaggaagtttttatcaatgccataaatcatttgcacatggggaaaataacaatattagaaaaagtaaagaagactcaccacttcttcatgtctgcattttcttacattaatcccatttatctgcaaaggaaagagagagagaatttgaagagcatactgtgaactgactgtatcttggtgacacatggaaaataatggtaaaatgtatacctggagaattgcgtccccaataaagagcagtcctgacagttcagctgtgaatggagaaggagaattgactatgccttgtctactttcttcacacagaagtaagagttcttaattcaataaagccaaaactgattgagggcaaaggcaaagatggaggaggattaaaggaaaaagtaattaaagcaaaaagtaagatggtctataagg

SEQ ID NO: 29103 - DNA, 1542 bp, Bovine  19866880823172
ccttgttgttgtcttccgttctaatataaagtgacatccccaggtagaacattggtaaatatttcataccagaatatgaaaataagatgagacgtttcaagggcaaaacttaattcattaactgtcaagaataaatttaaacaacttgaaaaatgttcatgacatttcctgactactatctgaatattcatgtatttgtgaattattgaactcacattttaaaacactattcccaaaactagaacaaaagatatctgccctaataaaacctcaaactttataaatgacaatttgatacagtgcaaagaaagacattttaatgacatgaatatgagtcactgacttgagaaaatgaataaattctcctaaaatattacttttattcaattgacaatataaagccaaatgatgaacttgatacatagaaggtgaatactcctgtatgaaattacattgtcttagtaagcagtatcaagactttacaattaagcaaatttaataaacacccaaagtgccaacatcatgaacaagtgctgatgggagctatgtttcagacagagcacgcctagaaaaatcttctaaaagactaatattatctcctgattcattgttcaaaatggtttaatgatgagaggggtaaaaaaaatctctttcctatatccacgtgtttgtggttggaagtaagtagttatttagtgacctcattgtaagaaatggaggctgtgggcatccgctaatttgatggaagagaaagaaagggcaaaaggaaacaaaacatgtctgagtcctatcttttgggggagatgaacgagccaggaagaggactaagaaacttaacggatgtgttctgtgggaaaagaggtgatcggggatctttaagtccatggaattcagcttagtacttaagtaacatactttagctgctcctagagaaggggagggtttggtctaatgattgtcagatagctctgggcagggggaaaacatcctctggctgcttgaaaaggctgaaaacacgtaaagagacggctgctcaattttctgattaaaatcatcctcaatccctgagctcaagaacagaccgtgaagggataatgatctcccagcttgctttgagagaacaagtaaaagctgaccgccagctccattttatttgctgcttccactgacctttaaagagtaaaaacgtcatctgaatttttgaggacaaagtgaatgcgtattctggttttcactgtttacagggattggaaggtggactgccaaacagttatctttcaggatagaagcctcagattttaagctctttctattacactctaggcaaacagagatgagcctggagttcagaaacctgaaccccggatcctgtaagtaaaggacagcagaacttcggagaaggctgcgtgcagcactgaatgcccaggggagggtgtccttgtgctttagcgccatcgttggtgcatgggatccaggggtgagtgatgggggaagcacccctcagcacagaacagcacagctgcaccagtcctcgaagccagg

SEQ ID NO: 29104 - DNA, 926 bp, Bovine  19866881524941
ctctttcattgattaaattgactccttgcttaccattgggggcttccccaacagctcagagggtaaagaatctgcctgcaatgcaggaggaagaagacacgggttcaatcccagggtcaggaagatctcctggagaataaaatggcaacccactccagtatttttgtctggaaaattccatggacagaggagcctggtgggctacagtccatggggtcccaaagagttggacatgactgagcaactgagcatacacacttcattgacttcagctctgttcacaggttttggaatcatatgtatttagaattattattttaactgccttagcagtcaggcacatatatcctcaataagaattcttcctggaaaataaaatgtgcattagacagataacagagatatgggggcaaacaaaaaataacactgttgttgtaaccaagctaagtgagtatgtaagattcatcatctttcgtgccattgttcacttttattaaatgcattgggtacctccccaggcattcaacttcttctgaagaagttattatttctttactctagttgacaggaaattgatcaaatctgcttgtagaaatctaaatgatatctgtaatatcagtgagttgatcatgttattttgaacctgtctaaagcatttttccagaactaaagtcttataaataaaattttaagaagtaagcttcatgatattttcaaccagtaaatatatcatgttatcttaaaagaatggagtacaaacaattaagtctgtacttatgtatatatataagtacttgtgtatatatatacttgtgtatatatttgtacttgggtatatatatatgcacaaacttccaaggtggctatataatattttatatatatatatgaaatgtagcaaaatatattctatagtatatcataca

SEQ ID NO: 29105 - DNA, 770 bp, Bovine  19866880555691
cccctgaaggtgcttatggtggcaatattttaattatttttaaattatttttgaaagcttaatttcatgcttaaaattattttaaatgcatttcagtgaaatatatttaatttttctaacaaaatgaattgtgaaagataaccccatatacttactgatattgtactgtttttattcccttaaaaatctcattttcagatgtttcaacctaatattacaggtgctgaaaaaaaatgcaaactcttattcccttagttttgctgaaaaacaggctaaatgatactttcaagtagtctaggttatgcctcttgaaaatagtttctctgaaagttttatagaatttgaatggaaaatgttttttgtaataaatgttattaatggctaacatttattgagtgtttattacttattaggcagtattctaaatgctttacatgttttagttaacttaatccttacaacattaccatgaagtaggaactcttattgtattcacattttacagatgaggaaattgaggcacagagcaattaagtagcaattaaggaacttttggcaagtttgttgtttacaaacaagcaaatttaaaaaatgtttttgctgaagtatttgtttgctgaagagcttcaagacaataactaaattgtagatatcatttggggcttttatataaccaaatagttgataaaatattgtcaacccctgaatgccttaaataccacccacctccatccaattacaaattctaaagaattttgtcttgtggaatt

SEQ ID NO: 29106 - DNA, 1188 bp, Bovine  19866880575291
ggtgcctttaccttctttgcctctgctctgccccatgatgtctgtggaagcaatgggcttcctctcacaccaaattccatcaagattttagggcgctttcaaatcctcaagaccatcactcaccccagactgtgccagtatgtggatatttctaggggaaagcacggtgagttgttgttttctcatattttgtgttctctaccctgaaaccctgattaggttataatatacacagtgtatcattttggatgtgagagctggactataaataaagctaagcaccgaagaattgatgcttttgaactgtggtgttggagaagactcttgagagtcccttggactgcaaggagatccaaccagtccattctaaaggagatcagtcctgggtgttcattggaaggaccgatgttgaagctgaaactccaatactttggccacctgatgcgaagagctgactcatttgaaaagaccctgatgctgggaaagattgagggcaggaggagaaggggacgacagaggatgagatggttggatggcattgccaactcaatggacatcagtttgggtggactccaggagttggtgatggacagggaggcctggtgtgctatggttcatggggtcacaaagagtcagacatgactgagcgactgaactgaactgaacatgatacacagtaagtgttaattgctcagtcctgtctgactctttgcagcccaatggactgtagcccgccagactcctctgtccatgggattctccaggcaagaatactggagtgggttgccatgcccttcttaggggatcttcccaacccagggatcgaacctgggtctcctgcattgcaggcaggttcttaccatctaagccaccagggaagccataataataaatagtaaacatataaagtaatcagagtgtgtatgtttgcttgccatcacttttcgctccagccaaactgagtcatttgagttttcctgactgcatttgaatgattcatatttctcagatctgagaatcaggatttttaatattctttttcagggaagcccctatcctcaagcatatttcttcatctctccaaaaaggaaatgaaagactaatgttagaaactttgtgttctgtcgcttatcatgtctgactcgctgtgaccctgtgggcggtatcccaccaggttcctctgtccgt

SEQ ID NO: 29107 - DNA, 1165 bp, Bovine  19866880599596
aataggcaaacatttctagaggaacatactttatatgcaggactatagacttacaaatgatgcatatatattcttaaaatatcctgattttaaaattaataatcaagataatttgagttcattaaatacaatgtaaggataaaaaaacctttcaattatatttttctactctatctagtctattcctctattcttttcacataaaattgccaaagattcttaatgctcatattttactacataacattcagaaggcactttcattcttttttcctaatactgttaatcagcttccaaccttctcttttctcttttacctcaactcccagaagagcagcccaggttaaacctctcataagaggaggaatgtcgactcttgcctctttccagatttgattttttttatatggataagcctacagataaaaaaaaaaagatatgaaaaataccttgaattaccaatgccacctctttagtctagccagttctcaatataccagtgaaaaagttcaaggtgaattataatgtttttaagtgcctgaaattactttggtgttattaatacataaaagttagcagtgaaatagttctctatcttctgtaaatctcgtattacacaatgagaggagttgattctactgtttttagtcatccctctctatcttgtgctctgtgagaagtaagaaaaagactcattctgaggataatattatcagtttcatacaggtaaagtaatataagtaaggctctttgtaaaatagctgatgatatagaaagtattaaataaatatgttattattacagtttctcctatatctttgtatacaaatttgcctatttgtaaatttgtatgtcatgagaaatttctagaagagacatattaggataaagggtatggatgttgttaatgctcttgatatataccttcaattgttttacaaaatgtttctatcaacttacacttattccaaaagaatgacaggttccaatcttaatatatcttaattactttaatttggtatgcaagaaaaggctattttacttttttatatattttacttttttacatttctattaatagtaatgatacattctctaatagatttactgactagttgtatttctattgtgttctttatctatttcccctgtttagataatagtg

SEQ ID NO: 29108 - DNA, 1356 bp, Bovine  19866880611071
aatgctgtgctgcactcttaaaaatttgttaagagatctcatgttaagtgaggtcacacacaaataaataagactcaaggaaacttctgctgtgagtgcgtgtatgctcagtcatgtccaactctttgcaaccctaagaactgtagcctgccagctcctctgtccatgggattctccaggaaaagaatactggagtgggttgccagttccttctccacgggatcttccccaccaagagtgtacccgtgtctcctccactgcaggtggattctttagagccaacatgtagattttatgggtgcctgcatatatccaaactcaccaaacatatacattaaaatacttacagttttcttgtatattaattataacccaattaaaatgtttaaaaataagttaaaatgagaaagtcctattcctatcagcttcaaaccatcagttctttacagtatttgcaaagtttccaagaagagatgttattcaggttgcaagaaacacaggccaagaaagagaatgagaggtcaggctcgcagacatagatttggaagtcatccacagatggatggtaactaaagtcacacatgctgtttcctcagatccataatccatgatatttaagggccactccataagccaaaatacctatacagtcagcaaaccaaaggaggaaacacacttctggattctatgagttcaagatgttctttcaccttataaaatccgatcattcccacagaaattttccttttggtctaaagctttctttactaggtattagcctgaggtaaaaatgtttagaaagaggaagcacagatgaaatatagttagctactgtgtgatttaagaaatggaaaggaaaaataaaacactagggattaatgttcagataataaaataactgtataactctgtgttatctttaacctaaactctcctcctataatttcaaggtaaaagagctccactagtacagaatttttaatgattcactggtgtgtaatttaagaatttggagaggggtattttcagtgatgaactactgcatttgatgcttttaacttgtcttttatcaattactaaattttaaaactttgttaaaaaatcataacatttaacagcaattttttcttctaaaggaaaaagaaaaaagaaagcttttggaattgaaaaggaaagtaactcatttcactactggcacacatgtttgagcctaaaaggatacaaaatttaagaattaatttgcttcagattcagatgtttaaaaaaggaagttgcattgattaactgcttaccaaaagattattttgtaatagatctaaaaaaaaaaaagtccatctgtccataagttattcataa

SEQ ID NO: 29109 - DNA, 1324 bp, Bovine  19866880697285
caatttagactcattgtatttccacattgtattgccagtgtgctttgtgtgtgtgcatttttaaatggttttccctaatagctcttaggaaatggaaattgtttcatttactgcaatggaatggctgccctacaatgtagacttcaattttccttccttgcctgtgtgctgcttatggaataagttgacagaggaggtgagaaagcagacaagaattgaaagtctaacatctgtcccataggctattgacagagctgacaagaggttgactatcctcaaaggcagtgaacgacacatacccatgttttccatattgttccatgacttggtctggaccttcacatgcaaggttcctgcataaggaaaagaagtttctgatagctcttttgctcttaactcttgctgttaaagaactgccaatttgagtcagctggggattacatggaaagatagtttcgttgcatgtggattattttctttttgtttttttcttcttccctttccttcaacttcacagtattgtttcttttggctaatctggtggattcctggaaagtttatgggacttgcgggagtgtgttgccctgaggcaaatctagttcaacttcctagttaaggcacattggtcctggcttattgtggagtgggtctggttttgggccccctgaggaagggagtatcctgtctttcttaataatgaagcaaaaagatgactccagaagagaattggcggccaccaacagggatgctctccagttctccactgatccgtgcaccacctcctgggcagctttgtaaaatctctcatcagtcttccttgcagttttgtttattctgtgttattttgtaaatgttgtgactggttaaccagagtcagaaggttagcgtaacttctgttaaccctgcaaaactgttttgaagtacgtgcatatctgcatacatgtagatatatagatatagatatatatatacatttaccaacattatataattgtcattcaaatcactgtgtcccatctttatcaagctccacaacacaaaagattctatgatccgcatacacacagagttcttccgaggacctagacccctagggaatgggactgaatgagtgagaaggagagactgaatatgtaagatttaatttaagatctactgatgcctgttgttttggtagaaaccacagtaatgcatttttctaaactacatacgatgaacatgtttatttcaaagctttctacactgtctcttgtggaagcactgcagaaagttaccatcaggtagtcattctcatacactttattttattgacagatgaaacaat

SEQ ID NO: 29110 - DNA, 1583 bp, Bovine  19866880703447
tgaagaggaactaaaaagtctcttgatgaaagtgaaagaggaaagtgaaaaacttggcctaaagatcaacattcagaaagctaagatcattgcatctggtcccatcacttcatgggaaatagatggggaagcagtggaaaccacgagagacactatttttttttttggctccaaaatcactgcagaaggtgattgcagtcatgaaattaagagacacttactccttggacgaaagttatgaccaacctagacagcatattaaaaagcagagacattactttgctgacaaaggttcgtctggtcaaggctatggtttttccagtggtcatgtatggatatgaaagttggactgtgaagaaagctgagcgccgaagaactgatgcttttgaactgtggtgttggagaagactcttaagaatcccttggactgcaaggagatccaaccagtccatcctaaagatcagtcttaggtattcattggaaggactgatgttgaagcttagtactttggccacctgatgcaaagtgctgactcatttgacaagaccctgatgctgggaaagaatgagggcaggaggagaaggggataacagaggatgaaatggttggatggcatcactgcttcagtggacatgggtttgggtgggccccgggaattgatgttgaacagggaagcctggtgtgctgcaggtcatggggtcacaaaaagttgcacatgactgagcgaccaacatgaactgaactgaattattttgcaaccacttttaaaaaatccaaaaaattaaacaattggctactacaagcaaactatatcttaaataacacatcactgtagccatcttaaatgttgtactactttctcatcacttcctcctgtttatctcatttactttggtacccaaactcatcactctgttggaatattcagtatatttatgtcaccatcatttcattgttccctattccttaacatgcatcttttttatttatcaattattagtctttatctcatttaactggttagcatttgacattgcccattgatcacttcctcttgctttataaacttccttcactaggtttccaaggtaacacagtcttctattatttcttttgttattctaccaatctagtttttcctccatcatctcctttacttatatcttatcttctcctcaatttcttaattttgaatgccataggaactaggccttccatctcatctctaaattttcagtttctcgtttatatgatctcttcccatagatttaaatactctttgtatgtcaaagatttgcaaaaaaatttccccagactagttatttcctcccaaatctattcttataggtcccactacttactctataaatttataaattctataaattttctcagacatactaagatacatttaaatataacttaactttttagaaactaaattcctgactccagttaaattctttcttactgtctagtccaaagtccttagtgtcatgaaggacttcattcatttacataccatatccaaattcatcaggagagcataattgctctatcttcaatacattcacactcatccc

SEQ ID NO: 29111 - DNA, 929 bp, Bovine  19866880718745
acatgtttgtatgtgtatacacaaaaatatccacacatgatacttgcttagtatcttacatttttagataaatgaagtactctatgcatagtgctttgcatacaactagcacatagttggctttcctggtggctcagatagtaaagaatctgcctcaatgcaggagacacaggtttgatccttgggtcgggaagatatcctgaagaaggaaatggcaacccacttcagtattcttgcctggagaatcccgtggacaggagagtctggtgggtcacagtccatagggttgcaaagagtcaaacatgattgaagcggcttagcacgcacacacacacttttaaaagagaatgtggatcattttctagcaaacactaaattttattttactagtactttaaaaaattatgccagcacctttattttggactgttgaatattcttgaggatattagctgcatagctccttttaagagagataagaattactgtggtcagcaataaattccatttaaacatagtgaaataattttgtgaataactgctaggtgactgaatgtttactttctgatgactatctagccacaaatattttctaatcatgttaatatgcaggcagaagtaagaagttagatattaaacattttttggtgtatttgcataaaatattgtgttagcaaatgaattttgcattattgacaggcttttttttgccttttcatactgttcatgctgatgctgaagctgaaacttcaatactttggctacctgatacaaagaactgactcattggaaaagaccctgatgctgggaaagattgaaggcaggaggagaaagggacgacagaggatgagatggttggatggcatcaccgactctatggacatgagttagagttagctccaggaattggtgatggagagggatgcctg

SEQ ID NO: 29112 - DNA, 1952 bp, Bovine  19866880861513
aatttcccaggtgtgaaaagttgagtgggttttgaattaacaagtatcagccaagttatcttagagctgaaaacttaagtgtatgcatatattgagagcctatctctactgggatgtatgatattctaatgaatacatctacagaaacaaatgtaaaactttgtcacagccttaatatgaaggctcatcatgtcaatgccattgtagaaatgagcagaagttaataactggtacttgaacaattcaacgtgcatcatgccaacaagaaagtcaagagtagtagtcagccttttcatttaaaaggattattcttttttcctgcaattattgagcccatggcttggcttgtttctgctgctgttgctaaggacaacagcctgccagataggaaatgatgttgatgaagacataaaataacacttacacacatattttactcaaaaatccagagaattgggaatagggtaagttaggaaggaggtgggagtaaggaaatggaaggaaaaaaaaaaggaggggggaatacatagggtgaaaaaataaaatatacaataatctgctgaaattccagatggctgactttcaacaaattatttcactgttttgagtcctttctgtaattttctcttatactcctatgaattatctctgccaaaactcacaaaaagttaaaatcataagttcaataagtaacaatgtatatataaattactaattcttttccatttcaaagagctgctatctgaagaagatccagttttacatacaggcatattagccatcagcaactatctttcattattatcgtaaaactttgggttatcatgcaaaaagtactgcaagtgtgtactgttaatagaagtgttcctggtttaaacacctactttatctaacctattgctctaaactgagtgatgtcttcacaggcagacttctgggacagacgtcatcacaggaccacacccttggtagcagcatgttcacagaatcaaggcatgaaatggttctttagaaaggcaacagccaccaacagcagcagcctagttttaccaagtgattcttcctatatcacttcctcagcaaaaacaaaaaaaacatatgaataaaactgacaagacatgttgaaagtacttaagttagctatgaaggattaaattttttacatataattctctaataaaacccatgacagaagacagatataggcttcccccgcgggctcagcgggaaaaaacctgcctgcattgcaggagatccagattcgatccttgggttgggatgatcatctggagaaggaaatgacaaccaactcaagtactcctgcctgggaaatcccagacaggctacagtccatggggtgacaagagtcggacatgacttagcaactaaacccaccaccaccatccctctcactttcattagaaaaggaaatagatcttccttaagtaaaattttggaaggcaaagctttctctacaaaacagcaattagcaatattactgttagatgagttaacattaatttgcttcactagtttatgttctctatcttggcgacagttttagtttatacaccactgcacagcacttagaaccaggacttgtgtcataattaagtagtcaaagtacacagctaacacagtacactttgatattcttatatatttaaaggtacaacatataacttccctagaaaattcagtgaatatactcatgcccgttttaacacccttgtcataagcaatagtgagttgctcctccacccaccaagaacctgagaggaaaactgctgttatttatgttacactaacacacagtagttattaacagatgtactgtctttccagtctaagaaaattgcaaaacaatttgaaactttatcagttacattaaaccaggaaaaggcatcaagaacagggctgaccagtagcaaaacacctaaaacagggatttc

SEQ ID NO: 29113 - DNA, 2860 bp, Bovine  19866880946271
cgttagaagaactgatgttaaggctgaagctccaatacttaggctacctgatacgaagagccaactcattagaaaagaccctgatgctagaaaagattgaaggcaggaggagaaggggatgacagaggatgagatggttggatggtatcactgactcaatggacatgaatttgagcaagctccaggagacggtgaagcacagggaagcctggcgtgcttcagtccacggggtcacaatgagtcagacgtaactaagtgactgaacagcaacaacaatcttctaaatctacatggtgaataggtcctggtttgagttagacacctggaatcattttaatggtaacttgaggtatttataccaccacctgcccatttgactttttcatggacttccttaaagatatcccctgacaccaatgactgattatcattctactgtaggaaatagattatcttagttttctattagtctaaccatatttcccacaaatttagcagcttaaaacaacacacttattatctcacagacactatgaatcaggattctaggtgtaagtaggttctctgcttcaatgtctttcaaggctgcaaccaaggtgtcggctaggtatgtcattgttggcagaattcagatccttgcatatgcttcgtttccttgctggatggaggctgtaaactttccttaactccttgaggcttcccacagtttcttcccacatggggctccccaagatgactacttgcttctttaaagccagcaaaggagagagagacaccagcaggatgggcactaaaatattttacgatgtaatcacaaaacaatgtgcgtgtaaccatccaatggtccatttaaatacatctaatttgtaatacacaaagattatcccaagtcctgccctatgatatgtgcaaatgtgatttgtgtctgttgttcctacatggcaatcaaaagcctcgaattatttatctcctccaagatcagaagaaagttcctcctctgcatacagcaaactttcaaagagctatgctaatcctgggaggaacactttgcaaaagactcttcccactttgatgtgctagcttttaccctacattcaaacgcaaatccctctctattcctacttttatgagatcactgaggaatggagctgccataaatttctcctctaaagggtcacattgtatgcaaagaataccaagttatttttataaaaatgttaagtctctaagtgtttttaaaaatagtattaatggggaattctgtcagtgtgtactgctcttactaccaagtctatatcttttcaagttggttgcaacttgatcatccaagattagccagctgtcctaaacacgactttattttggcttcgaagtttgtgtgaccttattaggacacccctggggtggggggtttactagcagtgctcactgttaaatatcggcttaattcccacccctgaccttcttctataaaaaagctgtaatttccttgggcatgaaggaaatcctcccattggtgggagtggttggcagtccctgttatgagatcactggctattttgtccaaggtgaaacatttccctttgacctggcaaggccatttctaaacccacagcattttcagaggaggtgagcagtgccaacttgcaaaatgggttaatctgtttgtttcaataattttaaaatcctaaactcattgaataatgaacatacgatcttaactgctttaattaaaaaatatcattcattaaaaaaacttctttcccaacaaaactcatgaaagatgtatttttgagtgtacagcttgtgacctgaacgtgtcaaccactcttcttcacttcttcctctataacattagtgtgtctatgtctcagtgcataatgttccataattttaaaattcactacaggatagtagatatttagaaccttgaatcattctttaggatatttcatatttctaatatttccttctatccttacacttttggtgggggataccttttttctctcttgccattctaatttccctctagagttttcctttttattacttgtccatacaactcttggatgtgtggggggatgggggttcagagaggggtggatggtgattggtgttcccccttctctgggctcctaccaacccacaaatttaggaactcttccttttctgaagtagcaaggaagtcactgcattctcctttctttactctccctctgtcttcccaggaccagtgaatagtgtcaggctagacctttggtccatagatcctgttgggtggggctagtggagcctcacgcctgtctctctttgcctgcctgtagtttccacatgtttttctcaatcttataagccctctcagggaagatcgtgctcctggagggcggtggggaacagtcctgtaattgttcagctgctttggctaagaaagtctcttaggcgaatgatgattggtcatttagtcacaaagtcgtgtctgactctttgtgaccctatggactttctgactctttgtgaccctatggacttcagcccgccaggctcctctgtccttgggattttccagatgagaatactggagtggattgccatttccttctccagaggatcttcccaaccaagggaccaaacctggatcccctgcattgcaggtagattctttactgctgaggcacctgggaaggaagccatttgggttgcagatcccagcccccttcttaaatcttgcttagcagtgatacagatagtcttttggtctctgataacagagacttttaaatttattcctcatctagcagagaagggggtgctatgagttcatatcctcaaataccaataaggtgctatcaacctagat

SEQ ID NO: 29114 - DNA, 1551 bp, Bovine  19866881051698
tttatctcagtgcactttacctacccacctcccattattaaatggaagtgatgataatagtgggacttgcttccagatacaggcagtaagggctgaacacttagatcattttcttcttcgtcattggccagctatcatattctaacactgaagttggtttaggcccagattataatggagaacttttaattagaacagaatgaaacagtaagaaatgttgtacttgtccaaacttaagagcctaatggctttatgaattcaatgtcattcagtatgaaaatatatgcagtacttgtatttttcacccagaaggtacagtctggttgaggagacagatacgaacattagtacaacaaagatgtcagtgaatgctgtaatacaggtaaagttgaagtcttgaaggactagaagacggaagacaaattgtgattaattatatttatgaaggccttatggagaaaggtgcatttgatttgtgacttgaaatgtgcctagaactttcaggcaaatggagatgttaggatgcctttaaaggagtattctcctttattaagggagtattctagtgttcagaatttagctactccagagttgggtgatatgtggctcccaagactagattttatctagttaatggagtcaccccctaataacctcctgaccatttcacctcttctaaagatgatctctggtgtatattatcctgggttttagctgactagtattatcatgctcaacatgtacagaaacctaagtccaagaggtctagtaacttagattctttcgtgtgtgccaaaaattaaagataacatgagctcacaggagaaaaccagaagaaagatttcagggaaaagcaaaatgttatttttcgagataagttgtttcacccctgtctttccaccatcctaatctgagtttgggtatgttatgagtatgtttattaggttttgctggaaggtggaagaatttgaaggacacttgagaaattatataattattacttttccttttcaataaatagtcgaatggttcattgcttggcttccatggcataggctgtatcaggaattaataaaatctaaaataaaagtcttttgcctttgactgtgatataacatctgctgtaatttcctttctgcactcagccaccaggagcttgctggagaaaagttactaaactcaaaatcatcccattgtgtttatgacaaactattgttcttagaccagtttgataagtatttacttcaccttcctttaggaatatcttatttctctaagattcaccagcttccaaacaaaatgttggctgttttactctactaatctatttgacatgcttacaaatgtctgaaattttatcacacccaattcaggttgacctctggaaccccttacccccatattgaaaactacttaattggctccctcagggacacacagaaaattggatagttcccctgcttctaatccactagggaacactatatgtagtcactcacccacttgcagaaagctggaaaattattaccatgtgagtagaaagaagtaata

SEQ ID NO: 29115 - DNA, 1271 bp, Bovine  19866881060321
gtacttacttatccaagggctccacagttatctagagacatgactgcaagttatttctttcaatactggaattggtctggccacaattcaccagattttctaccttcaatgtggttcataggcatgtttgccttctgcagtaaacttccagaatgaacccattatctacaaaggcatctaaattctgactctagcttcactgttataatgctttaattaccaagaccttagaggaataatccactgagctcaactgcaaaaccttcagatctacaaatttcccttattgcctactataagttcccctgcaggtggcctgcagagcagctgggagggagcagtgaattttgttgctcattttcttctgttgtttttcagtgaaatgcttttgagtctaaaagattcctattggcctgtgtcttccctatttctatttctaaaggactaccaaccactccagcctggcttttctgggaatctaacctcctgcacttggtcccaggcctccagggaatgttgccatggttcactggagcaagtgaagggaaggaaagaggccagcaattacaaacagcttgtgactcattttcagcagcataattgggctcacagaggagggcctgtccactgaaatagttcaaagtcctggagaaacaaaagtttatggtttatctattcaaaagaatactcaacagccattcagacaaggtagtaaaggcatgtccaacttcagggaaagctgtccgtaaagtgttgttaattataagcttctacctggagtttggagagtgagcataggttcacacaaaacaaaagttctgaaagaatacatacccaagtagcagccatgcctattccaggttgaggtataatgtcttcctttgttacttccttcccctccttcttttttttgcttctttctttttgaattttctcaatacttttcagtgagcatttatgacttttggcatttccagaaatgttcattgggttctctgggtactcctgagtacatgttcagaccctaaagcctcttcctgctctggccttcccccacctccctgtagggcctatggaactcgctactctggctctgcagtaaatgagaacactttgaaaatcaggcctggtacctattgtccaagtgatcctgggaagttttattactcaatggccctcatatttcttgtctgtgaaataaaaaacttagtaatgcctatagtcaagcactgtggtcatacaagggaattatgttatccaatgaggccaat

SEQ ID NO: 29116 - DNA, 1619 bp, Bovine  19866881076857
acataaaaatgacttaaatctacatacagcaatgtgaatggctcttttaaataaatattgttgactaaaaaaagcaaatcacaaaggaataatggcagcataactccagtactataaagttcagatatgtgcttgactaaacaatatattaatattttttagggttacaaacctggtaaaactgtaaataaatggaagggaattatcaacacacaaatcgggacttttagtgataatttcatattcattatttaaactggttggtaggtacatgagtgttcttttaagctttattctttacaccttattcatatttaatagtctgtattttatatttactaaggcaatttttttaaaaacttatgttggtgaaggttaagggaaagaggcagtcctatatactgcttataagaatataaattgccataagggcaacttggaaacacataaaattttaaaattcatctaccttgtgactttgtagtaccatgtctaggaatttgtctttcatctatgtatttatgggaaatgggatatctgtaatatatccatgtaagcattttaagtagtagtcaacttccaaatatcctccttcagagttgtatcacataaattaagtgtatcaatgcaatgaaattattggcagttttcaaaaagaatgagacaaatctatacttatttataagaatgatctctaaaacatattttgagtgaaaaagagtacagaatagtgcatatactatacttccctatagggcaatgatgacaaacgatcaactttatttgtacataaatagtgtgagtgactggagtacagagattggagagagtcttacatttcaatttatatgtttttacagattttgacattcctactattcaaaagaataaatactattttcaaagataaaatttaaataagagttaagtataaagagaagataggcagtaaggaagaaggaaaaacacctcgaaatctggaagtctgaaggcaatgtgttaatacagaggaagaacaaagaaaagagctaaaagtgagataggtttaacattccttgagaaatgtatatttcctcttgattcctagacataagacctgtgttatggtagttaagaattcttcctagcaagagttgttcattttatctcattgagcttttgtatggattatactgtactgatagtaaaaacgtaccactacgtacctatttccccctttctagctcatggtaataaattcattcttaaattataccattttaggtatccatcatacttggcacctgaggtaattgcgcaaggaattttcaaaaccagtgatcatgtgccaagtgaaaaaccattgccttctggccccaaatcagatgtctggtctcttggaatcattttgtttgagctctgtgtggtatgtataaagaaatattaaactaataaaaatagtgtgtttattagaaaaatattttggggtaggaaagctatttagtaatagcatctttttatcttttttttgcaaattgactagatatgaggattaaaaggctgaaatctcaatttgattttttaaaaaaccccacttgacaatttacttgaatattattttggtatacctaaaactattt

SEQ ID NO: 29117 - DNA, 745 bp, Bovine  19866881079285
agaaagggcaaaatgaaagatttaccaaagttaaaatgttaataggaaggttggtttttggtttttgaaatcgatttgttttattgtgttttgttggcctagttctcaggtgtgtagataatatgaaaatgttgagactatttttaaatttgagtttgaaaaaagattttatatttttaatatagagattattaacagtgaatagtggtggagaggtgtgatgaaatggagaatttttctaatattttcattattctgttaataatcacatacttttagctgcatgttattagtttgtatgtgaagtctttctttctcctcccccaccagatcatagccttcagtgttctgtctgtaagataattgtttaggtgaatttctgtacctccaacaaaactacaggctagaattcatcaagggcaaggatgggcattttcgtaatgagatcccaaactgagtttcctgctgaataactaatcttattaaagcaagccctcattaatcttccatcattaaaatgcagactcctattgcagaaaagattgtgatttctggctcctttccatttgccgtgggtcacagagctctgaatactgagtactgctgtagcttgaaaagttgggaatattgtgcattgatgtgttgctttagattgtatgtatcatggtagttatgcaatttacatttaaatagggtgagtaatgtgtatttggaaaaattggggccacagtgatttttatcattt

SEQ ID NO: 29118 - DNA, 1319 bp, Bovine  19866881163796
ttgcttattttctctctttcctcatttctagtgggactccacatatataatttccaatttagactttctaggcaggagagaataaagcctatgaatcacataacagacaagacttattttgaaaaaaaaaaaaattgttctcaattgtttttggagtttgaatgtcagccctcatcccttgggtttctgtgactatgcatgctataaattctttagtagtaagagtaaagcacttgttctctcactttattagcttttaaacagaaatggaagttgctaagttttatgagtttattgcacttaatcaaaaataggaattaggaattttaattttttagtattagaaattaaatctatttaaacattctgaaattaaaactgcttcagaaagattagttttaaaatcagcaagccatacaatcaatgcttctatcttcttttgcattagattacaggctctataggtattttcctcagccttcacctgaagctgtacatttatgaagataaaataaagaactcttgattactctagttctgctttcagtcattcagtgctgaatggggcttttctaaaagaggttttgtctgaacggaaggtgtgcctgactgatgaaggaaagaatttgactaaagtattctctatgaagaactgactgatgaaagagatttgaccttggcgttggttccaatcaaatgcatcatttgtgaggagtttcttcaaagaaaagactgattgccttatgaaatggtaagaaaagaaggaaacaggagtcactgacaagttcataactttctgaaatttcagtgtgtatcatcaaagaactttaatatgttgcaagcatgttcgtctacaaatcaaatttaggagattagtaaattatacttaggaaaaattatacaactttgctttatgaagaaaataattataatactaaaaaattcagaatatagtttttcttttattagacagttttatacacaatttcactattcactgtacaatttccacttagaggcataaaagtaaaacttcctttataaaatttaaaccttctttagtatcattgatattgatattttcctgtatgagtaggatttcaaattcacagaacattgtttatggacaatggacaagaattgaggataactacagaacaactctgaaaatttctattatcatttctgcctaagaacgtgtacatacaatgcacattaaatttagatgtccaaatatcagaaatcaattggaatgagaatgactttaaaaaaaataatattccatttccaaactagagtcaaaatttatttagcaatgt

SEQ ID NO: 29119 - DNA, 922 bp, Bovine  19866881169519
tgctgattagatacctgcccatgaatctgcactataacatacctggcagaggaaccttaacactatttcagttcaacaccatttattcattggatactttcttcatttctggcataattatttcttgctgctgttgttgttcaatcactaagttgtgtctgactctgcagcctcatagaccgcagcacatcaggcctccctgtccctcactatctcctggagtttacccaagttcataatttcttaagccatccttactctgcactggtctgagaatagactttggctctcctcatttcatgaattttcagttgatgttagttacagccactgttgggcagtctccaaatagccccttactttgattgtatttttctttacattgaaagatatatatgtttagtggaagaggttgttaaatagaacttttctttatattatgaattaaaatcttagaaccactcccttacttggaatatatgctatagactccagacagcaaattaagaagcttccaaaatatcctcatccatgctaatttaactagcagctatgactgaagatgaactgagagtggaatttaatttttggcaggagtatcccaaagcagccacgctatctgccgcatccaacagtcttggcatgggatcaaggtaattctttctgagggcaagtctttaagatcacagtctcttaaaacgagtactctcaaacatcattggagccctgcatctccccagttttatcctgctaaatgctaggggtgaacgtcaatgttatttttaaattcatgtgtgttggtatagagaggaataatgggaagaaagagactattaaaaaaaaaaaacacattaaaaggctcaaaaagaggttgaacaaagcaaattttattctagtaataaggggacaaccctcttcccca

SEQ ID NO: 29120 - DNA, 1018 bp, Bovine  19866881188100
aaatgtcatcctactggaaaaatacagatactgcaaaaagcagtatgcaaaaagttcagtatgtttcttgtttgtttttaagactgagatagcaatatgtcactcccatgggaaccccgcttcttttttggaatgggcactggtggtcctaactgcatcaggctacccgattagaccttgcaattcttttagaaccccctctgctccatgattcaacaaagaatgatataattaactacagctgacttgaaggagaggctaacgatcaccaagcagaagtcaatccagcccgtgccaggtactgtgctgggcacaaggaatatagtgacactgctcttgccctcctgctggttagtgtcttggggaaacctcaatgtggtagagaggcagttccaccagtgctttaagagttactctaggggactcgaagggctgtagaaacacaagctacaggagtctcagccaagtgaaaaagtacacgggcttccttcctgggtaagtgtcagctaagcttgaacccaaagggtaagtggaaagtgtgtctgtatgaaggagggagatgctgagtcactttgctgtacacctgaaacaatgtcaatcaactatattccaattttaaaaataaaaaaaaagaaggatgatgaatggagtgttttctaggtcaaagaaaagatacaaaaaaaaaaaaaaaaggaggcaaacagagggggtattacaatcttactccagatatccatcctattttcacctactacttatcctcctttacttccaactccagtttctagcctgtcggtagcccctttctctctaatcatccattgctcaacccaggaacctataaaacaaagaaaatgactaaggagcagccactgaaacctggaaccaagcctacattacacttaaaaatttttattttctgcagaaaaaatattttgactactacattttttggagttcattagaaagatctgaaatggatgacaccaagctgtttgcctaaaataatttcccaagc

SEQ ID NO: 29121 - DNA, 1576 bp, Bovine  19866881236708
attacccagaaaacacttctcaagtgtttctataaacagtcaagtccttgatataccaggtcaaagttggcctttaacctttgccttctatgtctttgctaggcaccaggcttgaagaactggagaagtccttgtatcagcctcccagtaacacgtggaaagccaaagagagggactaccaggaaagaggttagttagctagtttctaggtctattattcataaaagagaagaaatacactttagttagatcagagatcagttaagtcatatagtcagttcggtcataggtcagatagtttgctatcttaaaaaaaattaattttatacctgaggtaaacaatcttgatgatttattacttgtcagatattatatcttttctaaaattatctttaagatcattagtaatctcatgtaccatgcattcatttccatgaatttcacatcaggttattaaggacctgaaaggcatgggaggaatatgatcactggattgagcccaaatgacacaaagagtaatttgcatactaatgtgcaaccaataaaagagaatcttttatttcaatatgtaataaggattaaaagcaatctctgtgctcacacaccatcattaattatgtatagcaatacaagattacaggataaaacatctaatgcagtggtcagtatgaacacttggttttattcagtctctaagtcatgtctgactctttgtgaccccattgactgcagcacgccaggctcctctgtcctctactatctgctggaatttggacaaattcatgtccattgagttagtgatgctatctaaccatcccatcctctgttgcccccttctcctaccgtcaatctttcccagcatcagagtgttttctgatgagtaggctctttgtatcaggtggccaaagttttagagcttcagtttgagcatcagtccttccaatgaatattcggggttgatttcctttaggattgactgagttaatctcctagcagtccaagggactctcaagagtcctccagcaccacaatttaaaagcatcgattcttcagcgctcaactttctttatggtccaactctcacatctgtagatgactactggaaaacccgtaacttttgactagatggacctttgttgacaaagtgatgtctctcctttttaatatgctgtctaggtttgtcatagcttttcttccaaggagcaagcatcttttaatttcatggctacagtcaccatccgcagtgattttggagcccaagaaaatacaatctgtcactgcttccactttttccccttctatttgcatggagctgtctgtggcatagatcatgaacctccttattgcaaaattcaggcttaaattgaaggaagtaggggaaaccactagaccatctaggtgtgacctaaatcaagtcccgtatgattatacagtggaggtggcaattcgatttaagggattagatccggtagacagagtacatgaggaactgtggatggaggtgtgtaacactgcgctggaggcagtgaccaaagctcagtttgatcgtagtaactccttattctgagcctgattc

SEQ ID NO: 29122 - DNA, 1406 bp, Bovine  19866881290785
tgtaaatgccctgtcagaataaatgtgccacttctgtgcctgccttgtacaaggtcagcaacctctgtagctgattgtccctggccatggtaagccatgcaggttagcctgcacgggcagggtagttgagagaaaaagcaaggaagagaatatgaggaacaggagaagagaaaaacaaataaaaaggagccagaccaatcttttatggcttcacaacacataggaattatgattgcttcagaattcttaataatcacctctgatctgttgccttaataaatatacaaagaattcactttgggtttttcactttaatctatataaaaagaattactgtgtttttgtttgaatgttgtctattaaaaaaaaaaaaaccaagtgccaatttagcggaacctcaagtaatttttttctttaatgtcaaagtcatctcattgctaatagcaaccgtgccagaacacaagtgcaccttatttgtacagagcacttttcacattctttctttctttttgtttgaaatggacaatttgtacgaattttgacctttcttgctcttagaagcatatgtttggactgatttatttggataagatgggatattgcacctggtgtggataagactagattacatcttcaggaaattgaactttttctttttactctttagaacaaacagctttctgaaataaatatgttgggtacagtgttagctttttttttttttaacttcactatgctacatagaatctttggtcttacaataaagtggtttccttttgctttagcaaagtgatatatgcattttctgaaatttaattccttggcatgttcttgattaaattcaatgtttttgggggagttgttggcatgtgggctttaaaactttttattttaatataattcaagcttaaaggaaattgccaaaatagtgcaagagatatccagattcaccaattattggccccatttgctttatcatttatactcttttctttctctctctctatatatgcatgtgtatatacatatatatatatgcatattttttcaaccagtgagaagttgaagatgttttgcccctttttaattcctctacccattttcttatgtaaccacagtacaatgatcaaaatcaggaattcatatactgatacaatattattatttcaatattctatattcaaattacatcaactgtcccaataatatcttttatatttattttttatctggttcagaacacactctaggatcatactggattcagtttttatgtgtctttagttacctttaagctgaaatgattactagacttttgtgtattacctatgaccttgatttttttttttttggatgagacatttttgaagagtatagacaagttatttgaagactatttccatcaa

SEQ ID NO: 29123 - DNA, 1173 bp, Bovine  19866881316345
tttatctatgattgtacacattccctctagaaaagctcccatttggcctttcagtcataacctattttttcttcctgttggcactgcactcacatttcattggctaggctccaggtctatggagaggaaattgaaaatagagaatgttagaataaacattgtagcaatgagaagtttcttgccaatagctgaagattaagagagaagaactataaaaagcagactaaatatactaattctagtaaaaattagaaaatacatctctataacctctgaaggcattgttataatgctgtattgtgtaaaattgatagtcatagtcttggcctcagtaaagaaagtttaaattatattcaagtttttaaaaggttaacaaatatgcagccagcttaaaaaattccaaaattgtagatgttttcagttgtttgtaattgaaaaaagaaaaagcaaaaatgaaacatttcaaatgactagcaacaagaaaatagataaattatattaaaactctacaatggaaaaacaaagtacagttacatatatatacatggatgaatgttagaaaacagcaagaaatgaaatttgcataaattatgtataaaatacaattccatttacctacagtttagaagtattcaaaactaaataatatagcattagggttatacatgcatgtagcaaaaaaagaaagccagtgcaatgataaacacaaaattcagaatagtgacagtctcagggcagggaaagatgagggagatacaactgggtagggaaatatatataggatttaagagtattagtaatgttttatttcttaggctggacattggatatccagtaatcattttattaccaatagtgttatttataatatatgcatataaaatacatttttatgtaggggatatttaataacacaaattttactttttaagaaggttatgttttagttatctagaaaattttggtttatgagaaatatttccaaaggtttcagatatgtgattcattattattattattattattacaaaagaaatataaaaataaccagatggctatatcagggagctcatttaaaaaacaaaatatattggtttacttacctacagatacctcctttatattagaccattgagtattaatgtacagaaggggtttctatagggggaaatt

SEQ ID NO: 29124 - DNA, 904 bp, Bovine  19866881643294
agtttatttggtactttattttcccattaattttccacaagaaggggcaggcttggcagactgtaatatcatagaagtaaacatccaatagagtagtaggacttgatttgaaaagttcaaggagaaggtaatgaaggagtagctccttagaagctactagtgtagatagagcaagagctttgcttacttaagcatctttttccaagaatctactctaattaattaagaaaattttactattattttggataatagtaatttggataatatttggataatattttgaattttggatctaggagtcaaaacattagaaaaggagttgaaaattaatgtagaaagaggaggaagaattgtataaggatagaaggaatggagcagaaagatgtatggaaattgctttgtcctcaggcccctttcttggttctttccgtaggttatttagtaatatagcaacataatatggtagtgttttttgcagttaaagaatgaatcagttcattaggaagagagaaataggtgagaagaggaccgatgacagacacatttgtatggatgaacagagaagaggaacttggcaaagaagcctgagagaagcattctgagaggtagaaggagactggaaaaaggagtcactacaggcaaagaagagtggtcaacagcattaattttgtagatcagtcagtgactgcaaaatatgagaaaaatctacttgtttgtacaaataagaaggtggacatgttaaaggaagtgggacaaaggtgggacagaatataagttgcagatggttacagaataagtatatggcaagggagtggagtagaaaactaattctgtgaagagaagaattattactcataacttggtgatgcaggaataaaggaatgagccaatggagggggct

SEQ ID NO: 29125 - DNA, 1174 bp, Bovine  19866880404619
caaaggaaatatgcatgagactgcgtcctgctgtttgttgctttttctgttaagagtcctctctgagacatagtttagcgttctgtgtggcagatttacttttgttaatgttgtaagcagtgttttaatacagaatttatgtactgtgattgttgagaatttaaatgtactgttggaaattttacctttggaaaggggaaatttacagagattgtactgttcttgcttgtcttattataaatttgctgaatagttctagtatggggcaaccttacttttcactgtaaatatactgaaactttctcttttaggctgggataaacattcgtatggttaccatggtgatgatggacattcattttgttcttctggaacgggacaaccttatggaccaacttttacaactggtgacgtcattggctgttgtgtcaaccttatcaacaacacctgcttctacaccaagaatggacacagtttaggtactaaagtaaccagatggggtgcttatgtacttacagcatggtagtaatggttattatgtaattctcctttatgagtagatgcctctggagattatttctttgttctttctaggtagaagctgagaaaatggtgaaaatttaaatctgaagtattatgtaatgggcacatattcaattaaaaatcttaattttttacgttgaaggccacatgatatcacacctgtgggactaactagaaataactgcatgctcagatatttattctaatagtggaaatgctgcatgctttctgctctgctttgaataaagcccttcacagtatgatccagttttctagataccgagtgccgagaaaaaagctgtcagtttttagtataatatgagggtaatgacagagcatggaaaagcttatgctcccagcgaaatgaagggcattgacatactgaaaaatcaggcctgctaacaaaaaattaacaaagattgtaactacaagctagttctgcaaaagggagcagaattaaaatgagcaaatgataacaaaacttctaaaagacagctggcaaatagatagattagtgaaaacatgagaaaatcactccgctgtaagactaacaggaattagggggttttggttgaatatctgtactacttcagatttaatacttttatgctcccttttcttagattttttt

SEQ ID NO: 29126 - DNA, 1923 bp, Bovine  19866880414308
ctctaggtttttggagtttgggtgagatctctggaaacaagcaagttgtgtgcttttccagttaattccacgtgctgctgctggagcagttaacaccaaaaggaaagctgctcagaaaggacacatctcaccatcagcaggtagcagtttcctccgaagtttgggaaccgtgctgtcaaaaggccttctcccattttctttgcaaagatgatgccagaactcctaattcccagctgctctatttatttgttttttttctccctcagcagtcaggaaccaggctctgatcacagaaattttgggtgtgattagcctggcctccttctcattcccaatgtggtccctgcacaaaccatccataaaatgtcagcatcttcccctcctgaagtcgaccagcatggggcagggacagcggccggccagcgctgctcttcctccctggtttgcagaagggcacatggccatatggttctgggagatgtaaaaccataatgttactgctgagtgatccacaataaaagcacatgcagccgcgttccccggattcctgtacagtaggctaatccacttaatctcactgttagcttccccgggcggggatttcacagtctcttttgatttagtggtttgtaaaatctctgattaagtgcctgtgccctcccgttattatctgtctattccctacatgagttgggaggaagaaaccagggaagttgaaataggggtcaacatgccctcatccttccctattgggtttttctttattgttgttatttttaaaatttaagtggttttgtgtgtggggagggaggttactgctaatgacagcatttaattttttaagtttttacatgtgcccctttaccttgacatctgcacagggtcctcccagctgaactgaccttaaattgatctctgttgaggacttgtatgttactaggtctactcgtggtctgagtccactgctctgtgtgtctttaaaagtggtaaggagcaaggctgatgggatcagacagatttgactttgagacttggttgtgtcatttgctagctgtggggttgtgggcaagtcacctaacctctctggtctcaatttcctcatctgacagtgaagattaaacaccagtacctaggtgctgacacatagttctcaataaattatgacaatagtagctatcattcattcgaggggatgtagttttgcacaacaatgctttgttttgggacatcctgttaagcccttagctgtgtgtttttctggcacctcctcttagattaagcttgtagaacttaagaacccaagtttttcattcactttgtaattgctaattgcattcagtttgaactattatccacctgattctctgccccttaaaaatgctgataaaaatatttggggaaatttgccttggacagtataattatagaaataatagatattcagttgaaaatctgccagttatattgaagttcttgcttaagttttaaattaagttgcaaactagttgaatttgtgcccatccataaggagaaattcaaagtgaaaaaaaaaaaattcagcgtttttgatgtttgttattgtttggtttggggggtttcatttttttccccatggaattctcttgaagactgttcagactaatgaaaacattttttctgcctcctccttcctcaatacctttcagagaaggggaatttggagtttttttttttttttttccatagacacttctgagtttgaacagtcctatcatccgacccagataatcacgatggggtgatcactgacctagagccagacatcctggaatgtgaagtcaagtgggccctagaaagcatcactacgaacaaagctagtggaggggatggaattccagttgaactattccaaatcctgaaagatgatgctgtgaaagtgctgca

SEQ ID NO: 29127 - DNA, 1900 bp, Bovine  19866880597174
ctgttattttgcggatatttttggcatgtagtgtttgttcttttaaagggactttagacattatgaccttggctttcttacttaaaaatgtgtctatctattatagtaccagagccctttcttgagatgaaatcttagggagaagaccaagatgcaaactaggtcaaagcagagatgttctcagaggacggcagagacgctcagcgcgcttcccatccaccacccctattatattccagtgaacctgaaaacactgccttatagcaaagacggtttttaagagccaagataacaagtgagccaataaaaatcctcataaatactttatgaaatatttgctaacaataaagataacaggagacataagaccctgaaaggcattttcacaacttgaatgggttataatggacattatactattaattgccatttatgctctcttgctcaatggcgactttgcgtggtctctctcatcttgtgagcgagttataagatgctttcaatattattttgattcactaccaaacacatgcacacgaagagatgatgtgtgtgtgtgtttgtgcgtgtacacacatggcaacctaccctcttctttcttccaaatgctcaatgctcttctgattttataacttagatttggttatttccatgtcctaaatccagccttggtctcatagacacaaaagtacttggatttttcaaatggaaaaaattgggggcaagctttatttaacacatctggggaggcgtttttggtttccagcgccagggcccagcgctgatcacaagggaaactctgtagcagtccctttccatttacctcctctccccgcctcaccagacccaagagggcagcgcgggggctccttcctgcggctccgcctcctccccgattctctctcccagagcttcaggctcaaacttctatttcttcactgccatctgttttacctcccttttctttttcccaatccccagcttccttttcttaaattatccccaaccggagggacttgcaatctgtagatgtaaaaatctaagagaaatatggaagtaaatttgcatacaatggaatttggcaaagtgaaggagctcaaagacacaaagagattattgccattttttcaaacatgagctatcactgctggtacctggaatgaccttaagtaatacactggattaaagtttcctcaaaaattggattttttatgtattatgggttattaaatatagttcttagaatttgtggcaagatagtatacttgttttcagctggataaaagctccttttaaatattaagtttttaaaaaatgatttttctggcaaaacttgtgaattcgtgacatttgggagacaatggatgagtcatgctcagtaaatcaaaagagtaattttattataggactccttttcccatcagatctagttaagcagaagtgagcacacggtatatcgaatcctgctccttcagtgtaatgagtgttaggatcaaaaaaacaatataaaacagtctattacaatagttttcagtatagtctacacatccctgggggttcccatgacactctgaatgtgtccatgatgtcaaaaactattttcataataatactgagatgttatttgctcttttcaacatattggcatctgcactgttcgtgcaaaagcaatggcaagtaaaatgctggcatctttgggtgattccaggcagcagcagcagcctgcactgctggtggatgtacgctttcccacactggctggagaaagaaaagtccatgtcgctcaacagtgaccttgataaagcagtaagacaggtcagatctcaacacagtgcatctttgtcctgttctgtgtgacgaaatggcacgaatgaatcaagcattctgctgtgtgctatgt

SEQ ID NO: 29128 - DNA, 2984 bp, Bovine  19866880630761
gtggaagcctccagtcacctggagtccacctgctcctgctccagccctcaagctgactccaggggcaacctcgctgctcgaaacagcatgctggatgctgttccccatcgagagagcctggctccgcccagtctgctcctgggctgaaggcgtccctcctcctggacttgccccacccccgccccgccgcccagcactgaggccacagcctttaacagcccccttttgctgtcggctttggtggagcggctttgtttaaaattcaaaaaataaattttttagagggatatagttgatttacaatgttgtgttagtttcagctgtacagcagagtgaatcattatacatatacgtatattcactctgtttttagattcttttctcatttaggcccttacagagtattgagtcgagttgcccgtgctgtaaaccaggtccttgttagtgacctgttttctatataatagcgtatattgttgattgttgtgctcagttgccttcgactcttggcaaccatatggactgtggccctctaagctcctccatccatggggttttcccggcagggatactggagtgggctgccatttcctcctccggccgctcctcccaacctcaggatagagcccgagtctcctgtgtctcctgcattggcaggcggttcttaccacttgtaccgtagttagtgagtatagtcaaccccaggctttcaaggtgaaggggctttaacgatcctacaaagacggatcagcaccaacttgttccataataggagggcagctctgccacctgcctgagaacctcagcctctctgagccctggttccttcttctgcaaacgggggacgctcagccttgcccctgaaggttcagtgagatgctggctgtcgacccctttgcacgcagccgggcacagagtaagcacaaggtctggtgtccctgccagtataacccgtgtccttgcctgtgggacagactcgagggtaggaggggcgacaaggaggacttcagaaagccagaacaaagcatgcttggtttttcaccttggtagaagagtccgttcagtggcttcatatattacttatttctttttgcaggatgctttaagggacacagaggagagacttttaagaactacagagctgagattgtcctgctgttggctctggttattttctatgtaacactcatcattttcacttgcgtaagtatcttttgcaaacatctctcattattaaaagatcacctggggcaccaatcttaatgtgttttgtagatggtgcgaatcatttaataatagcaagggacctgttctcagaaccctggccttactgaggtccccagacagtgagactctctactggaggctcccagcttgttctccatctggtggttctgcatagagacgtgcgtggagaaagtgaatcaggaggtgaagaaagtttgtgaaaggtgaaaggatcctcttagggcaccagcaggccgggacatccctcaccgttcagtggtcaagacttcaccttctagtgcttggggtgcgagttcgatccctagtcggggaactgagattccatgtgccttagggccaaacaaacaaaaaataaacagcagaagtattgtaacaaattcaataaaaacttaaaatggtccacatcaagaaaaaagtctttaaaaaagcaccaacagggcttatagatatgctggaagaaagtgggaccttgcccgtccaataccgggagaggtgctcttcttcccataggtggatgagcaagtctgtccactccagtagtggatttgtctccttcatctgcccttgaactcttttctcttagagcaggggtccccagcctccaggccacggattggtagctcttgttcagtcaggggtggcagcagattaaagtgcacgaaaaatgtaatgctcttggaatcatccccaaaccatccccctcaccccaccacctctggtccacggtccctggtgccaaaaaggttggggaccgctgtcttagagattccctctaataactttggtacttcctctacgttttaagcattaaccttgagaagtcagaggtacgcagggtgtggcctgggtggaggatggctggcctgtaacgtgggtgtccttgacacgcccttgagctgttgggtgcagactccagctgagactcctctctgccccccacgcctcctcgtgcatggctgctcacctggagtgacagtggtcgttggggagcagggccagctccagtcctgacccaccaagaagtgatgggtctcgtatgccttagcaggaacaggaagtactgtccatttggggaccaggacatgggtcaccctggagctattccagggccggttcttgttgctcactgggcccttctggtcacttagtgaactctctggcccaacactcatctctctggttgctattttagacatgcatccagcatgagtgagcatgtgccgtgtacagggctttatgtaagcactgaggggatgtaaaaaggctaagacctatgtccttccttcaagaaacttacagcttggtcttgagagttatttgcatgtgagaagataattgttgtttggttgctcagttgtgtccaactctttagccaccccatggactgtaacccaccaggttcctctgtccatgggatttcccaggctagaatactggagtgggttgctattttccttctccaggggatcttcccaacacagggatcgaacgtgggtctcctgcgttggcaggcagattctttaccatggagccaccaggaaagcccataattagaatgacctggtggtaaattttaaaaacgagtgactttagtgttctgttggcaaatgcccgtttctacaggcactgactttccatgcaggaaatcctaatggcagggtctggaaatggccgcagtctgtgactccttgttgaggttcagagataccagtgaaacaatgccagcccaccataga

SEQ ID NO: 29129 - DNA, 1333 bp, Bovine  19866880648368
cgcctttcgaaatgaagcaaataccttttcggaaccttgtccagcaacagtaatgtgagatggaacagcagcataggcggtaaagcagggggtgggggaggagagaaacagagtcctaaaaatgtctgcaagcctttgagaccccaaagagaaggatgagttcaaggaaacacgtttttttcaccctcagattctctcctccattaattctctccattttaaggaatttaactccctctgagcattaagcttggtacataaactttaatgacttgcagtgacttctactagagctcttatatctatttaaaatgcagtaggatgtacgcttgctattgatttgggttcgagatttgaattgttcttatgtaggtatttgtcaaagaacagatgttttctccatgtgtcatttgagatgggttaaggatgcccaggaggaaatggttgatatagaggtctctccctgagcagacgggttagctataaattgctctgtggttttttcctaaccctgtaatggctggagtaaaacctagcagctgaacagttaacccatttatttaatttgattttgatttttccattaagctctcatgatttatttaaataggttctgaaataccaaattgaaatgtgaagaatttggcatgcagggggggattaagaaccaaaatatgaattgagtgaaatccattttgcaaatctccagacctgtccaacaaatcgctggggagacctgcacagaattacgccttaagtggttttgagcagcaatattacatctgtgtttcttaacacatgggcttcaaggaacagcttccctcctggggctctgcttcaaaacttacagttaaagcccaaagctagtcaaggtgtaaaccttaaagtctgccctagaaacttccagaatctgtggtccacacctttctgacaccaggtccacctcaaggggggaccttttccataagcttcatcccaccctcctgccagaggcagccctggcctaacccgctctctgcgctcatctttccaaggtgcacatgtgagcacatgttagctccccactaacatccaccgtttctacctggccaatagcactttaggcctcctttcctggccagctccctcccttcctgcacacaacctaagcaggaaaggtactgagtggcttgcccctttttcttccccatccttttaaaatccagccctgtgtttgcatagaggcaaaatggagtggtggttcagagcaagtgtctgaggtcagggagccttggatctatttattcatttttatttattgggttatttattttggctgcactggttttcattg

SEQ ID NO: 29130 - DNA, 1026 bp, Bovine  19866880652316
catttgcaaggattcggagaagaatcggtgtttacgttttagggacatgctttggttagacagagctcagcagagtacttcaggacccatgtcttttgagtcagaggcgcctctgagttcaagtctcagctttgcccttgaagcagcggcatgggctcagatgggccctttaacatctgtgtgccacgtggacaatgagactttgctcacaaggttctcatgagaattttgaaagatgaagggcttagcacagttcccccaagacagtctactcccagtgaaagaagtattgttattaatggggaagcagcttgtcatgtgcttccgctggaggctctgagtgctgctcctcctgcttcgctggaagccagtcagccccagcccaggctgggcagtcaagtctgcctctgggattgcgggcagggggatgtttattaataatagtaaatgaagcatcattcatctcagctgctaagcatggccatccaaaatgctcatttgcttgtcttaaaccctaactgccgctctgccacttcgtgtcatttccagctatacaatcttgtatatgaccacagaatggccatcgggcagctgagatctaatctttctcagatgctgatgtattatattagcgtataccaggcgttccgtctttctgaatcggttcttataataatgggaatgataatacctgcgcgccgtatctcacacacaggttgagaggcgtgagtacatttaaaaacgcaggaagaggctttgaacccctcgcagacaggcatattatcaatacaaaggttttactatttattacgactgtctatctttcctgggtattccattgtgaagatttgtggatggcacttcatcttttttttttttcttcttcttcttcctttttaaaggataaaattcatttctaactaccttttgaaagccaatttatgctttggccatttgattaataggagtgaggaaaaccagctcccctatcaaagcgcttttgaataattcaatgctcgatattaa

SEQ ID NO: 29131 - DNA, 1869 bp, Bovine  19866880662064
gcaagggctgagttgtaggagtaatctggatcatttcaaaatctcaagagaacgtaggagctagatctgctctcagaatctctcttgtgatgtaagtttcctgaagcatcaacaagaggtattttgtaagaactcatagcttaccagtggccaataagcacatgcaaaaatgctttacatccttagttattcagttcagttcagtcactcagtcgtgtccgacgctttgtgaccccatggctttgtgaccccatggcacacaaggcctccctgtccatcaccaactcccagagtttactcaaactcatgcccattgagtcggtgatgccatccaaccatctggaaatgcaaatcaaagagataccatttcccacccattaaggatggctagaaaccacaagtcagaaaacagcaaatgttggtagcgatgtggagaaaccggaatgcttatgcattacaaatgggaatgaagaattgtgccgccactttggagcacagtctggcggtttgattaaatttagagctacaaaatgaactaacaattccactcctgggtttatacccaaagggaatgaaaacgtacatccacacaaaaactcgcacatgcatatttataccagcattttttcataatagtgaaaatgtggaaacaacacaaatgtccattaattgataaatgaagatatccattaaaagggatattatttagcaatgacaaggaacgaggcactgacatgtgttacaacatagatgaaccttgaaaacactacgctgcaactgaaagaggccagtcgtaaaagaccacgtggtgtgtggttccatttatacgagatgtgcagagcaggtagagctacacaggcagacgcagattagtgattgccctgggctgggggtgggatgtgaggggacagggtgatcgctaaagagcatggtgtttctgggtgataaaaatgttctaaaattgagtgtcatgatagttgcacaactccgtaaatacactgattcatacaatgggtgaactgggtgaatggtgaatatgtgaattacaccttaataaagctgttaaagagaggaaaaaaaccaaaaagaatccatagtcccctatggctacctatgtaaaactttgaaggcttttcatatgttaatttttgtgatcttctcaaaaatctcatgaggtggaaacttttaatcttccttattttacaggtgtgtgttagtcactcagtcatgtccgactctttttgaatccgtggactgtagccccccagactcctctgttcatgggattctccaggcaagaatactggagtgggttgccatgccctcctccaggggatctcccccaacccagggattgaacccaggtctcccgcattgcagggggattctttaccatctgacccacgagggaagcccatgaatactggagtgggtagcctatcccttccccaggggatcttcctgacccaggaattgaacccgggtctcctgcattacaggtggattctttaccagctgagctaatatacaggaaaagaaggcacacttagggtgcagctgccacatatgcccgagctggggctctccaatgaatcccgtcactcagatacagaaggcctagcaaggacaaagtctgagccatctgcatacacagaaagacagtcttttcttaaactccatatttattacttttgaatctagggggagaggtaggtcagactgcatagacggcgttgcaggagtattaaatagaagaaaatgatggagcaggcaataaaattggttggggatttgggaatttatgagagagaaactgaaataatatgcaagcatgtccacgaaatagtgcctgtctcattcttcattatg

SEQ ID NO: 29132 - DNA, 1107 bp, Bovine  19866880750290
tcctaaatacttagaggaggttaacatttcggcagtagttagactccagacagagcccttaccctgcctgcacaaggttcttgagtccgcagtctcattctgcctgagcttgaaggaactttgtttctagggaactttcattatggtcccaactgtttagttaaatgacgtctattaacaagtgttgattttcacaattctttctcaatagttcttactatttttgctttgagtatctagtgttttacacctccgcttaaggacaagcctgaatagtttcatttgctttgagagaaaagcaaaaggaaccagtcaacatcatgaatgaatggaaggaaaaaacagtcagaaatgcgtaactgaaagtcattgagtaaagatgggcacaatttaaaaaacagagggaactttcccaaacattgagataaacagatactgttcactgaacagtgtgtacagagttgcctgccaaccattgttagtgttgaatcaccagtttttagtaccaaaaataactttgagagactgaactaacactcttaccatttcatggatccagagatagtgagtcattttcttaaggtcacacagcttgctttctgaagctaacaacctgagcacctaaccactgtcccacaccacctccaaattctgatgataatgtcatggggatgaagacctttagagaacttggcaagaggggaacttgactctaacaccttttctgctgatgttttcttcaaggaaaagagttgctttctttgtaaccaatgcatcccaggtcagcactacatcatagcacagaaccacctgtggtataaggaagtcatcattttcaaggaaaaagacctctccgtggcatggttagctcagatgtgagagtggggctgtgatgatgttgaaaagctctctctacctcaagaaggcagggcttgttgttcagtggctccgtcatgtccaactctttgtgaccccgtggactacagcatatcagatttcctgtccttcactatctcctggagtttgctcaaacttgtgtccattgagtcggctgataaactgcgactcctcttccactgaggtagaaaaataataccaggcatgtgt

SEQ ID NO: 29133 - DNA, 2307 bp, Bovine  19866880810132
accccattaacgtggaagtcatgcagtccatgggatgtgcctcattcatttcatcggggctgcttggttccttcccagatgttccctttcagcacatataaccattgttttttaaaacttgggataattatagctctgtaaacctagaggacaagattggttggctccagccagctcctcactccttatgtaatagcttcattgtttagtaattgccttattcatggagcaaagggatccatgtcagccaagacatctattcagaacactttccctgtgctggataaacaggagctggagtggtcctacccagagaaccaaaacctctgtgagatacttgctccttttctctactcaaatgcaaccctccttcagaaatggcttcaccttttctttagtaacaaatcagcccccaggtgggtctctgcctctgctggtaaatcctgaatgagtggggtggcccacgtggatgatgaggaaatgctggaccgctgagcaatgagatgaagggtgtggggcgagacacagcacggggcaatggtctatacttgctgtccctgctggggagcaagaaagtttcctctgtccttctaagttatccttctggtctaagaattaaattgacatgagacagatgaacaggagaaaaatcaaacaaaaatttaataacgcttatccatggatgaaggacatgtacactagaagaactgatgctgaagctgaagctccaatgctctggccacctgatgtgaagaactgactcattggaaaagaccctgatgctgggaaagactgaaggcaggaggagaaggggatgacagaggatgagatggttggatggcatcaccaactcgatggacttgagtttgagcaagctccggaagctggtgatggacagggaagcctggcgcgccccagtccatggggtcacaaagagttggacacgactgagtgactgaactgaactgaaacatgggtgaggggcttcccaggtggcgttaatggtaaagaacctacttcccaatgcaagagacataagagatgtgggtttgatccctgggttgggaagatcttctggaggagggcatgacaacccactccagtagtcttgcctggagaatctcatggacaggtgactggtgggctacagtctatatagggtagcaaagagctggacatgaccgaagcgacttagcactcatgcatacatgggtgaaacccaggtatgtcatttgccaaaatggacaaaaccctcaaataccatcttcagctaaaataaaaaaggaatgttgaaggtagtggtttgggacttcaaagggaaggcagtcaatcgacatggaggcggatgagtaaatggtgggtaaataagtattgggccaggcagagatgatgggacatgcagtgaactctgacctttatatcttgatatctaggctctgcctagacatcccccaccagacccagcctgtattctctgatgacatctttggggatagctctgttccggggtatgtgccctctgtctgaattctcttaggtgataaggggcaaggtcaaagtttcttcctgagacttttgggccttggttgttttcagcttgaagtaatccacacgccaaagagacattttggggtgatgagttttgctgccctacattccgaaagataagcgaaaggagagataaaagtgctaagttattttctggaagaatccagaatgatttctgggagctctcctggggactctggggtggaggagctgcacagtggcaggaagaggtaaagagctttcagactttgtggagggtcttcaccagcaagtctagacctccgtttcccagcctagaggatcccactggctattgatcgtatgtgctgccgtggagcacgtgccccagggaaagcggcccccgcccctctggtgtttcagagattccctgggaaatctacttagagggtaaagcccttgagccacagagaaccagtgtcctctaacgttcctggtgggcccaagagcccggggcggaacctcaggaaatggcaaagctccccagtacacaagccacatttcccacctcctcagccctctccctgtcctgatcctacagccccaggagagcaaacagtggagaacaagagaaaaaaacagagggagctttaaaacctaacaacaaagaatgatgcagaacagccactgaggctgtcttaatatggactcagaaggaacagagatgctatgacccatccttgagaatcaatgtgctcatgattgagtattagcaacatgtatgcacatatacatatatat

SEQ ID NO: 29134 - DNA, 993 bp, Bovine  19866880872158
tttaggctcctagatactcatcaataaaaatcagagattacaacttctgtaggattgtttgtctgtaaatatcaggacatcaatctgaagaggtatgctgctgctgctgctaagtcgcttcagttgtgtctgactctgtgcgaccccatagacggcagcccaccaggcacctccatcccttagattctccaggcaagaacactggagtgagttaccatttccttctccatgaagaggtatactttgcccttaaagcgttttaaattttctctaaatgtttccttatacactaagtaaaaatgaccactactagtctcgaaactcacaactttctcaaaattataaatatagtaaaagccagaaaggtattcttgctatactattattctaaagtaaaaacaaagtcacaaatgaaaatatttttccttttcatctctcccaaaagtgttttgctcacttcccataattctaaggaatgtattctctctcctccatcttcaatagaaatgcctacatatcctgaatatctgtacttaccaaggcccacctgtggtctgactcagtaaaatgtgatcaatccgatgaacaaaatacttcaattaataatgggcaaagatttttaaaggaaaaaaaatcactttctaaattctacatttactatttgccttaatataagccttggtaagcagaaacagaaatattagattaagtgttattgaatttgccctgaagggcttttctcaaaaggcctttcagcctcaatcttaatgaacgtgtcactctgcaacagttacataaagtggctttattgatcgacacatactcaactgtgaagattaggataaagcaaagagcttcaatgtttttttaatgagataaaaatgatgtttgtataggaaaaggagcacactgttaggaaataaagttttacatttattacacatttagggttaaatggatttttggtggggtgtcagacatactaaatactca

SEQ ID NO: 29135 - DNA, 794 bp, Bovine  19866880909790
cagtgttcttgcctggagaatccccatggacagaggagcctggtgggctccagcccatagggttgcgaagagttggacaggactgaagcgacttggtgtgcacacatgcatggtgcgtcgtagggtttcctaggtggcgctaatgtaaagaacccatctgccaatgcaggagacacaacagacatgggtttgatccctgggtcagggagatcccctggaagaagctatggcaacccactccagtattcttgcctggagaatcccatagacaggggagcctggtaggctacagtccatggggtcgcaaagagtaggacacgactgaagcgactgagcgtggagcatggcacagacaagggagagcatgctgaccattacctggtccaggtggagaaccgccctcccagctgtttacacagcctgtgtggggtcctgagaggggagtcaccacgtgaaggcgtctgggatgctgaaaggcaggtgagggagcgcgtcagttgtaagcagagctcagatgtccagcaatcttaggttggctgttgtctctcttatgggcaagcgtctcctttgaaagtgacgcctgtggggctggaggagagagctctcgtagactcgtgccaccgcgccctttgggccccacttaaagtcagagggggcagcaagagggcagctggggggagtgtgatgcaggcgtaaatgaatgccgaccttgttgggataaccggcgtgcttcagcctctgcagctgtggagtccctggggagttgtctggctacatgtgattttacatatctg

SEQ ID NO: 29136 - DNA, 1871 bp, Bovine  19866880919449
ccggcactcagaggcgcatcgctgcagagcatcgttgctgagagtggaagacggaagtaggaaactgggggttggcccagaaaagacaagaagaaacgcagcgcacaagcttaccggcttcggcggggagggaggaaacggcagataataatacactctagagataaattaataacactaagctacctcgccagggtgttacgagtgttaattaattaattattgtttgccaagcactttgaaggtggaaaggctctgtaattattatgaataaaatgtcagggataataatcgggcagaaggcagtgacctccccggcacctcatttgcatggcacgaaggattcagggatgctctgccaaggcgagacctgccgagacgacagatgcccgtcccgacgcccagcctcctcctcccgcgtctttctggcgccccccggggtccgcggcctctgttcccctggcagcggatgcccgagaagccgggtgaggtgaggtgtttacgagatggcaagcgggagcacgctgatggctgggggtgcggcctgaggaacgcccctcccacccaaaagctttccactgagccggctgttttgtttccgaggagatcactattaatatgcgtaggtttgggtctgtctcttccagagtgggatgggaggggcctgtttgaagtggggggcgaatgtgtgggagaacaagtcctcctgggaagatggggtgccaacttaggtttgggggaaatggccaccaacaggccaggtcactggctcatggagactgcaataaaccacaacctgccccccatgtatatgtggaaagggtcccgtggccctaaaggcaaagaggaaaattataatccagctgggcagagagtagcatcaccaactcaatggacatgctgctgctgctagagtttgagccaactctgggaggtgaaggacagggaagcctggtgtcctgcagtgcgtgggttcccaaagagtcactacttagggacgaaccagcaaccacaccaggcagagagtgagagcgtccagcagagacccgtgctgagctaggctgcatgacatgacgggtgtcagctcttcgaggttttggtcctggaagaaagatgtctgaggactgttgtcttcagcagatgctcccgcctccctcccgcctccttggttgacgaggcaaaagaactgcagaatatttaccagccctggcccatgtgttcgggaaacagtcctgccaatgaatgcctcttcctaccgaccagcggagaagagagaggaacacctccctaaggctcggcgagtttggcgagtttggggcgggggagggacaccaacgtggctactgggtctggacagaattttgcacattttataccagaaaaataaaagaataaacaacgaaaacctcctctatctcctagagacaagaggactccccttgtttgtctcctgtgttcctggtgggagaccctgactaagcgtccacagtgcagggatcttaggagccacgacttcgcttataaagtcagaagagcagacatttttattaggtctagggcttcccaggtggcgctagtggtaaggaactcgcctgcgattgcaggagatgcaggagacacaggtttgatccccaggtctagaagatcccctggaggaggaaatggtaaccactccagtattcttgcctggaaaatcccatggacagaggaggctggtaggtccatggggtccacggggtcacaaaagagttggacaccactgagtgactgagcacgcacaccagggcttggggaggtgcattcgttcctagggcgtcgcaaggcaccaccatctgagtggcttaaacagctcttccgttctccccgtctgt

SEQ ID NO: 29137 - DNA, 2004 bp, Bovine  19866880931138
ccaaattaagccacatccataagtcctgggggttcaaccgcttggcggggagtggggggtgggaaacccttcaactgacaacgggaggttttcctttttccaggaagggttttggcctgtgcccttagtggcctgattcccacctgggtgttgggaaattgaggcagggaccctctctcggtgtccttagggccagcatagaggtcctgtgttgcttaaacagagaggttgctgggaggcacaacctgccctgtaaccttttctttccatcctgaccttctcctggtgctgctaatacaacacaactggccatcagggtccgtgtggcaccgtagcccacgtgtagggatgaaaggctgggctttcatggactggaggacgggcctggtgtggagtcagcctgtgagctggggcctcggctctcatttcctcacctctcaggtgggaggtggcagtgtctacctcccagggctgaatgagatcaccggcagaacacgcctggtgtctgggggtgggtgttatcaatcattaggagcccaacgggaagtctaaccaaaaacttgtcccggagcaccgagtgccgatttgtgctgaaaagtttgctaagttcctctgactcctgttttcccggccacccccacgggggccaggaaccccgcaagtcaatggctttgaggctttgaactgggacttcaaagagaagccagctctgttcttcaaacaggtttataaagagattttgatacaagacaacaatacttgtcagcagtgtccagttaccgtccttccctttgtagttttattaggaaataatttcccagccggcgaggctcctgctggcatgccttgtttctctgtttgcgatcggatctgcccaccagaggggctgcccctcgagctgcagcggtcttgccagctggacgcccagagaaagacatcaccgaagggtctccggagccgatttaccatctgcccctcccctcgcctccccttctctgtagcaaaaatgcaatttgtttgacctctggggaggtttaaaacctcagctccttaattgcccccctccccccattattattattttttttaagaggggaggaaagagggggaaacggccagaaaagaaaagaaccatttaagccatccttgctagcctgccctgcattctcggctggcagtaagaattcccaatagatgaaaactaaggagctcagctcactgcgggtccctagttttcatctgttgggactaagtgggtccttttcgcaggggccagctttcccaagcagaagagaggcgtggttttccagaagtgactattgatttttccttccgtggtacagttatttccctataacttgaaacatgtgatggggagtctactctatgccaagcactgggctggttctgagatccagaaatggggaacacagggttcctccccagacatgtttctcagcaggggcgggggtgagccagttgagaagcagactcttcagggcccttccttaaagggctctgtgtgctcccgctccaggaggccccgccagagctgatggtgggagcttcaaaatggggccactgggatgcatttcctcaaggaaaggggacagatggagagagggagaatggagatgccctgggaggaatatgatcctgagatgggtgggacagagggaagtgggcctaaggggctcttatccccagagaaaaagacaccttccttcctttttatgaaattggggaggaaacgaggatgtcagtcatttagagggtgggagagaagagggtgtgggcaggttcagctttcttgaccttttattttgttgggaagtaggaattttttaggaagcaggaattaatggcatttactggggagaggggaagcagttggcttaatgggacttagaaagttaaaagcagatgtttcttagagaccattaagttccaggtcctcattttatccagtgtaaagccaatgcaggggactcaagagatgcgggt

SEQ ID NO: 29138 - DNA, 2499 bp, Bovine  19866880950972
tggttctactttgcccttagacactccagtttcactcatatttcagagaggagatcaaaactgattctttgcgaggtcctaaaatgggaatgtgtatgctagtctaatcccttgcatagggaaatgacctgcttttccccaggtttcctatagttctgatggggctataatgaacacttcctgaaaagtagaaatctaagagcatgtgtgtaagtgtgcgtgtgtgtttgtgtgtgtatgggttgagtgttagaattttgtttctaggattaaatggctagatatcttttttacatgtgctaatttccacatttgctaaattctgagtgagtccataaactagtttgcctcagagttgattttcctcattgctatcaattctctgctctggaaggcttcacagataagaggttttgaaactaacacactaactagcaacaagaataatcttttatttggaaaatggaacaatgaggaagctatttgcatcacaaatgactccatcattaaaatattccacatctaacccatttgcagtggaaggtttttgcacggctttgttttgtgtgggggcatctcctaccatgtggtttggccatctgcatatagttatggagtcaccatctctgaggacagctgaagctggtgaaacctaggggaatcacaagaataactccactccatttacttggatatatttcacagggaatcctttgtatcaactgagtcactcccatccagatatccatgggaagttcacataacctcatttccctctgtgattgttactgagttaagcacaagacagaaatattcttagaagatatatggcttcctcttcatcagagctggcctagagtggagaaacagagcccctggggacaaagcaagacactcatgaactctggccaccgtaagacaaacaatggggaccttattcttaatttagtttctaagcaaaggttttcctggtggcctcgtttttctggagcaatcacaacactcccttgatggattagcaacttgccatcgtaccatgagttccctcttgcctcccattttctttcaggagatatggattttttttttcctaattacatatttcttccctaattctgcacaacagtgaaaataaatataacttctatcctcttaaaaacctggtaatcattcagctggaagaagggctactgtttggcatagataaaaatagtctccatggtgacctgcctagaaataatccaaacttgaatttatagtgaggatgacccaaggtctctcatgcttaggaaaccttcaagctgtgatggtgcctagccagatgcagctactgtattgccctggggcttaggagccctgagggatccacatggtttatctgggttgagagaccccacccaaagtgcacggtaccaactttccccatcaatgaaaccttcactgcctcacccctactgcctcatcttgtgaagtgaggaaagctgtctgataagagaagtggaaaagagggaagaaggaggagtgtgcaggatagaaaggaaggggaaggtggtttccatagagacctagccttcctggtgccctcatcctctgatggtctggaagagcagcctctgagagccactagtctgattccccagctgcctatagaagccctaggggcactgagacatcagttctttttccaccgaaaaagagctgttaaattgcccgtggagaacagtgtgtaagctttgcatatatcacaccatctttcaatggagccaatagagccagttttgttttcgtttttttcattattgaaatacatctctgatgaagtagttggctttaacggccatgttaagtgagagctgtggcttctggaactgttggcttttctgaaaatgtgtttgagtgcatataagttgaatgtgagtgtgatgtgtctccactatgatgcagaaaggggtgaaagtgaaaagcgttagtcgcccagttgtgtctgactctttgtgaccccacagactgtagcccaccaggctcctctgtccatggaattctccaggcaataatactggagcaagttgccattccctcctccaggggatcttcctgacccggggattgtagccgggtcttctgccttgcaggcagattctttaccacagaaaggtatgaggctattttaaatttgatatggtcctaagatgagccgataggcagaatgacatttctgtccttccccaggaaatgcctggtattcattctatgctaagttgtttgattccgaagatctactggtttactcatggctcctctgtagttttcttacccaaattccgtcccacgctacttatttgcccgggagaggtcaacatttgaggacctagtacatcaggtcaggctcgaatttctgttacaactctgatgtcttctgtgagcactttgtatcacagagaaagagtctggaggacaggacacagagagctcagagaggtttccacgacattactcaga

SEQ ID NO: 29139 - DNA, 1079 bp, Bovine  19866880968212
tcctttgttagcagattttaacaatgttaattaggaggttagagtgatcattgttcatctagcaaacaattagggtgattcgcactgtagcttttgagaaacttctgagcaaaacagaggagtttccctttggcagggaggggagctgggaagggaaggagcagccgggatggggagaaggggcaaggctactcctaacatttttgggcctcggaccaaggcaaagcgtgaggaaatgtcagctgcgggtgttgcagctggtggagagcagtgcgggccttgaccttgtgggataacagtatttgcagatgcaaggtccattccccccatggttctcgtcttgataattcaggagactgtggttacagaaagcagagtccggagatctcttaatcatctggttgagtaagggcaaggatggagtgtaggacctgctatctcagaaagaaacatctggcacgtcaaatgtgtgaagctaaaggagtttgagaaaacggaagatgcaggaaggtcacactgacctctcctctggttgccctccctgagacaagtcaaaaagccctcctgtgagagctgccctccctggaccaggaggagaggagcatgcctggctccaaagacaaaggaatgccaagaaggatcggagtgcacaggcctggcgatacgtcccccggtttactcccctgacctcacacccttggccctaggtattccttcgtgactgccctcttcatcaaatctgggacagacacacccaaatctcactttcttcaggtcatctccattttgttatgaaactcctgtgacgtttacagtttacattaaatacatttgtatgtgtatctcctgttaatctttgtcaatttagtgttcagacccaatcaggcaccctaagaggctcaaggaaaactttttcctcctctgcagttaaggatacaacatcccctggaagaggaaatggcaccccactccagtattcttgctggggaaatctcacggacaggggagcctggtgggctacagtccacgggatcacaagagtcagatggactgagcacagcacagcacagcacagttaa

SEQ ID NO: 29140 - DNA, 2395 bp, Bovine  19866880986760
accttggcaagacttttacttctcatcacccccaggatagcacatctcctttttcggcccaaggaaagaatatccatactcctgttcccaattttgttctctccaagtttatagagtttcacctcacctctatggattgcaaaaagataatgttttaaaattttcatgttctaaaactttatataaaaaggcacaaaatatttttaagaggataaaaagaaaagaaagagccttttccaggaagtattaactcacaaccaagaccaggtcaagtctgaagagaatctggtttcatagctacatatttaaagaattgttctcatttaaaaattattttccaaatattttaggaacccactgtgggagacttttaaattagtggaaaagaatggaactcatgcctcagtgaaatttttattaattgagaattactgttgagaatttggaagagcttgtgtgagatttcaaatggaagaaaattttgaaacattcacaagagttccattagaaagtttgaaaaggtttgaaaagatgtgttaaaaataattcagaaaaaaaaattaggggaaagggagagagaataattaggagagaaggaagctttttatgtggtgtggtgatgaaacaagctggtgattaacctggcaggtagagagaagacccgcagatggtaattggggttgtgagtgctcaggatggtaattctttcccttcttccattcttctgaggaaataaatgctttattgaagtggtttccatgaaaatctttacaatttcttggaagagctgttgattcaagaggcttttgtgactacagacagttttaaaataatttccggaggaaagaagtttttaaagaattaatgccagtttggttatttgtgtggaaataggtgtttagcatccccacagggcattctgtagctttaatggcagtgtcacgtcttggcccatcggagggctgagttgcatcatcacaaaataggaaccatctcccttccagattgaacatcacaatgtaattctagtaaggctacaaaagatataatactgtgtgtcagggcttaatagtaaggaggggggggaagcaaggaaagtcaagctcaatgtcctatacttaacatcctaaaggacttgtatttgaagagagacagacttattttgggctttccaggtggctcagacgatagagagtccacctgccaatagggaagacttgggttcgatccctgggttgggaagatccattggaggagggcgtggcaacccactgcactattcttgcctggagaatccatggatagaggagtctggcaggctacagtccatgggtcacataaagtcggacacgactgagcaactaacactttagacttgttttactaatagttcactggaaaatgcttcaagtctaacaactctgtgcttcagccgccttcatcaggagagaatcagcactcatgttaatgaagaacataaagtattttccatacaggaccttttagagtgaatatacagtatgtatagaatagaccaaacacatctgggaaagagtaacataaaccattaaaggactggatttatgtggtttcattagcattagatatgttaataaataattgtaatatcacaagatcattgaattaagtcgagtattttcactgaggagacagaaagtggattatcatgaatttgattacaaatgctacctgaattatgggcacttggcttacctttttaggagccttatcctaatgtcttttttaaaaaaatgtgtttatttatttttggctgtgctgggtcttggttgctgtggacggggcctgctctctagttgcggtgtgctggcttctcactaaagtggcttctcttgttgcagagcatgggttctagggcatccggcttcagttgttgccccaggctctggggcacagggcacaggggctttagttgttctatatcaggtgggatcttcccggatcagagatcgaatccgtgtcttcttcattggcaggcaaattctttaccactgagccaccagggagcccctaatttccctttataaaaaaaagcaactatgtggttattcagcttttcttttaatattaagtgcacactgtcagattcttttaggattaaaagccatgggtagatgcctctccttttcttcttttttaaacaattatagttgctgtagaatgttatataatcgatgcctttcttttttgtatcagacttccctctcttaattctttaaagaaaaagtgaaagtgagtcactcggtcatgtccaactttttgcgaccccatgaactgtagcccagtaggctcctctgtctgtggaatttttcaagcaagaatactggagtgggttgccatttcctactccataatt

SEQ ID NO: 29141 - DNA, 2653 bp, Bovine  19866880987146
tgtgtgtgtgtgtgtgtgtgtgtgtgtaaaactaaacgggcatttgaaggcttaagtgtttgagtccatgaaagtgaacagacccatatggtctattgtagaataagtaattacagacttattaaaaatacatgttaattttactcactgacactccatgataatggcttcctcaggatctaatccattctgccgattatacttatctatttctagttcaggaacctctggtcctgaacaaacggctcgagcaagatgagagctgacccaatcctaccacagaagatgaaatcaccacttttcagagatgtcaataatttaagatgactttctctgttgccctttacatactcacttcaagccagaggcagataaaacagaaaagaggcttctactcccctcaccgcctcaatctgaagggaaaaaagtaccaaaatatgctaattttataggagacaagacagaaatttccttgagttgcctccttaaagaatatagtactcatttacttaacaactccagagtaaatcattgatacttgaacatgggttataaattgtatccccatctggtttggggaaaccagctttgacatttctcccagctgttaatgaccaagttacttatcaatacttctcaaattttaatatgcttatgaatcaccagggaatgttgtgaaatacagattctgatacagtaggtgtggatggggcctgagagcctgcatttctaacaaactccttggcgatgctgatgctactgatctggggaccattctctgaatagcaaggacttggctgactgataagatgctctggtgctggtccatgcagactcaagctggagaatagaccaagtatctctattagcagactatcagttgaatacagattataacccaggccttaattctgaatattaaactttattttcttagactttctttctttaaccactgaagtttccttagagctgataaatctgaccagaagaccctgcccttccatgggatgccattctaaagaataattacagaatacatttctctctcttataatctaggcctactcgttgttaatctgaggttaataaatctccaaagctctgttgcttatgagtctatataactcaaatcagtcatgtgtctttttaaacggaaatatatttattatttttgagaattatagatgacatatattccccataataaaaaatcaaacaaggaataatctaacatgtattctccccaatttaaattggtaccccagcaaaatatgacacatcatggacatctgaatagatgaagtatcaaatatgaaatcttggaatgccaagtatagtaatatgccattaaggtaattatagcaataggtaccaggtactgagagtctgctttgcagagcacccgactgtgtgccctggctgtatcatacacttcaagtttgtaatggccagcattcctggattcaaggaaagagacacaagctgattaattctgagcagaaaagtattgaaacagtgtcagaatggaaggctagaaaactgagctctgaaaatgagcaggaatcaaggaaggctgagcggtggggacacagcctggattttgtcacagggtcactctggccaggacctcgccattctcagactctgggcccctgatgcagcctccagaagggactttgctgctgtccccagaagagtgaaaggctcagttttcccgtggggccggaatcctgcctccccgatgggactcacaccatggattcccccagggttgtcatagaacaaaacagagtccacagcttttcattatcttgcttgatccttacaacttggtgaccaggttccccaaaatatggtaccttggcatactgaatactttaaggatttgggaagcagcacttgcaggaggggctttctgattctcccctgaagtaggttgtaaagccctcatgtgagaagtgccctctctaacctggagagaagcatccttgtttcctaagacaacggaacacagagagggacacctaggcttggccaagtctccacccgtccactagactcaccctgtaccctttgtcctaactctgtctgctcttcatcaagcttagcataaagcacccaggtttcagcagtttcttccagtcttcattttctggtgaaggcccctttgtggtgtaaaacttacattgaataaacgtgagttgttgatgttgctgctgctgctgctaagtcgcttcagtcgcgtccgactctgtgcgaccccatagacggcagcccatcaggctcccctgtccctgggattctccaggcaagaacactggagtgggttgccatttccttctccaatgcatgaaagtgaaaagtgaaaagtgaaaaggaagtggctcagtcgtgtccgactcttcacgaccccatggactacagcctaccaggctcctccatccatgggattttccaggcaagagtactggagtagggtgccatcgccttctctggttgttgatgttacagggatcctaaccaagaccctagaaagtcagagggaaaagatatccacccttccctacatggcagaagctgatagtattgttgccatttttgagaggaggatcctggatcctaagggtgaagctatttacccaagaagcaa

SEQ ID NO: 29142 - DNA, 1126 bp, Bovine  19866880995676
tatgttgaaagggatgaagtggttctaggagtcaaaacagagaactgggaacatctgagaagaccgtgagcaagtccccagagctgattttggacatatgtgtgttatgtgaatattacacaagatctggcttttccaaaggacctgactttgcaaagctgatataatggtgcctcaatgtcactgtacttgagtttcgctgaaatgctctgaagtctgttccatgtgtaattggacatttactactgtctcattttggtcaagcagaaaaccacatgcaggtcagatgagtttagtttcttccaagcctggaacaccctccaccctccagtacgctcaagtatggtgattcggatgagtgccatgtggtgccctagcctcatttctcgatggctgggactactattctctcccggaatggttttgtttgcaatatatttactggtactgccaactcagggcattgcagaatataaatccggtgctgtactctcccaaaggctgagcagaatcttctttctgtgaacattttcaatagtttgcttccaaggtgaggaagtaggaagtacaagagggacaggcatcaaggcaaatttttttctttctacctttacttttgttaggagggaacatttctatcaaggaatacagtttcctttcattttacctgatccagagaaactatggaacttctgttaccgattctttatccataatttatgttcgtaacataggacctggtgatagaggttattgatgaaaacagaaacgggtggctttcttaaaggagggggcagaggctcttaagagagttgtgtcagagtcagaggagcatttctctgtctaaagcttccagtgggctttttctttccttttgcatctgagttattgccacacttactggctactgttcctgaaacggtgaaagaggaagatgcttaagcgtttctgtgatgtcacagtggatctagatattaaagtcttctcttcctcccatttgtatttgatcccatttcacattgtttagtgataagtaatttcaggtctcagtaacccactctagcatataatgccaaggctgttaaggaaataggagaaataattcctgtagtaattaccatagtgg

SEQ ID NO: 29143 - DNA, 763 bp, Bovine  19866881031303
ttcagaccacgtgttgttcaacagtctggaggaacctggaggggcaagagcgttcactgctgccttctgcaacatcccccagaattgggtagcgtcctcttctattaatatccagtatcccagagaggcgtggaacaccatcaattactctccttcagagtgctctctacctgaaaaagcacgatgttcttattgacactgcacttaaaaaaatgttctgaagtaaatctacagcacactctggctctttagatccggaaactggttaaccagtaaggatataaagacacagagagatgctttggcaaggttgcagaacaatttgtgccagagattagaacagaatcaatgctccgttgcagcatattggccaagggcctggataacctccaactattgactttgtcagtcccggggttattggccagtggtaggctctttagacctgggagctcctatcatcttgtctagtccaataaagcccagtttcagtctctcacaagtcaaaaagataaagataacgggttaccccaaaattcacctagcaaggaccctaaatcatatagagtgacagagacttgctagaacctcagaccttctggcagattttgtggaatatgtcctcaactttcctaaagagataagatagacctttgctctgctgtctttatgggtgccccttccatttctcttagcaaccttcttccctcccactccatcccatccatgctctaatattagctgcaaaagcgatgccaacact

SEQ ID NO: 29144 - DNA, 2506 bp, Bovine  19866881051343
tggcacttagtcctgaagaacttcccactgactccaatcactgcaggctcataagaaatgatgggaggcggtgggtacaaagtaacaggaagctgaaacaggaggactgcaaaagcagtgtattttaaaatctaaaaaataatccaacagtcatgtagatgatttccctgggtcatttctgcttctgtgatcctttttcaaagtctgaggaaaaaatctggatgtcacaaaactttcattcatttgtttatccactcaactgacttttgctgaccttctattacaagcccagctctgtgtgaacagaggagacagggaaggagggagagacagggaagtcagtgatccccaccagagtgataagagccatgcaggatggtatgggggatggagggaaaaaatgaagctgaggcagcttcccaagactggctcatgacttctatggaaccctgacttggggtgattgaattctaggtaccttgatgaagctcaggataaaaaattaaattaaaacaagagctagagaggtggacaagatggagtggcaagcttttgttatccgtataaaggtttcaaatatagctcttctcgagatatgagcaatccttcttggcttccttaaagcacatcctggacgcaaggccaagaaactgtttccttccatcactgagacagaacatctcgtgtgacaacacatgcaccctccccccaacccaccttccacatgctgaaagtcagagctcagactcacactgcccgcccccgcgccggacactaacgacttgggaatcactaggagcagagcctggcatgtgcgggagccaccctaagagaaaccatcccagaagagaggtgctaactaggtgaagacatatgactctgagctccacttcctgattctaatggagggagagtctggcatggagccaggaagcagaaaaggcatgaaaggaagaactaatttggagctggcgcagtgagtgttttctggcttatttaaacacgtagatatagaattcaagcagggaggagggaatctgactaccagatggagatgctgagtgaggtagcatgtcaacaatgaaggcagcaatgcccaggcaggaaaggagacatttttgacagcagggaagctatagagggatcgatgcttggtggattgggtgggttccaattaacctcaggattttattttcacttaaatctcgaggaggcagaggatgaggttactggcttgaccccgtgttaaaggaaaaccacaactcagtcctttaaggatgactaaggaaacaagtcaagtagctaacaaacaggcagaagtaagaccttggaacatgaatgtactgagtgcctggtgtgaggcagagggagtgtgctggagtacagggaagcacagaggagcatgactgcatcctggccctcagggaacagccattctggttgctgtttaatgtcccaaacacagggaggtgcacagaaggcagagaaggtccgcaggtagccgtgatgtggcggaaagctcccagaaaaccagtcgtgcaacatctctcggcagtttgcttgcttggggacctgaagcgagtctctgaaattctccttttcccttctgtaaactagcggttccttcgaggtcacactgaagagtcacgaaggcagtgttacagggtaacagcgtgctggagggtggaggaagggcttggagccgtattctaccagccaaacccacatgtggtagctctcaggggatgtgactttccctggataaaaatgtggcaggacaggcaaaaccactgggagaacttagaggcaacagtcagagagagggcttccctggtggctcagtggtaaagaatccgcctgccagtgcagtgttggatccctgatccgggaagatcccacatccatggagcgactaagcccatgcaccacagctgttgagcctacgttctggagcccatgagccacaacgactgagcccacgggcacaactgtggaagcccacacaccctagagcctgtgctctgaaacaagagaagccacctcagtgagaagcctgctcaccacagctagagactagccccctctctgcaactagaaaaaagcccgcatggcaacaaagacccagcacagccaaaactaaataataaatgaatatgtgtgtatgtactcagttgcatctgactttttgtgaccctatggacacatggggaagacccaggggagcctggatcccaccaggctgctctgtccatgggcttcttcaggcaagaatactggagtaagttgccatttccttctccaggggatcttcctgacacccgcaatctcttgcacctcctgcaatggcagacagattttctttaccaccgagccacctgggaagcccaataaataaatgaaattgtttttttttttaaaagatgtttaaaaaaaaagagagagagagagtatgcatccacctccagcctagttctatagcgtctggaattcattgcttttccctcaa

SEQ ID NO: 29145 - DNA, 1109 bp, Bovine  19866881175973
gtagcagcaggctatggagaaagatgggagagcagggactaaaccttaatatcctattaagtgacttaaaggcgtgtgtgcatgttcagttgtttcagtcatgttcgactctttgcaaccttgtggactgtagcccaccaggctcctctgtccatgggattcttcaggcaagaatactggagtgggttgccatgcccttctccaggggatcttccagatccagggatcgaacccacgcctcttacatctcctccattggcaggtggattctttaccactagcaccacctgggaagcctgatttaaagacagaggaccaataaaagccttcagaattagcgtatgatcaaattcgccatcaccgttcccctgccgttctcttattcactaaaccagcctcctagaacagacctccgacagctctgaggttcccctgtctctttacaataagggcagtcatctggtccaaggtcttccgagtttctgctgagcctgaactatctttctgttccctggcattttcgtcctccttgaattgttcaactgctctgtctgttccatcgctgtttcttgaaaggttcaaagtggagcacagcttcaaagaagactctgatatttgcagtcttacactggaattgtaaccttgacggcttcccttgggggaatgtctgtgtctgtgggcaacgtcagattgcaatgtgttcagaagaacgtggcagtgaatgcaggacacagaggaagagccacccacgcaaaaataaaggaaataaatttgaggtgagacagaaccactgaggaagaaaggctagcaggaagtgtcctgggaagcagtggtaaaaggtaaatgacagctgtggctggactagcaggaagggtcaaaggttgggtgactcagtttgaatgaaaactcacagtgacatacagatggagaggaattttcccacaggttgggataagcctccaggcccagtaattatacataagccactatttaatttagcaattgatgtgaaaagaataaatagtgatagtatttcagcttaattcaagtaaacataagataaatattttcagtaccctgtataaaaatacccaggacaataaaacaaa

SEQ ID NO: 29146 - DNA, 1702 bp, Bovine  19866881254245
actgtgtgatgtttgcaggggggaggagagaatctaagaggattctttaaggttccatctctttttggaataagatcaggactgcattttatgattctctgtatcccaacttccactctacgtgaagcagtgttcctgttgaccataaccttgcgtcattaatgattacgtgatgaagtgcatgaatcaggctgaatcacattctcttgctggttgttgtctattcaatgttctcttcttttcttcagataccaactcatccagtgactgactcttatttttgtagctcagggttttatttagaaaatgttcctaaatctgttaaggtcattgccagacaacttgacaaaaaaacacagagattcagatgagcaaagcctcccgtgaagagtcatcctgttcttcagagactgcgcacatgtgggctcagccatgaccctgcaggatgtaccacactcagccctctgctgcggcaggaaggcagctgataacagcacctcgtggaaactctctgtgtcaggccacttggcagtcgcaccaagacacacgtggaagggcgtgtgtgcgtgctaaatcgcttcagtcgtgtccgactctttgcggccccatggactgtagcccaccaggctcctctgtccatggaatcctccaggcaagaatactggagtgggttgccatgccctcctccaggggaccttcccaacccagtgatcgaaccagtgtctccttggctcctgcactgcaggcagattctttactgctgagccatcagggaagtccccatggaacggcagttatgacttaaatcactgaagtcaggatggatcagcccgacaggagtagatgccaagtttacccacactaacctggctggttttctttccccgaacaatctttgttattaaactggtggagtctttccatcatctcctagttccatgattaaggacacaccatgttcaccatcaattctctctccccaggtatatttttaactggcctagttaacttgctcattggtcctccactgaaacgttttaaagcttctaaacctgatttacatcaacaggaaagccaatcactgttttcagagctccagggcagccctgagcctttgctgagtgactggggaccagcagggagcctggggtctggcggcattccttcctggtccctggagtggtgcccacaccagagggccccttaggaaaagacaccactgctctctctggctccacctgccactgtttgatctcctatagggagcatctcctgtaggaagcaccgtacaactcctctcctagtttcaataggcaatcagcacagggaaataaatgaccaaggaatgcggggaacagaggcagaggcagctcaagacaggagacacacacgtgtgtgcacacacaccccctccttggtttctgcttcaggtattaggtcgggggatgcaccgtgaggtccatgcgaagctcgggttcccgcctccgcggccccagctccagcgagcacgcctgtggagtggcctgcagagacatctggtggtagatttatcgctcctgcaagaatccctgcttcattcactcccagcaccgggctgagactaacagcttctctcaggccgagtctctgaacatcaatcccaatgtttgaaagttctgctgtgtttgaaaagttccttcctaaataatcaaggatctacaga

SEQ ID NO: 29147 - DNA, 769 bp, Bovine  19866881273867
agtaccatgcatggcaggcaccagcatctgagctggagaggatccagggaagtgccaaccgtgggccaggggcaggggtgtgcactgtgcaaatgggtgtgccctggggctgcccccctcctgggtctaccctccatcccaggctaagatgatgagaagaggcaccagttcatgcctgaccgtccacaaagactccagccgccacagcacaacacgtcaggccccggggtccgtctagcagccctgagtggcggctgccctgtctctgggaagactcagtagcaaagcactagaaggctgagctgatccctgtctcttttttgctaacatgtaagtagaagtgaacatgttacttccagcatataggaaaaccaccgagtcaatatctggatgggaaacagaccacagacatatgcccagtggctctgttcacaccatgggcgccgatcacagagactgtgatagaaaacaaaggctaagtgacctaacttgacacgtggcaagaggtgtctgacttctcggcgcgccagtctcgcttaagaggacggtgccagacagtctaggaattcgtggcagacacactggcagaagccatacaccatcaggatgacgaggctggaggggaccaggctgacgaagacgacccccagtgtgaccttcttggagaccagtaagtagatgcccaagggcagggagctgaagtacagcaagcccagcaaccacaccagcacccggatggatgtctaaagaccaaggacgtgcagttcca

SEQ ID NO: 29148 - DNA, 690 bp, Bovine  19866881393516
agtagcaaagtggtgggaactagaaaagcttctgtgaatttggcaagggttaggataaatgtttccagtccctctggcaaaggtgaggccggcagagggaaacacgtctattcatcatgctttagtgccacttgttcattaagggctatgctctgggggtaaagctgtgctttcctgtacctgagacaatgcctggacctcgtaaacataactgacaacataattttgccgcacaggttattgttgtgttgttccaatatgcttgaagtgatcatgaatcttcacggaatgctgaacgttttcccacgggaaatactttattttgcacacagagccacccggtcttgagagtcccctgctggggacactgtgctactccactgaacacgagggagcagatgtttcagaggatttcgtacagttgggaggaattttgctgactgccagccacatgctagacccttctgcatttttcaggtctgcacgcgttgtagacagcctctctgcaaggctgacatcactgactgccgtccaagggcagaaggtggagcacagggaagggaggggcttgcccgagcgtgccccactgtaagtgacggagctggggtgctgcacacccaggccgtccttgtccaaatgcaaacttctttccctacagcagtgacatggccctccaatgcttctttgagg

SEQ ID NO: 29149 - DNA, 2610 bp, Bovine  19866881465984
ggacaggtcccatgtatatattgttctctgagtacttcagtcgtgtccgactctgtgagaccccatagacggcagcccaccaggctcccccgtccctgggattctccaggcaagaacactggagtgggttgccatttccttctccagggagtcttcctgacccagggattgaaccctggtctcctgcactgcaggcagtttctttacccactgagctacccaggaagccctatttgctttgggatgatggcaacagtgttctacttaataattgcccaggttttagccatgtgactaagacagcctccgaagcaggatgcccacactcaaacaattccaggaaccagacagccagtgtaaaagagtgaagctgatggtgcatagagcagtagagatcagtgggagctgtcacagactagagactgtaaaggaattcaaatcagaaagcttgaaacacgacacgggccaaacaaaacacttctgtggctcagacctggttaaaatgtcaccagttagtggcctacaggctgatcggagctcagagctggaaaatcaggccaattacagatgtcctggatgggctctgctgtcttacatttgtctggctccctgaagagtcaaaaactattattatttcaaaaccagcatgagatatcaccccacccctgtcagaacggctatcatcaaaaagtccacagatgacaaacgtcgacgaagatgtggaggaaagtgaacccacgtgaatggttggtggaactgtaaattgacacccccacggtggaaaacagggtggaggtttcttttaaaaagtgaaaatagaactaccatctgacctagcaattccactcctatgtatataaacggaaaaaacaaaagtattagttcaaaaagatacacgcacccccgtgttcatagcagctttatttacagtcgccgagacacgaaagcaacttaagtgtccatcgacagctgaatgataaaaaaaaagatgtggtgcatatatacgatggaatactattcagctataaaaaagaacaagatgttgccatttggagcaacatgagcagacctggagggcattgtgcttagtgaaataagtcagaaagagaaagagaactactgtatgacatcatttatgtgtggaatctaaaaactacaacaaactagtggatataacataaaagaagccgactcacagatagagaacaagttagcggttaccagaggggaggggacaatatagggccggggagggggcagtaccaactatccgctgtaagtcaggctcaaggatgtattattgtaccataggttgaatatagtcagtattttatacaactctaaatggaaagtaacctttacaattgtatgaaagttaaacatttttttggaaactgttacatttgcctctgcccactgccccatgggtgattggaagaaccagcgttttcagtcacgcttctctgcctgtaaaaccagatgtagaggtgatcttgagatacttcttggcttgccagggaaatctgagtcataggtgtcccatttacttaacaagctgcaagaaacacctcaaaagagccatttcctattacagtgccctacatcgagcaggccctccttaaaaacttcctgatgctcgaacaagctagtttcataatacttgcttccacgtctttaatccaccgtgtggcttttattttaagcatgaaggttttcagtctattatgatgcaaagattacatgtacgggtagcgtgttggggaggatgtggaaagttggaacgctcatgcacggctggtggaaatgaaacatgaggcagtcactctgaaaaagagtgcagtgggtaaacatggagtaatcataggacccagaaatcccactcctgttcccaaaaggaatgaaagcgtatgtccatatgctgccgcctttacgtgccatcttgtcctgaccaatcacagtggtgtgtactaaggggagaattttttaaagaaagagtctgactcaatcttcacaactgtatttactgaaaaataaagtcaaatgtgaaattcactatgaggtttgttcagcagtatctttctgaaaatatggggaaatcttacttaaaagtatgtttgttttactataaaatttaaaatatacacttatgcccagaaggatctgaattgatgtttgctcttttaattaacacataatatatggttttccaatagcccacggaacttatgattaagccatacttttatgaacgatgagactaatgacaaggacgtgtccagacaatttcctgatggtccagtgttcaggactttgtgtttctgtgggaactgtgatcctgcatgccaagcactgtggcgaaaacaacaataagatttgttcacagatatcatagcagcattatttataagagtcaaaaggtggaaacagtcccgatgtccaccaatggaagaatgaataaggtagtgggggtggtatggtttagtcactaagtcgtgtctgacttttgcaactccgtggactaaagtagtatatccatacaatggaacatccatacagtggaagtccatccatacaatggaacagcattcaacagtaaaaagaaataaattc

SEQ ID NO: 29150 - DNA, 752 bp, Bovine  19866881767483
tgcattctgccagtctcctctcagtacagtttacatccatctgctcctctcgcccttccatgtcacagagttaggtgttgttttgttccctggaggaagcccatattgttccattcctaccagagaagagacacatcaagagcaacaaggaaaaatatggagtgtaagcatgtgtttctaggtcatcaacatgcaaggaaatgtgcatgaaaatgagtgttaattttctgcatgattcagtgtttgcgagactatcgagtcatttcccataggcagcccgacagccatcacatggtaatgaatttctattacaaccatgtaagatggttgaaccagaaaactaatgatcaaagaaatgaacaaaatactaacaaaggtgataacaatactgatgttttaataattaactggcatttacaatgggggtcaattgggtattatagttacttgggggcagttaatacaggtctgattttctcattttaacatttgtggtttcacctgccttaatttttttaaaaacaaaaattctcaatgaaaatagacctagcctaatgatcaaaatagaaacaagttgtatggttaagtagtttgtgcttttatttacgtttttctccttaggtttcagaagtcttttaaaattactccggactgttctgcagaaattaaaataaagactctatctttttggaatttgtgttcagtattaaattatattcttcgttaccaatttcctcattcatacatatgta

SEQ ID NO: 29151 - DNA, 2543 bp, Bovine  19866880631118
cagaccagaatactggagtgggtagccattcccttctccaggggatcttccccaacccagggattgaaccccaggtctcccacattgcaggcggattctttacccactgagccaccagggaaggccttgtgttctgtaaggtagtaacagtttttgctcttccccaaaatatgtaaacttgttttccatattctcaccaatagccatttctgatcttttaaactatttgctaagttgagtgaaaataaaccttatttattactattattttttaaagtcaaatagctttgtgaagtgaaagtcactcagttgtgtctgactctttgcagccccatagactatacagtccatggaattctccaggccagaatactggagtgggtagcctttcctttctccagggaatcttcccaacccagggatcgaacctaggtctcccgcattgcaggcaaattctttaccaactgagccatcaggaagcccaaatagctttgtactatatccttatcggttattttgctttttgaatggcctgttcaatcttctcccatttttctttgaggttatcttgtgaaagtgaaaagtgaaagtgaagtcgctcagtcatgtctgactctttgcgaccccatggactgtagcctaccgggctcctctgtccatgggatttttctaggcaagggtactggagtgggttgccatttccttttccggggatcttcccaacccagggatagaacctttctcttctgcattggcaggcagattctttatcactgagctaccagggaagcccacatatgtatatacacattacacagaccatgagtctctgagtcaagtatgagctcatcacccccaccagcacatacacaaattcacacactgcacacacacacacaaacacacatgactatgctactatgggaaaagcattgcaaatagcactgcttttatggttgttactcgggacattacacaaatctaaccccacccccaccactgggaacagaaggtatatctgctaatgccgagttttcatagctgaattctaaaatccatttatgaatgggtacttgttcataggctaagtgatccactgatggcccaaagcaataaacataaacttcccttgagaaaatacttgtggagagaacccagattctagttataacctcataaagcactgtattctctcatttcatagcttcacccacataccattttcagccagaatccacccccgggacctgggaatctccactggattccatgttcttggtgaagctgtgtcaaaaatgctttgccagtgggcccttcttcccttgaggctcatcaaatattgctagtagagagttttctggctttgaatatttcctttcctcaggtacccaggaataccgtgtaatttgtaaagataactggggtaatgaatgcgcactgtagtccgctcttcccagtagtaattggcgcacctttcatctcctggcaagcagagtggttgggattaggaccaaaaggcagctatcatctctctcatttcctgactcagacaaaaggcaaaaaaaggtgcctgtctgtgctgataggtgtctgatcaaagcagctgaaagctgtcagaagccagccagcctgagcagcctggctgctgctttctgcagccctgcctttgatcggccagccgtctaactgcggttctatttatgtaaaaaataataagcagggttgtaactgaacagaagaaaggatcattttctattttggttctggtttttgcagtctgataaagctaggaaatgtggaccaattctatccagagtgcatgtgtgttcaactcattcaataaaacaaaaaccacaatcaaaaactgtcaaatcttcatgagataaatttgcagccagcagtaagcaggatgctggtagaaagaaattattccccttggaaggttaaaaaaaccttgagtaaaattgctatagtattggcatctgtattttgtcattagcagcatcgactggctggctataggtttgtaaaatgggaaactggtcttggatttaaaagatttggggtcatacctcaggtcatcagtttctagccatgtgagctgatattcatttctaatcacatatgtgctccaggttcctcatctggtaaatgatacgtgggtacattcctgcatgccagttactgccagcatctagatgaaaacactggcttgtggttgttaaaagcaacaaaggacggctgttggccagaaagcagacagacaagtattaatatcacttaaccccgctctttttcaggttccactgccactgagtagaaccaagtgtctttcatctctgtaataaattttactgagtaagtgaataaatgaatttgagcaagaactaatgaaattctacttggagaaccagaatagcatagagatacatttcagaaaagctgtatttgtatccttattactatgataactagaggtctatctgcactcagccttacatacataagccggacacactgcctagcctatatacatgtcacta

SEQ ID NO: 29152 - DNA, 1817 bp, Bovine  19866880770135
agaaaatgaaaaatgactctcggtagaaaccagttccatagtctacgagctattaaagtaactctgccttttattttccctaaatttctcttttatacatttacctacctagtatttatctacctagtattaataatctgaaatttatattatatttttctttaatcagtttactcaaaaattttccaatcaaaaccaaaccaactatttattaaaaatctaggggatgaagtacactttaatgacttttacctaaaagtattataggatagttcaaaatatgttaaaatcaaaagttctatgaattttgatttgtacagtgatactaaaggtaatgagtactttgtgcaagtgcttgtatatagatataaaactgcctttccaaaatactttttactcagacctgacaatgtttggctatttatatgatgtttacagagaaagtcttaacttacatattaatatagaattaggttgacacatatgaaacacattttaatgcatattctaatttcaaggaggatagaagaatcattattttctaggcaaacaaaagtacttttccaagatttcccattattttaaacaaggaaaaattctgtcaaacttaaggaatgtttctcaaagcatagacagacatggcagatgtcattcatgttcaaggaaggtgtgagtttaacaaactaccaaaatagcaccctgtttgagtatgttatgtgtataaaatgcatagacagtgataatagtgtctgaagaattttatcaacagtctgagttgaagcaaatgcttcacatattgttatctcaagaaaacagaagtaaacctttctgaaattaacttgccttcacatgcatggagcagtatgtgtattggagaatgaggaggacttgtcttcatcttgtctttctgtattagcggggtctgtgtacttggagacacagtcatgccagtcaaacgtgtctgtcgttcaagtcaccgtgaaagaattgctgttgctcactttgtactcagaaatcatccctgtggtgccagcttctgaaagaagcagactaggtttttggcttattccaaagagagcgattgttcaaagaaaaactttaatgcaaagcatttagggtaatgttatgtaaataagcagtaagactggagccctggctctttttctcttcatttccttagctctgtgattttcgccttgaaagtttttacttcaagtttcatatagcctcattatttttccttggcattttctttaaaacacacagcagctgcacaatattgataactctaagagggatagactatatactacattgctatggcttcaatctaaatggaccatatatagaaactctgaatttgcactatttgtgttgcaaaatcttcacctctattttatattttaaaaattcagggtctgaaatctctatacagtaagtctctcagagtgtctttattctaatgtaataatctccacatttagtgtattacaactgaattggatgataaaatttcagtctcagaaatgattaataagtagtcaaaatgggtctaaaaaaaatttcttccccaataatgtcattcttttttttaaagttcttgtgtctttcaaaataaatccaaactgtccattgagatcttattaagaaaaccatatcaagaaagggacagaattgccaagcataaaattatgggtgacatcacaaaagaaaaaggaaatgatataaatttccaaagtgaaatcaggaataagattcatttaatagaaacaacataaatgaataaggaagacctgaggaatatctgcaacaagtat

SEQ ID NO: 29153 - DNA, 2611 bp, Bovine  19866880781987
tactgggaagtgggtagcccattttcctttctcccagaaggatcttccccaacccagggatcgaaccgaggtcttccgctttgcgggcagattccttaccagctgagacacaaagggaagcccaagaatactggagtgggtagccttttccttctccaggggatcttcccgacccagggaatcaaactggggtctcctgcattgcaggcggattttttttaccaactgagctatcagggaagctctctcttgtgggacatatactattaacagtagcttctgtgttttgtagcattatataattcaaaataatgtttttgtattttctattttcctgtgtttaatttataagagaagcagaacgacttttatttataaaaacacaaactccctcacgtgcttcctatgcagaacttttccatgttagcctgacccagctcatccagtctatataaagtttacttataaagtaaaattttcacagtattatagaattaaaactgtactttgatattgaaacagatcacggcactggaaggtgagttcatgttaatacataatagtgggtccttgggagcgaaaaatggttcccatagggtgtctttcaaaatattattaaaataaagcaatgctgcagagacatggttttcatcattgcagtggaggtttagtacatctaactgggatttgagtgagcttgaaacacttaacccatgtttctgggtgaaaggcagtgaagggcatggagttgggggcctactgcaggagttgggacagtatggagttggggtctctgagcaaaagctccccaaaaccacactgtcctgatgagccctccacctgccacaggtgtgtcatgaggggggcccagcaatgggacttcagtcccagcatcaggaagaccagccagagcagccaccccatgctgagttctctgcatatgaaagaatctccctgcatcttaaatgtgaacccaagtctttaagctccatatatcccaggaactaaggggccttggccacaccacacaccctcagagaaccaggccctcttgtctgtgtcgagtagggcctccttcctgccttgcagaccaccccctcttccctccattcttttatttcttatcctttgattgtattctggacccagagtctttaaagcacattcaaagccaaaaagaaccatctaccctggagcaaatcagaaccaagccacagctgaccagcatactttgctaaatgcaagccctcttgctcccccagaaccggggtgctgtgcttgattgacaggcaataggattaaaatcaggcagagccatctgacagctgcagtgtaacgctccaggagaagagaaaagccagtgttctgagagccgggcctgaggctggagctgcactccagccagttccgtgtctgcaggtctgtgggaggtagagggtttcccccgcccggccccgtcagtgatactgctccgtgcttcctctgcggggggctgctaaccgcagtgataactcagctcatctcatgcatccatgaaagcgtgacagattgtggaccactgagccgcatgcccgtcttttaaattcaatagtgatcttatttctgttatgatttcatccgcttaaagacgagccagggccacagaaaagaattccatcttctcaaaacagacttttcttggaaacgttccatttacttattagaaattgacatctacttagaatcagcatgtttaattgctttacataatctcagcctcccttttgagaaaacaaaaataatgccagaatcctccccctttactcaaggctcgtgtatgcatggttcctgtagtgtccattccaagtgaaatgggtcagacctgggtgaaagcactaataagatatttccatgcaggtaattgttatcttctctcccctccttttgagaattaagaaattatataaaggataatttcattttctgagtaagtgttttggcagtccagatgggcacacatgcactcttcacaaattaatatttgtttcaaatagtccaagcaacctactcccttctttattaattaaatcaattctcccgagaaatgctctccaagtttgaaaaacttagtgttgaccatggacagtaattcatttatgaacattctgtccaattaaaacagttgtataacatcaaggactttttttttttaatggattactggagtgaagtatccattagttgtgacatgtccacagcccctgtaaactgtggtgtgcaaatatagctctggcacacccttgctcccctggtgagtgtgggcttcatgtgtgaaaatgagaacccagtttgttcattccaaggccatgtgacatcaatctgacccagtgagagaggggctagcctacatctaacgtgaaataagtcagaaagaaaaaaaacaaatatcaattactgaacacatacatatgaaatctagaaagattgtatggagaaggcaatggcaacccactccagtactctcgcctggaaaatcccatggacaaaggagcctggtaggcttgtggtccatggggtctcgaagagtctgacatgactgagcgacttcactttcacttttcacttttatgca

SEQ ID NO: 29154 - DNA, 1671 bp, Bovine  19866881120282
aaatgttgcatactcactttttgtttttacaagcagagtccaggttaagtggctgcagtggcagtctgctaatcaattcctgacactttgaatcaattctcaggctaggtctctgatggcaggcaaaaacagtccatctttgtgtgaatgccagtttctatttctctcttaccctaaatagtgaggtcatttactcaaaaccaggaagggaactggggacgtgggtgtgtgtgtaggttgtgtggttgggggagggactggagttggctaaaattgcatagatgattgctctgactctatagacttcctttgtcagtggagatggctatctaaattgatcactggtttccatgacaaccaatctagataatttgagtcttccacagcagggattttaagggtcaaattatttttaaaattgcccagttttctcctctacagttatcgcctcagatattagttgttagaatgtagagattgcttctttatgaaaaaatattgaaactgcattcccacagaaatattaacatgtcaaatgttatgcacacacattcctcagggatttcttttctgtcccacatctacacagaattgaattttaaagtgattgctttggtgttgatactttttacaagggtagacaatgtttcttatttgtaaagagaataaagcagtcaaaacccatagaaatattgaaatggaagaatatctttctaataattttggcatttccttatacatctcatggccactttgtagattattattctcatacatgaggtgaaaccagcttacttctaactcatctcaactcctgtgaactgtgatttacttttctaaaaagtaaaataattccatctttgaattgaatgttcggtggtcgttagccttataatgctaaatattatcactatctccagacacttcattcaaaacataaggacatatattctataaaatgattttaaggaggctatttgaggaaaatatcgtagcttaaagatctgttttaccaggagctcaaaacgatttgagtcagcttcgtttaaaaatggttggtaagtttcaggggtcatctggaaactgtgggaagagcaggctgaccgtcactgcacgtgcacaactgaccttattatcttcaagaagaagccattccacatgaacatatttgttctgagcaaccagatgctgggcaaaagggacatgtggatttgaatgtgtaatgcagttatcttacaaatattctgactctaatttaaaaatatacagctttcaaactttaaaaaatatatagctgatatgctaggagaagagaatgaacatcatcagttaaaaagcaatgattgtcaggattggtgaaaatgctagatccaactataggttgtctataagagacctgttttgaatatacagacatagataggagaaaggaaagagaaaaagataaatcctgaaaaaactaattaaagtaaatttggagtagctaatgaagtttcagaaaaaatagacatcataacaagaaagatcacagagataaagaaatggtcagttctcaagaaaacactttagtccttagaatgtatgcacccaggaacagaggatcaaaatatgggggacaaaaactgagatctgcaagaaaaaaatgggcaaattccctaaggaaattggagt

SEQ ID NO: 29155 - DNA, 730 bp, Bovine  19866881164752
catctaggcatgaactcactttaatgtactgaatctaaaatttgtaagacttctttgttaaacagcaggctgcgtgtgtactcagtcgtgtccgactcttctgtgaccccatggactgtagcctgccaggctcctctgcccatgggattctccaggcaagaatactggagtgggttgccatgccctcttccagaggatcttcctgacccagggatcgaacccacgtctcttacatgccctgcattagcaggcagattctttaccactagcgccccctgaaaagcagaaacctctgattcaggtagaaataaaataaccccagctttctttgtgctgttgtaatatttcataataaaataaatttagcatttacgtagcactttaaaccttttcaagtgattttatatctgttttaatagctttatattagtttgctatacttttctactaaatcactggaaatatttgttgcttcctataaccactaaaactggaaagttcgctcaaatgattaatgatgttgttttatgtatttcctttgctatttatataatttctttaatccagtttacttctgatggcttttccattgctggatgagatgaaaatttgacaaaatttgctaaaacttttacaaatgccataagtcctattaggaattcattattcaaggtacaaaatagaatgcattttatagagcttttaacagtcgccgaggctgaggcaattg

SEQ ID NO: 29156 - DNA, 774 bp, Bovine  19866881264313
caaaaacaatacccagttgtggatgtgagtggtgacagaagcaaggtacgatgctgtaaagagtaatattgcattcattaatactccagtattcttgcctggagaatcccatgaacagaagagcctggtgggctacaatccatgaggctgcagagagtggtacatgactgaggtaggaaactacccaggcaggctcctcgttgtgctagttaagtatacaagtgtcagcagcagcagcagcacctgcagcaaagcccacatggagagagacaactgcgtacactggagttctgtaaagtgtcgctcagccttcttcaatgtgtgtggtcacccccaccttagagatgagagcactgaggctcaggaagggtgaggtaacacaggcaagcaaattcagctactaagggacttaaaaaaatcagctccttctccttggctctgcagccatgggactgtgcacataattacaaaatcttttcacttcctaaatgcagcaatgtgagagacttcaggcttaggcagatctaaatgtgctctgaaatgtccagaatggggagaagtgttgcatttccccagctattatggcaccaaatctccactgagcccacgagtgtgcggaatcttggcttggatgagcttgtcttacacattttacagaatacagagcatgcaagggctgtgtctttttaggagcttacattgttttggaatgcacacaacctaggtcattaactcctaacagctatttaaaaaagcacagctctcctcctaatt

SEQ ID NO: 29157 - DNA, 1274 bp, Bovine  19866881277130
ttgagtcagtttaaaaaaaaaaaagaaaaatcattttcccagcaagtatttgtgcttcttttcagatattaaaatatttatcttaaagtaacaggttatcaaatagttgtatgttgctgattacaaatgatgcctgtcttgatggactcagaagtaattcaaacacaacatattggaaattatattgcagataaaatacatctatttatctcaaatggcacagatattggctacggtgatgtttccaaagtcatgaaaatgagttaatagcaaagtgtgtgaagaatacagaagcctgacagctcttgaaggctagggccatgcaattttctctttgttttgcaacaaggaaatattgattatttgcaccctgggcttacctgcatccaatatctctgtttttgtgaactgtgatcatattttgtagtagagttcttaaatgggtatcatcagctaaattcaatttgactgtatataagaaatgaagcaacaaaatacagtaaaaaaaaaaaaaaaaagactcacaaagattgtctgaagactgaaataaggtctttccagtgtaaaaacatctggtttatgataattctttgtcaagtgaaaactgctatgtaacacaagtgtggttatagttcactgtaggactaaagtgaaaataaaaataagcaaaggacaggcaccatcttggagaattgctttgctcatcttcccttgctctcacaccatcagaggcaggtctgtgattccacctgcccaggactatgtgggccaagggcatctgcttgatccaagataggcagtctgtaaatgcttggagatcagtgtcctgagagcagtcatcattgacagatgagtaagggtggctggtggtcagtatggcggccacatcaatcctggggtaggagagctctcagagatggtccacactgtcctacaggctccggagcaggactgagtcctcccgcccacagccatgacctgctccattgacttcgttcccttcctagggtgaccttccaatttaagtgttattcttgaatccttgtatcagagtctacttctgaagggacccaacccaggacagaaaggttgagtatcgtactagaaaaatcaccaacctcagcataaaaaccaaactgtgactctcagctctgctatctctgatgaacaatgatgggatagtggtatctacattcagggtgggtactcaaggctcctggtggacacaggaccaactctgtgctggggaacttccttaagagaaatctacagta

SEQ ID NO: 29158 - DNA, 3599 bp, Bovine  19866880256798
tattttttttttaatttatttttttattgaaggataattgctttacagaattttgttgttttctgtcaaacctcaaaatgaatcagccataggtatacatatatcccctcccttttgaacctccctccaatccccacccctctaggttgatatagagtccctgtctgagtttccgagttacgagttacgtggcaaattccctttggctatctattttacatatggtaatgtaagtttccatgttaccctttccatacagctcaccctctcctcccctctccccatgtccataaatctattctctatgtctgtttcttcaatgctgccctgtaaataaattcttcagagaattggtgtatttttttctccttgatcctaatgattccctctccctcggtttcacccgtgggtgggaggtcagtgtgaaatgagagccatagaaagaggtggagaatataatgctcaacgcttagggctggggccatgcaggcagctgggttactggcttcctgtaagcctctagggggagggagagagagacccttgagaacggaatatttcctgccatagcagcaaacaatggatgtcagcgattgcggcgctccaacgtgagccaaggtgggagctggtgagccctgaggaaactcgggatgtgaaaatacaggatactgtccccagatagctgaggtgtatatcaaaggcatgatttcagtgagcccagacttttgcatcttcccatatatagaaaagcgctaaattccttaacttgggatattcgttttttttttttttccttaattaacagtaatcttttgatgctcctgatacctgcccttggttgcaaaactccgctatatcctagctctgccccctcgcctcctcagagcagttctctcagggttacttgagatgctgcctcccaacgtgaagtcctaaaaattcacgtggaaaaaaacataactctcaacttttaggttgtgaatatgtttttaagatgacacccttaaaaaaatacattcagtgttgaaccaaatatctgaacaggttttatttcctgcagagaaactcctcctcatctcccatagttggctcaaggaggaaggtgggcatttgtggatgtcttaggaaggacttccctggtggctcagtgtctgcctacagtgcggaagaccagggttcaatccttggatcgggaagatctcctggagaaggaaatggcaactcactccagtattcttacctggaaagtcccatggatggaggagcctggtaggctacagtccatggggtcgcaaagagtcagatatgactgatcgacttcactttcttttctttaggaaagaaaggtatattagtatccagttgctgtgtgacaaattagcacaaacgtaatgattgaaaataacacaaattttgttatcttacaatcacagaaggcagaattccaaaatggatctcactactggctgaaatcaatgtgttggcagagttgtgttcctttgggaggctcctggagaatctcttgtttccttgcctctgtcagcttgacctttgttttaaagtcggttgattaatgcatctgctacctcaattcccctttaccaccagtgtaacataggaacagtttcctggaatgaggacatgggcctcctggggaagccattgttttgcctaccacagacatgaattggtaaagagcagtgctaatcccggatgctacagggtccgagtgagagtggcctctttcattctttttggttcctgggcagccttctgtgttgggggcaccctcctcgccctgatgtgggccaggtgccttccccaggagctctctttccctcaagaaggactctcactaccctgttgagcaccccatatttttgtgggtgcctaggcctagggatatctggaagtaaacctttcccaggctgaagaagagcttagatttagcccttaactttctggggggctgtggaggtggtgagaaggcagaggtcgggaggtccaaactgcaagtgaacccagttcattcattccacagagacaggttcatacgggcccattgaatgctgtgtgaagcttaactccctttgaaatgtcaacctctcaaaacaaggggccatgatttgcttaccaatggtttttcctcagctgaatttattatctgagagatgccctaaatggtttcccaggctctggacccctcttgcctctcaatcctcttttctagttctttccatatgaatcaaacccacaaaccgtgcattggaaggtagagccttaaccaccagacttccaggaaagtcctccactagctttagagggtgcttttgacaaaatggtcaaactttctccacagaactcttgtccgtaggtggaaacccagatatctttatacagcgaaattaaaatttgggagttccttttaacctaaagaaaaaatgtagcatgtcctattacagtggggaagaatatttccttttttctttggagaagaaatgaaacagtctggtggcatagtggatacaaatctgcctaccgatgcaggggactcaggttcgatcccgggtcaggaaagattccacatgcggtggagcaattaaacccatgtgccacaacaattgagcccgcgctccagagtctgtgcttcactgcaagagaagccactgcaatgagaaatccttgcatctcaactaagagcagcccccatttagtgcaaatagagaaagcccgtgtgcatcaacaaagacccagtgtaacaaaaaaaaaaaagaaacagggtgattgtgtgagacagtaccacagactcttgacctgatcctaaggaactttgcgtattgaatttgaatcttcagtcaatttgctggtgtgggctgtgtccatggtgtggttgttgggccaaagatgtgccgatgccctttgcatccttaactttttccccactatcccagggacaaaactgataagtgaaaggttctttaacagttctgcagttttgctgctgctaaatctcaaacagggccatttttaagtcagatgttcagttctgttgcacagcagccctgtccaatagaaatataatgggagccatatatgtaatttaaaattttctagtagccccattaaaaagtaaaaagaaacaggtgaattaattttaataatatattttattcaacccaacatatccaaaatgttgtcatgttgatatgtaatctgtacgaaaaacattaacaagatattttactttctttttttgtgctcagccttcaaaatccagtgtatcttttacactttgagaacttttcatttcaaatgcagagtttttcttggcaacacctgatctgtgtttagagttcacaaaattgagtgttgaaaaagtagattcacataccccaatccttccaaatgtagctagaagttttctgataactgactcaaggatccatttaaaattttgaattaattaaaataaaatgaaaagtccagctcctcgatcacagcagccatgattcaagagcttcctggctggactggatggcacaaatctgagacatcactctacaggtaccaaagccaacatgtgatttggagctggaagg

SEQ ID NO: 29159 - DNA, 1600 bp, Bovine  19866880349412
ctgatataattttatttttctgcatttaatgtcaagttaaattctcatgttgaaagcatacatattatcaagaaacttgattcaagctgaagttcaaagtaatattcaaaccttctgttatctccactgtcatattcaatccatcttctatgatgtcaattccagtttcaaaacccattttaaaagtgaaaatctgattaggttaaaaacaacacagagtaaatgaagaagaagctacaaacaccatacttcccagatttattctgccaagtctgatctagtatccccaaaatggagaacagtctatggtgtcttaattgcctgttttgggcaagaagaccaggctcatgatgcagcatcagaaagatgacagactcctaaagtaagactattccactatataatttaaccaaggatcttctgtgacaggcagaggaacgaggaataagggtcatttacaaaaaagcagacgttagagtcagactctctaggggtggttccctcctacttgtccaccaggctcagtaactctgggtgagctatttttcaccaacgtcttagtttcttctcggtgttaaatgggaatgataaaactacctgtacttcacatagctgctgtgagattaaactggtgcttagtaaacattagctatcattactttgaaaattaagcattcatttttataaaaattcatgtaaaaatgaatttttttatttttcatattaaaaaaccttattcaaatatttaatgagcagctattataagccagtcactgtttctggtagttgggatagctcagtgaacaaaacagacgtctctgcctctatcaagtttacattctagtgatgggaaataaaataacaaaccaatcacaataaataaattacttataacaggtgctggcagctttttctgtaaagggccagatattttaagttttgtggggcataccgtctgtagcaactatttaattagttgttgtagcacgtaagtagtcacatgaatccatgggcatattccaataaaattttattaatatttatgggaactaaaattttaatttcatataatttttgcatgtcataaaatattattcttatttttcccaaagacttaaaaatgtaaaaaccattcttagctccttagccacacaaaaataactgactggatagagatggttaacccaaggttgtaaattttatcctaagaaatgttacacaaaaattacaacaaaattcactagtggctaatctcagcaaatactatcacgtgtcactattaaaaattagtcagtagagatattgataagaggtataacaaatgaaaacattagtgataactataaaattttttaaaaaacaaaaaggatagcagaaaactaaataatgccctcacgtgagttatggaaaataacatcttaatagactcgcaggaagttttacatatgttctcactggactattagaaaatctttcatatttagtaacaagctcaggtaaagatcaggtcatgctacagactgagaacccaaatcagaggaaaggactctctgcagtacagagtcagcccccgcagagcggttacagatgctgactgcag

SEQ ID NO: 29160 - DNA, 2732 bp, Bovine  19866880403494
ttttgatgataaacaggaagaaatactcaaatttggaatatatttggaggtaatggtatcgagtgctgaagagttgatgcttttgaacagtggtgttggagaagactcttgagagtcccgtggactgcaaggggatcaaatcggtcaatcctaaaggaattcagtcctgaatattcattggaagaactgatgctgaagctgaagctccagcactttggtcacctgatgtgaagaactgactcattggaaaagaccctgatgctgagaaagatggaaggcaggagaaggggttgactgaggatgaggtggttggatggcgtcactgactcaatggacaagagtctgagcaagttctggaagttggtgatggacagggaagcctggagtgctgcagtctatagggccacaaggagttggacacaaccgagtgactgaactgaactgaatgtcagaacctgctgattaattaaatatggaatatgaaagacagcaataaaggatgatttaaggtcactggtctcaacaattgtgtaaatgattctgtctttgactaagataagggcttgtagaacagcaaacttgaagagtgtgtcagtgtgtgtgcatgtgtgtgtgtgaaagggagagagaggacaaagattagcagtagtaatctcttggggccaagttggatttgaattacctataattatgcagagttttgggagcgtcgaaccagtgatgctgtaagatcaggagagtatttgagatcatccagtagttgggaagaggtgatggtcacagacagagttctaggttgggagcagcaggacgtttcagcaaagaaaaaggagcagtcagtgaggtagatggaagaccagacaagagtaacatcacaagaatctagacaataacgcatttcgatttcctgctactgagaggttcagtatgaggacagaagggttaccagtggttctagtctaatacaggccataggtaaccttgataagagtcactttggttgggtcgcggtaatggaagcccaagtggggtgacttgaagagttaatgggagattatgggaaaattgcaggggaaaggtcctgagaagctgagagcagatggattcagagaacagagaatgatttgttgtgcttggagagcaaataacatactttctccatatcccaatggcaagaggctgaacaaggtcatctgctgagagagagggcattttagatgtttgagaggattagagaagatgcaaaatagttatcttgaggacttggaaagtgaattgtctggacaagtgagtagcatgcttggcggcgtggagatgcgtgattacaaatctaaagcagatccaatcagcatgactatgatgtgatttttcctgcagaggtggttggctgggtattgactcacagtaagcagatacctaggtttattgaagttcaggactctccaggctggtgtgatgtagacagaaaaatgggcagaagagacaaacatgtgcaagagagtggttacggtgctgatcaaagaagctgaactggacaagaaagaggatgagaatgtgtgcgtgtgtgcggggttgtgggggacagagaatgatgatggtgtgagagagagagagagagacggactggattgagcatctcaatgagatcagatggctggagcctctgatgctgcttcatcagctgctctagatgaagggaagatgtagccaaagggtggagctcactttccagaagcctctccctcaccccactctcaggccaggactctctgagcagcatcttgagccgcaaacactgagggctgcttgcttgcctttgattggctggagtgggggagacaccgagaggacacaggtgagccaggagagaggggatgagatacctgagggctgtggaggctcagctgcgaggtttgaatcttaaaggtgatggagttctgtgtctatgagtgaagagacatggctggaggctggcgaatcccccaggacggcccctggggcaggagccctgtccttcgctcatgacccctggcagtctgccacggcgccttcttttctggcctcatggaaaggccgtcttgacagttgggaaaggagacaatgtctcccttgggctgaggtaattattggtgataatgcggccccagggactgaagctgcatgtgatctagccacaaacatctctcgggtcaaggatcctgaattggtgctgcctaccagccgcagaaccattttgtctccttgactttgcctctgtctccctgggcgcaggcatcgggcgacagccgccgagctcccctagccacggggtccaggtctgtagattcaaggctggacctgggcctcgtcatggagtctgctccacaggcagcttccctggcatgagcagctctcctgctcctggagatggtctcagagcccagtctgtccaatcccagagctgctttctggcggccaagatatcatctgcatacactccgtcagcactgagcacccttctcaccctcccctgtactcacaccacacgaagcctcaggtcacccaccacactaacagaccgcactcaatatacccaggtggcacttatggtaaagaacttgcctgcccaatgcaggaaatgtaagtgatgcggctttgatccctgggttggaaagatcccctggaagaagaaatggcaacccacttcagtattcttgcctggagaatccccacagacagagaagcctggtggg

SEQ ID NO: 29161 - DNA, 928 bp, Bovine  19866880403495
tctgtccaatcccagagctgctttctggcggccaagatatcatctgcgtacactccgtctcagcactgagcacccttctcactctcccctgtactcacaccacacgaagcctcaggtcacccaccacactaacagatctcactcaatatacccaggtggcacttatggtaaagaacttgcctgcccaatgcaggaaatgtaagtgatgcgggtttgatccctgggttggaaagatcccctggaagaagaaatggcaacccacttcagtattcttgcctggagaatccccacagacagagaagcctggtgggctatagtccatagggctgcaaagagtgggatggacatgactgagcacgaacacacacacactgcacaatccttcatctcagaagtcacagtgtacacacagacctcacctggagtctcagatgtgcctggaccatgctatcctcatcctctatcctccatactctctacaccatacataggctcccacccgcctgtgaagtcttatgcctcagtttcttccactgcacccgacaaacatcccacccataggtcctcacaggacaacacacacggcccctttggagcatcaacagccagggactgtgtcattaagctgctgacaggtggtccctaccagcagctaccctccccccacccagttctgcatgcccagccttctgccagagccagacagtaaagcctgcctcctggcaggcctggccaaaattgtcaggaggttgatgatgtgtctgaaaaggggggaaaaaaaaagacatgatttggaaaatatttccaggatttgaaaacaaacgtatgatatttgatctgttcgtgatccatttgtaacactcatgttgctaaatactgcctgatggagaaaacatttggctaggttgcaagttttatttaaaggttg

SEQ ID NO: 29162 - DNA, 1212 bp, Bovine  19866880477669
gccagtagcagaggctgttgggattccgaagcaggaaatggggcaagaagatggaggagctgtcacagcccagggccgagtgaggacaccagagtgccagcgtgtagcacactcgctgctgccctggggccaaggaagtacatcctgtgtgggcagtcctgccagccacagcaagccacctggattcatgcccagttagggacatgggtctggatcaccccagctgtcctggccacccaagtcaagtaaatgagatttgggtaatttaaaatcagatttggatgcctactaaaccaagattctctctcaggggatagaactggggctggaggcaagagaccaaatgaggctttgtgcctcctctgcaatgtcccatcttattttttattttctcaagaaaaatgtattcatgggtaagaatgtattcatacccaactacttgggtagtaataaaaagaaacttaaaaaaaaaaaagatcggaccttaaaaacttactataaaaatatcaattgtctaagaagagactccagtgttccttttcagagctggaggtgggcactgcctggttgagaaagtgctcctgacttgccgaatggtttggcatcagctctggtccttgggctttagtttccccatctgtaccaaggggaggtgaacccaatagtctctgagagtcttcggccctgacatcaggtaacgagatgcttcactgtctatttgggttattcggggccttctctgtgctgtgaggattcccttcagaagcagaggcttgggccttggtttgggagtgggtgccgcccacccaggtctgtgggtgacagcagagcagccctgggctctgtgggcagaccagctgagctgccctcctgggggcagggggagctctgccaggcccctgaaagccctcagagttcccaggcctcgggacagtcaggccaaatgctggcattgcagtggggttgattgtgtctctctctgggtttgggattgaacagccgtgacctatgtgtgtcattaagacagagatggtttggttaggtacattggcccagtgaccctgccccccagcaccgatcactatggcaacagttcaatagggtcccaagggcccaagaatccggcttctactgagagtgaggttggctgaggtcagacaaagagggattaatagagccctgttctcattaagccacaaagcaccattatta

SEQ ID NO: 29163 - DNA, 969 bp, Bovine  19866880554250
aatagcatattagtcgagtaattttttaaaaaacttctatttctgatccaacttgttctagatctgctatgttttcatcttttgattaaaaaaaattttgtattttgacacaatcttaggctcataggaagttgtaaaaatagcacgtaaaaccgctttacccagcttcccacgtggtgacgtcttatgtaatggtagtgtaatatcaaaatcaggaaactgacattggtaatgatgcggtgaactagactacaactcaattccttattcagttttcactagtttttacgtgtagttttgtgtaactttatcaccataaaggaacttgcctaatgctacttcttcatttttatactcactctccacccccatccttgtcccctggcaatcactaatctgtttccatctctatagttttatcactctgagaatgtcttatgaagagaatcatatagcatgtcaccttttgagaatggctttttcttttctttttaaagatccatccaggttgtaacagtgccataccatttaccccttctttattttggcatatgctggtcctcatgctaaacgttcatcttttacgactaagctcaagtgtttgcctctcctcccattttggtctaagtttaggctcctccctctgtgttctcgtagctctcatgtttacctctactctgatcacactgtactgttgttaggcgctgggtccagtgttccccactagacttttgagtaatccctgagggcaaagattacatccgagtatctccagtgcttcaatgtctgtcacagagtaggtgctcagtaagtaaatagtggttaagttaataaatatatagctgaagtattcttcttagtgaattgcataccaccttataccagatcagtcattcaataaatgtttaataaagagtaacattgatttattttagggcacaagggatccgatttgtgccataactgcat

SEQ ID NO: 29164 - DNA, 871 bp, Bovine  19866880632546
caagccccacccaagctgccaaatccagctccattgctgcctcctctttcatcttttccaacccctgagcccaaagggcttctcccctctaccctgccctgtccactccctccacaactaccctgtattattatcctgtaatctgggtccatgtcttgcctctttcatagtctatgagctccgtgagctggggcatgtctgatgcttctctgggaccccagggcccagacccaacttgcagcagaggccgccacacctggctgagtgactctcactgctggtcctgaacttgggcagcaccttcacaacccagctgggcactgtgctgcctctccaagttaatttcttttcctgtgtgtggtctctccattcattcattcattcattcatcctgctttgtgccagatgctatggtccccatcccctcttcttgattccttgcactactagagaactcatccccaacccctgggcagcccagcagactatcttgcccataaacagtacttggcaaatattgattaacaatcagttgattaatggatgaacaagatattccatatagtggaatattactcagcaacaaaaagaaccaaagtgctaacacatgctacaacatgaataaaccttggaaacagtatgctaagttacagaggccagacacaaaaggtcataaatcatatgatatcatttatatgaaatgtccagaacaggcaaatttatatgaaatgtccagaacaggcaaatttgtagaaacagaaaatagattcgtggttgccagaagctgagggaggaggaaactgggactaactgctaataggtatggggtttctttgagggaggttagaaatgctctgaaattggagagtgg

SEQ ID NO: 29165 - DNA, 1296 bp, Bovine  19866880713032
aatgtaaaacatttcaaggcaaatttcaaataaaaacttttcctgcaatgagaaatcattaatatactattaagactaaagaaaataggctttgagtacaatgttaaggtggcttgttgtttagtcgctcagtggtgtcagaatctttgtgaccccatgatctgtagtccaccaggttcctctgtttgtaggattttccaagcaagaatactggaacgggctgccatttcttttctccagggtatcttcccaacccaggagttgaaccatttcctgcactgcaggtggattctttactgctgagccaccagggatttaaggtatgacactttaaaatttagtgatttcatcattatactacactatttagatatttagatataaaaatctacataaaaatgacatctactaattacaattggccctacccttcaagaaggccgtccaattcggattttctgttatctttcggagtatgtttggtgaagatttctagagcaagatcttcatattgctgcttctgttccgaactgagggtctctaaagattcgagtttaataaaagcttttgaacaagtaccaaaagctctactggcacacgcacagagtgctaacagagagtagatctcaactgcagggatgatgtcttcatagtctctcaggtgaagagctaggaaagagaaggcaatttggattgtgtaaagcaataacgccatcgtgaacatgcatggggaagaatgttaggctggctcagtttaacccacatgaatgttagcaaagttaatgaaaacaatggtaggtgatcagagaactagtaggggaagtagaccacatgaccaccacgttctgtaacacgagccaacagctcagggcctataaaaattaccaccaccaaatgacgcacatggctgcaccacttagaaatatacgaaaaattattggtgtcaaaatacactgcagatataaatataaatatatatattataattgtataattttatatgttttatatttataaaacataaaacatttatatgttccatataaatatgttagaaatttctgtggattctcaaaacaatatcatgtttctttttgtttaaaaaaaaaaagtgaagtatgaaatcatatgttttctctttgtgtttctttgaacagattatcgcttctcagtctgtcttattgaaaaaatagaactttgagaaaaaaggaagtgaaactgagtctctaagttatcagctcagatcatttattttgattaccatatcctatcttcacaggctacagggcatggcca

SEQ ID NO: 29166 - DNA, 1878 bp, Bovine  19866880713849
tagcatttttaaactcttgcttggcaacaagtcagtattgatttgcagaagtaaatgagctgatggtcatgcaatgatcattcaacatatcggattaacaccccacagtcaatgtcagaaagtcaaggtaaagtgtagaactcagggtcagggagttcaggtataagggggtctttattattccactcagttattaaccacacagttgtaagctctccccttcacactcagaatgcaaaaattaattaataagataatatgaaaaatttattgaataattctgctagttcaatttcatttgcttaattattttttcaggagaaaagacaaagtatttgcctcttcactgacttctctctgtcagcgtgaaattcttgggattgaaacttgcatgatgcttctccttccctacccaatgcacccacccctacagacaaagggagaccagaagtccgcggactcttagtccactcctccaaactccccatctctagaagtactggaaaatccagatcccccattctcctccagtaccacaaacctggagtcatagaataagcatcctctattagagaagaaaaaaatacattcctagtggcagtcagcaggaggcaggggctcttccagcttaatgacttgcaaatcaaaagcataaaaaccagaatgcaccttttgaacctctttcccattctgcctagagtgtcctcataattttctcccatagcgttcctgttatttttgctaccagaggtaataaccttccttgtgcatttttaaaatgttggaggaggagctgtccagtgatctcaaagcatgtgtttttgattctcataagattatggataccaaaggaataaaaatggaaatcactactgccaagatatgaaagagagtttgcatagtaaaataatttaaacctaacatttggacccaataaggcaaatggaacgttttttccatatttttggaaaatgtgcattttcttcacattaagtggtaccaataaaaaataatgattctcactcagtttatttctataaattagattggcttatagttttccaggacatggttttgtatcaagctatatggcaaacacctgggcataaaacccactcagctctttgcttccatgtgggtgaaacaggtcaccattcctctcttctaaatctagagcaaagagcaactgaagccagttaatatattgagttccatctatctgccaagaatgggtatgacatcaacaacttgcggatgtttgtgaagttcctcccagaggctgggcgaccatcttctgattagaaatcggatgattcagcaatacatgctggtaaagacatttgactcatcctggaatcagataaagaaagagagaagatcaaataataaagaagcgttcaaaattacttttatgtggaattcatgcatgaatatgctaatctagggagaaatctaccaatgagaccattgcctggaaatggtgagtggtgggtggatgcaaatgaggacatgggaaatggagaagaggtacggacaagcaggaaaaacaagagaaaagagagaaaaaacagaggggagggaagagattaaatgttgcatctagaactcatgttgtgtgttattgtttttttttttttcaaagttaagttagcagacgatccagttccaaagtagctggaagcccagctcatccggaatggtggcctgaacagcaggccagaaccagaaccagaaatgtcaaaaccagaaatgatggttcaaagctagtgatgctttaagtcccaccactgtacataagctccagccgccgaggaccccctcactcagcaatctgatgtgacagattccttccttccccatttcccaggcctgttggaa

SEQ ID NO: 29167 - DNA, 1486 bp, Bovine  19866880744253
tgaccatcactggccatccagtaggaccacgggccacctccaaccaggcccacacaactaggctaaaaacaaaggtgtccttcacttatccccctgccatggctccgaaggtcccctgttctctccttgccccatcccactggactggctgtggccatgtcacctctcctggtcactcagtgatgaaaaggaatatgtctgtcttccacattgacggcaccaagttctatcccaccatccagctgagaaagctcagagtcttttcttcttctcctcttcatcctcaggtcccgtgattctgtttgtgtctcttccatcccaacaacactatcttcctggaccagcttctcccttgccttcaaagagacaagagcccacaggcagtcatctctccagccacctcctcaatctatcctcatgaataaacttttcaaactgaagttctgacttaagggatccatgaactagcagataagacgtggttgggaagggtgtatttgtacaaacgactccactactttcatcggaatctcaaacaatttatgctccaacaaaagtggacagacactgtctaccatgctgccagaatgatttttctgcatcatcactctgtgttctgatcaagatgaccttgtgtgcaggaaccgtgtctgaaccatctctgtttccccatcattttctttggcgtctggcacagaggaggaagttccacgcatgttgaactgaattactagctacggcccagtatgatttcaacagcatgtgagcgatgccttgaagaactctccctcttgggcaagaaacccagaggaaactcttggctccttcctagcaagataacagccttgaactctgaaagaaacattccatatgcatcaatttttcaaatgaaagtgagcctagcataggtgcctccagcctgtagaagggacttggggacaaggcgccagctgcagcaggtgattcgccctcaggcgtgactgtgcaccttgtcacagccaagccacctgccccattgaaccgacaacagaaacaagtcctccccacttgactacaggagccagatcccccaattcccaccagccccaaagctttctgccaatcattactccagtcctgggctcccctacagatgccaagctgtatgcgtcttgttcagagatgtttatagctcaagttccagagacaacttggagggctctcaggctgtaatctacttaagacaaaaatccatgacgtctccttggaatccaggaagttcccagggggcattgcaatctgaactttgggatatttgattttcctgcatgttgtgtgcccaggtgagaaatctacaaggtaagccagaagatggccggacccacaaaaatgtaaaacatctatttgcaaaggcaagaaacaggggatcgtggagtcccattcctcgcatgggttccggcagcacaagccaagtgcagaagagatctacagaggaaccagtgtttgc

SEQ ID NO: 29168 - DNA, 1324 bp, Bovine  19866880758814
tgcttttgtttttacaatttgaattgtttctaatagctttttaaaaatttattttttattttcatagctgcactgggtcatcgttgctgcatccaggctttctctagttgcagaaagtgggggctactctctagctgtggtatgcaggcttctcactgcagcggcttctttcgttggcagagcgcaggcactggggcttgtaggcttcagtagttgctgcatgtgggctcagtagttgtggctcatggcttccagaatgcaggctcagtacacaggcttagttgctccacagcatgcgggatcttcctggaccagggattgaactggtgtcccctgcatttcaggacaaagtcttaaccactggaccagcagggaaaccctaatagcttattttttatatcttttcctttttacccactttcttagtttcatctaagagatggcaattggcatgtactcttcataatattgtgcagaacacttgtctctatttataatgatgtaaatttatagaaaacatccagtttgtagttatagttttagctgaaacattgtcactaagctggaccttttatctaaacaagtcttgggtttgggaagtgattctcaataagtgcctgttttgatttactgtcattaattttaaaaagaaaaactgttatcagtcatgcataatttcttacctgttaaagatagctaataatgttctctatttcccatgaacttacatctttttattctgtggctgcaaaccagactttagcactattttatcaagattatttgctgaactttgacatttagtagaggcaataaagagaaatatacaacattgttatagcagcttcagtactgaagttagttaatccaaatgtgttatgtttttggtcctttagagacaagttaggcatgtagcagatagagaatagtgagctatgagaagaggtttggagcttaaatgagttcatgtagatagtgggttgctgtgcctagttaaaacgagaagaccaggtcttctaagtctctgtgttcatgtgccttgtgggaagttaccttgatataatggtagcctccaaatacagtaccaggcaagccattcacggaacacaaaggattacacaccaaaaaatgatgcttaagtcacatggtttactgaatcaacttaacgtacacagtgaggaacaaggagaaagtgatgggagagattaacactgttagtgaaggatgccagtcaggtacacggattccagttcccgattcctgaattatgtactgttctatgtcctcactctatcttcctcaccagcttcccccagtggtgtgg

SEQ ID NO: 29169 - DNA, 1671 bp, Bovine  19866880806504
caactctgagaagcaggcattgttatccccatttcacacatggggaaaacagtccctaaagttggtcatatatattcagtggcagaagggagataaaaatctgtgatggtctgactccaaagattatgctcctccctccaacaagaaccaatgaaataaattctgggaggcaggtgtcccctctaatgatcgaattctctaacagtgagaatgaataccacttagcacacgtggtaggaagtaccttaattagaggcatccaggcaggggattcagtttccagtcacacgcgtctcctccaacacagcctggttaggtcacactcttacacacacacacacctcccaccgccctgattcaccatgcacccaggagatggtctgaatcactgagggggtataacttgaaagtacactcccaagtggttccagtctgtcatggcggggggtattgctgctggaaatcctcagggaaggaagttgggtttggatgttccaaacactcttctaaaccctgaaagccctcagctcttgaacatctatggagcttcgacaggacacacagcactttggctcggcgcctccagaacattccccagagccgggatcagggtatccaccggatcctcaatgacctcaacctcttcttgcacaaacacaacacaggtctggctgaaaggagcagcggagggtgtccagaaatgccctgggtagatcgaaaccaaggccccaggaggctgaactaaaagtttgctgtgtttattctcacttggtcagatccaggaagaaaagcggagaagagtgatctgggctggcaggtcagcaaacccccccaccacgtgccgcccacatcttgttccagctgaggagggataagccattctgccaccatgaccctgccaagaagctgatgacaaaggccaggctgatggctccaggccctgcagccctctggttccagctggggtcactcaggctcccatggaagctcagcctggtcctggggcaaaggaaggaagggtgggcacctggccagcagcacacgggctcagtgcccagccagcagggccactcgtcccctgctgacccagggcctggtgccgatgatgtgcatcgccctccatccacttccctttcctgcttcctccctcctccctcctatttcctccaagcctgaggaccttcatcctctccagttctctctagcgcttgctccagggaaaggagactcaagtctggactggaagcccccttggcagagaaatttcactataggtctcagctgtaacttctgcaagctataactttcctgacccgccaagactgggtttcaggctattctgctgcgtcccaaaaaccttctctctctctttagtcactaagtcatgtccaactcttgtgaccccatggaccgtatagcctgccaggctcctctgtccatgggattctccaggcaagaatattggagcgggttgccatttccttttctgggtaagatgtatggcattgccttgaattatccatttacttaccctctgccctaccagaatataagtaccttgagggttggaactgtcttttttcacccttgtattcctaacacctggcataagagagaaactcgagcagcattggttgaatcagtggatgggagacagatggaaattctaag

SEQ ID NO: 29170 - DNA, 2314 bp, Bovine  19866880815746
aattggataatttattattatccaattaaaaattgagcaaggcatctgaatagacatttctccaatgaagatatacaaatggccactaagcaaatgaaaagaggctcaacatcattagccatgaggcaaatgcaaatcaaaatcacagtaatacttcacatctactagcatggctagaatcaaaatgtcagacaataatgagtatttgcaaaaatgtggagaaatagtaggaatgtaaaacagtgcatccactttgagaaactgcttggtagttctgcagaatgataaatatagaattaccatatgccctagcaattccactcctaggtatacacccatcattaatttagaaaaagatattcttcaaagttccttctcactaagaatatattctcttaaacatcttttcatctgttccatttcctagtgaatatttaattaaatttccaccgtgtaccctttgatgaaatagaaaatccatcgtaaacagataaagaaacagagaattaaagataaaaaataacttgcccaaggttagtcaagcaaaaataaacaaagtaaacaatataaaatgaaatacacacattcacacaaaacacagaaaaacaaaaaactcattaaaagctcattttagtacctaatttctaaattcacagttaaaatggtacaaaacatatttttcaattcacaaacactgtacaaagtaatcattaataaagtcaggataatgggaaagtgttaataacagctacctttatggagtttttatgctgtgtactatgcttggtcgctcagttgtgtccaactctttgtgaccccatggactgcagcccgccaggctcctctgtacatcagggattctccaggcaagaatactggagtgggttgccatgcccttctccaagggatcaaacccatgtctcccgcattgcaggcaggttctttactgtctaagccaccagggagttcttgccacagtccaaataaaggacatttaaggcagtaagagacataggaactgaacaaaaaattagaaactagactgatggtatggtgttaattgaataaacaagttgagattcaaatacaagaatttttatatgctaaatacctcagtaagttgaattatatttaaaaaatttttttcattacaattgtcacgatttctctattcaaaatgtgtaccaactgctatcaaactctagagggagcaagaagccttcctttaaagaacagctgattggaaggcagtcctgagaatggtggcagagccccaattcagggggagccctgagtgagacgaaggagcagcccacgtccaggttttgctcaactttcgctgatcccatctgcactaaatcataagatacctgctaaatattcagtaaattctaccatggatactctgacacaaataactattatgcctttagtgtgatatgaagtaagttcacaaaccttaactgctttctaattttattagaaagcatataaaagcattattaaccagtgcttagctacaattaaaaattatagtcatgtttcctttttttgataaagcctaaataatcacaagttcattattagctgaattcaaaatttaaaagttagtggttcacagcaagtcaaactttggattcaaatcacaggcacttgctttaagtttgtgtacatggtccatcgctcagtcatgtctgactctgcggccccatggaggccttagataaattacttattccagctgaaccttggtctgcttactgtaaattgaagataataatattaccaaccttatagagctacttgaaggattaagagagaaataaatataagtatagtatagtatctggcacagaatacataattaataatagtaattttaagtgccagtatttactgaatttctaaaaattatgccaggtatgttatgtaattacattcgtatataattaatgtatcacatacataattcatacctaccctgtaaggtgggcactatcattatccccacttagcagatgaagaaactgaaggatggaatggttaaataactcgctgaagtcacacgactagaaaaacaatagaagctgggacacgaacacggccaatccggttccagagtctgtgttcttaaccactatggcagactgcttctccttaagggttaataactgttagatgtggttgctattatttttgctttttataataaaactatatatattcactagtcaatacaacaaaaaacaaaaatatatatgacatgtgttcttctgaatcattatggcagtaattttggcaaattcatatgcat

SEQ ID NO: 29171 - DNA, 1412 bp, Bovine  19866880822195
ggcttttttggaagaaaggttctcatagatcttttaaaaaaaaaatttttttttggatgcttcctgctttttagaagagaaaataaaaccaggggcccaaagagtaaagggaattggcaaaagccactgaatgggatataatggtctgtctagtctctgtctagtcagagttcttttcaagcaattcacccaaatttcagcactactttagaggaaaaggtacccagggatattgaaattgagaggtgattcttgtgaatcattagcaatgcaaatagatgtgttttgtttgttggtttgtttttcacagagagaaagcacacacaatccaggcttgaccagagcatctgggacctgcacaggtacctgtgctagcttgtccccaggtcacactgatggcccccacgtcaccaagcccagtttcagggccaccacaagaccctgtaaatgcctcatgttcctgcgtttgtctatgaactcgagctcagaggcgatcctaaggggagttacctggctcaggtatggaatttttcaaggccccagaccagaaggccccaggcagggccccagcggggctgagtcagtgtcaggaggagacatggtgtcagcgtctagctaatgcgcaaatagatcatgaataatttgctggaagcagctgaaggccatacgcgttctacagccatcaaatgtagactgtacattgttttcaaacttatttcattttctcttttgccaaaaaagggggaaaaaaagactcaagttttgggccatgagatcaaccctgttcatctgcgctatggccctgtgttctccgggcctgggcttttattggtgttttgtctgcgatgggctttggccatggaaatgcgaacaaaatgaggtaactcacacttaaatcttctggatatattgtggctgatggctagtgccgctgagtgtcggtggagataggcaggcaggcaggcaagcgcctgattcgagtggccatatggccaggagccagcatgttccacagataaggggttcagaccactggtcaagaatggagaggctcaggactgcaggacaggatgaccttggctgtaggctatggtgtctacttcatgacactgagcactaaacatcatcatctcctgggcggcagtgggacccccattctgcatgtagcacaggggggcttcactgccctgaatggagcacacagcccctggcaaggggggaaatggtcaaacagaaaccacagcctgcttttctgtagcctgtcctcattcacccctgcagaagtaaaggaagagcgaagaggaggagggggtcagatgcgggggtcggagtggtgggggtgggggtaaaggaacacaaaaaatgagagaaattggacatcccagtcgccaggaggctggggaccaagccaa

SEQ ID NO: 29172 - DNA, 910 bp, Bovine  19866880864703
tacccttttggtatgtctgtggtgttaatactcttgacatgcaaacaaaatttggggtgggagccattcctgctgcttttgtgtggtcatcatatacagaaaagactggatcacaataaaagagttgcaatttacattatcagactaaaatatgaaaacatgctatcaaatggaacatttctggaaatttaaaatctactatcccaattccaaaaaacatacatagtacataggaaaataaacactttgaataagatgaaagtaaacttgcaatatattctcagagtaaaaaattctcaaagactgttcaatgaaggtcaaagtagaagttcaaaaattatctggaatttagaaagattactttataaaacctgaaaataaaaatggaaggaaggtggacctccaaacaaaaagttactcaaatattctagaacaagaaaaagactataaagaaaattatcaaatatttcttcagtgttctctgttactaacataaaataatgacaactaactaccctttctgagctcttggtcctagcactccactaactgctttctactcattatcttacaaaataacaatactgtaagaaaggtcctattactgcccacattttatagagataaaagcaggctcacaagcaggaaaggaaaatgaaactttaaaagatgaaggaagctgtctaaaggttgtgtgagtgacagagcaggctggaactctgcaacccacactcctcaccagcaccccatactgcccaggacaaaaacgaattccagtcaagccaacaacagaaatgtaactgttttttaataagaagtacctttaatatctcatccaaaagaacagatttaatttctaaatcctcaaagttacagatatatccagaagtctgaatgggttcctttaaag

SEQ ID NO: 29173 - DNA, 759 bp, Bovine  19866880875684
tgactcatttcagaagtggggttcagtccttttcaaaaacagaatcaatgccatctttcatgaacacagtctttctctccccttttgctgcagcccaatccattcttctcagctcaggaagaaccagagaaggaaaccaatcagcaactccccttgtggccctggtgaggacacagggcataacaggtggggggctctttaaagggaatgaagaggagggtccttctgctttacttaggaggcccctctgtcattaatcatgcctgtccctccagtttctaggcccttaccccacccaataaggccaaacatcaagcagagactctggaggtcacccaccttcctggagcacccagggccagtggattccagaatggactcccgcacccgggaaagatgaaatgggggtggatccacatgcgggtggattagcagacatcatcggcagtggcttatgaggtagtttgttgttgttgttgttattttgttagttgacttccctggtggctcagacggtaaagcgtctgcctacaatgcaggagacctgggttcgatccctgggttgggaagatcccttggagaaggaaatggcaacccactccatcactcttgcctggaaaactccgtggatggaggagcctggtaggcttcagcccaaggggtcgcaaagagtcagacacgactgagcgacttcactttctttcactttcactttctattttgttagttaatttatttggctaggccagatcttaactg

SEQ ID NO: 29174 - DNA, 1478 bp, Bovine  19866880914155
attccctttccttgttgcctaaggtctaatttctaagaccacagttcctatcccctcctccaagggatcttcccaacccagggatcaaatctgcatctcttatgtctcttgcattggcagacgggttctctatcattagtaccacctgggaagcccaatacagacataaaatagaacaaataaagagcttagaacagggcctgatgcctagtcaataaatagtagctattgtcatcatcattgttattattacttgtacagacatagagattgaaatctctatgtggggagggaccgtgcctgcctatttgtctactgagttccaagctcctagcccagtaccaggcacagtgtcctttagtcaacaataaatattcagaagcaatgaaccagggtcctccagactcttacacctctcaggccaggaaaggggctgcaagaattgaataaaagagcagcctgagtacccactttctctctccagccagaagatgtaccaagtaaagtggttaagagtctgtcccacaacaggctggagtaccaggtccctttggggtgttgccatgtccttgagcccaggctacgtgtttccaggagtacagttctcacaaagctagcccttgtgtttgccctgcatccctgggaggcacagagaaaacaatgaaaccatcatcaccaacttccattcctagtctgtgtgtggacagggagggctggggagaggctgtgtttgatttggctggggaacatcatttttctttactgaagaaatgcatgccagaggggctaaaagtagaaggtagttctcacccaagagagctgtattctccagaggccaggctcacagtaatataaagaagctgtatcttccatctgcacatcacccactcctgctttaagattcagttcaaacgtttccttctccgtgaagcccttcccaccttccccttggctcctagtgtgccctgggcctgctgtctccatctgagcatgctcagtggatgccttcctgaaactgcctcacccaccagggcaaggactgtgtcttatttgcttttgcaactgtcttagcagagtagagtgctgctgcattctgaacccaggaatggcagaaagaaatcttttgaagggcattaaaccccctgttgttccagagtgtgaagaagagaaggctggggttatgtgtgggtcctcgtaagagggaagttctctgaaaacttccctgaacttctctgggaacttctctgaaagctagtgctgtgctccctaaggtagggcagtcagggctacaggccactgcactatcagcctcaggaatgtgactccctttactgctgaaacgacctccctccctggtataatgaccagaacgctcccttattccaagccaggggttctcaaagtgtggtccctggaccagcagtatcagcatcacatgttctctacctcagttgtgctgatcagagactctggaaagg

SEQ ID NO: 29175 - DNA, 1481 bp, Bovine  19866880957473
ttagtaaggaccaaaaattttgagcccaggtctatctggtttattccaagatatgacactgctccttgaagaatgcttttatttctgtctactacttctctgactaaataaaggatcttttcctattccctgagtttagaatgtttgtaaacttcttataaaattgtggtaaaatataacttagcctattatgagttggtggtgaaagtgactttgaatgtcagtatactggcattttttacttgcttgcaattgacttttaatctcaattaaatactttttatttcaaggatctcttaatatattttattactgatttttaaatttaaactgatcagatgctattttaattaatagaatagtaataagtttattatactgaaactaatacctattttatgtttctcttttatgtgtagttttgttgtttttgttttgtttctggcctccatttaagaattttgaggtctgatcaaaatttttacctaatttattttacttaattcacttaataaacttattcaaccagtgtcacatacctacatggcatactgtacttgactttagagacactggtgaagaaaacattctgcccaccatcatcaaatttgactttttttgtggtaaatacagacaagtaaaccagtgattgcagtataatgattataatgctgttgacttacttattttatttaacgtagtgatcctctcccttagaattattatctttcctttatgggtttttttgtaccaagttaaccacagactagattatattagagttgtttgggattttatttgctctctaataaattagaaataagaaagttaagaccatgctccacagctttgaagagtacagttgacccttgaaaaacacaggtttgagctgctcaggtccgcttatacatggattgtttctgttcaaatcctaaaagatgatgttgtgaaagtgctgcactcagtatgccagcaaatttggaaaactcagcagtagccacaggactggaaaaggtcagtttccattccagtccccaaaaaaggcaatgccaaagaatgctcaaactaccacacaattgcactcatctcacacactagcaaagtaatgctcagaattctccaagccaggcttcagcagtacatgaaccgtgaacttccagatgttcaagctggatttagaaaaagcagaggaaccagagatcaaattgtcaacatccattgtatcatcaaaaaagcgagacagttccagaaaaaatatacttctcctttattgactgcaccaaagcctttgactgtgtggatcacaataaactgtggaaaattctgcaagagatgggaaaaccagaccaccttacctgcctccagagaaatgtttatgcagttcaagaagcaacagttagaaccagacatggaataacagactagttccaaattgggaaaggctgtatactgtcaccccgtttatttaacttatatgcaga

SEQ ID NO: 29176 - DNA, 800 bp, Bovine  19866880976564
gggtcgccggctcccaaccggtctcccagggcaccgcggcggccgggccccccgccggtgacccgggaggatgcggtgatcgctgcaactgcaccccgcccgcggaccctaattcaaaccagacccgccgagctccggctcctgacccctcggcggaggcaagtttgggcgccgcggactcggtgcgggagcaagcgggcgtgttggctccggagccccagccaaggttgcgcggcgaacgacggcgggcgggtggaggtggggtcctcagctatccgttggccgccggagagaagccgggccgagctggtagcgggagattccgggaagttggccccggcattctagagacccgcaagaacccaacttctgggctgctgaagttgtgctgcccgcggaggggcgcgagccggcgctgggcaccgccagggcgcccgggcggcttccacgctagtggaccctggaatggcttttcccctcccccgacctggctttgtgctggggccgcgcggagggaaggcgggtcccttggcccgcccagcggatctggaggaaaagggggacaaatgtggagcccggagttggaggggaggcctttgggtaggactccagcatccacctttggcgaggggtgggtcccctctctgagagggacctagccgacaaagagcatcctgaggctccccagaaagtggtctgtctccccagccgccgtccgctggcccgccttccccaaagggggcgctttgttctcggcccctgtaaccctttcctggaaccgcccctcagcgccggcccga

SEQ ID NO: 29177 - DNA, 894 bp, Bovine  19866881043247
acttcctgaagtgtaagctcccgtcaccagagaagggaagtgtctgtgccaggcatttgatgagttcccaaggaagacaccaagggcacaaagctgcctggcagcaacctgcttctgagccaggcaccgcctgagacatccttgagcttccaggagaccccagagcagtgcttgaggccctgtctcccagtgggagcacagaaaggcagcaagcttggtctgctcttttggctacgacctgagtgcagctaggcagccgcttcatcttcatgaagttgaacgaggctaggaagtgagggagagagaagggctcagggcagtctgtcgccctgaacaccccctcccccaaccctgctccattccagaaggggctcactcatcccagagcctcgcctcgccctctgcctgcagcgcgggtcaccaggggtatcagctggacagtaaagggattagcatgtccgtcccagggcagtgagttaccaggcaacaaacaactagctcctcaaccacagaacactagagatcaggaattacccagttgttcttgctccagtgaataccaaaatgcccctagggggctctcagaactcctctctagaaatagaaagtgtatgctgagggcatttgaatctcagggcctgtctcttaatacagtgcaaagttaaagagcacaaactctggagtcagaaggagtgggctcagatttcactttttacatgctgtgtgaccctggataagtcacttgactttctctgtgcttagttttcctcatctgtaaaatgaagctattaatagtatctacctcttacaactgcttcagaacaattcacaccgtaatatactttcaagtacctacaacaatactcagcacaccgtaaggattgcacatgttga

SEQ ID NO: 29178 - DNA, 2257 bp, Bovine  19866881078995
gagagggaggggaagacaagaagaaatatttgaagaaataatggctgaaaaagtttccaaacttgatgaaacctataaacccacagatccaaggtcaatgaaccctaaccacaagaaacacacacaagggatagttagggattttggaaaggtcatgtacacactgctatatttaaaacggataaccaacaaagacctattgtatagcatgtggaattctgctcaatgttatgtgccagcttggatgggagtggagtttggggggagaatggatacatgtatatccatgtatatgtatggctgagtcccttcactttcacctgaaactacaacattgctgattagctataccccaatacaaaataaaaagtttaaaaaaacacacacacaacataaaaaatgtacataatgtaaaaaaaaaaagtacaatcaaggaacatcataaacaaattgctcaaaatcagtgatagagaaaaacttccaattacctgaaggaaaaaaaaaaaaaagagaggctttccatacagaagaacaaagttaaggaagacagcaattttctcagtggaaactatgtatccagaaagacagggcagccacatctttaaagtcccaagtgaaaaaaaaacctgacaacctagaattccataccctgggaaaatagcttttgaagacagaagtaaattaaagacattttcagacatgcaaaagccaaaagaattcagcagcagcagaaccatgctggaaaaaaaaaaaaaaaacagaaaaaagtaacacatgtcctctggctgaagaatggtaacagattgaaatgtgtacctatgaacagactgaagagcactagaattgataactaaatgcgtatatttggaagttttaaaattatttttctctttaaaagataattaactgttgggggggaaaaagtcataggtcagagaaagatggaatctgggcagtcacttgtttgcaaagttatttacttatttcattcaactgacgggagggccaggaatataaatcagctttcctgatgccgtgttcggattttgagctacctaactgaatgatgacagatacaaaactcctttctaacggaccagaaaacagttactctttttctggtttccaggtcaaatacttcctcttcaggccttcctttacccattccttgctcaacacagcccctcatgataatatttgcacagtgctttataactgccaacctttccatgtctgttacctcacttgatcctaagaacaactccaagaaggccgtaggccaggaatttgcattttcctgatttcacagatgcagaaactgaagctcagatcccagttaaatttcccaagatgagagagtaatagcttggtgacacgaggaattgaatttcaactttctgactccagatcctgtgctcattccaccattctgcctctcacgtgtccttattccatgttaggtggcaacattctcctgctagtaaattattttctcatacttaaaagtcatgactttactaaaaaaaaaaaaacaaagcaacctcagaaaagcaaaattacaactttttctttcactcaacccttgggcttatttataacatattccttctctcagcaaaaggagacctgaaaatggcacatttagcgtttgcctacaaggaacattggaacgattaaagaaagttccatgatgaccgaacaaattagtcacagattggaaaacagggcgattggtacaccatccaacataaggaataaaatgtacagtttatcaatgagaagtttcttggtctcatttttaacatgctttaaatgtaggcatgggggcttccttggtggttcagtggttaagaatctgccttgcaatgcaggggacaggggttcaatccctggtcagagaagatcccacatgccttggaacagctaagcccatgctccacaactactgagctccaagctctagagcctgcaagccgcaactgctaggcctgtgggctccaactacaaagccctagagcctgtgctctgcaagagaagccactgcaatgagaaacttgagcaccacaacgaagagtagtcccaacttgccgaaacaagagaaagcctgtggacagcaacaaagacccagcacagcccaaaataaataatctttaaaaaaaattaaatgttttaagtgtggtgtggccacatttagatgataccaaatttatagacatgaaattgaagccatgaaagacacttgctccccggaagaaaa

SEQ ID NO: 29179 - DNA, 930 bp, Bovine  19866881095099
atggaggccattgagatgtagatggaaacagctagaagaacagccctcctggcatgcgctggcaggaggacaccctggcctcagctgtgaggtgactagcggtcccagttagagatggagactaaagactcagagataaaatgaaggctcagcccttcctgccaccactgaaaaagctcagttaattctagactcctcttcctcccctctgtgctgagatttcatcagcttttgtaacacaatcggtttcacctggtcaacacaactttctgagtagccactgtgcgtcaagtacccaaggacatgcactgtggacaaaaggatgctctcaggtcaaagggagggactgctgctgctgctaaggcgcttcagtcgtgtccgactccgtgtgaccccatagatggcagccaccaggctcccccatccctgggattctccaggcaagaacattggagtgggttgccatgtccttctccaatgcaggaaagtgaaaagtgaaagtgaagtagctcagtcatgtccaactcttcccgaccccatggactgcagcctaccaggctcctccatccatgggattttccaggcaagagtgctggagtggggtgccattgccttctccaaagggagggacaattttctcaaaagaatctataatgttttctctataaatctataatgtaagtgagccaaggaatacataatctcctttaatatgaaccaatttttttccaaatgctcaaattctgaagtgctgccttgagaccccaagccttcccacctactatgcacacgtgtgcacacacacacacacctgaatgcccacccctttcagtggtacatagcacaatggtgccccacctcttatactgcggctgccaaagctactaaaaggaaaatagagttactagatgcctcgaactcagcagcctc

SEQ ID NO: 29180 - DNA, 927 bp, Bovine  19866881102702
tcaatgatgaactgtagtgactgtggctgaacacattcaatacacttttgtacaacatggtttccattttgatctttcacacatttgagtacatgaccatcgagctcctttaccatttcactctgcaaaagagaagacatttaaattaccttaccaaacaacataaaagaagatgggaacaaaagtatattcaaaaatttgcttccaattttttatatatcaaagtttaaaattcctgaaagtgtcaataagcagaagccactgacggtgagaattactaaaatattttggattataatgtaaatgatatttgctaaaatataacctgctgctgctgctgtaacctagtgatactcaatttgctatatttaaactgtcttcactgtttgtatcttccactcatctttctcagctgacaactaatataatgatatcagaattctatacttttttctactaagcataccccttccccccagtaatcatcatcatcatttttttggctgtgctgtgcagcattcaggatcttagttcctcaaccagggacaaacctgtgccccctgcagtgggaagtgtggcgtcctaaccactaactgccagggaattcccccaagtagttattactgatgggtatttgagattatcaagcacacagaaaacggtaaggagctgaatgagccctgaagagccgtgtaattttcatgtaatacatcaattatgaaaaattattattgagcacttttattcttctttttaataatcttacagtaaagaacttgattcagggaatttcctggtggtccagtttttaggactcttctgctgctgggggcccaggctctccctagtggggaactaagacccttcaagctacacaatttgggggaggggggtggggaggcagtggtggtgcatgcacacgaatgg

SEQ ID NO: 29181 - DNA, 785 bp, Bovine  19866881110981
gtcttgctctctcaaaacatcatttcaacagacacttgaatgtacaaagcagagttttaagagagacccagtgtgatttcttcacgaggagacaagacatacatgagaccagtttaaaaagcatcagcctcgcttaacaccaagcccacatcacaattgttgccttgaaaaaacttctgtgggtctttctgctgattgtcactccatgagtcactgtgaagggacaggtgtactggctaaaagcaccttgtaagttagagtctagacactgtggttgaagtcctttcactctcactgcagtccaggttctgaggattgaagctgacttcttcctgcaaagtaaacagattcaggttagtctcccaaaccacactcttgtattcggaagggactggtgcaatgaggcattccccacagggctcccacagttcccagccctgccaagtcactgaccagcctccccagacactggtcacggtgccagcaggtcccactgcgagccgggtctcctcatgtcctgattctcagacggactcagggagggaagcatgatcatgacacatgcagccctgtggccatcagccagggacatccagagcccagtctgctttttggggggctgaagacagacctggcattcatggaagggagacactgaatttccccagcagagtccagacctctttactgggagccttgaaacctccaggccccaaggttacttgagcagtatttggatgtaggatgaaggaaccatgcgtccaggaaggagaaaaggaaaggga

SEQ ID NO: 29182 - DNA, 1137 bp, Bovine  19866881135931
tagttttctagcagtgagctttggaaatagatgagtacgcaaaaatcaaaatttatgagttcagccagatttttctttttctgctaaaaatatcagtctgcttaaagcttacagtgttggaagagatagaacccactgctaattatctatgagcagttcatctgtgctaccttcttctcccctagggcgaagggccctaggctgggtgagtagggctgagttggccttggagatgaaaggcctcattcccagggtaccagcaggaagatatgtgagtactgcccagctgagaaatgtgtggctactgagaaggagcatggccaatcggggttcatggaggatgatggcctggccagctcccttcagctggctcttgccttcatgtagtggtacttgaggacaggcagtgtctggcagggtgggcctcctggtcacctcacaaaagaatctgcttcctaattcagtgtattccacattgggaagctcaagggaaccagacaagaccctttagtcagcgctgcccctggtccccccaaggtgggctggaaagaagctgggacattgggttcaagtcccagctcggtgtttactaaccctggtgaagtcacggggccccttggaatctcaatcccttcatctctgaaacgggatgttcgggtcgtgctggccttgcttgggttttggccagagttaaatgagaacatggaggggttggtggttgttattactggcataaaaggagctatctcccagctcattaatgtggaaaatgtaaacgtctgcatgcctaaggacaaaggcccagccggccctttccgcattccctccccacccccatattgttgggagtttgttttggtttttctggaacttccagaacaatgggttctgggggttggttctgcagctattcacactcccaggggatgcatttatggagccgaggccacattccaaggataaggggtctgcagggataaaacccagctcagtcttgcagcctggagaggctgtgctgggggcaggaaacccagagacactcccatgtcagccccacagctgcgggcccaagtccaggagcctcacgggcgatctgatccatcagctgactggaaggcagaaaggccaagaggtgac

SEQ ID NO: 29183 - DNA, 1706 bp, Bovine  19866881143784
ttgaagacgcgcccacccagagtgcgtgtgagaatgtgctgaacaggcttcctggggaggccaggtctaagcagagacctaacagattgtgagcaggttcagggggggtagaaagcttgtctcaggtggggacacctgaacctacaaagagccagagggcgtgagagcacagtgaaggcaggttctgaaaacagcacctgcagagcctctgacctgcccacctggagaagggctgtcttcaccaagtccctgggtgacttggaggccatcgcctggatccagatcattcatttcttcatttattcctttaatgaccactggattctgacaacgtgccagggcctggactaggcactggggagacaaaaatcaagggcttagacctctgtggctgaagaaatagcactgaaccatgtagatgaaagaagtcctgcccaagacgacaccatgagacctcagccaccacatgcagagggtacagctgggtcctccttccacccacgtgcctgggtgtagaggcgaaatcagggacactcccgccagccttgcagggacttgcccttgaactggtccttctgcctggagagcctgcctttctgctcccttgtgcacgcactagctcagcacacacagaggcacatacatcacctccactctggtcacaggcacacacccacgcctacccctatgtcctcacacacacgagtcacacactggtgctagttaccaagatggggaaaaccagattggggtggggacagaaagcaaaagttttggcttgcctatgttaattttgaaatgcctggtagatatccaaatggagatgacaagcagatgtgagcctatagtgcagtggagaggtctgagtaggagatgcaggtgtaggaggcatcagcagatgaatggttttaaagcctcgaggagataatctaggtagtgtccagaggagaggagaaagtctagaaccagccctgatgcatgacaacatgtagaggttgattaaaaccaacagaggagcctgtgatgggcagagagagagagaaaggagaaaagcagggagctgattttcgctgaaaccaagagaagagaacatttcactgaagagatgcagccagtcatcccactgctgctggaagatccagcaactgggcagaggagtgaccactggcttcaacaacgtggaggtcgctagagagaccttgacagacaagagtggttttaatggagcagtagtaatgggacgccaacggggttgggtgtggagaaaatgggagtgaaagaggtgagagcatcagatagagcttcttaaggaaattctgccatgaaggcctatgggagcaacagctgctggagggagaggggcatcaaggcagaaattttttgtctgatttgcttttcttttatttttattatattttttatggtagcatagttgatttacaatgttgtgttagtttcaggtgtacagcaaatgattcagttatatcaggagtacagtgtgtacagcaaatgattcagttatacatatatgtattatttttcagattcttttcccttataggtagttacagaatattgagtatgatactctgtgctatacagtaggtccttgttctttatctattttatatgtgcgggtgctcagtcactcagttgtgtctgactctttgcgaccccatagactgtaccctgcctggctcctctgt

SEQ ID NO: 29184 - DNA, 2839 bp, Bovine  19866881222342
cagccaggcatgtttagggggaggctggacttcttccggagcactgggttggaggatggagcttacagagagtgacttagaataaggacagtttgtctgcccactgctgctgtgccacgtcgtgggggcatggtgccactgctgcccgggaggaacccagaggagcacagactctgaaacctgggctgctcccagagaggaaggagaggaagtggtccagctacacagtttcagttcttcattccacttatcaggggagtccctctaacccaggttgaggagggatgggtacaggggtggagagatgtctttgctattagagctccacccacatggaagtaggcatggatggactggggggacatagtctttcttctcctctcaatagtctagctgcaactgccttgattcagcatgttagagcctctgctctttacgttcagagccccttcccctttcaagaaggctctgagttgctacacccctcctgaagtctttctcactctcctcagagctattgtcccttctctgaatatgtgtgctcatcagcttatactcatttatatagggccttatgcttttcaaaacaattcaagttttgatcagtggttatagcaaatactgtcttcttaggagccctttaagggtctcctttacgtgggccaatgcatgtgtatttatttgtgctcagttgctcagtcatgtccgactctttgtgaccccatggagtgtagcttgccaggcttctctgtccatgggattttccaggcaagaatagtggagttggttgccatttactcctccaggggatcttcctgacccagggatggaaactgcatctcctatgtgggccaatacttgcacttaaactttgtgtttccttttctttgatgttcttggtgtttctaaaattgtgatcatgaattaggggctggaggtcctcaatggggagaagccagcatcttgaactagcctctgaggcccaacaggggtccagccccaacagggactctgtggccagaactcttcatcaccaaggccaagaactacacctcactcagcccaccctggcccttacagctaaccaaaccatgatgttcagctaggttaacaggatggaccacccatttttatagtgagatacattgaccccctgagaccattacatgggctaggaagggaagactgggccgagtggagggattagtccattacagcatgttctggaagggagacaagctccataattgggcctggggggaacattcttactaccttcctcagagactgcttcaggactggccaggaagggccccacaactgtaggcctacatctgaggccattagatcacatgtggaggaagaaagggccaggccaagatggcctccaaagccagactgcgttctgtcagcttccacagaagagttaatattgatccctgtgggagtgaagatggttacctggtcatcactggaaaacaccatcacctggagaagtgggcttcatacatgttgctatggagatcatgactgttcctgacaggtcaggaaatgtgagaaagtggggacagttcaactggagctgttgaaagcccttgtggagaacttagttcctgagcagcgtcttcctccatggaaggactccagatgtgatgagtatccttgtcgccgatgtttctcctttgctaactggagactagacagcagagctgaggtaattcgccttatgtcataaactctaaggcgacaggcttggagggcctttgctgtggaaccgtgagaatgctccctgtttaatgaaggggtcaagatccctgaatcggaacaccactgacagggcagcagggctgacatgtcctggggttaaaggtgtttgaaatttgaaatctgttgatatttatggcatgccctacaggtggtcctggagagagctaacacagtgaccaccaccatgacgaggaagcagaaagcaggtcaggacagtggccaggacctttaggtgctgtcctctgaggaggaagaaggcagggtctcagggtgggcagggctcttcaggtgacaaaatgtgttcttgaagttccctctcagatcttggctttctggctaacaggccccattgtcactgaactcaagccatatggttaagtatactttcctggcccaagttcaaggtgcatgtagaggtggggagtcgctgaggcaggaagactaagatttcttggctcatgtggactttcttccagggcttccttccttaagaaggataaccacacttgttaaacgtctcataaaatgcctgaaaattagcatagccagacactagacaagcttgatgggtgagggccaggtggtttgggccaaagtctttagaactcacgcagatctgcaggcaaggcctcttcctcaggctgagtgagcaaaatgggcccagctgagacgatgctgtgattcacagagagctgttcagagaactcaacagaaaggcgactttgtaggttggtcaggacttgaggcagctctcagaaggttgagctcatcttgggtaacagaagggaaagatgaagcttttcatgggcagaacatgttagggtcatcgctctacaactcggtaggggttggtgctcacctctgccctcctccgcaggacactggtctgggcaacgccgattacggttcaagtgcagacagactcaggtcaggtagtgtaggcatgtgtgagaacagaagtgaggaacagtggagactccctagcaggacatctttgaattagaggctttaccatccctttgaaagtctccagtgacttcatagttcaagcccttattttgcaggagaacat

SEQ ID NO: 29185 - DNA, 1155 bp, Bovine  19866881419662
aatgggtagatttcgaagggtatgtaagtgcagcacttccactcaaccaaaatgtccaagaggagggagatggtaggttttttactggtatttagggatagcaattgttaatgtcctctgaagcaaggtgaaacagaggtacccccaagctggaaatcagaatggagtaaagcaatgctcataaagaagggagaatgaagatgataattttttggcagaggcatctgcaggggacaactacagagaacaaaatgttgatgactaatcagctcctgaatacagcaggaagggtcttaacaaataaagaaacaggggaatttgggagtataccagactatcagtgacattttattattacaaagggaacaggatatttatcttttctctatttttcctgtattattttcggcctacaaatctacagaaactagttatttccacaaaagttttttttaaattatctgttcttttgatttgcttcagcaatctaggattatctggggcaactgcttgtcaactgttagaaacaaaaaatgagtctatgagagtgcctgggctacatattaaaatagtaagctccaaaagtaatgaaacagatcaaataggaaaattaaaagactgaatagtctctatgttcactagatttttcctgagaagttcccatgcccattctttaggcaatttttttattaggtaaatacgatatttcctttttgtatctcattatatcaaaaaagaactatgcacctaaaagttaataggtgttctggaccatccctattaaaaaccttcaaagagttaagaagatactttcttagaaaactggcaaaaatagttagtaatgactggcatgtgttagtttggccattttttcacaccagaaaagaatataatttcatgtggcaggaaaacagacgagaagcagattttaagactcaaggacaccagagaaataaaacatttcttgaggtgtgaataaatgtcccttataaagaaaaggctgtccaattataccaagagaatgagagtaagctgtttttcccctaacgtttcctgaacactctggaaacaccagagactaataatacatgtgtcaacagggtgtcaaggtgggcctcttcgatttcagctctttctcagttacaaaatcagctt

SEQ ID NO: 29186 - DNA, 691 bp, Bovine  19866881765255
cccccactcgcctcttctgtgaagaactgcagacttgcatccctgccaccatgccacctccctggagcgcccagccccgctggcgtctccccttgcccacggagttctgggcccgccggggaggggacctcacctctgcttctctctctgacttctgcctggagacttgggcacaagggctttctcgcgaacgactgacttttccactgcagacagcacctggcatcctgccacgctgactcaatttctccaagctgaagcaggcccagctctggagagaaggggaccctgctgctttggacgaagatgctgtggctgagggtggacacgtctgtagcacttactggtagacaccagcaggcctgggggcgtgtcctgccgagtagcagggccaggaggtcagggctccgtcagaattcactttgtttcgtggggaggtctaacttagatgtcaacttgtttttgcacatgtttttcctctagtttctttgttcatagcccagtaggctttgttacttttgaggtaagttaagtaagtcgatttggttattccccatctttcttccctaatctacagtcaggagacagcatcagggtttttaagaagactttttcttttttttttttgactaggagaaccaaatccaggagccaatgtctaggttagtttgtgtcttgtctgagtttatcg

SEQ ID NO: 29187 - DNA, 1581 bp, Bovine  19866881898685
cactgtaaggaccggctttgttgaaggctcttgctagttcacaggagaatgacccagagaaaaggtgacttgttgccagaagaggacctaacagctggacagaccgtgaggtcaccctgctaatgcacagaagcccagaatggaggtgtaggtcacagtcacctgcaggccaagtccctgtatcaagtgcttctacccagaccggtaacagggccctaaatccaccacgattgcatccttcctttgggccactgggacttcggggcttgtgcccagtgttgatcaggaggcttagggcgtgcggcagagggtcaggtgggaggcacctccatctggtcctggaggagggcccaccgaggagcccggccctcgtggggacctctgttggggttgggggtcagggcgcagccctctctgttttccctcttgactcaggaaaccacctgttcctctcattccaggtctccaaaaagtacagcgacattgaggagttttaccagaaactttgcagtcgttacccgacggccagcctgcccccgctccccaggaaggtcctgtttgttggcgagggtgacatccgggagcggagggctctgttcgacgagattctgcgctgcatctccaaggatgctgagctggcaggcagccccgagctgctggaattcttaggtacctgagaccctgtcccaaatccctacgggcccctggcccaaaactaggcctcactgccctggcttggggggagggggccggggtgtggtccacagcaccctctgcagcccagagacctcggccaagctattgaggcatgtgggcttcattcactgccatgcttgggctggggtcgtgggtggtgggtggaaggagccggggacccagccctggaggacggactgcttgggtcctggacagggctcaccagggaccttctccatagtctgatccctccctttcccctcctggccagccccatgcagagctccccttcacacatacacacacacaaatacacacacacacacgtgcacatgcacacacacacttatggagaagcaggatcaggtggtctgactttcctagcctctctgtgcctcggtttccttatctctaaaatgaagatacaattaggatctctcacatgaggtttttgcaatatttaaatgaatttatacctatcaaatggcaacctactccagtattcttgctgtaaaattccatgaacagaggagctgggtgggctacagtccacggggtcgcaaagagttggatgcgactgagcaactgagcgtacctgtaaaaatgttctttgtgtgatgcttaccccatgaaatggaaggttcatgagattttgcaagggactttacatttgtcttaataaaataacaaagcataacgtaatacaacatagtcaataccacttagttccacatgtcatatcagtgtacacgttacatccctgtgtcgggcactctgtggcatggtgatgggttctttacccacagggtgatatatctttagaaggttcactgctttcaaaaatacactggttcagtaactggatagagttaaacaagcattcta

SEQ ID NO: 29188 - DNA, 1526 bp, Bovine  19866880480879
ttggcctataagtagaagtagtagtatttatctgttaaggtttcatgaatattaaatgaattgatacatataaaatgtgtggtagattaatcttgtcctttttagtactgggtggtcaagccaaaagaaaagaagggagctctagtatcgttaaaaaaactcccattgtattatagacgggtagcttagaactcagagtctactatatgaattcactttaacaaggtcacctgatgtgtgtgtatatccatatttttcctgttatcagctatataggcttgtctttaacagttattagaagatgaaaaaaaatacccagacatttcatagtgattgatgtccagtttatgaattgtttcatacatagaccatttaattaataaattatgattatgcaaactttaatgagttgtattaacagacatttattaaatatccactgagtgtcaggttattatgtgaaaaagaaaggaaaaccaggttttttataatctgataaagcaacatgtaaaacaatagtggaaaagaatatagtaaagtttatcaacaaataatatactgcaattcttgaattgttttgaatgtcctttaaatagttatttggaaaagcaaaagtaatcctagtagaaatatttctgcttttattttggtggatttcgtgatttttctcattctaaatttgtacatggatgaagttgctaaataacatgaattttgttacaaaacctcactcccttaatgctttttgatccttctgtttctctgactgctgcaaagtgtaaaattgcatggaatgttcttcctgcacagttgagctattaagcagaactaattctttatggaatgacaacaaggcgtaagaaaggcatctcttgtattaggcaatataaggcaatcacttggcaaacgctgaaggggaagtggtcttggagaagacaaagcaacagcgctttttctcttccctctgaattcataggaaccacacaagttgaacagctttgaagctggttaatgtggcttactatgcatgttttttctgtgccatttcctgcttgtttttgccagcagaggggccaagaataatcacttgataaatgcattagcatgtctcatacacttctgtgaccacacactgttgctgggaagacagataatttgagaagaggaaaatcccagttggggatgtctttcaaagtgagatcagattttactcccaaactaacaggatcctgtctagattatgagagtaccatatggagactgattatttaaaacaaaatttttaactcaagattaagtaacagttgggaaagatgaaaggcaaagtgaacagtggtttattttcattttatcagctttagaatggaagacagaaatgttggtattaattttatgatgttttaacaattatagaaagctgtttttatttccttggatttttcctgttggcagtgaaggtcttcccaggtggcccagtggtaaagaatccgcctgccagtgcaggtgacacaggagacgtgagttcg

SEQ ID NO: 29189 - DNA, 1079 bp, Bovine  19866880578691
atttaaatattaaataagaatatacacaaatgatggttcaatgtcttgagtataatttatgtaagcattctctttaaaatgaatataggagaaatggttggccatatctataggccctggataaactggattgatcgatttcatgctcactgtgactatttttggtgggaagggccttgagagtaaggactagggtggtttagtgttgtgtaagcgactgaagtggggacttctgggctccctgctcgattccctttgctctgaaaggttgattgaagggtcagggaattagatttttatgcctttagttcacagtgatatgtgcatttatacttggcctatgtgctggccatattgaacatagctggtgcttatgctgaagatatttgtgataagcaaatatttagcttctttttctttatatttataatgttggtctggcatcctcaggctgcagtttcagttagcttatgaatgactcatcattttttttcaccatcaggctctatcttgttgatctttgaaacttgttttatttttatactggtggaattgaaggaattagtttataattacataacatgtctgtttatactgtttgatagaagatggatgtttgtatttaagcaattacattcatattctgtctcaaaatagaaaaacaaaatattctatagcctgtagttttcactgagatcatgggtatttactatacttgctggatcttgccaaggtcatgtactcttccacactgccaaaatgtcttttttaccaaattaaaggtgtgtttcaaaatatgcttcatggcagttgtttataaaaatcaaaggggaaaattcttatttattaaagtagtttaagtagattaacatttccaaagaacttaatggctatttaggaagaaataccactcattataatttaaataaagaataaaaataaatgtattttgtgatggcataactgtaattagaaaaataaaactgtgatgaaaagtagctactggtacatgataattttcaaacggctttttatggaccatctgtcctgttttttttttttccactgcccttccacca

SEQ ID NO: 29190 - DNA, 758 bp, Bovine  19866880596884
gagaaaggttaaaatagaacagtctacttacaaaagtttttcaaaagagtcttttgaaaagcagttcgcttcatcaactttcaaaatcagtcatctctggaaaaacccacaatccagctaattagtctcagctgtttgtcatatggcccacaaaccagtcaagtgattttgcccctttcaagcttttactaaaacccaatctcctggtctctcagacaaaaggcagctgtattaacctcttccagtgttagaagacttacacttcaactttttcttttccccccaaccaaacaagtagaatatttgttttcttgataaaacatactaaaagtattgcgttctaaaggtccttaagggttatattaatattgtgtatgagtgtttagttgctcagtcatgtccaattctttcagaccccatggactgtagcccgccaggctcttccgtccatgagattttctaggcaaggatactggagtgggtatccatttcttcctccagggggaatctttccaacccagggattgaactcatggctcctgccacgtctcctgcattgcagacagattttttttttttaaaccgctgagccactggggaaactcttacattaatattgcttctttatttacaattagcaatattttattaatattgctttcttgtatttacaaggcctgattcaagcaaacactacatacaggagatcagtgtaagttgaaggaagtgaagggacttcccacacatttcactctggc

SEQ ID NO: 29191 - DNA, 1304 bp, Bovine  19866880616333
ctggatgaagcacaagctgaaatcaagatttccaggagaaatatcagtaacctctgatatgcagatgacactacccttatggcagaaaggaaagaactaaagagcctcttgatgaaagtgagaggagagtgaaaaagttggcttaaagctcaacattcagaaaacgaagatcatggcatctgaccccatcacctcgtggcaaatagactgaataacaatggaaacagtggcagactttatttttttctgctccaaaatcactgcagatggtgactgcagccatgaaattaaaagatgcttgctccttggaagaaacgctatgaccaacttagacagcttattaaaaagcagagacattactttgccaacaaagattcgtgtagtcaaagctatggtttttccagtagtaatgtatggatgtgggagttggactataaagaaagctgactgccagagaactgatgtttttgaactgtggtgtggagaagacccttgagagtcccttggacagcaaagagatccaaccagtccatcctaaaggaaatcaatcctgagtattcattggaaggatgatgctgaagctgaaactccaaatactttggtcacctgatgcgtagaactgactgatttgaaaagaccccgatgctgggaaaaattgaaggtggaagaaggggatgaaagaggatgagatagttaggtggcatcactgactcaatggacatgagtttgagcaggctctgggaattggtaatggacagggaagcctggcgtgttgcagtccatgggtcacaaagattcggacacaacttgacccactgaattgaactgatggagagatgcaggtaaagctagctgttgttgacaggcctgtccctttattttaaaaagtacatgctcagtcatgcctaaaccacagtagaatgcacagcttaggctagagcatggatcagtaaactttttctctggaagcccagataataaatatgagttttgtaggccatgcattctctgtcacagttactcaattctgtctttatataaggaaagcaaccatagacagtgcggccacgttccagtaagacttcgtacataaaaacagtgtgctgagtttggcccataggctgtaatctgctgaccccagactataaactggatcatgtaaaggactctggagatcagaggacaggcataggctgcatatacaaataaggaagacattacctaagactggataaactcacccaataccaatgagaaatgagagccaaaaacaaaatccagggaaatgctgacattttaaagga

SEQ ID NO: 29192 - DNA, 1231 bp, Bovine  19866880632606
ttaatcaagattaataatatttagttaccaattacactagcagtatcaaacattcatactgaagcccactatagctataaataaggcccctgggcaggttggtgctactgggttctttaggtctgcccaccacatcacactagtctttcagtgatctgctggtttagcctagccagaaaggctgcccacctagaaagaaggcaagattcatgttgctcacatatcctatcaagaaaaacaaaaaaaatcagacttctttacacttacctccctgctctacctgcaattcttgcagctcctcttgtgataaagatgcacattctggagcgggctcacagctgtcactagctgcaccatgttcagaattcaccatctcgatatcagacccctagagaaaaagcgatcatcagttaattgtctatcagctacccaaagctagatttgactacctgtaaatgcttccattattaaaagtcccagatgctgctataatccaaagggaacagtatctattgcttttgttcaatttagtccataaaacctacagcagagaaacagcagaaaggagccacagatttagactctgaaaggagtcagtccagaagtcaaacactctaactgcactaaaaacccaagagtcaatctgaatcccagaggatttctacatttagctatttctattaatttgcttctactcaacatttatggaactattctagccaaggcattttgctaggtgtcacagagtataaaaaactgaaatctaaaattcacatttaaagcctattcagagaaacagtcacaagtaaatattaataactacttattacaacatctgactaaaaatttttaagggcaagcattaaaattaatctattagattaatatggcaggctatagtccatagggtcgcgagagtcagacacgacttagcgactaaaccaccaccaccattacactaatagagtaaacgttctctgtaaaagtagactcttctttattcttccaaggtttttactttgatgtcagattgtcttttctttaataaaagtggatcttaacagattttttttctcatcttaattagcaaaataagttatccaaaaatgactcagtctctctccagatccctctctcaaccctatagtttactgatcatgaaatcaaaaggtctgagttctcctgagacatgtaactcaacataactaagagacttcattaaaggaggagt

SEQ ID NO: 29193 - DNA, 1769 bp, Bovine  19866880671261
caccaggctcctccatccatgggatttcccaggcaagagtactggagtgggatgccattgccttctctgagtctcttctagtacatataaattaccttttccacagcattattaagactactgaatagctgtaactttttctattaaaatactgtaatttaaagatgaacgaaatctactctatcatctctgttcactttctgaaactttaataataatttctatatttactataaggcaaaactctgacatttggaatcatttaaataaattccatattttcaagtaatctgtgagcaaagccatctaaaattcttttttgaaaactgaattttatagtattacttttttatttaagagtctaatattttcctccataaaacaatccttcaagttcccactggtctctgttgccccactgattattcatctaaaaagttaatgaggccatttccaatggcttgactcttggccttacctaggtccctcccatcactgtctctaataatgctggttctgtcatctccatgatataataagtcacgttaaatcagattaatgctcattggggctaattagaatataaactaccaagaatttctgtaattattactccttagaaatgaagctgcaagggccaaaatccctaaggagggaaagtagtgattatagaggtagttatttaggttatcttaataacttgatgccagagcttctctctatctgctctacactcttcaagggaaaccatgaccatttcagccagaagttgagagctgtggggcacagaaccaagaaaagggaactttcaaagcttgttgtaacaatggctactttgatccttttgttaattcttgaacttcttaatcttatctcttcactcctacctgcccagtgccctccgaatgcacaaggggcagagaagttggaaggagtgatgtccacaatagggaaagaaacctctctcatcctaagaaagtaaaggaatttaatctatatattatcacccttcattatgtcaatcaatctcaattaagcaaaataaacttttaccttttatgtagatctggaagcttatttctctccttatcatcttaggggagtttccaacctattaaatgaagctattttttcccatctaaagactctacaaattaatgatttttatatgaaactcatttataaggataaaatcatttatttgtatgtgttagtcactcagttgtatccaactctttgcaaccccacggactataccctgacgggctcctccatctgtgggattttccaggcaagaatactgaatcgggttgtcatttctttaacaagggggtcttcctgacccaaggactaaacccggggtctcctgcattgcaggcagacacttaaccatctgggccaccaggaaagccaaagtgaaagtgaaagtcgctcagtagtgtctgactctttgcaacccccatggactacacagtccatggcattctccaggccagaatatggagtgggtagctgttcccttctccaggggattgtcccaatctagggatcaaacccaggtcttccgtactgcaggtggattctttaccatctgagccaccagggaagtatttgtaagcactttttatttcttaaaatcaattttttccctttttaaagagtggattatttactttaggcctcttatggttttttcttggtctaggtacaacttctttattctttaggtttaagactcaatctatttggcaccaagtctttaaagggaa

SEQ ID NO: 29194 - DNA, 1872 bp, Bovine  19866880687767
aattttcatttatgtttagcttttaatcacccttttatgatgtatgtattttgtgtattaattaattactttgtatgttggcacagcaacacaagtatataataaactcatgcatgtgtatgtattttgagagtgaacctcagtttttttagtgatgagctgtgtgtaatcacagaactctgcagacagctgctatgtggctagtctagatatgcaaggtcgagatcacaacagcgttctctggggccttcactctgtctctcagctcttattttgggcaagatggcaaatggaggcctaactcatactcttccaacttaacacccggaggccaaagactctggcagtaccagaaaagtcctggggagactgatttggttgggttccattccataatctgagctagtcactcaggccagggaatggaatattctggccacttggattagatcatgttctccgggaaaagggatgatatgaatcagtcttaagggaaccatatggcaaaggtgtcccccagcaaagaggaaggacacacagggaagtgggcagacaggacacacagcggtctgggtgagagtggggcttactgccccaggacagaccgctcaggagaggaagggtcccagccagagtgttcagtccagatgtgggcatgagaaacagaagtgggctgctgggcttagtcatgggccaaggaaagttttatgttaaatatgcataaaggaacactaccgagcctaggtgaagatggtgtctgatacccacgaacaaaaggctgggatgtaatttctcttcaggacttcctgtactttgcctgattatgtcctgtggtgtgcatcaaattagagactttgggatcagagtggccttgcttttcatcttagctctgccacatgctagctgtgtatatgctgcccaatttaccagaacctctgaatctcacttctgtcatttatttctctctggaagagttgtggggaagatgaaatgagaatacctgtcatagttcctagtgcctgataaataggaactattatggtgatgctactgatgcttttgttttcctttcagccagtttggccaaatttctgtggtgaaggatgcaggactgattcatcattgaaacctcactgagcccccagagagcctggcatgtaggaaatgttcaataaatccttgttgaatgatcattgagggagggactgtagcttattctgtgtcaaatcattcctgagggactctattatgaaatgctgctcagacttgcagctctactgaaggacaaattagtctttgaccaagaaaattacgtcttagtggtttccctcttgccttgtgaaatgtcgaccaatattactacagggaagcttttcaaagtattgagatttcttcactggctttgagagcacatattagtatttttcatggcttcttctattgctttataaaaatattttaatctgtattcccacactgattacacaagagctgaataaactagtcattaatgcagccaaaagacccccacccccacccccacacccccggaagggatgaaaaggctggcatgacttgggattgtctgggctacttggaagagtaacttgggaataaagattatgagttttctcgagccagcttcgaactaccgtgactcagtgtggaggaagttgccatggaaaataattacacaggctgttcttaggacttccctggtggtccagtggttaagaacctatctttcaatggggaacattggtttgatctctggtctgagaagatcccacatgccgctgggcaactgagcttgctggccacaactattgagcctgcatgctgcaactaagacctgatgcagccaaatagata

SEQ ID NO: 29195 - DNA, 1672 bp, Bovine  19866880744466
aaataaattttaaaatagaatgcagaaatgtgttgagtatatgcattatttaatgtctaaatttatgaaattttgcttaagttattaaacttaagtttaaagcttcacaatttatgtaccatttaaataaatcaaaatttacaaacctgtccaaaaagttcttcatctatgacaaacctgaggtccaattctgttggatcattttcaagaatccatcttaatgaattgtaatactcactatcctagatgggataaattgcatatttaaaatttgtgtacagaaagaagatacctgaatctgcaaagaaagtaaccgaaggtctgaataactggacaaaagacgaaaaggtcagatggatctcttttacacacacacacacacacacgttacaaaaagagatgaatagtaagtacatgagtataaatacagatattgggacttctctggcagtccagtggttaggatgccatacctccactgcagggtgggtgcgagttccatccctggttggggaagtaagatccagcatgccacagggtgtggccaaaaaaaaaaaagcatttatcaatagcatggtgctgcttaaaaagtttagaagtctatttctgtttggaagcagtggaggtacagatttttattatccagttaaagggtcagttctgagatatatcctaacttccatgacattcaggggctctcagcaccagtccatatggccaatgagactgtgtttgaaatgattaagtaactctgaggagactgctatttatacttggccctaaattgaagaaaaatctcaaattaaatacagaaccttaattttctaactccaataactatgcagtgttatgatttataaagaactatactgttcaggggcttcccacgtgccactaatggtaaagaacccacctgccaatgcaggagacataagagacgcaggttcaatcctgggttgggaagatcccctggaggagggcatagcagcccactccagtattcttgcctgaagaaccccatggacagagaagcctggagggctatagttcatagggttgcaaagagtcagacacgactgaagcaactaagcatgcatgcacataatgttcatactgataatatgtcatgagaaagggacttggtgccatggaagaggccttggaatccatgtgttctacacatttctatgatgctattcagcatgggttataagggtatagtcaaggatttaattcttgggtttctgtttctatgtagtagcctaatttcaaaactttgctttggactgccagtttgaaaacatgtcattcatcacaaatgatcacaattcaaatactgacacaacagacacacaaaattattgtatatagcatgctgaagtatttagggagaaatttactcatacctgaaactttctttgaaatgcattaaagaaataagatgggttgatagatagggagcaggcatgtggataggtatgtcataaagtaagtatggataaaaagccaattgtggaatctgggtggtagatatacacatatccgctgtaaaactttttcaactctattatatgttagtaaattttccaaataaaatgttgggggaaatgttcatttatattcagaacatccattgatttcatcattaaaaagtaagtctttaagatattca

SEQ ID NO: 29196 - DNA, 1696 bp, Bovine  19866880762334
actgtggctccccagagtttctcactgcccgtgctgggccacactcagactccagcattttgtcaaagttaccgtttaagtgtttttgccagcttatagctccagttgcttctggaaaagacaagcagatctttgtgtctttctggacacacttgtctctctgggtttcagagtagcagttttctctgtgactgacttttctgataggtccagaaagcttcgtttttagtgtatccatctttttctgttataaggataggaataacaactttttagcgtgtcagaatggaagctggagctcctttgttgaccttttagctttatatatatatatatatgtgtgtgtgtctatgtgtatgtgtgtatacatactctatataaataaacataatttttatgatatggatataaattttaggttattcaagtttttaatggttgccatatgcagctttagcttatcacaatctatgatctacttcagtttaacactgactcagttccagtaaaatatagcaagtttgctttatactgcttcatttggtctctttatttttgggctattattgccattcatgaataggtatatgtatatggattttataaataaataatatgtgttataattttactttaaaaattatttttttttaaatctcaagttttcaaagaaagagaagaaaagcaatcaaatactgtgttttaaaaaattttaatggattaaacataaataacataaaatttaccattttaaccatttacaaatacatagttcagtctcattacatacattcacattgttttgccaccatcaccaaccatccatttccagaactttttttattttcccaaactgaaactctgtacccattaaatagtaacttcccattccccatttccctaagcccctagcaaccagcagtttattttgtatctgtgaatttgactcctctaggtgtctcatgtaagtgccatcatactatatttgtccttttgtgcctggcttctttcacttagcataatgtcttcagggttcacctactttttagcatgtgtcagaattttcttcctttttaattctgaaaaatgttctgttagtatgtatataccacattttgtttatccatttgaattgtcttttatacttacccatatatttaccatttcccatattcttcattcccacttacggatctgagttcgtgtttagtatcacttcctttcagcctgaagaatcttctttagtatatcttattgggcaggtctgtgacaaatagtttctctcagttttcatatgtcttagaatgtgcttatttcatcttcatttatgaagaatggttttgcaggatctagaacttgcagttttaatttctgtctgtctgtgctttgaacaacaggtctttcgctgctttctgtcctccattgtttctaatgaagaatcagcctttaattgtattattattcctctgtacacgatgagtccttttttttgtctctgctttaaagattttccagtttttgtttggtctttgggttaatttagtagtttgactaagctttatctaggtatatctctttgtatttattttactcttggttgaaattctctgaaaagtgtaatgttctcatcagatttgagaagtttttggtaattatttcttgatgtatttttagttggaaactacacattttagtg

SEQ ID NO: 29197 - DNA, 3778 bp, Bovine  19866880898077
ttggaaaagaggctgatgctaggaaaaattgaaggcaaaaggagaagagagcagcagaggatgagatgattagataatatcactgactcaatggacatgagtttgagcaaactccaggagatagtgaaggacagggaagactggcgtgttgcagtccatggggtcacagagtcagacatgacttaccaactgaacaacaacaacatcccatgtagtatggtaaaagaagtaactgttattatcatttttattttaattttttgattaaaattttttcaagtgaaaaaaaaaaaacaatgtttatattctcaattggtgacagtttgggagaagaaactgctcctgtctgagagcccatattaagctgcagtgttgttctacctagaagtcatcaccacttgggcatctgccatggtagaaagaataggcccctgaacttttcaaataacttggttgccctacttttcagacttttctttttccatctaatttccccaacgttgacttcctttgtgacttaaatattcttcccagctctcagacttcttttgaggagccatagaaatttcgttcctcagcctaaatagaagctgatttcttcaaatggaaaattcagcaaatcactgcagtaatgtgtattgattcttcctgctccagcagctggatcaatgtgagaagcgaatgtcattatttcctgtgctgtctacaatcccagatgtattcacaagagaggccaatggtaacgactcctgaagttttacttgaaagagttgtaaatagtctgttacacctttggaaagctcaggacagaactctggttatgcctgtttgtggcccaggcactgtcaaaaatcagaaagtctgacatctttggttctactttgggatccagaaatggtgggcctcagttcttgcttcttcatgctataggatcatgggacaaactcctagaaaattagatcaccttcaaccacttgacctgtgaatacaaagaattaataccatactttctctgagatgaatttaactgcttatcttagattaatataaatataaacataaacaaaatgggtagttttgcagtaaataaatgtactataaaaacaaaaatttagagcttagtttaacattattttttcacaactgagcaaacaaagtccaggaaagtaaagagactttccctagtcatcatccattcagagtggtgttgagtctagggcccaggtatatcagtcttctttggttacttaataattctcaatagtagtatgaatggcaacagtatgtagtttgaagaccaagcagtactttgtcccatgttagtatttttaattttagacagtatttaaagaaggattaagactgttcaaaagtttttatttttcctgggaaagctttaaatccactttggtaagggagaaggtgatgttgggagtggtattggtgtatgcagaaaatggggtttgtgcagaagtctgagacaagttgggtgttggtaagtcttttaggaggctctggtctgggaagcaaagcaagcataattattcatggattgaggaaatgttggaagatgacacctgctgctgctgctgctgctgctaagtcgcgtcagtcatgtccgactctgtgcgattccatagacggcagcccaggaggctcccccatccctgggattctccaggcaagaacactggagtgggttgccatttccttctccgatgcaggaaagtgaaaagtgagagtgaagtcactcagcgacctgaccccatggactgcagcctaccaagctcctctgtccgtgggattttccaggcaagagcaccggagtgggttgccattgtcttctccaagatggcacctagataatgttaaattgaggaagtagacccactaagagtgaagggattctctagtggtggggcttccagacaaagtgtcctggatttcctaagatgtgatgatggtgttatgttataaaatttccaaatagtcttaaaaactatttaggagatgttttctttctctctctttttctctttaggggaaattgttggggagtttagggagatagtagtagagtggctagagtgaagttaccgtgttttcaaatggtgtcgctgacatgctatttattttgcccagtgatctaatatggtgttgacagaaggaagatgtctgttcaatttccctttcttggagaaaagtttattgcccataactatatactgtttaacatgctgacatttatagtgaagaaataatttttaaagctgtcttttcttagtgccacagttggttgaaaaagagaacaattcatttaattaggagaatatattggtcatacacagtggaacaaattaacctatttttgacttttttttttcactggtgagttgacagagctttggacaaaactggctgtcttctttgacacaattcactcacagccataggatagcctttccaacataaagtgaattataataaattcttgtcttatttggaactgttggtgaatggtctgttctggtgaactaaggattatcattgagatcatatgcaaataagcttatagaagaaacatcttatgttgaaagtaatatgacttttataggtttaactgctgactcactccatcaaggttcttagaagcatgcaccagaagctgactgtggctgactaagcgaaatgatactttgttcaaaggatactgggaagctcatagtatcattgacctgactggagaacaggcctgaggttaagttcccaggaaccatgtccagaacctcacctcaccgcagtaacactggcattttgcccagcaccggtgctacttctgcacaggaaacttggccttccggttgttcccaacccccaaatctagataccttttctgttactcacagaattgaaagtcctcctctatttagtttcttacttctgagtctttgtgtcatctgaagtctagagcacatgtccatgtgttatcttttaaggaggttggggtaaagatttctttaggttctgcctttttttttccttgaaatgatttgtctagaaatgtttaatgaagaacaattcataacaacaaaaactggagacaaccccaaagtcccatcatctaaactatggataaagtatatctgtactatggaatatcatacatcattgtctaggttttaccttgatataagatgtgacttggaaggttttccaaacatagcaaggtgttaaaaatatgctgggtctctagaaagcattacaaatacctacatggtgtgtctttgggcagaccatgtcatctcattaagcctctgtttctccctctgttgaatgggattattcttccttatatcctttcatgaactggtatagtaagcaactttgttgtccaaatgtaagtccagggtccccaaagtaccttcttacttctgagaattcatgacttgccataacaggtctgattttcattttggctctcatgctttctggaagtagtaataacattgctggggaaatttatagcttattagatggccctgtttatgacagcattttccactgtagagcactagccttccagaacgaaagatagatagttcctctttattatagaggatgcccagacaaaataggttgtcttccccaacctaggattcactggatttgtgtgccacttcacaagtattgggaaataaaagttatgactctacacattatagaaatagcttctcccaaattgactgagagaatttgggcccttggtgtggggaaatat

SEQ ID NO: 29198 - DNA, 882 bp, Bovine  19866881558093
acagggatttgaacactcatctttaatgtaggtaaatctatatgctgagcagggggatttacagtgcttttgaaagtactaaacatgaaattgtcttaccctaatttaaatcttttattttttgatatcttggcttttaaagatttagggagagagtcaaatatccccagagggatagatgggtaaggacagagtgcatttttaggattcttctctaacagatctactttttcaagattatggggcatttccaaatttctttaaactgtttggaataaattttagggtaagacatactggcatctaattctagtttattcaagtcaacctttaaggcttattgacaagaattacatgattacctttttttagagaaagaaaatatttcccctaactttcttgaaccagcaaatatcactcagtataatccatgagattctgaacacctttcttgatttactcgtttgtatcttgtaagtagttcatggtatatagacatagtcttaatttacagattttatctttaaaatttatgttacataagtttgtttttatttaaaactatcagaactcaggactatctttaaaaataacagcaaagaatacttaaaaatttttacctgaaacatttttctcccttttaccacattctgtattctttttgcaaatgaaaatgattaccaatgatttaacatgagcctgataaagaagtttgcaaagccttaattcacacacattgtcttagcctgtcagtagactagaggacatatataaagtttgtctttctgttgctgttgttggacgatattttatgtctatgtatgtgcgatttttttttctattttcttcaaagatggaattaaatgaaagtgtgggagccag

SEQ ID NO: 29199 - DNA, 1357 bp, Bovine  19866881652767
aaatgatgcagttggaccaacttgggtttgtgtcttggctaagcaccacactagctgtgatctttggcaagtcagacattttaaactacttcctgatctctaaaatggggatactatttactctgtagaatgtagcaatatgcatggccgaagcatgtttatggcacatcacatatgctcagtaaatggcacatcccatatgctcagtaaatggcacatccctttctaaggaatagaatcaaaagtggctgaaaaatgaccagcactcttaaccttactcataatatcatcacgggctctacctcttaaaggagaaagctttatcttgttcattgaagaagtgctaaaacttagaattataaattatccttcatatctgaaagaaggcttgattgacatgacctaggaatcagaacaaactacagcagtggaatctaaagctttctaggaaaaggaacaactgacatcaaagaagaattacaagaaagataaaatttcccaggagttgtacctgctgataaggttaagtggaggctctagctgaggctcatggaaaatcaagaagctgtatcaaattgaaaaccaaacagtggcttgtgaaactgaagaaataagcctgacttaaaagtcagaaggtgtgcatgttgcaaaatgcttttaaaagaacatgaagaatgaatttgagcataattctgttcatctactctgaattcctatgtttgaggtgttttcctccactctaccctaacaatcactcaagagaaaaggacaaagctcaactataataagaacaggtttcaaaaatttctgatgaaattctgtaaagttaaagccaaatattaggaaactttgctgttaaacagatggaactgagatgttaattcacatattcaaaaagtttaaagttgaattgcttttgcaagtgatttggagagaaagcttaatgtgtacatttgataggcgataagccaaggttttcatacctttgaaatactgaagatccccaagggacacatgacttcacacttccaatctctgtaatgcaatagacattttatggggatcagagttctacagaaataatgtacctgttgtaagcaaaataatggccacccacagaagtccatgcttaaatcccaggactctgagtatgttaccagacagggcaaaaaaagacactaagaatgtggattaagttaagaattttcagatggagagagtaccctgctttatccaaatgggccccatcttatcaagtgagttcttaacattcaagagcctttcctggttagggtcagaaaaagagatatgttaatgggaagtgggtcaagagagctgctatgtagctgacttttga

SEQ ID NO: 29200 - DNA, 1594 bp, Bovine  19866882015996
aaggtctgatgtggtgccttctactctagcagccggcaccagggcaggcagcagtggtggctggagctcgtggtatgcacaccctcagctgcaggggcctgtgtagtggcaggggctggtggacagacacacacatgtaatggtgggggacagagcagacagaaaagtctggagccaactacagggcgtgctggcagctgcaggtaccctggctatcattatgcaggccttgactgctgcttctcaccactgatgcagagcagtggtagccagctacggggaccaggccagggctctgcagctggaagggctagcagaggtgagcacagtgcaagcagtgacagaagacaaggccttcttcaggcccacaagtgcacctttttttttttgcagaggggtcttggcagttggtgtgctctcccatggctggacaacgtccccttggacacatgcacagcagtggaggccagtgacgagtgtgaggcccgtacacagcagaaggggctctccctaaacgcacacacagcagaggggttcagctgcaggaatttaggctgatgtcttgaacttgagtggcctcacaggcctgggatggctgccaatatagatcctgggccccagcgggggccggggctgtggggtgtgaatggaggactcgggcagctggcatcagtgaatgtgtgaatacctgtgggtcaaaagccatgaaatctgcagggggtcggaggcagctctgctggccctcggtttccagtggggaaaacagtttgcagatgaggtcactgggagctataattactccggctgtgtggttactcctggcagctcctgcttctcctcttcgttccaggccatctctgtatgaattggctttgccggctggagtaggatgaaactggtggagggcattcatgcagtgtcctaaaaggttggggaaactggtcactcatccccacaacctattctgaggcaagctagccctacctacctgtgaagtccatttttggtgctgagcagtgccagcttggggatgggatgatgtacacaaatgatgaagctgtcttcttcccctttttgagctgttattctcaggggttttattcaactgtgttgctaaagtttaagtggattccagagctctctcagagctctttctatttgtatatagctatcaaactgttgatctttgttgggagacagaggctggggtctcctatgatactgtttttatgacagcattcctgaattgtacttttgaatactgtccatcagtttcatggttttaattcagtcttttctatcttgctcagtgcctggactgagggatgacatctctgaggactaaatcaaggaccttcctagtccccaggtagaatctttctgatctttaaacacaaagtccaaaatgacttttggttgaagtcagtaattatccctgaaatcaccaacttcatttgtctgttttattctcaaaaccaaggtgcaagggagtgttctctgggcagttagccagcccttccagtatcattgctctctcttcagtaagcttggaatatgggggtttgagacgagagcccagatgactccacaataa

SEQ ID NO: 29201 - DNA, 759 bp, Bovine  19866882039530
caatcctcgcaaggtcagatggactaaagcgttccggaaagcagctggtaaagagctcacggtggtgagtacacttagctatcagtatagtttttatagttttcaaaattttagtttttggatggggaacaattgatgttaattagagttagtatcaattaactctaataaggcttcccatagagtgattaatgactgactgacttgtatttggctttggcaatctcattctcacacgatccccaaaactataaatctgtagaattctgaaaaggaaaaaaagattcctaatctagtttgtagaaatgatttttcttattctccaaaaagtatttttagctcttgtaacaaaggggagaattatttaaatggattaaagtcggaaactgttacttaaggattttgaaaggaagttaagagataaaaggatgtttgtgtagcagtgagggctcggatgaggtttgtaataagcttgtttatcagtttttcagttttcttagctggactttgtgtctgagagcagagaacttagttaatgatattggtgtaaggaggaataatgaggaatcggggtgagggcgtttcatgagatgagcccccacaagtattgctcttactgagttggtatgaggtcccactgaggcttggccacactctatccttgaaaaggaaggaggagaaactgttgcacaggttgtttttgagggtgggagatctttcagctgtcttctccctgctgactttctcttccaccaaacc

SEQ ID NO: 29202 - DNA, 1713 bp, Bovine  19866880035830
ctggaagaagttggcttaaagctcaacattcagaaaattaggatcatggcatccggtcccatcacttcatgggaaatagatggggaaacaggggaaacagtggaaacagtgtcagactttattttagggggctccaaaatcactgcagatggtgactgcagccacgaaattaaaagacgcgttactccttggaaggaaagttatgaccaacctagacagaatattcaaaagcagagacattactttgccaacaaaggttcgtctagtcaaggctatagtttttcctgtggtcacgtatggatgtgagagttggactgtgaagaaggctgagtgccgaagaattgatgcttttaaactgtggtgttggagaagactcttgagagtcccttgaactacaaggagatccaaccagtccattctgaaagagattagctctgggatttctttggaaggaatgatgctaaagctgaaactccaatattttggccacctcatgcgaagagttgactcattggaaaagactctgatgctgggagggattgggggcaggaggagaaggggacgacagaggatgagatggctggatggcatcactgactcgatggccgtgagtctgagtgaactccgggagttggtgatggacagggaggcctggcgtgctgcgattcatggggtctcaaagagtcggacacgactgagcgactgaactgaactgaactgatacatgacatactttgtcaaaattcattttaccttaaatgtatgcattttattaaacatggatcacacaatttagttcatttcaaaagacctttcatatcctaacttccacctctctgcagcttaatctctagctgtttcatcttgaacttttaagtttacttcattgggacacttcttgccttcagggttttgtataaactgccccctcacttgataatcttcccactccttcctcacctcaaggagcatgtttccttctaaccccaaatgggttaagtgctcttcctgtctgcttccacagcactccagaatagcatacagtagaagatatatcacattttatcaatttttattgtttgtctgtctttcctgttacattataatctgcctgagtacaggaactgtgcttgctctgttcccacaacatacctgtcacagtctcggtttgtagttggcgcttaaaaaatatttgttgaataagtgaatgagtgaaccaataaatgaacagatctcctgagatcttcaggtcgattctcaatgatttcaaggttctgttttctaagtgaaattaattgagggcttccccttgaagtgaatgttatttttggtatggcaccacacaatttattataggtattttcttctaaattaaatttctcagaagccaccatttttgtaggagcagtgagtcacagaaatgcaattcttggcggtgccttcccccaccaccccgttcccccagctagccagaccaaacattccatagtaaccgtgtttttgattgtctgaaggatttctgtctgatttaggttgtctatcaagatattttgtagtctacttccactctgaaaagggtagcttattcttctttttttataatggtcctttcctttttgcaaatgcttttgaaaaaatagttgtcattatctataataatatatgccaacattagagacaaagcctaataaaatagcttcttattcactctac

SEQ ID NO: 29203 - DNA, 1561 bp, Bovine  19866880070833
catattgctactccatttcttctgagggattcctgcccacagtagtagatataatggtcatctgagttaaattcacccattccagtccattttagttcgctgattcctagaatgtcgacattcactcttgccatctcttgtttgaccacttccaaatttgccttaattcttggacttgacattccaggttcctatgcaatattgctctttacagcatcagaccatgcttctattaccagtcacattcacagctgggtattgtttttgctttggctccatcccttcattctttctggagttatttctccacccatctccagtatcatattgggcccctattgacctggggagttcctctttcagtatcctatcattttgccttttcatactgttcatggggttctcaaggaaagaatattgaagtggtttgccattcccttctccagtggaccacattctgtcagatctctccaccgtaacctgctcatcttgggttgccccatgggcatggcttagtttcattgagttagactaggctgtggtcctagtgtgattagattgactagttttctgtgagtatggtttcagtgtgtctgccctctgatgccctcttgcaacacctaccatcttacttgggtttctcttactttgggcgtgggatatctcttcacggctgctccagcaaagtgcagccgctgctccttaccttgtatgagggatatctcctcactgccgcccttcctgatatggtagttctatttttaattttttgaggaagctctgtgctattttccatagcagctgcctagtcccaccaatagggcacaagggttccaaattctcctcatccttgccaacacttgttattttctatttttttttttttttttgacagtagctatcctaatggatatgaggtggcaaagtttttcttatatttcttcataaagtttctggaattatggatgttttgaaagtatcccatcagtcaacctctagttgttcagttcagttttcagtggtgatggggattcaaataatcttcaaaattcaaagaagttgttacaaattaagggttttctgatcaagagtaaaaacatctagaaagttcacgtttgctttccatccaaaattatcactcaattaatgttcaccaccaaattccacctaggttcattacataagttttatagagctctccttacaagccttctgtgtgttttcctaatgatggaaagaccttttcgtattggcttctgcttttcttgtgccgtgtttttatttatgcttggactagactagaactataggagtccattaccttctgattttcattcttgatctctcttctcagtccgggattgttggcttctttttggaggtcacaaaggttgccttggctacctttaagtaacaactacaagcaacatagcatttttactgcaaaagactttctgttcatcaaatttcatttgcagttgatattggattagaacctggtgatttagcttggcaagagggttcctgtcagcatcatgccatttccaaggagggcatctca

SEQ ID NO: 29204 - DNA, 940 bp, Bovine  19866880487779
atgcataagtggagacagaatctagacaaagggaaaatcaacttcccccaggctcaggcttcctccaattcagaaataggtggtgagttcactttctgtagagaaggaagtgactctgagcagtccacactctcaggaggtctgtgctcagtctttgagagcccatatgcttcgtgccccctgtggttaagccctgagtcttataaacttgtaatatttatgtgtgttcaagatactgatagtttcacctcttgagggctgtccattcctttgtaatctttgggggttgagtttgaggcttattaagtcattggaccatgattttttcatttctgcatggtaatgtaactctgggtgtgtatgactcttggtgggaacaattgcattcctgtatacttcatctgatctttatctagggcatatcctgggagctggggggagaaatgtggcagaacagacaggacttaacccgtgaggcactcagggaagaacgggaaggcttgttctatggtgttggggaagcaggccaatttttctccttgaataagggcagtgcgccttggggcatcccactttaatctctgaccagggcttcagagtctgtcacttctcatttatcaacccaaacccagacgtccctcgagggcattctttgtaagagaaaccatagtattttgtagccaaataaggttttattactacattcactttccctctacccaggaagaaatacagaataaccattgagaggcgaaaccagcaggaagaaagcaacgttggaaaacatcgggagttacgggaagattccatcagatcccacttttcggtggcttaaaaggaagtctgttcttttggcttgagattctttaaggagatagatgggatgaaagacatcaatggaatagaaggggcgctcttaaaaactcattcttttaagcag

SEQ ID NO: 29205 - DNA, 1955 bp, Bovine  19866880632884
caatgaaggaagtttcatgccagaaagaggcatccacctggcctgaaatgtgtgaataggattttaataagatgagaagaggatggaaaggcatgcttggcagaacctacaatggcacaggcaaaggtgcaaatgtgtataacattcagtgggcagctgggaacctcagtctggagcaggagaaaagacagggacaaagaatttgtttgtggagacctctctttagtcataatcctaataatagcaaccatttattaattgcttactatgtgccagggagctgttaaaagataaataagatagagccaaggacagaattcattaagggctagatccgttcacaataagcacaagattaaatttcaggccaccaaacaaaactcgatgaagttgtcctccttcttctcccggacaaaacctcctgaacactgatgaggctacagctacgccagtgctcagagagcgggtgagctgtgtgtcactgtcattggccaggccagggtcaaccctgctgtgtgctcaagacacagacaacatggccttttgtcaaggggccaaatttcatttgctagaaagaccccaaattctaagaacatccagaagatcttcagcccatgaaggaatccatttcttctagtgcaatccatgtttattgattcattttgaattgactcaaggtatgaagagtcagcaggaatgatgcttcttgggcagagtcagtgtttctcagctttgggtatgagtcctctccaagggcacaagaaaggaaataaccctataacgtattctgttgcataattagaaaatacacatagaaccggaaatagcaactatctcagttactatgataatatggagaaaagcatttttttattttgaaagaagcgaaatttggtacaatacagctgtctaccacaatcttgttttctagaaaaaaaagaatggaaataaaaatgactaataaatgtaagccaaattaaacaggtatatagtcacaagcaaaactgatactatgacttcctgctttgagcaagtctctcgttgcattacgtcagtaacctttcccatacggagccattgaaagctaggaaagcggaggtcagcttggcgtgatgccccatcagtggggacaaatttaattcaacagacaactgggtgcctctggagatttacgagcggaacagaagaatgacatgattagactcatgcctagggaaatagcagtggattagactggggagacactgagggttcagagccacagtaatccaggcaagaggttacaagaggttacatgtgcgaagtcacagctccccacccaaaaaaaaaaattgtacatgggtctccgggtggttcaaatcacaggcaagttttcttttccttttgtgtttttctgaatttagcaaattttcagcagcatgtgcttttagaatcattaaaagagggcgagcccttgagaatgaatgcagagggctgtgcaagaggaatgtgaagactccacaagagtgagggagtgaacgacagcggtgatgccagagaggaaaggccaacggctgtcagaggaaacagcagagccagagggaggggaaagggttagtggatgtggaaatgatagtgatttcagttagggtcacggtcaattcaaggtgactgactgcagaacacccacgtggcagcaccaggctgcggctggaaagagtggtctgaagccagcaagaagaatgagggctagagaaagtgctggaggtcacgtccacaggtcttacactcagaactcaagaggagagggcggagggtgaacataaaccctttggggggtgctgttttaatgggcacaggagtgagaggagctaacagaaagccagaagaatgctgtgccaccaaggctaaaaaacaacagggattccagaaagaaatggacagaagcaatagggcaagaactagagctgacctca

SEQ ID NO: 29206 - DNA, 1038 bp, Bovine  19866880791248
gagctctgcccagtgaatcaagggttcaggaatactggtgtggctttgtgaaaagaaagcccctgtctgtattagaaatgctttgtatttctttaacacctattctgagttgtcccataggctgaataaatggcttctgtatcctcaaagcactctgtgagttccttggtgtgggctgggagggtgtggggttgagtggtgatagcccaagcttagctctttacccacacttagggcttctagcccctggagggaagtcatgtcaagtctgtgtgcctctgatcgccatcaactgaaagcatcatcatcttcataataataatttttcagccgcaatgggatactattaattagcctaaatttttgaagtgcttgagaagtactgaatgggaagtttcacccatatggtcaagctgggagtctgaggagggaggaggttaggtgaaaagccaccagtcataggaggaggctgaaagcagaacagaatggctgctgtcctggtgctgtgcgccctcccgtaaccacaccagaccacgctccctgcctccagtaattagaaattacttcagcacataaacaggcactttataatgttttctttttacaatggacagcatgcgtctcctttccactaggagaggggaaccagttttggcttcccactgtccctacctcctttatagcccagacttatattcatgcacagggaaagcggcagtcacgtgggaacatttgctccaaacatggtccccttccagtggttctggctcaaaagaagctggtaacatggcctcctccaacataaatccctggcgtctttggatgaccctgagttctcagccaccagccacagtactgcctcttcttctctttctcgttcttccatccacaaggttaagaaagtttttttcatagaaagtcacattgacatgaacactcttgctcagaacacccttaccatataccactccatccggtggtgagtgataacaactgtttgtgtttaattagctcttggtttatgggcagtttgtgttg

SEQ ID NO: 29207 - DNA, 1424 bp, Bovine  19866880938283
aaaaaacctcacctgactcctagaagttagcagggacatagtttgaaagatatctttagattttaagttatttgtttctgtgctgcctaatggagtattacatgtcaagatcccatagaaataacaatgacattcagataataatgtcatgtttattcgtccagactactggtattcttaggttctcaggacagcaatggttcataaagcgtgaaccccagaacaacaacatcagcagcacctgggaatttgctagaaatgcaaattcttgggccccatcgcagacttactgaatcagaaattctaaatgtggaacttagttagctgtgttttaacaagcccttcagatgatgctggcatacgatgaaaattggctgccactggattttagcattgtcggctccttgagagcacagtctgtctcctactactctttctcagccaggtagggattatttaatagacccatcgaaggacaactgagagatccaggcttagaaaactttgctttaatgagtttgtataaatagaggggaacatagcaaaactggttttcctcttgggcaacatatttgtttatctggcttctttgaagtcagagccaataaatcatagcacagacatattttggagataaaaccatagaaccctgtcctgagagtgaccttagatcacaaggccccacccccacattttacaaatgagaaactctaggcccagaaggatcacccagttcccaaccccactacccttcatgcgtacatacacaccaccctcaccaacattccctgaaacggaagggtttgttgaagtcagaatcaccttgctgatcatctgatgccttcatggctgggcacttagggaatcagccattctattcagaagctctaataatcacattgccattgtgcattcatctcctccctgtctacttttaggtggtttgatttcagaacacatacataattttagagagacaggtttcatgttctctactttccaatgttcagtttctcctctgcagtcaggaaggcaagacggtggccgggttgatgaccaactctcaccctttgggaggcagatgagccctgcttgtaggtggccatgctcagctccaggctgcttttctccacacctggttctcatttgtaacaccaaaagcatttcatgcttattaagcatcatctggtcccaatttttaaaccacaagtttggcctggtttgtttttaataagcggttacgacagagtccaccttttcagtgtgatgatgtctcttaaacccagctattggcatcttggaaatttaaatgaacatggctgttatagggggttaaaaacatgaaagacacaaatcctgaaatttgtgacactctcctgcctagatacgacacattattttcaacacttatatggaagaaaagg

SEQ ID NO: 29208 - DNA, 1604 bp, Bovine  19866881114609
cacagtcctttccaagtattagaaagatttctagaaaaagtaaggaaaaaacccaatccccacaattctatcaccttagtatgaatttggttcaccaaactactgtcctcctttgattagagaacttgcaactatgaaaggaaaacacatgatatgttcttaacaattaaaaggaaacaaatcaaacaaacaagtaattaaactaccttaagcctctgggggaaaaaatggagaaaagaaaccttcgaattgaggaggaggatgcagaatgaggcagtggggtgcggtggcaattgaagacagacttgatgacttatttgctcagggcaggccctgggtctagctgatccttatcctagtattaacagatccctcttctgaccgctggctgtcatcaggctagctggcattggtgcctgcactgaatgctaagtgtctcaccttccccacagagcactttggcttttatttcttaaatgaatcagtccagtttctttaagaaagatttcctctatgcgtaaactaactgcacttccttccactgcttaaaccaaggctcaggcttatccactgtcatttccgaatgtttgttttcttttttttcccagaacaatgagaatgacagcaagctctggctaaagggtcccaacacctgaaatactctttgccaattatattacttggcaagctacaaaagagtgagggatgcaatctttcattaaaaagaacatgtaaagaagaacgactattaagagcatctagcaaaaataagtaattaaatatttaaaactgttcgactttataatgactcaggcacaaaactacgattggccttttctgatctgtcaataagagtagggtcatagatcctggaatagatgaaggttttggtcaataaccatacaacttatttgttttcttgttttgttttgcgaataatttggttttcagtagaccagaatatcaagcagagtactgaccagaggccacagctggaattctcaaagaaaatgggctttttttcctctgcttttcttatgcttgagtaagattttcacagatgtacatgaacaataacacaatgaatcgctgcctgttatcagcctcacgtcgtcctgacctaattcctgggtcaggcactttaacacagagaggatttttgtgaaatggttatcatcacatatttttattagagattacttaatttgagagtcccttggactgtaaggagatccagccagtccatcctaaaggagatcagtcctgggtgttcattggaaggactgatgttgaagctgaaactccaatactttggccacctgatgtgaagagctgactcatttgaacagaccctgaagctgggaaagattgaaggcaggaggagaaggggacgacagaggatgagacggttggatggtatcactgactcaatggacatgagtttgggtaaaatccgggagttggtgatggacagggaggcctggagtgctgtggttcatggggtcacaaagagtcggacacggctgagcagctgaactgaactgaactgaatttgatatagctatttatcccatcacaaagatgcttcaaacatccaacattcc

SEQ ID NO: 29209 - DNA, 1357 bp, Bovine  19866881163597
aactcatctctgacctttttttcacacttgatacagtaacaactaactcctttagaaaaaagctaactgcttagagttctttcctgtacaaactattctgcttttcctttgctcatatctatcttgatccctacagtgccctttcattctcaccaacttatgtagctctggatcatcccttaaaactgaataggcttcacccctctggcaacccccagccccaccccgaactggtaagtgcccctcttcagtgttctccagtatcctgatggtttctcaggtgccattagtggtaaggaacccacctgccaattcaggagacataagaattgctggtttgatccctgggttgggaggatcccctggaggagggcatggcaacccactccagtacttttgcatggagaatctcatggacagaggggcatggcagactacagtccatggagttacaaagagtcagacacaattgaagcaacttagcacacaacacacacacattgactgcatcactataataaatttcacaagcatgtttaggaattttctgtttacttaatgacctcctgtggtaggctctgaatttcttgaggtctagaccagctttccttctcatcttgatgttccctaaacagctggcagtcagtatatgtttattaaacacaaccgcagagtcatgtatcttctataatgttcattgccctccatttgaagcacttcataaatatctatcttatctctccttttttcttctcctgtctcagggaataatgatcatattttcaagaaataattattggatcttgatacttcttgttattttggaaagtaaacatttacttggatagcttgagctcctgttgattttgactgccagtaacaagaagttatatggtactatgtaagatcagtagagaaagaatctctgtttttttgggtttgtgatagttcaattgccatagaaacagtcttccctctaagttatttcattagggttttttctcctttaaataatttggagaacagccatgttccacaaatagactacttcatgggaaagatcatacttgacatccctttccatattctaaaatctgcaccaaacagaaaagcagtagtccttcaatatcatccactccattttaagcttgacttattatagtaagtaattcactcgattttaaaaaagacttctttctggagtatgaatgtgaagtaagaacaggagcaaattttccaaacaaagccattctgacagattttatataatctatgcagttaggttacaatcttaattcatatcagatgtaagtaccacatcttcttaaagggaaaaaaaaatcagatttctattgca

SEQ ID NO: 29210 - DNA, 1959 bp, Bovine  19866881171535
gaagaaaagagagcctggggggatggttctccaatatgcccatgggaaggtgctgagctggctccatatatcatggaaaatgagttatgcaagtaattagaatttggatgtgggtacttatgggaggggttataagcaaaagacatcaagccaataaggcttaatcatcaggctccctgacgtgggactgccccttcagaggtcttgggtagaaacttagcaatcggcagatatggtcaggtttttaaaacttgcaaagtaaaatgtttttgtattattttgtttacagagagcttccatattatatcaatttcattctcccacagactctgggtctgtcttaattctaagataatctatattgaactttttttatcttcaagttttcagtaaagttccatgaaatattatagccgtgtcttggctgttctctggaggaattaaagaatattgggtttacacttgtgaaatggtgtagtgaaagtgttagtccctcagtcatgtccaactctttgcaaccccagggactgtagccagacaggcttctctgtccatgggtttgccaggtaagaatactggagtgggtagctattctcttctccaggggctcttcttgactgagggatcgaacctgggtctcctgcattgcaggcagactcttttccatctgaactaccagggaagctcaaaatggtagaggattgtgacaaaatcctggaaaagctgtttattgttcagtaatcgaccaatggaaagtaaaacagtgatctggggaatgactgttaggagtcagatgaccctgacaacacatgggaaagtgtcaccaaggcaggagtgtgccttgaccagacacgctcaccaacactcgtatatatattgatgggaatggtgccttgaaagaaatactatgtatgtatgtatgaatgtaggtgccattggagttacactcattttaaagaataatgaactaaagataacagaaatgaagcaaataacaagaagactataaaactagttagaagaatttgtagaaatggagctcaagtcttttgctttcatagtcagttttcacatcctgaaaatggtaaaaacttgaggatcagaggtttcccatctaggaaaactgagcaaaagtaaagaagcaactttaagcaaattctacttgctgatgcagtaagacatttgcatgtctgtatgaagtgcttgatagcatccaggattcttgtttgagcaagaatttcaaactagactttaccatcagacctctgttattctgtttcctctgcctgattccatttttaagaactccaaaagcagataaaactaatctgtggtgaaggcaattagaaagtgattgaaggagggccaggagaactgatgggaaaagtagcacaaaggaactttcttatcctctatctcattacagtcgtccaaatttactgcctgcaatgcaggagacacagaagttgcgggttcgattcctgggttgagaagttcccctgaagaaggaaatggaaacccactccagtattcttgcctggagaatccccgtggagagaggagcctggcaggctacagtccatagtgttgcaaagagtaggacacaactgaacgactgagcacgcaaagttatcaagccaaatacctaagaactgtgtattttgttgtacatgaattaaacttcagtaaaaatatgaaataaatgactaacaaaaccacatataaaaataaaaattaaattataactctgttattctgtagaggcatgagtaaagcctctcaagactctaggaggtaagattaagattccctgctcttcctgttgcaagggaaaatgtttccccacattactgtatgtcacacatctgtctcctttttatctctcactgtcactggagaacaatgccattggcagacacagtatgattatcaggcaaaacaatattattactggaaaaa

SEQ ID NO: 29211 - DNA, 995 bp, Bovine  19866881350017
atgcctggagaagacggaatgtgcaccaacagtggggccttacctcatcctcctccaggctctgtgggcctttgctctgcaacgtgatagctggacctcccggcttcctgcgtctgctctctgcaaaactgccgaatgcactagactcgccttccagtctatccttttcaactccatgacacgcgacaccctcctgctgccccctggctgctcaaaacttattttggggaaggcagttcattaaaatttgccaactgatagcctacttaaagacgttttatctcgagtctttacattttaaattaaaactagtaaccaatatttgcaattcaggaggcaaaattacagcttctcatggaaaaaaaagaaggcaatggtaacccactccagtgttcttgcctggagaatcccagggatggcggagtctggtgggctgctgtctatggggtcgcacagagttggacacgactgaagcaacttagcagcagcagtgaaaaaaaaaatccaaagttctagctttaaattgctacagtcctcactctttgctcttcatttaaatggactcgtttcactcaaatttttaaaaatcgacatgcctgtagatactgtggttgctactccctcagtgtagtgatatggcttaacaacacaagcattgatcagatttgaacctcagctcatgagatggagggcacattatttaactctggacatctttttctcatctgtgaaatggcgataataatacctacctcatgggggatgatataatatctacacctcacctaaaatgatgcccgctcatagatgactcttgattaagggcagctattcagggtactcttctcaaaaagctgttgttcagtcactaagtcgtgtctgactcctgcaaccccatggactgaagcactcaaggctcctctgtcctccacttcatgtgttacttctttcctaaccgtttccctcaattctcctctccctatgcttgtctccaa

SEQ ID NO: 29212 - DNA, 1220 bp, Bovine  19866881409293
attagttatgggtacattgacatctttaaatcccgaatcttctcatccattaactaagggcccctgcatttgttcatttagtttcttttgaaagtgaaagtgttactcagttgtgtctgactctgtgtccccatagactgtagaccgccaagacttctttgtccatggaattttccaggcaagaatactgaagtgggtagccattcccttctctaggggattttcccaccccaggaattgaacctgggtatattctatagttttcagtgtagagtattatacatctttgatctgctcagtatattaaaagttgttcatattaatagggaccattgtctcactttctcctcaaatatttcttaagatcacaaaatggtaagaaaaaccagacatggatttgtcctcatgaagcataaagtcttgtgctactaaaaagtttatcatattcataggttaaatagtaattttgtatcactaaagcaaccatataactcatattaaattaatattgaattttatggatttcatgaggctatttttgctcttagatttatttaagtttcattatataaaatcaaacagtttaattaacatcatgataaaaatatttcattgttgggcatctacaagaactttttccttacaaaatatctatattagtgaagtttgaaaaattgcttagggaaatattttttgcctttttcacattaattgtcaagttgagtgccaaatgcataggtatataattgtggacaaaatagctcaaaaaactttccagaaatagcctctaaatctatggtcatagattttagttacttttttatttaaaaaaatttttttttaagatttttatttctttcctgatgttcttcatgaagaaaatattctctcccaaaacactcattaaatatgaagtgtctggaggaaacattctgacatgtcaaaagacataggtaagctccaagtctatggtccatgagaaattaacttgtagtttttggtcatttgtttatgggccattgttcatacctggttaaaacactgatgctatcttggtagtgttcttctgagacacaaaaagtgtacaaatacatgagctatttttttggactgagttcaaacccaatggattttagagaatttttgttgaggttttcttgtttgtttgtttttgtttttatatttgatttaacaggatctcggaacatgttctatgagca

SEQ ID NO: 29213 - DNA, 1178 bp, Bovine  19866881494944
tgtgttgaatcagtaaaataaagtagtatatggctttgcagaaataaaacatctttgattagaaaggtgaggtggtggtggaagggaatggtcaaagacagactcgttggaagaacctaaatgttttaaggaaagacattctcctcttattctccctgatggagccgagactctggaaagttaaggggagacatcagaacatgtttgtgtgcagatggaaatgctccggagcagaggtgataattacagtcgcagtgactgaggaggtgagagggaatggggtccaggtggaggactggattttgacacagcagtgatactaagctcaatgtagctgaagagatgcagagatagatttggtggtggaaggctgatggtgactgcttctattatctctgtaaatatcatgtctaagaatgatgggaatgctgggggagtaggagatttgagggtagaggaaaaaatgtgaactagtattttagaataggaagctgaataaatgagacttgtgtgatagggttgcctgtttgaggttagcggtcatgaatttaaagtgagctcaatcaacacagttgtgttcttgggtggccagggaagtctgaattttagcagttcatgcctttaacttatcatgtgagaggtatttctctttgtccattggctgtttgtataacctttggtcttggacagggaatgtccaggcccactgctgtctggaatcataaccttggatggtatcacagctgacaagcgataacagacacaggaggagaggcctggaggagagaggtggttttctcctagctggagtaggctccccacaagctgaagataagggggctagagggaggccaggttacaggtcaagaagcaggaaggaaaggtcttgggatgaatagccgaccccatcttaccctagacagcgtggctccatcctattgttgattctgggcgtgaaatggtttccctggagactggaggctgtttattcagtcaggcgaaagaaacaagtatgttcatgccatggcaagcgtacaataagctttccttaacaccttctgtatcatcacattctccaggaccttcttccatccagttgccctatttctgctctttttctccatgactgcatgtttccttccacagtcagtcccatatttggggcccttctctaaggc

SEQ ID NO: 29214 - DNA, 1109 bp, Bovine  19866881527022
tcaaaatgtcttcaaagagaaaggtgagaaaagtccaaacctttccaagagtttgaccaaatttatcttttatggattctgtagatttaatttggttgctttggacaaaaatgatttggtccttttgttaagttaataatatcaaaacaacgagaaagcacagttttgtgttcccaacaaattcaaatcaaaatcatctgaagtgggataaactttgatgcattcatcattgtgctaggaacatggtagaatcctgggcatgatgttttcaactagaaacatctgaaaaaagaaatttaccagtatcctacctgtggttgtattatgttgactgctccatgggctataactttctccttcctatctgttatttctcaaattttattcagcatgctagtatttcttccataatgaaaaactaaagcataattgacttgaaaacgttacatctgtctgtgtaactatatgatatttttaagccaattaccttatttgtcacattctgtgtattttatataattattttacagctataggtagaaactatatattgtgatgtcatccacaatttatctagggtgtcaggaatgtttaattggagaaggattgtaagaggagaaagaaatgattgtgaaagcaacgtcatgagaaaggacgtggggaaaagagaacttttgaacaggacaagagttcagtctgtcatgccactaacgtggtgagtgcacgtatattaattaaaacaaggctagaaagactagacagataactgaaaatcataagtgctacgttaagggggttggacttgatttggcagcagtgggatgccatgaatggtggcatgagtaatggtgtgaaggcctacagcagagagactaaaaagcttaggagacaggttacgaagctatataatagttcttgagagaagtattttaggtcctgaggaaaatggcaaagggatggagaaaaatagcattgcctatgtggaatgggcaggacttatgggtagactgcacgtgatggagaaaggaaagtacaaagccatgaccgttacaaagttctccgtttggaggactgtaagagcagcagctctataattcagtggtgctgtt

SEQ ID NO: 29215 - DNA, 1284 bp, Bovine  19866881800536
ttactggaagacacccccaacatctgctcttttctattgggcctgccttcagggaattcatacttggtcacttgctgtctgattttagccttgaggaaactgaagctgaaaaccttcctccctatcctagtgaactctgaagaacactatcctcgtgcaaagggcaaatggctttctaaccgtcagacagcagattcaggagggagccggggtccagccctatgcttggccaaagaaccaccgtatcccctggcagacttctttgggatggaagtgggccctaaattgataaatgactgtctccatcccaggctcggctctagcccccagagtaatgcccaagactggtaaattaactcggatcagctagcctaaaatgtggctgacgcctgcaaataaaagcagattttttttctctttctcattacctaagacaaaatggatcattaaacaacagcagtcctgaggagatcattaagtctggttctgacccctcatgcatcttccacactaccgcaactggctgtccctctaatgaagagaaaagcagtgcaaactgcccgcaggtatcacagtgcttgcagatcacatccgtgcaccaaccccagccaggagagccacctgagaaacgaagtggaggaaaactggactcctggaactggaactggactcctgggattggtgggtgtggagcacaagcacaagaatgactttttaaaattctcccatggctcacgcagggaattcagtcatctgatacgtgtgccctttgaacgtgtcacacacacatgtcatataaggatgcttctcctcacccatcgctcttaaaggcttagttgagaaatgcacattcctaatgacataatcgtccctggctttcaggtgatcaagtgagcaatgtctgtccttggcctggatgtcccacctgtgctcgaccatctgtgcctccggaaagcttggggacccgacctccacacattgctctggtcactcactggcctcactttccagggatctgagttcctctgtcaggcacaacatcaaggtgggtgaacacacacaccccacccaaggtggagggcaggggcagggagcagccacctgatgggcagtaaggcagccccaagacatgaagcagggtgaccaaggcagagggagacacagacaagggaacacgggaggacagtgtctggcctcattgtttctgaaaggccaaaatcagaaggaccatgtaaattctaacttatccaacttgatgacatccttgacagctgatccagagaa

SEQ ID NO: 29216 - DNA, 713 bp, Bovine  19866881952119
actgggcagaccctaggataatgcgatttagtggaaagagcactggccatggagtcacaagacctgggttcatattccaacttagccgcatgtctgaatctcttaagagttttcttactggtaatacagaaataactatacctatctaacaggttgtttgtgaggaatatgcagaagtatttgataagataagatatgcagaagtatttgatacacggacactctgtgtagagactcactgagtctatttccgctatcaagcgtgcacccactttgtgaagaccactggtatttcagacaattcttgtttaggtgagtagttctctttgctgatagaggagaggctcagattcttctttgacttaggttttttttctgtgttaaaaagaatcagttaatgatctcagaggacacttgcatgaacttattttttcaattctaaatagatggtctgtgcagttaagtctcaaatagagttcttcggggtggcattattattaaataatgtggcattctccactataaaaaccatcttgactgttggaagaattgtcaaaaccatatttggtaaaccaggaatgaaatgcatctttattaagttattcaacaatttcaaagtttgcatttggaaccattcagagagctctttttaagctattaaaaattaatttcacacgaggcaaggaagacatgtctagacaaatgttctttaa

SEQ ID NO: 29217 - DNA, 1144 bp, Bovine  19866882055046
cgcttgtacagctaatcgggcaaccgcgtggagcatcccttctactgccaccttacttatcttttcagcatcataacttccaagttgctggtcttcaaagaattctctgacacttggatttgtttctcttcctttaccatctttgtcaagtactaggtgactctgaaataaaagatttcctgtcccaggggaattattacccccaaaagattccgtgtggttttgcaatgttaatattcaatacataatgtttctgctttgtgaaaatttttaaaactgggatattcttaaatggtctcccacaaggaggactctagagcttaaaatcctgcttttctattactaactttggggcctagcaaacctcactagctgtgaggccttcccaagcctcagtttcctcctttgtacaatcaggagaataataaccacttcattgggttcatgtggcacctgatatgaccagaaactcaataaatcaaagctgctactatctttatgaggcagccttatttaacaactcaggttcttgggttcctgggggtgaagcctggccataaactgagaccatggggtcttttggcatggaccttgtctggtggctcagatggtaaagaatctgcctgcaatacaagaggctcaggtttgatccctgggtcaggaagatcccctggagaagggaatggcaacccactccagtattcttgcctggagaattccatggacagaggagcttgatgggctacagtccatagggtcacaaaatgtcagacaggactgagtgactgagcgcacacatgtgtgtgcacgtgcgcatgcgcacacacacacacacacagtgtgacactaaatcttgtcttttgggccagcctctgctcatctcctttgtgcatcccaggagcttaaagatatctgttgagtaaatcttcactggctgattcttttaagggccacacaaaacctgtgtcccaatgcaggttcctgatagttcatctttgccttcctttgagtgatccctcacattctgactagttgggattaacaagttatcttcaaaccaaaactgttggcagaacaaacctctcagactgaagcccctttcttcaaaggtttcatggctgtttctccaaaccagtctccaatg

SEQ ID NO: 29218 - DNA, 969 bp, Bovine  19866880356652
cttgtgataacccagaagaagaaaactaaacatgaacagtgagtgatcaggtgcgtgcaaaactgaacacagcactgataatgaatccaaggcgtttataccacgtttagctaaagcctctttcctttgatcacagtatcaaagagctgtcttaagttattgagggtaaagaccaattttgtcttctctggtgatagccatcattgagggttaacaactactgtatcttttcaatcttttaatatctgaacactgaacaggaatgttggataccgaaagcaatgatgacttaaattagagattccaatgcaacactctccagcagtagttttccacagctaactagcttgacgatattttatcatgtcgtggggtgggaatacaacctcagcagaatgtcagggtgcctccattttcacatttactatttcctatactaaattaatttggatctatctaataaattatacctatttttctggtaaagaatcggagttacaaattcctaataaacaatgtggagcctaatgattactttccgccacaaacactgccaggacagaagataagttttgagctcagtgtagccccactgccactctgacgcagctaacctttctgacatcacttccggagcactcacatgctacgtctatttcctgaaacccatttacctggctgatccacaaataatgaagccaatggcgtggttttctgattttttattactatggttgaccaaggactgttgccatctgagagaggtcttattctacaagagaaaaacgtttattttgatatgatagaaccacatgaaacacaaactagcttttagtaaatgcacactaacaagatttttaggtagtaaagagaacacatttggattctgtgtggagaacacattctgtgttttaaagagctaacaaagcacaaataaaaccttaacatgagctgtaaaaaatttttaaa

SEQ ID NO: 29219 - DNA, 1792 bp, Bovine  19866880517845
tttagaatcatctaaaaagtttctgtcggggggaagggataaattagcagtttgggagtaatactatatacataaaataaataatcaacaaggacctactgtatagcacagggaaatctactcaatattttataataacctatatgggaaaagaatctggaaaaaaatatatatataataactgaatcactttgctgtacacctaaaactaacacaccattgtaaatcaactatacttcaattttttaaaaatctccaaagaagtctctgtttcactaacttaaggctagagactttccccatattaataaatataatgttaaaatgctaagcttcaggagatatttccgcctctacaatagcaatggaaatggaaatattccaaccctgtagtaattacactctgaactacaatagagctgtatttgcacatctggtcttgattttcctgctctctggttaatctttggtcaactagtttggttcagagctataacacagatgtttgttgttgttgttatttagtcactaagtcgtgttcaactctcttgcaattccatggactttggccctccaagttcctctgtccaagggattctccaggcaaaagtatcagagtgggttgccacttcctcctccaagggatcgtgctgacccacccagggatcgaacccacatctcctgtgtctcctgcattggtaggctgattctttaccactgagccacctaggaagccccatggcatagatatacaaatttaaactagatcaagcttacaccaacagcagaaatagtgattaatggaaagtacaaaacgagaagccacagggggaaataaagatgaaccaggggccagagtggtgcattttcttatcgacagagttgggtttcaaactcacagtgaccacattgtactatattgcactctccaggttttcactcaccccagcttctgtaagcaacaaataactgagacacattttcccactgatgtagaaagaagtccttgaaattcttcatcttcctcacatctcgaaacttacaggctaccactctgagggagagggcctctctttttctgccagtccttccttgttttatgggcttacttgggggccatgggaacaagtcacccagaggggcagcctggagatgaaagccacagtcacatgtgcaagacgtgggatctttaaataaagaagcactgttttggaaactctaacctgttatttagaatttgaacagggattcttgctttaaagcctgcaaacaactcttcttttatatgacagcaaaattcgtctttgcatttgagaaaaagagcaccagcctgggagccggtcagggcctccagcatgggatgagactgccaccgtgtggtagctggggcagtgatcatggagacagacccactgagtcacatggcctcttccccagggttcagagaaagtgcctgggaaaacagaagtctttctagggtcaacctcacaaaccctccattgttaggactctgcacctgcatgaaattttcatctatctagtggtaggctgcagtccatggggttgctaagagtcagacacgactgagcaacttcactttcatttttcgctttcatgcattggagaaggaaatggcaacccactccagtgttcttgcccggagaatcccagggaggggggagcctggtgggctgccgtcaatggggtcgcacagagtcggacataactgaagcgacttagcagcagcagcagcagcagctgtgtgtctaagaaaacaaaataaggactacag

SEQ ID NO: 29220 - DNA, 1515 bp, Bovine  19866880533141
tttgccctccctcaaagacttttcttcccactaaatttatacattttagtttgtgtttcctgagttgtggtccaggaacttcctgtatcagaatccttagaggagcttattaaataagcagattcctgaggtcagcacataccttgaaaaccacattaaagggggaatcctgaaatctccatcttcacaagcctccctgggattctcatccactgatgtgtgtgaagcgcagtcttggctggcatccactgtgggtgctgtgagcttgttttaatggccacatggagctttcttccctggaggttacatgagacttctcaagacaattcttaaggaacccctgggatctcaactttgagtacagtggtagaaatttatttgggatatttgttatcctgtggtagctcagatggtaaagaatctgcctgcagtgaggaagacctggatttgatccctgggtcaggaagatgccctggagaagggaatggctacccacttcagtattcttgcctggagaatcccatggacagaggagcctggtgggctacagtccatggggcccccaaaagtcagactactgagcatctaatacacacatttgtaaagtgataatgtgttctatatatatttttaaatgctgtccttctgactcatttgttttttaaaaaaattaatcatacccaaagctgtcctcaaaacgcacattctccatattcctattcttagacctgcattgatatttgtaaagtgtttcatgcttatttggcagaacaagctcaggaaaaatgatcgcaaaagtgtgagcttgtataccacccctttataataacattcattttctacagtggcagtcattttagtttttctaaacagtcctttaaaacaaagacagtgagataaaagagtgaggggatttttatttatttctggtgcatgtcttgggtatcctgtctagaatttaaagcctgtttattaaatgaaaaagatgagatggatataaatttgcagctgaggagttggactaagaatttaaaacttgaagtagtgttttccaattttatcctaaatttggtctcacagagatctgtagcatttcttgtggcttcttctgccttgttcaatgaatttagtaatactaattactccttgcagttctgtagctgaattacacctgttctgggagccataagtttcaattacctgacctttatgtgtgctgaggggtcacacacaggcatgtggtacctggcacttgataattcctctgaatacaaatgcatctatctcagatggagcacggcgggcactacatctaagtatgtttgtgatgggcttccctggtggctcacaggtaaagaatccacctgccagtgtaggaaacacgggtttgatccccagctggagaagatcccctggagaaggaaatggcaacccactctagtattcttgcctggaaaatcccatggacagaggggcctggtgggctacagtcccatggggtcgcaaagagccgga

SEQ ID NO: 29221 - DNA, 2164 bp, Bovine  19866880614597
ctgcaatcctggtgactgtgacatcctttccttactgatacagcaggaaatattccatttcccaaacctgtaagggaaaagaatctgaaaaaaagaataaataggcatatgtataaccaaaatcaacttgctgtatacctgaaactaacacaacattgtaaatcaactatgggttcagttttttaaaaaatgaggtctccattatgggtgaagagtgtatgtggagtttaggaagcatgttgctacttactgactgcctctagaagtgacagccatagaatttcacatctggggtccatcagtcactgctgtctacaaagcaggggtctgcagtccatgaatctggccctcttcatcctttccagcacatttatattctggatctccagcccaaaccactgggcacttttcccctcgtgttcatccttaggccacataaggtctcttctccccaacccctgcttctccccagaactcagctttctcctgtgctggcttgtctagcaaattaatgcagcagctcccatagcccatcttggctctctaaagcactttgtaacttgcaattcaatcctgtggagcagttttctccgggaagagtgactgaagaggtaggctgaattccatacacaaaaaacttgagcagtgtccatcatgatggggttttgtataaatctttccctgaaagacccaagtatggaggaggaaagaccaagctctgagtattcctttaagaaacacagagatataccatatcattaacttggtgaaattaaccacacaaggtttcctctgatcatcttgttgctgtttgaaagtccccttgaacagctgtcttgcatatgagacaaaggaagtgctgagaaaaatgtacacaacttgagagttgcaagttaagttttatttggggcaaaatgagaactgtagcccaggagacagcatttcagatagctctgtgaaactactctaagggggcgaggcaaggagctaggatatataggagttttgcaacaaagggcaggtagtagaaacatcaaaatatggttgttaattaaagaaaccaggtaggtcaggttaaggaatttagtgcttttctgtgtatgggaagatgcatgagtctgggcttattgaaatcattcctttgctgtgaaggcaatggcacccgactccagtactcctgcctggaaaatcccatggatggaggagcctgatgggctgcagtccatggagtcgctaagagtcggacacaactgagtgacttcactttcacttttcactttcatgcattggagaaggaaatggcaacccactccagtgttcttgcctggagaatcccagggatgggggagcctggtgggcctgccgtctatggggttgcacagagtcggacatgactgaagcgacttagcagcagcagcacctcagctatctggggccagtattctatgttttcacatcctgatgttcctcaggactcaccacagggagtggctacagtctactggccgctagatgacaggcattctttcctttcttgagtttcctcagagctcaccattggactctgatgactgtgacatcctttctttactgatacgtgaggaaatagtttcatttctcaaagtattccatttcccagaaggtaacagtaggaggagtaatgatcgtcgcactgtggctttgtacctttaacacaggctctctcaccaactgacatggctgccactgtggttgtcgtcactgatgcttctctgtctttcgctttcagctcggggacctgcttcacaagctgcagttcgtcctgacctatgtggctccttggcagatggcttggggttcctcctttcacgtgttcgctcagctctttgcaatccctcgtatcctttctgctttggttttcaccccctggctcagattcacatttcacggatgtgagcttttcattgaaccttggcaataaaaaggttttaaagtctttaagattacattttaatggggacctggggaggcactgtggcttccttttaggcacttagcctcaagagatatttcttaatttgggaagtcttcctgtttcttaatgcatattcaggagtggcttaatttcttctgatttttccattttccacgaccacatctgcattaagatatcatgtcttttaaa

SEQ ID NO: 29222 - DNA, 1705 bp, Bovine  19866880633145
tgcagagagtaagtggagttcacacgtttcccctgacctctgcaaccctgctggccttagaaaaccccttcaatggaaggaaggagggagagaaggagggaaggagaaaggaaatgaggaagaggccaggggaagctgaaagcagacatgcaaaagaaagacgtgcttaatcatggccacttttcatcactgttttgaggtttaaaatgagatgatgcatctgaagcacttagcacttggcctggcgcatgggatgtgtgcaaaaatcacatcctcatcatatctttggcatctctgacttacctacccagcaagcttcaggctcaggttggggagcagagcccaggagaggtttggagcaggggatcaggaggtaggagacagccaagcctcccatggtcaccagagtacacatctgatattcaaatacatgaatcaagaatctggagggtttcctattgcccaccagctggcaggaccacttaaagctgctaagtgttccatccaaagttgcaagccaaaaaggaaacggactgtaaccaaaggcatggcttctcagctgacaattatgaagggaagagagaaatttggtctgtctaaacatctggcacgagcaaacatctggtctagttttccctcaatatgtactaatcatgtgtaccagagagaaataacaaacaaaaaaaatggaaagcggaacattaaccttttcattcatttctagggaggaaagaaaataaccccttcacccatgaggtcagagtagttaatgaggactttgaatcccagggattcaaactcgtttctctagttctggcaaaatcttacagtgttggcttctgagtgggcttcccagcactgggctttcccatgtgggaggggagacagtaccatgtcctttccctgtgggaaaacagaactacttgaactggctgcaaactgtactccggctccctttatttaggcagagatgctgtcaatgaacagtgtgaaatccttcagaatctattgggatgaaatggatcccataataggcaaagctaagtcaggatggtgacatgaattgatggcgtacaaactgatccaaattgaaagcaaggacttcctctgaattagggcttccttcgtggttcagatggtaaagaatctgcctgcaatgcaggagacccaggttccatccttggctcaggaagatcccatggagaagggaatgactacccacaccagtattcttgctaggagaattccacggacagaggagcctggcgggctgtagtccctggggtcacaaagagtcggtcacgactgagtgactaacacacacacacacacctctgaattaatttgcgatatctggttcctccagcagggaccctcctggtttctcattttaattgtagatcagcatattctctcagacagttcatcccaggaagagaacctggcaggcagtccaacatgctggggtgttgggctgatgttggccttatcatctgcagggcaggtgataagcacatctcctttctaagagttgggcagaaacaatggtggccgagaaaccaggccctcattttccagcagaaatctcatttcttgctggtcaagagggtttgaaacactaatgaatggaagagagatggaggaggcacctgggaaaacctccagtcatcaggaaggaaagatttcaaataattcatagaggggg

SEQ ID NO: 29223 - DNA, 3157 bp, Bovine  19866880636935
tgttgggaaaaaagttcgtttaggggggcttctttgttggcttagtggtaaagaattcgccaatgtaggagactcaggtttgatccctggtctgagaagatcccacatatggaagagtaactaagcccatgcacctatgctctagagcccagtaactgcaactcctgagcccatgcactgcaattactgaagcctgcaagccctagagcccatcctccacagcaagagaagccgccccaatgagaagcccttgtataccacaactagagaaagcccatatagcaacaaagacccagtacagccaaaaattaaataaatatatataataaattattttaaacaaaaacgttcattcaggtttttcctgaatgaaaacccaaatgaacttgttggccagccatatatttcttctcatgtccccctaggcgggaggctggtggcagccgggaaggacggctcccataccttgatcactttgaagctcaggaagcttctgtggagcatgaggaccttgtactcatccgtgccctcatctaccacgtgcctcagggtcagcagctcctccttgttggccagcacggcgcccctccaggccgggtcaccctcatggcagatgaccactttcttctcaaaggactggatggcctcgtagaggactgctgggtcttcgtactcgtcggggcaagtgaactggtcctggggaaagaatttatctgtgggtcgggaggaccacagagctggtcctggcttgctgtgcacacagcaatgaggccaatgcctggtgcaaggtcaagtctacttccacatcgctcagccccgctgggtggatggaaggcacctcactatcacagtggcctcggggcccatagagctggtggcatagaagcctaggacttttcaccacagcgtggacacttctgatgtcattttctccggccaagtcccctcttccatgctagtgggagatcaccacctcctagggactcttgagggcacatcaccatgggtaccatcaaaaataggcaatgcctcaatgcttagttgctgggcctcccagatggcgctagtggtaaagaacctgactgccagtgcaggagacaagagatgcgggtttgatctctgggttgggaagatactctggagtaagaaatggcaaccactccagtattcttgcctgaaaaattccatggacagagaagcctggtgggctacagtctatggagccacaaagagttggacatacagagtgaacacacacacacatatattcaaggtcatgagtgtgaagtttcatgagcatgagtgtcttgttttaaatagtaagcaatttttattactcttttccccctcttatttatttattttaaattatttatttatttttggctgcggtaagcgggtcttcgttgctgtgtgagggctttctctacgtgcggtgagtgcaggctactctctggttgcagagcatgggcttctcatggcagtggctcctcttgtggagcgtgggcccggctaccccacgcatgtggaatcttcccaaaccagggactgaagcctcggctcctgcactggcaggtggattcttaaccactggacccaccaagggaagcctgagcatgagttttaaggttgccgttgaaggaataagcaccatctccaggcaaaaggagagatgagggttttaagagttactgtcaaaccaggctaacagggaggaggagggtgtgttgagggccagaagatttaagatgactactgaggcagcaaaatcagtgcttgcagctcagaagtgaagacaacaaagctctccagagccctttcgctgcaacagaattccctgatgagccacaagagtggcatctgccttgcaggagccccacagacctgtttcttacaccaccccacctgatcaaccttcctggatgtggggagacagccttgctccctggttcgcaccatcctcatcttcagccaggcacccctcctccaggtagaccacaagatgtggtgaacgtgctgagaccacaagaccttgagaagctggatctgagcctcccagcctcttctctccttctcaggcagcctcatttggtctgtgactactttctgtgactccctcctgactcccgaacaacaagaaggaaagcagacctcaggggaaatgacaggtgacaaatgtttagggagcatttccaactgtgtttttcgaagcttcaaggttctacttcacaagtgagggaagctacttcatcttggaggagtggggttgactctgagccttccccctaccactgcagccagtacagatctgattttacctcatttcatttaaggtttcatgcctttggttggttggttggttggtttgaaaaatataaaaaggtctgaagccaaagaaaaacagtgtgtctgtatcaacaacatgaccagaccagggacttccctggtggtgcagtggataggaatctgcctgccaatgcagggactccggttcaagccctgacttgggaagatcccacatgcctcggagccactaagcctgtgggccccaagaactgaacccacactctaaaggccctgagctggaactactgaagctcacgcgcctagaaccggtactctgcaacaagaaaagcctgagcaccgcaacttgagagtagaaccccctcgctgcaactagagaaagcctgcatacagcagcgaagagccagtgtagccaaaatataaattaaaaacaaaaaacaacaggccctaaatggaatacttatgccaagcccaatgtcaccaaaacaagtcttgaaatcaaaaactggttgatcagaaattgtcaccttgatgctgagcagggccctgtggggctcctgggcacaaagcctgtgtcccccatttctttgattataggaaacagctttcattcagcctctgtgaccttccctgagttctaaagggcagattcaaacagttgttaatcaagagaggagcagccaagaaaccacctgtggcaagtttaaagcgaccagagatgattagacctgaccacctgagactctgagctgtgcttagttgctcagtcgtgtccgactctctgtggccccatgactgtagtccgccaggctcctccgttcatgggattctccaggcaagaatactggatggg

SEQ ID NO: 29224 - DNA, 1168 bp, Bovine  19866880683652
agatcgaaccctgatctcctgcttggcaggcggattctttaccactgagcccctgggaagcccattgtaaaggtaactatttgctgtttggagcccaacatcataccagtcagaatataatgagatcatttaagaaaccagatatatatgccatcaggatgaagctatcaggttcctaaatgccagccctggatcttgactaattttgaaatgttaatgattctatcactctattaggaagctgtgggttccatcctggcattgagaagggactaatttgctccattttgaaactgaattaactttcaggccagcaggtcactgtttagtaaattgctttttccagtcctagcatgttttgtccctcagtcacctctgttagcttatgagcttgtaacctccagggaaggatgagaatgctcacccttttaatatgtgtagagaccatgcaagaccattatcttcaaataattagagttagccagatttgctctattaaatgtgtgtattggaaagactgctttctgtttggcatgtcattttgagcttccaattacgtttttaagtattaatgttgaacattttcattttaaatgcctgaacctttttaaggagtctccatccttagcaactgaacagcaacaaccatctaccccttaggcccgcctcttggctctcaacaaagaaggctgcatgtttctcagcactgccttggttgttatagtcacggtcctctgtatttatatatatatatatatgtatatatatatatatatatttactgatatatattaaaatacatatatatatttataaatatatatatatatatatttactgatggtccctaaataaaataacctatgaggccttctgttcactgctgccctacttctgacctactacacttcattttctttcctaccaaatttggacttcataagctagcaatattttccttatttcttaatgtctggataactgtttctggtgtttaaaaaatggatagcatcctctttggggacatgtttagaagcgaaaagaatggcagtgccagcccacccagcctgcggcctggcctggcttccgcttactttgtcctggttcttctaaccccacagggccccctgaacctgccagagtggatgtccctctcttctctccttcc

SEQ ID NO: 29225 - DNA, 1225 bp, Bovine  19866880733007
aatataatacattaaattgccattattcttatcaggtaacgtttttactaattctcacatatgggattatttttccatcattggtcatttttcatttaaaccagcttgatggggagcatccatctacttaattgtgtttacagacagacagacaaacacagtaactgagacatgaaagagcattataaaccctatggagtggtgatgatggcagaatgctttcaaagtgacaagaaaaaaagagcatgacttcctatgttcacataatgcattcatttcattaatcagccaattgaatcataaactctgaaagagcaaccatatgtgaagtctgggacagttcttagccttcaataaacaaggactaaagtcagtcttggacgtctgctcagagtattgtgaatgataaattttgcctgccatatcagcagacaaaagatgctgcagccatcatgccgtgcgctagagccacccaatggtgtaccctgcggctttccgtggcccagtggtagacaatctgtctgccaatgcaggagatgcaggtttgatccctgggtcaggaagatcccctggagaagggaatggtgacccactccagtattcttgcctggaaaatcccatggacagaggaacctgatgggccacagtccatggaattgcaaaagagttggacatggcttagcaagtaaacaacaaaaaacagtggttccctccgaggggactcagcatgggagaacacaggatgctggctccagagagctgacgtgagtgtcacaggaatcacttcaatgagcccagactcttgcatctgcccatacatagaaaagtgctaaattccttgagatgtctgattttctctaattaacagtaatcatttgatgctctgggactacctggcctatgttgcaaaactatataccttgattcctcccttacctcttctgagcagttcctcagagcttttgagaggctgtctccggggcttgcaggcttcagcaagtccttggaataaaacataatcctcaacttttcggctgtgctttcttttcagttgacagttacaaaattaaagagtcttccgcctgtgccccccatgactgcaatgttaaggaatgagtttgaacctagagttccaaatgcaaaagtcccccaggacccagagtggccatcccttagccaactgtgtcactgatggggacagtgtggccagtagcatcacagagaa

SEQ ID NO: 29226 - DNA, 807 bp, Bovine  19866880832929
aaaaaagaaaattagtctggtgctagttgttaatctaagcattttgagatctaggaagttccacaaagagattgttaccagagccaaagatcccagaatttcaagcaacacaaatggctaattcatgctaattagtgatttttggcaaataacatgacagacatccatttcatggggaatgctcctcaaatgacagcgggagtgtgacatgcatatgtaattcaatttaatttaatgctataattgttttaaagacaatgtttcgacctcttaaagcatttggtgagagatgcaccttttctattttgaaatgaagaaaagagcttaacttgccttgctgaataaaatggacaccatgaagaaatccagtaagaaactctctgaaatatctttgtagtcgaaatggaaaaagatcactgtgaagcccaagtgagtaaactgatggactgggttacagaaagaggtccgcagcagcttcatgcctgcaatgaccatcagaaaaatgtcccagctgttgaaaaggaaagaaaggagatgatcagtggcggtccacacgctgctgggtgagttacaacggctcacgtgtcttgagtgcttactgtgagttatgcacattacaaaaagccaagacggtaggttattatcttcattttacagaggagtaaactgagtctcagagtttcagtcactcatctcatggggtgagactggatcccaagggactcgccaacacagactctgccactagaggcagcttccccactgcgctcagaactttgcgatcaagggcacagagcttcctgggag

SEQ ID NO: 29227 - DNA, 1894 bp, Bovine  19866881108946
gtttgccttggaaatgaaccagatattctgtctttttgagatcgcacccaagtactgcattttggactcttctgttgactacgagggctactccatttcttttaaaggcagcttccttggtggctcagacagtaaagaatccacctgccatgtgggagacctgggttctatccctgggttgcaaagatcccttggagaaggaaatggcaacccactccaatattcttgcctggagaattccatggacagaggagcttggtgggctatatagtccatggggtcacaaagagtcagacatgactgagtgactaacacacacatatatatatatgcccacagtagtagagataatggttatgtgaatcaaattcaccctgtcctgtgcattttagctcactgattcctaaaatgtcaatggccactcttgccatctcctgcttgaccatgtccaattgaccttgattcatggacctcacattcaggttcctatgcacaagagaagaatgtaatctgttgaacaattagacgcctcagacaaccaagataaactgagtcatccaaatgctaaagtgttacaaaaatagcctttaaaaagtaagtactgccactgaaacacagcaacacgccccaaacttgggggtttggggggactgctgacagtcagtcatcactaggaactcacttcccaacttgtctgccttcctattaggtgtgtttctgcttcacctgctttacactctgtatgtagttaatacatgcacagcttcagcatgcttaacactcaggtttattacttttcttttcttaaaaatgcacacacctagagcttcactcatcatattaaaaagttcaaaagtttttatgcaattttccagtttcttcaacaaagtaatgctttaaagacaaaaggaggggaaagacgggggaactagcataaaagaagttttaaagaatctaacggaaaacatgcagcccaagttgaaattctgatttgcaccaatcaactgtaaggagacatctttcagataaactctctgacatcttgagtgacatctcaatatggaatcttacatggtatcaaggaactactgttatttttaaagataataatggcaagaaaaatactttttaaattcctacccatcagagatgcattctgaaatatttaaagctaaaatgacaagagtttaagttttaacttaaaatattgcagtttaaaaaaaaaaaaagatgataagaaaaagaaatgaacaaagtgactatctattgacaattattgaagctggttaatgcacacaaagggtttagtatgtcattctttctcctctttaaagtttttttttttaatatttgaaaattcctttaataaaattcctttaataacctttagtaaaaggctatttcttttccagttatacattttgagtacagttctgttttaactagaaggaaagtatcaacaaatattgatgtgtgaaaatatttttaaataatggtttagtggtttagtctagtggttcttgactcgtgttctccataatcttcatgagtgtgaacacattatgcagttaatatttaccactgaccttttcctttgttctcaactcatcaaacatttgctgaatttccagtttccagtcatcttgcatggaatgaaaggactcttgaggcatttcagtcataactgccttttcaatttcagtcagttgttcaagaattgaagcaaaagatggtcgaatgtgagggtcttgttgccagcattctaaaataaataagaatcatggtaagtccatttatccacatagttcagattgtcagccctgtgttgacagggtctgttcaagattttaaacatcagtcgataatgattttgaaaattttattttacaccatg

SEQ ID NO: 29228 - DNA, 2566 bp, Bovine  19866881128788
cgctggccgagccggcaaggcccgccccccctgcaccacgctgagagagcgctcgggcggagcccctgtgctcacaggtgactttccttcaccagcattagaatcttattgtcagggatctctgaccttctgtggtccccttccccaaattctccacctccagcctttctagatgatccttcgctcactaagaatattggatattgtaattctgtaaaatcttaggggaaaattcaaatatttagctctagtaagagcttccctgatagttggtaagggatagctcagttggtaaggaatctgcctgcaacgcaggagaccccagctcgattcctgggtcaggaacatccactgaagaaggttgactacccactccagtattcttgggcttccctggtggcccagctggttaagaatctgcctgcaatgcaggagacctgggttcaatccctaggttgggaagatcccctggagaagggaaaggctacccactccagtattctggcctggagaattccatggactatatagtccatgggtcgcaaagagttggatatgacttgagcaactttcacttcacttcagtaagagcttgttttaactgcactcaaagaagaaagcagttttgtaagatattaaaccacagaaagttgtagaacctcccgcagccctcaccccacagcattttccccaggaaaatagtgtcaggtcgtcttcacttgaaacgggacaatgaggcatccagcgctgagacaggggcctggtgttggagcttagccgttgcctgcacacaccaagactgcaccctccatgataaccacgaagaaacaggacaggcgccttcatctgaattaagtagccaaggcccagcaaatctgctttgcatatttatgcataataaggagctgcccagggccaacaacttgagtaacaaatcgtcacagtagagagggctacaggggtatttttggctgcaggcagatggaactggattcaccagatcataatgatgcaaagaactggctcattagaaaagaccctgatgctgggaaagattgaaggcaggagagggggacgacagaggatgagatggttgaatggcatcacccactcagtggacatacgtttgagcaaactctgggagaaggtgaaggacagggaagcctggagcgctgcagtccatggggttgcaaagagttgggcatgacttagcaactaaacaaatgtgatcaaaggcaccaagaacccccacgccagcagttttcaaagtaactcagtaacacataactctcatgcagatcaacagagtgaagcagctatgtacgtatcttgaatatctatcactggagttaacattttcaactcattcctgaagggaacacaaaactaggcatatctaatattgagagaatttacaacattttacattttgcccacctaattgactaatttgccccacattctggctgagctaatgcaaaccagggatcactacttctgactaatgtaaagaagagaatcctaaagaggtgtcttgttttgtttttttttacaactttctgcctgcttaccttctttgggatccaggtacttaagcacgatggctttgaaaggttttcctgagagttgatcctagtaagtaagggaggctttactgagaccagggtcagagaggttaataataataatgttcaacaaaaaagtaagaactctgagaagacaataaagattaagtgcacttcaatccatctttggaatgtagtacctaatgggtttagaggtttagagtagctttcaaaagcaagcctaatgtataagcataacaatatctgtttcaatatgcactattgcatacatgtgagttgctcagtcatattcgagtcttttcgaccccatggactgcagccctccaggcttctctgtccatgggattctccaggcaagaatactgcagtgggttgccatttccttctccaaatatgtagtacaatgattcataaataaacagaagctcaaaacaagtgaatccagataaatataaatagatgattactaatgtaatctactctacgtttttttttaatagaaacaagttgagatacaaaaatccctgataaagatcctataaactgatttgctccagatgagtttaccattcagtagaccaaggctactttatgagtaatagattctcaaaatgaatgtaaacactatgtctttccataagatttcactggggagcagatgataggcattttgtgcacacttttaaacattttgtatgcatttacatgagattgcttttgacactagaaaaggttttataatactaaagcatggttgtgcatcatttacagaagaaagctgttctatgttgcttgcaagaattcacagatgaaagaaaggtaaatctttgctgaacaaagaacagaaactatcaagttttcattgcaagacatacagaggaaataataaaagtctgctttgcagtgaaccctttggacacaaaacacacttcaacttttatgcagcttcaccttcaacttcctaggcagagagactattt

SEQ ID NO: 29229 - DNA, 1779 bp, Bovine  19866881163067
tcctgatcaagagaaaatatatcctcaaataagatatccacttgtcctaagttgcacatactgttgccaggcagcatcccaagtccttaacaaagatgaagtcatttcatcctcaaatgaccatgtgggaggtcccagtatcagcccccatgataggtatcagctgggattgaaaccccaggcaatgtgccctcaggcccatactcttaaatactgtgttgtgttgacatctgacaaagtgtcagcatgtcctttttctggtgggagggttattaggttattaaattattgaatttttactgtatggctcagggaactctggtcaatgttatgaagcaggctgaatgggagggaagtttgagggagaatggatacatgtgtatgtatgactgagtccctttgcagtccacctggaactatcacgacattgtgaactggctatactccaatgcaaaataaaaagtttaataataaaaaaatttactgagtcgtggaggaatcaatcactggaatataaagaactgtcattctggagatctggcttcagtgattaagaatagcagagtctgtttgatgagcggcatactgaaaatcttttacaaagcttgtattttattcttcagagtggttgtgaaaaaagagtaaaaaaacaaagcagagacataggaaaagaacaaagatacctggggtcttggctgcaattagagcatgagagtgcatgtgcctgattactggttttgcttatgtataaatacaggttgctgtgctatgcaaaaaataattgtgatagattcatttaatcataatgcagcaaagtttaacttgttaacgctttaaacttgcagatgaggctttccctggggctgcctgtctgattgtagttgcaatgcctgacctacttatcagcttttccaggaggtggcttaaaagcctcccaggatatagtcatacactgaaaacccaacaggaataactttttaaaacccatgattcattttcatggcatttgggggttcatacatcacataaggtaatcgtgctcatgcttgcagttttcacctaggcatgagtcacaggactaaatcttaataaccagactaaaaattcttaacagtgttgtgacgagaatgtttcaaatccagaggcattttgcttgatagagtggggagggcataaagaagcaagttaatacaagagagtccgtccccacttctcaggatttttgcttttgatgtactctagagtcatttgtttgaatgtctcctgttttgtaattagcgtactcttcctctggttgaattaatggtggggatgcatggatatgataatgaccttcaaagggaatcatatcttttaagagaagtgagtcaagagtttgagtctgtgtttgacctgtctgtccacatcatctttaactggtgggaagtcaggtgggcagaggactaattaaaaaaattttattttattttggagtatagttgatcaacaatgttgtacgtatacatatattcattctttttcatattcatttcccatttaggttattacagaatattaagcagagttccctgtgctgcacggtagatcctggttggttatttattttaaatacggtagtgtgtatatgggagaaggcaatggaaccccactccaatactcttgcctggaaaatcccatggacggaggagccttggtgggcttcagtccatggggtcacgaagacttgaacatgactgagcgacttcactttcccttttcattttcatgcatggagaagga

SEQ ID NO: 29230 - DNA, 1176 bp, Bovine  19866881163503
ttctaatgagtgattcctgttgatcccacagacacacagagacacccaaaatacctttcatgagcttggcaaatggctcagggcaggtggaggggatgggcagagtgagcttgttgaccgcccaccccgtaggccacagccaagccatcaatgccacggtagggcacttctcccgtgagcagctcccacagcaccactccgtagctggaaagtagagttttcataaagttaagtggggctttttcctcatgacacaatcaatgggagaaacacatcagtgccttcatccagctcctaataatcaatcttctcttccaacaaagcccataggggcccttatcccagtgtgagaggtgggttcttccacttaacattccaaacatatacaattactctccttccagaaatcagttatgccttcttctgaggaagtgaaactacttagtaaataggaaagcttaaaagcagtacatgactgaattaaacagggtccagaaccaggccttttcatactgttgagctgactcattggaaaagaccctgatgctgggaaagattgagggcaggaggagaagggggcaacagaggatgagatggttggatggcatcaccgactcaatggacatgggtttgagtaaactctgggagatagtgaggacaggaaggcctggtgtgttgcagttcttgggatcacaaagagtcgaacacgaatgagcgactgaacaacaagaaccaggccacacataaagagcaatgtggttgttctgatgtttgtccttctgtctcattttttccacacctcctgaagatattcaggacactgaagattccagccctacagaatctcatgctatacagcacaggactgaagtccaatcatgctgtttttttttttcttctaattttattttatttttaaactttacataattgcaatcatgctgttttaaaacagattttagaaactgcttctctctgcctctccctttatatttaggagatgtgttactcatgtttccacctaatgcctactagtaatgaacaaagaaatcctgtgggcctccctgagcctgctgggagaatatgacacatcttttttttttataactgagggaggtaaagtgaaaggagaataaaaaacaaggaacaactgcagcagccaagctcttcaaagca

SEQ ID NO: 29231 - DNA, 1750 bp, Bovine  19866881310422
cagcacttgaaattggtctttgcattgagaaccaccaagatggagtgcacaaaaggctgagatattctgcccattagaatactttttcttgcttgttgttattttttttaaagatgagatggagaataacaaatttagctaacagacttttcttcactgatagaaaagtgagacagcaaatgtccgcaagaacctctagccagaaatcccatctggctcactatactgttgtttttccaactgaaaattatgttccgataatctttttggctctgtgacttccatctcattcctgatttggtgagtcctcccttctccactcttagcagtgagctgtggtcctgttttatgactgttgaccatcctcatggtggattctacaagatatgctagccaaacaattccctggatgggaaagagcgagggtaaaacctgtgactcaactttgtgttgtgggccaaaactcatctcagacataactcaacacacctggatatattcctccacgctctctattcttttctattctttctctggctccactaacctatcagtagcctggagctgcacagtgggctctgtttattacagacaatgaggagaggggaagagtgcaaagccaaatggatacatactcgcaaggacaggaacacagtgctggcactgactgcaaaggacagaacagcagccaccgagcagatgatgagatccgattttaagatatccttctgtaaacagaaaacaactgtacagtttgcttgtctgtgtttctctcagcaaccttgggtcaccaggtaaatcgggtgacaggatcttaacccctggatacacttcatcttcagaccgtcacttacctgatctattcccaatggcacacgttgcatggaccattcagcacctcccatgtggggaatatcagggaaactaaggcagaagggggcaagaggaaatgcagactgccatgagaaagcaatggcaccccaatccagtactcttgcctggaaaatcccatggacggaggagcctggaaggctgcagtccacggggttgctgagggtcagacatgactgagtgacttcactttcacgcattggagaaggaaatggcaacccactccagtgttcttgcctggagaatcccagggacgggggagcctggtgggctgccgtctgtggggtcacacagagtcagacacgacatgactgaagcaacttagcagcagcatgctcccatccactagccagggagagaagattttctacacgtgtaagaggcataaagttcttcttgacaatcacagatcagatgcgagatgcccaggtttaataaagatgggtaaagtgtgaattgtaaacttttgagataggaagtggaaagcaactttagcagctaattggcaaattgatgttgagagtggatctcctcattgtattattgattatcccaaccaagccatgtagatttttcatcagatgggtcaggtcatttttactgcatttaactgtcctcctgatttcttcctgtcactttggatgacaattcagtcagaaaaccagcatcatgacttgcaagaaatttcacattttaattttaaaaagacaggaaaagataaagggaaggagggaatgtaggtaaacaggcatatggtttgtacagaaagaaaagaagggaggcgatggggaaacagatgtatattctatagattttctggcaggtaacattcaaaataattatttaagaggcacaattc

SEQ ID NO: 29232 - DNA, 1174 bp, Bovine  19866881321917
tcatgtgcccttcaggtgactgtcacatgtgtcccctcatagctatggcgtttaacattttatagaagacttttggaacttccctggtagctcagtggtaaagaatccacttgccaatgcaggagctgtgggttcaatccctgagtcaggaagaccccctggagaaggaaatggcaactcactccagtatccttccctgggaaattccacggagaagggagcctggcaggctacagtccacggggtcaaaaaagaactggacatgacttagtgactgaacaacggaagattttgatgtatcaaaatcaaatcattgcgaatggaacttttctttctttagggctgctaagtcaatttagtcatgtccgactctgcgactctatggactgtagcccaccaggttcataagtccatcggattctctgggcaagaatactggagtgggttgccatgccctcctccagggaatcttcctgaccagtccaactcctttaggactgagacagtggatgaaacaaccagggccatgagtcaaatgctttccagcctaaacatttgctgcatgttaatgataaagtttggttatttagcaattgtttatatataaagagaaggatgataaatcataatatcaatatgtatttctaaagctctttaaaagtactctcacataagaggatttataaacatcaggcactattattacagtgcatttgccatcactgcctgtaaattaaatggagacaccaggcagaactcatcaagactgattttaaagaccctcttcgttaagaacagtttaatagcgaacattgtgttgcggcaaatgaaatccagattatgaattcctttctcttttacataatattgttggacttcattaagttaagaaatagtcacacaacacctactgtaagcagagctgttctgtacatgcaacatagggacacaaagatgaaaacaaagaagtccaaacttggaagtagcatcagtcacaccaatctttggtacaatttacgacagccacagagcaaatttgttttccaaaagtgatggcttccgtacctctcatcctaaaagtccttcctgaaccttccattcatccatcaacaggtggaatgattctctgaatcattcagagatgccttttgaatctgtgtgggtggaagtggag

SEQ ID NO: 29233 - DNA, 1149 bp, Bovine  19866880470648
aaacagaattacaaagtcagcatgttttatttaattagagtggtgttacataatactgggagaattgtgagtataagcatttaaggacccaaaatgcccatttgtgaagcgtgactgccccagggggtctctgttatggttcccaagaatgctttcacatgaaactgggggtcaaggggcgataaggctatgcatccacggccactggtgaactgactgtctgagctgtggagctgctgggggcagggagccctgtggaggagaaaccaagtgcactctaccaacaatctcctaagaggggttggcagaatgtgttttcactgtgtagctcaaaggctgcaactgtcagctggcaaggtaggaccttgtgcccctccctctccttcatacagaaactgttagatggctccaaccgtccctgacaggccaggactccaatgctcaaaggcctgatatcccctccacttgctacaggagtcaaatccataaagaagagcagaaactcaccagtaaaggtagtagaagaaggagaggagatagaaggccagcttacaccacgcctccttctgacagtaactcaaggtgtctgcgttcatgaccaccggtgggtcataggcgagctcggagctgtctgctggacagtggaaatacctgcagggagagcagacaggccgtcatcggttctgagacctgggagggacatgggaagtcacctgggctgagtcctcctgatgcctggcttccctctgaggagtcactgccaagcagtcatctgcattctgccagaatcactgcccaaaatacagcccaggaatcactaaacagtggctcaaccactatcctccagcaggtggtaacacccgagtatgcagatccaccagcgtcacattcgccccacacacaggtgacagaaggaaaccatgtcacttgggaggtaccaggaagagcctcctttctccagggatgtgggtgggtgaagggtggtctgtgttgtgggcaggtcgggggggtggtggtgtctgttatgtgtacagatctgggcatcactaggggcacaggtgtgtgtggacgtcagttgcatctctgcctcccagtgttgctgtaccataattttaccataaatattcattacttcggattaaacaattc

SEQ ID NO: 29234 - DNA, 1126 bp, Bovine  19866880492173
tttaaatgcttactgtggagataaagactaaccaaatgagaaaaacaaaatctattcattctgagctcactatagcaagggagtcagccaccatcacttgcattctggcagtgactcaaaagccagcagacgagcaggaaagctttgtagtggaaaaaaagggaaggctgctggcatgtcctgattggaccatatcggcatgaggaagctgtctacaagctaactaaaagggagccatcctgtgtcactggttaggggtgcctatgtggctttctctggtgggtcctaagttggaagcaggtataaaaattacggaagctataagttattaaccaagtcttgggacttgcctggtggtccagtggctgagactccacattgccagtgcaggggaccccagggttcgacccttggtcagggaactagatgccacatgctgcaactaaagatcctgcatgccacagctaagactgggcacagccaaataagtaaataaatacaaatcaagtcttggccatttggggccaactgtgacagaagttattgtttgacttctcagattgtcactagaagtaagcagtctcacttcctgagattctgccttttaagactggcttccagggctgtttattgtagatgagagatttacttcctgggcaagttgctgcagattgtgggtcagagttctgtttttttatatggtctatccattgtcccttagtgtattcaacttctcactactgtgcatttttcacaattattttgagttaaaatctctaccataggttaatatattaatgtcttcatgtttgctgtttggtcactaagttgtgcctgactctctttgcaaccctatggactgtagccctccaagatcccccatctatgggatttcccaggcaagaatactggagtgggttcccatttcctcttctaagggatcttcccatcccagggttcaaaaccacatctcttgtgtctcctgcattggcaggcagattctttaccatggggccaccagggaagccctaatatcttcataaagtgcttaacttaacatgatttcccacaggaagacttaagcaagagaaatttgtattttatttttttctagtacgacataata

SEQ ID NO: 29235 - DNA, 3029 bp, Bovine  19866880518836
tgaatgcgagaaagtagacacaatatgagtaatatttcagataacccgatggtaggatcactcacctagagccagacatcctggagtgtgaagtcaagtgggcctgaggaagcactactacgaacaaagctagtggaggtgatggaattccagctgagctacttcatatccttaaagatgatgctgtgaaagtgctgcattcaatatgccagcaaatttggaaaactcagcaggggccacaggactggaaaagttttcattcccatcctcaaactaccacacaatttcactcatttcacacactagcaaagtaatgctcaaaattctccaagccaggcttcaacagtatataaaccaagaactccagatattcaagctggatttagaaaaggcagaggaaccagatcaaattgccaacatcctctggatcatagaacaagcaaaagaattctagaaaaattctacttctgcttcattgactacactaaagcctttgactgtgtggatcacaactaactggaatattcttaaagagatgggaataccagactatcttatctgcctcatgagaaacctgtacacaggttaagaaacaacagttagaactggatgtagaacaatggactggttccaaatagggaaaggagtacatcaaggctgtatattgtcaccctgcttatttaacttatatgcagactacatcatgcaaaatgccaggctggatgaagcacaagctggaatcaagactgctggaagaaatgtcagtaaccttagatatgcatataccaccacccttaaggcagaagcaaagaggaactaaagagcctcttgatgcaagtgaaagaggagagtgaaaaagctggcttgaaactcaacattcaaaaatgaagatcatggcatccggtcccatcacttcacggcaaatacatggggaaacaatggaaccagtgagagaccagcttgttccttggaagaaaggctatgaccaatctagatagcatattaaaaagcagagatgttactttactgacaaaggtctgtttagtcaaagctatgctttttccaagagtcatgttatggaaatgagaggtggatcataaagaaagctgagcaccgaagaattgatgcttttgaactgcggtgttggagaagactcttgagagtcccttggactgcaaggagatccaaccagtcaatcctaaaagaaatcaaatctgattattcactggaaggactgatgctgaacctgaagctccaatattttggccacctgatgcgaaaagctgactcattagaaaagacccctgatgctgagaaagactgaaggcaagagaagggaatgacagaggatgagatggttggatgccattactgactcaatggaccttgagtttgagcaatctccaggagatggtgaaggacagggaaacctggcgtgctgtagtccattgggtcacaaagagtcagacgtgactgtgcaactgaacaagaacaatattttacgagcatctcagtcacatctcagtaatatttttattaatccctttttgatttatgctacccttggccaaattgttcccatctgtcttcatatgactgggcttggggaggttagggggactatgaggaataagataaggaataagaagcttttgttcactgacagaaaacaggtccacttcatcttcctgtcaatacataaagcctttaagttactgctaccccatatctatcaaaagttcaattcagaaaaataatatttaaaaatttttgagagagacctagttcaccaattcctccagagcctcaaattcagccaaagcagcagaggtagtaagttctataactagatgatatcgcatcagttccttactgaattgcactttgtgaattatgatttcatgcactgtcattaactatacagggaagctacataaaataatcctatgaaatgagtcacaacacactgagtaagaatgctttgaggacactgttattatattatcaaatcctctttattaaatccttggggaagttttgttttacctagctttatttctcttgaatatgaggttttatcttgtacccactgtgaactttgtaacaaagaatgtttccttttatatatcagctcaaattagagtgtaagcatattgaaggtatataaatacaaaatacatatacatacatttgtgtgtgtgtgtttgcattctacacagcaccttgaaaaatcttacatatagtaaattcacagtactagttggttggctaattaactacgtttgtccctctgtccatttctaacactttttccaggaatgcaatttggagcaatagttttagttgatacataaaactgataaacagagaggatataatcaaagaattacctttaaaattgtaagttttatttctgaaattgctttatccctgacatcttcaagttgtttcaatgcctgagtagcctgatgtaactgttcttcacaaaattcatgtagagaatatgttcgaaacttatccagctaattaaatgatagtaaatgttcagtgttgaaagtcaaaattcatttaaaaaaaaagaaaataaaatatcttggtcactgcttcatatcataaagaatagcatattttatactgttttatatatatcatatatgccttatatattattcaaatttaaacactattactcaatctaagcaaacctttaaagaagacagaaaaacacatcattttaattgttaaattctagttagctttagttaacttttaaactaaagcagaaaaattcagaagttgatatgtttatgaaatatctatgaattcagggcaattgacaatcttaggaattgcttttatctttggagctcccattatctgtaaaacttaaaaatatgaacactagatgtaggatagagagactaaaattaaataatttaaataaagtaaattacattctgaatttattcagaatcctgcatggagaaatttccatcaactgtgctgctgaactcctctagtaatacata

SEQ ID NO: 29236 - DNA, 1815 bp, Bovine  19866880633546
tcagtgcagtggatggggctgcatactcctcattgtttcccgcactgagaatagggactggcactcaggagacactcaataaatactgaatgaacgcgggaaggaaagtgagtgaacacatactgtgaggctcagtgttataacggaaggagcactggttttggttttgggacgtggctcctcgccttgctgtgtgaccttgagtgatccgcttttcagcgacccctgtatttccccatgtcaaataagaccgctctagctccagacctgaccggtgaggctctgtgagcatgaggcgtacctcgttctcaaaggcagaacttgagcttctcagaagggccttgctggggctttgcagctggagaaggttagaagcaaaattcttcagtttcattgtctttggttttgtttcttagattttcctttcttctctctatattgtaaaagagttgtttttctttctgccagataaagtgtatattttggtatagaaacttcttccttgttgcagaattagcttgcagccctttctaagagtacagggatgtgtgaccccctcctcagtggtgttagaacaccaccgtaagacacatactcttaatgcatgtttaatgcctggactttgttaaaaacaagagggccagggaattaaccatttacgaattcatttagtttgtgagcccagagggcctgtgttcacacacacgtccctacagtcatgatggtgagcttctccccagcactgacatattaaccagcataatctgggagcccctggacatggccatcacatatgcatgtggcagctggtggcataaagaatccacggcaccccggacccctggggacctgtcctgcaattgcagaaaagaggaatagcagccataatcattatcctgttgagaataatgagagacgctcagagcagtcatatctctcatccaaggggcacagtgtggcctcgtaacaatggttacacgaggtgggaagtagaagagggaagagtttggggagcagataagttgctctagtgacaggaatgaaaaagaagccaggggtctggcttctggaaggtgcctcttttaagggccgtctaagtcctttgcaggctcccactaatgccgtcttttttcctcttctttttgcatccagcatgatctacactttagtgagctcttaactcgaagaccacgcacattcacagagactgagatgggagaggcccgaggctgtgcagtccatcctgctggtgacgggagcagggaccagtgtggggatgtgacagacagagatgggcagatactcggaattgggagccggaagcaggcagcagccagcgcccgagccagcccgctgtcacacgtgtggtcgccctgtgtaccagtcttccgcgtttgcaccccacacttggcctgtagatcccttctgggcagcaggggcatgtgaggtgatgaaacacgaaacctcttctgaacgagaattgctgcttcctgaatcccctttattgaaaggctccctgaagttcatgctgcgttcctggtctgtgggtgtgatggctggaaggctggagggtgccctctgaggaactgggtgacccagagtcaaggctgcatctgtgggacagtttgaagatctcaaggatgtcatggacttacctgagacactttcttccaagccctggccacgcccttcacttcgatgggcggggcctggaaggtgtgcagacttgccttgggctgtaaccagccttgagtctgcaagggtgtctatttttctgctctgctttgtaagagcccagtgatgttgggaactgag

SEQ ID NO: 29237 - DNA, 1796 bp, Bovine  19866880658513
atgaagagacacatagggtgtggactaggagcatcccaaggaatcaggatgagtcaccctcccagcacatggatgtgcttaccaaccactgatgctcatctaagcctcggggtccagagcttccaggtccaaatgactcccatccagagccatctcattagcataaatgatcaagacccaccatgaataacaatagcatttttatcacctgggaaatgctaaggtgttttagaagcaccaagccaggaacctgggacaaaaaccaaagaaattctttcttatccaaccacaggagagtggcataatctgagttaaattttagaaggagcattgcagctgctatatgatcctatacaagtcaacacaagacatggagcttacagtgaccttctaaccagatagtctctggtcagacaccttggctgtccctgactgcctagtctcccttggtccctgtccattttccaaacctggctttccagcttccccattgattctaagagctacgtaagaccttgaaatacatagtctgcttaaacaaaccagagttggtttctgttattttctaccgagcaccctaagcactgcatgctctctttctatcattaggtttccatagtctcttccacaaaggaaaatgtggttgatcctcagctcctaacttcacatgttccacatctgaacactcagactgctttcagtttcatttccaagttcctgggaaaagagtctgattgtttcatttgggtcagatatactctcttagtccaatcataggtagcttaaaaggctgggttatgtagcacaaacatcaccagggggtggctaaaatttttacaaatagactagatctccaaacattgtttcctgcatataggtggaatttagatagctggggagaaaaagtatgaattgcaaggagaacatgagctgacgatgcatagaagctggaatggttgtggcattttcaaagaacaggaaagattctggccaaatcacagaagagggatctgatgagacgtggaggaggcgtgggcttggctatgaagggggaggtcctattatgaagaatctagacacttggcagaaaagtttctacttgtgaagaaaatgggaagccatgcaggttttcttggctgaagaaaggtcttataaaagtattacctcaatagtagcagcaagttggatgggagatgatggtgatagagatacaagtttttaaaaaacagaatacactcatttactccatatggaaaaatgagagaaataaatcacaattataaaatccaaagttgttaatgagagagagcagtaaatctcaaacttagaaacaactgatagatgaatgccccataaaaaagaacagccagtggcaccgtgtgtgctttctgtgcttgatcctgtgatggtccctgcctctcaggaggtaatagcatgacagagaaccaccaaatctaatgaccagctcctttcttttttaaaaggcggggttgggggaaggggtggaatcttgcatttttgctgactcagctccattcaccactaggggaaatttattcttcatatgcacacagagccttgttaagagcctcttctccctctttcctctcatgtaatttttgttcagttacctcaggaaaaggtctcttgtgtcccctttttttccatttgtgagtcaaagaaaaatgaccgtaatcatgaatgataagtttaaagcagtactagtgatatatccatgtgaggaaaaaggaaggccctgcatttgggagtgaaatgtaatgtcatcaagaaccaat

SEQ ID NO: 29238 - DNA, 740 bp, Bovine  19866880731018
aaacagatcattgtgccatggcagggtctattacgctgtctagacatggccttgatgtggccaagccacttggttaataaaaccacgaagaatgtgaacacttctatcaggcctgatctcctctatcatagccacccacccactgggaagatgaaaattgtatatcaccatttctgtggcagggagcacctgtccataaaacagaactctcttggcccttttgaacccaaacccagggttttcaagggacattttgagctggaaaataaagctggccagcaggctgccctgagccacgactcctgattttcaagttcatgctcagcctacctgcgatgaaatctggagttgccacatcagggctttcggcatgagccaactgtactcagaacagctcttgttatataaccttcggccacggcccacatgtgtacatgagcacatgctcaccctgtacaaaagcacacagatcttcagatacagctttttttgtttcagttacaggaagggagtaacaaacattaagctggaaaataatgagggatgggtaaaggaaaagccctttcccactggaaagattaaaaaatatgcacatttcagagcagatagaagtccacatttcttgtggctatattaactgtgtggcttaggcaaaccgaaggctcaaagaaaagaaagccaagtggattacaactgggggcagtttcttcacacaggccatcttgacatggatagcttgg

SEQ ID NO: 29239 - DNA, 2164 bp, Bovine  19866880812103
gaaagttatgatcaacctagacaacatattaaaaagcagagacattactttgtcaacaaaggtccatctagtgaaggctatggtttttctagtagtcatgtatggatgtgagagttggactataaagaaagctgagtgcagaagaattgatgcttttgaactgtggtgttggagaagactcttaagagtcccttggactgcaaggagatccaccagtccatcctaaaggaaatcagtcctgggtgtgttcattggaaggactgatgctgaagctgaaactccaatattatggccacctaatgcgaagagctgcctcatttgaaaagaccctgatgttggaaaagactgaagacaggaggagaaggggacaacagaggatgagatggttagatggcatcaccaactcaatggacatgagtttgggtaaactccgggagttggcgacggacagggaggcctggcgtgctgtggttcatggggttgcaaagagtcggacatgaccgagcaactgaactgaactgaaagtgagggatcaaataacaaagtctagataaacagttaattaacaaacaactttattttgaagaacattatagtagatatcttttatcataattttatttttccttgatcacacctatttaaacacggaagcaaattgctaacatgacattctacacttacctgaagttgattataaaactgtatgattctctctttttgagctggccactgatgtaagcccaagtgttgtgttgcaatctctattagtttcttaaagaaaaaaaaatacattaatttaaatttcattgcaaattaaacttttaatatgtaatcttacaaaacctctctaggtagcaaatacagcactttatgatggtatttcttaattttttagttcaccaactccaaaataatgaaaacattacttcccctaccaaagtaaaatacacagaaaattttatgatcacggacccccaggtagcaaattcatagatcctctccgaatttaagacatgctttatgatgcatttaagaactagctgttaccacagtataattgtctaatgatcctacagtgaagaaaaggtaaaagattctatatctttgtggaattttttgaaaggagaacaatgataagtatttttatttttgcttatttgttaatctgtgtttaactctaatcaccattaaagttgaatttcaattttgtaatgactgttttactgtttcaacgttaggaatattctaagatagcaaaatttacaagatgaaaaacttgacgtggttatacattagatcatcccaggaagtggctgcacctttgaaagatatttactatttcaacacaggaattatagggcagcatgattcctcctaaagtggggtttacttcaatgttgatataattggtaactatgtctacagaaaaagtatgatttatcctttttctcactagcctctcctacaccatttctcattccttgcattcctacaatgggaagcagccaaagaaaacacacacactcagcaagactgtacaaacagaggaaaaatagactctatgtaaggctaactggaggtaggaaattatttttgaaaagcaacctcttccaaacaaagttgatgagactgcccacttatggccttcactgcttgcagtttcagatgtagaaactaggaatctctgcagttactaatacaaacctagatactgcctggatacaagtgaaaaagtcacacaagtgtggaataaagatagcatgggatgcacagaagatcagaagaactgggataataaaagaagacatcttcagatatactcgggtcatcccacctggtgaaggttttgaaataaaatcataatcctgacctaaaatatttatggctgtataagatgttcattggagttaactggatgacaaaatatatgtagttcttataacatgatatggttttagtaattctcaggttattctttggttgctctgagataatgatccctacacacgttgaatactgctaaagacagtaatgtgaataagttgtatagattccaacttattccacatgcaattcagattcttgtatcacaaataaacaataaacagcacacctacagggtattttttaataacatgccttcctatgtgggtgtgttata

SEQ ID NO: 29240 - DNA, 1795 bp, Bovine  19866880816069
acctgatcccccagccacaggtaacatacagtaaagttgggaaaccaagaacaatacaacaggagattatccatgtaagtatttagcatatcatatcccgggcacatagtgtggattcaaagagcatcagctgttagtaccattacgatcgctattgtgaagatgaggctgtggtggggcttccctggtccagtggttaacaatctgccatgcaatgcagggggacacaggttcaatccctgatcagggaagtaagactccacctgtgtcggggctactaagttcccatgccacaactactgagcccatgcattctagagcaagtgtgttgcaatgaagacccagcacagccaaagttaaaaataaagtctaaaaaaaaatagacgaggctgtggttagaagcaagagaacaatgttgagaagcactcatatcttcactacttccatggtcaccatccaccctcctctccctaaaagggccaggagggctgaaaatgaggcagcactaggtctccagggacagaaaccagggacaggcttccagtctgagctgtctggagtataaagagtcagaagacgggacactgagacaagacctgaagaactgccaagagtcagggccaggagagccagagtaaaaacccacatccaaatgctctttgtgagcaagagaagctggtggtcaggggccaggtaggccagagtagcaaagaagccagtctgaagcaactctaggaggatcctgggaggctgtccaaaaggatgctggaatagccacagatcaccctgacaggctgctgggcatggccatgtctaaccatcagaaagcttatcaactgtaccataaagaatatgatcgataggctcttgatgtgggggcctgaggttgagcagcagtggcatcacctggaaacttgtttgaaatgcacattctcaagccccacccctaacctgctgaatgtgaaactctaagggtgagccctctgggcttccttagaatccgtttgcaatgcaggaacctcaggagatgcaggttcaatccctgggtcaggaagatccgctggaggaggacatggcaacccactccagtattcttgcctggagaatctcatggacagaggagcctggtgggctgtagtccatagtgtcgcaaagagatggacacgacttaagtgacttagcatgcatgcatgtaaaggtgagctcagtgtctgccctcaggaagtacaataagacaaacttctaaaatcagcatttctctactttagctataccctaagatcaccagagcaacccatcctacatcgatgacatcaaaatctttgagagatggggtcatggggcatttatttacctattattttaaaaatgcccttggcaattccaggggtagaaaactactaatttcaaaaaaccttccttaggagaaatccatttataaatgaagggtattaatatatcattgctgttccctgggcagaccatatgttccaattttatcagccctcttctctgggtttcatatagccttaaatgagatggcttattggaaggacctttaacattaactggctgtagttggtaaggctttctaccctcctgcccaacagataactcctcaagtgtcagagtttaaattgagtaagggcacactttccagaaacctgggatcaacagaatcaaaatgcgtgtgtcatctcacaaatgactgagtaaagaccaaatgcttcttcaactgagatgaaaattaactctaaagtcaatacaggttcattgtgttcattgcaatggagta

SEQ ID NO: 29241 - DNA, 1876 bp, Bovine  19866880863814
ttaaaaatatgtatgcatatacatataatcttaggatttaaaaattgtacttacttttttaccagatcaaacatggttttctctacatttaccagccattgttctataccacttcttatacggattttcctataatttttttcaaaaataattattatgaaaaattctctttattatttttattcatgtttcattcctttggtcagtctgtaaaactgtcttaaaactacacctataatattcatgggccaaaggactataattctatactgtctttggtatttctagatcttaaattagaaaatagatcacctagtttttggaaattttgacatcaaaacaataaatctgaaaaattaaaaggagccagtaaaatatgaatttgcaaaacagataaatattacaaaacatttttggcttccttaatgaatcttccaaatagcaagccaaggtcagggccgggttagaggatttgtaaatgggaaggtttgggcatagtaatttttaatcacctcactttaggaacctcatgccaaaggctagggagctcttacaaggggtggcaaattgtactagtgtaatggaagaacttcatttactataattgccaggaaaccattcatgacaaaaccagaagtcagaggaaacagcagtgggagtagcatcagcaaccctaaggaaatagcaaatttccttcctacctatattcatataatgaaactttgtgttggctcataggatatattaatatatatagatatggaaaggtaaaactctacataagtaaattatctttgaagaaatagtttgattagcaaatgtctatgaaatgtcagaaacttccaagcaaaggttttaaataatgaagatttacagagtctaaatgcttagtttacgacatagatatcatactttggcagcacaagagtttctccttcagcagatatgaacattatcacagcatgagggccaatttcttgtttccatatcaataagtgtcttatattttcaaaacatttcacaagatgaggctgtgggccagaaacaaatgtcaataacattataaaattctgacttggttggataataacattgctgaacagagaataatgaatgatattacctgtacacactcaggatttctgctatcagatagaatatcaagaagttcagcattgctaagaaagtaaaatcttgggaatatcattcttttagtttcaagatagtcctgtacagattcaaaagaaatacaattcagagtatatgattaatcataatattaattacattatcatttgtgcctacatttacatacaaaaggcacattattaaagtttcagtatacatagtagtatcagtcaaaataacatactgtgctcaacaaaagttatacttaaattactaaccaaaaaaaaaaaagaaccataactaaagcaatttaaaacaaaaacaaaaaatccaagtcttacacacatgtacacacacatattattgatcattaataaagcactgtattttagtattatcatcattgctttccagtgttcccaactttctgctcttaattccctatccttctggagaataagttatcatttcagcaggccacttcacattctactatacagagaattcctgtatttccacccctacccacaatttatctgtgttcacaccaatcttaaactcttcttttcagaggaagagatactactcacttatgtgggtgaattatccttgttttatttactactctcctatatcttcaatttcttggttgcaacagacttcttaaattctctcgttaagtatatacattatatacatacacacatgcatgggcagagagctttctgtaggttgtaactaccatatg

SEQ ID NO: 29242 - DNA, 1996 bp, Bovine  19866880886854
ttaccgcttttagggaccaataatccaataatgggtgtgtggaatgaagtgggtttagtttaactgaagcacataaaaaaagacctgggctgttacgtaatgcaagttcagtatgaaaccaggcatatgatgtgtctacaaaaaggctaatgctatcaggtcacgttaacagagggtacagtttacagaacagaggaggtgagtggtgcttttactctctgagccaactgaccctcaccttgagtatggtgtttagttctgacagtcatgttttagtaaagacgtttacaactgtaatgtgactgaaggacaatcagaagggtgagataatttagtgccagttaacataacggctgcccactcctagtatcctagcatgaagaattccatggactgtatagcccatgggatcacaaagaatcagacacgactgagtgacttaaaaaaaaaaacatatatatatatatatatatatatatatatatatatatatataatggttggagagatttagcctgaagaaggatttgctgggttcaccatagctgtcaatactgataggaattccttgtggaagagggattcagtgatcctctgtgtctctaaagcagtgcattacaatagaaccttctgtgatgatggaaatgtgttatatctatgctgtttaatagctactagaaagatgtgattttaagcaattagaatgtgggaactgaattttaaatttaattttaactaattaaaattaaaatagccaaatgtggctaccatattggacaacatgcagctcagaggagaaataaaagaatagaacagaggttagcaagtttttttcattaaagagcaagatagtaactattttgagctttgctgcccatatggtttctgttgcagctactcaactcagccattgtggtgcaagaaaatagaccatgtataaaagaatgcatgtgtccatgttccaatgaaactttatcgatggacactgaaatttgaaatgatctaattttaatgtgtcacaaaatattattcttttaattttttctgttattctaaagatgtaaaaaccattcttagcacacaggttgtgcagaaatgagtggccagctagatttgacctgtgggctgtggtttgctcacactggcttagcatgtgggtgtaaaccttagggagttatatgtgagttcagttaaggaagataatgattaattagaggtagccaggggatagaaggagcatcttcagtaactggtgagtttcttgttactaaagcttcaggtatcagctggataatgaactatctggcaagggatgatacagaaatgtgtctctctaatattacttacactagaattctcccctaattctgtaggagtattaaaatcagagtgacatgtgactgagctaaaatcatacctgcttttttaagggaaacaagtcattttccctcactcggtacttgctctcaacccctgctgctggaacagggactattttggacaggggcactagcttcaccatttcagcaattctcccgagtgttcagggacccctgggatatgccttcctgggggagttggtttgtccatttgtgtgcagcccaggacaggtcctgagacccttgcaccctaggagaggacaccctactggctgtacacacctttgttctgttattgagtccctggtgacacctgggggacaaagtggtgggggttaggaagcgtcccttctagctagttctttctgtggctgggtcatgcctcactctgtgactggagaagggcacctctaatattttcccctccagacagatagggaaaccattgctttctggggacctctgagcttctgtccagaatgaccttgagaactcaagtccaatggagtaagcttgacaccttgattgtccaggagctgatcatccagcctttgaatgactaaagattcaattgttcctagtattgtcaactctgctttcttaattttctcttctcc

SEQ ID NO: 29243 - DNA, 1328 bp, Bovine  19866880903821
tttcaattacatatcaccataacagatataatagtaatggaaatatttggtgagcattaccaaaatgtgacgcagagacaagaagtgagcaaatactgctgggaaaatgatgctgatagactttctagacccagagttgccacaaatggtcaatttgttaaaaaatacagtatctttcaagtataataaaatgatgtacagtaaaatgagctatgtctgtgcatagggtaaggtccagaagactcctgagtacaggagcttacgtcatcctggagtttggggtgcactgccctgccagcatgtggatgcgttcaccagtctgaagctctctagatttatgaagagttcattatgtgagcatgattgattaaatcattggccacttgtaattgaactcaatcttcagcctctgtcccctccctaaggtggggcaggataggctgaaagttccaggcctctcatcatatggttagtttttatagagaccaaccccatcttgaagcaaactaggaagccctcaaattaaaacaatggtaatatataattttcttttattatgcagaaaatccaaggttttaaagactgataaaaaaaaactcatgttaactggaaggggtgatggtaaaattactgcttagagactgttgtgggaattctaaaaacaggtgcaacatttttggaggggagaatctagcaacctaactgtttctccctataggtaaagtgcttcttctggctgctttcaaaatttttttctttgtcttggtgtagatttcttttgggttatcacatttgggattccttcagcttcttggatctgtagatttgtgtctcttgccaaatttgtgaaccattatttcaaatttcagccatcatttatttgaatactttctcttctcctccttggactccaagtgacataagtattagatctcttgttatggtcctacaggttgctgatgccctttttttaagtctattttctgtttttcaaattagatttctatcattctaccttcaatttactgattctttcacttctctccttcattctgctgttgagcctgaacactaagatttttattttggttattgtattttcatttataaaatttcaatttggttcttctttatgtcttctatttctttcctgaggctttatatcttttctattttttgatgatgtgctctatatttcaagtgtgttcaagagtttcaagcatgttcataatacccaaggattgaacccgggtctcctgcattactggcagagtctttaccatctgagccattagggaagccctcagtaattgcctactgaagcctta

SEQ ID NO: 29244 - DNA, 990 bp, Bovine  19866881025011
cctataattgcattggaaatacttgcattgtgtgaagtaataagcctggagctgtgttccagttgccagatgatcatttcttgctactatcttagtaataagaagcaatcatttttactattctcccaaaacattatccctttaattttatctgttctttccacatgtgaagattcacatacaaaaataaaaaataggcctattatgatttttcttctctggttatcatactacatttttaaatttttctcaaagatccacattttgccttagggtattctggtatgacctttatatattttctgtgagaaatttgcttacacagacaggtccagagttctttttcttctttccctgcttggacatctttttacatcaaatctttagattcaatcaatacctgctcagggttttcattaattcattcaataaaaaaaatctactgagtaccaactatgttgtaggtataaagctaggaacaattttttagacatttaaggaaaaaaccatccttttatggagctattagttcaacatatagagtcaaacattttatcaataaatgtaggcagacggtagagttataaaggagtaaaagattacctttattttgggagctgcatcagctaactatcaaactaagtacaggcagaccttgttttattgcacttcattttattgtacttcaaagatactgcattttttacaggttgagtattcatagcaaccctgcactgtcagatgattgttagcatttttagcaacaaagcatttttaaaaataaagtatgtacattgatttttagacttaaagttatgacacacaatagactacagtatcatgtaaacataaatttttaaaatttatttttaattgggggaaaattgctttacaaaaacatagcttttatatgcacttcaaaatcacaaaatttgtgtgacttgctttgttgcaaccttaactttattgcagcgatcggaaacaaaccca

SEQ ID NO: 29245 - DNA, 957 bp, Bovine  19866881092787
atgagcagaagggagcaggagcaggaagctggccaggggatggactaatagaatccaaggacgaatgtgacatgctttgtagggactcactattgagggaagtttaaagacttggatctgcatattctttctggttcaaagtgatggaaatcacacgtactgagtggaggaatgtttggatttgatttttgaataaattaccgtgactcagtccatcctcccagggagtcattctaaataaaaatcatgcacgcagaaatgaaagtgacccttcctaacatcagcttcaagggttgaaaggaaatgcattttgtaccagtttccagcaactctggctggctgttgagttgataccactgatgaggcccttctgtagcacgaccttgggaaaatgcaagcaggaccttgggaaaattctccctttgtctgggagaaaaatgagcatgtcttccaagggagcagctgagcttggaaggagagggtgctagggactgaatgtttgtgtccctgaaattcatatgttgaaatcttaacccccagtgtgagggtgttaggaggtgaggcctttggaaggtgattagtgatgcctttgggaggtggaaccctcatgaatggtttagcgtcttttaagcttcgagtgtatgcgtgtgtgctaagttgcttcagtagtgtacgactctttgcaaccctttggactctagccctccaggctcctctgtccatggaattgtccaggcaagaatactggagtgagtagccattcccttctccaggggatcttcccaacccagggattaaaccgtggtctcccgcattgctagcagattctttaccgctcagctatcagggaagccccttttaaacttctcccaatatcaaatccttacttgggattagtgtccttataaaaagaggaggagagctaactaggcttcactctctctctccctgccatga

SEQ ID NO: 29246 - DNA, 2492 bp, Bovine  19866881151247
ctatattttattctcctttaatgaaatctatttttcccaggcattatcatttagtaagaatgaaagcctttcttcatcaattttaaggatgagagattaaattacttacataaatgttaatattgcagtgcaaacatttttttaaactaattttccttgcaaatatatgatatggcatcaatgttataagcgtaaatggcattactgggccagcccgggtacctagttgcatttataatgacattttaggagaaaaatacattatatcttaaaacaaacaggctctctttgatttctggaaatctaaattttgaaagtttaacactgtttaactcaacaaaagattctaacgggaaatacaaagttatacaattattttatgtagactaatggagaattccaacatgcatgtttgatgcacgtgactttcctttctcaccactttatgttttggtatttgttgtttatttgtttattgtctttatttgttgttctgaagttgtcatgatgagttcagctagctcacagagtgaaaaaaaaagagatgagctggaggtatgagttttgttgcatgagttttctaaatatatttattggtactccttaaattaggctcgaagctggttgtctctcaatttagagcatcttcccacttgctttagcaccatcacgatctcacttttattgtctgtataaccagatgcagctgcatttatttacattttttaaatgaatgaaactcttaacttgttgacatattggagagtctaaaaatgtcccatttaaagtcatcctcacaactacatccgcatggatggcagttgaattagccccactttgtagcagagttgattttcaagagaaatgtttacatggaaataaaggatttcgaaagccttattattggatgacacagaagaaactatttttgttgcatttcaagtttccaactgaaatttcaagtcaaggccatgagacaaaatctacaggaacaaaatgaaatgggagtacagctgcgctcccgtttcagacttcccataggctacttctccaccaactaaatcacctccttttgaacttctggctctggtgaaaaaagatcaagaattcttttttttctttttagctgtgttgggtcttagttgcaacatgtagagtctagttccctgaccaggaatcaaacctggaccccctgcattgggggtgcagagtcttagctgctggaccaccaggaatgttctagatcaggaattctgaagctataatatatacttcaacaccagcctctcagtgatccacactgtaggatttgcttagtattcattcatttgctaatatttgcagagaacccactatgtatagtcaacactatggtttttccagtagtcaggtatggagagttggaccataaacaaggctgagcaccgaagaattgatgctttagaactgtggtgttggagaagactcctgagagtcccttggactacaaagagatcaaaccagtgaatcctaaaggaaatcgatcctgaatattcatcggaaggactgatgctgaagttgaagctccaatactttggccatctgatgggaagaactgactcactggaaaagaccctgatgctgagaatgattgaaggcaggagaaggggatgacagaggatgagatggctggatggcatcaccgacttgatggacatgagtttgggagttgggagttggtgggagggagagggaagctctgggagttggtgatggatggggaagcctagcatactgcagtccatagggttgcaaagagtcggacatgactgaactaactgactaacactatgtatgaaggtggctcagtggtaaagaatctgcctgccaattcaggagatggaggagactgtgggtcccattctggggttctatccctggaggaggaaatggcaacccagtccagtgttcttgcctgggaaatcccatggatagaggagcctggcaggttacagtccacagagttgcgagagtcaaacacgacttagtgactgagcatacacacacactacatgtgaagctctaaggaatggacacagaaaggaataagattcaatggctgcccttgagaagcatacaatctggacagaaggcaactagctataatataaagcaatgtaaaaataagaactataggagaggagtaagaaaaatactatggaaagatgaagtcaggaataattgattccaattaggtggcccaagaaaggctatatggagatctagatttgaatggaagctaggaagattctacagacagtataaaaacagagattttcatgactcctctggtggtctggtagttaagattccatgctcctaaggcagggggcatgggttcaatccctgggtggggaactaagatcccacatgccttatggtgtggtcaaaagaaaaagcatagaggtttgaatggcaaattcacggaatggtgaggagtgcagtgtgacatg

SEQ ID NO: 29247 - DNA, 1555 bp, Bovine  19866881169042
accatgagaatcagttgaaaatgaattgagtccttggggaaattgttgagctgctggatcaagccctgcctgcagctcagacagataatgtcctttttttttaaaacccagaagcaaataaatccctggattgtataagccaagattttcatgtcttgatgttcaagagatgacctcaaaagtatgtatagcaagaatttggggggtggtgggggaacatggaggactgtaaaagacattgacacttgaaaggaattagagggttaaatcatgaggggctttccttgacccacactaaggtattggacttcacctgtaggcagtggggagacccacgctgaaaactgttgaggaagggaggtgacacaatacactggcttaaggaaactaactctgatggcaggacgagtgatagactgcagggaagagcgattagaagccagaaaatgtgattagtaatgagtctggaaattttatcaagtaccccccagaggtcaacactgcccggagtggggagcggtaagcaagcaaaaatactcctgtggttacccctcttatcagtaccaaaggccttccctttgccctcaaaggcatccagtatacagctgagaacccaaatcctagtactgtgataccttagcaggctatctagttgtctttagaagtttcaaataacaggaatttaaaaaaatttttaatctaaaacaaagtgcatttcaattgacttaaacgtttgaactagcaatacttttaaaaggtaggaaaaagaatacaccccagaacaacaagccaaaacaaaatgtctccattccccaagtgtgtgaatcactgataaatcatggtgctgccagctcccttcttgatgggagcatacaccacagcttgggttcccagcccccttggcagctgtcggtttgctagggctttctagaacctgtgcacagaaggggcctccagcactcatgtggctccatcctttatatccacgagaagatagaaatctctcctggagagatgtaagcatcttcattttctcacactgcacgtagacagcccttgctccctgctgcccctgggctgccccaccgttccagcagtgccttgggctgacaacgccaggggagtgatggaccaaaccccccactcttgccgccctgcctcgtagcttcctcgccagtgccctaacagcacttgataacctggctgctcccatctggcctcctcggtcttccccacaggcagactgccacctgcattccacagcaactgtttgatttacataattccaatagcactcattgccagcttcctgtttttgtaaactcctggacaattttttcgtttcataagaaacaaaagcctggactcacaatcaaccttctaccaacccagtccctccgcatcaaaggagacagggaagcttctctctgatggcttcccttcttattttagaaacagaagcttaaaaagcaccccgtggtttccaatccagagtttcatacaagcttttgacttcactggttactggcttcctgttaacagaaagaagtttcaa

SEQ ID NO: 29248 - DNA, 2467 bp, Bovine  19866881228615
tatagaaaggtgaagaaaggggaataaggctttcagagagtaggtagggttttttaattaattcaaattatgaaataaaagttattaaaattcagaatattaaacatccaatcaaatatacatgagcttcgctgatggctcagagggtaaagaatctgcttacaatgaaggaaacctggattccatccctggatcaggaggatcccctgaagggaatatctacctactctagtattcttgcctagagaatcccatggacaaaggagcctggcagtctagtccatggggtcacaaagagttggacatgactgagcgattaacataacacacaaatatatacacaaacacaaaaatattgagtataaaaagttggagattaaaaatataattaagttaaaagaatcaagaagactgatactagaatggaaaagagatgataaatataagatcaaagaaatgcaacaacaacttattttgaagttttagaaataaaaaacaatacaatattgtaaagttaaaaaataaaattaaaaaaaattagaaatcaaaaaaatatatatatatattaaatacctgatttaattccatcttaataaaactactggtgtttggtttaaattttttttttaattaattaattttaattggaggttttaattaaaaaaaaaaaaaaagaagagcagaataaagagaggggaaagaattatcaagaaataataaaactgaattccccagcacatgagagacatacattttgagattaaaattattaaaactgacaaatgagggaaaatcttaaaaaatgatatatcttaacctactttcataagatctcatagaaacaaaagaaagtataaaatttccagaaaataaaagataatctatgatatattaagaatcagaaactgactggcattgtaaaaacccgtttttagtagataatactttcaaagtttgtgggaaaactattttgactataaaccctataccaaacaacaagtgcccaaatatttctccaacaaaatgactcacaggatacatatggggatgtgctagaaaaaagaaaggtgaaaacgaagagagagaaagatttggactataagaaaaaataaaaataactttaaagtgctataaaattagctgcaagctgctggccagaagtgttctaactcagcgaaggaaattgtgagatgtaagttgaatgtcttctaaaaaaattaaaaaatggaggacattaataagaaccaataaaatgatagtcatatgtcaattgatacttgaaaaaagaatatttttttttctgttccaagaaataaaagcaaagagaaaatctgaagaatacttaaggtcatctaagtttcaaatagaatgtaaaataaaatgtatcatgatcttaaacaattgatgagttcagaaaataaaataatttatctgaatatgaatccagaaatagtttttattaaatagctgagaagtagtggacattggaactacagggaagaaaaggaaaactaaaatacaaatggtccttgatttataatggtttgacttacaatttttcagttttatgctagtgttagtgcagaggtgatatgcattcagtagaatctggagttcacattttgaattgtgattttttccctgcagtatggggtatgacactctcttgtgatgctgggcagcagtagctgcatcttctagtcggccacacaatcatgagagtaaacaaccaatatacctacaaccattctgactcaataaagctacagtagactggttttcactttcagtacagtattcaataaattacatgagatattcaacagtttgttattaaaatagtctttttgttacataattttgcccaactgaaggctaatataaatgttctgagcacatttaaagtaagctacactaagttctgatgttgagtaggttaggtgcattaaatacattttcaacttatgttatttttaacttaatgatagatttatcaggatgcaatcccactgtaagctgaggaagacttatagttaaaatactactactggcttttagagtttcaaatcaattgatagaaaactttcacataccttaattgtgtttactggaccaaaaataagattatcaaaattatcacaatcaacaagttaaaaggaaaaaccatagttgaagaaaggagttggagggtgttggagaaattgggagagaatataaactttcttttgtacgtcctataatgtagaaatactttataaatttgatgaaattataaatgatttaagattcagaataattctcttattggaagtttagtgaactgcaagcacacacacacacacattaccaaacattaggacatgaacaataatgcaaaacattaggacaataatgtttccaatgcaaacattggaaaggaaatagcaaatatcaaacaaacaggaatcttaagagttgcaaaatacaa

SEQ ID NO: 29249 - DNA, 1197 bp, Bovine  19866881395787
cttctgagtttattctcctcactgccagcctctctcagagattggcaggaagttgctcactctaagtcctaattcaagggaggaagtggctgttgattggtcaacatgggtcaggtgtccactccaggtccaatcaactctttcgttcatctactttttggagaattggaccctctcctcagaaaaatgcacacatatgcaatttttacacataatttcaaaggattcacagaactgaggcataaccatgagccataaaccccagggaaagaatccttggtcagcgcagttaacaaaactcactgtttacctcttttatatgtgaaagaaatgagtcactaatataatttgcataaggtaaacatccatattccagaggcacatcttataaccagatcgtaacaaaatgctgcttggatacaagcacagcaacagcacttatattttactattttctaactgactatggcaaccacatgtctttacaaaccattcccatacgtgccgcttggcagaacacccacctggagctccagtgaataacatttccatgtgactggctgtgttacttctcctgcccctacacttatacacacccacgctgtctttttaaggtgcgtataaattctaatctcctttcttttcctgttttccacctgggttctgtgagatactgaatcttgcttcatataagcatatgagccaagcttttccatctgtttcatttgtctttcccaccatactgctccaagttgcaagcttctatcagaatttgagttgcaaaaacaaataaacaaacaaagaaactataactccaaaactgattggagagaaggaaagtattagcttattacataaatattaggtcatgtaactgaaaaatccaaagtagaactgacattgggtacacctatacctagggactaaagaaggtcattcagatcaagcccatacatctcttttctcatctcccaggtctactttcctctttgttggcttcacctcaaacaggacctatccacaatgaacccctggtttatactctccttttagctagcattctaggagaagaagagcttcttcatcccaatagtttcaatagagcctcaaaactgagtctccttgggggaaatttgaatcatgtgcagattcctggacccatcactgtggctaaggagatgggcaggtactcattgg

SEQ ID NO: 29250 - DNA, 1116 bp, Bovine  19866881548675
tccctttctctgtgagcttataacactgatgaacggcccttctgctttttctaccatttgcactgcaattatttacccatatgtgtctctctggaggctgtgacttgcccaaaggcaggactgttcttatttattacttggcactgttctagggtacgctctctctgcctgtttatgttatgaccatgatttagcttttattaatttaataaaataaaaactaccaaagcaaaaacattttaacattcagcaatgtctgattgtgtgttaaacactgaaatctgcttttattcatgtgttgaaagaggacttgcaaagacatttcaacatctttgttttttgaccttaagttatggctttttttttttttttttttgctgcaaatcttataaaatactttgtttcctaagcaccttgaagtttaatccttgtaaagaaccatccgtctgaaaatgtcagacataatttattaattccttgtttttcgggtatagatagttaaagctctgcatgtctcgttgggaactgaattgcaaatgtgatggagatatggaaatagacaaatttctttcaaggcagagttaaagggagcgttttggaatcacttgcaactccagtaagcgagtgaatgctttgggaggtctggtacacagtatactttcagttctcacagacttcagctgttccttctgcctgaaagctctcctccagatgtccgtctggctagttctcttacttctttcaagctgaaggggagtatgtcaccccaaattatgcttcattggcataaggattatcctgagctggcaattttaaagaaacagcagatacggaaaaagctctgaaaactgaatagaagtcacatgtataggggaaacattcactggtaagtgtgtccatctctgtagctagaagaggaggattactaaatctctagcaatccttgtcagtgaagaaggcagtgacttaagtctacagaacaaccatacccttgattactgtgctttgcctgataaccgagttttcccataacagtcccgtcaccttcttttgtctttagctataagtggtatttaaggtgatggcttgggctgtttcagagagttactcagtttt

SEQ ID NO: 29251 - DNA, 863 bp, Bovine  19866881585394
aacctagacggaagaagggaaattttttccctctcaacataatctgatatttgctgtaatccacctttcaccctttaaaaccttccttcttctgttttttttttttttttttttaccttcctcttctctcagaaagtatcagtaaccattttgtcagacctactttgagggaaagatgaaatttctcaaactggctgcagaattaacaagtactttccccaacagttattaccttgatgttgggactattattgacagtcaatggcagctaagactatcctaattgttagtgaaagaaattaatttcatgaagatgtttccctccaagttgttgttcagttgctaagttgcatcaaactcttcacaaccccatgaactacagtgtgccagcagagcgatatcccacacaagtaagtatattagttattttcccctgaatagatggcaaatgacagtgttcatcataattgttcattgaatatgatttctaattacacagccatgagcagggctccagttttcattccaattatgttgttccagaggaatttttccatgtttctctcacctagatatgaattctctgcctcagtctctctacctactatagaaaattggctggaccaacctttgttctcactatggaatccaaaaaaagtgaacttgtatataatcctattgttatttataactcacatttcatctccaaggaaggaagtccctcctcctctttaaaaaaaaaaaaaaagggttttgatctatgtggacatcttgaaccataaaactttttgttgcaatcatgaagccaggccatgttgttttattagctggataaatgcagccgtcacatctggtcaggccag

SEQ ID NO: 29252 - DNA, 930 bp, Bovine  19866882177289
tttttaaagctaggagtcgtgattgtatttatctctacatagtattccttggtgtgtctcaccgtacatcagagtcagcctttctcccttgaatgctcacctgagctaatgccaaagcgccttctcttcgtgtggagtggacagctgagggcctggaggctgagaagaagatagtgttcactcagggcacattcatgtggctaaaatttttgaaatgtaagttggttcttccttcatatctcaattgagtattatacaagacccctaaactgtgcccaattactgtttagctggaataattaattccatatttgaatggaattcccttcaggctccaaatagatgccttattatgctaaggtagcttaaacttgtagctctagtcctgaagagcatttgagaggggaagggggcttttgctccttaatcatgttaattatgaaaaatgatcacaatcagagacttttaccttggtgagacggttgtgcaggtgggtttttgtcagaatctgcttaggaagaaatagcaagagaaagtgagtgaatcagtgatcttaaaccaaaaacattcccttgttgacaagattattttccaaagtgatgacgccatattcacacttggaatctagcgctggattgaaagcgttcacctatgaaatatttatctccagagcttgcccaatcattgtcgtgacagtgtacacgtgtgatgacagaagggtcaccatgttattctgcatgatgccaagaactttgtgcaccagtgctgaatccaatcttgaagacagagttttgggtggagtagaacaatagcttttgctaggcaaagggagatgcaacagtgtccctgaaaaactgtgtcccaatctaggagaatctggtgaggagttttatagcagggttcaagggtgggtttgcaaataaggattag

SEQ ID NO: 29253 - DNA, 1890 bp, Bovine  19866880448493
cccatgtaatgtgctcagagcaattcatggcattggctagatccctcaaacccagtccatttatttcccacttcccttgagcttttattatagcatcatgtttggagagaattaagatgaggtgagattgctgtcttgaggaaccaaggggcagtatttctccagcagtcacctctgaaggagagtcaacctgggaagcagcacatgaaacacatactaagtgacacagcctctggagtcatttacttcttttgtgtccgtggcgtgggctggggttgctgatacggtttcctctgtgtggctccctccttaggtgggaccacagccttctgtcgatacctgttggacagctcccagtactgtcagaaccatggagggtggggattaagcagctccagccacatggtagtagggaaaagagcattggctgtggggtcgctcaggcctgggctggctcctctgtgacgtcctgtactagctctttagccttggaaagccatctctcattgagcctcagtttcctcacctacaaatggaggataacaatatctactgtctcccagatgactcaggttaaaagaaaaggaaaatcccgaattgcttagtaataccagagacattgtatcacataactgaaaaaaaaaaaaaaaatccagagataggacttcaggcatagtttgatcaggggtctgactctactcttctgccataatcttagctctagtgctgtccttattctgtgtgttggctttatctttagactggcttctttcacatagcaaaattcctgtatgttgctcgtttcccataatcagaaagtcttagcttgggtcagactatctttggtaacatgaccactgctggaccaaccactgtggcactgggagcatcttcagtccactttgaagatggattaagtactcctcaaatcacctgctagccagggagagatgaaataatgttgggaagacaactgccacgctaaccagagtggaattttgagcactaaggagctgctgagatactactatgccagttttagagaatgattctgtgctgggcaggcagtatctcatttactcctcacacccacccagcatcatgacatgaccagcatccttggaccagcttctcttccaaacacttctgactgctctgcgtctcagatttcccatcactgtcgtcctcctaccaaccgtgacactatcaatgatttaaatggtggctgaataatgaccccctaaaatattcacgttctaatcccagaacctggggatgttcacttacacagcaaagggactctgcagatgggataaaggttgaagatcttgaaatggggggattatcctggattatctgagtggaccctaaatgtaaacacaatggtcctcatatgatggatgcagaggtagacttaaccatggaggaagagactgtgacgatgtgagcagtgattggattgatgtgctttgtatgaaaggaaggggccacagccaagaaacactggcccaactggaggctgaaaagacaaggaaaccaattctcccctcagagcctctggaagaaacaagccttgctgatgtctttaactttagctcagtgaaaatgatttcatacttctgaattccaggactgtaaagataataaagttttgttgtttcaagccactaagtgtgtggtaacttgtcacagtggccataggatgttaatgcaaaatataattacatgagctgtcgggtatggagccaggcactcatctaagtagtattacttcatttaattctcacaatcctggcaggtggtgagtattattatcattcccattttatagctgggaaaactcaaccaaaatgacattatagactttgctaaaacattctactcagaagt

SEQ ID NO: 29254 - DNA, 2541 bp, Bovine  19866880633728
gggagacctggcattcggtccttgggtcggggagatcccctagtgaaggaaatgacaacccacttcagtactcttacctagaaaattccatggaaggaggagcctggtgggctacagtccatggggttgcaaagaatctgacacaaccaagtgacttcactttctttatttagaccttgaactttggggttaaacagtctggattccctctttacaatctgtgaggtcctgcttgtgttactcaataatctttcagtttcattatctgcaaaatggggatatgataaatacaatcttcttaaaagtgttgtcatgataattaaatgagatcatccacaataagcacttagcatattgcctacttattattattcaatttgttatcctagattttggcccttttctgaactgaccctttcctgaatcaaccaaatccctgcacattgaaaaataatagtacagttgtccctttctactgcagggcattggtttcaggaccatagataccaagatcatacaacgatgtagtatttgcacataatctacacacatcctctcatagacttcaaatcatctctaatttacttaaaattcaaatgctatgttaatagttgcagatacagttgtaaatactatgtaaataatcaccagtgagtagcaaattcaagttttgctttggggaactttctggaggtttttttttttttttcacaagtatttttgatttgtggttggttgaatctgctgatgtggaacacctggatataaaggggtacctataatcaaaattctaagctctcaaaggaagcatttgtaatttgttccaagtattatggcctttttaatgggtattaatcccatccacagttagctcagttactgtcttcaggacatttcccgtccaaagacagtggtgtagtggagcaaaaactccactaggagccaggatgtggcttgttgtcagaactttgccaccaaccacctgattgactttgactagttctttcccacgtctgattctcaagttcttcatttttaacatatgcaatggccaagtcctcttatagattaaggactcagtgaattataggacaccttttccaaaggtccccagagaagggagaattctatccctttggcgaaagatcttataggaggcaaaggaaggcataaagacaaaagtctttttctaagacaaaagatcacataggagattgtaattccccttagaagaatcctttctaacatgatggacccatcagtcagcaacattttggggcactctactgagtacaaggtacaattttgtacagaaaaatggacgacaacattctagaaagcaacacttggaaaatgtaacaaatgcattaagtcccttatataggagcatttgtgttgagaactttcaaagatgcaaatgtgtgttcttcagtgtcaggtgggagtgaacttgcagcttgccctctgtctcctactcctgatgacctttcagctccaccatgtcccacctcctctctgtcctccagtcagtaactcttcttgtctgttcactcgatgccagcccctgtatgccagctgttgtacttttcaaggtactgaagattgaaaattctttattttctgtgtgtgtgttttttacatgctatttttgtgaaaagtactaagcttattacagtataacactatatagccaatcatgttagttacctaggttaactttgttggacttatgaacaaactggacttaggcgctcttggaaaggaactcatttgtatataggggacttactgtatagcaataaaatatgtataattcattgattatagtaaataattatataaggttaccatgtgctacatgcatgactctaagcactttacatatatcaactcatttcatcctcccggcaacccacacaagatagcttttattattgtcccctttttctgggtgaggaaactgtgatgtgcaaaacttggtaaatttgtccaaggttacgttgcttataagtggtgaagctggaattcaaatcctggtggtctagctctaaattacgccatgctcaccactaagacataaaagagtaagtggggccaagtgaggacagagaggaggcaagataaagagtctaactatggcaggaaggagaatacgtgtaacttaatatagctgtgaaccagagcgttcagatcttcacaagtcaagaggaagtgaaatgaatcaccagtctcagcaccctctcattctaagccaattaaaggatgttctttccacagttctgtctcctttgcatttccaaagtaacaatgcactccattatgaaaccaatattttatatttaattggtatcatcttcacagatcttataagtttcttcctttctgtgacctgtcctaagcactggagttcaaacatgaaaagatagaagttattattaaattctagcataacaaaatacagtaaaatggaacagctttgcaaaacctatgaattatattaattctcccatttgacagataagaaaactgaggttaaaggga

SEQ ID NO: 29255 - DNA, 1496 bp, Bovine  19866880657632
tctccactatcacaattgttgttcaactactcagttgtatctgactctctgagactccatggactgcagcatgccaggcttccctgacctccaccatctcccagaacttgctcaaactcacgtccattgagttggtgatgccatccaaccatttcatcctccgtcgcccctcttctcttgccttcaatatttcccagcaacaaagtcttttctaatgggtcaactcttcacattaggtggccaaagaattggaacttcagcttcagcatcagttcttccaatgaatattcaggactgatttcctttaggatggactggttggatctccttgcagtccaagggattctcaagagtcttctgcaacaccaaagctcagaagcatcaattctttagtgctcagccttctttatggaccaactcttacatcaatacctggctactggaaaaaacgtagctttgactagacggatctttgtcagcaaagtaatgtctctgccttttaatatgctgcctaggttaggcatagcttttcatccaagcagaaaatgtcttttaatttcatgactgcagtccccatctgcagtgatttagagcccaagaaaatgaaatcagtcaattatttcactatttccccatctatttgccatgaagtgatgggactgaatgccatggtcttagttttttgaatgttgagttttaagccagcttttttgctcttctcttttcaccttcaccaagaggctctttagttcctctttgctttctgccattatgggggattatatacaagaaaaattattattgttgtttttaaaatctcattatcaagtctatataaccaagttggtttgaaatcagtcaacaaagaataattagatcttgtgcaactggtcgttagaaagaattcagacatttatcgttctttgaattaactgctttgtggctaactcttattttcaagttggtatgtgtgggtctctctgatggtgccctgttcttaggcactgctctagaaaactgtcagtaacacgagttttctatcattttatcaagagtggagattccacatgatttttcagggacatgttcacctcgaggtatggagcaggttgtcagcaaacaggcagaggactcagcaccagtgagtagaaaaaacattgccctctgacagcgatgaatgtgcagtttctgagctgcattggtgcctgcaccatgcagttcactaactgcaggtcattcccactctccaaatcacagccatgacagcgagcagcgagttcagtctaaaacctagaccacaccaaggagtaggcaagagaataaaaatcatgttaccagggactggactcccataccaacagtaagtttgactaattttatgatttcattgacccaagtaagtcttctcttagtattagggacatagagcatgagaactcttccagaaaagaaagaagttttatgaaggaagttctcatgcttccttcataaaatca

SEQ ID NO: 29256 - DNA, 2803 bp, Bovine  19866880686697
tgggatcttcccccggatcaggaaatcgaaccctgtagctcctgcattggcaggtggattctttaccattgagccaccaagggaagccctgtccatagatttcaagtgacataaagtgaattctttctttttacggctcaagttggcttgagttaggactgtatcacttgtaattgaaagagtacccgttaattcacccagatccataacatatctgaagcatctcttttatgtcccttcatgtcaacatgtgtgattctctcttcatgttatgatcctactctcatctttaaatttgttgccaggatgccctaacttggctactttgtgaacttgtgtttttagaataactgcaaccctggtcatagtatcttgctctgggtcgtgggaaaccagggtgaggactggaagtatgcttagggtggtctgtgagctactgagggtagagttaagataatgctgaaaaccagcatctgggctcttaagtagggtcgtatcaaaccaataaaagtgggaaattatcagacccaaggcaataagtagcccagacactggagcatagacagagagataaagacagttgatctaggatggtcagtctgaggatggagcctgagggctggggtctgtttagtgaacagaaaatagtgactcactaacattctcaggggatttctcaggagataagagacagagtggagtgaaaactaagcgtcaatttgggtagggctttgaacaccagactgaagggtttagaatttatagtaaaacaaatggaaattcaagactacaattttggaggcaatgtacatgaaattggacatagacaagtaaatccgtcaggaggatcccactctgactttgagcctgggtgatgagaagaacactgctatcgtgcctggaagtaagggactcccacgtgggaagctggttttgcagacaaaggaaggaaatgttgagctggattttagatgagtggaatttcacatgccaatgggtgaaaataatgtggaacactctgacttgagatccagagaaagagctgagctggagtcattcccttgaaatgctgggggtcattggaggtcattgcaaagacaaagtgaagctgtaagtgtgaccgacttttcttagggaaaagcgccaagaaaatcgacctgtcggattcctttacttgttttatggaggagattggtaatccatctaacagacagcacataaacttaaaaatatatatacggtgatttaggaggaaacagagaagcctagaggaggatctaatcagctcatggaatgattcccttagagggaggtattcagagctgtgttccagctccttgtgacagggaagaggctcttctccaaaagaccacacacaaacttggactttagaaacaattgtggaaaaaaatatgaggcaactaccacacagcaaacatcagtcacagttttatcttttatttgcaactttgtggcagaaagccttcctgcaggaactcatggctgacagaatatattaatgttctgttcgcaaggaatgtgtggatcgcttactgatgtcaagaaaagaaatggaacggggcaaaagaaaggaatgtcagggattatttatcattaacctttccctcttctttgtccctgtactccatcggttattaatctctgacaatgtcgtcgctctagcgtctcgtcaacacataattaggaaagtactacggaccaaagtataccaggccatcataagagagaggataagaaattgtttctaccttctggtttctcagagacaagcgacagataaaacacaacgagcttgctggcgcccacaagcaaccagtgccgtggtaaaggtagtgatggagagttactttcagtctcggctgacagaggtttccctggtggctcagcgggtaaagaatctgccttcagtgcaggagaccagggctcagtccctgggctgggaagaccctctggagaaaggaatgggaacctactccagtattcttgagtggagagttgcgtgggcagtaacggcctggagggctacagtccacggggtcccaaagagttggatgaaagagtcggacactactgagcgactaacactttcacttctggtcttggttgacagaagtcttttctgacttcccccaggaagtgatatttcctatgatttgtcatatgacataaaatatgagtagggattttccggtcaaagacacatgggagaagggcattccaggtagaaaagtaacattacatggtcttactttattaacccattcagcttaccaaaacttatgaaaatcctagacatgatgccaggaactaacgatacagaaataaaagaaatgtacacaaagcagccagttagtattataatccattctctatgctcccaagatactgatcttacacatttctcttcatctctcttagattccagtttctactgacacttgaaaaaatatgggttattctaggttctgcaagggcaaaatggagcccctttataacccaagcagaccgtatcacaatggaatcattgttcggtgggctttttccttcatgttttggaaacctcagtgttttctgtctagggaattaatgatctctctttcccaaacagctggggcaagctgggatacttgtgttaactttggatacccagagcaatcagaagtcctcccgctcagctgcctccagagatgttctgatttcagtgctgtcacatataatcctgcctgggtcatgatgaagcggggtttaaagacaacataagccctctgccccgtgcggcaga

SEQ ID NO: 29257 - DNA, 1343 bp, Bovine  19866880809627
gcgggtgcccagcctttgaggaaccgagtggctggaaagaaagaattacggccaagatgaaatgacctcttcttcgctcaaaatagatttctggccaggaggcattcttccatgatcccttaacagctttcaggaaaatagataattgaggccataaagcacactgcattctgatacatgatgtaacttataaaggaaaggtccatctttctgatcctgccagccaagaaggaaagagaatgatgcttcctgaatgaggacaggctagatcacagaatgcttcccacacatagtgacctgcatgtgtttgtaaccacgctgaggccttgtccagtgtctggcatgtaggtagaattagagaaatacctgcaaagtcaacagaaacatgtattgagtacttacttggtaccaggcattgtgctcagcatggggacccagagataaagagaacacacgtgtgacccctcagaactcactgttgagtggaaaaaaaagatgaggaactaaacaactgtcacttcatgaccatggtatgaaaataagtcccgggatcaaagctcaggtagtgatgaaacctgctgggggctatcatgggaaaatctacacaggagatggcgtgtgaacttggtcttgaactatgaaggactgtaccactttacagataaagaaactaaggctcagattaaaaaacttgctgaagtcacagagtcgttcaactcagaagctcccatccttggcttgtgcacagaacctggtctcttaagcaggggtaacaggtgtctgctttgcagggctgaagacaagcttcattcattcctagattaacttctaagacaatttgatgatgcctgtagtgtgttccgcctggaccagcccacagcagctcctcattatgcgatgttcttaagaaaagttgaaagtgttagttgctcagtcatgtccaattctttgtgaccccctggactgtagcctgccaggctcctctgtccatggaattctccaggcaagaatactggagtgggtttccattgtcttctcgaggggatcgtcacgatccagtgattgaacccagctctcatgcattgcaggcacattctttactgtctgcacactggggaagccctatgaaaagttgctccggtttaatctgaccccagccactgtctgagttggggaggcctcatggtgtccggctccccagcctctgccccaccaggacactcactctcccctcacatcctgactgcctttctgtggtcattccaagtcaaaagaaaatgacagtcggccctcacgtcggggctatgacagctggggctggatcttttttcatctctgtttct

SEQ ID NO: 29258 - DNA, 1581 bp, Bovine  19866881007232
tcccttggactgcaaggagattaaaccagtcaatcctagagaaaatcaacccctggatattcattggaaggactgatgctgaagctgaagctctaatactttggccacctgatgtgaagagctgactcactggaaaagaccctgatgctgggcaagattgagggcaagaggagaagggggtggcagaagatgagatggctggatggcatcactgactcaataggcatgaatctgaacaaactctgggagacagtgaaggacagggacacctggcgtgctgaagctcatggggtctcaaagagttgggcacgaccgagcagctggtctgagcatggtgtctgttcatgagcacatggcgtgagaggacaaggatttacagtctgtatcggtctgtggcctccagcaaggcgcccaccccatccgactggatgtgccactaggtttaaagttacatctccgtcacacatcatggctctaaacacaagccaactgcttcctctggcctcgaccattccagagtaaaacttgcctatgttggcttatggaggtaggatacatccatttgctgacttcttttggcatttaacagattttttttttttttacagcctgacttgtgactacgttgtttgctttaaaaccaaacctcagtgtaagctgtgattccaaagtagagtaggtttcatccaagtagtatatgttgcattgtgacacgtgtagcagaaaatacggaagttagcaaaacaagtagagatgggaaaagccacagtctggatgcccacaactcctggagctggcaggtgaataataaatgtttctttgaatgaaaaaaagaatgaatgactcatctgctgctgacagtcaggaaagactcaggtgtcctttctgaaaagactgttgatgcaaaaggcacagggcatttttgcagcactgtgttggaaatgaagtctataaatattcacaggcaggcaaatcagatatgttttgaagacccaagtggacactgattcaattctcttctctctccatctagggcctgtcaggcatcgcatctcaagtgctttatggatgtggctaggaggaggcaaagggtcagctggggaatgcgagactcaaatgaattgctcccttgctggatggaccctcctggtcaggtcactggcaggtcactgatgaaatgtccctctttgtcacattctccgttcctgacacacaggacacggaagagctgggaatcgctttagctacctttagtagtgctttctctcaggacttccctcgtggtccaatggttaagaatctgccttgcaattcaggaggtgaaggttcaatccctggtcagggaactaagataccacaccctgaacaactagagtctgtgctcccacataatgcaactaagacctgaggcaggccagatgaaaaaaaaggggttcttcttccagaattagcttcaaaaatttaaaaaatggaggtgatggtatgagcctggggggttttgcttagcttggagatagatgcatgtgcgggagtctggcctggggacaatattaaacattctccagtagcgtcgtgtcagac

SEQ ID NO: 29259 - DNA, 957 bp, Bovine  19866881058165
ccctcccacccctttcactgcttcctcgttgctaatttcctcatgtttggcccagtgccagggggacaggacctttccaggtcaggatagtataccaatggtatggacagtcatagtatgaactttggactctgacccgggttggaatccaccctttgccttttttctaactgggttacctcgggtaagtcacttaacttcactgagcctccgattactgaaatgtgaagtgaggtggtcatactgccctcataggtttgatttggaaaccaaatgtttagaccgggctgacacattgtaaatgcttgaataaatgataaccatgattgtctttactacaacaagagacatcagagaggggagggttttaattgatggagtgtgtgctgtgcgttatctatacctacttaaaaagcctccaaactttatttccatccttatcacctagtgattttttttctttgcagcatttcagaaactgctgtctgcagaggaaaaggttagcagctatggcagaatcccttctggtgaaatctgaaactccgtaaacgctacagaatttggtattttgctcttaacctgagactcaggacactgtgggggtttgttaaaaagtctggagaggtattaggaagtttgagaaaaccaaagtaaatctccatgcagtcgggcctggactaggtgggccagtgggagtgattcattgtggtttcccacggaaatgccacatttggggtttttctacctggaggatgcaacttggtggttttgctgtaactgtttcaaattcctttgaaacccaatctgactttgaagagggaacaacataccccgtgagtgaaaaccaaacttgaaatgagtctgccaggggactggaagttggatatcagctcctggaaccctcaagtaaggaccagacatcaattttagacccattttgtctcttatctgcaactc

SEQ ID NO: 29260 - DNA, 1756 bp, Bovine  19866881105198
tctctgtagatgaagaatatagaaagggcttttccttgtgtgatcacacttcagtttcaagcttccttatgaaagatctaggaagtcataggtcctgatggttctgagttcatttatgagtatgtctttcaagagaatgcagggccagcatccacagacaatgaacaaaatggaacacaaatttttcctgctctacttccttggaagggaacccaagttccaatctaatcaaatcaagtaggaaattttcatttttaaaacaatttttaaaattatttgaaggtggtggtccctcttattctgttgcatttaataaaatccactgtatcttttattttcttccctgttattcattcacccatttaggccttaggaaaagggttctttattttgctttgtgatgagaatccataaatcaatcatgaaaatgcagcagtgccagtgtattagactgattcatgaagtgttttaaggtccattttttgcccagattatgcttcactttcattctaataaagatttcagttcagttcagttcagtcgctcagtcgtgtccgactctttgcgaccccgtgaatcgcagcatgccaggcctccctgcccatcaccatctcccagagttcactcaaactcacgtccatcaagttggtgatgccatctcatcctctgtcgtccccttctcctcctgcccccaatccctcccagcatcagagtctttttccaatgagtcaactcttcgcatgaggtgaccaaagtactggagtttcagcttcagcatcactccttccaaaagaaatcccagggctgatctcctttaaaatggactggttggatctccttgaagtccaagggactctcaagagtcttctccaacaccacagttcaaaagcatcaattctttggtgctcagctttcttcacggtccaactctcacatccatacatgactactggaaaaaccatagccttgactagatggacctttgctggcaaagtaatgtaaagtaatgctcaaaattctccaagccaggcttcagcagtatgtgaactgtgccctttcagatgttcaagctggttttagaaaagccagagaaaccagagatcaaattgccaatgtctgctggatcattgaaaaagcaagagagttccagaaaaacatctatttctgctttactgactatgccaaaacctttgactgtgtggatcacaataaactggaaaattctgaaagagatggaaatatcagaccacctgacctgcttctttagaaacctgtatgcaggtcaggaagcaacagttagaactggacatggatcaacagactgattccaaataggaaaaggagtgtgtcaacgctgtatgttgtcaccctacttatttgacttatatgcagagtacatcatgagaaacgctggactggaagaagcacaagctggaatcaagattgcagggagaaatatcaataacctcagataggcagatgacactaccctatggcagaaattgaaaaccagagacattacattgtcaataaaggtccatctagtcaaggctatggtttttccagtagtcatgtatggatgtgaaattggaccattaagaaagttgagcactgaagaatagatgcttttgaactatagtgttggataagactcttgagagtgccttggaccacaaggagatccaaccagtccatcctaaaggagatcagtcctgggtgttcatggaaggactgacgtttaagctaaaccccagta

SEQ ID NO: 29261 - DNA, 2712 bp, Bovine  19866881136594
tccagtactttgtcttcacgggggtgctggccatggtgacctgtgcggttttcctccgactcaactctgtccttaagctggctgtgctcctgatcatgattgccatctacgccctgctgaccgagaccatctatgcaggcctcttcctgcgctacgacaacctgaaccacagcggagagtaagtgcccaccactgtgctcaaaaagagctccacttctagtgggaaatgaaaccattgggaaaacgattaaggtagagttattgaaacttagagactgattgaaaattgacatatttctcatgcactttctggatgacaagtttaggcaaagttcctagttatccattttatcatgtgtattcactacagattaattcatggattaaagtttggactagaccatagctcaggtctccccacatgtaataatttacaattccttcaactgtaatagctccgagatttgtaaggtctggttgtcatttcgctgtagcactatcagtaatagcagaccctgtgcattgagaagttgctaaactccttacattgtgtaattttgaaatatggaaaaatacaacaacaacaaaaatcttagcctagatttcttagagaacagagcctgaggcaagcatgaagtgctaatccaaacccaggacggcaaaagtgaggggaaaggaagtgaaaaaggaaaggatggaaggcaaatacaagccatattatgctgctcagatgaatcgtgaagctggggctttggaggatgtctcgaagtatctctgggtaggcgacaaggtagggaaagtctctcaggagggatggaatctgttggttccttccctctcatttctcccattagtctcagtctatactctggatgtactgcctggtgatgtacctcagccatttctacagcctttggggaaaccagaccccacacctgccttagggagctccacgggaagctggaagtgatagaaggagccagacaccgagcagaaggctgattggcctcgagaggtgggaagaacagaggtctctctgagaccagaacacgtggccaacagtctgagaaatagaggaggaaaagacagtccaagaagtctcagaaaatgtgcctgagactaataatgggaacatttatgattcaacagctggaaataaacaatgtacacaattagtcatgtttccttctgcattttaaaaaggataaagtatttcagatattgttgaagttcccttccccagcattgttcttttatcctcctcccaagagtcaacttctaatgcatttaatgtatatccttcccatccatgtgttttatattgggtaggccaaaaagttagttctgatttttccatgaactgaaaaaatcagaacgaactttttggctaacccagtgtgtgtgtgtgtgtgtatacatatatatatgtatatttctttttaacccagtatatatttagttgtgtctgtattttaaattgtttataaaattcttatgctatcatgtaatattgtagtttttagacacatctaggttcatatctacagattcaactcattttagatagaacataccaagatatatttatcctttaacctataaaaacattattgatacttcagtgatcaccattgaaaatatctctttgggctcatatctcaaagcacacttactggaatagatggtatctgcattttcaactttttaagatcttgccaaatggctctccaacaagtttggaacagtttctctcttacaagcagtggtctctgtaattcttattcagttccttagtgagaattttatctcattgttttcattagtagttccttcatcatgaataagtttgtgcagtttgttgttgtttattggccattttcggtaaacttccaggtcatgtctcttgcctggttttctattaggtgtttttgcctttttctcactagatttgtaaaggttctttataaattctaggtactaatttgtgcctgttatgcgaatgcaacatccgctttatatccattaccttatttaaccctcatggcaacagtctgaggaacacaggcttcagatcagatcagatcagtcgctcagtcgtgtccgactctttgtgaccccatgaatcgcaggacgccaggcctccctgtccatcaccaactcccagagttcacccagactcatgtccatcgagtcagtgatgccatccagccatctcatcctctgtcgtccccttctcctcctgcccccaatccctcccagcatcagtcttttccaatgagtcaactcttcccatgaggtggccaaagtactggagtttcagctttagcatcattccttccaaagaaatcccagggctgatctccttcagaatggactggttggatctccttgcagtccaagggactctcaagagtcttctccaacaccacagttcaaaagcatcaattcttcagcgctcagccttcttcatagtccaactctcacatccatacatgaccacaggaaaaaccatagccttgactagacgaacctttgttggcaaagtaatgtctctgcttttgaatatgctatctaggttggtcataactttccttccaaggagtaagtgtcttttaacacaggcttagagaggttcaataattacctggatgcacacagtcagtaggtggtagatccagattcaaactcaggtctttcggctcaaaagcccat

SEQ ID NO: 29262 - DNA, 670 bp, Bovine  19866881341777
ctcctggcgctgacagcccaccactctcgcaccttcagcgacatgaccacagtgaggtccctgccggagggtgtggtcgagtccagagcattccattacctgcttttcaggtgacaggcctgacacggccatgtaggtactaccaatggtcttaatcttttcaatgtcttgaaaccggtcttcaccgagcagctgaaacagacccagacaacaatgtcagtcctggtccctgtgcttccagcagcctggggctcctggaaacagacccctggcgcaccgtggggaccacctcgggctgggttagcatccttggggtaaccactttcctctctcggagtcaaacatccaggccatcaacatatgtttattgatcacatgctaagtgttaggtgcccagacgggtgtgaccagatactctaaggactagatcagttccaatgagtctctgaaagaaacaaatctatcttattagatttaagaataaagggcaaatattccaaaattgatcaacacctccttttggctttactgtcagcatgtatttaaaatcttagcacttcctgtcggcacctggtctaaggcaccattagtctgtacctggtttgttactgctgtttagttgccaagtcatatgcgaccccagggactgtagcccatcaggctcctctgt

SEQ ID NO: 29263 - DNA, 1016 bp, Bovine  19866881487340
cctgccctgcacccccttcacccctaccgcccccagagagtgagaaaatacagaggtaggaggaacagaacgattagggcaagtgcttgaggattgcccagagggtgcagagagatggagaaagagaaaaggcagcggtgagaacctgccaggcaggtacaccgtgcggaggtctgtagacgacccagatggcagccttgaccatcaaagagtccaagtctcccgctgagcagctttcagactcacccttgcttgatttgcctctgccttcgctttggaacaagatattcgtattctcagtggctgcctcacattattaagctgcatcagcatcagccttgaaattggccccttctctcctgggagcacctgacaaagcgatccgcctgcgttctccgtcgtttgcctcccctgggtgcccaggaataatggtgtgttgtcagggagtgtttttccagcctgtttggggggaagtttcccatctgtgtggagccctttgggaacccactgctgcacagaccttctgttcttatcttaaactcctgcagagacttcctatcaaggtgatccataaaatcaaaattgcgcaggcattaaaaaaaaaaaaaccctcccaacaatgatatctgggctgtagaaatcactttccagccttcatgatggttgaccacgcagaggaaattgacattctacacactggtcactcccattcttctgctactttgcccacattctccaatctttcctccctaaaatcctactcttcaacctccaaggcctaacctaaatgtcacctcttctaggaaggtcttcctttccttgatttcctttcttatttcttaaaatcatgtttgttgattaccttttctctatcacaacgcagtatgtatcagttcatcatttgcatatccatattccctgtagattatgatctcctagaagatgggcaaaatgtgtctcttgtcttggtacccctgatgcctccctattaaaaccacagaagcaaaaaaaaatta

SEQ ID NO: 29264 - DNA, 740 bp, Bovine  19866881946055
aagaccttttccccgtaaaatgcatggttctgacagtatagcccatcttccttctctaaccctgaccttggggcttgacgaggtacacgaaggcattaataattagtaccaaggagggcaatgccagaggctgcaggttctaccaactcttcattcctgactacacgctagacaagtgtctatgtgcaatgcttacgatatttaggatggcgcccaggaaattaatcaagatggatgcaaagatgatgacgttcctggccaaataggtctcgttaatccaacagcaggttttccggaggaccaggggcaaacacttataatcctctgccgtagtgatgaggaccagagctgagtgcagcatgatcaggatggaaaactggatggccatgggcatcaccctgcaagaaacacagaatgttgggtcacgtggcattaatcagggatcccccctctctgtgcaaccttgtcaatcatgttcaggattgcccttccccactccttgcacccaataattcctctaaagctctcttagcccaggaaaggggcttttaacaagagacttttattaacaagagacttttcaaaaattacacccatccctataaaatattctcttgagaaactttgcaatgaacatcaaatattgggcttgatctgttgcttctgcccattttttcccacttatttcatcattcctctttctcacttggcaactgctgccaaggcaacacaccactgga

SEQ ID NO: 29265 - DNA, 1371 bp, Bovine  19866880633349
ctcgtagtaattgcgacacctgcgttcagtagttgcggattccaggctcaagagctgtggcgcacgggcttagctgctccgtggcatgtgctccgtgggatcctcctagatcagggatcaaacccatgtctcctggattggcagatggattctttaccactgagccaccagcgaagcccagagacagtttcctttgactgttttgttttcctcccccctgaatatgagctgtattttcttgtttcttggtacgacttttcactttctgttgaatactgagccatgtgcagctgtttggcagatgggatcagctcctatgggtcccctgtgttgtcagggttggaggcagtgagaggcagatgtggattccaatttgttctcaccttcacttcatgtccaggttttttttttttcctgtcttctggaatctgctgacctacagcaacttcaaggacaggcagacggaccaccttccacagacctcttccccagctgccacagttgtgtaaggactcattcttataattaagcccttactccatatcactgatggtggttctgcttcctttaccaagccctgacacaagatcccaattctctgttaaaatttaaacttcatcttttcattcatctcatccatttctttttccatgtataaaaatattaagtatagttattttgaagttcttatctgctaaccccgggcctcccaggtggcatgagtggtaaaaaaaaatctcacctgccaacgaaggagatgtaggaggtgtgggttcgatcactgggtccaggaggatcccctggaccagggcatagcaacccactccggtattcttgcctggagaatcctcatgaacagaggagcctggtgggctacagtcctggggtcacaaacagtcagacatgactgaagcgacggagcactcacgcacatctgctaaccccagcatctggggcacctctggcttctgtttctgttgactccatgatcggccaccttttccttcttatgttcaacagtctttcattgcgaggcaaacactgtaaatgagatgctgtggaccctctggattagtttctcttcctgtagagagtgttaagctttgttttggcaggcagttaaattcctggcaaatcacactaattctgtcaaagcttactttttggctttgttaaggcaggtctgtttcagctttcccccttatttatagagtgtagctgttttcttaaggcatggtcttaattccgaagtgtggctttcgtgatctcaaaggagagcacagggttcacctgtgtcctccgttttggctgggcatgaacctcagtatttccctggagctgtgtgacctctgaaatctcgtccagcaatca

SEQ ID NO: 29266 - DNA, 1657 bp, Bovine  19866880634243
tagatataatggtcatctgagttaaattcacccattctggtcctttcagttcgctgattccaagaatgtcgacgttcactcttgccatctcctgtttgaccacttccaatttgccttgattcatggacctgacattccaggttcctatgcaatactgctctttacagcatcggaccttgcttctatcaccagtcacacccacagctgggtattatttttgctttggctccatccctccatttttctggagttatttctccactgatatccagtagcatattgggcacttactgacctggggagttcttctttcagtatcccatccattcagtatttctagactctgaaacccctggggcaatagatgggaatttggataagccttgcacagggatggaagcatgaagagagatcctctccttctgaccaagggggaatcaagcaggtcaatgggcaatcaaaagaccgttttcccctcaaacaggcagtgagggttcccccagcatggtgacattggaaatgtgtgcacttggtcgggtttctcagttctcccatgctttccaagtctttccaggccatgagaaccatgggacctagaaccactttaactaagccgcatgaagttcttccttccggagaccactggccttgattctggccaaggtgctgagagatcccagagcctcctgtggtgggcaaagacttgctgctagcagctggtcccacgatggagagcttcatctcttcagtactccttgagtaacatgtctaaatgaaaaactccctcgggtttaagctctgattgtcttaatctgtcttaatgtcttaatccttcattttgaaggacattatttttttggtctataattataattatagattggcccattattcctcctagagtactttggaaaataatgttattccactgtattctggcttctgtggtttttgttgcaaaatctgccatcatttgtactcattcctccccatccactggatgtctttttttcatctggatgcctttaaagtgttctctttactgctggttttcagcagtttgaccatgacatgcctaactgtggtgttctttgtatttattccgcctgggttttgttgagcttgttgaaactggggtgtgatatctttcatcagtgtggggaaattttctgccattatttcttcagattttaattctgtccctttttctctctcctcttattttgggactctgtttacacatttgttagtcttttttacctttgtcctttgcccacatcttccttatattctttccagttttttttcccattcatttttagttcattcacatttactataattattgttacagatgtatttaatctgtgattttactacttgttttctaagtgtcacttttttgttctcttccttctttactgccccctggtgtgtaaaacaaatgttttttagtgtaccatttaaattcccctgttgattttcaaaactattattttgagttacttgcttagtggatcttttagggattacagtatacattttaacttatcacagtttatcttagagtaatattaaattagtttcaataaaatataaaaactttcctccaatatgttttctttttctctcttcttttttttatcatcacatatgt

SEQ ID NO: 29267 - DNA, 1651 bp, Bovine  19866880850822
tatttcttttcacttttatcatattagtagtttagtttacaaatgttgatcttaaattttaattcttagtattatttattttccagagaaagtaggaagtacataaaatatgaactgcttggcagatatcagcctttggtagtagataaatttattaatatactatttcataatctcaagaagctattctttacaggagaatttactaatgtgggaaaggaatgtgtgcattaatgcatccaaatatatttagtctctctggaaaaattgaaaagacaaaagcataaaaattaaactcatgttcattaactactgtctcagtattttatcttatgtaggaatgatgtagatgttcagtgaatatccatcatttaacttaatataactttaaagtttcaaattagcgatagatttgctgaactacttttatgcagacatatcataaaacacaattacttttgagataaagtttgtcagaaaaaaatgactcaatttgattaaatcaaatgtgtacttactaacctttaatatctggtagatatagtattagtttatttaataagaatgcccaagcagaattaaaattttttgtcagcattgtatttaatactgacaactctgaagacatacttatttttattaagccaacaataataaagtaagtcatgtgaccctggaaagtattttggttgattcctatattactggacttttttaaaatgtttgatttatatgcacttcttttactgtaagtcaatttagaatagaactgctttattcatttggtaatattatctagaggtaagaaaatatcatgtattatatatgtgtgtgtgaaaagaaaaaagaatgtatgatatacatatataaatatacagacatatgcaaatagacattgaaggggttttgttctaagattttagtcataattcagatataattacagaactcattaattatatgtgtttacattttgtctcacttgttttaaatccaaattatgtttctgaccagtggaccagtcaatatttcaatgtttaatattattcaatatgttcagtatgttcaatatgagctctaaaggttttccccaatacttgtgggggggtgacttcagtgtttgtttttgtttttcttaacaaataacattatggaggctgtggctttagctccaggtggttttttagtcaactaagatgttaaggcaaggtgcccttctgatgggagcgtgagttattattatacctcagatggttacactccaaaaagacggctctcaggtccatgagaaaacagttctgagtgacacaagttgtggaactcaaagaaagagagtaaggttacaatctttctaaaatagctgctctaaaaggaattttagggaaatatttgcctatttccagtgtttttactctgacacactaaattctcctggaagcattgtgcttttttcaagatgatattttgaaacaattaagacatatttgtggaaggtgcagattttaatttttttctaagtccatatttgatcattaattttattaaaggaatattttaggtgaaccatgatactttttttttccttttgtttaatttgatcctctcataggtttcaacaacatatttgtctactgaaaccatactcacagaa

SEQ ID NO: 29268 - DNA, 1127 bp, Bovine  19866881195362
atcatttggctcactaaggtagtgagttttccacatttgattattttggactgcctttaatataaaattgttagtttggcttattctgtgcaatcagtatctaaatgggatttgacttttaaacattttgaggggaaagtaaaaggagtttatactaccttcacttacttgctttttagttcatagtttatggcttattgtacaatgtaagtcaattgaaagtattgtcgttatagaggctgacaggatagttctggctgggacccacagaatggttgtaccttgtgaagaactgagatctggggttctcactcttaactttgcacatttaggaactgaaaaatgattaggctttttggggagatgatttatattaatcagactcacaaaagacttactcattcactgtcagtccatttgacatactttcactgaactgtgtgctggcagctcttatgggataagttattctaagccccaaatgattttatttggccttagtaagaattataatcgaaatcctaggccacaactttcaaaaatacttagttagaagactattgacactatgatacactcagaatgcagagtttgttatttttattttattttgttttttattattttattttgtttttcagtttgttatttttattttaatcagtttgttatttttaattgattctatttaaatgtcactaaattgtgagacattctgaaaattgaggaaatggattgtatttatttctcccacataagtggagtgtctctaaaggtttgattctcctgaggccctgattatattcctaagcagtttgatgttgagatctgtgggcattgcgtgggatactgagtagtaaggatgacacagtccctggagcagcttaaaatgtttttcagatggtaaaacctggcattgcgatagccaggaacttttggaatcccttcttgtacaccctaaggttctattcagacacccgtctccccttctcccagggccatgagtgtgctctccgagggtgcaaggttgtcttctgtgtttcaggacctgatgacatttgaggatgtggctgtggaattcacctggtgggagtgggggcagttggaccctactcagaaggacctgt

SEQ ID NO: 29269 - DNA, 1440 bp, Bovine  19866881629338
atacattctaatttactttttattttgtgtttaagtcttacgttgaatttataatttcacaatcttcaacatctaatagggataacataagcttgtttgattagtaaacctaggtagaaaaatttgcatgactgcagtatgtttaatgaggacagatctgaagtcatgcctatttttattaagccaacaaacttaagctggccttttaaaaaaattttattggtgtatagttgatttacaatgttttgttagtatcaggtgtatagcaaaatgaatcagttatatgtacatatactactttttttttaaaaagattcttttcccatatagaccattaccaagtattgagttcagttcctgtgctttacagtaggttctctgtgctcccaatttatccctacctcccttattctctggtaaccataagtttgttttctacatctgtgactctacttctgtcttgtaaataagttcatttgtacagtttttttttttttttaagattcagcatatgagatatcatatgatatttgtctttctgtgtctgactgacttcagtatgacaatctttggctcatccatgttgctgcaaatggcattatttgttcttttttatggctgagtcatattccattgtgtaaacacacacacacacatatgtatcacatcttctttattctttcttctgttgatggacattgaggttgcttccatgtcttggctattgtaaatagtgctgcaatgaacatcggggtgtatgtatctttttgaattatggttttctcaggatgtatgcccagtagtgggattgctaggtcacatgattgttctatttttagcttttgaaagaaattccatactattctccatagtggatgtaccagtttacatttccaccaacagtgtaggagggtacccttttctctacaccctctccagcatttattgtttatggattttttgatgatggtcattttgactgctgtgagttggtacctcattataattttgacttgcatttctctaataattagtgatgttgagcattgtttcatgtgtttgttggccatctgcatgtcttcattggagaaatgtctatttggacattttttcttaggtttgtttgtttttgatgttgagctgcatgagttgtttgtatattttggagattaatcttgtcggtagttttgtttgcaaatattttcttccattctgaggactgtctttttattttgtttatagtttcctttgctgtgcaaaagcttttaagtttaatttgatcctatttgtttattcttgtttttatcttcattactctagaatgtggtttagaaaagatctcactgtgatttctgtcaaggagtgttctgcttatgttttcctgagtttcatagtgttcattcttacatttagggctttattccattttgagtttatttt

SEQ ID NO: 29270 - DNA, 958 bp, Bovine  19866880349897
gcagtcagaccaaccctctgcacgttcctggccctcaccctcgtcctctctctgcagtggagccgacttgctcgctgtcaactccgatgggaacatgccctatgacctctgtgaggatgagcccaccctggatgttatcgagacgtgcatggcgtaccagggtaaggacagggccgccggctgtgaagtgggctgggtgtggggctgtggcgagcatctctcagatcagtgcaggtgaacaagttacctagagacgtgcccatcgcttagtgctcaggaactgggacgggaccccacgatggttgttacccatgtgatggacaagattgaacacagaacaagcctggaaaacgagctgtgcacaaggaggggcgtggctgtcatctgtgtcgcccacacgcatgggcagcctcagctggccccgtctcttcatcagctgtgacagttcaattcaaaacattcacaataaagatatattcccatttgggaaaatacaaagtcaagaacattcacggctgcctgctctgtgccaggcaccacttgggctgccagggaccccagataaacaagatgtgggctgttctcggctcacaaatgagcttcagagaggaaacaaatacagcagagaccagcccgcccccgccaccccagtacatgctcctgaaaggcctcctctttagaaatatatctcaaatccagaccctggactgcagtctgaggtcctcccctcatctctgcccttgtgtttctgcccagatagctgcaggaacctcccttttggcctgcccattccctggctctggagctttccctgtccactttctgtagaacttcctaataatttttgtgccagtctggttaatctatgatcccaccccttctgtacttttaagtggagttatcaaagccataggattataaaggaaaccactgctattaaagtaaggctcaccaaata

SEQ ID NO: 29271 - DNA, 1438 bp, Bovine  19866880494739
atgtgccctagaaagtgaagacctctgatttgggtatttatagagatgctatgtatcttccgagggcttggctgatgggtcagttactcccaaatgccagttttgaaaatgacgccagtgcatgatgaaattttctgtggcccttaatgaaattacagagataaggacaatgaagtgagttttcataaatctattttagtcaactgtattttattctgagattatggcctcctgctttttcagtttttaaatgtgctgggttttatcaaaaaatggaaagagtaggtgactgttgatgtttttgaatgtctttcacttgaaattgtccttgactattttctggctcacaaaatccttaaatcttgaaatatcaactttgaggttccttgaaacacctacaaaacaggattcactgataattagttgatctttttttcaattcttcagagaaccatccactatatatagtaggtgataagtaacttttgcagaattactgaataaacaatattgtagtataacatctggctgtgtgtttatcactgactggaaagaaactgttgcaagaggccaaacttggcagactgagaagtatgcaccaggcatttagctctgacaagctttcctctcatctagccggcagcacctcggacagctcagctacaattacacggatctctgaggaaacctatttaaacacaaaggcatttttacattatcttttctctacttcattatttaaataaaaatctcttgttcacacacaaggctttctctttgctcatttaaaactcgctctcggattgtttgcctcatggtctgcaattccccagcaaaacagtcagctccaactctgagcttcagaaatgccaattttaattaaaagtgcaattttcaaatccacctaaagctcagctaggatatggcacgcttgctgccctgtgatctttctggcttccttgttgattaaaatgggtgctgttctaagtgctttgtcaaatcttcacaaaaatgagacgaaattgacatttacacctttataccagcaagaaagtgatatattagattcacctctgttgccataaaagcttacttctggtttaaggacagcaagaggccaataggtccctagtgataagtctgtttttatgcttcagctttaaaggctttctctccagctggtggtggggtaggggagagttactatgtcatttacccattgacttctccatctctgtcttcctagagttccctttgtagctatgcaaggactttgagcttttagggtaatggttctctaactttagtgaatataagaaaagcacaaaagattctcttagaagcttcattggcttctagagactctgattcaacagttttgagcatgactccagaatctgaattctaatgaagcacccaattattctgatgaaggaag

SEQ ID NO: 29272 - DNA, 2616 bp, Bovine  19866880584534
tcggtatctattctctgctagccctggcagtaaccctctgaatgctccgtattgattggctttgtgtctgtaaaatgtgctggccagggaggtggggggcttgggctgtcatcaaatggagcctagcttgttggagtttctgcatatcggtagcccgtgtaactcaaatcctatgggtcttaactcacgtggacattggagggagagcattggtctccttgattcctgaacagttctcgggattggaagctgggggctattctgccaaccgtcactgtgcaatcttgctctgctggctggggaggtcacagtaggacaccccagggtaaagacctccacatccagggtcctgaggcctgaagatctcttgggaccacagatttttttctctatacttcagcacaggcccagtgcagagccaagactggctttagatttgggaaatctcttgctccacagattacatattaattatcatcagttcagttcagttgcaacggcagctaatatttattgaacatttacaaggtgccaaatacagtgggatgtggattacagatgcaatcttttctcacaacaaccctgggaagaagatattactattattattgctattattcccattttacagataagaaaattgaggaggcttagagaatttaagcagctgattcaagtaccagcatctggtaaccagtgtagtaaaaagtaaagcccagggctacctgactccagacctcaactcttaaccactaagcttgactatctttctagatgcagcaacccaggaaacctactgctattgaaatgatatgctctatttaacgtagtcttgcttatccactaggcagaagacagggctccctgatagctcagttggtaaagaatcgcctgcaatgcaggagaccccagtgcaattcctgggtcaggaagatctgctggagaaggggtaggctacccactccagtattctttggcttcccttgtggctcaactggtaaagaatctatctgtaacgtgggagacctgggtttgacccctggtttgggaagatcccctggagaagggaaaggctacccactccagtattctgacctggagaattccataggctgtaatagtccatggggttgcaaacagtcagactcgattgaatgacttttactttttcttcagcaatattcttgggctaatttgattttccacatgactttcagagtacataagctattattttttaaattactctcatttctcattaagtcagatctcccccaaaataatatgaattaatagggcccttgggcttccttggtggctctgacagtaagaatctacctgcaacgcaggagaccctggtttgatccctgggtcagaaaagggaatggctacccactccagtattcttgcctggagaatcccatggacagaggagcctggtggtctacagtgcttggggtcacgaagagttggacatgactgagtgactaacactttcactttttcagtagggccccatcaaactgccatatcatcaaaagtcacactaactcatatgcagccaacttgccttccacacacatttctttagcacttacctgagcacaggctctatccagaaggagtttctgttctagcaagagagaggtatgtgcacagctagtcatgtaccaaggcagactgtgatgagaaggagggacattgtgtgattggaaagctggtgacagaccagttaactccactgaggggactttccttgtggtccagtggtggggaatctgccttccaatgcagaggatgcaggtttgatccctggtcagggacctaagatcccacatgccatggggcaagtaagtctgcatgatgcaactactgaacccgaacattctagagcctgtgctctgccatgaagaccaagcacagccaaatatataatatatatataatatatgtgtgtgtgtgtgtgtgtgtatgtcactggggactttttctggccatgcatcagttgttttgggctgggaaagataaaaaggatttcaagaagcagagttgggtctgaggacgttccattcaggggtgttgtaaacagaagcacagtgatacggaagtggcatggaaacatattgtgtatgccagggacatatagcttaagtcactgggaaacgagagagaaacccgttgagtttatcctctcttcttgtagggataaacataataacgcattttctccccctgggtagagaagaatgcattaagcaaaatgactgtgagacgaatcctagcttcacttggcttccattagaaagccaaagacatatatctgtgggaagggaggcaaaatttcctccagcaggtggtattgaagcatatttacgagaaaggagtagaggcagcaggcagttgatcctggtgactgtagacagcagccgtgctcagaggagtgggtgggtccctccacggtcacctttccatggtgtcattttgtagggattttgtcaactctaggatttttcctgaagtgaaggccctggacagtagatctgttgatattcaggaaacattatttgcaagacccagaaattagcttcactttttgccagggtataatggaagcac

SEQ ID NO: 29273 - DNA, 1437 bp, Bovine  19866880629778
cgctgaagatgtgtttccctggggaagaagatgtgggcttcaaaaatcaatggcaatcacactgaaggatgaagcaaatctttgactatgacatattgatgggcaataataatgctaatagttggggggagcacccccagtaggatgtcctgctgttacttaaagtgctacagggaatctcaattccagcttttccttggctctaactgtgtagctagagtgactctgtactgtgcttagttgctcagtggcgtctgactctttgtgaccccttggatggtagacgccaggcttctctgtccatggggtttctccaggctagaatactcaggtgggttgccatgccctcctccaggggatcttccaacccagggatcaaacccaggtatcccgcactgcaggcagattctttactgtctgagccagcagggaagcccaagaatactggagtgggtagcctatcccttctccaggggatcttcccaacccaggaattgaactggggtctcctgcgttgcaggcagtttctttaccagctgagctactgtggaagcccagagtggctttgtgctctacttgaactgaatcagtccctagtttatagcagttgtctcagtgaaatttttaataatcctccctttgattctcaaaaggatagatgatgatttgttactttatcaaaaactcctggaaatgtcctccttgagaattcccgttttcttcgatggtggtgtatatgtttcaatgccactctctcagttcgtcccaccctctccttcccccattatgtctgttctccatgtctgtgtctctattcctgccctgcaaataggttcatctgtatcatttttctagattccacatacattaatataggatatttgtctttttctttatgtcttatttcattctgtataatggattctgggtccatccacatctctacaaatgaccctatttcattcctttcagtggctgagtaatattccatacattaaaccccctgcacacactccagggaaagaaggggtcatcttctgaaaacagccttaaaacagttcatagttttgatgatcaattgagggaaacactcattcaaaatgcttttgacctggtttttcatttttctttagtatcttttctccaaaaagctttcacacatgagaggatttgagaacaaaaaggaatgactgatggtcacgtgctgcataggttagacaaagcctggaaccccaaccccagagcatcatttgagtcagatttggggagttctatgcacagaggccagggcacagaagggtgcaggggcctcctgcatctgtttgttcagccccagaaccttcctaccgaattctgtcacagatcatgtgggccacacaaatcagcagagtaacagggttcagctacctctacttattaactgcaaaatactcctgg

SEQ ID NO: 29274 - DNA, 1469 bp, Bovine  19866880631655
gactgagcgacttcactttcacttttcactttcctgtattggagaaggaaatggcaacccactccagtgttcttgcctggagaatcccagggatgggggagcctggtgggctgccgtctatggggtcgcacagagtcggacacgactgaagtgacttagcagcagcagcagcagcagcagggcattttcatagagggaaactgaaactaggacaagtgtgtattgtgaacaagtgtgtatgtaacaagtggtgcatattctaggacacgtgcataggacagatttgcatcaaaaagtctgacttagttcagaaacataattattgatgatattttcatagatatggttttcttacctgtaggtatatatagtaactggaattaggctaaccaagatgtgcttattattttaatcaataaataagaacaatttgtaatcagcatatcgattgcatttaagtaattggtacttctgaaatactttagagagatttggaatggtgctatcttgggttgttttaatcatctgcccccagtcttgctgccactataacttcctatcagacttcttcatggatcaaactaaggtgcactagagtccagccccagctgggttctactgaccccacagagaaaggatggacacattgacatcttgggggttagttggagtttctaacctagcatatgaggggttcaagtgttgtcctagggattctgttggaatttatttatttatggctgtgctgagcctttgttgctgcttatggactttctgtagtttcggccagcaggggctaaagctgtgtgggctcattagctctggtgtatgggcttagttgccccgaggtatacgggatcttcctggaccagggattgaacccatgtcccctgcattgccaggtggattctgaaccactggaccaccagagaagtccaaaaattatttttgaagaatatttgtgacctagaatataagtgcagccctctagagaatatttgtatgactctgcatgtccctggaggcaccaccaatttgggttccctaggcactaaatttatggcttctagcttttttttttttattttttttgactcctgggagattgactttgagttgcaaattcactggtagggggctgtggtggctcgtggtaccatttttctaggacttgtgaaccattcctgctctgctcagtgctgatcgactttttattcaggtcttcatggagtgcttccctgatggctccctgatgggcttccctggtggttcagctgataaagaatccacctgcaatgtgggagacctgggtttgatccctgggttgggaagatcccctggagaagggaaaggggggaaaggaaaagggaatactacccactataatattctggcctgaagaattccatggactgtatagtccaaggggtcgaaacagtcagacacaactgagggactttcacaagggg

SEQ ID NO: 29275 - DNA, 1752 bp, Bovine  19866880634397
acattcacactggaatgtggactctcgtccattgtccattcctagcaccttaaagtgtgcctggcaaagtgcagaccctcagaaagcagttagaacacgaataaagggcaggtacaggtggcgatgtgcatcacttgagttgtacaaaaggtaaaaactaatgtttgttgaatatttgctctgagccaagtactaggctctaataatcatttcatgtatgtttcgcatttaatccgctgaagaaccctgggagagggtaaattttattatggaaacaaacaaacatgctcaggaggttaaggaacttgtccaaggtcccaagcttagggagaattgaaacccaaggcaccctgagcatgaaattcatcctagtccatccaggatacctaactgcctctcacaggttctacactattgaagatatcttgacatctttaggactttgactagtttattcagagtgaagacaaccaaaacacttttatcctgactctccttcctgtgggggaacctaggtgatcgtggccaccaatgtagcagaaacctccatcacaatcagcgggatcgtgtatgtgattgattgtggcttcgtgaagctccgggcctacaaccccaggacagctatcgagtgcttggtggtggtcccagtgtcccaggcatcagccaaccagcgagcaggacgcggtggccgcagccgttcagggaaatgttaccgcctttatacaggtaaatgtggcttttttctcttttaggggttttgcctttctcctagtcagcctgggcatcagagaatattacaggtatctacccctattaagcagaacttaagacccagatcttcctcacaaggccttctgtaatctgacccccaccaccttcctcactccagacatggcccttctttgctactgttcctcactggccaaagctagaccagttaaaaaaagtctgtatttatttatttggcagcacggagtcttagttgtggcatgcaggatctttagttgcagcatgggaactcttggttggaacatgtaggatctagtttcccaaccagggatggcaccccagggccccctgcattgggagtgaggagttaagaatcctcacttaactccactggaccacccttaagttaacccttaagttaacttaactcttaagttaagagttaagacttaactccagcccttaaggagttttctgtggagtcttaactccactggaccaccattgaagtcccatgaattaccgattatttgccaccccttttctgacctagtctgggccttggcctgtcagcagccatgtgacatgtagcttggacccttgttctgtctttcttaacattctcttagcatcctgtggcatttttttttttttattctgggatccttgaatcctgtggggccccacagtggtttccatctttcctctggttcagagcacctttgcacagctgaaccagtagggtctctcctgagactcattgatagcagttggtcagctcctgctccatgcttgtctttgaaggagcaacaggaaattacaatgaagacggtcttagcccttaaggagttttctctccaactaaacagcagtcttgtctgcagaaaatgaggtttccagagctgctctttacttcattgtacctctcttctgtggatgacggtgtcaaggtttcttttaattatctagacttaattttcaaatcatttttaattccctcctctgtccagtatccctctgcag

SEQ ID NO: 29276 - DNA, 1135 bp, Bovine  19866880695118
ctgacctcgtgggagagatagagtaaaagaataatgaccacaaatagccatacaatcacagttatgttaagcaccatggaggaaaattttatggacgttacatcaatatatctatgatgtggaagtcaattttatgttgggttacaaatctttatcacaaccctgaattatacacacacacacatacatgcatgtatgatctgtatttctggatgaagaaactgaagtgcaaagaagtgaaaaaattggccgaggcccaaaaaccagtgaaaggcaaaagcaggatttgaaccttggccttgaactttgcctcctgtggaaaagaaaattcgagcctttgttttgatgtcttctgtaaacaggcagggtgtatggtcacgtgatgctctaaccggccatcctaaaagactcattccttcctggggtcaccgtggagctcagtcaccacctgctgcatcaatcaagctgcaaactgcctgcgtcaaggcacatttgtgggacactagcgggcccaggaaggtcgccttgaattctgagacatccaagaatagctccccatcaccaagcgcctgcactcaggaacttcccaaaagtcaaggccaggagagactagggtagtcgccagatacctggagcacaccccactgtgacccatcactaaggtgcctgcagtctagcatccaggggtgcatggtgaaagaagccagacattctgcaggcagcattaccaagagcatgcatgaggtggtacacataagcacagagcaacttcagagacctctagacatgagttctcaccatttataagccctttagcaaatcacctcactctctatgcctcaattttcccttctgcacagtggggataaatgcatctacttcagtaagtctgtatgaggattcgatggcaatacaagcaaagaccttggacagtgaccaacatccggaaaagcacttagtcccctcttatggtcaataagggagcgagatggtggcgcttcctccacccacacccccttcctccaaatgagaaacatcccagggtgagagacacgggtgcacaagtagcaaaaacatctcaggaagaaggagggaacgtctgtgctttccgggtagaaggaagaggaaaggacag

SEQ ID NO: 29277 - DNA, 745 bp, Bovine  19866880721506
tgtagaggaaactctctcccctaccctgccccaaacaaatgaacattgttttttcattagccacagctcaccactcagagctgtgggtctgttcagtcacctttgacccctgacttctggccctgacccatgcatacaggccactgccccactcttttgagtctctacatagagaattttaagatctggtagggccctttgaggtcacttggttgtctagacttccagcatttgtgctttagctgtcaaacaattttttctaaagaatgttatcttggaagcccagtatgtaaagcaggcccatgcagacatgtgatggttgaaagataaggccgggaggccattcattttctgttggggggctttgtatgtgttgttccttctaactggaatacaattccatcctccctgtcccaattacctcgttaagtattacctttcctttaggtcttaaatgaagtaacccctcctccaggaagacttccctgcccttccactgattagatcagtttcctctacattttccagtgcgcacttcagttgcaaatttatgatgatgaaagttcattttctcctcctaggctatcagcaaaagaggagcaaggctatgatgatttggtcaccatcatatctcaagcactcactataaggcttgacgcacagtaggtgttcacttaatattcgattccttaatgaaaattcatctgattcgaccccttcttcttccagctggaacaaagattta

SEQ ID NO: 29278 - DNA, 3607 bp, Bovine  19866880754851
ggttggaatctgactgcagattcctcccgcaaagtcagcatccccaggacctctcatcctagatggggactgggagtgcttcctcattaatcacagctctttaattaacagctctgaggctggaaccaaaggtgcttaccgggagaacgccagcgggccctgaactctggccgcctgttctgatttggaagagttggcgcctgggggagggggcctggcatggctgggcactgagcccggcagggggtggggtttggagggcaagcagctggcaggccagccgcctgtctctgcctcggacctcaccttgcagagctgactcgactcagtgcaagttgcaggcagctctgtcctcccagggcccatggaggggagatggccagagaaagacactctcggacagcaatctcaagacttgactgcaccctagaatcactgaaggagcttcagaaacattggtgcagggtcccctgcggtcctgatgtgataggtctgggatgggatggggaaatgggagttttcagagcttcacaggttatcctgatacacagcaccatttgagaagcacggttcagcgggaggccctcaggctgtaccaggagactggctgagtgtccgaggcccgggttgatgaggggccctcctcttctctgtgttgggtggacccagcagcaatggaacccgcagtttccttctcaccccacatgccccaaggatgctcagaagactgtctgctctgagaagaaggaactcagggcagaggctgggtgggcagcctggagggtggggagaaagcacagcctgacacaggaggccatggtcctaggacccccgctgagcccacagtgtgaagattttcctcaacagatgtctgacacatttttaaacctcctgctcctttgtggggtgaggaaatagggagagactgataaagggtacaaattttcagctataagataaacaggatcaagggacttccctggtggtccagtggttaagaatccaccttccaatgcaggggactcgggttcaatccctggtcaggaactaagttcccacatgccaagggacaatgactgagcccgcttactctagagcctgtgctctgtggcaggagaagcccagtgagttgcaacaaaagaaagctgcatgccacaatgaagacccagtgcagccaaaaaaaaaaaaaaaaaaaaatgatggataaggtctgaggatctaatgtacaacacagtgactattgtaccattgaaatttgctaagagagttgaacttacatgttctcatcacaggcaggaaaaaaagagatagatatatgagttgatggatgttttaactaactagatggtggtactccttacataatggatacatatatcacatcaccacaatgtacactttaaatatctcacagttttgttagttagacctcaataaagctggaaaaaacctatcaaaacttttgtttctgtattctgaggactgatgatgaggctccgtaccactggacctgggtcattacagagtcttgctagtaaagttctatctgggcggccatctcctcatttgtaacaggggaatatcacagtttataaattcccagatttttgtttgacatgtgggaggtactcagaaaatccttgtctaaaccctaaagtccaaatcagggttggcaaggagatttcatcccacatgcttgtccttaattgattggcagcagcctcctgaaaaggaatgtgagtcccaggatgctgcagttgattagtgatgtctgtcagggatacgggaatgggaaatgatggatgaatgtcattaatttgccatccaggtctagatgtaaatttaatgaagttaaggagtatgtttttcttgttcacctttcatttggggaatttggccccaacattctccaatctggagtaagttgccttaggagatgaagacactcttgggggaggtgggtgtttcgttggtagtagaaaccccaacacagggatttatttgctggaaatgggatggagcaatggtgtgctagagctggctggtcctgggagggtctccctattcctctcacccccagatttagatcacactgggggtagatttgtggccagagacccaccatcctggcatgggcttcagacatctgtttacccacagagttacagccagacattcaacatgcttatacaatctagcaaaggctcttctgcctcagtttctctgcctggagcccagcttgtctgttggatccagactttggctttcatttcgttgggtagattgtcttcctaattctcagttggtacacttaatcccatcatttggctcattcttatgcatcctttagatcatgctgtccaatagaaatatgatgtcagacacaaataggagtcagttatgtactttctttttaaaaaattttattggaatatagttgatttacaatgttgtactagtttcaggtatacagcaaagtgattcacttgtacatatatccactcttcttcagagtcttacccatataggttatcatagaatattgagtagcgttccctgtgctatacaatgggtctgtgttggttatctattttatatatagtagtatgtatttgctaatccaaaactcctaatttgtccctctccccacaagatttccattttggtaatcataggtttatttttgaaatttgtgagcctatttctcttttgtaaataagttcatttgtatcgttttttaaaaactagattccatataacacttaatgcagtattctttcattccctgtcttacttcagttagtatgataattgctaggtccgtccatgttgctgcaaatggcatttcactctttttcatgactgaataatattccattgtatcagtgtatatatatatatatatatatatatatatatatatatatatatatgaaccccatcttcctgtactttcaaatgttctagcagtgatatttaaaaagtgtaaaaagaaacaggtgacattaattttgatagttcgtcttacgcaaaccaaattatcccagatcttatcatttcaatatataatcagtataaaaattacccatgagacattttgcattctttctttgagattcagtgtgtgttttacactcacagatacacttcagttggcaggaatcatgcttcacacactctatgacccaggtgatggtggctaccatattgaacaaacacaggtctgcgtctcaggaaagtcccatgtccccagggagagccttaagcctggacacatgggctcccaccttgggctctccttatcaaaacagttactgtattttactgttcttggtagtttaatatgtcttttgccctctagataatgtttcttcttccagtacttttacatttatctatttttttggttgcactgggcaattgcagcggggggctgctgtctagttggggtgcatggcttactcgtggtggtggcttcccttgttgcagagtacgggctctagagagctggctcagtagttgtggtgcacaggcttagttgtcccccagcaggcgggatctttcctggatctgggctgaacccgtgtccctgcatgacaggcagagt

SEQ ID NO: 29279 - DNA, 1517 bp, Bovine  19866880756835
cgaggggaaatggactgctctgaagttttccggaggctgaacttgaaagatgaacagtgagaggtggaagaccactctgggcaggaggaacagtgtgtgttaggctctgagtggaggagatcctgaaaggctggtgtggctggagctgagagaggtcaaggggacagtgggcagtctgggcagagatggaactggatccaaagggatttgggaagaccggaagggtttactaatttatttatttaaaaaaaattatttatttttatttttgactgtcttggatcttagttgcggtatacaggatcttttgttgtggtgggcgggcttagtcaccccctaaggcagtattagttccctaaccagggattgaacttgcatcccctgccttggactaccaggtaagtcctgactggaagggtttaaatctaccagatcaatggcctgagaattctgagaccattcccagatttgctcttagcaaatctacttttggccccaatgccctggcatgggatgtcagttggtctgctctgggggatggctactgccccaggccctttcaaagagtcccatatattcttccagaccttcattgaagtccttcctctctgggaagccttctaaccttgaaatcagaagagatctcacctcccacgtcctcccctccccacacttggctcttggcatcttaggggcactagtgtgaaggggaaagttcttctgggggcagggcagcccaggctcagcgggaagggggctggggggtgaaggcccggtaccttgctgtgggcaggtgaaagtgttagttgctcaactgtgtccaactctttgccaccctatagactgtagcccgccagcctcctctgtcaatgggattctccaggcaagaatactagagtgggttgccattcccttcttcagggaatcttcttgaccccgggatcgaatcccagtctcctgcattgcaggcggattctttacgttctgagcctgcaaactctcctcctatacctcccagagtccacacccctgcttgcccctcacacctggatcttgcaggatatgtgccatcgtgctctataagggacttcatccacagacttggtaggggacagtctcttgtcctgattgtcaagtctgggtggggaacaatcggacatccactgctgtgctttgcacgtccctggaaccaaggctagggtggtagaaatgaaagattcctggcaaacccatcctgctgctccctgccccctccgtgggctgctcagagagtgggagatgccttctattgagaaccctcttcccaccccagccactttgccttctcggggaggggttggggagccactttcattgtccctgaacactggctggcagggggcccagggagggggctccccaatagcgaatctgcagctgcctgtctttaaggtaaaattaccgtaattactccaattaccaaatccatcaagagctttggactgaggaggccggtacaatcagttctgaggagtgtg

SEQ ID NO: 29280 - DNA, 1246 bp, Bovine  19866880761679
caaggctgaattatcttctccccctccctcactcttttttttttcctttttgttccaagttgtgtcactctatggacaatatgggtgtgtccatcattttgtgcttgatgtcttgattctcttggcaaactctacattagagggactatgattttatttttcagggaacctgaggcaggaggtagtttaaataacagcatattggtgtttagcagcagatctcttccttaacgacatcttgcttttgctgagaggaggatgggagtcagaatgtgggcttacttcctggtgtcatactgagctgcttcatgctgggagaagtgccattagcacaaccagagctgtacagttttataaagtgtgatcagtgtagttctctgcacttgtagtttctcttagcttgaggaaacatggcttatggcattgagcacttacaggtcaagactcatgcagtgacctcagaggttccaattttgatttcagccacaccttctgggggcttcccaggaggttcagtagtaaagaacctgcctacaatgcaggagttgccgatttgatctctgtgttgggaagatcccctggagaaggacatgacaacccactccagtattcttgcctgggaaatcccatggatggaggagcctggtggggtacagttcatggggttgcaaaagaactggacatgacttagtgactaaacaaaaatatcaacacataccttcatagcaatagaattcatccattcagaaagaaaggaagtatgaagggaaagaatgtttttggggaagagaaggggtgcctttgcagaaagctctgtcttgaaagaaagtgaaggcgctcagtcgtgtccaactctttgtgaccccatggactgtagcctgccagactcctctgtccgtgggattctccaggcaagaatactggagtgggttgccatgtccttctcccaggggatcttcttgacccaaagatagaacctgggtctcccgcactgcaggcagactctttaccatctgagccaccagggaagctgtgttaccataaacctgagtacttgtgtatgttggttaagaatgtgtctcctatatgactagcccctgcatctccacctgctcataacctttcctcttggtctagtccaggataccctaaaactgggccccagaacagctctgaatggaatttggaagaaaaaagtaaaaaactgtggtccaaacagttttggagagactgcacactctctccc

SEQ ID NO: 29281 - DNA, 1400 bp, Bovine  19866880762629
cactcataataaaagcctacaaagtgtgtgacctctctggcttctacttattgaagtgaagttgctcagtcgtgtccaactctttgcaaccccatggactgtagcacaccaggctcctccatccatggaattttccaggcaagagtactggagtgggttgccactgccttctccaggggatcttcctgacctagggatcgaacccaggtctccctcattgcaggcagatgctttactgtctgagccaccagggaagaccttataagtaagaccttccacttactaccctcccctcactctgactgtcctcaattaggattagggcaaactcttgcctcagggccttttcactggctgttctgtctctccggattattattcattccgatattcacaaggcttgctccctcaatcgtctgctttagtccttgctcaatacaccaccgtaaccctgagtcctctccctacccatcttactgaaaagctgtaaccctctcctctcctccgtctatcatgccgtagaatctactgcttaattctactgtttattatcttcctttgcatactagaacgtctttccatactagctccataagcacaggagatttcgtgttatgttcccggacatatttcaaacacccagaaaagtccccattgagagtgggtgctcaacacatatctgttaataaataaatgcactaacaaacaaacccaaacagatgctccaagagaaaagggcgttattttgttcactgccatatcccaaccgcctagcacaggacttgcctacgttaggcgtttaatatttgatagactgaccgaaagactaaatgacaactggagcgactatcatctctcggagagcggagtgacacgggacacgaccacacccctctcctcaatcctaaccccacctcgcctgtcacctgtgaggagacacccagatgctggaagctgtagtcaagcagcaactcttgaagctccaggttcaccggcacgttgcggtcgaagggcgatcgcagcatccagcgcagcggctccaggctgcccagcgcgtttcccacctgcgggcccgccccgccccgagccccaccccgcccgcgggcgcacacagcgcggaactgcagccggggctcggggcccgggtccggtccggggcacgcccagcctgcgcgggcctggaacgacccattgtccagcaccagtggcaccgggagtgacccgtgtgccaccgggccggcctccagcaccggatctggcgcggcgcgagcatcgcggaacagaaacacgttcgtacccaggcctgcagcagtggccgccgccatgttggagcgctgctggctccgcccctcgccgcggcgtaaccacggcgcgagactccgcccccgacgcagcgtgcg

SEQ ID NO: 29282 - DNA, 1117 bp, Bovine  19866880807037
tgcagtagtttatgaaggattctaatttggggttcaggaaatagcctctcaacgctcctaattcagatctctctcagagagctactggatttcatcataattgacaaacattagtgaccgccccctggggtggctgcttttagaaacagctgttgtcatattttctggactttgccagctgaaggcatgacaaatccctgcccaggttttttaaatacttctgttacctcgctgctacttttctgccagggataaatgttttgaggtggccagacccagaacatccttacaaggattcctgttacagtgctagagtgtacactgctcattctcctattcttatgtttattaagaagaacataagaatatttatgttattttcttttttattaaggttattttgtgctaagaagataagtgacatttaaaagtccaaagaggaatgatcacagttgtgtaaggggtgatttcctacttgaactctgatgtcagtagattctgtaggtcaggactatagtgggctgtttggttcaatgttttggtagtttacttagaggacaggggatagtataggacctaactcccagtgcagatatttctattccagaagtatatattgatatctaggagcaagaaatgtgggcatagcagctctccaagtttgcctcaccttttttcttcatgtttgttttaagctcaggtaaaggtaacctcctccttctatgactccagtttccattcagggtataacatttgattttctttttaatctgggcaataaattgatgttcccagatggtagcaatgggggagggggatgtatgattagtaagttctactcttaaattagtagcccagctactaagctatagagtgagatttaacaactttcatggaaattccagattgacatttcttggggaaaaaatgggcccttctttctaataggtgtgggcaaagaaggctataaattaatgtgcaacttgtaacattccagaagctaaaaatagctgatgtaggtatgcatccacagtgtgacccttgagatgacactttgacctttggcatagtgctcctgtcaggaaaacgtactggtggttgttcgtgttagtggcgg

SEQ ID NO: 29283 - DNA, 767 bp, Bovine  19866880810047
tggagatgccgtctgggtgttgccccctccccacagtccttgacttccgagctcagggcacagacacctagcgcttatctgggtaccctagggagtgctattggtatggtgatggctccactgggacggtgaacgtggagcccaagcaggatacacaggccggagataaggccaagaacagattccctttggcgctcaggtgctgttcatcagaaatcaacagccccacaaccctggctggtgacaggcacaggatgataacaatgccacatgatcagtagccttggaggacaggctgtcactggttcagagagataagagaacaatgagcaacccctccaactagggaggggccctcacggagcctacagggcaaagcagcaggagctgaagcttgtctctgacccccacacctcaacagggcccactcgtctcagcaggcctggagttctcttctgtcacccagggaccccttgcccccattacacacccactttctcgacccctgttctctggagttaatcactgtatgtctagagcacaagtgttcaaggctgataacagataagaggtgagtgcagggagacagggagaggggccatcccagcccgacatgagaggtccaggacagggcctggagcccccgccccctaccaaggctaagtccaacagaatctgcctggaaaggtttcctcttgatgccagaaggaaacctcatcccggcaagtgccaagtgaggcctgaagacacaaatatttgctcagctt

SEQ ID NO: 29284 - DNA, 4468 bp, Bovine  19866880812323
ttggctgctgctgctgctgctgctaagtcgcttcgtcgtgttgactctgtgcgaccccatagaaggcagcccaccaggctctgccgtccctgggattctccgggcaagaacactggagtgggtagatggatagaaataattttgtaaaaatgggcttgtagccatatatttgtttttgctgaatttaacaaaagaagaaactgcattgaaataggaactttggagtactgaactttgggtaagtatttgttcagcacaagagaatttattaaagcttgaaagcgaagaaaaaggattacagaaagctttagaaggttacttatttttggaactatgttataggtagttgcctattgtaagagtaaattagcacgcttattctttccacctttctttcctccatttgtgataaattccgaactataattttaatttcaagattataagtacatgttcttttctataatcataactcccacaggtatttaacttcaattctagtttaataattgctaattattttccatggttttgccaaccttgaattgctcatttcacttttttttttgcactttacttcttgattggctgaattgtatatgcctgagaatgtctgaatgtggtctttgttgatataaaattcttgatttgcactctgtaagagccctgtagacactgccttttggcctaaagcatcactgtatagaaataatttgaggtccagcagagcccccctcaccttccaagcttgctttttctgcttgaatgcttgtagtactgctgtttcattgggatatgtcttgattctgattgttctcatttgttcttaaatgtggaagaacttttaaatcttcatgttaaataactttatatcagggcaggttttcttctgttatatctcggcatacttttctgttccatttattttttttctcttttctaggagcaccaattaagtgtatattagattgcctttgtaatatttatcactatctctgggctcatcgcctttccagtttcttttgtgatatttcttcaagcctgtccacaatgttcatgattgtttttagtcagacttatttgattttgttttctttgcatctctacctgggtctcacagtcacttctttgaatgcattttgtttttcctctactagagaagtgaatatttaaaatgggaggtgatattacaatacatgacaaattttaaaaactgataatataaaaagcaaaaccctgatatcaccaacattaaaaaaaaaaaaaaaaacccagaaaataacatagtatttttgttaattaacagtctgacccatttctgtaaatctttcttcctgcaatttttggctctgtccccactgagcccctctttattccctcaagtgagagcagagcagtgtctcagtgtctctctcgtgtgggtgattcacatgtgctttgtggtgttggtactgcactgacactagagaagctcctttagctttgtaactgacatttgtagcattgtgtaaattaggggggttgtcttcaggtttgggagaagcctctcggtagtttctttcaggtccaggctgtgagatctggaggatgtccacaggttgatttttctgacctgtccctttgagaccttgtttctcctcgactctgctgtgactttgtctcgtctttaagctgttttagcttaagcttgtgatttctttgaaactggatttctttggctgaattctgtctctctgagtaatacttctttaatttattttttcttttaaatgtgaatgtttatttttggctgccctgggtctttgttgctgtgcgggctcttctctggttgtgacgagtgggggccgctctctgttgcagtgcatgagcttctcatggaagttgcctcgcctgttgctgagcatggggtccagggtgtgtgggcttcagtggttgcagcacacaggctgagtagttgggctccagggcttacttcttttgtggcacatggcattttcccagaccagggatccatcccatatcccctgcgttggcagttggattcctgtccaccgtgtcaccagggaagtccccagaatgcctttattttgacatctctacctggacaagaaattaattctatctccttgcgttagttttcttctgtattaagttttaattacttcattattctttccccccaaagttcactttctacttgtcttctagttaggcatcatcgatgaacattttccaagttcttctgtgtatgtaaaaatggaagtagtggtttggcaacttgactgctgcgttagatttaacctttgatgtcatgaaagatgattcacttacttaaaacattcgagcaattttttctgtttgtagtttggaatcccagctcttaatcagtttgcatttttcctccaaatttgtagccatggataatttccatgcaaccacatgctttctcttaaaggacaaaaagtatataaattagcctagtagtattaatagagctgtcaagtttgaaatgctccatctccacaagtactttgtgtgcagaccagaatctgaaaacgatgtcagagccgaagaacagatggcacaagccactgcctgatctcagtgagaggcagctccttaatgagcatttcactggactcctggtctgggtttgacttcacgaccaggcccccccgcctgggcctgtgattcaggacaagtgctaagcttgtcttttttcagtttcttgctttgtaaaaaaagagggtctctggcccacccaatggactgtatgcatgtttaataagatacattttgtgaaagcttggagcacagcaccttcacataggaggtgctcggtcattggtggttggcctttcttttcttttttacaagtcttcattgaatttgttatagtattgcttctgttctgtgatttggttttttggctgagaggcatgtggagtcttagctcccggactagggattgaacccacactctctgtgttggaatacaaagtcttaaccactggatcgccagggaagtgtccctggttttcttttgacctcctttttcctatatctgtttctatcagtatttatcctgtctaattgttgagcttattgggaatagaacttatacagtagaggtaaaaaaaaaaaaatcactaaaaaagcccatagaatatggctttccagatgtctagtggtatgaccatacagaaaatttctaaaaaggaacttgaaaataaaatccattttatagcaaatgtatacaaatagtaaataaatgtttgacttcataaaatgatcacatttttatggagaggttggttcccttatgctcactcttacaagctggttttccccataagctccagtatctgtatgcacacactctctgtgccagtttttaagatttacagtttaatgatctgtagggtgggaattgaaacaataacaataacaaaactgtcctggtgaaatactggttatcgggagctgtaacctccagaggtagagcagtgtaggatgaatttctggtttcataagatgttttgaaagattctgtggtgcacaccagctgcttgatgacaggttctgtcttggcctctgagatctgtaatttcaagtcactgggcagagccactttctgatcctcatctgctctttagtttcttaaacactgatggtcagataacgcccagtgtgcttggcttgcagcactgggtgcagagcctctggactcctggacctggggctgctgcagcccaatggctgatgcagcccaatggctgatgctgaaagctctgcctcagacatgccctgtgtcagcttatgatccaaactcaggacctgtgaaaggaggagacaagacgcctgggggttggttggtaggccaggtccccgggaaagctctataattttgcttccctttgggtcttttttagttagatagtttacataatgagcattaaccctttattttctttcaaggtaaactaagttctaagtgttattgctcttctgcttttatatttattcattttatcagatagttttttaaatttatttttttaagcatccagcaattattttatttattcattcttttttttatttggttgcatcacatgccacgtgggatcctagttccccaaccagggatcatacccacacctcttgcattggaagcttggagtcctaatcactggactgccagggaagtccccacatattttctgttgttgaattaatagcctgtgagtggcctggagtagtagatcttacagctggattcttttttatctttcccaccctcacctttcatgtgtcatgtaaatgaaatgtaaaagtgaaatgtacaatgaaatgtaaacgtgaaatgaaaaggtaaaaaatgtatctgtacttcatggtcttcatagtgtgttattcatttctttattatggtaacgtggcgccttcattaattttctcctctcat

SEQ ID NO: 29285 - DNA, 1615 bp, Bovine  19866880859078
ccagtgagagcccaccagctggggactgagtgcctggaaaacctaccaatggaacacaggacttttcataaaagactctttgaagagtcatgtgatcatggaactcactaaaagctatctaaaaattagctagtgtaaatgtatttggtggtacagaagaataaatcccttacctagcaaaatgaatgtcaaaagaaagaaaatacagaccatttagaaaacaagttccacatttttacaaattactgcatttagaccatctattttcagttcctttgcagcaacctgagaggtaactgagattctaataaccaacgtttatttcaccaaaccattttctttttttttaatttaaagtttttattactgaagtatagttgatgtacaatattatgtaagtcacaggtgtacaatacagtgattcacaagttttaaaggtcatgctccagttatagatattatacaatattggccacagtccccatcttgtacaatgcatccctgtagcttattttctacattgtatcctgtagccccctaatctcccacccctgttttacccctccctctttcctctctccactggtaaccatgaatttgttctctgtatctgtgagtctgcttcttttttgctatattcattactttgttgtattttttagattctacacataggtgatattatatagtatttgtttttctccatcaaagcattttcattcattgatcctagcactatctgaggagactctgatttgcacagtggtatgcagtagacactgctgagctgactgtaccctgattctatgacgctaattattttaatagtagcaacgaggtcaaaacacacataaaatccatcatcatgtgaaaatgggccagcgctaattagcacaaataacatttatgaattctacactttatcaatttatactatttgtccctgtttttaagtcttttatagctaagtttctatatttagacagctacgtggattggtggggagaaacagtgaaacacacatgagaaaggacagctttgagctctggttctaccaccaatgggcacgacatcaggcaggtcactcaacctcccaggtcctcaacctcttcacctgaagaaccaagggcataactctacttccaaagtcctttctgggctaagatgtgaggacacagaaagagctctgtacctctcaacacgccgatttccctgagggccaggatactctcatacgctttctgtcatggcattagaggcttattcagcagcaacggctgcgtgtttttacctccccccaaataatcttcttcctcatttacagaaggaaaccagctgtgaacctcaccttaattctcgtggccagcgggttggtgcagtcatcaaagcggatgcagtagcccacctcatggcccagcaccgcacccctttcctcagccactctccctgcaacctttgggaagaaagatcatgctgaaaatagagacacagaaattcctgcccagagcacacactatggaaaatctaaaggtcacttattttttaaacagtatgctgaacacagtggaaaatgaaaagagaaaggggcaggttagcagagaactagtgtgataat

SEQ ID NO: 29286 - DNA, 955 bp, Bovine  19866880859983
acctggcggcggtgctggagtacctgacagccgaagatcctggagctggcgggcaacgcggcccgggacaacaagaagacgcgcattatcccgcgtcacctgcagctggccatccgcaacgacgaggagctcaacaagctgctgggcaaagtcaccatcgctcagggtggtgtcctgcccaacatccaggcggtgctgctgcccaagaagactgagagccaccataaggcgaaaggcaaatagaagtctggattacttcgcagcagtttaggtctcaatcaaaccaaaggctcttttcagagccaaaaaaaaaaaaataaaaaaaaataaacaaactccacgagatagtgaaggacagggaagcctggcgtgctgcagttcatggggtcacaaagagtcggacctgactgagctactgaatgacaagaagaaggagaatcagtagagtgtttaaagtaaatgaaagttaagatcgccacatatggagtacaaatattaatgactatagctgttaatatccagttagaaatacaatgcaaaatagctcagttacaactgtgatattgataaaagttatcctaacaaactttattaggaaaaacacagacctagaggaaagaactttaagaagttattaagagatataaagtacatacgtgttatgttcctgaattagaagatcatccagagaacaagctgtgaggtagctttaaaaaaaaaaaaagaaccaggagcccgtgtcctataagatgtgttgtagcgcactgccagactgtggttccttctccacgatttcagagtgaaaaatgaaaagcagaacgttttttgtatgtttgtagaaaattcatttagtggaaaaatctgacctgaattgacacaaggctatttgtagtcttttttcattgtgttaatactcttctgtttgactgcagaaatagtggtgtctttaaagaca

SEQ ID NO: 29287 - DNA, 1174 bp, Bovine  19866880866663
agaggagctccagagctgccagtgatatgctcatgtcttgccgccactgggaattgagtctttgagtgacgagatgaatgctgcgaatcaggagcccagcagctgaatctgtattaagagctaggatataaccccaatgccacatcccacagggagggaaaacaactaagcattagtaacgagaagcacagcattccactaggcacagaccacagcagccacagtgagcatgacgggcacccacacagtgttatgctccccgccccactggcctgagcagctgagcctgactgaacaatggtgcgcagggcacacacactggaccagagcagcttctagctcccagctcaggtactctcacacagacatccactgggatttgaaagcttcaatatcattcttataacagtataaatctcaacatttccaaattaactcacagagttacatttaaaaaaaaaacaatgaaaaaatcaaaaggctatcaattatttccttagaattttatagaggaaggaattcaaattttagaatctcttcagatgctgggaattatcctaaagcatctgctgaaattattttcagggttcatattgtcaaaagtcacatgcaatgcttttttaagcaaactttaacatttaattctctgagacaactttaatactcttaaaaaattaaataatcaagttactgtgtttttatgtagcctccaattctatatttaaaagtaattactagtcagttaataataaattaggacaaactaaattgaatttataaaggaagctttagggacattatacctgtcgatcctatcagaaagagggcagtgacaacagaaaaaggaatgatcattaaagagagacattcatgcaacactaacacaaatctggatttcttagtaaaaactattttatgacattacaagcagaactcactaacaccagttcaaaatgctgaaacaaacaataaccacttcgaacatttatattagaacacatataataatgcaaaaattctttagtttaaacgtgtcttagaagcaggaaaaataaacaaattttcacctatatttaaacacaagcataatgaataaaataacgatttaaataacttcttcataaatgcaatatttaaatgtgttaaatagccacataatgaccttatatatctg

SEQ ID NO: 29288 - DNA, 1432 bp, Bovine  19866880906153
taccactgcactgcatgggaagccccagctttctaaatctatagctcttggtgcattttaaaatgtaagtatccagaccagagataatgccagccagcaaggcaggtctagggaaccctggagctgaacttcagagggctctctcttcccctactttgtccaaaacatgtggcagcagatgttggagtggagaaactccttcatgggcagaaagatctcaatttggtctaagaaactcctaatctggagggcagaagaggaggagatgcaggtagtcccctaccccaggaagttaccttctgggagagggaggaatctggaagaggatatggcccatgaaagccccaagaccaattaaagcagtgttccgggtggccagctgaggataaaacctaggaaggcttctggggtgaagtgaggcgacatcagcccctaagaacaagaatgacaaggcggggagcaggggtcccttactagaaccaagaagtggtgaagcccaagtgaggtagcctatgctaggagaatggaagggggaactgagagggtcccatgggggaagaggcaggaaagagggagggaggaagaagactggtcatccagatgccaactgggggggatataggggagctggggccaagaacttcctcttactctgtggccatgtccagggttttgtttcctttctccatcagtgtctgatgactactcgttggcaggaggacagagctctaggggacctacacctcaagaggctttcaaatgcctgtttcattttctccagtgttggcttagggcagggtgtcgcctctggtccatggcttgctgtcttcataactgctctttcactgccctaggcctcccaagttttttggccttggcagccagtttcttttaaagaatcactgaggcctggggaaagcccatgcagcagaggcactcaccctggtcgcctgcccagcatcccaggagccaggcccccagatgaggacaagcacggtatgtctttcctctctcaaaatctcccaggccccctgaacagtttgcctgagccttgcactcaagggaggtgaattaagatggaaaacaagttcatgttccactcatcaacagcaaagcacccactccaaggaaggggcacctttcactgatttgccaaaggtgccgtgtgggcagcagctgtcctggctgtctcctctcctcccaagcctgagaagggcaggcattcagggtcagagcatcctgccccccagagaggcccctgctgggtaccactcttccccccccagattccacaggctcagctggttcctctgagaacagctgtgttcttgtctcctaaagcagtgtttctcagtccttagcatgccttagaataatgctaaatactcattaaaacaccagtgcctgggccttacctgcacagtttccgatt

SEQ ID NO: 29289 - DNA, 803 bp, Bovine  19866880918309
cagttcagttgctcagccaagtccaactctttgcgaccccatggactgcagcacgccaggcttccctgtccatcaccaattcctggaacttgctctgcatctctgcccacatactgggccttgtgttactatggatgaactgcccctgagcttgtctctgataccttccattatcaccaatccctctactactaagcttatgtctctagcaattctctcctcattcctggatgatcagtctccctgctttactgtttcattcctatcagcatacaaatatgctgaaatatttttcatccttcaaacaaccctctcttaaccctacatccctctagagcttcctccccatctctctctctcacttttatagcataaagcctcaaacgagttttctatacctgccatctccagtcttcctcccattctgtcttgaatcctgtccaatcagactcattcctcattgctcaaccaaaacctcttgtcatgctcatcatgagggacttccctggtgggccagtggttacgaatccaccttcagtccctggttggggaaccaagttgccacatgccgctacaactagagaatctgcgtaccactaaggaaagatcctgctagacacaactaagacccaatgcagccaaattaattaattaattaaaagatcatcatcacagtgctaaatctaatagctaattttcatgcctcattccctttgtgtgagaagacatatgtacaactgtagagtgttcataaatgtgagaggttaccactagcatgaaaaaacaatatacttttcaaatca

SEQ ID NO: 29290 - DNA, 1457 bp, Bovine  19866880929967
ccatgctccaccactagagaaagtccacgcagcgaagaagaccagtacagccaaaaataaataaattaaaaaaaaaaaaaaggagatcaggagtgctaggcttgtgttgaagacataccagcatcaagctgctactttcttctctgccaaagcagagttgcaatatgactaaagagggcatgtccttctcacagcaggatttatatatttgaagccaggacaaagcactaacctgtgcaggggatttaaaatccaggcctggaagtagtgtatcaggtgaagtcattgagagctgattttctgagctaaatgatagcaggactagtcataataatagagattactcgctgtgcagttatgcacctcataccctgttggtcactaaaaacattagtttatttaatgcttgcatcaactcggtttatctgtggttttaaccactgtcaggtatcttgcctctcaccttgaagaaaggtctggtatttgcatccagcgtggacatgttggtgacaggggctgcgacggtagagaaggtactgcctgctgtggctatcgccatttggcatgcagcactggtggcttgatggcatgcaagagcggactctccccttcacaatcggtgtgaaaaatcaggaaagtcacttcacctttctgagcctcagttttcccatctgtcaatggggccagcctggggctctcctctcctggcctgactcagattcaagtcgaaataaagggcaggaaagcactttgtctgtaatctgtgtgacgatgattggcttaagagcatcttgctgatgatcactgcagaaactccctccccaaaacacagtgcagaagccacacaagcgagtagtaaaaggtacttaataagtaataagggcaaacactgagcacttactatatcgtatcactgctctagttactgcacacatagtgaccaattgataccttacaacagtcctacagggaagcgtttgttattttcatcctcattttgcagagtgggaaactgaagcacagagaggtcaagtaactggcccaaggtcaccctgcacgaagtggcagaactggatttgaacccaggcagctgggcttgagcatcagtccctttaccacgactctggtgcatctttacatttacaacagacaaaccagacgttgttgttgttcagtcgcaaagtcatgtccaactctttgtgaccccaccaactgtagctcaccaggctcctctgtccataggatttctcaggcaagaatttccttctcctggggatcctctggacccagggattgaacccgtgtctcctgcattggcaggctgagtctttaccactgagccacccaggaagcctcaaattaaatgacttcggtgggtaacagagttggggcaaatcccctgtttaatgaagccctggattgggttttaagtaaaaatcttctaattatgatgagaa

SEQ ID NO: 29291 - DNA, 991 bp, Bovine  19866880944191
aacagttagaaatgcaaactcgagcttaaggagaatggtgcagttttaagcccgcttgttggcgtaacgagaggcaggcaggccgagagaagagagactctgaagttgtctcaggttcatttagactctgagagaacaggattaacccagaagcagagtcattttcccttctcacctcaaaatgacagtttttctaggtcaaacccacaaagttaaagagcagactgactgcctcagaattttgaagaaaatggcaatgccaaatttgtctttttttttcctccccaaatgcctgtttttcagctcatctgctccactctgacgactgcttatgatcagagtagttttagagaggctgggcttagaaatcatgtagttcagcaacctcattgtacaggcgagggccctaaccctctcctaccccaagaaacttggtccctccttaactaagcagtccaaaggcacttgtcctaaatggattgatttctccaagagcccagccactctccagtggctgcccatgcatggcggagggtttggctgagcacagcgtagcgccccacagccatgcagagcccacaggtcatccccggctctgttcctggcattgttggtgactttccattaccaatgttttttagagtgttgctcttgccctgttaagaggcctgaaatggtccagagtcctttgtttatacacaacattctcttcagaaatgagcaccaaaaatggccccacaggcacgatgacctcatccccgttcctaagctaaggctttgggtgtcttccattggtgggcggggtcacgtcaggtgaagtgcgtggaggagagaattaggagacatccagcaagacccacagcgggagagggggacgggggacctgtccagagatttgccttgcaagtcctcaggctttttctcctgcttctgagcgatctttgggattgagggaggaccctccaggcctttgctggaatctgcattggtc

SEQ ID NO: 29292 - DNA, 2376 bp, Bovine  19866880967150
ctttgcttttttaggaatgcccagtgacatgggcttgccagttggctcttgtgagctcctgtctggcccaggggctgctatcctgctccggcccaagcctgcaaatccaaggtgcccatctgtgctccagcgtcgtgcaccgaattccagtggtggtgctggagttgggtcttgcgccagctttacagtttcacggcccccaatctttctgatgctggggagggaagactgcgagggacaggatgcctgcctcctctccactgcgtcctctcatgagccctttgaaattgttgcccatgagttggacgctgtccacgggcttggccaaaacctactggtgtaactaactagctgcaggtctgtttcctgctccgtgcgccttttacttgttctaaaactacctctttagagctctgaagggggcccctgaagtccagattcagaaatttgggggacaaatctgggttctctttaacccttttctttctgaacctatgagaaattctccctgtgagacatctgggccagaagttggggctggtgggggccccttgtgccacagtgctagtaagggggtctgctgtttgtcccagtcctccactgtggcccccagggctcctgtagcccagaggcagagctggattccaagggttctggctgatgcttcaccaggtgcagggcagctggaccggagagcagggcctcaggagtcacttcgcccctggtggctcctggatgcagggagagtcacagcatcagaccactcccaccccagtttcagggcggatccagtgtagagtggaaagtcaggtcaggtgactgcagacaggtgtgcgtgacgcctgccacatctctggggtctggggctggctctcttatctcatcctatgattgggtcagggcagggatgatccaaaacactcatacctttaggctttaaaaacagtgttcagatgagactgacactggaattcctcttgagctgtgagctgggaggtcccgagggaagccacacgctcctaggagagagctgtgcaggttttcagatctgtttgctcagagaccagagactgaaggcatttattgccccctctgagtccttctggctgtttcctccttcctcccttgcttcctgctcctgggccactgtctcccacccagaaggctgggagtcccagctgattgcctgacaggagccaactgcaggcttttgggcattaactcatgttttcagtcagggataaaccattcccatcaagtcccagggaaactttccctgtggatctccttggtgtcgagggacaagctggggccaaggtcattgagttattcactctgtagtttattgagtagctgaggctcaccaggcactgtgttaggctctggggatagaggaggaacgaggtggagtgaggacactgctctttacagttctcatccttggaggaccacgagtaccagcaactcccatttgattcagagacagaaaagctgtgtcctggtccatcaaccctgtgcttttctgctcttgagaatccctggactgtggattcctttagtttggaggttgctgaaatggccacccttggataacatttgccactaaatggtggagatgctgggtcttgggttccaggcagatgccatctgaagtctatctggaactttcaaggatagctgccttccagccagcatcttttgggcactgtctaacagcagtttgaagtcagtgtctggaagaaaaaggagcctggaatttgctgccaaatacaactcaggttcttcagcgcattgtctcttgctcgtttattacctaatcctcctgccccaccagtggatagtgggaggaaaaggagcttctcctttaacatcgaaagcctttcctcataagtctgcctctgttcctggcagatatggagcagggagcacggagaaagctggcaagatcgaccagatgcccagctcctggttagaccccagtctggtggcagttcctggcagattaaaggaggctatttctaaagcatgtgccacatagctccatgtgagctccagcccttgctcccaccctgaaaattggtgactcccaccagagactgagctgctggctagtagctccaggaagttgaatgaaccctaagcctaggtcttctgaagacttaaggatgtaattctccatcagattatgcagcattgatgaaactgctctgtactgtttgatcaatctcagcaggcttagaaaagttaacaagggtgtgtcccctgacctacccaccagttggctggccttgtcataacatgagacccatttggtgtcagataccttttgatctggagttctctctcccacttgcttttccagagcagaatactggg

SEQ ID NO: 29293 - DNA, 1465 bp, Bovine  19866880968160
tctggggatttaaattaccttcttggcttgactttttggtatctgttacctcagccttaggcaagctcccccctcgtgtgtgtgtgtgtgtgtgtgtgtgtgtgtgtgtgttttgacagctttatggagatattatgtaattcacatacatacagtttacccacttaacgtgtaccgtcctgtgactttaaatacattcacggggttatatatccatcaccacaatcaatcttctcattagctcctaaagaaaactgttagcagtcgttacaactgtgtgcgtgtaacccatattcccagtaagatatagaatgctttcatctctctagacagttcccttgggtccctttacagttaattcccagctcctttcagaatcagtgagcctttgcttctatttctacattttctgatgaagtcattagactctgttcagagttgtgtaaacaaaagcatagggaaccagaaggttcaactgagatgtcctggaaatcacgtgggacttagagtctcctctgtgcagtgggcacactggtacctaccactcaggtcatgaggcttaggtgagcaacatgaatacatttgtctagtgtagtgcctggcgcacagaacaggtggatgcattttaaaagtaaaggagaaccatctctaattgttgtggttctgattctaattataataaataggaaaacagctcgtgatttcttcttatttcagggttatctacaatgaagttatccaaacctccaagtattacatgagagatgtgaccgccattgagtctgcttggctgttggagctggctccacacttttatcaacaaggaacggtaggaatgaacccccaaaccacctgttaacctgcctcttcatatttttaaatatacgtttatttttcaatgtaatgtcctaaacttgcctgccccccaaccccaacccgtggtacatagatgaaaggctgttaccatagtctcagatcgttctgggtaaaagcaccatactgtttgctcacatgatatttaaaatgctcacatgatatttaaaacgtgcatttaaaaataaatccctccagcttacatgataaaaaaaggagaatatatctttaactcttcccctctccctctgcccttttaaaccatttccaaagaaagtctgtcacactttggaccatgttcataagaagcagcacaaatactctgatgaggattgcctcgcagaacgtgtgtgcaagcttaaacctgtttcattttaaacacttggtgggcgcattgctgtgtatgtagtatatgcttttttctatggaagacgtgcattaattcagcatctttggcgtctctgatctattttgtttttagactgtttttctacctcattatgggccacatttcctgcttctcttgtctagtaattttttgctgtgtgctggacattatgggtggtttgctgtgaagaattgaatttgttgt

SEQ ID NO: 29294 - DNA, 1209 bp, Bovine  19866880980598
tggctctggaggaaggtgtctgctacaccctcccagcccccgccaccttgggtactgcatgctttctccctgacccctttgtacccagcaccctgggtgcagtctcatccaggctggcagggagacaaaatctcccaccacgccccaataccttatcacacttaagggccaaacaacggcaccaaaacccagcgtggagagatgatttaatgcatggctttctgcattttttttttccagcctatggaaatgcaaactccctgcgccacccattcactgaaggtgcaacttcccctccaggctggcaggagggaaaagggtcagggctcttggcccctctggtttgcatctgctttctacaagacacgtgggggtgactagcaatgatagactcgaaacgccccgcagctgtctctggagacaatctttcaggaatttccccctaggttatgcgcttgttaagtcatacatctctaaaggaactcctgaaagtgggatctagagtcggctgacagccaatctgacaactggtttttaactgaaagctggaacggacaggatttccggtcaccctcccagggaatgtaaacgttaggagttggaacttgaacacaattcgcattcttggggatggagattcctcccactctccctggccacgaggagcggacggggaggagatcggggatccgaggggatacacacagagtggggagagttggggaccccccgaccaaccggcccgagctcctaggagacctcagtttcccattttttgaagacgatgtcccgtgcgaccgggaaccgaggagacccgaggggctgggccgcgccgctcacctctcgcgccaagcggagctgctggcgtagcgcgtccttgcagccataggggccgccggcgcccgcgccccgaggctggaagtgcgcctcgacgcgcgtggccccgcggtaggcgccctgatagaaggcgggccagccgagctccagcagcggcggctccaggtccgactgctcggggaagtaggtgccggacgagcagtcgtgcgacgagccgaaggagtcttcggcccccgccgccgcgccctcctctccgggccgctcggccgcgcgcagaatggagcgcacctcgtccgggttcaagaagcggccgaggcgctcgcgtcgcaggaaagccgagaaggcatctgggcccgcccgccagcagctcct

SEQ ID NO: 29295 - DNA, 2612 bp, Bovine  19866881002410
atattcagcaactctcccctgtggggaataggttgcttcaattggtttcactatgagtggctgcctgcatacttcacaagcaaagcacaggtccatccctcctgcttacactgcctgtcaggattcagttgcagacaaaagaatccatttcaagtggtttacagataaaggaattaaaaaatttatatcggctactttgaaaaatcatttgaagagctggagaagcaggctccagactgagcttccaaaagcaaaacctgatttcattaatgttattaggggcaaagatttttaacactggagacaagaaatacaacaaatataaaaagttaagtaacaacctggaaaacctaaatttgaattggaaatgtcagtacaaactgatgacaaaaactgctcattttaaaaatgttatctatttctgaggtcatccaccagaaaggtctagaaataattaataattcagtaacaatgagcatccattgcacatgctgtagtctctaaatactttttcctattcaaagaatatagagccacctttcttgtaggagctgtatctttgagttatcaaataggtgatgttagaataattcttccaataaatgaagaaggactgaaagaaatagaaggcaactattttgtgtgaatgtttcatgctacacctaatgatcaagttgatataaaaaaaacccagcctaatattataggcctcctagtggaagtattcaataccacctacaaagtatttaagcctgaattatcagaagtaaatctattgaagtctctagatctaactaccagtttataggaaatacagtggacaaaggattttgttaaatagcaccatgggattttgatcagaaaaatctaaactatggaaaaattctaaaggataaatgatctggtttctttaacaaaaaaagaaaggagaaagggaagacttataaattaaatgatacttaagacatgtcagtcaaaaggaatgagtgggtcttgcctcaaacaaatcaagtttaaaaagaattacttatggaatactaaatgaaatttatacattaatatgaagaaattatgtttggataatttatatgtttgaagaatttatgttttgggtataaatgatagtattatggttatgtttttattaaaaatattcatcttttacttaatactgaagtatttgtacattaaatattatgattttgcttgaaataatccaataagagttgggtgggcaggaagtggatagaggtacagataaagcaagattggtcatgtgagcaccatttctgaagctggatgataggtatgtaaagggaggaagtagagcttatactagcctctttgtatgtcttaaattttgatgataaaaagttaagcattgcattgtacatatgtaccacagcttctttacccaatggatctctaggttgtttcgtgtcctagctacagtaaatagtgctgcaaggaacattggcgtacatgtgtcttttacaattatgattttctcagggtagcccagtagtgggattgttgggtcatatcgtagttttattcctagttttttaaggacactccatactggcttcgatagtggctgtatcagtttgcatttccaccaacaatgatagagggttcccttttctccacattctctccagcatttattgtttgtagattttttgatgatggctattctgacctgtgtgaggtgagttcacattgtagtttgatttgcatttctctaataatgagcaatgttcagcatcttttcatgtgttcattagccatctgtatgtcttctttgaacattgctcagtcataaaaaggaacacatttgagtcaatgttaatgaggtggatgaacctagagcctattatacagagtgaagtaagtcagaaagagaaaaacaaatatgtaaagtatgtaaaagccatatgtaaagtagatagccagtaggaattgttgtatgattgagagaactcaaaccagggctctgtgacaagctggaggggtgggatgggctgggagggagggttcaagagggagaagacatatgcacacttatggctgaatcatgttgatgtatggcagaaatggacacagtagtgtaaagcaatatcctccaattaaaaataaataaaatttaaaaagataataagacctagggtggacgggatagttaaggagtttgggatgggcatgtacacactgctatatttaaaatgtatagctgacaatgtcctactgtgaatagcatgggaaactctgctcaatgttatgtggcagcctagatggaaggagagtctggggggagaacagatacatgtatatgtgttgctgagttcctttgctgtctagttgaaactataatatgcattaatattggctatactccaatacaaaataaaaagttaaaaagaatgttaagcactcccaatctcccatactctgctttacttttatccctcaagcatttatcactttaaaatataccatacaatttgcttatgtactatgcttattgtatgtcagtcctctggaaagtaaattaagggaaacaacgtttgtctttttcattcactgacacatcccaagcacctagaactatg

SEQ ID NO: 29296 - DNA, 1017 bp, Bovine  19866881004994
cttaatgtaactaaaccataaggcatcacagaatgtataaaatatgtagatgaaatgaacccagagataaataatgcagggttataatggcagcttctgggcacaacgtatttttccatgggtccaattcgttatatgtaacatctcttggagtcactgcaccaactctgtaatgtaggtcttgttcccatttcaaaggggaaaaaactgagactcagggttaaggaacctgtaaggagtgctatttcagttgtttatggctggtatctcttctgattgatcaatcatatgctatgatggttaagtatttttttttatcatctctcctgcttgaaaataaaagagaaaatgtcagacaggaaagatggcccacaaaagcacgactaagagcaagaaaaggagtccttgcaggaaaataaatgaaatctacgcagagtaaagataattgattacagtcataacttcccttactgttggagctgtcatcacctttggaggcttaggcaggaaatatatgtatcttatcctgaatttcataaaatctgccttccaaaccctgtgagctcagccccctatgactagtgttccctttcttggtgagtactttctcattttcacttcacccaacagctcccaaaccagattcataacagcaactgtcctctctcctctgctctctgtgagatgaaactgtcagtagaataaatcaggaagtttccagacactctgcattttggtaaatgaagtttctgtccagcatacaggctttgaagtctctccgtatgggatttgtgaccttccaggtcaccatgcagagagaagcaagctgtagttgactgcctttacattactttcattcctcccctctttgatctccagccaaagtcccttcactttgattccctcctcttggctcctcttgggtgtgcagaactccaagcatatctctgcttccccctctgaccagctttatttctggttaaaattctccataagccatagattcaatcccatgaa

SEQ ID NO: 29297 - DNA, 1438 bp, Bovine  19866881052877
gtggttggacaacaacgcgaaagtacttaatgctgcagaactgtccttttaacatttttaattgcatttaaaaatgagtaaaatggtaagttttatgttgtgtatttttcaccacaaatttatacaaaaactcaggtgtcagacccacaggaagcaaacaaaagcgtttcctgaattaatgatgacggaccttgaatcacaagttaacaacatgccccaaagcagacatctttagatgaaaactccttcaggcttaaaaaaaatgctggcacatgctacattgtgccccctcccccaaggtacacagaatttgagaaacaactttcccgacaaaataaaatcaatgagaaccgctggtctccacctacctgattcaagcagcatttttgcaaacatgggattcaaaggaaactctgctattctcatgccaagaggttcagttaggcgacagtctttgtctagacctgccgtaagaacaacaaaaggcagaaggcatgtaccagtgttggaagatgtacagttgttgggagaataaaaggtaatacatgctagccaaggtgtatccaggagatgaatcatacactatcagcttcaacctgattgctgttacagtagaaaaagaaaagatttcctcggagctcttgaatactcaattttgaaaaattaattctaatggcctctatgggcttccctggtggctcagtggtaaagaatccacccgccaacgcaggagatgcaggttcgatccctgggtcaggaagatcccttggagggaggaagaaatggcaacctactccagtattcttgcctgggaaagcccatggacagaggagcctggtgggctacagtcaatggggtcgcaaagagttgggacatatcttagggactaaacaacaatggcctctatgtaaagacctaagtataaggaaatggccccagagccgcctccggcccccatcctctcctagttctacttctccccagaacctccctctcccagggcccaacccacaaccagatagtgccaaacacagagggcactttccttagggccccagcagccttcgcgcctgctaactacagctccttggaaatactcttccccagcgtccatgacccacactgtctggcttctctgccacctctcctgctgttttctctgcctcacctctggactactgcactcacttcccacgctagcaaggtaatgctcaaaatcctccaagctaggttccagcagtgtgtgaatcatgaactttcagatgtacaagctgggtttagaaaaggcagagggagcagagatcaaattgctaacattcactgggtcacagagaaagcaaaggaattccagaaataacattcatttctgcttcacttaccacgcaaaagcctgtgactgtgggatcacaaaaaactaggaaaattccatttttctccc

SEQ ID NO: 29298 - DNA, 1851 bp, Bovine  19866881076680
atgatcctcttaaacacagttatgtcacagcctgttaaaaaccctcccatagtttacagtttttcattatacttaggttaaaatttaaactccttcctattaccctgcagttttcagtctctgtttacctctcaccctcaccttgacacgccttggcctttgccccctctactcttaccactcagctttctttaagtttcctgatacagctcagatttttctcacttgacgagaaagttttctcatttgatggttctatttatccatctacaatctatctacttatctatagactttcagctattgcaaccctatctgagatgaatccaaggttttggtgaatcccacacagtgtttggtaagagttggcaattctctctcaaaagtcatttagcattcaagataaatccacattaattgtttaacttccagtaaatagaatttaaattatgtaaaatataactgattgtctcgttcatgtatggttttgagtgctttatttttgagaatagaaaaactatataagaccttcaaaggacttaatactattcttgcttttgttaaccttattctcctcacaaggcagtaagtttttctattgtgaattctctgaccatagagagtttttgacaagtcaatcctagcttttggggaaagcttcctagaaaatgtattatgtttaatacataagcactttttagttctctttcccaaattctttcactacttcagctcatttgagcaaggaaatacccttatgaggtagatagggaagactttatctttcctattttacagatgataaaactaaatcagcctgaaatcatattgattggacgcaaaatgaactcactataggccaagcatattgagagaactgtgaagaaagatgagacaaattaacattttgactccattccctttatctttccagttaaattaccttgttttcctttcactgctacaaacttggctttgccagtgcagacctgacctgaatctgtccatgtttggatctgtccatacttttgcacagagggatgaccttaatgtatttgtagaatctacatgctgtacactaaaggccatctggcaaatgcaaatacagcaaatggaaaacgcatttcaggtgtggatcaaaactgtcccagcaagataaataactgcagtgacagggacgctggctgtccagatacatgctgaatgtctctttgaattaaaagcagagtgtttgatgatttcatgtctttcccatctgaaaatttaatcttcagcgggtggaggaagtcatctgggtcactgacttgctcagccagattctcaccaacaaaaaggcattatttggttgagtggaagtgatgggaaccttgggagaggtgacagagtgagaagttaaaactggggacagtcagatgatgggaaaggggaatttcaaacaattgagagaaaaaaaaagtcagcttgaatctgtgggctaagtcttcaaaatgcagggtgacaatggctggaaaatctctccgaagtgcaattctgcctgtgcaaatttttccagcaatggagaccatggagaagtaaccagagaaaccagtgtggttagccagggagctctgatgaatgccagtgcagaagagacacccagaaagatggaaagaaggactcaggatcaagaacaatatagacgagatggcagggaaacaagaagactgtgtcatggagagtcagtgcagcaggatctgagggttcaaatttgttgaggaaagcataacagtcatctcccaaaaggtggtctttagaagatgctcttaaaagctctaaaagtcatttttcatggaggcagtagatctttgaagg

SEQ ID NO: 29299 - DNA, 1234 bp, Bovine  19866881101205
catgaatcttctatcaatctcttctgggacatcagcctttggagctctgagctgtcatataagaactctggcttctagggtgctattctagagagagcacatggagagaccagagaaagatacagagaaatgtgtttggagtcccagctatcccagccccagcccaggattcagatatgtgagtaaggaagatgacttcaaacgtcaactgacattgaactgcaacccacgtgaaagaacctggacaggaagcaaccagctgcaccaagttaacccttaggaccatgagagatggtaataaatgattgttgttgtttcatgccattaagattaggatggtaaagagagcatagaagaagcccttttgtgatgagaaaggatgacactgacatgctggaatagatggaggtaattacttgactccttggtctagttgtctggaaactctcgtccctgcccttcctaaaataattccttagatcccttgagccactgaactcttcttatgacctaagttagctcaagttggatttatatctctggcacctaaatgaatacagatgatttaggatgaacccaaagagcttgatgtgtttggagcacacatctgggactgggtcggggaggaaagaggaggtggcaagtagcaagagatgaaagatgtggggtgatccccgggaagatcgctgatgaactgtaggaccccgcaaggagctttggtgtctttactttctgtctcgcctgtctccacaaatgatttggggtgaccaccaaggattttggactttattataaagacaatgtggagccagtgaacaattttcagccaaaaaatgaaaggctcagatatgcattgtgaaaaggtccacctgccagtttagatgatgtgttggagagaagtgaactggtcaggagtctattgacgtgatgcagggaagaaatgatgagactgaaccaaggtggagtaatgggggtggaacgaaagagtagtgagcattaaggtagaatggacagacctggagtcctttatgagaagcaggatgggaaatgactaaggtggtttccaagttcgtggtctgagtacctgaagaagcaacagtgcctttgccaagatcaactcaaggggtaggatgatgccttgagctttcacttgcagagcttgaagtgtctgcagctattaaaggggaaaggcaatgaatgcattagttcattcatttaaaacatttattaaaca

SEQ ID NO: 29300 - DNA, 872 bp, Bovine  19866881109022
ttcggaccggcttagcgggagatgctgatgatgcagttcccagcctcgcgcggataattggagctttgaatctggccctcccaggagggccgtgcggaaagccccagactcggagctcccgggcatctcagaaacccagggagagagagacgcggctccttaagagcttctcagaaccgaaagccgagctgcttgcgcgcgcatgtgattgaattccacataatgggccgctgttctcgctgtcagaagcgcccacccgctctcggcggccctgcacaccaggtgccacctctgaatcgccctctgtggagggcccggggccccggggtaccaggcgcccttgcccgccgggctctcccaggaaggcgcctgccgttagcctcctgggccggcgcgggtacttccctgagggccctgccatttcctgtggctggcgaagcaccggagaaaaaccctctgtgtgggaggcctcctcagaggctggtcataagcatcttagcttagccagtgactcgctttcttcccgagggcaaggcacttggcctccgggagcctcagttgcctctaggagatggggctaatcaggccgtgggaggatgggggcaggaccctgtgaggtcctggcagccggttgctccgaggttaatacccaggcctttcagaaagctttggaatggggcgtgtctccttttaggcaggagcagaagtggagccctggtgggtggttctgcaggcactgggggagtttccacatcttcctccctcagctttgtcatcaagaggcagcttgcaggcggctggtgggcgctggtgagtcctttgagctcccagcctgctcccgggccttcccacacaactcccctccccagccc

SEQ ID NO: 29301 - DNA, 1131 bp, Bovine  19866881234047
tttagaggctctaagcttctgtagctcaggaacataacttgtccgtttgtcttctgtgtgtttgcttgggttcttgtgagaaggcgggggcccttccagcaggcactggtgtcattgtccccggggctgcttggctgtgatgatgtctgcaaacacatagcttgaaagtttatttttgtactgatcctagtttggatgtgccacttttggcaccaaacgtgtatgtcatttttatttctgttttataaacatgtaaataatagtggtaacttgttaataatagtaaacctttatacgtaaagtaaatgtagtccctcccatccatggttctcctggtctatgttttaagacagtccagtgaatttttacaagcgaatgcttgacatcagctgagaaaccagaggcttggcacatagcaactctggggtcatgtgggcacagggagccccatagagcaagatcatgtgatcaaatgccctccagacatccttagagcagacatgggatgttgtttatataaagtcccaaagaagtgccagttctcaccagtttctgattgggatccttgtggggaaaggtcagaaatgctttcataaagtctgaatttaggaccagggctgatcctgttgaacttctcttggggtgggaggaggcaaaggggcacaatccacatcccctgggggcgagaccacacatcaaatcaggagatcaaacaacagtccggggtgcaagctggagacagcaaggtgtctccggccacctctgcccgtgggtcccatctatcgccgtctctccacctcttgggcagtccccagcagggcaggcaggcctcccagcggtgttcactgtgtcacgttgcagcccctcgtgtgtggagatggatcatcaccatgaaaggcctgtaaccgcgaaatgccagccttggccccggggcccctttacacgtctctgcaggaccacgtgaccttgtcaagagagcactgactcagccttgctgagagaccagcagggcctgatggcctggcagctcccaagactttgtcccccagttgttccacaagaatgagccctctcaaggcccacacaggtgctcagatacgactttccacgactttgcagtgtcttctgaag

SEQ ID NO: 29302 - DNA, 1168 bp, Bovine  19866881272417
cccatcctcacacaacagggaagatgcggttgtgcctccagagcgagacagagaccccaggtgacgccggacgtgttttcaaccctgtgggcggaaatagaaactcttagtcagctgtagggtttactgaagaatttccctggttaacagaaatttgaccgatggggaggggagagggcacagattctagggcaccttggaggcctgggctggtggctctgtggttcctgctcagggcctctcatgaggttgtagtcagcatgtcacccagatgcccatcatctgagggcttgactggggctcaagactctgattccacgatggctccaacgtggctgttggcaggaggcctcagcatctcatgatgaggtctttccaaggctgactaagttgtcctcacagcatggcagctccttctccagagtgagtggcccagggagcaagatggagcctgcagtgtctgctgtgacccagcctcgcagggcacatgccctcctatgatgacacttggcagtcggtcctattcagtgtgtgaggcacttgcacaagcgtgggaaccttaggaggaagccatgcgtcttggggactggatgccacagccacagtgccctttggctccacctcgtgtcagcccacaagacctccacaggtgcccaccacttggagccaccatttggtggcttgaagacggggctccacattcccgtgggatgactgttcagaaggggcagagccaactagctaaatactcctcctgttattataataccagtaataatctactctgaagctttcctggtggcttagaccaccagggaagaatctgcctgcaatgaaggagacctgggttcgatccctgggtcaggaagattcccctggagaagggaatggcaacccactccaatattcttgcctggagaataccatggacagaggaggctggtgggctatagtccatggagtcacaaagtcaggacacaactgagcaactaacacacacacacactaatctactccataatctctcagatagcctcatgaggttataactcctctcttacagatgaggaaaacaggctcagacagaggcgatgacatccctgaggtcagatcactgggaaatggggtctggattcttagctgctccacctgtgttttcaggcagggg

SEQ ID NO: 29303 - DNA, 1312 bp, Bovine  19866881287453
acaggccttttggggccccatctctctacacagatgctgatcaccctgcttaccatctgactgctgtccaatctcactctcttgtgctaaagggcaagtgagaacttaacaataagcagtcttaagtatctccatgagagtggccaactatcagacagaacccttccctgcggctctttgcaaatcaaccttccctctctggcagctcaaggttatcactttacttgacaacaggcaagtacaagaaggtctggtactgatgcgtaagcccaatactttggccacctgatacaaagagccgattcactggaaaagaccctgatgcttggaaagaccaagggcaaaagaagaaaggggtggcagagatggttacatagcatccccaactcaatggacatgaatttgagcaaactgcactgcaggagcggagaaggcaatggcaccccactccagtactcttgcctggaaaatcctatggatggaggagcctggtgggctgtagtccatagggtcgctaagagtcagacacgactgagctttcgctttcacacgactgagcttttcactttcactttcacttctcacttttatgctttggagaaggaaatggcaacccactgcagtgttcttgcctggagaatcccagggacgggagagcctggtgagctaccgtctacagagtcgcacagagtcggacacgactgaagcgacttagcagcagcaacagcagcactgcaggagatagtgaaggacagggaagcctggcatgctgcagtccacagggtctcaaaacgctggacacgaataagcgactgaacaacagactacctccaatggacgggagcatggagggggcctttgtagcggcaactgtgcttactttgataaatgcttcatacacattgagcatggtaagatggtcaccctcctccacagcaaattttcggtgcgctcgaatctggaaagaataaggcaatgtttagaagctgactcctgtgagcctcttgtcctggaggtaacattacacgatgaatagctcagtataattcatttgcaacactgtcttaatttcaagtgtacataaatatcgtaacttttccttcacagtctttccagcattcacccatctactcatcacgaatgcctgggctggggagggccctgtcagcactttggctgtgccaggccctgctgtgcccaggcaagaactcctggcatccctaatgagcccacccaaggttgcccccagagaagccttgaaaacaacctcccttacttttgaaaagtcagtaggacaatgggttaagatttg

SEQ ID NO: 29304 - DNA, 1284 bp, Bovine  19866881305720
tgattcttgcccggggcccagagtaggctcagaagcccaggtctcacctccgggactcgtggtcagggtgagcgaggtgcagtgcacggctctgcctacctggtgccctcccctcactggagaacttggcattaaagctcaaagcccagattctcgtggagcgtccagaacaaagtgtactgcatgcagagtcctggcccggggacgtgagggcacctgagccctgaacgcaggaggaaagctgaccctggccctgagtttgaacattctctggcattgcccttctttgggattggaatgaaaactgaccttttccagtcctgtggccactgctgagtttcccaaatttgctgacattgagtgcagcgctttaacagcatcatcttttttaggattttaaataactccacagggattctatcacctccactagctttattcatcataatgcttcctaagggccacttgaatacacaccctaggatatctgtctggctctagatgagtgaccacactatggtggttatctgggtcattaagacctttttttgtatagttcaaggaatctttggaatttggcttcttttgaaatgaaatgggaaagctacatccaagcaagcaggtatgggagttaaagaggacaggaactccccagggtcactgtgggtcagtctgcattctgagcgttgatttattcattcagcaaacagtgttggcgcttactttgtgcccagtcttagagagtcaagagcagatatccaataaatgtttgtggaaagaaggacagaggagagggggaggggagggagaaatcaaggaaggaaggcaggatgcatggatggatagatggacagaaatgccctcacagagtctgtagtcctgaaactaatatttacaaccagcacagtgctggtcaaaaaaaaaaaaaagtgagccacatacttaatttcaaatgttctaggagcacattcaagtagaaaagaaacaggtaaaattaatttgtatactttctttaactcagtctattctttcaccatataatctatacaaaaaattattgaaacaaatgttttcccatctttttttgggggtggggtactaaatctttccaatccagtgtgcatgttagactcacagtgcaaatatttcaatctgggttgtgcagacctcgagtgctccatgggcccctcgggaagggtgacaggtgggttggaggtgcacactgcctcctgagggcacttaattcaggctcaaggagggtggggcattcagtcacatattcct

SEQ ID NO: 29305 - DNA, 2825 bp, Bovine  19866881315923
caccatgccgaatgtgtgtacatccatcttcttcattatgagccacttgagggcaggtcctgccacttatttttctctttcttccaacccccatcacagtgccaggcacacaactggagtcggttagttggttagtctccttgcttgttctatcaagccactgggatactgtgttttgcggggagaaaagagagaaaatcgggagggaaggaagaaagcttgagaagtgcgcgtgtgtgtgcgtgtgtgtgtgtgcacgcgcactcagttgctcagtcatgtccgactctttgtgaccccatggactgtagcttaccaggctcctctgttcacgggattttcccagcaagaatactggagtgggttgccatttcctcctccagggggtcctccagacccggggattgaacctttgtctcctgcattggcagggggattctttaccgctgagccacccgggaagccctatagaaatgcttgttgttgttcagtcaccaagtcctgtccagctctttgggaccccatggactgcagcatgccaggctttccattggaggagggaatggcaaaccactccagtatacttgccgttagaaccccatgagctgtacaaaaaggcaaaaagatagaaatgcttagagaatgcttcatccactgtagttattaatatggctgttgggctctgcccaccatgtctccagcacagggcagctctgctttatcctttccctggtctccctggctagaaaccagagaaccatcttcctatcctttattctaatgctgttcgcctctcctgtgtctcctgcattggcaaggtgatccttggccaccaagccacttgagaagcgaggcagctggttaaattctcaggggctggagggaattgggaaagggctataagcccttgggtctgcatcaccgtttctgtccagactgtcaccactagagagcacagcgcacccaggaagagggtctgcggagccctggcactggcccagcctggccctgcgccgcccccacctccgcctctcctggcaacaccccagtgggcagtggagatctggatgaagctcagccctgccccagacactttgcaatcttgggcctaattaaaacaccacagacggtctgaacctcgcattaaaatttgatgagaaattgatcagccaagcaaacaggaaatttagctgtgagtgaaggtaatgtttgctcaaatgtgtaatgaggcccatggggaatatttgtggggacccccatcatgtctgaatctactcctgctctgcaatttcattttccccacgcgcctctcccctcgaaacataccaggatgcttccggagagaacggggaaccagaaaagttttgacttgactttacaaatttcctttgaaagcccaaagtgaaagtgaaaggcactcagtcatgtccgactctttgcgaccccatagactatacagtccatgggattctccaggtcagaatactagtgtgggtagcctttcccttctccaggggatcttcctgacccaggaatcgaacaagggtcttctgcattgcaggcagattcttgaccaactgagctatcagggaagccctaaaagcctcagcagtgtttgcgaacgatagctcaggaagagcagagctgggtgggtgggtgggtgccattacctactggtgtccatgttttgtgataattgatttcataattagttgttgactacctactgtgtgtcacctccacgttagaccctgaagatagactggtatgtaaaataagtcatggttcctgcctccagggatatatagttgagcaagagaagctctgaaccccaatttccccatctgtataatgggggtgttggtattgtttcatgttgggttgttggataaatttaaatgagaaaatatgcacagaacacaaaggacaggaacctcatatattaaggatcaaatgaagatttttctacacccttcctccccatagcctgcatatcaagtctaccaagacttctcagcttttctcttattcagttttctgcaggtgacatgacttgatattcacttgctggggggtgtaactgaggttgaagatgaaataagtcacatgacagatcttacgggaactggaattggctcagaagttctactagaaagatcaaagagaaggaattctttggtcctctgatggagaaagtttctccaaagattaggcaaaatttctggaagcttaacacttcccttggacatccccaagatcctttcagcaggagaagagaggagcctggagtgattttccttctattcaggctgtcatgaggaccctttgccctaagggtgatgaagtgccctcagctttcccatctttttatcactcctgtctccatcccagtgccaactatcaggcattcctcatcttcattcctaccttgaagcccaccatcatccattcccattcctgtccttttcaccactcttcgccatttgttcccttcattgctgccaacattattaagatcgtcaccattatctttattgcaaaatagccccatcattggtttgtagatgcagccaggttttgttggcctgtcttttattcatggccttacaaatttataagacggttgtgttcatgaaatttctggggtaatttcctttgcttggttctaaggtgtatgctcccctacctcatatgttttaatgcttctaaagttagaaggacagggaagcctcatgtactgcagtccatggggttgcaaagagtcggacatgactgagcgactgaacaacaacgacaaagttagaacgcatcctataaaaatagca

SEQ ID NO: 29306 - DNA, 1432 bp, Bovine  19866881385193
gagttgtcaactccaaatgtcaacagtgccagatttgagaaggcttctactggccatgaggcccctcaggtcagtgactgtgtctgattcagtcagccctgtgtccccaattgcccagcatgacggcgggcacacaggagacagtaagcattaaagggatgaatgaggacttggaaggcctcatgtctcttggagtccaggaggtttggcttgtgggacattttgaatgaacaggagagagatgcagatgaacttgagcgtgaacgttggtcattcaggccaaagaaattcagaccaaagctattttccttcccgcccgtccgccaaggaggcacttgggggcccgaattatctgaattgttctatgatcatggctgcactttgctcacatagacacaggtccgccctttatctggacaagcaggctggggcaggggaaggtaggtactcacaaggaacaccctctcagaggggcccctgggatttgccaagctggggtgcagctgctgtcagcttcctgtttttttccctttctggtggaatgaaggaaaccactgaatggctgtttttccactgacatttacagcaatgtgataggccttggattaatgaggtcaagctccagtgtgaaatctgcctgataacttgaagcttggccaacaggaagacatggcttgttttctttgggcatttgatgtctttggatggctttggctagggaagtaggggtcacaactctgtacaaaagacgggaatgttttatgccccagaattacagaggccagaattgtcttttttttttttttttcaatttattgggaaggtttattttcacatggactttgaaataaataattcatcaaaaggaaggttcaccatgagccctaggttggctgctacatcagggccattaaaaggaccacgctgtttttctgggcctccctgggagtctgaaggaagagactggccccaaagggtttttggacaggttagagctgcacatggattagaactcattctgatgggggaaggggtctcaagcatatgcctcagatttgcttgcgggtttctgtaagaggcagaatctgattccttaggtctggggcctggacatctgcatttagaataacgtttcagaaggagtcatgtgctgctggtctgtgaactgcactttggggagcaagggtctatagctgaggggtccccggtgtcacccactccagcaaattcggcctgtcatgcctgctcgcacagccatctgctctgtgggctggcttgcaggagaacagacttactgtgccccttctctgtgtgctcagacctgggaccaagcatgaaggaaaggctgcttgctcccaaggggccatggaaacgcctagaacaggtgcgaggggcttctggtgcttccagaaacatgtgtcggggggacaca

SEQ ID NO: 29307 - DNA, 520 bp, Bovine  19866881411263
gggagtcgggggaggggacaggcagagctgggaatcccgcgctcacctggatagcgttggtcacgttccagcctgcctcccatgccgtgatcttaggtttgtcgtggcctccgaactcgccaccagctcctagggactggtccttggagcccgagggcggcaggggcgcgccaccgccgcgctggtaatggatgtctccctcgacgggtggttcggcgccctcgtccccgcagggctcgccctcgcttttcaggatgtccatctgcaagccctgacggtgctcaaagtcgaggtcgtcgcagtgcgcgaagcccaccgcttcctcgtcggtggccgcctgaaaacccatcctggcgaacatgccgctcaccttggcctgggacttgttggacacggatgtggccacattggacagcttgctgcggagcagggtggccatggcggcggtggggcccgaggagaggacaccagggaccggggacccgggggacgcgcggccaggcggcgagggccagggggg

SEQ ID NO: 29308 - DNA, 883 bp, Bovine  19866881416160
ttttttttttaattaatttattttttatttgaaggataaaatttttttatagaatgttgtcattttctgtcaaacatcatataaatcagccataggtgtacaaatgtcccctcccgcaatcaatattttttaagtgaatgaataaattgatgttattgccaggactggctggggctcttgcaattcatcctgtaacccagatcccaggcctgcctcatgtttccttgcacaaacccagacttaggtcctgacccaactgcatgctactgcagggtgattggtggattcctacacccatcctggtatgtgggagggacgaaggaggtgcaggccttaagggtggggaccccaccaaagggtatgggtagaagctccctggaaattagtcacacttgggggcagggagtcagggctgcccctggcccatttctatcttgttgatgtggaattggagaaaatgctgatttttttttttttttttttttgagcactggagacagagagcaatctgggttgctatgcaaccagtgcctgtgcccagctgataacaccagaggaattaactgtccttgtcccgcacaggctctggaggaggcggctgatgctgcctcccagcaccctagcctcagccccacaccagctcagtttctggcccagctatggatgggggagtctggcctctctcttgcttcacaaagagcaaccaggggagtcccttgcctcgtgccaaggaggagggcattgcagagtgtaaggagggggctgcgtgggggtctcttggacacagggcatccttgtcttctttgatctgctaatgagctgtgaattaaagacaaccacaaactcagagggaggctggaaagagggcaaggcttgtgagggc

SEQ ID NO: 29309 - DNA, 818 bp, Bovine  19866881418660
tcagtcctactgctggagaaaaccatacaactatggagactgggttcattagacatttatgatttccatatctatttaatgtcctaaccctctgctgagctgtagctggagaacttctcttttccccatagtacctactcctaacatcatgattgtcccttgagccccaagctgttctttattgggaaaggtcccagtgcctacattcagatgtctcaattttggacggatgccaatagactgccccagaacccactggaaatgtaggagtgagaagatagcgaaagtaccaggttttggggtgtattcatagaggtgatgataaggacctgatttactgaagagaaacgcagcaaggagactgagatagaagttggacattttcttctagagcatgtgaaatgcttccttttttttgatgctctcagttttccaagaattctaggctcagtggcttttcaagtgttaacacacactctctccagcctgtgcctctgcctttaattactctactgactgcagacactacctggagccaggtcctggctgtcgcagcttcagagggagtttattgccaaccatgcattgtagggactaattgtgagccccgtgcacctgctggtgccccctgtggcagggacttcagggggaagggttattaatgagcttgttgctcattataataaaacaatggggaagttggcagagggactggaggtccaggtgtggtgtcagcaaaggttagttggcatttctggaaacaggactttacagtcttatcacctacctccttctgtggctcttgctgtgacatcagt

SEQ ID NO: 29310 - DNA, 1059 bp, Bovine  19866881543413
atagtcgtgtgtgccgtaaatatttttttgaattaaactaaataaaatctaagttggcatttgaaatattatctcagagaagtggatagtccagtattgagctttctttcccccccatttataattatctcttccatactctttactgtttaaccttgttaatataaaagtttatagaagtaattgtgtatattatttctgtcctcaaggaaatttttgaaagagaacctccagaagataaacataagcagaaaaatatttggatgtccatgtgttgctttccttctcccttttttagcatgatttattcttgatttctggggtgacagtaggggaggggtcataaaaggctcgagagaagatggagaggatagttttgtttgtgtgaagtacagcctgcgtttttgatgagtttaaatgcatctgtgggaaggtcttgctggaagtgtttaaaatgtacttgagacaaaattgctctgcttcccaaggaccatccgtgatgatcatgaattgcacatccacccagcatcggtcctctatgcagagaagccgccccgctggtaagccccctcctgcccctctgctttgtcagtgctttgaaggcaaggcctcgttctggttcgtctctgggtccccagcgcctagagtccaggtgcccagtacacatttgctgactctgttctacaaagaatttctactctgtcaaggatccctgtaagccaatggtcttattcctctgcctgctgatcccctcagcaaacattcatgttcacccacagactgggtgctctgtcctcactctcggtatagctgtgcagagagaggaatccaggtcccattccacagcccgacagagaacagatggactccagtacctggggagaaaggcttccgtagagggatgtatttgataggtggctgaggttcacacttccgcgggccaggctgtaagggctggcttcggggagcagatactaatactcgctgtggaagctgatacggctgcagggtgggcatgggtatctagttccccgaccaggaagtaacccggcccccgca

SEQ ID NO: 29311 - DNA, 930 bp, Bovine  19866881700960
tggagtgggtagccgttcccttctccggggatcttcccaacccaggaatcgaacccgggtctcctgcattgcagccggattctttaacaactgagctatcagggaagcccctgacacatagtgctgaataaatgttggtcgactgaattaattaatgaaaccctacttggtcccattatatacaatctatgattggacactaacccctctcagagcctcagttactcattagtcaaagagggatgtgatcctgccctctagccagatgccttgcagattgtcaggtcctgcccactgcaggaactggttctattcacttccatacccacccccgctcctctatgcttgacacctggatttctgagagcctgggggctcagccccccagcacatgcatttattctaaaataggagaccagcacacacatcggtctgcctggtccccctccccctccccacagcttcagatggaagtggggctgagagccagccagcgacaaaggagcaatcaagagtcattatggcttatttagggtgggcttagtgattggctgagaagccccagctcgctcctcactcaagaggaagaaggtctgagcaaggcagctggaaaccagcccctcagctaattctttccagcacccagccccaaggcgggctgtgagagacaggagggtccctgaaggaagccttgtcctttaggtaggcagtgactacccccaccccctaagcctatgcacaagcatcccctgagctgaagattgcacctgtgtgatgctaacccggaagagttctaaagctaagtctggccatctatcctccaaccacatttacgatgaagtccaaactccctcccttgcactcacagccaagaagaccctgtgtgtcctgaccccagcctgccttagcattttcctgtccagcagtaaa

SEQ ID NO: 29312 - DNA, 770 bp, Bovine  19866882075752
acccgtccctgcacggccagaaagccttctcccgggtgtctcagcctcacgtccgtctatctggttgccacggtgatggcagaaacatgaacccagatgaggatgactcacttcaatttaaataaaagcattaaaagctactctttgggtctcaaagtccctggttactgggactctcccaatgagcagaccgtttctcacagttccacagttagtgctggaaccccaatcaatcaccacaggggaaaaagtccctgactctgcaagttttgagtgctggtactcgcccttctagaaaaatacaactgagatttgcagctggagggggaaatattcctaaagaagcagactagacctgactggtcattcacgccaagcttcaaagcataagcaaggtcaaggctacaggaggccaacctggactgtggccactggcttctccacttccggcgtctcctccgaaaacaggggctcgaaatcgttgatgttttccacatcttccagagatggttcgagctgctccaggtcaggagtctgagaagagaagaaacataagacagaacctgtgactcagcgagccttagctctgtgagctcatggtcaccaaaaagaactgggatctcacccagtgtcctgaacgtatgtccacacataaaaacgatgaaaagtttctaaactattaaaaaaaaaaacccaaacacacatgaacacaaggttaaaagactaaaaagccagagatgggctttgttcttaccccctaacttccccac

SEQ ID NO: 29313 - DNA, 2338 bp, Bovine  19866880458358
ctcccttggtgatcgtttctgcaggctgtgtgagaagaatatccccaacccctgatcttgaccaaaagtaaacagtactgtggatgcattccaagctatttggaaacctcactctaacataaggaccatttttcctattggagagaacactgaggagccacagatggttcaggaacacacaactgggccaagttttaacattttagtgttgccacattgggttttgttttccagtaataatgcagccaagaatcttgaaactcctgcccttggcaggaggctgcttctcagtgcttcttactcaggagagctagttttctgagtatcctttttttttttttttttcattaatacaactgtctcataatatctgcggcccaaaggtgtctgtcatactttaattttaatttgggctacttatagctcctggtaacacaaataattgaaaaacattttaatttttatcagtttctcacctttatcagggcctccctggtagctcagcagataaggaatccacctgcaatgcaggagaccccagtttgacccctgggttgggaagattccttggagaagggataggctacccactccagtattcttggacttccctgatggctcagatggtgaagaatccacctgcaatgagggagacctgggtttgatccctaggttgggaagatatgctggaggagggcatggcaagaacactggagtgttcttgcctggagaatcaccatggacagaggagcctggtgggctacagtccatggggtcacaatgagtcagacacgaccgagtgtgtatatctcatggacaggggagcctggtgggctacagtcaatggggtcacaatgagtcagacacgaccgagtgtgtatagcacatgcaccaactgcattaccaatcaccactctaatcacagaactctcactcacacagatactattcacaaagcaacctcacatacatggaatagggctgagaaatgggacacagggggaaatggcccctgaattgccaaaactcaggctcaatcagtccataaaccctacagtttgtgcacttgactcattcaataacttactggctcctcacgtggaacctgctctatgttgttatacacataatgctaacaatcctggtgaatctgacttttaggaggcctattagaaggagaagagcctggtaagagcaggaagagtgaggactgttagagacaacctcaggaaaccttacaacctgggatcgttttccatttgtgctccacagagtttaataaatgcaggagctatcagtcaccatattaaaatgtcatacacaataaatgatgtgtatggatcactgagagataaaaaagactatgattcttcttataaaataggttcccataaaaagtcaactcttttctaagtggtcttatagatgtaaagattcaggtatctataacatttacttacattgattgcctcatctcccccagatgccatatattaataatggctaacatttttttttaaacacttcttgtgtaccaaatactatcttacgtgctttaacctttacaacatgattatgaatacctgcggagagggaggtgaaaactgactaaacagagtgaggaaacctgggacatcccaacatttttgataccctggactgggaacagtgggttaacccctgttcctgggcaataaaaatcccagggcagttcttcagtctgttcattcttatttacatcctagaaatcagaagcttcaccagggtgtagatgtcttgtgctcagatggctctactgtttacgcacctttcaccggaaagatcatgggccaggagaaaccttataaaaacaaaaatgccatcaataatggtgttcggatctctggaggaggtaagaagtggtgtatgtacctggggcatatagtggagatctctgatgcttacttcatgtgtattctatacagagaagttgcattcttctttcaaaggaacaaaacctaggaactaaaggacaagggtactgtactaaaagagcccacacattttccaagatgtttcaccactttccctacagtcatcttttttatacatacactccccacctagctctatacctgactggggcactttcctcctgaggtccacatggctttgcttaatattctccaagcaaaatcactttcagcaatattagctataatgaatggatgctttcatttaccagttccacaactggaaaatgttggcatttctgcaagagtttatgtgaactgttttcaaatgttcagctgtacatgtgtctagtggtcaaagtaaagtccaaagcgtaaagaacaat

SEQ ID NO: 29314 - DNA, 1592 bp, Bovine  19866880499303
gcacgcttcctaatatgctctgcgaacacagtgtaaacagtctctgagtgtgtgagaggcaggtctgctccaggacaggctcacctttaggaagcacaggggagccaggaacttgtctgccctttgaggacagacatgggacctgaggcgatcagagccaggaagatctgactctgaaagctcttttctgaaaatggggaaacagcccaaagagggcagacatctgtttcagggctctggtcagctggccgttgctgccccttagggtaagagtggctctgattctaaagggtcaagcccaaggtccttccctgcacctgccgcagaaggagtttatcaggtttctgggcagcagaggggcatggggcaccttgagggaagatggtgtggttggcaaggagttatcctcatcatcttgtggttgtagccagttttagagttaatgaaccttaagcaattgtgtttcaccaaaccacacaaatcaccgagagatccacgccaggtgttcatccagccgttcgaccaggggaaactaggggtcagaaaacttaagttacctaaataaggagaggaattaagactatcacaaactttagttcactaaagaactttcgatgcttacagctgtccaagagagcagtaagtatagcactaagtggtgagttccttgtccctgggagtacgtaagcagcatctgggtatctgcttactgtgacaactgtggtgggcattcatgccttagaaaggctagatgacctcgagggagtcgaggatctggctttggtaggatagtgggaaggaaggtgaggggtggtgggccatacctgcgcttctcgttccaggcgttgtaccatttgatgaaccgcttggtgctctgcagcttggggtgcaggcagtgctcctgaccccggtacctggacatgctcttggtggtgatgctgaaatggaggaaggtgaggtggaggattgagaagccagaatgacagcccctccgtgtggctcccggtcaggacactgagagactgtggcctcctttcaaagcgccctacccatatgtgccctccctggttccttcataaaagtttctggttgtccccttaatctctgactccacattcaggtctagccttgtacagagtgatgggctgtcactttttctgctggagcccccagagtctgggagagtccctccccaccccccacagcactcatgcctcccttagggaacagatgtcaggggacccttccagcttctccaaacctgggatggagacgtggaaagagctaacgccagcatggtatatgtgccaagacctcattccttggatttgaggcactccatggctgggcttgaatgtgctgtggtctctgtctgatcttctaaaccctagttccctggatcctctgcagattgttctggggctgggcatttgttgaccttgaagctgtcttgttggccttgaagcccattctgactcctgagtgtgaagtcccagttatctcacccttgggaaggaaaataagactgcccttcaggtctctatccaccagtgtcccaacaccagggagatcagccacaggtagagaagcag

SEQ ID NO: 29315 - DNA, 621 bp, Bovine  19866880537494
acaactgggggaaaaaggaagaaaagcagtgattagccaacccatgaaagaatgttcatcctcattaacagtcgaggtaaagcacattaatgacttcagtattgtggcatacaatagtgaaatatttattttaaatagtaatgtctaaagctgcaaactgaggaaaggccacataaccattactagcagggtgagattcggggaaatcatatttattgaatgtatccagagtgtttcacgtaaaactatttcatccttttaatccacttcagaaaatctgttttaaaagttgacaaaggagaaatgccacatgcaaagatattctttgttaaaaacagttaacctgaaagcccaacgcaagggaattgttacctaaacaatgaaagttctaaatgaaatattatatgggtgtgaactcatgattacaggatctgaggaattccacggagtaaatgctcatgtagtacgtagagaccacataaggtcatgtaaaccctgtgattgcaagtatgtaaaacagcaaccactgtataaaacatggcaaagacagagatacaaacatcattctctttgagtggtgggacttcaggcgtcttttaaagcttctctcctgctttccaa

SEQ ID NO: 29316 - DNA, 872 bp, Bovine  19866880570030
catcgccgactcagtggacatgaatttgagagaactccaaagagatagtgagggacagggaagccggcctgctgcagtccatggggttgaaaagagtcagacacggctgaagagcaacaacaattcaattcctgtcgtgtaaaggcactgttctgggcactgcatcttccattatcctcacagcaaccttttcaggagacataatcttccctgctaggtagatggatcatggaagttcagggaacgaaaagctcaggtccaggtgtacacaaggcgagggctggatgaaaagctatgctgttgacacatggcgtcaggggctttggggagacgagtgccagccccccaccatgatgttgggaaggggcctgttagtgagtatctgagtatagagctggtgagtgcctctttccgagtcaggctgactccagactaatgcccccagtttagctctggtttctcacctgggggcacagccaccacagcacacagcccttgctgtcctcatacaagacctaggtcacctgggccatcttcagggactcttatgtgttcacttgcctggccctgattcctggttgaagtttcacgtacagcctgaattctgagcccaagtcaaccaataatgatgacaacccatgacatctctcacccctcctcccaaagcgacttctcaaaaccagccccttgaatactctctcagccgtgctgagtcctcagtctttcttttctcttccttcaaacagttcattatttgcacggagatttcgcttttctttgactttttttttcttcatatataacctgataaaagggctcccgttatttcagaatatattctgggtcctattctgtgctcaattacacaccat

SEQ ID NO: 29317 - DNA, 1939 bp, Bovine  19866880620553
ttttcactttcatgtattggagaaggaaatggcaacccactccagtgttcttgcctggagaatcccagggaccggcgagcctggtgggctgccatctatggggtctcgcagagtcggacacaactgaagcaacttagcagcagcagcagttatggggagaatatctaaataggctgagcaacactgctactgaggggctgtcatgctggcagcagcttggggtaaatggtcacaagggccactcctcctagtctggagtttcccacaaccaggatcccacacttgtaacttaaggtttcagacccatgggtctatcccttattaacctttgatatagataaatttagggactgcctttttatcacaatatcaggaaagactcttagctggacaaggttcctctcacagatgtctgaaacctcttgaagagaaagcaaagccaaccatcttcccaggtggcgctaatgataaagaacctgcctgccaatgcaagagacacaagagatatgggttcgatccctgggtcaggaagatcccctggaggagggtatggcaacccattccagtattcttacctggaaaatctgatggatagaggaacctggagggttatggtccatagggtcacaaagagttaaacacgacttaagtgacatagtatgtaccataagagaggtttacactctactcctcagacagcatcagactcattcacactagggtgtaaagacaatgataaccaatgagatcagagagtggtccctgtggggaatttcatcttaccctggtggctcagatggtaaagaatctgtgtgcaatgcgagagacctgggttgaatccctggatcgggaagatccactggagaagtgaatggctatccactctagtattctttcctggagaatcccatagacagaggagcctggtgggctacagtccattgggtagcaaagggtcagacatgactgaacagtttcccttttctgtggctgctcaggagattctgctgagtgcttaggtcagcaataagctcactttctttgaaacccagcccaccacctactcgcaggcccatatataaaggtgctcatcaaaacctcagctgtctatgtcaatgcaccaaccatgtgcatggtgggggcttgagcagctctcctgagttttctcagtgaatgtgctcggtcctgcactgatcctccctgaggaggatcctgagggatgccctggagtagggggctagcgaagactgaaggtgacttttccctgtaggaaacagcctctaccttaaggaaaggaggacagtttggtcaaaatgtcttctcagcactgagaattgtgtttcaaagtggaaacaggccacttggtgacaaggggcccaagctatgtctaccacaaagccttggagaacagactctgggagactggcacagttaacagtgctaggaattaaagaataaatcttgacaggcatctatgagaaccaagtaaatgccaggagacacaaagaaggagtcatgcagcccagggaaacgggattgcacgagggcaagggcgcaaagctatgccctggtcaagtcagctctgtaacccagggccacggcttcactggggcacagtttcctaattacaggtgtgattgattccaagcaagaaaaggcagtgttatccaagttgaaagttttctttcaggaggtattagcacagaacggatggattagtaatttaagaaatttgctttttcctacaagtgcatttgtatgccaactctcccatatccaaacctttcatacttcccctggagctcttgagagagtcctgagaggtgaagtcacctccgccagccatagcttcctggacaccctcctgggcagcagcccattcagcagctccggtgcagtgtctgtgtcagtccatgaaggggtggtggctcagccaagt

SEQ ID NO: 29318 - DNA, 698 bp, Bovine  19866880635154
ggaagaacaccagaggaggggccacagagatggagaccagagattcaggccttggctgcattcccaaggagcctgaggcatccaggtaaggaaaagtccagatggtcccaggcagcagaatagatacttaagacccctcctcaccttctgctggaggccctgggggactctgtgagtctccgggcacaagtctcccagtgagttcactggccccatcatggagaactgatctgatttccggaagatgcctgcctgccctttgtccccctgagcctctgggaaggctctggattcagctgaattaagaggcaggagatgatcaaggtgttgggtgcttgggcaggagtctccatggtaacagagccatctggctttcttgcctggcaccaggccttgtgacttcatgatggaatcttctctgccaggcacagaggtttcccagggggaagaggaggccaggaggaagggacctgctgaggaggctttgtcttttcacccagagtttgaagatgaagcttgatcttatcatgactcagggctgctgctgactctccaatggccgctggaggtagcatctggggggagatagtgtaaacagcattgtgcactggccacctttggctgagccccttggagagttagtggaggcagctctacctccttcagtccaggcggctggtggagggagccaggaccca

SEQ ID NO: 29319 - DNA, 3507 bp, Bovine  19866880636893
gaggatggtagaagtgggggaaatcctggaactttctgtggacccagtaacccagtaaattcaagggacagatgtcactatagaacacaggggttctatagtagtcctctggaatattttaggaagtaatgattacagcaaagtttggccccatggctggagcttcctctcctctgttcaaatacttgtctgatcaacattttgtgttcctgaaatgtccaacaagacaaagaacaaaaacagcacttgagataaacatgaggttgccattaagccacttgtggtttctttgcactttctgggctccaactctgagctcagtgcagtggagggtgtgttcatagctaagtgacaagcattattgcacaggatgagataattttttgtggcaatgctcattccaaggaaagattcctcattaaagaacttgtcaaactcactctgaggcagccaaaggacagataaaacagtcaagatatttgagtcttttctttcaccatttagaaagaagtctttccaagtttggcagagatattagatttttgaggattacagagaagtcgcatcttctgtgtagagaaaccagtcctctctaaaggcccctggtccccaagaggagtggcccggtggggaactctgttaaggtgctggtgtctctccacccacgggtcgtgcctttatatctgtccagtaattctatagaaaagccagtcattctagcaattccatgtgctaagagctttactatacttccctcaaagaaattagacttctgatgcttttataaatgtattcataaaatgtcactgctaaacctcatcaatctgctaatgtccgtccatgtctagcaaatgttgagatttctgtttccaacttaatggtgcatttacctcctaatagttgctgtccaaatttaacaactatcagggaccaaaatttctgagcctgccagaataacctcatcatatctttcctattgaattcccaaggctgtccattatatttttaagtttctgagggtccctaaaagacagctgaatagggagatgatataggtgaagagtgtcaacaggaattgagcttactaacacggagactaaagagggtaaccaagtcatagacacgtacatatggtaataactacaggtctggaacacggcactggtttgtcagggtcaataaagagaatagtgatttttcatcgtttcaccactgaagggtcggtgagttcttgttcacatggatgctctcaggtaaatctcttcccagagagctctttatcctctaagcaaggataaagctcttttgccatgccaaagagcttgtatgactgattgcactgttttccatcctttgatttcccattctgatgcataatttaggttgtctgtctgttaaaatctgagagctgagaaaataaccatcatcctcaagggctcaaaatacctctcagcagcaggtagatgggagaagtccgcatcaagagtgctgaggaactgcacaagttctagttatacaagtacaagaggggaagctgtctacctctgttacctgttaacccttgtggtccagctgtccttacaaattagtacacagacttggaaagcgagagctgtaaacaactttagactcctacctgatgtttttgcactgtgcagtgtaacagttcataactcttgcatgtagaaatattaaaatgttagtcatttccctaaacctcctttagcctcatcccaacaaaatcatctcattagaaaggaacgagagactacagcttttgaaggcccagccttgacaaagctgcaatgttgtccagagacaagacagagagaggacagtgcctccacaggtctttgtatcctcctcatctgtagctaccagagagccgaaaatgaagtgaaaggcgcttagttgcgtctgactctttgcgaccccattgactaatacagtccatggaattctgcaggccagaatactggagtgacacacgattaaataaaaatcctaaggcaatgtttaaagcattgccacagaggggaaatctgtgccaggaaatagagcattttgtgctcttctgttccaatagctgctgccctcaaatccagacagagggtccatcacatgtcaccctgctgggagaggacttacgagtgccagacgctgaccacctcgtccttagccaagtctgagccctgcaaaattctctccccatctctccacccatttcctaccagggttttttttgtttctgtctccactagaaagccagccactttgaagggaagacccaactcttacagcttgttttagctccatcacctgcagtgtccatcatcaacttgtccatagatagttccccaaagggctcataacataaatacataaggacgctatagaggtctccctttgtgaatccttgcacacaagcttttcaagagtcagttgattttttttttcccttggtctttttttttagtcagtcgattttaagttcccccttaggagaactgcctgaggctctccagtgccacgtactatagtatttcctataggtcagcagctatgctgcactgcacatgttaaataattcattcccaacatccactctatgcaataagtactattttatccccatcttacaggcgccttcactgagacacaaagggattaagaaacttgccaaaaaccacagagctgtgatttaaatccagggtctctgctgcagagactgtccatgtccacacacacacaccccagcattcccaatcacccagtcacattggcagcattacagccttcagtgctggaggtaaaggtcttagctgctgactactgaccttggaatgaatctgattcagagctttatagttagcagggcttctctagaagggaagagtcaaaatcaacatgtgattttcactactcattcctcttctttccgtagaagccctacctttataacccactattactcagcacctctttcagcccccaggacaaagagtagaatcacatggtaatgtgaaaacacgatgatcagagacaccatgtgctgagtgaacatatactccccacttcaaagaaagaagattcctgagccctgggttagagatttttaaaaagaatttttgagggagcattctgagtaatctgccacgaatttagtcaaggtcattcaaaaatgtgagacccactccagccttgtatgtttcttttggaaaacgcttgatccaaagcctgcctcagctgattcagctttgcacagcttggacactaagcccttgcttatggccactggcagcaggcagcgagtgagggtggcatttgatgagaaagactgggggttctgagtgaggagagatgctggcaacagtcgctgcatgctctcctgcagtcatggcctgcctcgtgggcttgtggctgcgaggtccccattaactgcttccacttgtgggctaagagcccagtgccactaaacacagaggggtgtcgacaagtaaaagcagg

SEQ ID NO: 29320 - DNA, 2474 bp, Bovine  19866880638926
cagattctttactgtctgagccccagcaaagcccttgttgaacaaagtgagagtcttactaagagaatttcaagccctatgaagtcagaatagatagccagatcccagcagagagcatggtcagcagtcaaatcctaggagcagttcccaactttcctgcttcctttaccttcagaaccaaaggtctgcttatgtttcacagtggcttcagtatcacaagctggcattcagggaggtgcaagaacagaggcatgtgtgcataggccactgggtagtgagctgggcttgtctgcccatgacagacaggcacctgctggcagctcactgtgtctaagtcatttctgttagatactgcagacggccagaggggaggaggagaaaggtgtgcagacgagcttcatgctctcagagcatgaaaccgaagtgtcctgagacaagggtaaggacgtggaagtgaaatcgcctgaaaatgcattttctttcaaaaagtcttaaagttctcaattccaactgtttgaaattgtgttcctattgggaacatatctttgatgttatcatggaaatcagtagacacataggatttgctctctggagttttgttttgcagccccctttgttggaatgcacatattccataaggcaaagcttttctgctgagagatcatttggaaaccttgggatccagtgctctacttagtgttggaaaaagagagataaaaatccttggctcactagtgacgtacagctggatgagaatgccaggggaaagggtgggcttccctatactccaatgggcaactgtggtaggacaggtacccaaaaaatagaaggagctgggggcaacgaggggacccagggcagggaagtgaagggctcgctaacacggcccaggatgggctctggtcttccctttgggtgaacttggcctcccccacttagttttgattggagattcagtgtaggccctgaccctcaaaagggatcccagccgatcttttctacaggctgtcgtggagtcaacttcatagcatagctgggttgagacatttctaatcgaaaaatacctctcttaagggtatgccatttctaaagaatcattttaccaaaaggaacttgagcagtgctgggcaaaattagaagcttctgttttctatgataggcatggaaactttccatactctatgtacggaaactcatatgcacgccaggggcagaaggcattgagtcagctccagccagctcagcggggctgcaggaaagccagctcctccctccagagagccaggaggcgagccctggggctgaggaaggactccctgagactctgcccacacataccacaccccaggaccactgtaccaccctgctgctgaacagctcttgacaaaccaatgatctgccctctcgtttaatccacacacctatggaataacacagacactactaccaagaaactgaggctcagtgagatggacttgcccaagaccacagaaccaaaaagagatttggacccagatctgcatggcttcaggcctgtcttctacctcttgacctaaaattccccaactcccacaccagggcctgtgctccaaggtagaagctaattgtctttaaaaagttgggtcactttcctatgacactaaatactaaagaatggcatattaaattcagatttggattgtccttaggagcttgatgattctacatatctccactctcaataagcagcctgtgattgtccctgggtaaagtatgtttctattccaaactgtgttcattcatttgacaaatgttatggagcagctactccatgccaagttctgtgtttggccctgaggttataaggattaataatataatcttcccatccttgaggaactcatagacaagtatggaatttcaacaaagggtgggagcatcagttatttacaccatgtgatcaaagggtactcgggcagcccagtgatgaggaagcactgaaatctgcctggcagggtcagggaaggcttcgtggagagggtgaccctaaacagaggatcatggaggcctgtttaaggtaaaggagctgagcattttttttaagtggagaaagcagctgcctcgttcccctgatttggatttgttcagatgtttcaatgcctcataataggtgagaattttcttaacaatagcaaaagccgcttccagaggcgaggtctggggaagggacaacaaatagcatgtcaggccacaaaaggtggcaagaagaagcccctgaagcagcccaagaaacaggccaacgggatggatgagataaggcacttatgcagaaacaggaagagcagcagaagaaactctagaagctaaaaacaaagaagggagagccccctggccaaggagcaattaagaaatctgcccaaaggtaagcttgcagactgattgggaagacagatattaatcagtcacaggaatgagggcatatgtgcaaccgagca

SEQ ID NO: 29321 - DNA, 1006 bp, Bovine  19866880651996
cctatgccttagttgaagatttcttccttcagtcacttgttcaagaatgcatttcatttgtgtgaggtagagaatctggccccaagcatggacgacaaggttaagattggggagcagaatatagttagactgaagtagcaatgatgcaatgatgtgactgagcttgcaaaaccctgatgacatggcaactctcctgtgctatttctcatcttccccaccccccctcccttcgttagaatactgatgactggctcttatatcagcatttccaataaaggaaaaagggggaaatacagacctgggcttcatggaaagtattttcactctcacaaccagaaccttaaaaaaaattatcgttttaagatctttagcttttcctacagcatcgtggtaccaaactttttgaaaagcatcatttctgaggaatgatacttcctgggacaaggtagcatagtcttcgccaagtgactcagtttgagatatatgtatacatacacattttttttttcaatgtcaagtgacccaaacttacagagaaaaagtgggcattggtatcagtttgatgtcagggttttcccatgtttgtggctttaaatacaacgtgatctgaaggcatttgaagtcatttgaggactaagctccagctctgtgtcaagatgctcctggctgtggtccttgcctctgccctgttcctctgctcttcagccagccaggggtgtttcaccttgacagggatcaggaatgctgtgtacctcatcgacaacctgcaggtaagatgcagaggcgaggcgccagtgggaaaggcagcgattgaaaatttaagtgaaatatacgaggatgaaaaacacaccactcttcacgagttcttatttctctactttctagaaagacacgtcttcaaaatgcagctgcagcaccaatgtaagtagatgctcttaagaacttttcagactgattttaatattcacatctgggatcttcacatcgaaatttctcttttgcaggc

SEQ ID NO: 29322 - DNA, 1857 bp, Bovine  19866880700929
atatatatatatatatatatatatatatatatatatatatggtgtttgctgatacagtgctgccttttcctgtaggtggccggggtgttagagctgggggctaagactaaggcttcatgcaggatccccttcttcctctatccacttgtctttttccttgttcagtctacactcttgagcgcagagccaagtattacaggcatgctcagtcatgtctgactctgtgcaaccccaaggatcatagctcaccaggctcttctgtccacgggatttcccaggcaaggatactggagtgggttgctatttcctactccaggggatcttcccgactccaggatcgaacctgcatctcttgcgtctcctacattgccaggcagattctttaccactgtgccacctgggaagcctggtgccgagtatataccactctgtttgacccctctctgtcttggtacatgctgttcctactgtatagaatagtgtttttttggagttttatggaccaaagcttccccctaaaatccatatgttgaagccctaagcaccagtatcttagaatgtggttgtatttggaaagtctttaaagaggtaattaaggttaaatgaggctttaagggtggcgtcccagtccatcatgactggtgtgatcataagccgaagagacacatggaggaaaggccctgaaagggcgcagcaggaaggcagtcatctgaaagccaaagagagaggcctcagaagaaatcaagcccatagcttgaccctgaccttctagcctccagggctatgagggaataactttgtgttatttaagccacccagtctgtgatattttgttgtgggagccctagccaactgatacatgacaatcaattatttttctatacacgaataattgtttcttatatgagatttaagtaccgaggtataccaagcaaatgtgaaagtcccctttcaaaactcctttcttgtttcacttgctgcctcagagggtaccatttcctacctttgctttctgcataggcacatttgtattattatgtaaatggcacttgcccaaggatatttttctacagcttgcattgttttcatttcacaatatcatagagatttgctctgtcagcacaaaaaaagtcttattgtttataaacagcgttttaacgtctgtgctatctccacttatttaaacatgatgatgggctatttccagcgttttcttttaatgaatgtctatgtaaaatcatatttctgcatggaattgttgtatcaaaagcatcagtgcattttattttgttttaatgttgagtttattcatttaacttctaaataggtatacagtgatatgattttaagcaggaaagcgtttaaagaaaaagcgtttacagccatcctgtcctccaaccccccacctctcaacagtacaccccttcttgtgtaccctttcaggttatttttctttttcaaatgattttacaatcaaaaaggaatacgttttcattcttcttcctctctacgtaaagacagttcaatatatacattgttctgaagcttgattttttctgcttatcattataattggaggtctttctacatcagaatatagagaccgtcctcatcctttttagaaactgcacaggttcccatggttcagacgcatcataatttatttaactagattcctattaacgctcagtttgtttttcatttcttgctgttccaaacaaggctgcaatcaatagctcatggttcatgcattttagattttgataaattgcctcccaatacactctcgatgcctttgactgtctagcagaatcagtctttgaatggcctctgcaagcttcctccccgcacactcac

SEQ ID NO: 29323 - DNA, 1517 bp, Bovine  19866880748047
tcatgcttccctcctgggtcctactgggtggtacctgtctgagagtctgtcttctgcatgcacctggacctccttgagggcagagcttgtcttcatgtgcttgatcactgcagagcctatccagggctgggtgcagaggaggccagtttcctttgagtcctgcctgctccttgggaagaggtccaggagccccatgtggaaatacacatcaatgagctggcacttggctctagacacatgccggggtagtgtcctgagcggggaagtctggcaagcttctgttctgtgtgtggaaacaactgttggctcccatgggctcagagtacatgcatacacgggggtggcccaggagccccacagcctagggatcctactaccaccaaagccttcactccccagaagtttccaggatccatctatttgtcccagactgaaatgcaggtcacgtggggtctgtcttccactccaaagtgaggtttctgtctttcactggttttgaaattccaatttgtattaagctggtaaaggagaattaaaagcagacaatttaaatttgcaacacaaagccacagaaattgccagagggccttccctttgttttggcaaaatcaggccacattgcactctgtatgtgtggtgatggcagcttcccgaggtggcaattgaggctcccagccccaaagctgggccaggctatttttcttggcaccagacacctcccgtgatttagcattcttcccaggaaattcgggtccttcttcagctcctgatgactattccagatgcgggaggtagcttgaggtgtaagcagcagagggagcaagttgacattgagcacaggcctcccccagacgccctctaccggtggcactctgcatcctagagagtagttttccctgtgggtattatccaccagtgtgaagaatcagtcttctaggaagagctctaaattaggagcaaatcaaaagtttggaagtgctttgaacctctgggttttgtgtgtctcctgcatcaggggttcagaactctgctcatgggctctgagtctggggtccaaatccgcaaaacacagtgctcggtggtggcagtctggccgcaggtttatttagaaacccaaggtagcaaaaacgtaacagtgacaacaacccttactcctaaaatctgcgacatcgggaacactgggacagtgcagagagcaggagcacaggacccactcacaggcagaaaacagccggtggttcacggatccgcccactaacacctccctggagagttatcttgttagaaaacaatccacactgctgagagtgcagcgtgttatttgtgttattttaaatgaagaagtatttctgttaaacaatataaaggatgggaacgtgaaattaatgaaaacctacaaggtgaatttgaatgctttttgttttgcattggtagccaaggtaaagtaacttattttattccaccaaatatggtcaaatacgatggaattgtcaccatcaaccattacatcttgtttt

SEQ ID NO: 29324 - DNA, 1739 bp, Bovine  19866880763034
ccctatgtgcatatcaaagctctttgctatgcgttttgtcactcggtcctcatgtcatgttgtaagggacacatttagaggacaaaatgtgccccaaacttttagtagtttggtccatgtcccatggtggtgtctgagctgactgatggtggttcagaaagacagccctgactccctgttctctgagcagaagctcacagagtcgagatctgggcattcctcacacatgtgtgttatcatggacagatgtgttatcatggacagatacactgtatggggtgtttcctggaatgcacccaaaatggggtccagcatgatcaagacctggaccctgccaactcatcttccacacagaaaccagggtgactgttttcttccaaaaaactaatctgaccatgtcactctcctgcttatttatctctttaaccatcacaaccgtcctatgagatggatgttaggctttgacatgcaggtgagaaagataagcctgaagacaccacctttactaacttgcctccagcactgtgctgttgttcagtcgctaagtcacatccaactctttgtgaccccatggactgcagcacagcaggcttccctgtccttcagtatctcccagagtttgcttaaattcatgtccattgagttgatgatgccatccaaacactcatcctctgttgcccccttctcctcctgtcctcagtctttcacagcatcagggtcttttccaataagtcggctcctctcatcctgtggccaaagtattggagctttaggctcagtccttccaatgaatttcagggttgatttcctttaggatttacttgtttgatctccttgctgtccaagagactgtcaagagtcttctccaacaccacaattcaaaagcatcaattctttggcactcagccttctttatggtccaactctcacatccatacatgactactggacaaaccatagctttgactagacagacttttgttagccaagtgatgtctctgctttttaatatgctgtctaggtccatcatagcttttcttccaaggagcaattatgttttaatttcatggctgcagtcactgtctgcagtgattttggagcccaagaaaataaaatctgtcactgtttccattgtttccccatctatttgccatgaagtgatgggaccagttgccatgatcttagtgagaaatcagcttttgttgtgttaagtcatccagtttgtgactttggtttgcagctctaggaaactaacagaggatcttattcttagagtggggagaatctgggtcatgcctacaggtgctgtcttctctcctggagattttcagtgcccatctacatatgaaagattccaagaagtctcaaagtcaggaaacctgttcaacatttttaaatctagtatttcccaaacaaacttgatcttgggatgcctttctcacaaaacaccttttagcttggtgtgaagctggggctccaagcagcatacttagagaaatactattaaatgtcaaacaggtctcctttcaggctacatgcaggaaaaaatgccttcttgatcagacctgcctgtgcttttccatcactcctgacagcccttcaccactctcatcagcagtgggaaaaaaaaaccctcaagaaatttaattaccatagaaatggctatgaaaatgccattcacagtgagcaatgaacaagatggtaatattttatatcagacagggacccacaggcaaaaa

SEQ ID NO: 29325 - DNA, 1238 bp, Bovine  19866880791830
tgtaaaacagctctgaactcatgaactgctgatggcagcctgatgaatggaaggaaatacaataaacagattccttgtcacgttgttggcttcatagcaaatatctgtgttctccctgggattacgtgaacatttgcttttctttgatttctggttgttctttttaatatttcttttgtgagagaagacgcttcaaacagttctgtaggagcccctgactctttcctttgcaagagttgtgtttaaagtttggcgcagcctccacgcatcacctgttagttgttaggggtctaattctgcaaaccatgacttcatctccctgaaggaagatagacacaatgcttcagtacaacagataggactatatgcaagacgcttggagaaggaaaaaaaagacactaagcctttggtctctgagtgaacttggaaagtagacctgtcagaggcattcacgttcagacagctgggctgtagccgagaaggctgccaaataatgctgttactcaaggctgtggggatctcgtcaagtggccctaaaatggtcgcattcctcgtggccagggtatggtgggcccaggggtgcctctgccctgcctgctgctctgaggggagagtaaggttgcatcactaggcatgtgatggagccagtaccactggccagggactggccaggagttggagccagagatactcaggtgttttaccaattagatcttaaaaagatcttagaacaggagactggcacacgagttggctagtgtaactcatcattcgacctgacccctttgcagggtctgtcactgcggaacttcaccaagctgagttgtctcagaggtgaccccccaggctctgagccccaaacctgtcccagcgttggtcattggtgacaaagttagagggggtgcagaccctggtcagggggtctgtttcttttcctgctaaccactctttgctgatttcttacagattccatttgtttcggttacagtctctgcactgtggctcctgaaactccctctgaggcaggatccaagcacagagcactgcaaaccatggagaaaagaattttcgtctgtaaatgtggtgcttgtctagttctctttctcagaatcccttttctcaaaatagacagaggcaaaaaaatttagagacacacaaaaccttctgaaatacaagatgaatcaagtgcagcaaaccctccctggtaggaaggcatgggattccattcaagtctaggt

SEQ ID NO: 29326 - DNA, 889 bp, Bovine  19866880814128
tgaacccaagggcttcctgaattaaggtaattgatagcctgtaattttcctagtgctcagctaaaagcagtccaccaagacattaggaattttaattatcagggggagggggcaggcgcatagaggaaagaaacaaacattttttccagctgtaatggtttttcctgtaacatactttaaatacctatttgaacaggcacagatgaaagtacatttcagtgttaaggaaattttacttcactgaattaccacaaaaattttcaaagcataagtttaggaagtaaggctttgtgaagataaaaagcggaaacaacaaggtgtgtgtggtggtgggagtcttgtaaaaagattttcaatggtttgggtcatttccttttgcggagactccaatttgatacaaacatgcagatcttagaatctgtttcattcaacaaagccacaacttctctaaacagctgtgggagaggcaggaggaatctgagaagacaggccatccatgtttgatgctcaggagccaggagggtgccaagaggctggcggtgttaacctttagggaacatggtcaatgagctggaattttctcactaacctaccagttagtgattcttttaccagattaacctcctaagtaagcaggtgacgtgtaacatggcataacacagagtgggctagttctgcatcaagtctttcctatgtctgagtttctataaactctttgatgttaatcagaaaacattcaagagtctttttccttcattaagtgttagttgctcagtcttgagtctttgtgaccccataggctgtagaatgccaggctcctctatccatgggatttcccaagtaagaatacggagtgggtagccattctcacctccaggagatcttccca

SEQ ID NO: 29327 - DNA, 1525 bp, Bovine  19866880924358
tgtgaggggtgaccttggagggtagggaggtgtacacatagcctgtgtgtgctcagttgtgtccgactctttgcgaccccaaggattggggcccaccaggctcctctgtccatgaaattttccaggcaagaatattggaatgggttgccacttccttctccagggaatagcctggggctaaggatttcagaatacggacttagatagacttgggtgcaactctgactttaccacagactgactatgtgacctcggatgaggcatttattctccctgagactcaatgtccttatctatgaaattcaaaggatacagtcacctaccttaaaagttcttgtgcaggtgacatgagcctaatctctgtaaatacgcttggcattatgcctggaatctacatgctagtgttagttgggagaactgcccttccatgctaatcctccaacaaggctgctgtaactcttcccccatgacaaagggtcagaaacctatagcctggaagacagacataggaaaatatagggtttgttccacaggtgaagtccagaatagtcccctttattttctcttaccactccctctgaaccctctctcccctggtactgcaacaactcatttctcatgattgccagagtcattttatccataataatctccttgcaatttaatctgagatctgataataaccactgatgtaattataattaataagaatgcttagaacatgtagagtgttttttctcctatgtttcccagaaagcagtgagaaaaaacaggcttccaggtcttgcaatcttgagcttaagtaatggctccactacccactagctgtgtgaccttgtacaagcgacttaacctccttaaaaatgagaagatgaggcagacttattgtcaattcaaccctccttccttggagagcctgggaagttccccaggctcccttgcagctaaagttatggatgggaagtaagtcccactagttggtggttctcatgggaggtttggagctgaaggaaggaactgattcctctgccaaggcatgcttggctgttttgagtctagaggcagtcaagaaagagggtcatcagcttcaggctgggagaagtcatgtgacagtagccatgttggcagctatagcagcttcctgatgtcccaccaatgtagtgggtccttatagatacagcttttatcacccctttgcatatgcagctcttaccataatcttattggcacttgatttctgatacaaaaatccccctttgctcaaaatacctagaacttatttcttgcactgaacctgacataggatgatgatactgctaattttttaggattacaaggattacgcaagctgttaaatataaaatacctgtcacagaaggagtactcagtcaacagtagtcactgatacttattataataagactgtgtaggtgttaaaatttgggggaaaccagttctgtaaattgcatcttgccgcccactgatgttagcaggatttaacacacacacaccccaccccccgcac

SEQ ID NO: 29328 - DNA, 921 bp, Bovine  19866880941092
aaacataactaaaagcatggatctgggtaagtccccaactctgttatttaccaacccatgtgattctgtctgagcaaattaatataagcctcagcttcctccccctgaaaagcagggagaaatgcattacgtctcataaggttgtagagaggattaaagtaactcaaggtgccagcccatagtaagtgctcaataaatgtcgcccttgttgttaaatcatctaatgcattttcctgaacaaatttcattatgttgcttaagctggagcacagttccaacgaaaagccaaatggcctgtgacagttttcagatgacaccccaggacatgggagatctagagaagcgggatatggcagggactgaagccgcagcagcatactgggtcctcactagctgatgtaaacatagcaaaggaacgagcattctttcccaacagaaagaaaggatgactcctattagctggagacaaaactaagtgcagacaaaattcaggtatagatatagccaagtatatagggttatcttgtacatatattttacataagaattcaaagtattttaagtatacattttaaaatagtaataagggtagttctgaattttatttaactttggttgactctttaaccctcttctcatccctggatgctaggtatgtgtatgtggaagatttggcatcataactgaaacataccttcaaatctaatgaaatatttatttaatatgtaaatatccctgtctcacgagtcactgtctgatgggaaacatttcttaaccacaacatagagatggatcccagaaataggaatgacccataaaatcactgagcaaaatgaaaggccatctttagggtttgggaaagggaaggaggggtaggaaaaaactgtatctcgagcactaggcagaagagccagtgcacat

SEQ ID NO: 29329 - DNA, 1805 bp, Bovine  19866880959584
atgacactgttccacctccaatggagcaacaactgaattcaggaaagatatccactatcggccctacacactctacactcaatgtaactatgtcaactggcacttggaaattctaaatacaacacctagattttatattaatgccatctgctgtgacacaattattaaaattacaaaacagatctaaagaatgaaaccatgcattagatatctcatcaaaaatatctaatgtgtatctaagtgctagtcaacaaaaacccgctttaagtaattatttgaatgcaagtaaggttgtgatctatttttaggaaaagaattatgtttgactgaatgcatgctcagtcgcttcgtcgtgtctgattctgcagctccagggactgtagccctccaggctcttctgtccatggaatttttcaggcaagaatactggagtgggttgccatttctttttccagggaatcttcccaacccagggatcaaacttgcatctcttgcatctcctgcactggcagggaagttctttaccactagcaccacctgggaagccctgtgtgtgtctagttcaataatatttaagaattgtagtcaatctcacaaaaaaaatcatctttaccttggacatattcagaaaacttggcttggccgttgaaatcaagcccaaagtctggatagaacaatttaccagctgcgaaagtataccacaggcagcttctgctgactcagtactactatcaacctacagagacaattaaaaatcttaatttcatgaatgtaacattagaaggttactggcaatataattatttaacagaattcaatactcaactacaaaactgtacttatcccttcaaactataaaataaatgagtattttttctctaatatacactatatttgacaaaaaaggaaaagcagagatgatgacaaatgaactttctaagcactttatactttcgaatcttgtaagattacctgaattttattaaaattattaatggcatctacatgaaggaagctgaagtttattcaattgtagctcaagtactacatctaaatctacgcaagtaacaacaaagaaacaggaaatagattgggataagaattctgaaatattcattgactgtttcagtataatgatctaacacaaatactaacaaaacttaagtcatcgcttttatgtactgcttatttttcttaccttaaagctgacatactggagatgggcagcatgctttttaatgatctgctgaatgagatcaggatgagtggagttaaaatatgaagtagctgactggttcagctcaaattcaaactttctccaaaggtcaggtatgtggaaaacttcattccatctcctacagacagaagatgcccgggctcgatctattaaaggaagatactgaaaaatgcgtaacactacgtggtgaggcaaattcccccagtccagaagagcagcacgcatgtgagtctggctgagagaagaatggcacccaagttttggctgtttcactgcaggtgaagactggagaactttattcatgaaagataaacggttcctcttcattctgtaaacagtaaacaatggtaagtgatcattttccccacattcccatcctatactttgctttaattgtatggaataacaacatcagaaaatgagaaacagtttaagacaattttcacaggaatctttcactttcatgcattgataggcactacttagcactagacatacagagataaacaggagggaaaagtcaaagcgttagtcgctcagtcatgtttgacttgcggcgacaccatgg

SEQ ID NO: 29330 - DNA, 1389 bp, Bovine  19866881041856
ttactgatcattttccatcctaaaagaatgtcttactctcaaatgttatgaaaagtataaaatagctataccctcttttcatactgttaggtataacttactgaactacctagtaatcttattgtggatttcacctcagaaacccaggccaattctattctcatagtttacttatataacaagagaatggaaaaatgatttatattctgttgtatatatttgacatttagatcgatgttttctttaaattttctctaaaggaaaaaagttcacttcagtagatcaataacatgcctactagtttatactccgtaacttaagccaggtaattatgtagagatacaatagtgagatgcacctcttaaattctgctgttgtttttttttttttccagtcagtatatttttgttgctttaatacattgactgattgattgattgccttcgctcagttgtgtccgactctttgtatctacctaccaggctcctgtgtccatgggattttccaggcaatagtactggagtggattgccatttccttctccaggggatctccccaacccagggatcgaaccgggtctcccgcattgtagatagacgatttaccgtctgagccaccagggaaatcttactttaatacataactgagattaattttgattctattcttctttttctcatttaccaaactggatgtagttttattattcccaggctctgtcttttcagttggcgtatatttatatgctgtaatgctataaaacaagatcattttgggtgtgatgatgctttcataaatttgactataaaccattctggagattaaataaaaacttagaactgtaattttatgaaatggtttctttcagaggtacttttctcacttggtaaaattttagtttttttaatcttactggctaatttttatttcccatccagtcctgtactgagcatcgtcaagaattacaggatctgctggattgaatgaagttttcatgtaaaacccaggggtgtggagttaacagcttttaggaaatacaataggcttatacttttccatgaaactcttaccagttaatagcttcagtactgtcattcatgaaacacaactctttagagaaaacacagaaaaagccaatcacataaaatcttgctaactctaaaggttgctacatgaataaaaacaatttttaattaactcagttgaaagcatcaataaaaacaatagtttccatcagttcaggcccactgatgttgattattgattacatgcatatgccagatcaccctaggtgatttttctacaaatgtgtttcaaagattgtgccatgaaccggctaagtgtacaatgatgtaaatagctaagttctatcactaagcaaataatcct

SEQ ID NO: 29331 - DNA, 667 bp, Bovine  19866881043274
ctatccatttgcccttttaatattcaaattcattaacatattaacattttttactgacattgaaaagtaaggtctagttttactaagtgctttaaaaataaggactggtttcacatttaggttacatggctaacctggaatattttctataaattaaatgagctaaatttgatgctccaaggtgtttatataaatgataagacagaaagcattttattaagaaacatggtattagcaaagatctattaaaattatcgctattctggttctcctaacaatttgagtgtatcaaatttgacaagtaaaagagaaacacgtataatcaacaattacatagtaagtcttagtaaagccttttttgatatactttccaggaaacaagaaaggcaaaggctggatgacaaatcctttcacaagtcagatgtttctaattctgtgctttcaacaaaactgaagaaataccaaactgagttagcagctgattcatcattaaagaaaggactgatggagcttaattaatagtagagtaccagtgcaggtttctcagttgtgatgaatgtacagggttatggaagatgttaacaacagtgagactaggtgagggatattcagaaattctctatacgcgctttgtaacttctataaatctaaaacaattctaaaataa

SEQ ID NO: 29332 - DNA, 1229 bp, Bovine  19866881062654
cttgttgtcacctccatgacctttggcggtgctgatgctgccatcaggttagctgggctctgaattgctgaggcccctctacctgctcagcagtcaccccgtgccccaggcaggcaccaaccgcaccaggcccccaagccaggcaaggctttggggcgaggagtaaactaagctggctcctccacctttaggaggagacttcgaagttaataaactctgttcacattgcaggttgtggtccctcttaccttgaaagtgaactcacaggcggattaaagtgaaataaaatctaccatttgagttccattctcagctgattggaaacatgcgttacctccctgtgaccgggccgtgagaagggaagttattatctttctttagagtttgtaaactctttatggctgaggcagctttaatcctgcagcgggggggaaaaagtgatccaggaataaattgctctcatttacctttgttttccaatcatacgctccagtgggaacaaaacatcctaagtgaatggatggggggagccaggtgatcctcgacagaagagtttaattattttcttctttacgcacgtgagttgaaagggctttatattgccatttggcaaggggggcttgagccacaaaaatgtgtgttcctgcagcaatgtcagcacaatcgagctgttcctatctctgcctccatttccccacgatgccagcttgtttaaggggctcagtgccagtcactggggaacaagaaagaagagatccgagaaagggcacttatgagtcaaaatcaaaccacagtccggaagggagggagaaaccgtgggatctggagttgtggaggggctctccttccccctctgatggtcctctgatcccctcggtgttacctgacacagagcttacatagagcaggtactgggcaacgccgtcaggatgccccggctctgagccaagcgctccaactgctgcaaggaaccccagctgggctgtctgcctcactttcctttaaagatgtgggggcagggggtagcgggtggggaatcttcagagtaaaagcagagacaggggcctttggagagaaagctcagccaggcagccagccacagggtttccgtaattgcttctctgagggatgaggatgctgtgatattctttcattcgttggcctcttgctcacatgggctgggaagatggacccttatgttcaccttgcttgtgggggaggtggggaga

SEQ ID NO: 29333 - DNA, 2015 bp, Bovine  19866881064760
cgatcttttgatggttggtgccaaacagattaggcttccccagaactctgtcagaacacgcaggctgcagggcagtcatggtgaacgccacctccctccatgctgttcatgatgctagaggcaccagaaagctctactgtaaccacagggggccacaacccctggcgtctcacttctgtttatgcagctaagatttgcaaacaacagcaactagcatttactgagtacttactatgtgccaggctccaaatttagcctcttctgtgtattacttcattcacatgaacaatcccataaggtagtcctattgttatattatggatgaggcaattgagggttccaaaggtgaagccaactgcccaggtaggtggcagagccaaccttcgaatcagagagtctgagcctgtgttcttaatatgctgtgctgcctcattccgtgcatatctctaggcactctcagtcttttggagggtatttaccttgaaatgctagagataaataacccacctgccaatgcaggagacataagagatatgggtttgatccctgggtcagttagaccccttggaggagggcatggtaacccactccagtattcttgcctggagaattgctaggacagagaagcctggtgggcttgtccacagggttgcatagagtcggacatgactgaagcaacttagcatgcacgcactttgaaacacagagcaagaaccctgtataagttcaccaatggcttttctttcccagagtcagaggctggtggcttctacactgaatcattgtatttgtatcatttagtgaggattaagaagtgcccgcacacagtttcatgtttcttgcgatcccaagtcggccctaaaaaacatatccaagtcttgttaggcggcttaaaagtgtaaaacaaaatcggccagcttactgaaaatgccactcccaagcacacagttctctgacatgtgtacacatgcatcttcgtggctctgcacacggtgccaccttccaaaaggctggcccacgcccaggggcacctgcaacccacacacaccaagggtggcctcctgggtggctggtgggcatcggtggttacagatactcacgttgatttgccacagatcttcctctggtaccactgcttgcagttggtgaagtacttcttgttggtcccaatgagcttctgcacagcgcacacgttggggctgaaaacaaaagctgcagtgttagcaaacggtcggcatgtcacctgcctcctcgtccttcccaccacgtgggccctcctgggtcaccagaaccttctagatacagagaagatacagtcatttcggtcagcttgggggtacattctggtcctcgtgatccagacttccatcatccctcgcaaaaatatccccccaaattcaaaaactgtcaaagtatatatcatacagtgacatcatttcatttaaacattctttgacactgacatttagtaagtataaataaaaacatcttaaaatttttaggctacatgttttatagatggaaaacaccaccttaaaaagaaagtggtgtttgctaagaacagcagcagctttgagggaggcccccagactttctttgtacccccactccgcacatgcacaggattgaacctggcctcccagcaggcatcgctggtcctgtggtccaggccccagcactctgcaggcagctccacacacagacatcctctgcatccctaggcagctgcctggctcccagacacagcctatctggtgtgcccagcctggaaactagagggcatggccaagctagctgctgtcaggacctcagaaggagacagtcactcactgaactaagtcgtttattactggggccccagtttgcgtcccactccccccagaaagccctccttcggtgccccaggtgatactcttctgcccaccgctgagctgtgtgtgatacagccattgtttgatgctgggtatagaacacaacccaaaactaatcagggtgtgtgtgacctttcagctatc

SEQ ID NO: 29334 - DNA, 1459 bp, Bovine  19866881090233
aaagtctggggtaagccagagacttagggctgcaagcttgggtttcctgatatgttttcaactcatcagggccaagtaatgatgcagctgcctgagcccacgtctcagactcaccagctgtgctcttctagcagagcacaccaaggcctatgtcttctgaagctcttccacctctttttacacctaactctgttatctgacccagatttaatgactccacaactaagagcagcaggtatatattggttaacttttctcctttattttggttcacctggtggccttgtgaaaggagcaaattttccccaagcataatttgcttcaaaaaattgagacaaataggaaatgtcaccaaaataaaagaaaaaggaaatcactgaaatgatttgatctcatctgacctttataatgtttacctgctaaaaagatgctttcaagaccagaagaaaaataggaaaaatgcatcaattactaacctcgcttttcctccctatggcttaaatcaagggggactgagttcagggtaaccttccacaactctgaagggccttatcagggattttccttatggtctgcaataagtacagtaactctgacaggtgcattttctgccagaagacaactatttgagtgaggggacaaagaaaacattaaatttctcaaagcagctcctgtggggaatcccaggaccagcaaggttgcacctgcgtggcagatccctgcagtcaggtacctgcctcgatgagaagatggagagatgtccccatgtcctcatccaggtagtcaccgggagatgttacttagagcccagtgattaaggagtagggaaacttggctgtcaatccttttaacagctgtgtctgtctccatcttccccacctttgtctggcatctctgggaccctgctgggacatgcagacctggtatcccttgccctctcaacccttcctctccccactctgcagtcattctcccacttccctcccctctctccactaccccagccagggcacagtgacaggaaaccatgcagtgactatgtaagaatgtctcctgtctacagcaaattatcccagcttgttggctgggaaatgggctccaaaatgccaactcagtcagataaaatgctgaaaaacttaaagtaggtttatgacatcacattcataagtcaacatgaaacatggttaaattcctttttttttttccccactgaatttatatgaggtattttatttgtccttatatttagtctctgcatcctgaatttagtacatctacctatggctaaaaattatctacagtctgtactttgtaaataacaaggttaaacttcatagagaaatgtcatacgtaggacgtttgagggcctcatggttttcaggtaaacctctctgtccacttctgaagttattctagtgccatctgacaatctgataagacaggtgactccaaacaagtt

SEQ ID NO: 29335 - DNA, 1008 bp, Bovine  19866881265806
ggttagactgtgcccatgcaagcatgctaaagttcataaattaaaaatgaaatctcattacaatattaataagattttaaaatattaggtatttttgctggtagttcacgatagaataaatgtcaaggaaaactctgagtcagtcaatgtagcacgatggcatctgtgatttgagagaatttacctattggagatttttgaagggagcaaggttgacattttatgcaggtcatttatcgtcttcctgcctatggattgcagtagactcttgacattcatgataggtatttcttgagacctctatgactctcctaatatcgctagaataaataatttccctcacaaaacctttttattctgaccaaaactatcacgtttacagtgtttcactttttcttctcactcatcaccagggccattttgtccttgatagctgacaatgaggaggaacattataggctctgaagtggtggccatactctggactagctgaaggattcaccctcagtgactggtttgctaagagatttgaatttatgtttcagaaatatggtgaatgcttgaatttcctgggctgctgggattgtttgtgaagagcccaaactgtgaacgttaatctacaaatatcaagcatcttcttttctttggggtgtcaaatatatcttcccctttcactctgtgctagaagacaggataataccacggcttggggaagaaaggaaatcccagaaactcaaacctgttatcaccgtaacaagcagtctacagcagggtgtctctgaactccaagaccgtgaatatctcagcacctttaggaaacgcttccttgctgtactttggtgaacagtctcagcgagctcttgagataagctaaaatgtgagtccccctgcacttggtcagtagggttgtacatacttgaaactacaacctgactcctcccctcccatagctctatgcttttgaatatttatctaaggctacctttccctatgggttatcaattttat

SEQ ID NO: 29336 - DNA, 1239 bp, Bovine  19866881370052
ctgaccctggcccctgggtatagaccagccagtgacttatagttgtatgaagtacagaatgtcatgtgtgatgggctagacaactcaaagtttagtaaaacgtaagccatcccatcctcattctaaaggccctgcctcaaacaattttcacttatttaaccccctccctcctcctaaatacctttatcgaaggatcagtattaacaatggtaagagatcaaaacagtaacaaagtggagagatttcctactctcctcctaaaaatagagtaaataagattttaaagtcttgaggatttaggaagaggaagaaagaaaaataggttgaaaaatacatctctcctcactggggagcctcttgtgcaagactgagatgctgccgcccagctttggttagtagtgtacatgggtattaattccaggtgcagcagagaagtgtccatttcagagctaataacgcctctgaaagcagaccagtaatctaaaggtggcctggagtaggtggattccatctaattcacaaatagagtctcccactcattgaaatttaaaacttcaaaatttcctgagtccttggagcaggaaatcttggaacaaagcgctttccccctctttaatgatgaaacctcaaaccacataggtagaagagagagagaagctagcaggagcgcccctcttaattgtctattcttatacgctgtttattggatcattaaagtcttacaaggacttcgtggtaactgtaattgttgaatttaaggcttgtctcagctatgtgtctcttatttccacactcgggaaagtacgtttcaagcaatctgctgacaagattcttcgtgagtgatctgtggtcccggcactagtgcaggtggcacgcgccgtcccgcacacctgttgtcaggtgacttgaccagcagcaccctgcgcactcacctcctctttccaccccaccccccagcgagagacttccctcctggccttctccactcgaagagtctacagccttctggagttaccttgggaaaaaaacaaaaacaaacaacacctcccaaccacaaagcaaacaaaaggctgatcacaaaacgagagggcagcgggggttcctgtggcccctctccagccagtccctgggacaaatccctccccgccccgccttggttccactcttgcaactatcccccaaacccccatcccactctcccagcacaccacccagacgcctacaccaccgccacctggg

SEQ ID NO: 29337 - DNA, 693 bp, Bovine  19866881958531
gagcctaaaactgccttggcttttctttcaggataaatatgctattttaggacaagtaaattaaatcaaagcttccattgagtgtcttcttcagaaacctgcctggcaccttattttggaggaatgcagttaaggcttgtttgtgaaactattggattggctgaaaagttcatttgggtttttccgttaagatgttgtggagaaatacttgaatgaaatttttggccaacctggtacaatgcatgtatttctttgtatttagaaacatgtatttaacaatctatatctatctctattttttttcctgaatatattgagctttttcaaaaatgaaggtttcaagattctgaaaaccatgccgattctaccagaatggggtagaaaatggggaccgcccaactcatgaaaatcttccaccgaccattgctgaactcgcaggaataatgtagtgatgtggaggagaaaagggatccagtgtttcttccggggattaaaagtgagtccaaaattgcaagaacttggagaaaaaggctcttgttgagtttccctttgaataaccgaggcgctttctctctgagcactaagtgttgagaggcagcatccttactgcctagaaacccaacaaagactggcttggtggctgctttgaggtttctgttccatgtagaattttaaccataaaagatacaaaga

SEQ ID NO: 29338 - DNA, 1214 bp, Bovine  19866880446483
cttctgttgccctcttctccttctatatatgtaattatactgagtctactatccatcacaatacacaattacgattttttttattttgatgagaaattttcagttattcccttaacaactttcaaatacatagttcagtattattgaaaattaaataaaatacaattaacacatgcaacaccagcatgaggttaaagtgttaagatgctttattattccagtgacagagctggttggacctgggtagctttactccataaagcttctcttaaacactgcaccacacttctctcactttcttctgggagaatggtgttgatggtgcagtcattaataaaagcaaagatatgaaaaggaggaaattcatatattcttcatatgaattcatatttctgtatttcatatgacaggatttgacatgatactcatggagttggcttaaagaggtggagaaaactccaattttgatattggaaattagccagcttcatagtgttgtgattggaataaatgagattaccacagaaggggcaaaatgtgagagagaagatgaagagcagagtcttgaggaaagtcttcatttgaaagaaaaataggcctcagagagggagtaggcacaactgctatgatttctgaagagctgagaatgcccccttgggccagacttctgcttaggccagttgctctaatggacagcattcaatttctgacccatccaacaccctctgcaaggctttgtatctggcatataggaaattttcaaaaacatttcaaaaatgttttcaagttaaattgcaaagaactaacattttctgtatgtatttgctatgggtattaggttttcataaccctacctcatcaactacttagtctcttttcatgacttttagaaaggaagaaactcatatgttcaataaaggggaacctgggagtcaactgcaggctcgtctatttctaaactgatttctatcttctaaactgtataccagagatgtgtgtctttttcattgagtcgcttgcagggcagttttattgttgtggtgacaaggattaaagaaataagaagacttaaacaggaaataataagctgtcatttttacagtcatactatcacaaaacaaagttcatatggaagaaaaaaccaatatggtgactggaaattgggttaaaactatcatcactcccatctaaacaaagtaagcaagagtagcaat

SEQ ID NO: 29339 - DNA, 2644 bp, Bovine  19866880452842
ctggaggataattgctttacatattgtgttggtttctgctgtaaaacaacgtgaatcagttataagtatacatataccccctccctcttaagcctctctcccaccaccccccatctctttcacttctaactccttcttggcatctgcttctaactcagatttacaacaaacaatagctcttatttgaggctactgctgctgctgctaagtcgcttcaatcatgtctgactctgtatgtccccatagacagcagcccaccaggctcccccatccctgggattctccaggcaagaacccactggagtgggttgccctttgcttctccaatgcatgaaagtgaaaagtgaaagtgaagtcgctcagtcatgtccgactcttagcaacccagtggactgcagcccaccaggctcctccatccatgggattttccaggcaagagtacttgagtgggttgccattgccttctccattatttgaggttatcaaaatataaaacaccaggacattaattgggataggtttgaaatctataaactattcaattatttgataaatagttgagaactactgtgcacccatatggttgtcttaagaacaaacaggatgtataatttcataattaaattaaagcatttctacttcctgttcacattctagtctttgaattcagagaaaatgtctcctcctgctgtcctagtgtttgggtcatgattataaattaccagaatttcaccttatctcttgtgaaatgaaataatttacattttatattacttgttttcatagactagtcatgtttgccagatagtggtaggtcataaaaaataaataagtagaaccaaatacctaactgcccattaaagagcaaaatactagcaaaatcaaaacagattatatttctgaaatacttagattctataattgaaatccaaacaaaaacacaaatcacataataaactattatcaaggattgggactatagtcatttgtaaaataaagtttaatatttatgcaatagatgtgtcctggaaagttatacacaaattgaatttgtctaatcaaatcatacactaatgctttttattaaaggaaattatgaatctcttactaacaaaattgtccagaggtttatactggatttgcctgaatcaaggtaaattctcaggatggcatcttttaatatattaaaagtggcaaataattggaaaggaaatatctgatgaataaattcaaaagctatatcttggagtctgctgctaagtcacttcagtcgtgtcctactctgtgcaaccccatagatggcagcccactaggctcctctgtccctgggattctccaggcaagaatactggagtatgctgccatttcctcctccaatctagacacctacaaaataaaggagcaatgtcccttgttcaatttgattcagtaaatttgtaaaataatcagttattttaaaaccatactgcactctttaagatatcaaagttatgtttccttccaagtacttcagaaaccaagtaagaacaagttttctttctataatatgcattaataacctcctctttcccaagaatatttttattgaaatacatattcatgcatacaaaattcaagatacttcattacccttatgaagtaattaatatgatacctattaatatgatattttaacatacaatttcaaaattagggtttatctaaaagagatctaaaagaataaaggatgataaaattatctagtttctgtagaaaaaaacctaatctgctaagcaataacatttaaatgtcaaaatctattattaagcaaaactttctcaaatgcttccatcaccaaaagaaactagcatgttaaaccaccaaattccaaatttgctctctatggaattcattctttttttcataacagaaactgaacacattactaccacaatgaaatatattcagtcgataaaatacttctatgctgacttcatgaaaagttatttacttgaatgaagataaagatgagaacaaatttgtccctgattaaaacgtaggaacaccaaatggcagccaacaatgtccagagagtggtttttgaaatttctgtttttcagagggtttcccaaatggctctttttgatattgcaagcagattgcttcaaagggccagccatttctctagagttcacttaaatatctgtgagcgtgatcttactgggttacatattagatgtatactgattattcagttagcttccccaggacactgtagttaaggggttatactggctttccattcaaaggcacatctaatattgaatgcagagcagaactacctttgaattcacagtcactgttagcctttttagcatgaaatgtcatgtgttgtggactttgaagatatagtgcctgaatcacatgcttttagttttcaaacaaaagaaaatgtagaattgtacaatatcacattgttcttatctaggactgaagttgagaaagtattaaaaagaaataataattaacacaaactatttaactaaactcagcagaatttcagctgcacagcagcaatctgatggcagagaccctagtataacttcatacatatttcaaaagttgttccttataatccagtcctgactcctgaaattatattaag

SEQ ID NO: 29340 - DNA, 846 bp, Bovine  19866880560400
taaaaattgtccaggtaattgtaaatgtgtagtcagggatgtatgactctattattttatataacttatctcaacctcttgtcctcagctgatagggaacagaggcttgacagttcgtggtatctgactttctcctcctagcttaacatttctttttggatgactgtctattttaagaaaatgtttactctttcagattccacctcttccccctcaccctccttgagatggtgcttggaggggatatgagaagctgatagtgatgggggagcggagcacccatatacagctttgagctgagacacccatttccacttgcgtctgcgttttcactttggtccctaccattaccaagtgtgcaagtgatgtaaggagccctacctggagaagagcacccactgcagctgagggctgaccctactacttctgactgccacctcccacttattcagtcacactgagagcttctcttagacacctatacccagtacgaaaattgccaaaaccagaaattttatacttccacatgtcaaagaaaaagatttgtgaaagcttgtgaaaaattatttatgcataggttcagttttgtagaatagtcaagacattgagcggaatcattttgtattctttatttgaagaatataatagttctatgaagttgggaaagatcaaatatttatgaaaataaggcaaggctttaatatctactgacagatgggctacatagattctaaatctactatctatgctttgttctcaccaatcttctttattccatatgaactttgtgtttacctaagggtatatcacggagaaggcaatggcaagccactccagtactcttgc

SEQ ID NO: 29341 - DNA, 1054 bp, Bovine  19866880583157
ccttttttctagatcttaaaaaatgtttttcctgcacactactaattttctttcggttacagaggtcactgtttagcagaacagaagggaagaaaattgagagcaagtattcatctacctaatgcaaagcaggcacaaaacaagattaataatcagtgttaagttctttctttctagcatatgtctccctggcctggaattccactgcagcttggtgagatactactctaaaagcagcatctattgcggtattaattgcagtgacaattatcagtgtaaaataattccttcagtattttgattatggcctattatctccacaatacttcataaacgaaatggtgttctctttagcacccaattttacatgaaacaatttgtcccaattaccctgcagagggttctttttgcttctctgccccatggagctgatttgtaagggatagctgctttaagaagaaaaaactatgattaaagtattctcacaaaacctaaatgttctgaggctaaggtgatagaataaacagcgacagtaccattctgcctgagcacatggtcatactgacctccttaatttcataattgctttagcttttcatgggtaggaagttttatttttatgggtacttcaattcaattcagttgctcagtcgtgtccgactctttgtgacctcatgaaccgcagtatgccaggcctccctgtccatcaccaactcccggagtccacccaaacccacgtccattgagttggtgatgccatccagccatctcatcctctgttgtccccttcttctcctgttctcaaactttcccagcatcagggtcttttccaatgagtcagctctttgcatcaggtggccaaagtattggagtttcagcttcaacatcagtccttccaatgaacacccaggactgatctcctttaggatggactggttggatcttcttgcagtccaagggactctcgagagtcttctccaacaccacagttcaaaagcatcaaacctttgacactcagctttttttatagtccaactctcatatccatacatga

SEQ ID NO: 29342 - DNA, 1027 bp, Bovine  19866880625885
aaatgactgtatctacctctcttcttaaatttctttgccctatcctttctcatctctctgaatcctcctctaccctttatctcacgctgcccacaatcctcttcttccttctaccaaccaacattgactttaccactactgtaatgttgccagatttagcaaataaaaatactagatgctagttaaatttaaattttacataaatcagggaatgcattttttagtatatgtatgttcaaaatattttataggacatacttatagttaagaaaaaaaatcattatttgtctgaaagttaaatttaactgggtgtcatattttatctgtcaaacatactatttcttctttatgcaatttgacactccctcctccctcatttatccaagcaattaaaagaaacattctctttgtggaatacacattgtacttttttttttttaatagtcctattaagacaatataaaaagtctttaaaaatgataacttatggattaaaacacatgagccaggaacttcttcaatgccaatgaaattaagattcacgctttgatttcctatacaaaagtcaggttagtaggcctccccatggctattttgcaaagacaatagtaattcaactccaattaagataaagataattcttttgatagaaattcaggctagattttaaaagactcaaaatccattatatgcttcatcactcttacttgaggtgaacataaaagtcactccagtgacaacctcaatgcccattccatttcagttctaatgatcatacttaacatcaaactccaagctaaattaattatacaatgttttagttatctatttctgaataacaaaccaccctaaaacttagtggtttaaaaaccaacttgtcataaatttacaatctgggctaggttcacctgaatggttgttttgttgactagcttgctggcagtctattggatggtcagattctggtagtgggttggcctgagactgggcttaggtaagaccctaaacacctggactgctccccctc

SEQ ID NO: 29343 - DNA, 3503 bp, Bovine  19866880635200
attttcctaatgctttcttcttgacaaaaacataaattgtttgatgtgacagtcccctcctgcctatgtagtctgcatgtcatattctctaaaccattgcttttgtcacccaagctagtgtatatgttcactcactcattccctaacaaatgagagctgaacgagtagattctataccttggaatcgtaattcattcctttgcttcacaactgacacccaaatgatcagaaactcttttgatgctacttttaaaatctatacagaaactaattactacttctaactatcctccttggcataagtcatggactcttgactggaaattttccaataactttctagccaacatccatgcttttatctccatctactttatagtctattctcaacaaaatagattgctagcaatcctcagatcacttctaatttgccttcattgatttcttgcttcaccaagagtcaaattcagacattttcctgtggcctacaagccctgtatcttccagccattttatcctgctgtttttctgactccatctctcatcactcttttcctatatgatttcattctagccacactactgttctaattctttctcagacacaactaacatattcctatctcaatatctttgatttgcttttccctctactggaatacctttctctcaaatattcaaacagcccattccatcaatttatgtatatgttttcacatgtcatttactttttctgtctgagagccttctttgacagttctttacaaaatgctacttcttattctttctttaattccctggtactacatttctatcttcatttaactattctgaaatgatacataattattatttattcattatttaccttccccaaatataatagaagcttattgaaaacagagatatctttcttttttctttttttttactgttgaaacttttagcatcaatagcaactagaattgtgtgtggtatatatttaatgccatatttagtacttaatggtggtcaagagagatactttacagtgttcacaatatgaatattaacacagttttaaataagggcatttatctaaacatgctatacctttcgttataaagtactgtttacaaattaaagtccaaattttgatccaaaaattatctctcaaactaagagagttctagtatatatgttcttgaaagtgagtcacatggtcatgtctgattctttgcgaccccatggaaaatagagttcatggaattctctaggccagaatactaacatgggtagttattcccttcttcaggggatcttcccaactgagggatcgaacccaggtctcccacattgcaggcagattctttaccaattgagccaccagggaagctcttcttgatcacacaccagcacaagcctactttgcttcacaaactacttaggaagtagactctttatatgttaacgtagggtttgtacattgaaaagtattcagaattataggtgtgattaatgcaaataatagtttatttaagataattacctaaataaactttctcagagaaataactcgttagtaacttttaaagaaggacgttgtttgtgtgtgctctggttagctttctgtgtagcccttcttgtagatgtttacttgaccatttcacaagggtaaccactaacacgtaaagaaaaaggaccttctactgccagtgttactatgtccaagttgttatcctctcaattcagtgttgatgaaatccaaatttagtctcgtttttgttttagaaactctctagatatttagaaataagtagaatggagctttctctcaagttttccaaatattaatgaaaacatcctgttactcataaaactataggtgtatcttgaaccaattttatatcagtcttttattttgaatgttcatagctttgactttggcacagactacaagaaatacactttataagtctcttgctcccaagtctctaaattgcacattctgaaaaactggctatttccgcgcagaacatagagattgaatgcaaggctataattcactttcaggttttctgctgatgacataaaccaccagagctcgttggtttatgaacagcaaccggacacagagattgaattatggcatgtgtcggtgatgagagataaagaattggcacccacaacccaaagataatagtttcattccatttaaatttgacatatgaaagaaaaaagatttttgtacatgtaagaaatagttcatctctataaaagttcatattttataaaagataactagcaagaacaatttaagaaaatatcaaatctatgctcaagagaacataaagtatagagatgatgtaagaaagtccataggcagatatggcattttacataactgagatgtttctgaatctgctgagaaaattgccatttctgccttatggaagaagcaccttacaaagcattacattagttcattcatggccctggcttctgaaagtgttttacttcttaacagtgtaagaaggtatttctttttatttcctgatgtatttgagaggaagaggagatgagaagcacaggcagaataagttgttttataagggtagccattaaagtaaattctgatagcattctttatttttcaagatcctgcagaggttcaggtgccaagtttttaacagtcagctctgctactaagcttataaaggctgtcatatgtaaaaagagtgtcttaatttggttttcctagagtcaatgcctgaagtaagggttctaaggcaagtattttatttgggagaaacagggaatgtggacaggggacaaaaaacagttacagtaaagagaaagcagctcctaaaggcatgaggtattaaaccatttacttcagtggctactggagcttagttccgcagggaaactctctgcagcactgcaagacagggcctctgcttaaccctacagggtgaggtggatgagtcagtcatatgtccagggcagaggtaggctgcatcagtgcccccaacaatatcagtcttagaagaacatatgttggcaattagaagtcaaggtcagagggctactgactaggcactactcatgtctgttgtagagggagttgttggggacattgctacaaagttggggagtgggggacaaagtagcttgatttccattctttgttttttcactcatcagaaatgcaattgtgagcaagtcccaatttccctttatttcagctaagaaaatggttgacacagataaattttaaggactgtccctttgcagtattttgcagacttggaatttcccatgatattaggtgattaaatattttagaacctagactataccttgaggctccaaagcctggcttagcatcaggcagtcccaccatatgacactgtctccatatcctacatgcccttctcatacctgcctcctcatatggccaatggcagaagcatccacccatgtttaaaatgattttagtctatgaatatatcacttaatac

SEQ ID NO: 29344 - DNA, 1325 bp, Bovine  19866880666534
aataatgaatgagataccgttagagtagggactctgtaggcaaacagagtagccatcatataaactggaaataattctcaaaaaagataaatatgaaaatgaaagccctttatgccctttcttttgttcttctaagtttttggtaaaacttttaataagttgttgtctggaagtaaatgtcatgtctaaagagagggaaatgggaaaggctatgggaaaggatatgggaaaatgcattaatcagggttgtatttgtaggtcatgataatcatttattagtctaaataagactgctgggtttttttcacttctagaacttatccttctaaaaacaatttttggctgaggtcaaagcccctgccaaacaatccaagatagtttccatatagcttccagagacttatgaaattcaagcatattgtcttttactagaggcaatcacatataaagtaaactatggtgagtctaccccaaacaggttttttaagctaaaaacagaattcaaatataaccaaaatgatgactctgtgaatagcagtttcccactgattacctttagcatttctctctctgatataaaagcaaaatgatttgtggaaatacagccatagattgaacactgtgatgggagatggagccatgggtgaacttgggaaaagtttctttttagcccaaatttcctgactacctctaaatttactcttattagagtgattatccaacttaaaaatatttaatttgatatttcttctttagaaaaataactgcttgaagcctggccattgtttcaaagaagaaaaatgttctctgttgaggaaagattaagcaagatgatgtgtttctacatttgtagagattaaagaagtggcaagagcacacagaagaactatacaaaaaggtcttaatgatctggacaatcacgatagtgtggacactcacctagtgccagacattttggagtgtgaactcaagtggtccttaagaagcattactacaaataaagctagtagaggtggtggaaatccagttaagctatttaaattcctaaaagatgatgctgttaaagtgcttcactcagtatgtcagcaaatttggaaaactcagcaatggcctggaaaaagtcagtttttattccaatctcaaaaaggcaattccaaagcatgttcaaactactgtataattccattcacttcacatgctagcaaagtcatactcaaaaagtccttcaagccagttttcagcagtacatgaactgagaactgccagatatacaagctagatttagtagacagtgaaaccagagatcaaattgccaatatccactg

SEQ ID NO: 29345 - DNA, 1149 bp, Bovine  19866880686753
tggaataaaggaaaattaaaggcatttagagcagagctcttacaagatgcattcacatcccttttaactgatgttatataaatgaacacaaaagaaatgactctccaaaaggcaggggaggaatacagcaggagagccaagtttggaagaaatgtggaagagggtgagtagtgctgggccatagacagggataccagaggctggcaagagagatcagaacaaagtgagcgtatatggaaggagcagtgggactctggcagagtgcgccatctcagacggtgtgtttggtactaggttatgttcagttagctgtttgtggatttacaaaattaggagaacatgcaaagttccctccaggatgaatatgtgagaggtgagaaacagattttcaggcttctagtccacactttcccttaaaattcactatgcacaaattacaagaaaaagggagtctgaaatatattgtagggtccaaagaaacatgtggcatggtcttgcttgccagggcctcagaattgtgttcctctgcaaattcttccttcagtgatacaataagcttcagacatgtatcattttccaacattgtgtcttatggtgaaataaaggcttgcttctcacattatgataatctacactgaaaataagaattgtataaaaaatcacctgaagcatacattttccctcaaaggacattatgtttctttactcatttttatgcaaattttatacaaaagaaataagatattccaaaaagcaaaaaatgatggagcaggagatctgatctggagctaggtggggtgtcatgtcttataaagaggattgtgttacattcctgttaaaacccaaaagtacatgaataataatattataaaaatacttttgttgagtgttgcctgatgattatatccaaacaagtcctttagtattgtacattagttcagttgctcagtcgtatctgactctgcaaccccaagcactgcagcaaaccaggcctccctgtccatcaacaactgccagaatctactcaaacttatgtccattaagtcagtgatgtcatacaaacatctcatcctctgttgtctccttctcccaccttcaatctttcccagcatcagggtcttttccaatggagtcagttcttcacatcag

SEQ ID NO: 29346 - DNA, 701 bp, Bovine  19866880761819
aataacttcatttattcagtcaggtaccttttaaaactgaatagatctttatcaggtgcttttggcctatcatgaatgaaatatgtatttatttaaataatgtgctcactttatttggaatagattatgtaaagaacacacttctattaatacctgcagaagaatagtacacattactgtaaatcagattcttattttgtacacaatcaggacgtgatcagaaaacatgcaaattgagaaagtattatttaataactgtatctttaacctcatttaaaaattaatccaataggcatatagccaactatctttttagttttctcacccaacttccaaaagtattttgtgttgatattttaggagtagatacacagttagacaaaccaattacttcttccttgtctgctacagataaagcataagttattaggtttattctgtatgtgacttacacagcagtttaaggaaaaaaataacttttaataaagttttgagcccatgcttgttttcccaaggtacaatatagatgttatttatagttttactgaaaaagctggtcgtgaattttcagcagttcatgtaactagctttctgcttgggaaggcaacattactttccaaaactagctaagaatttgtctctgacagcaagattttcaagaaaagatctttttccccagaaatccaaattaaacaataaca

SEQ ID NO: 29347 - DNA, 798 bp, Bovine  19866880787080
tgttagctactatgcttgtatgtcaacctttagatccactaattccctttactattcctttaacacatttttgggactattatgttttcttagtctagtcttagaatatttgatttgttcagcactggccctgtaaactgtctcatagtagtatgatagtgttactgagttattctgctgttgtgctgttctgagctctccagtaaacactgtggattatttaagcagtttttatatattacacagatttgtaaatttttatgtggctatacatatttataagtttttaaaataataattttgtttgcttgtacagttcaagcttattgggaaatatatatttatgaagttttaaaccatgttatagattatatgaatactcattttgttacatagccctgaactctcgaaaatttctttgccactaatgattgtacatttaatttatcataaatactgctaagttcaactatgtagaaattatcttttcaaataagaataacaaggattgctagatgataatttatattttgtttttagaaacatttgagaactttcagagaagaacataggatagtgataaaataatttctaattagaaatcattcaaagttgctggaaggcaggaacttttaagatgttctgtctactctgagccataagcagaatgatgagcttcattcattcatataaatatttactgtgcgcctactttacctggaagtagctatactgggggaaaaataaaagaaatacaaaagttagaaaaagatatttggcattctccagctgtttaca

SEQ ID NO: 29348 - DNA, 1294 bp, Bovine  19866880829792
ctcaataaaaattaacaaaacaaaatgaagattgatagatacacaaaaaagcatatatatttctgtatgttttttaaattattattatacaattttttaaaaaaagacttgcaacatactttggcataaacttagaacagagaaacatatatatacacacatatatatgtgtttgtgtgtatataaataataagatcatcatatataataagatcaccatataaatgcttctgtgtgtgtgtgctgtcactcagtcatgtctgactctttgcagccctgtggattgtagccacctggctcctctgtccatcgaatttttcagacaagaatgctggagtgggttgccattttcttctccaatggatctttcccacccagggattgaacctgcgtatcttgtgtctctaagcaggtggattctttaccactgtagctcctgggaaacccatatatgcttatatatgatgatgcaattcatttgccattgaatgagaccattctgagaaacatataaatacaataattttgcatagtgacaagagtatttggtacaactttgtttcaaggacgagaatttcaatataatctctagaaagtgaaagtgaagtcgctcagtcgtgtctgactctttgtgaccccacggatagtagcctaccaggctccaccgtccatgggattttccaggcaagaatactggagtgggctgccatttccttctccagggtaccttcccaacccaggaatcaaacccgggtcttctgcattgcagacagatgctttaccatcctagccaccgatcacaggtccatagaataacctcctggaaagcacctatcaggattttcagtgccttggagaaataatatatgttcattgacaagaactggttgagagtaatgattggaattactctgtcatgattctgctcttctgaggctgttcaagcattcatcaatgtaatagtacattcttaataaggatagatttgagtggaaatatatcaagacacctttgctcagttcagcaacatttctgagttatggtttaagttacgtcactccaagacgatcaaatatttattcactgtatttgaacaatctgtactccttggaaacctttctggtaaataaaaagaaagataaacataaattcatttgatgaagaataaaaaatcattgttttgaaactaaatctcaactaaacattttttaaagtcaaaacaaacttctcagcaccacgccagtagtgaaaatccatatcagactctaaatttactcctctctattctttttaa

SEQ ID NO: 29349 - DNA, 773 bp, Bovine  19866880897201
ataatttgaggttctgaattccagtgctatttctatcatttgttagcaatgtgaacttaagcaaatcattgataatatttcctcttctgtaaatgtggtcaagtaacatatctgtgtttgttatgtgtgcgcacactcagttgtgcccaactctttgtgaccccatggactgtagccagccaggctcctctatccatggaattttccaggcaagaatactggagtgggttgccatttcctcctccagaggatcttcctgacccagggatcaaacccctgtctcttatatctcctgcattggcaggcagattcttaaccactgtgccacctgggaagtggtcaaataataccttgtcagataacccttgggggccattgaaggtaacaaatgagaacaatatgtgaaaatatttctaaactataataatacataaaaatatgaatttgctgttatccaaaatatgtgcaaaaatgtgatgtgagattaggaaggaaatcctggatttgtaaaggagaagggaattgtgatacataaccaattttggctcaagtttcaggatcttataaattctattcactggggtgagcaaaataatcaccagggataaattaattattctaaaagctaaagggttcagttctagtagtcagtattgagtaaaactggggcagtatacatgtcagaacagagtgcatggaactgcattgctattgcctgttacccctcagcattccatgtgcactatagaggctttaataagcggagctaaaag

SEQ ID NO: 29350 - DNA, 1374 bp, Bovine  19866880926852
ttttccccctctggaaatggccttggaacacagtggagggctttaaaagcttatgaggccatgcctgtgctattgagtcccacagttttggttatataactgcctgaagctggaccaattggattttaaatcctggaaatgtgaattttggaagaggtacgaatactttgagttttgaaactgggtcacattgatggcaatactatagaagacaggctcttcttaaacagttctatgtatacttaaagcgtaactttcaacaaagtgtgttttcatagctctcgatatacaatgtttttatcttttttctgtgtatattctataattttcatttggacttttaaacttaatccaaggtttgtttccgtcaattcagaatagattagcactaacttcatagtcattagggtcagtcaaggactgtgctccattaatgctcactcagaaccatctgaaatgttgccagtcactgcagcacatgttggagaggaatagagaatagcaccttaaatacttaattggctaattcaagtcacaacatcatgcctacattcaagggtgtagggaaacacaatcctgttgcatcgtgaaatgaaaaaaactagaaataacagaaatattgatgagaagcactaatgtaacataccagttggaggaatttttgctcttggttgtgtcattatgagagaatgttacctgtattctttctaaattttggtatttattgtagtttgcttagtggttgaacacatgatcagtttttatgactatttcatgaacacttaaagaagatatattacatatattcaggtgtagaattgtatgtatatcaatacatattctttttacttaaagcatttagttttttaatgcatggaaaagattttttataattataaaagagaagcatatctacaaaaaattaatagccagtgcctaaatgcccaatttgtttttattattaccaatgaaatatgcatataaactaattttacaggtgggctcattgcacctgtttttcaagtgacagtccttaatgaactgtcttttttattaattagtttttattgcagtgtatttgttttacaatgttgtattagtttctactacatagcaaaatgaatcagtcacacatgtgcatatatcccctccctttggacttgcttcccattcaggtcaccaaagtgcattaagtacaattccctgtgctacgtcatatgttctcattagttatctattttatatagagtatcaatagtgcagcaaatagagtttagaaaaggctaaggattgaacactttcagccgtcatttcttgggttaatttttctttttcctacatgtgagctacatctctgcttgtggaagcattgag

SEQ ID NO: 29351 - DNA, 777 bp, Bovine  19866880979165
tcgtgttatcaggagagaatttctgaatgctacagacctgagaactctgacagaggaagcagaggcttttagaaaggctatcacatctgcattcccttatatagatgcaggggcggggctcaccagcccagtggtgcaggggaagcaggaggataccctctgagtcctcccagatgctgtgaaatacggagaatctacggcagcacaaagtaagagcagcacctgtcagagcagcacaaacactgagctcactgagcatgtctaggatgtcccctcagaactctcagaaaccactcacaggagactttgtaggggtctgaggaagaaaatgtaaaagtaatgagtcagaaaacaacaacaacagaaatgagatattccagtaatgacccttgcaggaccccagtatatcatttattcatactaaagtacttcatgttcagaatgtgataatgtatttcagtaagtggtttatttaatgcacaggagtgaatcaagcactgaggaggtctcctaattatgaaccaccaaaaactctcgaaggtatcaagttgataagcttatgattttcattatatacacgtggacattgtcttattcaaccattgctctgaattaacaaagctatcaccagcaaatgctaagctgagattttcctttttcactccttgaaataatacatttcatgtgcctacacataactacatgcatctgttgttgcattccacataaattattttgtatccagtaacagataatatataattagtacttaaaagg

SEQ ID NO: 29352 - DNA, 881 bp, Bovine  19866881019590
ctttgctgataggaaattagtgtcactggcagagccatgttcaaggaggaaaaaagaagaagaatatgcatttctcaagcacttcatgaggaaagtacacacattctttgaaagaggcttatccatgtgtcccacaggacatgaggaaacatacctctctgcatatccccttaccagaagctatttctcctgcaaaactgcaccatctgaaaaatacaaaatgacctcacaaccagcatatataaaaatactttttaagtattactaacaagatcacacatagaaataggtgtcagctttgaccaagtaactcaaaccatgttacagagttttcctcttgaggtaactagcttcactatcggtatgaggaaactaaggaataaagtaaattccataggtcaggaacagagccaaactcgaccctgccctttagaacagatcaactccctcacttgaagttggcatattacactgaaggtaacatcatacaagtatctaataaagactttaagctattatactagagaggcttcagacaaaattcgaattgattgaaactttcctctgaaacttgaatcaaagcaagccccatttttttccctgtacttcttctcttgcactgaaggatccaaagatagcacacaaatggatgtttctcctgatacctgtggcttatcagtaagaatagaagtaatggaaatctcatgagaaagcctgctcttaaaagatttccaatccaatttttgaactcaaaaggcttgaattagtttcagattatcatccaagtctttcaaagtacatcttccaggattcagttatcaagaggacatcagatgctgaatgttaggttcaatttttgggcaagaggtagatacaggcaa

SEQ ID NO: 29353 - DNA, 1552 bp, Bovine  19866881088396
agtctagaatagtgtctgctgccactagatacactttaatatctaacaatattcttctgtttgctttcagtgcatattttcagtaatgaaatatttttggattatatttttaacacatagcatattggattagtgtcatcagggaaatgacacctaaactcttttcctgatctgacgttgtacatatgcattcttactatacttcaggactcatattgtcttacacttgaaagctttcaaatttctctgccatttttctaaccacttatccaggctcacaaaatcttcctagtttatagtcattaacttgatattttgctacccatctagaagtttagtattatcttcaaaattatgaatcttattatatatttcctttatatgtcatttatatagatattaaatgtgactgggtcacaacaaaatgtcatcttgaggcccatatattcctactttttatctgtactttccatactaacccatggaaaaatgggactggaccaccagatctcttaatttcatcttatgtttttctttgtatagaactttggcaaaaactgtgtaatttatttatttctttccctttcacttcccagcccccaatgtgccagcttatttcaatttttaatattaatgatgcctgccaaattattccctccaagtctgtttcaacttagccaacattttgattattcttataccagtaagtatcatgaatccaaccagactgaaattccagttagatcaaaataaagattttcagtgcaaaagtattcctacatttgtatcataaacctttaatccttaatttggttgtagagaaatctgaacatcatgaagaatacaaagaattctaaataattttgttggatttcttctgactctccttttttaatctttttaggggcatttcttgcataccaataattttctctttctttccctcataaaggcagcaatactctaattaggaagctatttgcatttgctggatctaaatacttggtatttgtcttggtaacaaaacaaaacagaacaaaaatcagacagctcaattcagagtctttacataaacctggcaagaagacaaatttcccatttttttgcactgagtgaggaactctgccttacctgcagagatcttgtcgagacatagcaagtagctggcagagcgtatgctttgctgggtgtctttgagtatcctgtggtgcagggagtctgaatcaccctcccagcctcctgtgcatattttacagatgctgctccaggaagatccatacttcctggagtcctcagaagtgtttgaaattcagaggcttggcaaggcatactcatctgatgctttctcatttaatcttgccgaaaggggtgattcttggaaagtgtgaaaataccttaccaagctacatcaacagatgtatagtaactgaaactcattttaaatacctaaggggattcattctcttgacatacgtttaactcccattatgattaatggaagcattacatgatttacagcatgctcctgactttagagggctgatgtctgtag

SEQ ID NO: 29354 - DNA, 1633 bp, Bovine  19866881109390
aaaactaatccaattatgtaaagtttaaaaataaaatttaaaaaagaaaagaaaaaagtgaaataggggtacaggtgtagatgaagccaagtttggatattctttcacattgatcccccccaaaaaaagaaagtatagattcaatgaaggcaaaaatggataggattctaaacacaggaaaagtgaggctaagtaaaggtttagaacagggaattctagtttacctgttcacacaggcacaggtttattatctagagcatctccatacgccatttcaaatccttgagtggtgggggacacaacagggaataaatgtggcttgtctaggaaaatgacaggagtcttgaaatattggaaaagatagaaacaaataaatcatccagataaaataaataagcagtattgtttgccagacctggaacaagatgccagattactgttccaacaatgtcatgttttctgtcttctcccatatataagcatcatgatttctgtcttaatcaattctggtgctgtaacaaataccatagactgagtgacttaaacatcaaacatttatgtcacacagttctggaggctggaaaattcaacatcagtactcagcagaatagatggctgaagagaacactcttcctggtttactggtggccattttctcttggtacacttacaggatagacagagaacactcttgtcccttcatccacttaaaaaggcactaatcccattcatgagagctccaccctcatgaacctaattatctccccaaaaattgggattggagcttcaatatatagattttgggggagatataaatattcaaaccacagcagtatcccttaccaacattgattgaattcgccttggaattttctcagaatagtgtactgataactactagataattagaattgacatagaaattgatcctattctaactaatgatggaaattgctgttttttgggttctgttttcatgctataaattagagtttttcagactgcacatccaatatatgtacatttatttatacattttatttatagccttctacattacaatcaataactactgaaatgcagaaaggaaaaaatataaataaagaatgaaatgttaacacttttcctgtatatcagtggattattttgcacatgctttgggatacatttcccccactgtaatttggaaacagctggtactgatgaggtcctctttgacaaatacaccatgatcacctattttatatatgctgtttaactctgtgaagtcagccatggaaattgttaattattgtgatttctgttagatattgatttagatattgagatttgaagctacttttaactaatgttttaggtaataaaaaattcatctgagattgaaaattttctattaaaagtagcactgacacctccttccaaaatatctcttttaaatgataccatcatgccatgatttatctaattttgctctgtgacccatgcattgagattaaattgtcctcaaagcatcttattgctacagaacacctcctttatggtcaaatacatttttagactttctatccaatctattttgcaaaatacattttttttttttctgttttgataatcttttcaggcactaacttaa

SEQ ID NO: 29355 - DNA, 655 bp, Bovine  19866881117876
aaaaacacagggcaattgacaaagaattttttttttttttttcttttgcaggggtaagctttaatcctgttcttactcagttaaagtaaacctgaattaaactaatctgaagttctcattcacttacaataatggaagaagaggtagagtaagatgagatctcctattataatttcaaagtgaccaatatttcccttgatgataacatgttttaaaagtattcatgagccaagctctccgcccaataatgtgtagagcagccttctctccttacatgatgccactctgtcaatggagagatgattaaactatgtacatctttcttcacattcattaagaagctgtgtagcataatgtacgggacacaaggcaggaagtcaggaccttggtttctgcaagaataagtgactgtcagcaaagcacttaacctctgtgaaccccagttgcctcatctataaaatgagaggcttggccagacggcatctaaggtgtctctttcacttcaatagttctttcattctataaagcaatgtatatacaaagaagtgaactgattcctttctttagataattctggccattcaactctgctcatctcaatgatataaatgtttcaagcaaaatattttgcctcacttttccatttcacttgaaa

SEQ ID NO: 29356 - DNA, 984 bp, Bovine  19866881161138
tctcctccattttagacatattttgtcattattttaaaaaaatggatcttcttacacaaactttttagtgtcttactctttctcagtgctaacgcaaaacctcccatttcaaaccacaccacataagagggagtggtgggtataaaggcacagtggccctgtagaggaaagctcatctactctttttactgatgtccttggcagcagatgtggggttgtttgaggctattctaattagtaaatttggcttccaggtatctaccactcacagtgctttttctggggactgagctcactgtttcatttatacatcaagaaaccagttaatcttgttttgactacactttccccaaaatgcctgagtcctggtgtttgggcttccccttgtctcttggctgagcccccattctctgttcctgggcttctacactatgctggacattggcagacctcttttataatcaccactttgaaagaagaggtttaattaacataatacagcctggcagtagtgaacagcatatgggaagctgaaaattcccactaagcccagcctgttcaatgtcctcagcctcactctcgatcagtgtaggggcagaaacaagtccttctggctgaagctgcaagggggcctgtctcatgcctgtgttcagtgctataatatccacacttctggcaatctatcctctccctaggttctttgcctctttcccataatgggttttcttctctttggtgcactctcagaagaataaaccaatctctcaattaacctgaaattggaaacaaacatcactactcttctttcctctttctcaaatggaaaaactgccgtaacaacaaaaacctcaagctcttgttggaagacaccagcaaagctcctgcgggtctcagttactaaactttttactcccttctagggataggcccaacaaagtctctgcaattatcacagcttacaacaacatatattatggcaatttc

SEQ ID NO: 29357 - DNA, 834 bp, Bovine  19866881213262
aataaaattatcccaggagatatctagattgattgataatattgataatattatcccaggagatatctagatttttatattatatgtaatttccattttatttccaaatattttttccaaataatttccaaatattaataatatttacacatataaatataggaactttaaatatttttttatttaataactctccccatgaaatttaaaatcaagactaaataaagatttctcttttacaaggagagacagaaaatcttttgagatcttttaggagccctatggaaaagtccaaagttagtttgaggtccaaaaagagttcattcagaatttgatttgaggaagtttgttaaaaatgtcaaaatatttaaaatacttgatcaaacaggagtataagtcactggaaaacaatacttaattatccattcaaccaaagggacaattaaaagatttcaaacagaaaactatatagttgtaaataaaattcagcttttttaatattaaaaagactcacgcttaacattgttatttattagagaaatgcaaatcaaaactaagatatcacctcacatctgtcgaaatagccatcatcaaaaagtctaaaaataaaaaactctggagaagctatggagaaaagggaaccatctacattgttggtgggaatgcatgtagaatagtatggaaattcctttaaaaactaaaaagagagttaccatatgatctggcaatttcacccctaagcgtgtatctgggaaaggcaataactaattcaaaaagatgaatgcacccccaatagtcacagcagcactatctacagtagccaggacatggaag

SEQ ID NO: 29358 - DNA, 689 bp, Bovine  19866881379636
tctaaataagagttaaaatttgtagacatgtattagttaaccccagtaagcagagagctctttaaatgcaggggccttatctttttaatggttatatgcttcatgctgccttttccataagaagtcccagttacatatttattattaaactttttaaattgttttgcaaattactattgatgttgttcatattgcatcatgaaaataacattttcttagcagcatatctatgttacctttgaagagataatacaaatcaagccttaggagaaaacacccaaaccttctgatatgacatacaatatttttcatcatatctttgcattaggataatccttacacttttaaaaagccaaaggagtatatacatgttgcaaaaatattatgtttcctcaaaaacctaatgagaaaagatagagacagatggagagttaaattagttaattttctgcccagctgcctagatgaaaaataaagatgcactgaccctatgcttctgcatgctaaactgctcaaatgtcatgtctctgttagttaaccattatgcctagattgagtggccagtatctggattagcgagactattcaatttactgtcccttttattctcagtttttaatgcaaaggaagagaaatctaaaaatagtacaaacccttgcaactgacttgcattcctgaatagtcaatat

SEQ ID NO: 29359 - DNA, 1147 bp, Bovine  19866881388006
atgaaagtatttacatttagttaaagttgaccatgactaactaaagatatttaaatatatgtattagaaatacacatgtaagggtagttttgttttcagcatccctctgaagaaattcctgtatatgtataaataagtgttatataatctgccagttttgcaagtggggtattaatgcttatattatgagtcattttaagaagtaaaaacagtgacatatttaataatatctgacaaaaatgtagccaaaaattaaagaacactttttgaagcaaagttttacataatatattatcattgattatgaataatacccaagaatatatttaattgtactctgagtcatatcaataaggaggcggtaaaatattattcactgcaactttatttcatattttcaaaatcttcttttgaatatgttaatatatatgtatatgggagatacaaaaaaggtaatggacatatgggtttaatgataaaattttgaaggcaattgatagactatagacatcagaacctcggagggctttgtgaagagacatcaggaagccttaaaacttcctgaaattgtatgcaactaagtgtatgtgctgacttgtatgtttctaaagagcgtctgcagaactgtcatgacattatcatggaaacagtgacttaattttacttaaaagcagccacatgttatcaattccttatggatttaggctgaagaatatttaaatgtattgaaaacaaatatttggtatgtgttaagatgtctggatacatttttaataaattgggtttattgcaaaaaatatgccttcatagaatgatataggttgcaaaaatacataattatggcaattggctgaaatgcgtcaaataacaggtgtgtgacaactgatagctgaaatgatatttaatagaaattcatgtggtagaatttcattttttcttttccatttagtcatcaaaaatacctgatagtataaaatgaaaacagatgaaatgaattttcacaaatttcatcttctccgtgagttcttaggaagtccagaaactattcctgtgaggataactggaatctgcagaatctgtacattacttcattctgccactgacacactgctcacggtaatggaatatgaggcaacggaaggcagtt

SEQ ID NO: 29360 - DNA, 1321 bp, Bovine  19866881428877
catgcttaatacacagtcctgtctgactttttgcaaccccatggactgtagcccaccaagctcctctgtccatgggaatctccaggcaagaatactgcagtgggttcccatttccttctccagggcatcttccgaagccaggtatagaacccaattttcttacgtcttctacattggcaggagagtaccactagtgctacctgcaaagtcccaatctaccactaaaaacaaaattatatatatatatatgtatgtatgtatatgtattttatatatatatatatatatgtatgtatatgtatacagtacagaaactctccctaattgaatacaacttttgttaaagtcagtcagatatgaaaacagagctttacatgcaatcgacagtgaatgaatctattaagaaactcaaataaaatggctgaaacattctaaaataatttctgtttttctctttcaagttgaaatatacgagatggaaagcatgagtccctaaaaggaaaagaagggaagtgaccattttatttaaaatgatttggcaaatcactttgcgaatagtgtttggaaagactctttatgtgaactcagaaagctgtgaaaatattgtatattgtaccactgaaaacgttacagacattctgaaaaataacagaaaatgaaatacaatgctatttcaatcacaaaaagttaaatataaggatttacaataatgtaacttatgtagatagttataaacacataattctaagcacatataggaacaagtataaaatattgtaattaaaacatccattaaatcacatatggacttaagagtctcactgaaattctactattaacttttaaagggtattaaagctgccagttcagctgtttaaataataggaagacttgtaattggaacatattaggtcattgtaacagaaaagcttacattttaaacctctttaatgttagtttttctggggtattccctgcatattttattaatagcaggactcttgtctgggtgttgtttcagctacacaaagtctttctagaatccatgtgaatgtatttggaaagaatccactgcaatgcgggagacctgggttccacccctgattgagaagatgccctagaggagggcatggcaacccactccagtattcttgcctgggaaatccccacggagagaggagcctggggggctacagtccacgggatcacaaagaatctgacacaactgagtgactaagaacagcacagcacaaactgcataaaggaaaatattttaaatatcttaagtcgattaacaggaagtgtgcttatcaggaaattt

SEQ ID NO: 29361 - DNA, 1040 bp, Bovine  19866881472400
tgttccgtttaaacctgtctaattatttctgtgtaagcacaattattttcacagttggttgactagagatagtacatttatatttgtgattgcagatagagataagaggaaaatacatggtatgatgcctatctttaacaatttttttttaaatgagatcaatcacaaatgattataagctaatgtatcttatttagacttccaggtaggtttttaatttttaagccaatcccttctcacagaaggatattaataaaatagattacaataagaaaattaaatattgtctgagattaaagatttgtgacaaagtaggaagtaaagagcaagaataaaaagataattcttaaagtggtaggactttaataatgatgtcccctggagatttgaatcagtagcttgtatcctcaatatacatgttaaaaataatagatgacagtgaataacaagaagttgaaatatgctgatagtatgtaattacaatacttattttggtaaaacattgagggaaatggagaattgtaagaaagtataataaactggtgattaaagaacacaaaggtaaatgaaatataataaaaagcacaaagtattacataccttaagaaataatttaaattacttgcatatcctgatggactatgcaacctttcaggatattattttggacaattcaatgaaaaagagcaatcaactacaaataaatcaatgctacaacatgttaaaagcatagctaaaaagtataacaacattaaatagatgatgattgtagcatggtttctattttagaagtattgccatttttaaaaggtgagggtcagtttcatattcttgtaacatggaaaaggttcaaacaaaggaaaatacattaataagataatggtagaagtcagttacaatacaaccagcataatgcacatctatttttctggctaatgcctggcttaaaaatatcagttcctaaagtggggggtgctaatctataaatctttataaaccatagaacagaaaaacacatataaagcagagacatttgcaaa

SEQ ID NO: 29362 - DNA, 758 bp, Bovine  19866882215355
attcctataataaataatctctctttccctctctccccctctgtctcactgtatactactgattctgttttgctgggaaccctaatataagagttctgcacaggaattttttctttacttgacccatgagctgtcagtactccatggttttacctccctgtgtggtgtcttcattgcctgccctaaccagtaaagccatttgaaattctcttcctattcagcccctgaggaagagacttgacagaaggaacaaagtttgtcagaataaacaggattgctgacctgtttccttcattaagataatctctcttcagcccttctctctcttggtcagcacagcacatgcatgtacatccacatagctgatgtgttttactttttaggtctgtacatcttattggttttgcattttttttcctcttaacataatgtaaacctacaatatgtgtaggtctgactacttctagagattaaaaaggagatattttataaatactgaaatctatactgtactaacgtgcttgatgtttttggaaaacagctcactaagctctaaaaatggcatgatgttgttttctaaaatgtattacttaaatgactattaataataacatgacaagataattaacacctgcatagcatttttcattttaagaatactttagaaatattaattgtataacctcttcaaaaccccactttgcaactagaaaaaccaaagcagaggtttaggatgacttaaaagtaaaaatatccaa

SEQ ID NO: 29363 - DNA, 3064 bp, Bovine  19866880372703
gaagatcccctggagtggtaaatgacaccctctcccgtgttcttgctggcaaaatcccatgggcagaggaggctggtgggcgatagttcgtgaggtcacagagagtcggacatgaccgagtgactgagcgcacacacacacacaaatcaaagtagaaatgttatttttggttcccctacgggcatttttaacttttagaactgattgatagtcgctggtgacactgcgtaggtgtcaaatattagagattcacgctgtgagagaggttgtcaagcgctcggtttgtactcaaggccctttgagaatgagagtgctgtctacagagtacactagggtgtacttgcaggacattggtccaggtggatggtggactcagcgtaacgcagagaaaaaacttagtaataatggaatggacctttctgaggggaattgcacttcaaataggtatggaaacctgtctcctttccctcacactcctgcctccagagacaaaattccaacactcttccattttaggatgcggagaagactaagtcacacggatgaggagaaagctaaacagagtccacgtggggaggcatataggctcagagatgtggggaatctcaccttgttaggacagtggaatgaggtctttatgatgcacttctgtgaaacttaaagtttataaggggcctttgaaagctaactgaacctttgttactgttatgatttctgttctaaatgtgtccagaagttatttttctgtttcaccatttttccttaaaaacaacatgtagcccattttcttacagaaaaatcttaagctatgtagtatttctctttttaatttgcgtaaggcaaaaatatctctatttccattacattttatagtgagtcaaaataaggttggctgtttggatgaatgcatgttaaaattttgaagggttctgattcttacttgaataatttagggtggttctgctcagaagtggaaatgaacgttaatactgttattaataaaggtttttttttagagatgaaacaatttaggtatatgtagtggaattatttgtacagatcacctgactaaaaagcatgtgtaacattttcccaaaagattccagaggaaatggaggaatttaccattaccctacttaatgccactggaggagctaaaataggaaatataactactgctactctgaggattagaagaaatgatgaccccatttattttgcaggtggtattgctttcttatttgagtgagtttatctttcttgaacagtgtaaggatgcttttttcaataattgttttaagtgaacattttcaataaagcataattgatacatgtttaaataggatttcataatttgaccattattcaatctctttgacattttaacagatatttttaaggattctgaaggaaaaattaagtactattttgttagctttgttttcctcttttaaatttcaaggtattttctttcctttggcaaaaatgaacactcttccatgttacctcttccagtacacagggaagtagtgaagacagttcagggtttgtgtattgtacttaatgaatggttacttactataattactgttaatttcatggacatataaattaacatgtaaattaaggtttccccattttttccacttgaatgctttctttacaactgtctttgccactggagacatcttttagttttatttggtatctaatttattggtatcttattcttccttaaatcattttttgcaggctgttcaatttgcaactgtagaactcgtaaacctcttgaattttatccatttatgttttaaccttcagttaacatgtacttaatgaattagtcctgtgttcagtcttctattaaccctgtagaagatgtggaaggtatctgggcctattttcaaaaaaaaatttatggtccaagtttagaaatgaattctatgaaacagtaagcagaggattccagatagtatacagtttactgacaaattgggagttgcagacaatggattttgtaggaatcaaggcaagaggaaagccactgactcagagtaattagaggagacctcatgcaggcattggaatcacagctgtctttcagcaaagactcagtggagggcatttcttggtggtgggcagggagaaatgtgcaatctgataatatgtagatggaatcagaaaagctcacacgttccttcttttctttgtgaatattttagagcctcgtgtagtgagggttcgggaaggtgagactgctgactttaaagttctcagaaatggatctgttgatgttccctgcaccgtccaatatgctaccatggatggggaggctactgccagagagggagactttgttcccattgaaaaaggagaaatgctcgtttttgcagttggaagtagagagcagaacatatctgtattcattacggaagatgatatcccagaaacagatgagcccttttatataatcctctttaactcaacaggtaaataaattatatttatggcagagtgttgtttcaattcttttacaagatggcattaagtacttcactgtcacctgtgaatgttcaagagcaaaattgtttcactgatttcttgagggaaggggtaaaagaatacatgtgttgaaactttgtgtacgtggtatacgctatgtcattatttttaatcttttttcacaaatagcacacacagaaaattatgttattatatgaggaattgaaatcttctagctgaaactacccgaagtctttcctagtcactcaaggacttagggcgttattatcctgtagacttttccctcctaccagggcaccgggcatagtggttgggaagctgtattctgcaggtgactgagcccaactgactgataattctctgtagccataatcacagtgtgtgacagtttgcaagggggaaagatagacttttccctcttctctatactgtaactgaagcagaatgttttgcccctatctttagtaaactagaggggctatagcttcttttggtaattgttttattcttttaagagtacacagagctattttttccttaa

SEQ ID NO: 29364 - DNA, 1285 bp, Bovine  19866880385178
gccagttttcattccaatcccaaagaaaggcaatgccaaagaatgttcaaactacccacacaactgcagtcatcttatttgctaggaagggtacctacatgccgcatatttggaaataggaaccctagaaaagtgaagtcgctcagtcgtgcccgactctttacgaccccatggactgtagcctatcaggctcctctgtccatgggattctacaggcaagaatactggagtgggttgccatttccttctccaggggatcttccctgacccagggatcaaacccagatctcccgcattgcgggcagatgctttaacctctgagccaccagggatctagtcctaattatgcctttaactaagccactcaatcagctagtattttaattttttttgaccctaaaatctgcggtgaggtggtattagacaggtgattgctaatttcaatctccctcttggtttcaaatttctataattctaataatccttcatgtgctttataaatctctgatgcagatggtgagttgcacgttgctgatgagatggtttgaccttgcaggctgaacgaataattgccaacatttgttgagggtttaccaagtgccaggtgtaaagagttgcacctcacacaaactcattcatttaatccttcccacagccttcttaggtaagaattaataatcctattttataaacaaggaggcagataacttactcagatgttgacctcagtttgtgcttagaagtgttatgtgggagtagattcctcatttctaacatttctccaattcacacgcaaattcttaagaggttaacatctcatggagcgcttcaacgttaaaagccatgcccttttaggaacgaaataagactcagtacatgagttttctctgcggaaagaaaaccagcaattgcgcacagttttgtacgcagggcacagtgccccgctgcctaggtgtgcgtgattcttgtgcccaaggggacaaactagcaagctgagtccaagcggactaccataaaacacggttcgctcccgaggtctgagatgcgctgcagctgcaggatgtgcgcgttgctgcgcgccggcaggtcagctagggcgcctagctgctggaagagtccattagggacggccacggcagggtgtttccggtcgccggagggccggacctggcggcccgctgcgcagacgagggcgcttcgtcttgggcggccacccccgctccgctggtcaggtgagcgcagcccggggagccgcgtgtccgattggagcagctggaggaggccg

SEQ ID NO: 29365 - DNA, 1246 bp, Bovine  19866880450417
tgattgccttgaagcttttcttatttagattgcctcaattttggtactgcttccattttgacttataatttgttgccaaaattaatacactacccataagtattgaagagtatgcttttgggatggaaagtataacagcaagggctggcaatgtttcagtgtcaaaagagattattttattaaaggcttccctactgaacacttctaataaagatttttgtgagttactctggataatattactctgcttcctcaaccagagcctctgtttaattctccactttttttcactcaacagatacttattgagtacctattatatgcaagccactgttctatgcataacatatgggcatgtgacagcagacaaatcatataaaatctccatcttcttgaagcttacatttcagcttattgttaataatagctttggtttggcagcattttcattaatcagtaaactctaaggaaattggttattatgtacaatattggttagagaaaagcaattggtgcttcaaggttcacttttattatctttctacctgggagttatgtccagaggaactcaattgataattcttgtcacatgcctgaaacagggacacaagaaatcctacccctgtctgcctgtgcttgtctctctatatatattttctattataaatctatggtggcagaacactatcagttattctattgctgttgttatggacttaaatgaaggaaatccaggaaaagataatatactttgtctaaatattaaaagtttgtctaaaaattaaatgtgccacttgtagaaaaccacattgaaaccttccagcttgagaagcaaagttaaaccaaggtgatgaaaaaaaacttgttgtcagtttaagccatgatattatgttttaaaacatagtcaaagaagggtcccctttttaatgaggtacaagatatggattagagtttctctcattaattagttagctgtatgaggaatgacacttaaaagcaactctagggtatcagttttcattgacttactcgttttgttcagatttgctgctgtgattaatgaatttttgagcaatgatgattaggttaattttgagttcattattcaaaaccagggcttaacagatggaacactaaactgaaggtcaggaaatgtgaattccattctaggctcactgcttactttccatgcaatttgaatttcctcctgccttggtagaagtattgtggattaacattattgtga

SEQ ID NO: 29366 - DNA, 3052 bp, Bovine  19866880458262
cttatataatgagtagaagatacattctgaatagaaaaaaaaaggatgattccaactttttgagtattttaggccatttttaaaattgtggtaacataaacataagacagattttaccatttaaactatttttctgtacttcctggtagttcagatggtaaagaatctgtctacaatgcaggcagacctgggttcagttcctgggcgggagagatcccctggagaaggaatggcaactcattctagttttcctgtgtagagaatcccatggacagaggagcctggcaggctaaaatccatagggttacagagaattggacacgactgagcggctaacactttcacactatttttaggtgtacaattcagtgacacttagtatattcacagtcgttgggtaaccagccccagtatgcatatccagaactatcatcttctcaaattaaaaatctctacccattaataactttccattcctccttccgcctgtcctggtaacctctattctacttttcagtctctattcaatttgcttatcctagccatctcataagtggaatcatgtaatatttgtcctttgtgtttggtgtactttgcttagcataatgtttcttcaggttttatccatgctctagcatgtgtcagaaattcactttttttttttaattgtttttattgctgttatagttgatttataatgttgtgtttctgctgtacagcaaagtgattcagttatacatatgtatatattcttttcatgttcctttctcttgtggcttattacggatgttgaatatagtccccgtgctatacagtaggagcttgttgtttacacattctgtgcgagaatggttgcacctgctgaccccaaaccccgtcccatccctcccctgaccttcggcaaccactggtctgttctgtcttgagtctgttctgtggacgggttcgtttgtgtcatttcgattccacatgtaagtgatattatgtagtattcgtctttctagttctgatttgcttcacttaagtttgatgatgtctgagtccgtccatgttgctgcaaatgacgtaatttcactctgttttatggccgtgtagtattccatggtatgtatgcacttcatcttctctatccgttcgtttattgatggtcatttaagttgtttccatgtcttggctattgtgaataatgctgtcatgaacgtaaaggttcatgtatctttttaaattatagttttttctagacatatgctccggagtgggattgttggatcatatggcaactgtgtttttagccttttgaggaacctccttaatattttccatagcggttgcaccaacttacatttccaccagccgtggttcgctggtctcagtccgtttgcacctggccgtgggttgagaggtcagtagtggcagctttaagctccaagtcaccagtgaagatgtggatgcagaggtgaagagacgagttttataagctgttgtgggtggcctgtgtggattgagatgttttaatatgcatcctggatgcagaggtctgcagtctgaatgaatggctggactaaagctaaatattcaaaagcaccaattcaaatatggtaaagaatttttaaaaatctttaaaaaaatttttttaatgtaatgtatagctagaggaaaaagttagcctttcccttttccttttttttctcgaatcttctatttaaaattctcaactccatttcccaatttagccttgatgaggtatttgtatccatgatgcaattatatatactcagcatcacttatgggccatctcacttacttttatcctactcttctccatattttttcagacaggtttcacttaagatttatctttgtatcttttcattatttgcagacatgatgcatccacagaaaaacatctatcagattttttggaagactggttacaaaatacagactcacagaacttctagcctcccctaggcaaggatttttatttagtaaggatgggatgtaatgtagaaatttgtttgtttttttttttttttttggctaggccactcagcttacaggatcttagtttcctgactaggaattgaacccatttgccctgcattgggagctcagagtcttaaccgctggaccaccagggaagtccctagaaatctgtattttttaaagcaagcttcaaggtgatttcaacacacattgaggtttaaaaagcagtttcactgatcacagggtctagtgccttggggttgttgtaaacagaattattaaatggataaagatcctgttcaggggcatttcttttatcagacacatggttaaattagaaatgctctgatggctcagaaaagggtgaggtgaacttgatgagaatttggctgtagatatataaggtttgtgatactcttgattataaagcagagagcttcagttgaatggtgcatcctttctcaccctgttgcacccatgctgatgtgactaacacagcaatagacattttatagcacagattctgatacctgtgaaacaactttcagaaacccatgttttaggttagaggggggttcaggcaaggggatacagaaagttctgtgcgaaaaatcctagcaattcaccgtaaaagaactgaaagcacgttctctttactgcttctgggtaggcagtgtcatggttgtacctaacgaacagagatccagtgtaatggatttttaacaaatgtgagtggatatacatatgcaaatacatgccattttagcagaaccttcgcttttctgtcatagaggtaaaaccatccttgacagctgcccgtatttgtccatactggctcttcactggtaccctcagcagatcaatgggcacaagtttgaaggaaaagaaggtgattatattcgagttccagagaggttattggatgttctggatgcagaaataatggccgggagaagcacatgtgaattagtccagtttacagaatatagcagccagcagtggtttatgactggaaacaatttccatgccttaaaaataaggtaatctatcatttaaagaattacga

SEQ ID NO: 29367 - DNA, 972 bp, Bovine  19866880468265
tctttgcagatgcagaatgtgtgttaaaatatctcttgaaatgtgtcttgtttacttaaggaatacatttagcagatcatgttaattagaagtaatatctgggtaaagtctttcataatgtatctctttttaaacataaaaatcaaggggctaatttcccaagttgtgagaatggatgttccctctcattacctgtattttggattttgaggttttcttgtaagtaaaagtttacagcatccttgagtttttacagcattgcttgagttttcagcatcccttttttttttttttttaactatataataatctaggtttgcaggtgttatgtatcaagaaatggagaagttggggaaattttttgaaaaaagacattgcctactcttgaaattccttgtaaagtattattgtcatataagttgtagaaagtgtgtcctctatgtgaatacctctgaagcacaattttagatattgagaacctttctaaccactctccattttgagttttgtttttttgtgtgtatgtgtgacagatttcatataaataaaacttttttggtgcatgggtaaaaacttccaattacatctctaaaaccattttctatggtatttcagtgttaccaaaatatgtaatgttaagtttaccttaaacctcattgacctaaataaactccatgaataatagatacaattatgtagtatagcttctagatggaaaattgtcatcattttcaagagaatgaatggctctggggaaatgtacagcttaggaatgacaaaactgtcattcactcagaaaacaaaattgtggaaatgacagagttgagccctgggaatcctcaaatttgcctttaaacaataccttcttcaaactagtgattaccagtggggagaagaaagggggaaaggcaatatagggataggggactaaagtgggaactattaggtataaagtaagctacagggaatatt

SEQ ID NO: 29368 - DNA, 1327 bp, Bovine  19866880479045
ggacttccctggtggcacagtggctaagactccgtgctcccaatgcagggggcctgggttcgatccctggtcagagaactgagagttcacaggccacagggaagggctggcacagccaaatagattttaaaagtaaataaataaaaataaatattaaataaagggtgacacttaagatcaagagggactgctactaacagtcacagcaggacaccacatataaacctggaatgtcctgggctttaaaataggacatgtggtcaacccaaccatcagtgaatatttaaaacggcttttctctgtttctcataatgtttttattacattagagcgtggcaaggatcttcactttcttatttatactgagaagtggatttgttctactttcctgaaaactaatcttataggctaagtctcagctaatctgttctgaacttcattgtataatctacttctctgaaaccgagctgtaggtttcccacatatctaagtttctgtgaacccttcagaagattattttaaaatacctacagtctttcccatgatttcaacatttcttcaaagacttttagttttattttgaacaacttcaaagtttattttggaaggaaagtgtcagtttttccctaaaattctccaggttttagtagagcaatggactcacctttgggaagaactttgagtatctgactatatcagcaatttactggccaatatcaaatgatatggactaattgtccagcctctaccccatcagtcacttgcctgcctaatttatatattgacatagatatagaaatacagagacaaaaatgaaggttaattggtagacagatagatacatgtgttcttttaggcctaggtcggacaaacacacagggaatatcagttcgaatattctagattttaagagggctcctttggctacattttcaaattttaattttatttaacagggtgctatgtatttttctcctgctgtacacatttgtgtaagctttctcaaattctttggaatcaaaaaaagcaccaaagaacaatcacaaggttgtggtgaaggatgtgaaagctagggtgggctggggggttaaccaacggctagttagggacaaaaatcaaatggcatctgcaaggaatgaagaggattcctgcgcttggatcctccagtttggattatgagggggtttttttaatctatttatttaacatgactgctccagatcttagttgcagcattgagagtcctttgttgtagcatgtgggatctagttctctgaccagggatcaaaccaggccccccttcactggcagcagagagtcatagcca

SEQ ID NO: 29369 - DNA, 1579 bp, Bovine  19866880587445
tatgagtgattcaagtaattccccttcttaaattaaatttaagctagaaataatcttattacaaattctgtaccacaaaggcacatgtttaaccccatcactccaaatatatacctgtaataatgatcatggcaaaatctgcaaagccagcgtcatcctctcccttcacgatctgtgctcccccttgtgggtctgtgagaaacacgtagaagaattcctgtccctcgggatcaccatcatccagaattgcaatcgacactttacgttctctttctccatctacaaacgcaaggatgagagtctgcgctctaaaatcttcttcttcggttgcccatgtcaggttggaaatcccacggctgtcaggaaagggcagtgcgtttggttccttctgagcagatctttcaccaaaagttctgactgttacgctgacattgccagcagacccgccagttctccggacaagaacctctgcagcgttcaacgtgccattctccatttcctcttcgacgtaaacaacagggggcccaagactaaatgtcccatgaacggaggtatctgtacttacagtggctgcgttaggcttctcagacgtggcagaggtcccagcaagggtgacaaggttctcagggatgggaggtacgccagccacctccgtaaccacagcgaccacgtcggtgtctgtggaatggcagtaatctcggttgtgtcagggtgtgtggtggcagagtcggtttccagaggaagggctgtgtccactgctgtggtcacagctgtcttggcgaaagaagtatccgttcctgccaagtcatcattatccaatattgtgatcactgccacgctgaaatcttgattcaggcgtggtctccaattagcatcaaattttggcaatccttgaatttccactgaagttaaattaatgtaaaaaatttcttctatctcaggaagctcatcatcaataataattatttcaaaatcaacttcaacttggaatttttggaaaagcagctccccattctgaacaggctcaaagtcttcctggggctttgccctccctgcagctgtctgataggaaactttaataagctccccgtggaatccaaacagtctttgtacatgtaatctgatcatctgtgtatcctccgacacgatgatatttcttgaactgggcgaaaactgaaagactcccattggttcaatttcagcaacagtgaaacctgacctgggggtaaaaaaaattaaaccatgagagaactgataaaaaaacagggctaccacttgcagagagtcatctttcacacgtggaagatgctgctcatgagggcatcttaaaaatgacatgccctttcaaattccgtaaaaccctactaacttattgatgaatagaccagagcacaagaaatgaaccgacaggagctgcagtggcaggtgacaggacctaacaagtgttagcaagctgaggcgctcagaggcctctggcctgtttctccaatcaccccacagcagctctttggaaggatctgaaatggcaggttctctctcacgatcagcacaccggggaccaaaatcaaagtctcacagt

SEQ ID NO: 29370 - DNA, 834 bp, Bovine  19866880591249
tctttgttctttttaataacattcttcctgtatccatttgaaagtcattacccccaaatatttccacaaaattataattttgtgcacgatttcaggtggagataaactccttatgtttgttttataatatactgcaaagtttaaaaaaaaatactgagtaatgtttatctctttcaaatggaacaattgtattagctttctacaagttagataatagcagtattttcttttacttgagtagctttcactatcattttggaagagtgatattttgtttggaacatgctatggactggatcattcatcatatatgctttataaagaaattagagtataccctaaactgagaggcaaataggtcaggatttttttgtgtatctttttggtttctattttttaatataaaacgggcagaatggtagacatgaataactcaagtagtaatttgtattactctgtatatatgaatgtataaataaattatatatatttttatatgtatataaattactctctatatatctccatctgtagagatgctcatacagacctcccagacctctcagcaggtgacctgtgctgtcattcatgattcctagatgatagttcaggtaggatttaagtttttgaagttaagatgcatctagaaaatgcgactaggaaatagtctgttaattgttaattagcaaattattaggcatgtcattattaatacacaaagcggtgtcattgtggacatttctctttcagtctaatggtggggtgtgttttaaattattctcaaagatagtttgggaagtcatctggctttaaaaaaaaattagctaactcaga

SEQ ID NO: 29371 - DNA, 1428 bp, Bovine  19866880614043
cgagacatcgcagacccagtgagcgggtccttttctttggagatggggaaggtggaatgagaagcatcattctcgttatctacccacatgatgacactgaaattgaaaagactttcattattaaacttgaacttgtgagaggagaagctcaattagactccacagctaacgatgttacattaacagtaagtctgactttatttttcccacagaatttaggctttaaaggatctttcagaaaacgtgcttacatttgttgaaactctatgggcttatgatgaattaaaagttataaaacccaatgaagtcgtagtaattcctgtgggtcagatgttctggttgttatattagtttattacataacctgattattggtaattttttaagatactgagaaatagttattttacactttttgagaaaatttgatgctttggggagatttggcacttttcaagaggaggcatttgttgtgtcataaacattggatatctttgccattaaagggtgtcagagttcacaggtaatcacaagtcagactgttgaaaggaagaatggtactttttcagtcagtgcagtgatggtgtgagtcggatctagatacagtttatttggtatgaatcacccagtccattggggcagaaaatcctggagaccaaggttaccaaaaaaaaggtagagagatgcaccttgttctaagtttggaaaagcctgttttatatggggtctgtatcaatcagatacagagaactggagaactgaaactgttaatgttgggagacagatatgaagaaagaaagacattctgtaaggaattatatcccataactgtggggctggcaagtcagaatccataaaacaggtagaaggaatccataaagcagaatccataaagccggcaggaagctcaggaacgaactgaagttgccttcttgagtctgaattttgtggcgcaggccagcaggctggaaatgcacgcaggattcctaaattgtggtcttgaggcagaattcctttttctttgggaagcctcagtgtttaaagcttccatctcattggatgaggtccatccacattactgagaatagttttattgactttgttagctggttgtcagttttaaccacatctaaaatatcattacagcaacatctggatatcatttgagcaaacagttggacactttagcctagtcaggctgacacataaaattaaccatcacggggccattacctctctccatattatcactataaatgcatcataaccagtagaaagaggttggctaaacttaactggttaaatgaggtgaacatgaggtgagtaaagctaattcaagcttttgaagttctatccttttgaggttctacaaattgtcactttctgaacacttattcccgttatccttgaggagtaagaaccttcttg

SEQ ID NO: 29372 - DNA, 2155 bp, Bovine  19866880618812
actggtgaatgaatgcttggtatgcaaatttaagaagaaataaatgctctccacttggaatttacttttcctgcttttccactaaccccctgcagtttgttttctttaaaatattactcaaaatttagccttcatttcttaaagctttctaaatgggaaatcatttgcctctaatccctttgctgttgttcagcagccctttgtacacctaagtgtaatctcaagatatttctgcttagagcctatatcgatgttgggcttactgtcctttaggaaatactgctgtcccaaaggactgggcagcaactttcagtctttcctttttcagaagttcgtgctaggccatattttgtggttcactgggcaaacataacttgggcactgactgtatctctgcatgtgtttgcaggctcgcttcttgccttttgacttttaaagcactagttgggggaacaggtttctttctgctaactgaatcttgacagatgaactcctccttgtttggaagtattttaatccttgccaaattaatttacctagttgattgactggagttaaaattcaactgcaaaatgagagcagattgttctcttccttgcgacagattcatgtccgttggagtacatcatcttcaacaaatatgaccaacacaggaggtgactctgaggattaacaaggtttggccatgtttatataactttttaagctcttattggaaaagtgctttggggaccataaaatgttgatcttaatctgtgtacgcttagaatcagaattggcttccataagttcaactttttctccaaaggcagtggggattagtaaatcgtgtttccagaaagttcaacctatatttgagaccagtttaaatgatagctgatgtgaattcagttgctccttagaacagagatcctccaactttaggatgtctcgaatcgcctggagggctggcccggggccccagaactttggaggcagcaggtctgggatgaagaccaagaccggatatttctgtgaagttctgaggcgaagtgggttctcctggcactttgagaaccactgccctgggaattgtacactctgaccagtgggactgagagcgaaaacatccgagggaagttgtgtaaacttctccagagaggttcagatgtggtcattttaaattagatctggtttttatttgttttcttatcttttgtatattgttttggaagggagttattaagggggaaaaagatggcttctaatactcatgtctagatctagtattatttgactgagtgtctatcaatgcctgcttctaaatccaacagctcccctcacaccttctccgtccatccagaacaacaacaacaaaaaaaaacaaagcaaaaatccaaactgaatgttgtctcctatcagcacttaaaaagttaacaacagcaccaagcagaatcgctcagggtcagtggagggtaaaaccagcatttggaaatgctgtgagaacacaaatagtttaaactgtagaagaggcccaaggaaattacagagggaaaactttccgtccaaggttccagttgccaaggagtttgtgtaggttgctggagacctcacccctccgtggctccctctgtgactcactgtgtccctgggaagcctcagattcagcaaccggagagaattcaaactgggcctttgatctcactgggatgaaatgcaccagggaacttggcttctaaaacatggatgtttccgatcaaatagctgatactctggttcctagaaatcagtctggttctggcccaggtgcagaggttgagatcagagaaagctgtgtcatgggcccccttgcagctgcaggagagagcagggcaggttagacacacttgggcccagtgggagatgtctgggtcggtttgatacatcagagttactcctgttatgttcttggaatccagctcccagttcccctgttttgaagttggatggctgcctacaggtagaaactcccagccatgaagtaacttttctttctggataccatcttactctttgcccgttgtacattttgcccttgctcatccaaatccagtactagccggaaacgggatatgttcattttcctttccataacaatgagggagaatacaacctaatgctgcagcacttaatcaga

SEQ ID NO: 29373 - DNA, 2337 bp, Bovine  19866880635132
caggtggcaacgagaaccctcaacccgatagtaattttggaaatctttttcgctccaagtttccatgatttattcccttccataatgatcctctgacttgatagcaggtccctcccaaacgacctatacaagggtatgcatgtagtaacgaaggaggttcaagagacagtacagggcaagagaataggtatttcaccatttcctgccacatggtgtgtctttagctatttagacgtatgaaaaacatattcccatttggtaactctttctttaattaagaggatgcctgggataccacttgcatctgcttctgttgctagattgtaactaagattataactaaatacacagcatttccctccactggagtaggaacaggattcaagagaccagagaggaccccctcagagatccatcctaagggaggacctagtatgcctaggatacatttcttggggtttgctggctcaacatataattgcctgcttcatatgaagactgcacctgagggtaaagatagaggcatcagcttccttcttccgtgtttctatatgcagagcttttacaaagtcatttctctttgactggctacagacctctctcctctgggtggagctgagctcactgaaagcagagttattttgaaaacaccacacctataattgaaaaggatttgttaaggccttttatgatctatcttttttctgtggcctcttacaccatccaaaatcaaaccagctgaatccagaacccaggtggcagctgttcaggcttggcaccccaaagcccttgggactcagggcgtgactcttcagtgagatcagatgtaacccatgaggcatctctggctactttctaattatttccattgcaaaaggccctgagttattcgatgaatcatgtcatttttattgaaacgtaaaccaagggtggtaaaagacctatggccacacacacaagaaccataggttcataactgggatccagaggaagaaaatctgtacatactcactttatattttgggttctgggcaccaggaattgtggccagaaggcacatcttctctaccacacatttcagcaagagtagggattatgatttgcttttttttagggagctatttttagctaaagatagattggtacataggcgatttttaaaaattattccttatgttccaattcccttcttataaccatttaatataataattattgattgctaggaatgttctgggcactacttcatggtcttcctatacttaatcttgctgaatcctcccaacttttctaaaagcccattgcttgattattcctgtgttacagaagaggaaacaaacccagaataattgaaatctttaatcaagaatgatttccacctcagccttctccttcccagcctcttctagctttctttctgttccaccttaatttttcggctttttcttttttttttttgtgggggtgcggagtagtgggcatgggtgtgtttgtttgttttttttttcttctttcttttctctgtcacttgcttctctgggcttcaggagcaagagttcaattttagaagcataaatgttgaactcacataagagaagacaaatacaagccaagttgaggtgaagccaggtcaacagagcaaggatttactcatgccctcccccatccctgtcctcagaagtggtctgctcactcacctaactgatgaaacaagcttgccgaggaggtcaaagtgaagacaagagcctgcaacaaaatctgccccacctcccacccacttactcagagagcaggaggctaaacatcacctctactgtgtagctgcagtttagctctcaacgctgggggccaagcatcccaaggtattggggagactcagacctgtgatatttgagccataatgtcttccacttgtataacctctttacaaggaatattctcacatgtcatctcatataatcacttacacattttattcattgaagtgtatgaagtttgagattaaagcaaggatgctattccctcaaaatagcttgagactttgattttaaacaaatcctacctttatggtccacgttaatagttttctgatgcaggttcatgaaacacagacaggacttggtggcacaaactagaactctctctgaagacatttgtgtaaagagctatgggtagttcctgcatatatgcaagtcagcagtattccactgaaatattggactccactggctgggtgtgaggcctctccctgtagccttgcagaagtctctactgattttctagatagctcatgaatgggagaggtcctcgggtgacaaggactcggaaagacttttt

SEQ ID NO: 29374 - DNA, 3489 bp, Bovine  19866880636274
aatcgagaaggacatttgttacttaagtgacccgataggaaaatgatttggacagtcttgggtgggccatactctctttcctggaaaacggcaaagaaaaggcaatgctcaaaaaatttctcagctctgtttcctgttgcttcaggaatcatctggctcttaaaaaggaagtatggtctgagattttcaggaagataacagaattatgattaatctttgttcctctggggctataaagctttcaaggccaaggatgtgtgtatataccctgattctgggtatatgacttcaggcaaggaccataatcaataaccacgtagaattaaaatccaggtttgattggtccaaagacacacagattatgtattttgctaattttagaaagaaggcccagagtaaaacagagacctgtcattttaaaacccctctaatatagtctgcacgatggataattttggaggaagtttcaagagagctgccatataagaattttaaaagaataatcagacaatccagttaccacggatgccctcagaaaggaaagttactaaaccaatgctctcatctcaggaccattcaacccaatgaacacgaccagatgtgatctataagatcaaaaccaagtgaaaggcacttggtgagtggattaaaagtataatttttaattatacttttaaataccactccttgaaaaattctttctttagttagctaaagtagcaaactgaagaacactgaagaagcaagatttctggaagaagaagagcctttgaggctgttttccgctcatatcttttcaatgtaaatttgtcctttcttgatacataaaaattcttcctaaactataactggaatctgacatagacatttttaacaagacacatgatatttacaacactaggtctaaaagctagattctcctgtaatccaagagctgggtcgccgtcagcatgtagctatcttgtaaagaaacacagcagagcttctcctatttcaatgctttccacaaaaacagagcacaaaacactgcaatccatctaaaaagtgctattacagcgccattttggaaagttagattctaagatgcatcttcctgaggagaatggatcaagaaaataaagaggctatcaggctatcaaacacgctaatatcagatatcttgttctttgtaactccctttctttaatctttgcaaaatctcactgcagacttcctgatgttcatatttgtatttgcttagagttccaagtggagcactttgatactaacttaaaaagaaggaaaagcaaagtcagaaagttccttttatagtttaggtataatctttatcaaatgatcagtgccaagatactaaatagttctcagtctatggtttggtaaaatgtttaggctatcattacatcttttatacaagaagctttataagccaaacaaatagccaattgctaatggaaattacaatgatttctcaacattcattcattataaaaataaggatgctgaatataattttcagaagtcaaatttatttaaaacatgcatttagtcagtacctcccagttaaagggttgatactcttatatctaagttaggcttggcatttatgggttccatatgggtcctttcagggcttttagattccatctcctgttctaggtgttgtattcggtacttttgcagacaatttttagtttaatcctcaagacaaatccgtaagacattgttttctccattccttcacttaaagaatatttaccaaacacctgttaaacgcaagagactgttcaaggctccagggctggagcagtgaaaaactaccatcacagaaaggtcctgccctcctggggcttactttctagtgaatactgctttttcttaattctttgtaatctaaacttgtcccatactaaattattaggaagaaattaaaaagtaaaaacttcctcttagaccacaattggaatctgatatggaggcctgagagaaaagaaaatattttaaaaacccacattcaaataaatagatattacatctgatggtgataattgccatgatggaaaataaaacaggataaagtcactatgaagttctgggaattgctaatgttatatcaaggagtcagagagatatatcttaactgagatatgagatcttttgataaacaaataagtgaaccagactagtgatcagtgaactagaactagtctctttcaaacaacaggaaaagatggtaactgactgacggtgttcttaccaacaccttgttgtccctaacaaattaatgctaagtcttgaaatggcagaatatcacccaatgaataccttactctactggaaaaaaaaaatcctatcacattatttctaaaacataaaggtcctcattgtcaccaaatgcacacaaataggtatggtgaattatttttctaattctttatcagcaggatctggaggaggactcctagaattctccctggaagggcagaacgtgacccacattagtaaaataattgcaatgagtagctgataagtcaatggatttatatgaagtatttctagacctcagacactgtattgtttctctcacagttttttccttttccctaaagcattctctcttcaaaaatgatcaaaggacactggtgattcaaaccttaaatttgtctgagggtgacatttttttctgtcctgtaagaattcaattcatttgattatggtcatccttaaatccgagtatttgcctgaacacaagctatccagtaaatacactaagtaatatttattaccagtgtgcattaatatgtagggtaacaagtgtccatgtgtggccatttgatgtagtatgcatgtatttaattaatttacttcattttagagtacttgtgattattttgtgcttttgggagttttgatagagacatccatatatctacagaaatgaactctaatataaatttcctttcattacaatgtcttcatttactcagttaccaaatagttgctgagtaagtaaagaggaactaaaaagcctcttgatgaaagtgaaagtggagagtgaaaaagtgggcttaaagctcaacattcagaaaacaaagatcatggcatccggtcccatcacttcatggcaaatagatggggaaacagtgtcagactttatttttgggggctccaaaatcactgcagatggtgactgcagccatgaaattaaaagacgcttactccttggaaggaaagttatgaccaacctagacagcatattccaaagcagagacattactttgccaacaaaggtccgtctagtcaaggctatggcttttcctgtggtcatgtatggatgtgagagttggaccgtgaagaaggctgagcgccgaagaattgatacttttgaattgtggtgttggagaagactcttgagagtcccttggattgcaaggagatccaaccagtccattctgaaggggatcagccctgggatttcttggaaggaatgat

SEQ ID NO: 29375 - DNA, 950 bp, Bovine  19866880645011
ttcccccacccatccacccctcagtgttcaattttcttttggcaattaaaagtgaagtatggctagaggctgagcagagattgctgacaaaggacatttttatgagataggagaaggctagtactaaagagctattctacaatttttcctcctggccaaagcaccctagagaaacacgtgaaaaccagcttaatcagtcttcaagtcttagtgattatttgtagctcctagttgaagaagaggcagaaaaggtttcctggaggctgtagctctgtgtgattcaaaatcacctagaggcaaccactgtgaaaccttcttgaaatattcatcaggtctctggcttgatgaaaaaagctgaaaggctcatctttatcctacacaaactgtagctgtagtatcataggctaaaatcagctttcgggtaggtttttgcttgatctgcttagtgcttttaaaaaatccaaatatttcacacaatagtttagatactcaatttttcttaaaaagtcaaaagtccttgacatagggaatgattagtcagagttgggtaatggcttccacttagaaagggcatacatttaccagttaccatagtccccagggccacacttaaatagcttttctggtctcctgtaggcatttggggtctgtgagtcttgttctataaaaattaactttacaatctccaacctgaccctgcattatctgtccatttaaatctctcactagtctcaaacgcagaacctactattaaccctgagaaactcctcattcttctgtaaatatctcatattcatttctttctcagctttcttttagtcaaatctacccctcctccagggaacaccatacgttaagccatatatttgacatttaagccaaatatatctggcccattacttttctagaactaactccttattatgtctgctaaagttttcttaattgaa

SEQ ID NO: 29376 - DNA, 1435 bp, Bovine  19866880669162
tagtaaagagccgggaaatttttttattttgatctaagttgtttcttcacttttaattatagctactattatctcattcagtcaagaaaagcctgactttgtgtaaagatttagaataatttagattaaaaaaaagtttcaacagcaacaatttgttgttgtttagttgctaaattgtgtctctgtgaatccagggactgcagcttaccaggcttccttgcccttcactatctcctggagtttgctcaaactcatgttcattgagtaggtgatgccatccaaccatcttatcctctttcaccctcttctcctactgccctcaatctttcccagcatcagggtcttttccaatgagtcagctgttcacatcaggcggccaaattattggagcttcagcttcagcatcagtcctaccaatgactattccaggttgatttcctttaggattgactgggttgatgcccttgctgtccaagggactctcaagagtcttctccagcaccaacagaaagtcaatttaaatcagaagaattgttatactcccgtaagtcactgaagacatacagatgaagaaattaataagataaacctaaacaaagtttgaaaaactgtaacatgctctagaaagaaaatgtaacattattataattaagtcaaataggaacttttaaattttactgtatatgattaatttgacggctacaggcaaaaggctaagaaatctcacagtattgccctctatttattttcctggcagtgtttggatggttttgaattccagaattgctgtgaggtcttttcattattatttttttttcttttgtttccggtgaagaaaaatatctggttttgtagtgacgtctgctgtaagagattgtttttcagaatatttcgactcatctttgggtcactgacctcaggtctgaaaactgcaagatatttcctcatgcagcttgttctttggagcacttgtctttcataactctagtttctacccccaggcattctattctggcactaaggatttaccttttcatctcaggggattttgaaagagtgtaaacttgtatcacagtatcaagcattattgtgtgcgtcttttatgaaaacttccaagttcttatttcagctcctttcttttctagaattttcatcatagccatttttattgcttcttactcttattaatagtttcctatggtggctggtgattctattgacttatttctcctttattttttcattgcttgcaaacattgaagggatcaacacaactgaggcaaggatatcagctttgaaaatgtttgcttcttccctggaacttgaaatacagtgggaagggttggcagggagtaacttactggaactgtgcaaagaaaagctctgggtgagtcaaaattatactgccagagagtgaagacagagagggcaacat

SEQ ID NO: 29377 - DNA, 919 bp, Bovine  19866880751772
tctatgttttctgtgaaatgtcttttttgtccttccaatcaattcctctttttcccttaagctaatttaaatgtactcctgatgacaggacaatgaagcatttgagagaagagaagctacgatgagatgtatctttttctctctgctgcctcctctgtcccatcttcttttctcctttcctctttctccaactccttgatgcttctgaggctctttcttttctactattaatatccttctcttctcccgtttaaagaggaagagggccttctttcctttgaccacttctgttctccaagtcttgaccgtttctgccctgagtagaaacagccgggatgcaaaggaaaagaacagagggccattcctaggaccacttgggcacagaaaagaatgtaactacttatactaaaatagaatatgtggagtatatttatttaaaataacccctttgttaagtacactgaacttaagaagcagcttcaggctggctttacagtatttacatgcagcaagtaaaaatgcttattactgtctttgaaatttaaacctttgtgatgttttacttgatgaaatacttctatggctcagtcagcttcagccacgctaagtggcctttaaaaattagacaatcttcattgaactgagagaaaaagaattgcagatgagaaataaaggtctagatttgttattaacttgaaatataataggtcatacataagatttatgattttacatcctaaaaaatcctcactatgctgcgagggagggctgagttaaaaatgctccaattttggcttgggttatttttatgaacctttaggctgagttgtaaactcacctgatcaaggcagacaacatatttgccttaaaagggcctttggcgggtctccctccctgcttttgtggagaaggggagaaa

SEQ ID NO: 29378 - DNA, 798 bp, Bovine  19866880757331
gaaggaagggatagttagggagtttgggatggacatgtacagactgctttattcaaagcgaataaccaacaagatcccactgtatagcacaggaactctgctcaatgttatgtggcagcctgggtgggaggggagtttggggagaatgaatacaagtgtatgcatggctgagtcccttctctgttcacctcaaactatcacaacattatttgttaattggttatactccaaaacaaaattttaaagtttttaaaaaaggacaacaacaacaaaaagaaactcttagactgcccactcaggctaaggaaatctcgaattctggtgtggaaaagaagggggaaaagaaaaggaaagccccgagctgcaggaaaggtctgtgacagaacaaaggagtgcttttatcacaatcagtgggtgccacaatgtcagcatactttaaaggtaatgacgtatatttggtagttaatcaccaaagagtgaacatttggggtgttatttcagatgtttggatttcttctctgtttcagaaaaaaaaaaaaaaaaacctgctatatttcaaaggaaatgttagttctaattttttacacttcagacgtttggaaacttcaaataactgttccaaatctgatcactaaatatttcttttgttgcatagaaactgacttttaagtcactgtatttactaaaaagcaaaaggaaaagctggtcctctccagccacattctctgggctcccaggctcagcatgcttcatatttaattgcacacaatccaaacattctctacatacagttctcat

SEQ ID NO: 29379 - DNA, 901 bp, Bovine  19866880774726
aattcttcaggcaagaataatggagtgggtagccattccctttctccagaggatcttccccaacccagggactgaacccaggtctcctgcactgcagacagattctttaccatctgagccaccatcatcataatactgcataagaaataaaaattacaatcttaaatatgatttttaaaacactaatttctacaccatgtgtaatttaaagcagctggacaactaaaaataactatctactaaagaaataaatttaaaaacaccaaattttttcttcagtaaagagtaatggaatataaggagtagaatacattaccactataggtattgtctcctttactttcatttatcgtaacaattagatcatcagaaacaaattctataatcccatgaggatcatcatttttcagaattgttatgttgacaactgtagcacttcccaacttgctttcccgttcaccgtggctggtgaggaccacccaataatgttcatccaactaaagtgagcatgtcaaattaggaaaaataaaaagttgaaattttcagagcaaataaaaatatatattcaaaaatattaataccatcaatttttcacaacgatgcactcactgaaaaaaacaaagctgattttttttaatttttaacatttttccatcaattaagagagatatcaggtataaatatacattattcaaaaacggaaaagacaaatcacggttactacattaaaatagtaaggagactggatcttataatgatgttccagtcatttaaactaataaaattaaattaatttaaaagttacatatgcaatgatgtacatacataacggaacaatatctggttctcttaatatatttaaaacttaaatttattttctttaaaagagtaattttacaga

SEQ ID NO: 29380 - DNA, 3138 bp, Bovine  19866880776179
acacacgtgtgtatatatacacacacacacacacctaatgttcggaagagtgaaatgggaggagacctgagtattgatgatttcatcatcttttatagtatgtagtcaagttgatactatgaaattgaaatacctaggttataaaaaacagtgattccaatcctttactgtatttataatttcttaagagacaccttttatatttcttatgattattagaatatattttgtggaatagaagcattttttgatatttaacagttatttctcttccattttagcttttctcaagacaaattcaaataaattgaaattaaattttgtatattacagaaactataatatggtcacatatttaaaacatttataagtaggcatcccatcatatttagtatgtctagaaagatatctgaaatgatgttcacatatgaacatcacttttttattttaaatgtgatttttactttaaaatagtcaacagtctgtgacaaaatgacatataatacataaagtaggaatgatttgttaaataaacctttatatgtaatgacttacttgctctttccagtgttctccattaattttcatagaattagatttctctcccatcatttccctttcccttcagtctgtataacttctttttagcatttcccaatgctcagattttttggaaataaattctttcagcttttgcctgaaagtgtttttattgtaccttgctattagagggatattgtcactgcatatagatttgcaggttaacaggttttgtttgtttgttacaggactttaaaggggtcattccattgtcttctggtttccagtttctgatgagaatagtattaacttctattatgattttcttgaatacaatgtttcctgcacttccccaagctgccctcctgatctgctattcagattttcaagaatttgactatgatatgcctaaggatacttttctttgcttggggttctctaagcaatttggatttgggtttgtgctaataaacttggaaaattcctggacatcataatagtcacttaatatttatgaagattacttatggatgaagtttgaagtgactttaaaagtttttaatctttatatttttattatttgtttcaattcctataataaatctttataatttttctaaaaataatgattaaaaaatagtctaagcaaatttgtcaatatattagtagtgatcaagtttttttaacaatatcttttatttttatctttatgtaaagagtatatagacacaaggaccatttattaatactgctttttttttttctgtttttaaaactctgaagcacaacaatattaaaataataggaataatggttttggagacctaaggaaaatgtacaatttcaaaatctccaggtatatgttaattctgttatgaaaaatagttaagaaataggtagtacagtcctacaagcggtctaatcaaaaccacctatcttttggatagcctaagaaagaacacagaacaatgcagcataaagaacttagaagaatgaaatcttcaataaaattaggctatattttttcaactcaaaaattacaaatttgggattacaaaaaaagagtatctttgattcaatggtaacctcctagaaagcaagacattatgtccagttagttcactgatgcaatttttagttcataggttctcggcacccagaaaggagcttaagaaatatttgttaaataagagattctggcttttaattttcattagtgacagagagtaggatggggtggggacaggcaggtgttggttcgagtcctctcattttctcactatagttaggtaatttgggagttgctcaataaaaattcactttggctcagtctttgtgtttctcacattacatgtgccaagactctcttgcaggagaatgaacacccactgatggctggtctctgctcttctgggtctgtgcccctctggtggtgggcttgtttggccgtgaacctccaggtgacttcctggctgtgtctggcttctctgcggggcctgagtttgcatattgctgctgccttttcctgtgactgcttctccttagagggcttcacagcttctgcttttgctctccacttggcagacacccctgtgaagtctccgtggtttcttgcttctggcgtcacacagagctgctgacctactgctgttttgtatcaccaagtgacttagcagcagagacaacggatttcgtaccaacgacagaattgaaaagaccaatactgtatttatgcatctgtacattttcttcaggtgtgagaaaactaggaatttcatctttcattgatttacatttttttcaacagctctttttcgcaatttaacttgcttttgttaattttcttatttacaattagattcttcaatctgacgtgtgtattaaatatacagagaaaaggaaaataagtgagttatcttgatggccaccggctctcagtgcaattgaaacatttagatgctttgggaacaactatcacccaaatgctcctaaaaatatttggatgggatcagtaattacctagtgttcaccatgggttatatcaagttcttctaaaattccttactaatttaagggctgctattcagaacaaggagaaggcaatggcaccccactccagtactcttgcctggaaaatcccatggacggaagagcctggaaggctgcagtccatggggttgctgagggtcggacaccactgagcgacttcactttcacttttcacttacatgcattggagaaggaaatggtaacccactccagtgttctcgcctggagaatcccagggacgggggagcctggtgggctgccgtctatggggacgcacagagtcggacatgactgaagcaacttaccagcagcagcagcattcagaacaaagagagtcaatggaagttcagttagcttagtctgctggcttcagagatgtttgtcactaaattatctgggtagcatggcttcactttcaaggttgaggcttagaccgatgtctattctaaattttgtaaattctaggagcaataactgtttttttttttaaccagaaatatacagattatacataagataccttttgttttatacaactaaagtttctat

SEQ ID NO: 29381 - DNA, 794 bp, Bovine  19866880796529
ctgtgcaagcctcagggtccctgtacaatctgtggttcagcaatgctctgtcagattagacttctcacaaccttgatgagtggtacagctaataagaatagatgtgatttggaaaaataaagacacacaatattatattttgcatgcagagtgttgccatacttgtattggtatggaaccatattctagcagtaccttaacgccacataaaagaatggctaagagattagtggtttgtctttgcctgagatcaaagcatgcagcagcatgctagtgtcagcaagaactgattgttaaatttcagcaatcttgcaaatcagttgttaaacatggccactgttaataattatataaacttgcagctaaataaattatattaaccacaaaggtaatacacacaaaaactcatcacttcctaattagcttactattacctatagtcttgaggttactgtcagcctatccagcccatacagaacagtgtgcctctctctgcacatcttttttcaactgttttcaatgatgtcaccttagtggtttgaaatcagctagggtgggagttttcacatcatggaaatcaacaaatgctacaaatcagggcttgatttgttgttttttcaactgtccagacttaagacatagaaggtaataatgtggtatattccacattattaaaagtgtgtcgtgtctatagctgtgacattatgaataacatgaacaattaagaaaatagttttccaatattcaaaaagtagtatcaattagcaagggaagtcactcacatcactggctaa

SEQ ID NO: 29382 - DNA, 1559 bp, Bovine  19866880848446
tgaattatactgacctacatttctgtctgatctgcttttattattggataattaaaacactgaccttagtatgtctgatctgcttttattatctcataattaaagcactgatcttagtataacccttgttttattcatccttatacacctgaggggcagacagtttctctttagattccctacataacttgcagtaagcaacagaatccaaaatataaataaggataaaataatgactaattaactctctcactcaggtaaggatacttgttgctgaaccaaagttgagattattttaatcattaaagtacctgtactaaaaagtgggccccattttgaaggaatgcatcatttcttattggcaattttatagtgacttgggttttctgttctggaaaaatgagactgcttctcttggatatatttaagatgccatctttcgctcgcaaagggtccacagctccagcaggaatataaagtgcagaataaaatatcttcacatctcctttagttcctcccagtcttgtaagactcaaggataaacatcgttcacctgggctactttcaatcttctggttttccacaggaaaaaatgttattaggccataaacatcatcactatcctgaatgtagaacaaaagctgcagataaaggaataaaacattaaagagcaaaattctcacatctgagatcaccaaactgtttattttctaggctattttgaattttaatgtgtaattctgtatcatatctaaaaatgattactcatataagtaacagagtaaaagaggaattgggcttcccaggtggctcagtcgtaaagaatctgcctgccgatgcaggagatgcacgttcgatccctgagctggaaagatcccaactgagttgagagcaggaaattgcaagccactccagtattcttgcctgggaaatcccacagacggaggagactggcaggctacggtctatggggtcgcaaaagagtcggacacaacttagcaactgaacaactacaaaaagaagatgaattaaaaatacatttgaaaactttgtggaattttttttaagaacaaactttttatttacagatgggacaaacctttcgcaagggaattaaccaccacttccaaaacccatgctcttcctttcgtatcaaactaaacatgtataagatgtgtatgatcaaattctttgtctgttcgagagcacagaagtatttctacaagcaaagcgtagcaagagatctacctccgctggttcgctcacttctgcacctcctcgtatcgtatgaggtagaatctgaagtaggtaagcttctgcctcttctggaagatcatcattaacgacaatgagaggaattgatgccaacatctgcccttgtgcaaaatgcagaactccagatcttggcctgatatctgtcgttactggtgagggatcactgctattgcgtgtcagcacccagttcacggaaacatttccatgagtgccaccatttctaaccactgtaatttcttcaaatcggaagaaatatgatatggtcacatatacactctttttcc

SEQ ID NO: 29383 - DNA, 769 bp, Bovine  19866880880446
ttagtaacacaacttgaaacgattcggcaatctctggtatggcatcatccactatttgaaatttcaggtgtgattcataaataaaaggtggaaaaacaatagttgtgtttggctggagatcaatgaagtctaaattttgctgggcatgtgctgttgaattcccagttatgataacataactgatagaaacttcacagtcatcagatccaatcagatttccactgtcatcttttccacgaaccactggaattgtgagtatgtggtcttcctcaggtaccaaataaacattctgaatgaatctcacaggactatcatttttcttaacgatgatctccactgagctcctggaggtattgatctcagctcctccttccacacttttcagttgaatcaaaaatatttcatcattttctggtacctgtcagagaaatacaagcaatggcaaaacatcaatagctaacacacctgcaaaacacaagtgtaaaaagtacttatatttcaatgcaattacacagcaattttaaaaaaatctttaactgaaaggagcagataaggagggttgttcactgtctatttactaaactattttccaaaggtaaataacatattttagataaagcaatgatacgaataagaaattaagtatcagcataatgactttcaaccttgatcaatctctagagaactaaagatctgacagaaaaacaagttcttattagtttcatcaggtgtgcaggatcagaagcaacattcgaggtctcatactatt

SEQ ID NO: 29384 - DNA, 1754 bp, Bovine  19866880954428
aatcgatgcttttgaactgtggtgttggagaagactcttgagagtcccttggactgcaaggagatccaaccagtccattctgaaggagatcagccctgggatctctttggaaggagtgatgctaaagctgaaactccaatactttggccacctcatgcgaagagttgactcattggaaaagactctgatgctgggagggattgggggcaggaggagaaggggacggcagaggatgagatggctggatggcatcaccgactcgatggacgtgagtctgagtgaactccgggagttggtgatggacagggaggcctggcatgctgtgattcacggggtcgcaaagagtcagacacaactgagcgactgaactgaactgaactattataatatatataattgtgttctgaaattttgactatggaatcaacatgtgaaatttaatcttctttcctttgattttcatcagaagagataatatatgcccatatgtgaaacacaccaactattgcagagttgaaaatttctgttgtgaaagattttgggagtgtggacctgcatcttaggaggtactttaagccacaggacttaatttttatttagatgcctcatatttttcactctaggggtaagatcttcgaaatagataccccagctttatcttattttatgacccacagaattttccatgtactagatactcaaaaacttttcaaagaatagtatacaaccttattttgttgaagaaaggtaaaaatatttggaagactatcccaatttaggtaaagccaatcactggacccatctttcacttcacttatttccccttcaagcaacgttctgagatttaggaagcagaggaactcctggtggagctccaagcattgaaccacaagactgggcctgaaacgctggaggaagcactcaagcctgtctgtccactgcctgcgtggaacctaagtgcacttcttggtgggcattcagctatgacatatgaacttaatgaatgaatcaaaggtggttaggagagaatttaaactgcagaaaaccatccttacagaaagagggctggttagaatctggatttttattaagatttaagatatgctcaatagctctgctgattcagtcaggatttatttctcagtgccgggtctcttgtgtgtgttagtcactcagttgtgtccgactctttgcgactccatggactgtatgtagcccaccaggctcctctgtccatgggattctccaagcaagaatactggagtgggttgccgttcccttctccaggggatcttcctgacccagggatcaaactgggatctctcacactagaggcagattctttgtcattgagccaccagggaagcccggatccttcttgagccctaacgtaaggggggtgatgttgataaaaatgctgagacaacaggcaaaaccaggaatttttaacaaaccagggctgtcccaggcaaaccaagatctaaagtttcttcaactattgcccaactgtaaatccaaccttcagctctttttcccaacaaaatgcttacatatggaaacatgtccttacataattaacgggttggggaaaaataaaccctctctagaaattgtagttttaagaaagtttatatccaagatagagtggtgatttctgagtgttaagatttggggatgaggagtggcttctctgtgttttatttccttttcccccttctgcaataaatattaacaatgaatgggctgctttaaat

SEQ ID NO: 29385 - DNA, 1326 bp, Bovine  19866880961776
atgtttccgtggcttggcagctctttcagaatgattctgctttgcaacctggacaagagttctatgaaacttcagggactgttaactttttggatggagaaggagccaaaccaataattctccatgcttttccagacaaaattcctgaattcaacgagttttatattttaaagcttgtaaacatttcaggtgcagtgttttcccatctattttattttaccactgaagtttaatattttatgctgaaatagctagagctaggtagaaaatgcacctaatgaagttttatggatggaaacttatttccattctcaaacttgtaaataaaattttttcctcacaccaaatagagtatctcaaacaaaacagtaataggtgataggaagtacagattcatggtagcttaaaaagcttggcctttgtaccttaatttaaataataatgtccccatcaattttggttttaagcatgagaattaagtctttctatttaatatcctcttttcagctggttgttaatgaaattatagtgaataccttgaacatgtggtgaaagctgtatggtgacaccatgttcattgatcaacaagtaaagtacttaatgagaagtttggtaaacaaattccttttgccttcactttatactggaaagtgttttcaattctgagttttcattctgatttcattacaggtgggtccccaggtcctgggggccagctggcagcaaccaacctccaggtgacagtaatgattccattcaatgatgatccctttggagttttcatcttggatccggagtgcctagagagagaagtggcagaagatgtcctctcggaagatgctatgtcttatatcaccaactttaccattctgagacagcagggtgcctttggtgatgtacgagtaggctgggaaatattgtctagtgaattcactgctggtttgcctccggtgacagattttttgctggctggaatttttcccagctccgtgcatttgcagccacacatgaggcgtcaccacagtgggacagatgcattgtacttcagtggactagagggtgcatttggaactgttaatccaaaataccatccctcgaggaacaactcaattgccaacttcacattttcagcttgggtaatgcccaatcccaatacgaaatgggatttgttatagcaaaggatgatggtaatggaggcatctactatggggtaaaaattcacacaaatgaatcccacttgacactttccctccattacaaaactctgggttccaatgctacgtatgttgccaagaccactgtcatgaagtatttggaaaaaaatgt

SEQ ID NO: 29386 - DNA, 981 bp, Bovine  19866880992967
ggaagaccatatagtatatactatatcaaccacagtggtttttttgtgtaaaaacattacatcagggaagagaggtaaacatgtgtatatccaaagagaacatacttggatcaatttggaaaattctatgcaagagttttcctctgaaaacagtagcaaatgattccttatacttttaaaacttcattaagcagttataaaaggtaaagacccttttgacccaggtataagacagctactcccagaaatcagggacaaaattatgttcctggtctaaatgactcaaataaatgtcttcgcagtatgatgtacttttaaattagatatgtactttactaacagttacatttggttaagtatgtatgttccatagtctagagactaatttttaaaagggtgaagtataccctacactatcattttttttcaataaaagtggatacttattagttcacttaatcttacttagttaaatctttaaaatgagctttaatttcatttttaaactcaaacagataaaagcatgtgatataatcatgaaagtgaaaaaaattcagtacttctgaggtaaaatgtcaaatcatttattatataacttcaagcagctttcttttgaaaaattaaataaacccgtctaaaatgcctcttacaattataggcacatgtggtattactatataagacttcctttttgattcttatccaattctaagtcttttagaaagaggaaaagggtatgcatttttaatactaatggaatgagatgacactataggaatttctcatgttttaatgatgttgttttgagaactcaaggatgatatcgatctctctaatttcaacattcaagggcagaaactgaaaatcaatatagttctactgtgctaaataactactcaggaatgtattctcttcctatgaaaccacttctcactttcagtctgagattgccaagctttttccaactacaatttctcctct

SEQ ID NO: 29387 - DNA, 1600 bp, Bovine  19866881040529
cactttttctaacaatcccctgagatgattccagagctgaagatggagctgggtgtgcagtagtgtttctcaactttgcctgcacactgggaattatctagggttttaaaaatactgatatctgggttctgttaccagaagttgatcatttaattggtctgaggtgtggcctttgtctcaggatttctaaaaagccttccaaatgattctaatgtttagccaagctggaaactactggctacaagcaaaagtcaagagccctcagctgtttgtagaggagagatatgcaggccaagcttgtacatttcaacgagctaggaaaaatactagaagactcataggcttttttttttttttttttggacaagtcaaccatttgcttttacagtttaacctcttagaaaatatgccagaagtaaacaggtgtacgattaaccttgcaaatcaaaaggttccgtgattttagattctaagcgctagctgtgtgtgaccaaaggcaaggttttagaactggatctcccaaattgctcattactattccatgcttggttaaaacttacatcatcctgcaatggaatgtgacccaagtcaaagacaaaataaaaacagttgcattgctttcatgattagtaatgatattagagagaggttaaggtgtctcaaaacagcttgtacttttcccaacctattcaagacctgattcatctacagtttagtaaccttgatacttccagatgatattgcaaatgtgtaatttctggatgtgtaactctagatgtgtaatgtgcttggactaaatccaaatctggaaactcattttttatttaacgtatattcttaataaaaagcaaatacaggcccctactcccaacttccattatccgaattcttgtccacagctccctaatagaaagcaatgaactatgaaacaagtacacatttgtctgtggtgacaatacatcctggtttaccctgacagtctgggtttatgcctattgtttaagcataattattaatagcaccctctcttcgaaatgtttccatctgggtgataaattatctgggcaccttacatatagctcactcaatcagcattccctctacaagtattgtagggaaacctcatgattggagtgtggtcactttatatttagaatgctcccacagctacacatgaaagtcagtgtattgaaatatcaaccagctgatcaacatcccttccttaaaaacaaaataatagagatttcgtaaagtatttctgtttaactccatcaacacagaggccccactaaacaaaagtaaaaaccctgtacttttccagcttaaaacctgcattctttatctgtttctgctagaaactaacaatgtggccttgaacaagacatttggttttttgtgatcaggtttttctcctttgcaaaagagtagattagagtaagtggtctctctcatctttttgaataacaattctgaaagtctatattgctactttctctaggcattttacttaaccagtgctttgccagttctatccttctgcactgtctgtttgaaactaagctcatagatatctaagaccaaatctaccgaattcactttt

SEQ ID NO: 29388 - DNA, 792 bp, Bovine  19866881064992
tatttgttttatgctgtacagtttagctttgctttttaattgtttggtgggaggttggagaacaccataaaccttccataattaggacttctcaaagagttataaaacaataattctatgaggtaggaattactgtccccataaggcagatttggaaacaaaacttggcgagagtcaataacttgattaaggttacaaaggtaatgacggagccagaattcaaacccagatgcaggtctctaattgttccaactagttctattaaccaaacagttctgttttcttctccttcaaaagtgaagtgaagtcgctcagtcatgtccgactctttgtgaccccacggcaggctcctccatccatgggattttcgaggcaagaaaactggagtgggttgccatttccttctccattctccttcagaactaactatagtatcatacctgggaaaaggtccctgccttgagtctgtacagtgttctctcttaatagtatctcctcactttcctccaaaatttccagatggtagaaatcctacattctccttattgaacaagaaaaaagaatatgcaagggcctgaacgcatctgtttacataaaaaagttcacaagcatactcagaaacacataggagactatttctcatgaaagactgaacgttatgaccatgtagaaatcattttcaaaggaagcatattttagttgacctattgaactagtgacattaatagtgcttaagtggatccagttctcacattagcctctttatcaagcaaatcagcactgggcagtaga

SEQ ID NO: 29389 - DNA, 2547 bp, Bovine  19866881180537
atttgagaattgggtatttaaaaacttaactatccattaggaggtagttttaaggatagagaaaagaggaagttatttaactgcatttaatcttgaggttggagaaagcaatggcacctcactccagtactcttgcctggcaaatcccatggatggaggagcctggtgggctgcagtccatggggtcgctaagagttggacacaactgagcgacttcagtttcacttttcactttcatgcattggagaaggaaatggcaacccactccagtgttcttgcctggagaatcccagggacgggggagcctgatgggctgccatctatggggttgcacagagtcgaacacgactgaagtgacttagcagcagcagcaatattgaggttcttcgtcagttttactggtttccttcaatctgattactccagtccaaacaccactggcccaggaagacttgctcatttagttggaagatctccttaaactcttatcttatcttttctaaaatcaattgagtagttgatgcatcatgaaaagatcatgcttttgctgtagacaatcacttttattttgaataatatgcaattcagtaatcatggtgttgggagttaccataagtgataatggattctaataagcattacagtccagttggtatgtcaaaaaattaacagctttcttacagccacgaagtaaactgttttatttcatccacagttgggccagagctgtgcctttggacatcgtaagacatgtctaccaccttggacattaaaacaaatgttacactacttcagcatgatacattttgggtttttgccagtcacactgtcgagaactatctgttaaatcaggataatttaatatgaataaaatgtcagtgttggaaaagcagacttttaaaaataagaccctacacattagcgaacaatctctgtcctatttccatttctaaagttatgtatgtcaggcattaaatttctgcttctagacccataaatgcgaagcaccctagaagaccacgtgtgtttctttccttttacatggcattcctagtactgaaagcattcactgttttgctccaactctttattgagatccttaaaacttgatttctgggtttttttcccttcccaagagaacaaacaagctatagtttgaaccaatggtaacccccaagcatttttattaatctgtagtcagcaaaggtctggggccttctatggttactttatccagagtccagtgtttatctgtaatttcctgttcgccatctgggaaaaccagatgtaactcttttgagaagaagcactaaagtcccatctctgcttcattatttcagatgtaatcaaagaagcaaacctgtggagtgttgtcgattcttaatacagtagagttgtctatagcctggacaaaattccatctgtgttattcttcttctagaggcatttctgttccagatatagttacattaagtattatgttggttcaagctgacaaatcttaattttataaattaaaaccaatatcttacatcttgatggcagtactctttgaagctctggaaattcttgctacaactgtttaaggaggcttcactcaatacccatcccccacagccccattgtttggagagggagtgttgtgcggtggttagacaagggccactggagccaaagcaaacagtttgggttgaaacactgaatctgcctcctcctggtgtttaacctggaacaagttatttaacttttctgtgccttgattcctctatcttgtaaatggagatgataatactagcacttactcttaagactgttgtgagaattaaatgttattccactcattctacccttctcttactgagatgagtacctagcatttagtaaataacactttatgtgttacatatttttatggctgttcctgtctcaaaacctttgcttgatgttccttctggctgaatgttcttctttcagatgttcatatggcatgctcttttacttcaaatatcgcacttcagagaagcctttcctgaccatctttttcactctttatttactgctttatttattagagccctgatcaccacccagtattatattttacatttatttcatctttctgactctttgtttctttaaaaaatgacataatctcaggaaggattttgtgtaattctatattgcttgagtctagaatggatgtggtatataatatatagtagggttcagttcagtttagtcactcagtcgtgtcagactctttgcgaccccacgaatcgcagcacgccaggcctccctgtccatccccaactctcggagttcactcagactcaccgtccgttgagtcggtgatgccatccagccatctcatcctctgtcatccccttctcctcctgcccccaatccctcccagcatcagagtcttttccaatgagtcaacccttctcatgaggtggcccaaagtacctggagtttcagcttcagcatcattccttccaaagaaatcccaggggctgatccccttcagaatggactgggttggatctc

SEQ ID NO: 29390 - DNA, 923 bp, Bovine  19866881230193
gcttgagttgaaaaatgcttggagaagcagctcccaaaggttctgagtctttacttgaatactaatatcttagggacaaaactggcaccagcaatgaaacctgcagagccctaaagagagagagattgcaaggaaggcccaaggagcaggagaaatcacagaactgtaacttttggcttcagagatgaaagctgagtctaacctccttcctgttcttgataaagagaccattcagtgaccttttcccaccgttaaaagtgcccagctccaaagtgcgaatatggtttcctacaaacctgcagcatttgtccttcctctgaagacatcgtcgtatgctttccactgtggtttcacctggtaggcgtggatgaacaccacgaacaccaccacgaggcacattaatgggacgagagctgcagtgaacagagctgcgtagatgtttgggatgaaacacctggaagagaccagagaagagataactcggcttcaacacccacatttctaaatgcacggtgcactacaacgctttatactcgctctttgtatctcagggctggcaacagcagctttttggtttgccaaattggggttctgtttgagtagcggctacatgactaaatctagcccactgcttcacaaagtgggttccatggaacatgcataacctgaggtgctcagaaaacctcaaaaaaggttacggccaagtaagtttgagaaattgggggagtggaagggagattcaagagggcggggatatatggatacatacagctgattcatgtcattgtacagcagaaactaaaacattgtaaagcaatatactccaataataaaataaaaaactatcaaaaaagattctactccatttatagttgttataaaatattggcaatattccctgtagcttactttatacctaatag

SEQ ID NO: 29391 - DNA, 1086 bp, Bovine  19866881353802
tcgttgcactctgccacttccataggagaatatgtttatctttacccagcctctggcaagcatatcactccaccctgtgtagccaaagggaaagaatagtcctgaataaaaaataaggttcaatcattcaacagacatacactccttctgtttcagtcatctatttgtcatgatgagaaaccacaaaactatacttgcataggaagtacaaaaacaaaataaagaatgggggaagaaaaacctgagcaatcatcacatatttttcctttgtgggaacattcctcagtctgtgtttcaagaaggtttttttgttaaggatttttttgtagatttcccaatatgtaaccttataatgatgtaacctgcatctctataaattatatagcatgtgtcagaatcaaatgctcttaaaatattataaaaggttgctaaatatattttgcacattccttcctaactctatgttatacagtaattgatacacagcccacaaaacatctaaaaatacttttacagcaaaataaatgcctgcaatttctttctactctatggtaaatgtggaccacaaaaaccaatgtagaaattcaaaagtacaattcaggaagtgaaggaaaggaaagacaaaatagcagtctccacaactcagcatttacttcatctctgcctaagtaccaatccaagcatagttcaaagagttagagtccattagaatcatgcccttttttccccagtgatatagaaatgtttttctctccagtcaggaaaatgaacttaaattaagccaatatgaagaagcagcgcacaatttgtgatcacactgtcgcgtgtctgtcccacatgtagtctccctttgatcttcctaacagaaggatggttttccttaggtatctatgtctcccttccatgactcaggaaaggatcccctgacttctcaccctctctaagtgtacttctccacttctccagtaaacagaaaattgtgtacctctcaaggctgtttttggtctaagataggaggaatcctaatgtacacagattagactggcggcaacagctgattccatacttgaggccaggggtctcact

SEQ ID NO: 29392 - DNA, 1450 bp, Bovine  19866881429387
cagacatataatcaatccaaattcaatgcttcaaagttcattccagcaatattccagttcgaaaataaatataaaaaatgaattcacttgttatttttatctttacattataaaatattcattattatcaaatattagaggtttccctggtggctcagtggtaaagaatccacctgcaaagcaggagatgctggagacatagctttaatccctaggttgggaagatcccctggagaaggaaatgacaactaactccagtattcttgcctggaaaattccacagacagaagagcctggtggactacagtgttgcaaagacccagacctaactgagtgactgagcacacatattaaatattagggtgagtgggagtattagagtacttacatcttaatattctaaaagtatattttttaaagattttacctttaagagcatcacatttttatcttttatcttcattttcctttattatcatatcatactcattgaagcctagactcaccggcaaaatggcaactttgacataagtttcttttatgttttctttcattattatcattgtttcttgtagcacatagtctttattctcagtggcttgattattgatgtgcagtaagaaattgggtttagctaccaactgaatggctatgtctccaagtaatcctttatcgcgaacgatttgtaactgaagagcggtgacgttctctacgagacagacgtgccttaagtaagtaaacttttctaacagctgttgatgctattctaagcacttagggtggagtgttctgactatctcttctagacaggtaaagaaagacagataaacaaaggcaatgtatactcccaaggaatacttcgtgcttttcccaaccagtcaccagagctgtgctgaattcaccatacactgcccgcattagttcccagttttaaaccctcacttctgggtctccctcactctcctacgctgcacatggcatgcccattaacagaactgctgaaaatactaagaaagtgcgtacctggaggatgagcagaggggctaatgacaaatgctaagaagattcttcaaaaacgaaaaattaaacacacacagtcatttaatgactcattattaaaagagcaagtttgttctttggctatcacagagctcaaagtatctcacaacacctatttcacttcttagatttttaaaatttaatttgctaaaaatgaaaaaaaaaaaaaaaaaaaaagcatgtcaatcttccctaccagtctgttagtttctaatgaccgaataccatgtctgcttccaaaacatgtagcgtgatttttggtacttactaggtgctatggttgctgaatggataacagatcgttttactttaaggctactattttctgttcccatatatacagacatataaagacctacgtgaataattacatgtcatttttctccatcag

SEQ ID NO: 29393 - DNA, 963 bp, Bovine  19866881524803
ttaacgaacttttcctcaaaattaatactccaaagaatctcttcttaaataaccctgcttcctccataggcaatacagagagaatacaaagactttaaaaaatcttcccagtaaggtttttcctgtttctttactaaatctgaaaaaaaaaactccattcatttctcaaatgaaattaaaaaatttcatttaagcttatgaaagcttctagttagaatgctaatttgagaagatatccaaccctatggcaatattttacacagcatctcaacacactgttacacagtaataaaatcctgctcaaggcgatcaaacattcctacagaaagcgctttgattttaaaatatgcgtataatttcttcacaaaagacaatgctttttaaaaaaaataaagaaaatgccatttcaaaaaagaagcctctctctggtttcacaccgtctattaacaaggattggtaaaatgaggatttaatatagccagaaaatattcaagaaattgtcagcatcttcttcagtcccgtcttggaatgaggttgcccagacacaagaggcctgtactgagggacttgactgagtggactgaagaaacccaggattctgtctattggcaaggatcacaccacagtgatgtgatagctttgaagcaattatgaaacaagtttcacaaacagaggtctatgcttaggcagttgaggaacacaatagactccccaactgcagcatgacctggggggagaaggatgaggctgagcggcgagcatgtgggttcctgccccaggagctacggttccatcctctaaacttgtataagacccagagaagcccatgggagtcttctgtttcctctcccgcataatgacaggttcacaggaagcaccgactgtgtggcgggaacttttctggttccgggaaagctgcaaagaaagtggtgtgcgcgctctatgctcttgcaggtatgcatg

SEQ ID NO: 29394 - DNA, 1213 bp, Bovine  19866881613160
tggagagatgagtgccagcaaaataggcttgtaatgctagtttaaatagttgtaaatagtttgtatccctattaataagtaagtaagtaagtgttaattgctcagtcttgtctgattctttgtgaccctatggactataacctgccaggctcctctgtccatggaatttcccaggcaagaatactggagtgggatgctatttcctactccaggggaacttatcgactcggggactgaacctgagtctcctgccttgcaggtggattctttactatctgagccaccagggaagtcctgtgtcctattactagagaataaattctgaggtggggaacaaagggaaatgacattcaagaaacagacagaagcctatcagaaaggactccaggtgccttttagcaaattcagttttgaatcttcagataatggagacacaggagagagctgctctgatttgtatctctgtctttctactcctgttttgactgaatcattgttaaataatacattcagaatttaagcaagggaaagtagcattcctagcaaaaattttgtagaggaagatatttaatgtttatagattttatatatggtacctaggacttaacttttcagagagagagagagagagagtgagtgtgtaatcagtgtttcattaagaatgtaggttccaggacgggacagtttggttacatgatttattagcttaagttttagtagtggtttactttttctttttcctaaaaatcttctctttctcatgtgaaaggcatttgattgatttgtcgggtcatatgttgttgcttatttaagatatggtcagtattaaaaggtaatctaacctttgatattcttactgcacagtgataactaaaatataaataaaatcctctttctttaaaattttagatttcattttctgaaggccaggcactgtctacaattactctgactgttcttgctgatgatctaccagaattgtcagagattgtcattgtaacactcatccgtattatcacagaaggggttgaggacccatcaaaaggtgctactattgatcagaaaagaaacaagtctgtgataaccactctgcccaatgactcaccttatggcttggttggctggcatgctgagtctctcttcattaaagtagcggagcctaaaggtaaatcttgttagatattttcaggttctcataagttttatgaatatt

SEQ ID NO: 29395 - DNA, 663 bp, Bovine  19866881884155
tgggatacactgaacatgttataaagccagttttatgaacgtaaaaattatccatgtaattaaatgttcttaattttgatgcaagtaaggctttttctgccacattttttgaatatctgcagacttttctgttaaatttaaccagtcccctgctgttgggtcatttaggaagctttcatattttactttatgaacactactaaagtaaacatctttatttaaaaaaaaaaaaaatcatacagctaaggagtatgaaaaccctggcatgcaaccctaccaatgctgcgcattataattttagctttaaaaagtccttagctgtcatacaagtaggaaataacatcctcatgttttaacagacattttatgaattataaaagcaaacagtaaccttcattgtaactactgattatttggtcacatttttccaaaaaaatactttttaatttccaaaaacgtcgggctctctcaccttttactggagatatttctacctcatcaactgagagcagctgaatggtgaaacgcctgtcctcctccaacgtggcgtcctgaagtgtgtgcagcacaatggtcttctgggactcagtctacaccaaatgagaggagaacacgtgttttcagagtggccaaacttaaattttgaatgttctcatcagcaga

SEQ ID NO: 29396 - DNA, 842 bp, Bovine  19866882053369
attgactgtgctctacaacagaagatgatttaaaacaactacagaaatacaaatagtacgaaacacatactgtcaataagaacagttaagatagaaagttgaatgcttctaatatagcagtttgataaatattttttacggaatcacatctcttgttcaaatatttgcctacaaaagatatatgctgtctctaagaaaaggaaatattttaaatctattgaacatgacataatgattctgatgctgcagagctgtgtgaagtgaaccatctaacacagatttataaagagtgcatttatacacagcatgcgataaaaacctactctcccatatttctcaattctgcccattacatttgaaagaaagtaatatttaccactgggcatctatccaattgccttaggacaaaaatgtagaagtaggactttacagaattcaatatattgttaaacaccagggcaattcctccccatgaactgaaaatgtatcctaaagccagaagttcagcacagtccacattttaaaactaatcacataaatgaaactccaacactaggtcaaaagcaatgttaacactgcccaaagcacacatggtatttttataatttcatttccttagcagttatctttgaagaatcaccctgaagttttcatttttgtaaacttctgtgtgatatatatttctctatgcaattttgcagtaacataaagaatacacacacaaaatgctgaattcttgaggctgaacataatgctttgaaaaaaaagaaaattaacttagactctaagaaaaggttcaggaggaaagggaaagaaaagtaactaaaaaaaaatagaaattt

SEQ ID NO: 29397 - DNA, 727 bp, Bovine  19866882136263
cgagaattcctatcagtgagggtggaaaagagaagatgaagagtaacagtgaagtagcactaacttagtacccaagagctgcttttacatagctatctttcaccaatcatcttctttccaaatatcagaaagaatacctaaatgcaagctcaaaaacactgtgtgaacaagagataaaaagacatttgtttctagggctatattagctgtttcatagcagtgaaacatttaagttccaagggcaattaacgttccaagagagtgaggagtaagcaaagagggacgagagtgctcatcatctgcagaatgacacagctgccaccaacactgggcgggcaggaggccgagagggcttgccccagatacgaagccagcgttttctgtttgcttaaaggagatctagtcatgcaagcacatgtacaaaaacaaaccccctcctgaagtcttagaaatcctttgagttcctaaggaagtagctccctcatcaatctctgttaatccttctattatatcatcagaattttcccattttcctcacaaaacacagtttcctccaagaagtttagtgcagtttttcttggtgctattacctcaggaaagaagagttgaccagtagagttagcaaaattgaattctaggttttgcccaataattttccagttaacagtaacatttcctcgaccagggggtgttcttatcacatggaactgtaagatttctcctgcaa

SEQ ID NO: 29398 - DNA, 2624 bp, Bovine  19866880142362
ctgtgggcggaatcccgtagaagaaatggagtagccatcatggtcaacaaaagagtttgaagtgcagtacttggatgcaatctcaaaaatgacagaatggtctctgttcatttccaaggcaaaccattcaatatcacggtgatccaagcctatgccccaaccagtaactctgaagaagctgaagttgaacagttctatgaagacctacaagaccttctagaactaacacccaaaaaagatgtccttttcattataggggactggaaggcaaaagtaggaagtcaagaaacacctggagtaagaggcaaatttggccttggagtatggaatgaagcagggcaaaggctaatagaattttgccaagagaattcactggtcatagcaaacaccctcttccaataacacaagagaagactctacacatggacatcaccagatggtcaacaccgaaatcagattgattatttgcaaccaaagatggagaagctctatacagtcagcaaaaacaagaccgggagctgactgtggctcagatcatgaactccttattgccaaattcagacttaaattgaagaaagtagggaaaaccactagaccattcaggtatgacctaaatcaaatcccttatgactatacagtggaagtgagaaatagatttaagggactagatctgatagacagagtgcctaaagaactatggatggagggtcatgacattgtacagtagacagggattaagatcatcccctagagaaggaaatggtaatccgctccagtattcttgcctggaaaatcccatggctagaaaagcctggcaggctacagagcgtggggtcacaaagagtcagacacgactgagctactatacaaagatggctctggagcctaaagtgtcatttaatttagtccctgtctttcaatttccaaagttcctagaagaatttgagtggccttgcctgagtcaattgcccactcttggtttagttaccaaggggatggatcatatgtttttagggcggcttagcaaatatgttcttcaaaaatgtggtgtgagcgagagagaatgatggatatatcaagaatgtgaagtttctaaaaatctggttttgaagggagagacttctgtttcaattaactgtcatgagaacatataaaataaaaatgataaaaattcattctcatcctttgtacgtaatactactttcgtttttttattgctaaaatacgtctttatctctgaatgtgctatttctccaccacaaattatctttagaggataattttgtgaaccctgaccttgtaggtcctaagttggaagccaaataacaaagataaattcttcaaacactttctcattgcttctggtagtttcactttgtaatgatcatttggcctaaattaaaatgaagttaaagatagtggaaattaaactccagggaaaagattgaaaaagctaaggatactttttgaagcttaagaagatgaaagagatcataagcagtcttgaacctttctttgataatttactcatttaaaaatctgcttttttcaaaaataacacatgattttattgaagaattaactttgggaagttgtggataatcttacgtcttaaagattaaaataaagactgtctaaaaatgactataaatttgaacaactaaaaaaaatccttaaatggtgttattttaatttaattgtaaaaaatgtataatgttaatagcctcttaccaagagcttggcttcagttcagccccagatagcccatctatggccttccccggtagctcagctggtaaaaaatctacctgcaatgcaggagacccctggttcaattcctgggtcaggaagatctgctgggtgaagagataagctacccactccagtattcttgtgtttcccttgtggctcagctggtaaagaatctgcctgcaatgcgggagacctgggttgggaaaatctcctggagaacagaaaggctacccaatccagtattctggcctggagaattccaaggactgtgtagtccatggggtcacaaagagtcagacacgactgagcgactttcattttcactttaaatgcaccttagtgcagttagtttagtttaacttactaccatttactgttctttctttgtcaacatctattccaagccagttttgcccccaaatttgagggaaggtgattcaaggagatccaaccagtccatcctaaaggagatcagtcctgggtattcattggaaggactgatgctaaagctgaaactccaatactttgaccacctcctgcgaagagttgactcattggaaaagaccctgatgctgggaggaattgggggcaggaggagaaggggacgacagaggatgagatggctggatggcatcaccgactcgatggacatgagtttgagtgaactccgggagttggtgatggacagggaggcttggcgtgctgtgattcatggggtcgcaaagagttggacacgactgagcgactgaactgaactgaactgattataaaacttgatttaaatggcagatcattatttgtaagcataggacccaggtgaactctaaaaccagtttctgtgacttacagtaacagtatcgcaagtaaattaa

SEQ ID NO: 29399 - DNA, 3155 bp, Bovine  19866880166521
ctatggtttttccagtagtcatgtatggatgtgagaattggactataaagaaagctgggcgccaaagaattgatgcttttgaactgtggtgttggagaagactcttgagagtcccttggactgcaaggagatccaagcagtccatcctaaaggagatcagtcctgggggttcattgggaggactgatgttgaagctgaaactccaatactttggccacctgatgcaaaaagctgactcatttgaaaagatcttgatgctgggaaagattgagggcaggaagagaaggagacgacagaggatgagatggtttgatggcatcaccaactcaatggacatgggtttgggtggactccgggagttggtgatggacagggagggttggcatgctgcagttcatgggattgcaaagagtcggacacgactgagcgactgaactgaactaaatggaaagacaccttcagttgtaataatataggaaagagggtgctattggcatcgagtagatagaagctaaggatgatgctaacctatacagcacacaattgctcctgcaacagagaattatctggctacaagtatttgaaagtgatgaggttgaaagattatgcacaaaatacgtggggtctgggtgtggggaatctgtttagtttgacatcctccaaaactcccaacaaagtgatttgatagatagtagctcctaattctttaggaataaaaagtggtacccttaggatctagaaaagggataagttttaattaggaaaagcaataagaaatattagctaatttcagtggggaaatcataacctaaacttctttggtacaagtatggtaaattaagttagtattttatgttccattgttgtgttttcttcattataatatttatcatataagtctaccaacttacataactcattgggaaagcaagggattaattagacaatttcaagatgcataaatacattaatattaaaatatatacggtgatggggaatacattgagacataaatcaaagataatatagcagaacaaacttacttgtggaaaataggcttacaatgcttagaaattgttttcatatctaataatgtgacagagtcctggcacaatcctcctattcattatagggctattaatttcatcctatgtaacttgtgtgaacttgctttagtgcgtttgtgagaataatgtgaagggtcagtagaggtcactgccaaggcaatgacttggcacatccacagcttttgaaatggctcctgtgcatacagcaaagaccaacatctggcaaaggaaggggctcaggatgtactaacaggggtctgcacacagacatgcatttcaggatcaggttaattgggagccccagccaagtccagactctccgcccgccttagacagtgcattttcctccccagctatccaatggagattttactcaaaagcataaatccttaaaattccagccttagaagtatactgagagttgatctaactgaccctttcattttacagagagtgaaactgaggcagaattgttgatgtgagttaccaaaggcagagagctgactagcagatgccctggtttggatgccttctgactccactaaagtaagtaagcattagtcactcagttgtgtctgactgtttgcaatcccatgaactgtacccatcaggctcctctgtccatggaattcttcaggcaagaatatgggagtgagttgccatttccttcttcaggggctcgaacctgggtcttccgcattacaggcagattctttaccatctgagtcatcaatataattattataacgctatacatagtgtacagttgtatataagctatgtgtgtacataatttattccataatatggattcaattatctcaagtaatctttcccttgtctttcaaaccctatgtaaaatatatctacaagtattattaaagagagttatctgaacctgaaagcaccaccctgtgcccagagtatgtgtaccaagaaagcaatcctcttagaatggagcccagtgtgaaaaacaatcgagtagaagatgtactgttaagtgcaaaatgaacagcttgaaaacagaagaatcaagatcatgagacggcaagcaacagatatttccttgaaaatatttggatgtatagttggatgaaaatactggcaaaacactgttaacttaaaaaaaattcacaatgtgagagttgtgaattaagttttatttgggggcaaaatgaggactatagccctgaaggtagcatctcagatagctctgaaaaactgctccaaagaggtagtgggggaaggtcagtataaatgtgattttggtaagggccaatacatgcaaaatgtcaatccactccagtactattgcctggaaaatcccatggacagaggagcttggcaggctacagtccatgcggccgcaaagagtcggacacaactgagtgacttcacttcacgtaacttcaatacatgcaatcaagatcatattttttgcagaagatttctgttagtcacgaggagcagttgtcactatgaagacttttggtacttttctagatatgaggagatacaactattgggctcataaaatcggctcctgaaaatatctatttgaagacctattctgccagtttttcccagagtacagaatgcctcatttctgctctccaccccaaactcctttcaggggatgttgaaaatcagcagctgcagcaacacatgacctaatccttgtagcggtaagtggctagcagccatggcaagtgccagtttgacaagagactattagccaaaatatacaatgagctcttaacatataagaaagctaagagcttgattaaatgatggtccaaagacctaaacagacatgtcaccaaagaagatacacacatggcaagtaactatctgaaaaaatgctccacatcatgtcgtcaaagaaatgacattaaaagattaaatgacatttaaaagattaaaacaacaatgagataccactactgtgtaggaaaaactcagttcttctgtaaatctctttcatcttttactctcatgctaccaccacactcacaacacttctatcaccagatatgtgagggttttcccccaccaaaaatcctctgcaacaccagctgagcactgaca

SEQ ID NO: 29400 - DNA, 2167 bp, Bovine  19866880216573
agcataggggagaaggcaatggcaacccactccagtactcttgcctggaaaatcccatggatggaggggcctggtgggctgcagtccatggggtcgtgaagagttggacatgactgagcgacctcactttcacttttcactttcatgcattggagaaggaaatggcaacccactccagtgttcttgcctggagaatcccagggatggggggagcctggtgggctgccgtctatggggtcgcacagagtcggacacgactgaggtgacttaacagcagcagcagcagttgagcaatagaaagtattataaacacccatgaactcaaaagcactttctcacaaaagcatcatatctaatatagaaaaagaataaggcatgatagctttcagccattgtggtgctttgtgaaaacatagctggctcaatgttaattaaaatctgaatttactgccaatgttgcaaaagtataaaaatttgtaacaaataaataaaactatggccacaaatataaatgaggaatttatagaatatagttgttgccaaaaatatccatagcaggtataatgtttatgtttggagtaaagaaaagaagggaaaataaaatatcttgtctctcaggtctctgggtcaaaatttaaaacatgacttgagaaatgtttcataattatactgtcaactatactgtcaatatgaaaaggattgatatctatatcaagacaaaaaacttttaaaactcataaataagaaaacaactcgattttaaagacagcaagacatttgaacagacccttcaccaaagaaggtaaacagcaaacaatcacaaagaaagatgtcatgtgtcattcagttcagttcagtcgctcagtcgtgtccgactctttgcaaccccatgaattgcagcacgccaggcctccctgtcccttgccaactcccagagttcactcaaactcatgtccatcgagttggtgatgccttccagccatctcatcctctgtcatccccttctcctcctgcccccaatccctcccagcatcagagtcttttccagtgagtcaactcttcacatcccaaggatggaggagcctggtaggctgccatctacggggtcacacacagtcggacacgactgaagcgacttagcagcagcagcagcagcagcagcagcaagtctttgcatgaggtggccaaagtattggagtttcggctttagcatcattccttccaaagaacacccaggactgatctcctttagaatggactggttggatctccttgcagtccaatggactctcaggagtcttctccagggcagtagaggttaaaagggctctgaggataattgaatgtagaaagtagcgtactttttgttttcttgaagttttcatgggtccctgtgggagagtgatattgttgtcctaacttttattaaatatttgtcttgctaatatatttgctgatgacattcttaaatatgatgtttgtgctctatggatatggataagtagattaatgacattaaatattgtagtcataattgaagtgttgtgctatacctcaaaataagaattttaggaacctactaaaatttagcaataaagatatcctgtctttgaaaagcctgtcacctgaaggaagattattggaaagctcatcatagctaagtgggtcagatatatacatagcagcagctatattgatccaccagcacaaataaggagtttctgaaatctctaatctgtaaatcctgtatattggcaggtagaatggctgtgactgatagtatctgtgcatattatcaggctgagcacatctgcctatgttattaaaatgtgggagactagtgactagttgttggaagaagcagttttatggcacaacagtaaagatagaagatgctttttttctgtaaattgaaatcctgtgtttgtgctgacttatcctttccccaggttcaacttcaagaagctgagaggaggtgggaagaagtccagagctatatcaggaagaggacagcagagcatgaagcagctcagcaaggtaaggggaagaaatattcatataaagttactatgtaattctgggtaaaatttctgcccttctccgtatgtgaagaaagtataaattggcatttggttatagctcaataaaaatagcttttacactttaa

SEQ ID NO: 29401 - DNA, 3147 bp, Bovine  19866880475127
aaaatggaaaataactacattgacctttcccgccttctggttataaatacaaaccttctgtgataggatggactgctatagaaacaacattttaattgacatggaaaaacttaataatggaatctgttatggggtaggactgaactgggccaatgaatgtaaccttctttgttcaaaaacaccttctgatatttagagcagaaaagtgcacatttatgagcagatgaatgagtctgctgtgaactctgtagcatattggaaataactgatgaatggctttactacccagagcaccgtgtccactgtgggatgctggggccgtataggtggggggtgggtactagagggtaccagcacatatgggcacagtgtagctgccctataggtctctggcattgctttgcctcattgcaacatccactggtaatccagcacatgcctgaacacggggcaaaagggaatatttacgccagatggctgtctcaatatgactacttggtttatcctgctgagcttccaagtttacatgtactttgaaaagtgaaagcgttagtctctcagtcatgtccaactctttgcaacacaaccccatggactgtagcccatcaggctcctctgtccatgggattttctaggtaagaacagtggagcgggtggccatttccttctctagggaatctttaggaaaggagaataagaccacgtgtggacactgcagagatcagtggccagtggattctgatgttgaggaaaaagccgcactctcggccccagacctagatcctcgttttgtcactcacccactgtaaccatttcacagaagttattacctttataatttatcaacagaatgggtcaatgtcagtagcattcacaacactgtattcaaagcagagggaatggtgtacaacatgacactgtctctcctcaaatacaaacctgtgcttggagccagcactttcctgtagtccataacaaaagctttagagattactgttccgtttagctttaaatatgtgttggacattgattgtattaattagagataatcctggtttgaaaaacatgtttttccagaactaatgacttttatgtcaagctgacaagtataattaggcaataaatcgtcaatcagtctggttcagattgctacagggaagatgagatctctgccatccttgtcaatttatgtataaaatatgcatgagtactatttctaaagagaggaggtggctaaagggaattcataatttatttttgcattaatatactctttaaaatattctatcttttcaaggagccatatttcaaatgagtgcccaaaccacggctacaattagaaagtcacaaaatgcctacttggatttcatcagaatcaacagtgtttcataaaataaataaatcaaaatgataagcctatttgttagaggcgatggcgttgaacttggcagtgggccacacccacgcccgtctgggattggctcactgagctattccacaaaccttggcagagaacccagtgcgtgcacagggctggagcagacgcggtcaatcaatccagcaaacacagatgccagagaggatgtctgagcagaaacgtgtttctaacttggagtcactcctaattacactgaagctggatttggtcacggtaccaatcacaggagatcacttgatacagttcagagtatgacacactgagggctgtggttggagagctgggcaggaacacgctgatgtgccttggagcgatctgttcccaggaactcgtacaccgcttacactgatggaaagaaaacctccttgagggcaggaactcctgtctttttgaatcagtcttcgattcaggcagaatactgcgtggctaaaagtacagatcaggtgggtttcctacttcactgatgaccagctgtgggactctacgcaggttacttaaatgctccgtgcctcagttttgtcatcttacaagtgctggtcctcggtccaggaaggttagagctatctcagggcaaagatgctttagcgacttttatatcctcccagtttaccaccaagtgctgaacgacggacaggttcagatccgagtctgtataaacctcttaggctatcctaatgtgcaatccccggtttccattacttttgtctcctgtcttttggaaaataagggatgatgtgcaattttcccacagaggacacacatctagacgcatgaaccggttacattaccaaccacatgtgtacgctagtcaccattagtgacggtcaatttctaatggtgactttgaaaaggcagacttttcaaagacatcaccccacattggctgcatggcagcgcccacgaaacaggagaggacaagggaggggtaaagtcctgatagcacaaggcagaactctggagcttcccccctctcaaggcccacacagcagatgtcagagccgctgactacctaggtagtgacgaccaccgtggtccctggagaaggatggagggggtgggggtcacactcatctggtaggaaacagacttctaacaaatacattcaccagaacagccatttgttttctctggaacgtgagatgtgagaaagaagggatataggaagaaaagatgaagatgcaatgtattttaaatgccatgtatttcagtgaaaatgaaaacaacgatgagatacctctttgttgtacaccttaagactagaagagagaaacctaaccgtggtctcttataacaggaggtggtaaactttatggagacatatttagtcagtcaatggacaatgcgttaaaagatgggtgtgaatttgtctattgcaacatctaatttacttatctgaacattaaagtatctgcatacataagagctacctgtcacaggagacaaagctaattcaaagaatgaaccctaataaatatgaattataaataacagtatcttgcaaaatgactaggctgaaaaagtgaaattcattgttcaataattccatttatatacttttcataaataatgcatttactgggtaaaacaaagtatatcttgtttccaaagatacacaggtatctaccataaactatgtgttacagggagccaccagtaaatgcaaggtctaatttgttgccataagcaggcaaacttcccagtgctataaa

SEQ ID NO: 29402 - DNA, 3377 bp, Bovine  19866880491668
aagggacagaagggatggtctccactactgatgctccctaacgaaagtggaaggcaaacaccaaagtgtacttatcttaagtatttgcaaagaccagctgtttcatccaggatggaccttgatgagtaacttctataactgaaatggaacttaatagaaaagcttttcctaataaaatggatgaatcaggcattgcaatccttcaacatattatattcagtgtccactctatctgctaagtactgtgaacagtcctggagccctcaagattaggtgagctataaataaagtttccagtgggaccatgagtaagtcacagttattatagaatatgccttagtccactgaaagctgaggatggtttcgaatggacagcactggcctggagacttgaggggtttgaactgcacataaaaaaaaaaaaaaaaaaaaattcagccctttcttgcttgggtttttctgacaagggattacaaatttaaacaaagtcctgtgagcaagtttctgagacaatccagaacaagtgagtagacctctatttaaaatgtactatgtgctgggcactaaacttacactaagatgaaaagagcttagcttcttgtactataaagtgatctaagctaaacacatccaaacgacttttatatcctgataagaaatatcgtccatacactagattcctctttgtactgatgcctggatgttgtgttggtgggttgtgtaaccataagacctttgtgagttcttcttctcctatcattagtttaaattctatcccattaaaaacagatatgattccaaataatgtcaatacaacttgataagagcattaatagctgaaagccctcaactcaccttgtgaattaagtctagcatagtccactaagcatggtgtcagtattcaagcaatgatatatttgggaccatttttgttgttgaaggaaaaggctgacaacgtaaccctctgaatccacacatcacaagtgagctaaaacaccagttgttggcaccggaaacaagtcaaaagagcaatctggcacaagggctgaagccgtcggtcacattgatggaatacagaggagtgtatacatatctctggatcctaaaatcaaataacccctttctcccatgacagctcatggaacgcacttagaatcaactgagggcctgagcagagttggaattggagactaaaaggaagaagcacaagatgagaaaatatttagaaagcatcttacagatagcatcatcccttagtgcttcataatcacaatgttacgggtgagtgcctatcaaattatagccgaggaccaaggaaagcacagaccttttcagagcagttactgctcacttaatggtctgatgggacaaaggataaattcttgagaatgtcaggtattcaataagtcattttcttagagaggaaagaccttctagaatttaggcttattacccagataaaagtcatggggtcatgtccagaaggaatttgcaaagtcaagctcaaatgttgcaatattagttcccaaagctccttagtcaaaccaaagcactttagctgctctggatcgctcatttatgttccccaaatgccatactactgagaagcaaaagactccacagtgaattattctgaatggatccttacacaaaaaccctaagaataggtagactgtagctatggaaaaatgaaaagaccaggtaaagttgaacaaataaattgattaatctggttttgaatcccagggccactatttggcagctctatgactttgggaaagttattgaacacctctgaacctcaattctctcttttgagaaatggcagtaataacacttacctcatagggtcattgtaagaattaagagaggtaacatgcagagcattatagctagcatgtagtggataatcaataaagatcagtccctattctctagtacagcctagaaatgaatgtccatttgcagtttacttttcattgtgctttacctatttttcccattggaatggactggcagtccagaatagtggttaaagcacacagcaagtgcagctaaattgccagggctcaaagtctgattttattgatcgctaactctataactttgggctcattacttaacctgtttgtaacccagtttccacggaggatgaactgaattaatacagaaccttggaacagtgtctggcacatagtgaacactataagatttcattactatcattatcactactgttgttatctgtaacctgaataaaatatttatccctccttgaaataaggagcttatttcaactaagtttttcctgccagttgtcaactcatgttatgaataatgcacattttgaatcactttggcatttttctcttcttgtggaagattctatctttccaaagacaactacaacaatagctgccatctcacacgctcctgtacaaagtgacctgtccttctccatcaacaggtggtatccactgcccctcgaatctgggtgggctttggattgctttagccagtggagtgtggtggggagtgacactatgggttagaacaagtgatttagtgtctgccttgtctagcagaatgcttgcatatagagccctggagctgccaagctgtgaggaagccaagcacgtgtaggtgctctggtcagcagtcctgctcttcaagtcatcctagtccaggtgccagatatgggagtgaagcagcctccagaattcggaatcatccccaacttttaaaacttcctggctgagacctccaacattgtagaccagaattaacacattccttttgtgccctatacaaactcctgaccaacaaaacccataagcatattaaaaatggctgttattttaagctgctatattttgatgcaatttattatgcagcagcagtagtaaatggaacactgtctttcaaggagaaatttccattattttaaacttttctggagttaacatgtgaaaaaaattgtttggttaacagaaaatatggccctctttataataagccatgggagtaacctagaatgtacatttaaaattctatttttcttttgtgagttgatgggcaggccatgggactcatctttatgtattacatgccaaaaaagttcacatggtcctcctcctccaatacatatacaattatttttctagaactggagtttccaagaagaaattcttttttttttttttgttaattggagcagcaaagtctctctggtgtttcctaactctgaaataaaagtcatttagaaatgttcaaacagctgtatttaattatcactgtgcattttaaatagcaagcggtctcagattcaaaattattcagtgactgtaaaagggtagaagggtctcgatcaactcaca

SEQ ID NO: 29403 - DNA, 2381 bp, Bovine  19866880503566
aatctatacagaaaagtagcaaatggaaattttagaaattaaaaagtcctacatctgaaattaagaactgagtagatgggtttaacagcaaataagatacaggtaaagggaggtttggtgagctatacagtggctgaatagaaatatccatcctggggactggaggaaaaagaagatggaaaatatgtaaaagagtataagagacttgtgaatagatctaacatttgaattctataagcagagaagaatatttgaagagataacagttaagaatttcccaagctgatgcatcaaaccttaaatacaaagattctctgtgaacccaagcagggtaaatagaatgaagaccatgtctaatcatataataaatctgaatcaacacaaagagaaacatcttaaaagtagagaagaaagatatatttacctctaaaggaacaacaataagacatttgacttctcaagagaaaaaaaaatgggatccagaaaacaatggaataagatcttaaagtgctgaaagaaaataattgccaagttagaattttatattaaaaattttcccccaaaagtttagatctgaaaaagatgtgataggtaaataaataactatatttcaatatcagaaaaatgggtaacaaaatttagaatgagcaaaaggcatgaataagtattttgcaggagaagaaatacaaatggtaagttaatgcacaaagagaaaaggaaagtaaagggccaaaataaaactattttaggctccaaagcatattttaatttacttgttggccatgcagcatgtaggatcttagttccttgactagggattgaacccatgacccctgcattggaagcgtggagtcttaacctctgaactgccaggaaagtcctccaaataaattcattataaaaagattttataacccattaacttttttggatggatcaaataatgttaatagatgttaagtcagaccttgaataacgaagctagaaagatgaagcctcatcttttcattttgtaaaatacatttttatctcatctgcgttacaggaagaaaatacagagacaaagatgttcatttgcccaaatttaagaaggagaaagtagtaaaagaacttatattttaatggatccatggtcttaaactgtttattcctttgacacttcaactgtcactgggaaaaggcagagtttgacactgatccccatccacatgggaattaaattctaatagtaggagacagagaatgcaatggcatcccactccagtactcttgcctggaaaatcccgtggatggaggagcctgataggctgcagtccatggggtcgctaggagtccgacatgactgagcgacttcagtttcacttttcactttcatgcattggagaaggaaatgtcaacccactccagtgttcttgcctggagaatcccagggatgcgggagcctagggggctgccgtcaatggggtcgcacagagtcggacacaactgaagcaacttagtggaggaggaggaggaggaggaggagacaggtaggaaacaaacaaatggtaaacactttaaaggaaagtgaagcagataagaggatagaaaggaaagaacctttttagaaaagggctttgtgcattttttaaaaaagtaatatttatttatttatttaatttattgttggcagtgttggatcttcattgttgcgtgtgggttttctctagttgcagtgagcagcggctgctgttcgttgaggtgtgtgggcttctcattgcggaggcttctcttgcgaagcacaggctctagggcacgcaggcttccgtagttgtgctgcctgggcttagttactccaaggcatgtgggatctccccagaccagggttcgaacctgtgtcccctgaattggcaggcgaattcttatccactgtgccaccaagaaagtctaagaaatgaacttttaagataaactgatcaaggggctcttcacagaggacatagtgtttgaacagagatctagatgaagccagggagcaagccacgtcattgtttgggagaagggcattctaggcttcaacaagaccagcacaagtggacagaaagagtgaagggaaaatgaggtcagaacaatagtcttagggagctatggggaggatttcaaattttctttcattgttaagcactttgggagactttgagcagaaaagtaacaggatctgacctaagtgttgaatgagttaccccgagtactatgtggagaatgagggggtttgtgtggattcagggacactatttaatgggatattttattagttcaggcacgatactggcttggtctgagatggctgtagtgagttacagagaaatggctagtgatatttggaacatatgcttaaaata

SEQ ID NO: 29404 - DNA, 1936 bp, Bovine  19866880516945
aactagtgatgaatgtatgagccatacaaagccagtattggctccgttttctctgatttcctttggaaatcaggctcttttggttctgtcacagaaggttacggagtttccaatcagggtttatgtggagtggcgggtgccaaaccaattagggcatggtcatctccagacccagggagatagcgcaatccttcagccacccaaacccaggcccttcaaatgccttttagaacactcaccccagagctcagtcctgtatccacccttcattccctgtccacttcaagaagcccagccacatgtgagctcagtttccttctggcttgggtcgagaccataaacactctcaggactactgatgtcttcctcctccctcttttaccacatccagtatgcctggtccatattcctgggtttcagttctattcctatcatacttcagttctatgcctgcatttcccatccaggttgggaccagaaaatctgcctaaattttgctagccttctctctccagacctggcaaccatcttctcattccatcttccatcaggaatcctgcgcagtctggatagactggatatgttagggtctaaggataaggacctccatggccagaaccttctgatgctaggcttcatctgtcagatcacacccataggaaagcagtatccttccaggacagcacagcagtgaaagcatggactttacagttatccagcctttcctgtattgagtgtattttagggcttctaactagttgacaaggccaagtttttctttatagaattccagctaataattacataaggaatagtggaattagaaattatgctttggaacaccctgtgaaacaatgggtttcttctaggcaatgatcaatgttcactgaaagcattaagtaaaattttgatgaagagttttataacggatggatcaagttgacaatacctgatttgactgatcaatcttaaaggcaataatggaaagacagccagacattatcagccttctgatgctatttagtggggaagttcatagccccacctatgtggtgtcctttaagaaaattgaacctgaatctaatcaaaccttttgttgtaaacaccagtttacaaaattacggggaggagaggaaaatgttaaatgatatcatgtggactcatcagatctagattgtggggttataccacagggtgaatgacccagttccttaaatagacaataaagacaaacaaacaaaaacccaagggttaaccgttatagatttaaaatggattaagaccatgtcaaccaaatggaacatatgggtgaaaatgctttgtaaatggccaagttgttaaacattaggtattaatattacgactgttgccctatctctcagctccagatccttaagtctggtaaatccattatcaaaataaacttcaaaaactgtatactttatttgccaaagcttgtgtctggaatatttgaaggacttcagacaaacgaggaaaacacaatttcctaaatgggcaaagagaagccatgacagacaggtgatgtaatacctagcttgaatcattaagcaatggcaaaactgaatgtctaatcagattctaagatctaaaccttcccatatttttaaaaactttcttgtcacagaaagatttagcttgagcgtgtatacatacccatatgtactcactttaaacagtatgacaatgttatatgcttatatatgtacacacatatgttgacaaaatttactaacatatgttcatatatacacataccttgaagcaatgaatagataacaaaacttctcgtttttctctctccgaactaaaagctctcatagtaaaacactggctatgggacactcacaggataaattcatctggatacatggaagagttcaaaacaaatcaagattttatctcttcagttgccagt

SEQ ID NO: 29405 - DNA, 1806 bp, Bovine  19866880538177
caagtatgttcccaaatgctttacttttaataaaatgacagtattttcattgaatggtagagtgttttcttcagtcaccaaaatgtgtttgatagtaattggttagacttttgctttttacacgtgtttttaaaatgaataaattttcaaaacctatcctcctgcttttgaagaagctcttcaggtaaactgcatggtaaatactagtgccaccagtgccataacttacaaatttaagaggctgaattagcaagttttagacctatttcctgtaacagcagttctcaaccttcattattctgaagagtatctggcatgttagctacaaatcatattcttgagtcttatccttgtaagtgtatgatttagtggctctgaggtagagtcctggaatctgcatgttaagacacattccttgtgatagtgatttagttggtctgagccatacttgagcatgcaagcatgcacagtgccatactttgagaaacagtcctagagaagactagcagcatgcttacatagaataactattctgattggttgattcagagcactgatttgagagtgattcatgctcatggtgtgtggttacccatttttcttgattattttatggtaacttaagtgtttatattattgtcatcagaatgattcagagattatattcaaccaaattctttattagtatacacttggagcatttgttgtcatttacctgtaagtggaatcactaactcagcaaaactcatatgttttctttagtaatttacatgtgtttgtaataatggaaggttcctaatccagttaactgttttcaggcagtctgctgaactaaacaaactgcgccaggattatgctaggttggtaagtgagctgactgagaaaacaggaaagctacagcaagaggaagtccaaaagaagaatgctgagcaagcagttactcagttgaaggtgaaacattacctttatttatcatttcataaataatgtggcttttcaatccaatgacctgaaagtgtatatagcttttgagaaatgtagtttgaggcttaatgggcctgtatagaaacatttacactaatgaaagaattgaatacaggcttgagtttgaagttaaagactatttgaagatatgaaaattgatattagctgagtgacaggcataaacagaattttaccttatgtgtggaggtgagggtctgcatgtataagacaaaaatcaaatttttgatagggtagttaaaatcacccttcagcatcacttatcaataacttggatctctaagtaaggttagtagagcctatttttatttcagcattggaatagatgattttctgttgtgtgagcatgaggccaagtaatactccagttgctttcacttgagccacagtagaaaaaaaaatcacacagtttctttagacaccagagtggcacttggtgccattagatgcttatactgagaagacatgcatggggttgcttaggctgactgagagagaggagtggacttatttttcttgcacattttagcctgtgcatattgagtagagtgatgagtagaattgtctgttcctccttgtacagaggagaggatttgttgaacagttcagtttctgtaagttaaatgtattggatagattcctacataagtcatcaatatagatggtatactttaataccaattccagagttcagttcagttcagtcgctcagtcgtgtccgactctttgcgaccccatgaatcgcagcatgccaggcctccctgttcatcaccaactccggagttcactcaaactcacgtccat

SEQ ID NO: 29406 - DNA, 1236 bp, Bovine  19866880578973
ctgatttaaggaaattatttttatgcatcctattaaactttttcttttagtgtgggggtggtgtttataaacaggttcatattagcttcttctaaggaaaaaaatgttaattttcctcaatttagatacttgactagcacaagatgactagaaatgcaattaaaagacatatctacatttaaacgaaattcctaaaaatgaattagcttgattactatttaagaagaaccgtaccttgttatacattggatatttctaacttgtaattcatgaaaagccgtacctgttcagaaacaagagtctgtagcttctgaacttctaattgtaatgctttgttttggtcacttagaatctaaaagaaagaatctcaatttactgctttattaggaaaaattaacaaagcaaccatttgagtaagtttttaaaaaatcaaagccgtataattactataagcacttataaagtgagagatgaattatatactgacctaagaatgcaaatctcatggtggcttcatttttcggtttcaatgaatctatttccagggtataggaatacagtaatggtataaagtacatgtatgatgatatctaaaaagtagtctaattcagtcatgtggtttctcccaaatgttttaacactgggcttagaaccctttcatgtgtatttcaaaaagtttaacaatttgtcccaatgaattctgggaaaccctgctttcataagagagtacttacaggattactattaagcaaaaaaaaaaaaaaaaacacaaactaaaaaaaaaaaaagcaaatcttactgcatgcagagatgtacccatgcaatcagaatactttacaataatactcaagatatctggccatgaacagaaactaatactacatcagcaacagaggcaaataaaaacatgtcaaactatcaactaaaaatgtagagaaaaggttggggcaaaacaaatatcaagtctattataaaaacaaattagtcaaaataatagattaagtccccaagtaaactatagaaatactttttcagagtgattatatataaaaagtagttatttctacattcacttcaactaaaaattatacaaggttgttcaaagaaagctgagttgacaagtttaattacacaccttaaattcttccattttgtttgaaatttcacactgtagctgctcttcaagcaatcgtattttatcatccttaacatgaatactgtaagaaaaaaaaaata

SEQ ID NO: 29407 - DNA, 939 bp, Bovine  19866880580873
tgtcctctcccgccttggcatgtagtacagccctgtgatatagccctgtggtcttcctattccttttttgtgtgtcctctcaaaaacttctgggaagcaatgacctcctttttaggttggtatcggatgtttttcatctaaatgaaagagttgcaaaaggatataatttctggcatattgtaaatattgacattttagaataaagctgttacagcactttttaaaatttacccagtggaatcaaaataccatagtgatttaatatccatggttctaaaaacacatgaacaagctattttttttaagttggaaattttacagtgtttcttttcttccttggaaattgtatttccatttcacttctcttgcataactttatcctaatgtgatatatgtttatgctttgaaagttttttttattaatcaccttatcattctactcttcaacaaaaatatgtatatacattgaaaaattttaattgcttattttgggaggggttaccacaggactctataagaaaatttattatcgggttaagttctcaatggaattattattagtacacaattgatcaagactatacacacacacacacacatacatatacatattacatagtttagtgttcatctctcagtcatgtctgattctttgctgtcccatgaactgtagcccgtcaggctcctctgcccatggaattctccaggcaagaatactggagtgggtttccagttccttctccattacatagtttaatggttaattattaaacataagaataagtgtgctagaaatgtatctcttaatgcaatggatgggagagttatttaggcaattcaagtgggctttgcagatactaacgcttctgtgtccttttatttgttgctagaggttcttcactgtagaaaaatgcatctcagtaagcctgaggccgtttc

SEQ ID NO: 29408 - DNA, 4775 bp, Bovine  19866880582929
aacatgtaactcagtgattttcccaaaatggtaagatgggcaggttcaggttcttgtaaccaccaccaagctccaaacacagaatgttagaacactgccagcacccaggagcccctcatgcctaaacccaggttaactctgcccctggttttcggcctttatatgactgaaggcgtgcagcctgtgtactggctgtgagattcgttcacgtgtgtagtaatttttcatgcattttccttgctgtgtgtcatttcactgtatcatcgtaccccagtctctccattttactgtaggtggatatttggggttcttccagacttaggctgacaacagatcttgctgcagtaagtgtcctcgtatgtgccctttcatgcacatatgtacatgtttcaggatcatgatcgaggttgggatgtgtatgttcagcttcttaggggatggtgccagttgaacacctgccctcacttcttctgtctttaacaactctgtgtcctttcagtggtagatattttgatggtgagtaggggcttgcttggtggttcagacaatgaagaagctgcctgcaatacaggagacacgggtttgacccctaggtccggaagatcccctagagaagggcatgctacccacttcagtatcttgcctggaaaattccatggagagaggagcctggtgggctacagtccacggtgtcacaatgacttggacacaactgagcaactaacacttttcactttgagcagtatatcatggattattggtttgaatatgaaaagcaaaataataagctttccagaaaatagacggaggatattcacatgtccttgggcagagatttttaaacaggacacataaagaagccatcagttatactatattaaaatcaggaacttctgttcattaaaaaaaaaaaattacaactgtgaaaagatcacagcaccagagaagatatttatcatatacccgacaaagacttcgatatatctatccaaatatattttaaaaattaggcgaaaacaaaacaaaaatttaggccaatttttgaaaaatgacaacccaactgatcaggtgcttccccaaataagatatccaagtggccagtaaatgttgaaaacatgctcaattaacgtcatcaaaggagaagcgaattgaaaacaggagagtgttctcaagggaggaaaacgtgaagaagcagaaccccttcccagcctcgcctagctcactgtccccgcccttccagaatggtctcacgtgacttgacggcatccggcacccgaagcagcagctgggctggggtattcttgcgactcagctttcatacttggcctccgcgggcagggagcagcggtgcttgacctgaggagctcagctgtgcctctctccccgcccgcttaggatgtgaccctcggcgagacttctaaggaagatgaccgtctatcgactgtcctgtcacctgcagcctctaaggctctggcttcccacttcatccagccccacagctcagagctggtccttccagaaccgcattgttctgttaatcacccctaatgcctggaatttactcagcaggcctccgagctgctcaaagccatttgcagatcctgctggtaaaatggctgtccctgggcagccaagctctctgctaaattacttctaagcaaagaagccgttctcaaaactctaggagactcggagtgccttgacaagcaggccctgtccccgcctgcgccccaggaggaaagcacagctcctctgggcattacgagatcatccaggagggacagtggtctccgtaattatgggagtggttacccaggtgggctggcagacctgcagacagccccacgccagggagcactcagacgtgaggagagggaaactgaggcaggccaggacctggtgaggggggcaggctggcagcagagaagaggggaatgtgttttggttggggaactggaggagcaaagcagatgggtagaaacctgggacgcagaggaactgaagtctttctccattttcagcaggggccccctggtattcttcccaatatgtctcccaagcatcccgcctttgagaccagccctgtgtgggcacggcctcagacaccctgtggaccccgctgcttccctgggcctacaggatgatgggggctgggtgctcagagctgcctctgcacctggcagcctctaacccagctgaccgctggtccttcccttacgtagccctctggacgccgtgcggggagcagaaggcagtggcctgcaggccctggccacaggcccttcagtgcaggtgcacagacacaggaggagcttagttcctagggagggcagcccctctgggaaaacacgggaggtgggagacagagcagggcggggtagagccgggacatggtggcaggaagggaccagccccccagagtgtgagcaggttgggacagctgtccccagccaataccaccccgtggctcggctattccctacaattccactcccccgtccttctgggtccagagattgggttgtgatcagagtctggcagtaggtgcgggaaccctcagcctgggggcctgggtgacagctgatttatctcatcctttcccattcatgcctctcatgtacctcagtatccagaccgggctgtgagccccctgtccagtatcgagaaggtatgggtgctgtctgtacaggctccacagggagcagtgttcagaaagaggaggaatagggcctccctggtggtcccggtggtgaagaatctgcctgccagtgggggagtatggttggatccctgggctaggaagatcccacatgttgcagagcagcaaagcctcggcaccacaaccactgagcctatgctctagagcctgggacccacaactacagagcccacgcgctgcaactgctgaagcccacacgccccagagcctgtgctcggcaacaggagaagccacggcagtgagaagcccgggcaccgcaaccagagaaagacccacacagcagcgaagaccccgcacagccaaaactaaataaagtttttaaaaaaagaaagaggaagaatattgcagtgaatcgtggaaagggaggtgttcctctgtgcacacaggtctgtctcctctgtgccaagtgagcaagggacccctgtgatcagagagaacggggatgtgagtgcccacgcccacccactgcccaccctgcctagttctgtgaaaggcctctgatggcgctagcttcctgaaccacctgggagcacctgtcagacccccagaaacagactctgccgggagagacctggagccacgcatctctgacctgctcctctagcagagcctgtctgtctcagtgtgcttgagctggagactgacgttcactggctaagcctgtgtgtgtgcatgctcagtcgctcagtcgtgtacagttctttgcagccccgtggactgtagcccgccaggctcctctgtccatgggattctccaagcaagaatactggagtggaatgggttgccattcccttctgcaggggatcttcacaacccaaggatcgaacccgcgtctcctgcctggcaggcagattctttaccactgagccacctggaaagcccatacttttagtactaagaataatttcagtaatgactctattaggaaatctattatttctaggaaatgtgtaagatgagttcacttcttttttaaaaagttatgattttagtattttacctatcactttactacagttaagaactttaacctcacgtcaagtttcagcaaagtgatttgcatactacatgggacttacacaaaatgaattgttcatactccccttcttccagggtattgcctttagggtttctcttcttactaattactctccttctttagtctttatgattcgtcctcctcttgaagtgctcttggttcactttactttctatattcctctgatgatctcatccaatgtcatggctttaaatacctatatgctgatggcttccatttttctatctccagcccagacttacctcctgtgttctgtaaaacctgttctgaatttccttttggatgtgaagtagtaaactcaaactaaaattccatgttcctctttaaacctgcctaaggtgcagtgtaatctgtcgtactagatgacagctctgtccaacattcaagtgaaaagaaaatggaatcatccctgacttattcatacttggtattcttggctcagtcttattttgaaaatatatccagaatcaagtcacttcttaccacctccattgctcactaggctagtctaaaccagtcttctctcttgtctagatttctgcagttaagttcctgatgggtttctctgcttctgtcctggctctctgcagtctttttcagcagagcaacaagatcataactctctcttcaaaaatcctgcagtgacttcccatatgcatcgtaaaatctgaagtccttatgacctacaaggtcttacagaatcatcctactctccgcatctccccttgcctctcccaggatagcgactgctctgcctcctgcttatttggctccagtcccactgtcttagggactttatgctggttgtttcccctccttgaatcactttttctgtgaggtatctctatgagccattcacttgtctccttcatacctgctctttaattgtttttcagaagtctgctttcctgcttaaagctgcacttccctgcttgtgatccctgttctgttttccatagcgattgttaccttccaacaagctctaaaatttgcttg

SEQ ID NO: 29409 - DNA, 2045 bp, Bovine  19866880593003
atttccttggtctggagtttggatcggatgctggcacatgacccaagctggatcaatcactgctcttctctgggattcttgaaacacacccttttcttcttgaatggcaaaatggcaaaatgggagatgtgaactcagggactgcagacaccatgggtctggccccgaggagaaaactgatttgtggcaggggaaaatgcagctgtcactcagagaagcagggacaaaatgaggaaagagtacagatgacattcacatcctcatctgagttgtttggagctgtactgtgtctctttctagtaacaggagccagtacactttctatgtggcctaagcgtctctcagttgaagttctggtaatgtacagcccaaacaccctggctaacgccttactatgactccactttttcctcccttacttatttcttccctctctagctctcaaaagttgtttaaaggtatttgctccaccacctctgagaaaagaagctaatttcttaaaaatgagtgacttgccagagtcaattcatatttaacataaagagatatgtaaagtgcttagaatagtgctgggcatacaataagtataatctgtttgctattattattaccggtagtagtaatagtagtagtagtagtcagaaaagatacaatggtatatggtggtgtaacatgagagtatcaaaagcccttccagattaataggacttggtgatgcattacccaagaaaaacatataaaatggtaggtatgagtcaatccactttttttccccactgcctcatttttgatctcgtgccttagaaattcctgcagccaatgacctgcttttgcagcctggcatgtttcgtttctttgctctccgtgcctggaaagccagttgattcatcatgtccctggtatcacttcgtgtaacaactgcttcaactgcccaatctgctttccaggaataccagtactttgggaaggttgtgaaaatgaaaagactagtctacattgcatttcttggccacccctgccatcttcattccatagtatatgttctcctatctgctgatacaacagtccagtcagaactgacggaagtctgtattttcagtccattaattatggactctgtcgaggatgaacaaagtttaaacaggaaaaaaagttgataccaggcaatgcaatttaaaagtacatggcattgtgggtaaagttcagtataatcaatctgccagcatgtaatggtccacacgcctttgggctctgtccttcaaacaaaagttgatttgtcttttgctactggctgcttgagtaatcctgggaaataaagaggttttagatggagtcaaaaggatgtgtcatgattgaatacaatattttatatctcatggtctcccagtgttcactcatcttgtggaccccggtgaccacctttaaaatgcttgatgtttcaaccaatcacaactttctcatccatatatgtaacaaatagtcattcatatttgagatgaaaaaaaaatgtagctcttctgtgtatcttgtccttaaattaagatctttttgatacttgccagagaaaacaagttctagcctaagagtttatagaagctctttgttactggctaagagtttatataaaaatacagagtagtatgacagtttcttgtgttgagaggtgtgagaatcaaccaaaacactttcaacttagcccactgaatggacatatactcgtcttccaccagagtctttcttgtgagcaaatgactagtcagagcctttcttgagccctctgagttacctggacagtgctcagtgaactaaacttggccagttatgttcttttgaattcatatactatatactcacaaatccttattgccagaaggaaatcttatggtgaggacagtttttgctccaaggctatcactgccattatggatcctatgggccactatcaattcactcccttttgtgtatttcttactatgctatttcttatctaatcagtaaccctcttcaagcttccccattaatatctgaatatctttcaaatgtca

SEQ ID NO: 29410 - DNA, 1304 bp, Bovine  19866880614304
atgcctttagatctgatatctttgttccattgaactaaggacagtctctacttacctccagactttttaatacatgggagaaataactttctgcgtggcaactgcacgtgcaagcctccttagccaggtctctgttcctagcaggtaccacctaatagcaaatgtgcaacatctatctcccagggcctaggttatacacagagaaatcggcaatgcgcttcaacgtacttacaagtgtgcctgacaaactggaatcctaaacaacatcaaagaacaaatgaacactcgactgcgggatcttctacatttcagtcctctcgggcgaagcagttagttgtcttggcaaaggtcatgcaggtctatggtcacgtttgagaccaaacccacagatttaggtccacctatgctctgtatttctactgctgtgtgtcatcactgagccagcccaggagactctttggcctccctagttagtcaaggattagagaggcagtcttgacatttataaattctgttatatcactggtcatgtcaaaaagagattgtttgttgccaaatttgtgggatttgggaaaagattctgctgtcatggaagactggctagaaggacaggctcctctttcactcttacagaaaatctactcctgccccgaagcttgagattccatttcctttgctttgataaactacaagtggttttaaattgagtcataaatttctccaggccttttggagaccaagcccctgcctttgattccctcacctcctgcggcagtgaaacctgctggagacctactcacatcctttgtgcacatttaggctgggagtttgaaatttacaggccaagctttgcagcacgacctccactttttaatagcttgaaaaggaaccagagagactgcaagcaggattcatcagggctgcaggtctccgggacagacccagctgcatctagagaagaccctcacaccagatgctacaaatgagcaatattttggtggctctgataaacttctcgaggtgactatgtggactcctggttatggagtcctggtcatttgaagtcatcttaaatgagtttttctttttaaaataatgatttgtaacatatatgctttgccttgatttgtaacatatagactaagcttcagaaactgagtaacttgatgtgtaaagctggtacgttcagggagaaatggttagcaaaatccctgtctcaccaccaaatccttctatgtacccttggcaagtcacgtgcagaagaccctgggctgctttgcaggtgcccccattatccttgattt

SEQ ID NO: 29411 - DNA, 2110 bp, Bovine  19866880625616
ttggtgatagacagggaggcctggtgtgctgcgattcatggggtcgcaaagagtcagacacgactgagtgactgatctgatctgaggtacttaatcagctagatcatagattcatttaaagtcagtgaatctatttgtccagtaccgataaacatcttgtgttctccattccaggttttaaatttaagtggagaataaagtgagcaaaatttataaataaaatattagccatataataattaaaatgtattttataggaccgacaagtgcccccttttttacccttactctgaactaataactttcccatttcattaagaaaatagtagcatcaggaggataatttacacagacttatacactgtatctacctccttgcctgtgcctatatattccctagatgtcagtgcttccgtctaaggccagtctctttagttgcacaccaaattctttccctcttgccatttgaaaacgttgtccctcacccctctctctcctgcctcatcagactttccccttctactggatcatctttatcagtgtattaacatgctgtaatttcttctgcctatacaaaccaaattcccaacctcatattcccctccagcttccattgcacttttctttattacttcataggaaatctccagagtcgtctcatctgctggagttctcacttttcacttcttttcagtcaggttttgatgatcaccactctattgttttggtccaagttaccactaatgtctgttgctaaaatccagtagtcagtttctagttttcattgtaccttatttactaacaccatttaacaaagttgattcatctctccttcttgatatattttattcatttagcaaccagagtgacattctcctaattttctttttattttattctcaattgttcaggggctctgtcttgagacctgggctctgtttatcctcattcccttggtgatttttttctctaagccatggtccttccaattctttgtcctctgcccctttcaaatgatctcttcaacctcatcttttactacatttcctcttgtacattgtacttgtctttattgttcttgctcaaatgtgtcaggtgtgttcctgtctcatgtactgtatataagttgtatgtaaattgtgtaacagtgttacacttaatggatgataaaataactatacaaagtgaattaatagactgttgtggaagatggtagttgaaaagatactttcattgtaatgatttgagctgtgttttgagggataagcgaagatttgataaaaggaacaaggcaaaactttgtgggtttgatactagaaaggaggggcaattggactttgtagaaagtcattccttttggtttcccgatttagagtctgctgtggctttttactgctagttttgtctacttagttgactgctaaccttccgtatctggttatagtttatatttctcaaaatcatatctagaactcccagacaaaaacttactcctgtattcttgaacttgacatgtgatttcatagtttacagatttcttccaagctggaagcattggtgttgtcttagattccttcctaactttcaccatcccctaatctccattgacttaattcaccctatcagatctatttagcctattgaaatagtcattttaattggtttccttgcacctgtgttaacctatccattggattttaaattttgattgtaacttatttgttagaagtcctaattgattcatatctacctaattacttttgatagtttctattttttactcattccccagtttcctcttagttacttgatgtgtggtaggttataatctatatctactaattcaggtatcttaaatctttaggggatgtgattccttagtttatttctgttgcctcttgctcatggtggcttatcctcgtgttctgtcattttgtgttatgggctcttatctgaatgacagtatttgggaatcttgagcttcctggcttgagggagcaacccagcaaagaaagatgtgcattcatttttgtcacatgcactatgggtaccaccaacttgggaccgcttaaatattttgtcttggcatttccaagatcatgtaagtagt

SEQ ID NO: 29412 - DNA, 1378 bp, Bovine  19866880699646
ttactattccccacagcctggcgggctgcagtccacggagtcacaaagagtcggacatgactgaatgactaacacatacacattactttgataagctgtgtttagaatgttattttccccaaaatatttttaggaaaagagaaaactctagtgaagagcaaatttgactatgctaatacataaagtacttagataactgtcccttgagtgtttttaaaggaaagtaattcttaaagctatattagttatgattattttgcctcttgataagggtgaaagaggagagggaaaaaaactggcttaaaattcaacattcagaaaactaagatcatagcatccagtttccatcacttcatggcaaatagaaggggaaaaaatagaagcagtgacagattttattttcttggcctccaaaatcacagcagatagtgacctgtagtcatgaaattaaaagacacttgctccttggaaggaaagttatgataaatctagacagcatattaaaaagcaaagacatcactttgccaacaaacatccatatagtcaaaggtatggttgttccagtagtcatgtacagatatgagagttggaccatatggaaggctgagagccaaagaattgatgctttcaaattgtggtgctggagaagttcttgagagtcccttggacagcaaggagatcaaaccagtcaatcctaaagaaaattaatcctgaatattcattggaagggctgatgctgatgctgaagctctgatacttggccacctcatgcaaagagctgactcactggaaaagactctgatgctggaaaagattgcaggcaaaagaagaggggggtagtagaggatgagatggttagatagcttcactgactcaatggatatgaatttgagcaaactctgggagatagtgaaggacagaaaagcctagtatactgcagtccttggggctgcaaagagtcagacacaacttagcgactgatcaacaaaaatttttattatgtatgatagatgacataactcaaatcagcccatgtgaaaatgtgaatgaaaagtaaagtctgaaagggcatgtacttcaggtgtggcttgatcaggcttacatgatggcattatatactgattactgatatcagctttctccataccaggtctaatctcaagccttaagtattacagttataaagtctcttccagcagtccccaaggctatatccttccaagtttgaattaaacagaaaatagcaaagcttttatatatccagtgattcacacctaaacatcctaaaccaatttctgtgatcaggagaaatacagtatattgattgatttaggcctagatatatgctctatcctgggcttcccaggtaaagaaccca

SEQ ID NO: 29413 - DNA, 2328 bp, Bovine  19866880730089
tgggctacagtccatggggtcgcaaagagtcggacacgattgaagcaacctagcacacactcaggcaaggctaatgataaccataaaatggaacttcattctctcatttctctggtctctaacactatttcatgaacttatcaactctactggttactattataactagttactgtttggttataattcaggcatgggtggaggtgggaaagcactagaaaccataataacagtatctacttcattaaggcagtaaatgctacagtcaaccacacttttttctatttataataaaatcttaaatttaatgaaaaaagaacatcatataaattcattaaacgtgggtaactaaaagctatgggaaaaatattacacgttacagaaaaaactcttcatgttactgaataatcacaggtaaaacaaatataccaaatatgctttacattcagctcttcctctttcgtggccacctgaataagtccagtttcgagtaattcttctacagtcttcaacttctcatctttctcttgaatgctgaaataataaatttaaaacacatgtatgaactctatttcaaggaaaatgacatgatttctaaataaatatttgacatggattaactcttatgcccatcgttctttataaaactttcaattctacaaaggtttctgatgatcttcaatcctggtccaagggttcttcctctttaccaataagtaaaatgtattcaagtaatgcatgcttacacgctagcctaaacaagtaaatcatggtcatacatgactctcacaaacctaatggaatgccaaagcaatcaacagtacatcactctcttccctttatgaagtacaaagaaaattttaagaatttacagtaatatagttaatcattctgttatctcaggcttggtagaaatgagtcattaaaatattaaaaataattttaatctcttaccatctttccatttgttccaaaacatctttattaggctaaaacaaaatcaccaaaaaaaaaaaaagatacttttaccaagtttgcatgaaataaaactactttataaatagaactctatgaaaattgtttagtattaaatagatccaaaatttaggaagatgatccgtaaagactgctaatagttaaagaattttttcattcagaaaacacaagagacaaggctacacaaaagacaaagatgaagtataaaatgggctggaaatgcccaaacttacccttgtgagtaagtttttaattaccataaaagaaaatcttaagggtaagaagagaatttgcttctcctttacattaattcttcaaatctaaaattccaaggctctaaggccttgtaggccaagaaagaggctttgctctttttcatttttgtttctcacctaaggtataaggcaagtgtacaaaacctatgttcaattcaatgaatttttaacatgcagatttcacataaccaccatctaagtcaatatacagaatgttttaaaactatcaagtgcagaagaaacacaagcacatagtctccttgttacgttaaaacatgacatgtgagctggtccccatctttgacccatcttctagtattccccctatacacacaaattcttcaatgttataatttactatgtgtccagaagtggggcacccccttcgaagtcctaggccttcaggcagctaagtaacctgacaaatcaggttcagggtctttttcccttcaacattctcttctaccccttctgttccctacctgctttctcctaatactactaggtttgtaattttttcccattttactaaaaccattattacaaccatttttcacaaatactattaattttttccattaccaaatcctagtcctaagatttcatttattaaatatttctaaaaattaactatgttttattcaataccttaggttaagtttccagctttacacatctcaaatatcataataccctgcctctagttcacaaggattatattgtgaggggtacaggagaacttctcaatgggaaaaaaaactttcctaccactagaaaggaaagaggtgtcaaaaatatattaaatcatgattataaactgaaaaataaatcatgcaataagtttataaacctttcatcaagatgacttttgtccatctttatttttcatgaatcccatctcacataaaaacaatataaaatttgcgaccatgcatgatggcagatgttaactagacttattgtgatcatttaacagtaatacaaatatcaaattattatgttatacacctgaaattaatgtcaattgtaactcaattttaaaaagatactattaagt

SEQ ID NO: 29414 - DNA, 1006 bp, Bovine  19866880750942
tctcccccttttaagtaaaagaacagcttgcagccaggaaaaaacacttaagagttcttcctaaacaagaactaagcagtaactactagacggttgaagcctatacacgcaaggagacgctggtgacacgcttcaaaagagcacaggcaatgtaagatttgtattccaaagaacactggggagaactgagttcctctcaacaataaaggcttctagagagctttgaaagctatagcagaacttatatacaattatagcattaaacctcacagacacttcaagaaaacaacacacaggaagaactgacctctattcaatataacctgttcattaatagttcttactgcataaacaaaattaacaattcgatactctaagttaataaatgggagtccaccatggaaacggatttttaacaatcacaaattgcactgggaaagcacagctaagttgccttattccaacaatgaaaaaatcctagccacctcaactgcacaataaaataagacttatgagcacgaagaaaatggagcaaaagaaaaagaccagcttaataatgtcattacttacactttcttaagttcttcaactagagatgcaaaggaaacctagaaataggagggtatcctacttagtaatatgctcaaaatataaatgggccataaatagaaaagtatgttattttttaaattaaattttctactataccaaaatctgggaaaaataaacctggaaattaattctttccagatttttttaaatgtcagaattatgaaaagcactttgaaagtaaggagctttaaagctacttatggtaagtgtaggtcaaaagaaaaaccaatgtataaatattaaaattattaactcaatgatcctaaccatataagggagaagataggtaacctcttttactattatttagaatttttactttacatatgtatattcaaaaccatctatcattacagtaacgagcaaggacatgctatctagagtactctatcca

SEQ ID NO: 29415 - DNA, 1924 bp, Bovine  19866880799374
aatctaaaatagatccaactgatttttttaatttagtttattgtaaattatttcaaatcagtagaggaaaggcttgatcattcagaccaaataaagacatccagacaacttaaaaaaatgtataaagtacttcaagaaaacacaagaaaataagtgaattcatcttatatattgcatagctgaaaaagtttaaaagtttacaagtgtattaaatctacaataaaatttttttaaaacttgattctacaaaccaataaaaaaaaacaaattaatcaattcctgaaaaggccatcaaaatacaaaaacttatctaaatttctattctctagtttgtcactacaacaaaattataaccgccccagggtccataatacaagtatacaattatcttttacaacaagaggaaaagattcaaaccaatcaaaagataaaatactttaacaaagcaaacactgagttgcctaacatgggaacttcatttacaacttcctaaaattaacctaacagactacactggaatcttaaagctgaggtgcaatttctccttgtatactgcaacacatacttatttctatgactcacaccttattaacacatcccttaaattatttcagcaatacccaatctagagtactgctaccccaatctgaaacaaatccaactaaagccagagatgagtgatgaaattcaatttctccattaggtatcatgtcacaacacatgaaacttctattggttctcttttaaccattcattgttttccctttaatacaagactagataaatcagtttgaacagcttctccaaaaaactgaaaatgatctgcatagctggtagcttctgagagttatgccagtccttcagatttttgcttatccatcaagccccaactagtccattttctcaggaaaagacactgttcattttaaaacatatccacaggaaataacctggttaagtttattctgtaaagaaagctaacttaagttatacaaattaaaagctttactaccagaaacttaataatacatttaaataattagtatttcaaatcaatacataaaatcagtttctaaagatgattataaatcatcaaaattgttcaaaaaattaacattagaacatgaaattcataccactgatgtatctgtaacacagttacaccatatacagaagacttccttccgctaaaatctacagtcttaaaatctacttcacaagatctctaggttggaagaggccatctaagtcaactacatccagctgaatggtcagtgattttatgcttattaggaataaacacctcccataagttccttctataaagacattagaatattcttcctagttttgatccacaatcttcctcccgtaacttctccttgtggccctctaactgccctaaacctcatcaactgtgtccaattccactaccacaaggcattcctaataactgatgcatggtattgatgaaatttatcaacaaacagaaaacatacttcaaaccctatcatcctttaggaaagttttgccagggtgttaaagtgacagcgtttgtcactcactcacgtctgactcggtgatgccatggactataacatgccaggctcctctgtcctggaattctccaggcaaaaatcctggagtgggtagccattcccttttccaggggatcttaccaacctagggattgaaaccaggtcttctgcactgcagacagattctttaccgtctgagcaccagggaagttaaaaagtgttaagctaaagttcatcgccttcggtcactcatcaatgagggtactaaaatgataaaataatatatttattcttgcctatttcccaaaaagacataatacttaatatcatttcacaaactaaacatgaaatgtaaatgacaagataagaatgtcaaatactattca

SEQ ID NO: 29416 - DNA, 1500 bp, Bovine  19866880816957
tagtatgtggaatctaaagaaaacgaaacagacaaaataagacaaaacaaaaactcacaaaacagaacagcttagtggttaccagaggggaagggagttggagggtgggcaaaagtgaaaaaggaggtcaactgtacggtgacagatggtaattagtcttgtggtggttatgaccttgcaatgtacacaagtataatgctataatcatgaaacttagataaactttaaaaaaaaaaaggtatgtatttttttaaaaaaaggtatgtattttcttctctaaactacaagatcaaagtatatacaagatggaaataaaactccaagaaagctaaagttgtcagttgaaggttttgagagagatacagagggaaaatctccactatggtaacaagagtttctgtatttatggtaaatacacactgtatatacattcacacacactatgtcaattatccacggacagacagcaattcttcagttattcttacctaatacctgatagtgttctttctcctttgtgagctgttggtttactgcctgaagcaactgttgtaactgtgttacagtctgatttagacttacagacattgtctccttctcagaagactcctaagaaaaagattaaagagatgaaaaaccctaagcataagggaaaggcatttgcaaccaaaatcagaaaatattttattgttgtttcacacacagatataaaaaatctgaaagatgacatgaaaattgacaataaaaccacatagagcatagtatttgctacctcgcagtgcaaggtagtctgcacctaagcaagtttaatgttatataaatgctgtcactaggctacacagggaaaaataaagaaactatgaatatcagacaaaaatatttttctgcttccataaaaaaagtgtacaaagagccaaaggagaatacactcacaacaacagaaaaaaaacaaacatatattgagctcttacaaaagttgaggcattgttgagttacccactattctaagtcttttatatagtaattcatttattccctgcaacaatcctacaaaatatatactatcatcatcattaccttttatggagcagctgaaacccagagaggctaaagagtttcccctaagtcagtcacacagctactgaacaacagaatcaggattcaaatgcaaggagcagagtctacagtcataagtagtataccataatacctcccaactcaaacctaaacattaatgtaatatctcaccaagctaaagtgaaaacaaacattaataaaaacacagaatttcagataagatacctcaaagaaaagatgaccttgagttaagaatgcaacaaaattgatggaagcatattacaaaggcattttttcagagatggatcttgtagatttttcattcttcacataatttataaggtaattagctcagagatttggacctaaagaaaatgcataccgtttcttgggaaacatcactattctcaataacagtagtgt

SEQ ID NO: 29417 - DNA, 972 bp, Bovine  19866880837809
tgctctctctggagggctgcgtcggaaggagcatgttgttcactagtaacatttggtactctgcatgcatattagctttgggacttcccaggtagcgctagtggtaaagagcccacctgccaatgcaggagccgtaagagatgtgggtttgatctctgggttgggaagatcccctaggggacagcatggcaactcactccagtattcttgcctggagaatcccatggacagaggagcctggtaggctacagtccgtggggtcacagagtcgaacatgactgaagcaacttaacacacacacacattaggcaacaacatgtaacaatattctctgctttccaaaacaatcaggaatctggagcaccctatataattaagtattaaattatctgatagatatctgttttaatcataaaaataactgactaaaataataattattatttattgggaactaaattctgtgccctttaaaaacatcattcgaggttttccaacaactcttcaatgcaggtattgtactttacaggttaagaagtagattcagaatatggcccaaggacacgtagataacagaggcccttctaagaagtccagttgattgaggcttgaggaggaacatccaaagcatgtatgaatggcttgcgtgggggcaggtatacatgttaggtacatgtatgtttccgtgtacttcagtcattgtcttactcaaagttttgtgtaataggattgcaacctgcatcattccagcaggctgaacatcttgaaaataccagctgccaagataaatgttgtcttttgagagtaaatattttcatatttctacataactgtgatgtggccttattcaactggttttattctgtgaagaaaatgagattcttcagcagatggacaaattttaaggccaaattttcaaggccaagccttaaaaataaaatcccaagtaaaatgaaggaaaaaattgaactc

SEQ ID NO: 29418 - DNA, 1168 bp, Bovine  19866880885450
aaacccttgagcaactttctacaggttgttttaatgtagttctcacatctgctaaattaaaattaaaaaaaattaaatctcatcctacaagacagacaggttgtgtcctttgcaagccaccaaagaaagcaaatgatctttacatttgatttcctctctggggcaaagagttggttttagaaagctgagcattcagcaggttccagatgcaaggcagatgctggaaccctggctgctgtcattatggctttggagcagggggtgccacatttggaacgaggtaatagcacctaccttggagaaacattgtgaaattcaattgaaataatatgaatggcaatgcttgacccaaagtaggtattcaatcagtgtccttagggaaacacaatctaatgtctggatctcattaatgatgccacaatctcattaaaaacacttctatattgaactaaaaatgtgttctaattctgccctttttgactatgcagaatgattctaatttcttctccaaaaagcattcaaatatatgagagtgacctttcatgccctccccaccaaacttctcttttccacctaaacaccgtcagtttcctccaataagacaagaatttgttgtcttcaaagtaactagaagcatctgggctctggtgggtcccaagatacacctcaacacatctcagcaccgataatatgccagtagtcctggaggatcccaaactcggtcctgtgggatcaagttaacctcatggttaacctaatgctttcttcttcatataaaattcaaggaactttctccatatgctctccccacccccaacactgactgcagacactgctttgtttaaaagagcctgtttcaggactaatatgctcttcacagttgaaatccagccctgaacctttgaagtgacatttattgtggtcttgggaaaggctcagcagaggtgagaagtgacagctgagggtgataaatcaaatgcagctcagttttcatttaagggcaaactatcatccagtcagcctggctgagtcaccagccagcttgggcagcttgagatttcttatgtaaatggtaaacggatcactgaatggtgacaatttcttcagctgctaagatgagccgtcggcttctgttctctgctcaaacttgacatcttaagctgctggt

SEQ ID NO: 29419 - DNA, 1641 bp, Bovine  19866880946574
ccatccaacccatctcatgttccatcactgccttctcctcctgccctcagtctttcccagcatcagggtcttttccaatgagtcagctcttcgcatcagatggtaaaagtattggagcttctacttcagcatcagttcttctaatgaacattcagggttgatttcctttatactgtatataatatatagtataataatagcatatacagttatctaatataatagtctatatggttatgagggcttccctcatagctcagttggtaaagaatctgcctgcaatgcaggagaccccagttagattcctgggttgggaagatcccctggagaaggaaaagtctacccactccaatattctggcctggagaattccatggactgtatagtccatgggtcacaaagagtcagacacgactgagtgactttcattttcatatcacatccttcacatacttatgaaatagtaacatggttgtgaaacagtattactgtttgcaaaaaaataacagtatataagaatgcaaaaaacctttcacatttatgagaatttttatcttgggtttgtagcgctttgtttctgtggtggaggcatttgtttttgttcatttactggagcgttgaggagcccctgggcttctatccttccaaaccttgagaagaggctgacagcattattgatcacgtctgtcgcagtggctggccatgtgctgctcctgcagcgtttgaccattgcatttctattgctggaagtggcactgaccgctggggctagcagaggatgccacttgccaagtttataacttacccaacctcctggattcagcattttcacctaactccaaacttctgatgctcagattaatttactcttaaaataagaatgctctgtttctaagaaaaggggctcagaaaagcccttacaaatagttttaaatgtctcgaagagtttatgggacacacatttaatgacttaagtagaaaggagtagtggcataaacatcttccttaaattacttggttttaaaactagaaagtatttggttaaaaaaaaggtttgcatttttctatactttggatttggaaaataactgtaaggtactcaaggaatataatctgaccatccaaacatctgaacctcagagcctgatagacctcattacttgccttgagaaatcatttacacatctttgaagaagaccttggcatttccatcatgaagtttgttgtttattactattattcttttaatcctagaaggaacatggttatgttggaatcttagaaatttaaagtacgtgaggtttttattctcctaagtcaaaatcttcataatgaaatacttgtgtgtgttctttatttgctacagattgagattttattttctaagacaagaattgatagcattgaatgaaacacaggcgtagtcaatatacattttatgaaaaacactgaatctgtttacaggtgcagtgattggctactgtgaatttagtgactggcatatgatattggaggccaaaccgggctcaagagtgactgaaaacaaacccggagggaaggacactgcagaaggtgagccaaacaattacatttgccgagtagttattgaaaagaaggtcctggaagctaacagtttagtgt

SEQ ID NO: 29420 - DNA, 3447 bp, Bovine  19866880993445
tgtgtaaagcatctagaaaaaggtttagtacatagtacacgttcagtacctcgtcatcaccaccatcatgatgcacgtgttggagtcaggaaaatttcagggcccattctctcccttaagagccattgacttcctcacaaacttggctctcctttccttgtgtcatgtaaggctcctcagttccaccccacagctcccaccttcctggagctctgctgaatacactgattttgggcccctccactctctgcattggatgctgggggtgttgctcactcctgtctcagggctgataggcaaacagaagccagttgactgacctgcaaggtatgcccttgggtctcctccactgcctgccaccccttctgctccatctcctctgcacagaaagggggcctcacaggccacaggcctgggctcagctctcaccttgcaggtctctaaaccctggtattcttccagggcagaggggagctgtttcctgcccccagcacccaccaccttgctctttttcagcttcttttgcaggtctttcctctctacccaatccagactcattgccctgtggtacctccttcaactcagggaccttggttttctctacacacagcagggagcgttctgcacataggtggattggcagcacttcccagagcttctaccagatcctctaaatcccactagcctgcaactccttaaggctgaagcgcgttaatcttcatgtcctgctaagacccagaaaagtgcctctatgtagtgtatcaatatttattaaatgaatgcttgaataaatgatgaatttctagcgagcactggaggtgggggaaatgccctgctaacatgggtccttactacctcccaggcatcagccttctgttggaaagttggcccgtaatccttgcagtactcttcggctgctgattttccaactgtggctttacacctgtttcattttacaatatttattgggaaagcactttagctgcttattatagtcagatatcatccatgacaagccattttccttgaattagctcagtgagaagtatttctaaaggcgttaaatgaaatcatccagacatttcccatggccagctggaccagcagccagttcagccccctggcttgaatacagagtggaatgtgtttttagtctactccaagccccaaactgctactaattctcacactaataaatggggctttagcaaattctcctaagcaaaagcaacaggagaatttacaactgtgctttcagtaaattaaatgagataatgcagtgcctggcacgtagtaagcagccagtaagtgctaactgttatgtctctggacaacactacagagaattgttgcagaaaatataactaaaaagatgggggctgatagggaaaatattttcaaaggttagtagaaagtaaggtcatttaagggcttccctggtggctcagacgggtaaagcgtctgcctgcaatgcgggagacctgggtttgattcctgggttgggaatatcccatggagaaggaaatggcaatccactccagcactcttccctggaaaatcccatggacagaggagcctgataggctacagtccatggggtcgcaaagagtcagacacgactgagcgactgagtgatttcactttcaaggtcattaaaataattatttccttgaagttaggaataaagaagataatgctgaaaaagaaaatcatttaataaaaattaaagggatgaaaatagagttaggagattgctagaaagctaataggcaacgtgcattttataacatgtatttaaaaacatgaattacatgcactcaccctggaaaatttcactcaatcaaatcacattgtcacaaactgctgttacaaaaattttgagatataccaaaacagcaacaccaacaaggtagaagtagaaaattgtgcttacatccttagataatcattgcaaagggttttgggtaaatgcagaaatcctcactgaaacttgaatctacaaaacacgcactgtgtagctctgtgattccatcctggctgtcctgaaataacgcctgtgatgctgtcaacatgcctgaacacatggaacttgcatagggaaactcattaactccaagaccaggatccttttcccgaaatacctattcctggcttcctgatgccactctttctttgcttttgttgttaaagatgaaaatattgattttaaccagactgaaactagttaccagctccgcttttactaatgccttctcaaagtactgctttattcccattaattttggatgttcctgttttccataacttgagtttataagcctgaaaatggaattttatagcacgatgcctcttgatgattaccttttattcctgggtgagcagaaggctgattcttacccagcctgtgatcaggagaggtgatcttggtgggagaaaaatataatgtgatttttggcagccagccatactgggtcattagctgaaaaggagatatgacccaaggcttttttttcctaattaaaaaaatgtttagtttttaaaaaccactttattgaggtatgattgacttgtaaaaaatcgtacatatttattatatacagcttgatgagtttgaggataaatcactttcaaagccacagacatattcatcaccttctggaaggggctacttttcttttgcctcctttattattactgctattaatattattatcttgtgtgcacttgtgtgtggtaagagcgctgaagatgcatcctcttagaaaattttaggtactgttggctgtgagcactatgcttgagagtagatctcctggatgatgttctattacagcaagactggtgggcaatccaagggggagaaaggttaaccacagcacagaattcctgatggagtctgctttaaaggtggccatgagatagtgccagctgacaccatggggagcagagcagcgagcacactgggggaaaactgcttggatgaatgagggctgtgagacatgatggtgtggagccgatcttgtcctgagtcagagtcagtagtagagcaggatggccatctccccacctccatctaagaaaaagtggcagtatttcactctagcaaaaagctagaaataaatcatacttttgctttaacagtatacctctgaagtagttggaggaagttttcaataaatacatcctgaacagaggcagttgtcataaaaacaagatcattagaacacttgtctaggtaacttactcatagtgtagaaaaagcctagtttcctccctgaatttatggcggccagagccaattacagttatatatatattttttaaattttattttatttttaaactttacaaaattgtattagttttgccaaatatcgaaatgaatccaccacaggtatacatgtgttccccatcctgatccctcctccctcctccctccccatacca

SEQ ID NO: 29421 - DNA, 890 bp, Bovine  19866881006018
tagtggcatttatctatgatatttcagatcactaaagaagcctgggcaacatcctggcttgcagccagccctctggccttcctgtctggtatactttgcaggactggtcatgtgagaaagacagctaacagcaacaattgatgggtgatgaatggctggaagtagggcagctcgaagcatgacggggacaaggaatgcaatcaggaaaatgctgacctggaacttgagtggggtaagttgggctgtgacggatggaaggcagcagctgcacgcatggcatgttggcacacacagtcggaaatgctacttaatttgaattgaaatgggcaacttgagaggcagagctgcaagcagtgaccaccgccacagaccaaaatacagaccttccattaatctgtccaaccacactcacagtcttgggtagtattgttgttgctcagcatcatccttcaatgtgataaagcaccatgatacagagctgtgggccccagagccatgcattatgagacttctgtgggaggagtaggcagaaaaggcttcagactgagatttaatgggcacatcagagccaatctccaaacaaagattcctatttaatatttggaatggtcattttggagcacactgaggtgtctgtgaatgagggcagagtattattggttcctttttatttcacacctcaaagtcatgggctccctatgttatttttcttctttcctattgtggttattgaacttacattcagcccaagtcagagctctgggcacctgggtgccaggaaatttgactcagcaggaacctgatcctgagcaatcagtggactgttgggtccatgctctgtgggctccacattattctggatgcacttgcttatttgcatgggggaaaga

SEQ ID NO: 29422 - DNA, 1847 bp, Bovine  19866881022973
ttatttcatgtattatttgacttcaaatgcattttatagtttaaagaggctttgtatatatacctttaaacatatatggatgcataaatatattgatttgttcatttgttgatgtctaatgatcagtgtttgtatagtagccatggaaagtattccaggcacttcagaggggatttaatgcaagttacagaagtggtagaaggattgggggggaggcgcacaaaacacaaaaatagttcaatttaagtaagtccctagaggagcaaaggagaaattatgtctccagggtcatagctcactgccactctcagaatctggctgctgagtgagaaccaggggaggtctgctgcccactgacactgctgtctctgctgctgctgctgctgcccagagctgaaaaatgaaataggtcctccccttcttccaccttgcagtctcccttcagttcctcccaccagcagaactaacaaaccagctggctaaaaagtctgggaaatgtagtttacaggcttcccaccccaaaagtagagatgagtgaagaaggattgattaggacctgagcaaccacagacggcatctggcacagcccactgaaaatcctttgtcttgggcaagagcaagctgcatgtgtattttagtgtccccattgttgctcgcatcatcttttatccttattttctttcctttctcccttcttcacaatcacatgctaagcaagacacttggcattgggaatacagagtgaacagacaggtttctactcccatcagggttagattctggtggagggtaacacaaacacattctgagctctgtcctaattctttcctttcctgatttttgttcatgctttcccattcctaacttaaccaggattgcaatccccttatttaaatgacatgtcagtgctgcttaatatttatgctttagaatgctgttttcacttctactttgaatgtaaatcacttgtctaataggatgctattccaagattaagagaggatatgggttaatgagtgtgtgtgacttccaaaagcctgtttaaatttcatagtcctatcttttacagctgagcctcagatccctgtaagactttctgtattttcactataatcagtttgagaggtattaataagtagaaagctttgtcaaaacaaaacaaaaaaaaagagctatagtttatagaattttctcaaggattttccctgaaaaatgcataaaaaccagtttgttcacaaattcaagtgaatgaattaacagttaaccatgcattggtgctgtgtactgagaatacagaagaaaataagaaagagtcgctgttctcaaggaacttgcagcctagtgggggaggcagacaagagaattaacagtgacagcccagggtcaaaatgcttaattgtggggcaggaacacagagaaggggtatccatgtcagcctgagggttcagggcaatttccaagacaagtggggttttagatgaattggaagactgcagacaagtcaaatgaagaaggaagaaagaagaggagaccttctgacatcccctcccccgacacaaagcactggagggtcatgagacaagagtgaaggagggtacaggaatgacttctatgaaggataaaatgagatgacatgatggttgttagcaggagttgggttatggaaggattttaagttctgtgcaaaaggctttaacctgaagaaaatgagccagccaccagctttaggagaaagaataagatcaccattgagggtttatcagaaggactcaagactgagatagcaggaccattggaagacattgtggtacccaggtaatagacggcaatgctcctctatgcggttg

SEQ ID NO: 29423 - DNA, 1399 bp, Bovine  19866881043782
aataataagactctgatcagaagacccatgcttggacacaaaataatcaaatggcacatttggactcttgtgtaacctgtgtccactggacacttgcctttgacctttgttttcttttataatttgaaactaccataagccacatttttggtgtccttctcttcctactcccctcttctcctattcccctctctgtctccagtgcatccatatggtatgcttttaaaaatattagatttagtcttcacaatataccaatttacttgatggttttaaatactttttttaaagctatgctttaacaagagacaagtctagaaagttcagtatatcttccaaagcattttcaaagttactttgaatgtcttgcctaaaatcttttaggaacaaagtagggtataaatgaatacaaaatatgcacatatcactctaaatagatcaagagagtcatatagaaagttcatcactcttctaaagacacccactgggactcatctattagattagtgtggcctagattaacactcacctaagcgacatgtggggtataaaatacttctattactaaaccactgagtcctaggacccacgagctgggggtatcttgaggtcatttagttcaataccctacccaaaccttctagcatctcctttatagataagtagtaatggtgataataatgtcaaagacttaggtagagtttaatatgtgttttatcatattatttaatcttcaatgtgacagatgaggaaaactaatgacaaagagaggcacagatgaccatccaaccactgcttcatcttttattacctgacagttccaccatggaaaggctacacctgtaggaatttaaacttctccttataaaagttcaccagacttccctggtggttcacatggtcaagaatctgcctgtaatgcaggagacctgggttcaatccctgggttgggaagatcctctggagaagggaatggcaacccacttcagtatcctcgcctggagaattccatggacagcagagcctggcgggctatagtccaggaggtcacaaagtcagacacgactgactaacactttcacttcactttataaaagttcatctcaaagattttcctccctaacaactccagttcattttcagtcagtctgagttatttcttcttcttccgagatggtaggaattcctaccccaaactcagcatgcacttgtagtctattgccctccctgcatgacagtggtgtttcccagaaagcatcccttggcatcactgtaaaggttattgcctgaataacaaatttacctttgccctttggttcaaggaaggccccaattaccacattgtttcttcctatggaactagcgcacagggtaggcagtaattcgggcctccttaaca

SEQ ID NO: 29424 - DNA, 2877 bp, Bovine  19866881049040
tctactgaagaaattatgtgggctctcagagagaaagaggaaaaatgtaataccgctgtggaataggttgttgatgagcccaaggaaaggactagcatttaggaagatacagtgatgcctgaccaaagtaaaacaaattttactgacaagccagttagattctggttagagttgaaactgtcttctgtcacaatgtcacatcttagttttcaatgacaattttatgggcttttcagaaattaaaataacaggaaaaatatcaataattatatgaatgccaaaatagatgtgttggggttgtttgatattcttgtaatagtttaagtcctttgggtaatcggattagatcacatgaaaagtaactccagagctaaaagctagtgtcattccaggaaagagaccagcataagcacacaagttaattcctgggtaaaccagagagaaaggagttcaggctttgatccaagacgtaggattttcaaatcatctcccagttcaattaaagagccatctcctgaagggaatcactggaaaccagggtagacattgtgctccttccgttaccactaagtgtcccagagaagaaaacatgctcttgaagttgttgacctgccaagtgagaaaaagtgccctgtggggagggtgcagatgaactgacactcactgtgaaggagtttgctgttttctccccttcgtgaccttggcaaatgacttcagcacctttgagcagggcactgcctttccggatgctgtgaaaatggctgttatgtctatggatcatgcagaggtgccacgaggcttaatttattagttaatgtttgtgttacactctgcagctcttagatgaaaggtgttatagaaatgcaaagcagcaatatattatctaaacatctgcctcctcaaatagctctctagaaagtcttcattgcttcagcaaaaatgattcctcccaaaatggataattctgtccagggctttcttggtctataaattgtttcctcctcctttcagtacacagcatctctgtgcaggatacactctggtggctgcgttttccatcctgtccttggaatgttcactgctgatgctgtttccttgtgtgtgtgccctgcagtttctcacaggtccagcttttcctcaccatggctgccctcttcattctttattccaaagagccattataattaggcttttcttttgatgcttaattttacacatgggcatgtgacctctaacccaagggctggtgtttgaaaatttgtcagtaaaatcgagaaaaactacttaaaagctctcaaaaataaaagaaaatacaaaaaaagattggtccaagtttgaacatgttttggtgagattaactgttgaattgtgaaagattacattggagattatttctgctaaaattaattttgtccacaattttaaaactctgccaagtatcctacagcaaatggatatttatttccatagaattccatagttcttatacatacatatatatatatatatatacacacttagattttgttgttgtttagtcactaagtcatgtctgactcttttgcaaccccatagactgtagcccaccaggctcctctgtccatgggatttctgaggcaaaaatactggaatgggttgccattcccaggggatcaacccggggattgaacccacgtctcctgcttggaagtcagattctttaccactgagccacctgggaagcccatacttagatttaggtaacttcttttcaaatgcaactagagagataaaatgagtaataaagtatatcaatctactgtattcaaaggttttcctcttcccacatttttacttcgattttgagagtattttttccttcttcacatgctattcctcagtcctattgtttgtggttatgggaatgtcctaaaatgtccctgggatttgttttaatcaggtataaaaagatgacagacacagagacaattgacttgaaagaagagtttattacagttcccaagaggaaagggaatgctgtgaccaccaggggaagcacccaagtcattcgggaagcaggagtaatggaaaagcacagcccaggcctctattgtggtctctgcagcaagggatggcagaggcaggattggcaaggttgagcaggcttaggattggatgggctctgggctatgaggatggtctttaggtgtccattcccaggccccagggtgatatgaggcagggaaaatattggcttgctgtgtgagcatttgataaaggaggtggttggggacgtgcactttggattggttgatttgtttatgaaagttgtgctcacagacaaggtgttttttatctcaaagaattagctagctctggaacggtggtctctctccaggttctcaaggcccccaagatgtcacaacatcataaaatatagacaatgaaaaacatggcaacacagggggatcttctctgaaatcctccaagaaaatcttcaaaataaataagtttggccacacagatctctcactttttacttagtgataaaatacatgcattataaaggagaaaatttgtgaaaatcatcatgaaaatagctatcactgatgaaagcttactatgtctagcaattagtgaaatgctacatacactgtcatttgaagtattcaactacggatgctaaaacgaggaagaaaagattaagttaccttcctgctcttatttatttgttgtattgtagtgaagtatctcagcgccaggttggtgagtctgctccgggggggctttgaaagaggtaaatcagcattttcttccttcttaacacagatgagtcagcctctcaacactcatctgtggtgttgtaaagcttctcacttaagtgcctaacccaccatg

SEQ ID NO: 29425 - DNA, 1552 bp, Bovine  19866881059151
tcttcagtacactgacatttagtttatccacagggctatgtatgtggggcttccccactggcactagtgataaagaacccatctgccaattcaggagactaagagatgcaggttcgatccctgagctggaagacaccctggaggagggcacagcagcccacttgagtattcctgcctggagaatcccgtgaacagaggagtctggtggggtacagtccatggggttgcaaagaatcagacatgactgaaatgacatagctcactcactatgcatgtaccacctatagcaaattccaaaacctttcatcatcccggtagaaaactccatacccattaagcaatcactccccattcccatgctctctccacctcctaacaaccaccaatctggtttatgtctctgtggctttacctattctagttattttgtataaatggaatcatgaaccatttgtccttttgtgtctggcctctatcacttagcttaatgtttttaagattcatccatgttgtagcaagtatcagtacttcttttctgtttatggctaagtaatattccattgtacatatatataccataatttgtttatccattctttcattgatggatatttggacagcttccattttcagctaatgtgaacagtgctgctatgaacgtttgtgtacaaattcagagtaattgtgcatgaacacacatgctaactatacacacacatatctctgattgtgaccttattcccttaacagaagatggggaaaaactgggatggccgaagaaaactgaggctaaaataaactgtcaattgtggtggtgtcagaagtcaatcacaacgggtttggtggcattatgaaaagaaattttagtttctaaacagtcctgtgaagcttaaagacgtctgtccagcctaaagctgttgagcgaggcctcacatttcaaggaggagaaagggagaaaacttagtccttcccaaaccaggatcttccagccaaggccattgtgagttgcgattaccaacatagtcgattgcccttctcattctttagggctcccgccagtcaaaagatataaaccaacctataggaaagggccaaacgtgagtttttaaccagattctagttactactttcaagtctgtcgtaatacctataaacatcaaagcaaacccaaaatggagagaaacttctgcttcaatggaatctatccagccttctaactatatgctaatatgatgaacatgtaatgctaatatcaagccatatcagttgtagacattttgttcattagaaggtatcacttttcaactcttatcagtgtgtaaattaaattttgactctctggccacctgccccaaaggcacaaactctcaaaattcaattaacataatttttattctagcgtgatacttctgttgatgggggctggatagggcccctagctgaggactgggctagggttcctctacactcggcaaaaccagacaatgctaggtgtacctacggtaaaagccactagaagtcaaacttcagggacagaatcagaggatgcaag

SEQ ID NO: 29426 - DNA, 1104 bp, Bovine  19866881061753
tccccctatccctttcctcccctgggtcaagtgacataaagcctcattgtgccttatccactctgtgcgatactatgtttctacggaaatacagtctggtggaggaaaatgaacctgctagaggagtcagtccttgtgcctaatgcaactcagccatatcctgctctagtgggtcttctaattttcttgcacagacctcctaagtaaactataaattcctagaggtcatggagcataatatccccaggcagattcattaccatctgagctaccacggaagccctataatacccccaggacttaccacagtacctggaatatagcagatgctcaaaatgtatctgctgaggcaattacacaagataacgtgtggaaagttcttaacgcagtgacgggacacagtcaggaactaacagggcaaagctgtgctgactgtgatatgttgacagtgacaacaatattagggtttatatataccattcagtaattttttgctctactggcctcgctggcaatgtgcaaagaatattatttattcggatctcatcatcttagcatgtgtctaaatgccatgagaaacgaagcagttctggaatcttaaaaccccacgttcgctctgctcttgagtggtaggtaattcctgttattaatttcctctgtcttcccaggatttcactgcagactcacaatccaatagtcatgcaatcactgaaaaccagggcccttatttgataactggtcgaatgcatcttgattcgacataggcagcccgctttcgggcacggccagccattctcacagagcacgtggtgaaccccgctgaggagagcaccgacaacttcaataaaaggagcagcagtgatctcggaattcagaaaacacttgacagagttccgcatcaaaggttaacagccagtgtctgagagccgtacaccgagagggaaattgctattagactgataaaactccaaacagcaggaaacaaagaaaatgctcaaggaggaatgggaaaagtcacagaatctgacgtgggctggtggtgaaatccatgatttttatgttattttaaaacatctgaagggaaaccactctgtgtattctagg

SEQ ID NO: 29427 - DNA, 531 bp, Bovine  19866881133200
ggtccctctgctcccgcttactgtgagcccggggcccggaactcaggcgcggcaccggcggctcggcgctgcgggcagtgggatccgagcgaggggcgtccgcgggcagcgccttgcatattgttatggtgaccgccgcggcagccgcagccggagggcagtgaactgtctgcgacccgggcggccgggccggccctcggctctctccgccgggagtgtcgtggagggggcacgaaagccgctgcgcccgcccgggctccggggcgcgcggggctgcatcctctctgtccttcggtcctgcgattcggcctctcagatgtcctcccagcggcggggagctcgccagcctcgcctgcctctgctccctctcggcttgtgaaaaccacattctgaagatagtaattatctacaatctttaaacggcagcaattagggacttcatctacttcctgagtttccttgtgacatttctattgtttacacttaataagcctaaagagaggcttcgctgggattaaagcaggataaagt

SEQ ID NO: 29428 - DNA, 967 bp, Bovine  19866881152353
aaacaagtaggcagatttgtaaagaaatatccctgggagttgcgggccaggaaaggctttcctctctcttgggcacctgagttgtctcattttgccctctcctgtctgccctgccccctctgcccaggtgccctttggttctgctatttctttttacatcttctcattgcacttcagatcagactctccaatatcccttaaagatactattccaggcacagaagacaggtttgtgcatataatacagatttttccagatgtcttgcttataagcagtgctttcatagagtaaatcattcccaattctttaaagctaagcaacattaaagtcattatttttcctggaacacattccaaagattatgatctatgaagaacaccaaaatgagaatggatccctaggtttgttttgttgctaattttattcatttgatttgtggagttgataggtaagccaatgccctcctcatctctggactgaagatgtgctgacagctccatccatcaagcaagttgtcagagcacaatgcttcacagaggttgttaaacagaggtccagctggctaacacttccaggagatgagaaagaagaaagttaatcttatgcccatagaaaagtatttcattaacctggcagagaaacggatatggcagtaaaatctttagtcacaggtattagaatttaaagacaaatctcaaacagatgtctgtatttctgcttcttttatgatcctggaatcaatccctgcttgaaacacattgataaataatcagccaacaatggtgatatcactgaaatatggatccatcttcattaacaaacttaaagactatttgtgtctataactatggggcagagcagatagaggagatgtaattccatttgcacagactcgtccactgaggagctagactgcagctggatgccttcaacaattagggaaggacggggccatttacacagtta

SEQ ID NO: 29429 - DNA, 2632 bp, Bovine  19866881193188
cacaaggacagggtggtaagaagtcttcctcccacagcacaggagccatttctgggcacaagatttgggctgtgggatgtgtacagtcaggggcatctcagagtgtctggtgaagctgagtagtcaaccttttttttagggaggaaatactggtatttggagtttaagagttgctggagaaggattgcttgtagagagtctagaggcctcttcggagaagagggactaagtccatcctttgccccctgacactcaaagtcacagaagtatgtcaggatgtgatggtgaccacagcccgtcatcagagtccacttgggtagtgatcatggcccctaatcattatggggaggaatgtatccggctagaggaaaggcccctggtctttttggaagtgtttgctaagagcaggaaaatggtaccttattgaaaattggggatcaagtgaatgctcacatgctgaatagtaagatcttctgttgtcttccttctctcggtttctaaaacagtagaagtgagaccagtaacatcagccaggaaatctgaggattcttctctgaggaaacctaccagacctagagaaaaagacctaccagctgccaagtttcagaattctgtccccatcaacaaaacagatgagactcttgattactcagagctgggcctataagaaagaaagaactaataactaagtatttggtaaccagaggttaaagcagctttcagtgatagtaagatcaaggtgaaggtagaacagtgaggaggaaaagaaaaaacacttgggaaccaatcagtcaacttatgagtccaacccttaactaacggtgagttccagaaaacagtagtggggagaaaactacaaagaaatgattcaggaaaatgcatgtgcctccagattaaacgggcccagcaggcacagacaaaccttgttctttcgttccagttgagcaactgccctatgacagaaatatggaagaaaagaaatatattcattgatatatatatatatgaagtctgtaaatatttatactcatatactatagacccagctgtggatattatgtagatagtcataaccatgacagtgaatatttaataaaaaattactttatattagcaagatgaacgagggaaatctggctgagaaagttaaaggctcatcttgcaaaataggaagtcaaaactaacatgtaactgaaaaccgagagagagtacctcggtaggtcatgtcacactgaaccaacttgccgagaaagcctgtggaatttccaccctggtgtgacttgagacaggatggaaagcaatctttcaagcctttgctgatgacttctatgaccggattttgtctctggggtaggtggggcggctttatcgtagtgagattcctcaaggagctatgcaagcttcttagggcaggcttgtttaacatactctttctaaggaatactcttgggttacaaggactgcatcagtgcattcatcttattctgacaagccctgatctctgcaagtttcttttctcctatttgagaaggaacatattatggggaaaatacaggctctggagttggactgcctggtcccacatcctggttctttgtgaccttgggcaagtgaagacacacccaagtttccccatctataaaacagtgatgataatactgcctccttcctaaagtgattgtgaagagtgaatcagttaatatattaaataggtaaaatctttcaactagtgtatggcacatagcatacagttgtacgttattttatattaatagttttttatttagttaacttttttattttctgctattacactgttgtcttcttgattcagttcccaaaaatggaccagtaatttagaagcaattcattgaaaaatgaaaggagtgacagaaataggaatgaaataccacagctcagaataacatcataaacatcaatagcgaccagaaacccagtgtaattatagaatgtgaatctgccaggttgatagttttactcaaatgacagaaaaagaaaaattgtgagcagaaaggagcacaatgactgtctgaaaattgaattttacttggcagatcatttttttgtccacagtctccagtgctttctctgttatgaaactttgtcaaatagtgacatgaaacgctcaacacttttgagtcattttcaggcaaagtacagtggcctttcctagtaagccagttgtgtcttcccagatcaagtatacaatactgttttcagggtgaaattgatgaatgttgtcgctaagggcccagaatagaatacctcggaggcatggttcagaattccattcgtcatagccaaggcagatttgccgaggagtctgcaacatcagcctcgaagctgatggcaaatatactcgagaaagagggacaagcttttggcgaaatcactatatcaattgctgctgttgcctgtcacataacgtcagtggtacgggaaagtcatcttgtgtgtggggggtgaatattttactttatagcttgttgaaatcactgatatacagggtacaagtcagtccttagcatatatctgataacatatatcagggagaaagggttcaggagtttttagagagttttttagatgcttattttgtgagctctgatgt

SEQ ID NO: 29430 - DNA, 1201 bp, Bovine  19866881303968
tatgtgagataggacagtactctttgccctgctccaaaactctgagtgtaataagaacatggctgtttcatttttctgtcttccaaatttcccataaaacagctctcaaggtccacactaacctggaagtctagagtgaagggaattctgagaaacatgtatccagcaaaacttagctgacacagtacaaattcattatactctcatattttccttttataagagtaatggttttttgcagatctatttctactatcaacatctaaattagtttgagcaaggaacatgtctgatttatatttgaatctgaagctcctaccttaaatggaaggtacttaatgttcagtaaaataagtaataataatgtattcttaaacataacaacttaatactgagtaaaatgcttagttaattaatattatttttatgtatttcttccacattggttgagaaaccagtgtttggcatttgtataaccacctgagtaatgttctggaaaagggaggtttttttaatatccatgctggaactgaattctggaggggaataaacctacttcattggtaaattttggtagggtgctgactgcttcaaaggatgtcagagtaaagtattccctttggaatgcagtgccaagttttccaaacaggtgggaaaggttaattattttaagcatttggaacttggcaacaagtaggatggaacaaacatactgactagacatatgctatagaatattccataaagctccctctcatctgtagtggtttacacagagagcagaacatatggcaggatttgtttggctttttctctggaattatctgtcaggacatgagctgccacctaattacccactcacattacactctgcttttccatttttggtctgatttctcaaagccttcagacactgattttttcatttttttaaaattaattttatctgacctactaaagagttgtgtgcatttctgggagacatttttagagttttgaaatgtggactccatctcctggctctttgactctacagcctatcaaggcaactgtatcttagaaatgtatgattgatcaccctactaaagggcaaagggcttggagggaatggtgggaactactagaatcaaacttttatgttttcttgagcacctcctatgtgtaggcatgtctctcagtggaagcagtacttctctaagtt

SEQ ID NO: 29431 - DNA, 1112 bp, Bovine  19866881411714
tttgctgggccggtgtttattggttctgccggtccatggtattctaggatgaaaacattggatgaaaagccccgtaaagagtgaacaaacagtgtagcaaagacccagtgatcttaacagcgtctcagcagagtgggcttagttaacagggttaacagtaatacctgccttttactgcatgtttaccttgtggcaggcattgagctgtatgattgatgtttcgtctcatttaatcttcctaaagctttacaacatgggggctattatccccgtattttatagaagacacaacagaagttcagagatgttaagtaatctacccgagattacacagtcaacgagtagtaaatggcagagttgaaatctgctcgtaaccattatgtcatagcccagcagtgggatgggtgtaatattgatgaagtgtgattatttgacttggttaaaaacccattataggtggtccacttgatcacacttctctcattctaagtggcaagagaagcacagttttctttcctaatagctactattgttaccttcctccgacttctcttaaagactgtctttttggacaaagactgggctctctgtaattccttacactgatgttcttccaccaggggagcctgcagagctgaataatgttcttagatttggtgtgtctcatcttgtcactgattagtcctaagtcttcctggcaaggctcctgccaggctatttcaggaaacaaaaattcattacacacatccttattgattttccctctcctttgcttattactgaaatgcttttttccctccctctcttgaagaaacagcattgcaattactggaaacttgctctcccagcagcctgcctccaggaccagagggtcctgctgatgttccaaggaggtgggggaagacgggccagagaagcacctccttctctgctgtcctccaggagtgagctggctgattgcttcattctaagtggctcctatgtgtgcgacttagtcatctctcatcagatatacaccacaaccttgtctggtgattgcccgcatttgctggtttcaagcttttttctcagtagttttgggtgtaaatgctatagtgtgtataccaggaaag

SEQ ID NO: 29432 - DNA, 1275 bp, Bovine  19866881425942
ctgtgtgtagcagagagagctaagcttccccgtgttggtaatgtcaaagctgtgctttctatcacctccttccaggctgagagaatatcatagtcatccctggatattcagtgtctagcatacagcctgactccataatgctggttacatttaattaaatatttgttgaaaaattgaggatattgacatgggaataattattatgacacttctttgatgtgtaagcttttctgtacttattttattccacctttatcagttaccataggctaagttatgctgcagtaacaaataactccaaaaatctcagtggactgtttggttgcttgtatttcatgaattgactgcctctctgctccatgtttccttcatttcaggactcaggctgaagaaacagctatttcctgggacattgtgagtctcgtgggagaggagatgagggatggaagaattatctatccattaaagcatccatttatggtcattaaaacttctgcatagaagtagcacatgtcacttccactcacattttgttggccaaagtgagtcagatggctgacatgaacatagtcaggtgggaaaagtataatcttcctatagaaagaatctattgggtgggcccattgaggagaagcttggaggagaagcttgtaagagaagcaattgatgttttgaagagtaatgcacacaccccactgctctattgcaaaataaattttgagcctcttaaaatagatactgtgttttatacttctgttagcttatatatatatagaatggaacttttaattactcttataatcttagtccttcttcactaaatagtaaacttaattatgctattataggagtcagtcttatgcaaatacagtggttctcaaaatgtgttgagggaaccctagtactttccaagacacactcaggaggtctgtgaggtcaaaatgattttaataataatactaagttgctatttcctttttcactctcattctctcatgaatgtatgggttttttttccagatgttacatgacatgactattggaacagatcaaatactgaaacaaatatgacaatccagttatccaggcattaaagagatttgcaaaagtatgtagtaataccactcttctcactaatgttttcattttggaaaatgaaaattttccaaatgtgtttgataaaaatgttcatgtgtattatatttttttcttaataaggttaacaaatgtattttttaaatttcagctttaatttctaatatagcaatatattat

SEQ ID NO: 29433 - DNA, 685 bp, Bovine  19866881545128
tggggagctaaaaaaatcctgaagtccggcaaatgccaaagaaatgatatcaggctctcttgaggtgggacctccgtcttttcacctctatttagatgtaggcagaagtttggctgggtcaacaggtgtaatctattaaacgaggagacagatgttcattcacgataaaaggacaccaagctgttcactggcattccattccaagagccattatttaccatctgaaacgcattgccttcatcagttatttcatgtctctttcaccaaagtcaccaagaggatttagtgccctcaaaatagagcagccttctattttgagggctcttctgaaaagttaaacctgagagaaatgaatagttccttgtcctctgcgctcccatttagcccattgaactacacaaaggtttttaaataaccaggtgatgtcttgggcaggtgcctcgtagccagcattagtctttccaaatgaccagcctgatccagccggttctcccatttcccctctggctcagaggctttattcctattctgtcagcacaggaaattgctggcaggtatcttctttcatgcatgaggcaggggaaacaaagaggtcatactgctcagtgcttggactgtgttcagctgagactggaaaattttcccccagaacaaagccattccatttctgatgaaccaggccacc

SEQ ID NO: 29434 - DNA, 1402 bp, Bovine  19866881564923
actgcctgagcatggtgctacgggaggagggagccccacggggttctcagaggaggccgtgggcctggacagaaatgagaaagagcctaagttagtctgagaaacttttcctctgaagttctgaagcaccatatcccccagagaaatttctttcccttgtgtgtgaggcccaaagggcagctgcctctaaaatcatcaggagagttgataaatatatggatttctgaagcctttctctgacctaccaaatcataacttgggaggtttgagcctggaaagactctaatgagccatcttggtgaacctcatgcaggctaaattgagaacccccaccccagatgatggcccaagcaccaagtcaaacatttatttattcaacaaacattactatacacctccatgtgctaagcctagtgctgggaaatgagtaatacaaactactctcattatcctctctgccatgagcaataagagaatcaagcatacgtctattctgggaataaactatatttccaaggtcaccgaagttttggagaaaaactattctaattacggcttaattgatagaaggaagacctgggaccctcatgggctcagattcaaacactaaagaggtccaagtgaatagctctggagggctattctgagcttcattaaaggacgcccctgctgcaaagagtttgtctctttttctctcctttaaaagtgtgaacacaaagaaatatcaaggaaatgcaactgggaaaatgagactgtttttaaaagtcatttgcagaactggacaaaaacagaggaaattctgtgaccgagtccacccctgtactgcaaatccctgctcattttccttctgatttcttcctcaaaagtaatattgcgaggtaaggacagagtccacctcgctgtagatggtcctggtgtcatccctgaataacacacttgagcaaaccagaagcattcaggcaggcaaaatgaatcccaggaggtggccttcacagttgggaacaagtctgactcatccagtaaaaagaaatatctaacctaaaacatatgcatttagatacaactctataaagccaatgctaattaatcctcctgctcatataaaatggcaaagaaattaacaatattgccaagtctgaaaaagtcttttaattgcactgcggttctttccaagcagcaggcatctgagtcacacatggccgtaccccccacacccaggcggcttcgcccttcatgcaaagcacttggcactcaggctcacaaccatgttttgttgaagcctggtacacatctcccccacaaactgctcagaaaccagcaaggtaagtcctgtttacctttgtaaaagatcaactgctgaacattggcaggtaccctaggaaccccttcaagtcccctctgg

SEQ ID NO: 29435 - DNA, 696 bp, Bovine  19866881660577
cctaagggcatctcgcagaaacctcccaaactgaaaagcaataggaaaaggaagggaaaaaatgcaaaccaaatatccaagaaccgtggagcgactacagagtgtgcagcctgcatgaaatgggattaccagaaggacaagggagaaaggaacagatgaaatatttgaagcaataatgactgtcagttttccccaaattaacgtcagacacgcaaccatagatccaggaagatcagagagctcaaattaggacagatgtcagaaaactatgcctcggcatataattttcaaactgtaggaaatcaaagaaaaaaaaacctctggaagaagcccatgaaagagaccttacctctcaaaggagcaaagaagagaattacaacaacccttcagaaacgaagcaaacgagagtgaagtgaagtatttaaagtttcgagaggaagaaacccaccgacagagagttctttgctctgctaaattatccttcagaagcacaggagaaataaagattttcttggacaaatgaaaattactgccagtatctcttgcttggcaagacataggtacaaatgcagaatgaaatgtgtgctcttaaccgtatctctgggtgcagttcaccgagtgttgagtatattcacatcactgtgcaaccatcttggatattttttggatcgatttttgatttttttaaatagatga

SEQ ID NO: 29436 - DNA, 1627 bp, Bovine  19866880200225
tggagaagggaaaggctacccactcccaagtgtctggcctggagaatttcatggactccctagtccatgtggtcacaaaagttggacaccaattgagcgactttcaatttcactttctttaccttctgagccaccagggatgcccagggaagctgattcagtagcccatacttatccttccaacaaatagtacaggattatttgctactgggaaacacatttttattttgcttgttttaccatacttaaagctaagaagggagaaggcaatggcaacccactccagtactctcgcctggaaaattccatggacggaggagcctggtaggccgaagttcatggggtcgctaagagtcggacacgactgagcgacttcactttcacttttcactttcctgcattggaaaaggaaatggcaacccactccagtgttcttgcctggagaatcccagggatggcggagcctggtgggctgccgtctatggggtcgcacagagtcggacacgactgacgcgacttagcagcagcagcaaagctaagaagacataggcctcagtgtctttctaggtttatttataatgtcttgtattcccttcttaaatatagccccttgtatattccactcaacactagttttcttctacttcagactgcaattgaaacctctgtggcaaggaatctcatgtccttgaatggcgctttgttttatgtaggtacaggctgcattttgcttgcaggtgaagtaagctagtaaaactagcctattaaacatgtaaaaagccttggtcagaatacaagtcagataatactcaggatctagaatgataggaaaatactgcttttcataataactttactatattaggaatagcctcaaaaggaatgacggtacatttaatttgttagcaacattagcctcatagaagtagattgtccaaaattcatattatttttcaaaaaagtattttcaattattatatccatattctaagagtaaaaagtacatatctgttaatgaatatatttataaatcaatattattagcaaggcttccctggtggctcagcagtaaagaatccacttgcaatgcaggagacacaggtgtcaagggttcaatccctgaggctggaaaatcccctggaagaggaaatggcagcccactccattattcttgcattcttgcatgggaaatctcatggatagaggagtttggcgggctacagtgcaaagagtcatacacaatttaacaattaaataacaacaaaatcattagaaaatgcaatgtttcctaagtgttttttgtttttgtttttttttttgctacagagaatcaagtaagcactttcaaaactaagctatctgagcaaactaccttgaatcatacatttgtctttgtcctggtaggctgaatagaatcatggattattaatttgctatgtctcctctttctgcagctatgagcttgcatttctgataaccatctgctctcacgtgttccctgtcccactctgtgtcacacgccctctcccccaccctctcccctacaccctgttgatgtagaatggtagaaaagagttgagttcattggcttgaatgagagaaagctctttaaggtcagaggcagaga

SEQ ID NO: 29437 - DNA, 1478 bp, Bovine  19866880221395
ccttgatgtactccttttcctatttggaaccagtctgttgttccatgtccagttctaattgttgctccttgacctgcatataggtttctcagaggcaggtcaggtagtctggtattcccatctctttcagaattttccacagtttattgtaatccacacagtcaaaggctttggcatagtcaataaagcagaaatagatgtttttctggaactctgttgcttttttgatgattcagtggatgttggcaatttgacctctggttcctctgccttttctaaaaccagcttgaacatctggaagttcatggttcatgtattgctgaagcctggcttggagaattttgagcactaatttggtagtgtgtgagatgagtgaaattgtgtggtcgttcgagcattctttggcattgcctttctttggcattggaatgaaaactgaccttttccagtcctgtggccactgctgagttttccaaattttctggcatattgagtgcagcacttttacagcatcatcttttaggatttgaaatagctgaactggaattccatcacctccactagctttgttcgtagtgatgcttcctaacacccacttgacttcacattcccgaatgtctggttctaggtgactgatcacaccatcatgattatctgggtcatcaagatcttttttgttcagttcttctgtgtattcttgccacctcttcttaatatcttctgcttctgttaggtgcataccatttttgtcctttattgtacccatctttgcatgaaaacattgtccaccccagaagacaggcctactctgagacgcagacaagaagaggtccctgcatattaaagggcaacaagtaccacaaatacacacgaaatgagcatgcacataggctcctttcccactgggatccagtgctcagtgctggcccagtacaatctgtaagtctaaacatccactcttacggttaataccgttcgcaccccaaggaaatgctcctactcattttatacccaataaccttgaaacaaaacgtgatgctgtgaggctgtctgtgttgtcctgcttctgacaacagagacagacaatgccaagagagaggagtgagggaagttcagataagataccagtcaaatagcctgtgaaatcctcctctcagcatgaatacaagagcttcttacataatgaagtatagtttgccagatgtcaagcatctcttcaacttctcttcaggttccagtgtgtggttcaggggaagacaacagagtctccaacctatgatggttcgacctactaactttgcaatgacgcgaaagtgatagtcattcagcagaaatgatgtgctaaattttgaatttgctcctttctaggactagtaatgttctgtacaagactttctaatgatgctgggcaacagtcgtgagctgaagcttcgatcagccacgtgatcccaggataaagaaccaaagcacttaaccca

SEQ ID NO: 29438 - DNA, 842 bp, Bovine  19866880319991
cctagagatgggaggctttttaaggaactcaatcaagacaggattcatgagatccatgagctatgactttgtgtgtgtataatctctatggcagaaagagatccatagcttttgctttattctcaaaggcactgcccccaaccccaccccccaaaaaaaaatctctagcttttaaacaaaaactatagaagtttcctggtgcaaaatatatattgtttaagaatattaaagagaaaaattatttttttaaaaagataaaattgttgtttgactcatgcatgtgcaactcttgtcttttttttttgtttaatgaaaggtcaaggctttttcctttctatttggataagcaggctggaattctgtgtttgatttgtcttgtaaaaagtacatcattaaaagcatagcacaggagttctagtttcagtttgttcaaattgaaaaaaataactgtaagacactagaggaataatatgaataaagaactctagatttttataattttaaatgaacttttacagttgtcatgctcatacttaagtcagtagcatttattaggtgacttacctttgtcaagtcttttcaacatattcaacttaattgaaacaatactaattacatttcacctatttaagtaatgttgaactaaataatgtaattaaaattacaggagtgtacaaaagtagactcaataattagcatctctccttcctatctagtttccaaataagttgaaaataaaaccaagagcaaatattgaggtcagaatatcactttcataatgatataagccaggatgaaggactagactttaacagtagtctcattgatggtgcagctattag

SEQ ID NO: 29439 - DNA, 2805 bp, Bovine  19866880388430
ctggaaatccagcttttaaaaatatcagaccgtgttttaccttacatataaaataataactgagtttcaaatggatgaaatgatccatctatcatctgcctttttagtggcagagttaaatctcaaatgtagatcttcaaattctaaattattcttgtttttcaaatgaagatgatactcagggtgtttaaaaggacccaaagtctcaggaagccaatgaagtatcagaactaagaagataatcaccggtcttcactctaaaaatgcattaaagtgatttctagatcatctatttcttagtatcattctcaaatttctttggtcaagtaacgtgattattcaaataccaaccactaataaccaatttttataagaaataatgattcatatattcctgagtaaatcagctttaaaaattagaaaactattcattaacatgaaattgaatgtgtacatgagcatctgcgaagagttcactgagtagagttaaaaggtttcattcgactgaaacaaacctacttccccgaatcccatgtatttgccaaaatggaccaaggattggtcatatcttgacctttccactttaacccattatctgttctacctagaatgccctttctacccatgtcaaaggactcaaaagcccattccacaaaccttccccgaaccttccaatcctatacacccctcctttcctctgcactcaagagcacttcatcttttgcattccgccagcacttttccttcttaactgaactactgactaaacttccagatcaactctttcacaaccacacatttctctgattgagcacatccttgaatgtgtataaatttaattatgtgtcccagtggtgctttttcatttaaaaggtcaaacagtcagaggtcagcggtatgtttttacagacaaagctgatgaatgcaaacactgccttactaagagtaggttttgagggaactgagttctttgcttgccagtcgaatagttttgcaagcaaaaattagaagccacttgaagagaagtaaacagttttgtgtgtcaaagttcaatggttattttgactgtcccaatgctgaagaattcacaaaagaagagaaactgacaggtgtcatggtttttatcacaaaataaggaaaaaaataggtgcttgcctagtggctcagaggcaaataatctgcctgtaatgtagggagatgtggattcagtccctgggtcggggaagatccctggagaaggaaatggcaacccgctccagtagtctcaccagggactccagtagtctccactgagacaggagcccggtgggctgagtccagtagtctccactgagacaggcagcccagtgggctgcagtccatggggtcacagagagttgaacacgactgagagcctgggcacacgtgcacgcaagtagagaataattacaaagaccatagagaccattccatctcaatctttcacaggatcccagttaattctggaggcatccaaagaccataaataaagagatgctttcttggcttcagtggttaccaatgagagaaagtatgtgaaagtgttttataaatggtaacattcatgtaacatatgtatttttatcatcatcattaccagcatttcatcatcattattatagcagataatgcagcactaaacattatcagccagtatcaaattagacaatatatgaagcattcaaaaatatgagtatatgagattcttttctgatcagcttaagatacctgcccttctttttctcagacatcctgatttttctttttttccggaggtggtggggtggggaacacaggaaaacaccaacaatgtcattcctctctcagtttcatgcccctttccctaagaaaatcttttacattttcttcagtctgaggccttaaggaagatttactcacaaatcccagaatcctcctaatctaccaacaaaggtgtttttcttctcaccttccaaaaaggtgtaagtcagtcccagcctacaaatacagagcctgaagcagatccatgttttgtggggtctaaagcttttacagtttagaagggcggagttctttaaaaataacccagtaaactaggttatttttgcatatttcacaaaattgcaagaccacatgacacagtttgggggccctttgcaaggatttggaaagggggttctgaagttagcttcactgtaaatctacttttgctcatgaacccctgacgaaactagagtccttaagtgcaatgaacaaaagaaagacactctctttctacacttcttaccataaatatagtgcaaagatccctaaacaacagcaatgaagcccagtttaccccccaaacagcagggacagacaagtcaaccaatactcatgattgtgaacttccttgagtctttcatggggacatggggtttcttcctcaatcccagtaaaatcacccttcaggggcagccacgtcccccacctatgagcaaaacccattctataaactatgataactgagttataaggtcacagagaatgcagagaaactcatggcaaataaagacattctgctttgttttcaaaccttaaagaaatatcttgggaacctgggacatgtccctacccaagaaatgcatgtttgcatttaaagaaccacttagtccatcacttcagttgtctcctagaagtgttccacgtggtggatataaccagtctccaggaatgaggaagcactgttgacaccccatcacatgctttgcagcagaaccagcagtggccaacagaactctaataatgggcatctccacaagcacagat

SEQ ID NO: 29440 - DNA, 1274 bp, Bovine  19866880429041
tccaaaaaaaaaattccatatgacacaattttgctgtgccaccaattttatgccatcagaaaccacctctggcctatgctaaaaacaacaataaagaagataactattagcatgcaaaaacacatgttctgttcttagatccctctctccataaagtttgaattgttcttattgcatgaactgttgaaccaattagcagtttctagaaaccccaaaggcctgttttgcacgttattgttcctcctctttccaaccctcatgtacccagtgattctaaggatgcattttgaaaaatatcgtttctttttattctgactatatagaaaggtgcttaattgggcctttgtcatttaaggaaagtgaacagatggaggaaggaaaattaataactaaatttccccacctcattgattgagcccatcacaaagaatattagaatgcttgagattccttctcatgctttagaatatgatcctagaaactaccaagcagtttgcagaattcttaaagcaaagctattccattatcagtgtaacaagcatgaaccacatcttcagtttgagaatcaagacaatcaatcctttgtgtttttgcccaaatttacttgctccacctctactccttccctcacccctgaagtctagaacctcctatgagtctccattcattgctcaaataaccaagaatcacactactttcttaattcaacataaagacctatctctaaacacatcctgaaaaggggacagggatgccccataagtctacaagtcagagacttctaacattttcttttaatgaagtttattttatttgcacattgcaccttaaagtcttttattatattctgtgaaagtgaaagagcgttagttgctcagtcatgtccgactctttgtgaccccatgaactgtagtcctctcccctcctctgtccatggaattccccaggcaagaacactggagtgggttgccagttccttctccaatgcatgaaagtggaaagtgaaagtgaagtcgctcagtcgtgtccgactcccagcgaccccatggactgcagcctactaggctcctccatccatgggattttctgggcaacagtactggagtggggtgccattgccttctccgcattatgttttacttcatgtgaaaaatatgctgattaataccactaaaatgatttaatgtaccatgcattgcacttgagaagctggggctgggtacaattttcaatggttgctgtcacatggtgcctgctgtttaaaacaaacccaa

SEQ ID NO: 29441 - DNA, 2133 bp, Bovine  19866880429877
tgcatattctactttctgcagcatttgcaaatctgaccagatatttcttttgaagatttttataatcaggtaatcagctctggatatgaaaatgggcggccttgagccatctggtcttgattgtaaattaatcttaaaagagtgaagataaataggattccagatgaatacagattagaagaaggtcaccatcttctggtgttaaaaaaatcaccaatactcattcaatggactgtatagaaattttatatgcatatttatattctttgtgtttaaagaatgttatttcttataagaatcatagaatattagatatcacagaacccaactgcttcatttttcagataacaaaattgagactgatcaaaattaatgagtttcctaggatcattttaccagttagtgaaaggaaaagcaattatcaagtggtacacactttaaaggacttcccctagtagctcagatggtaaagaatccacctgcaatgcaagagacctgggttcaatccctgggttgggaagatcccctggagaagggattggcaatccactccaatatcttgcctgcacaatcccatggacagaggagcctggcagtttacagtccctgtggtcgcaaagtgtcagacatgactgagcgactttcactttacttcagacactttaaaaaatattttgtcaagtacttttatagataattatttttcattatctataatatcagtattatttcccacatttactctttgaagaagcaggtatttctaatcattggatctcaaaaatacatctgctgcttctaagatgtatgtatattatacatctcaagtatatatattagatatcacagaatccaactgctttatacttatacacagaacccagcaccatatatacttgagaagaggtggagcttagattcaaattcctatctttaatgcccaattttcagacattattttagatggggacatggtctcatgtattttacttatcggataaacctactgatgtgttatattaaagaagtaatacagtaaactgaatgtgaatatgtggcataatattccatctgtattatggatggaggtaagaactgagctgggttaaatgtctttaaaaactttggtcaaacaacagaaaacttctacatcaacagattatacttaaaagtaaagatctgaaatccacttttaaacttaatattaaatataatgtttttataaataatctttgtactgtggggcaaaattgtcatttgtattctgtgttatatttactatatgaaccttttctttggaggacataatttatcttattatatatccagatccatgtactaaatagcagcacaggctgctgtactagcaattattttaaactagaccacacatctgttttttacaaagtcatctgctttgccaacttatgttcagtcaacataaaatgaattggactccatgacctttcaatgaaccatatgattttgttacacatattagtttcaaaaggatttacttttccaaagtcatgctgtatatgtaacactatataggtaggggaattttaatggacattaaacatttagagaaaggcattatgaataatatttaaaataaaatatattgattatctatgatatatttttcaaccatatgcacagcagttttatataggagaaaaggatttttgtcaacaacgatgactggaacatgccatacaactcagtgggtatgagccaaatctctcatctaattttatacacatgagaatattctagatattaaaagtcagtgacaagaaaaactgttttgctatgtaatctgaaaaatcgctagttaagtaataaaaatattttatttttagaaaaaatatatatactcatctattacatactctcatacacatttctcaaggattgcagtttaatgaaaaagaatgttatgtaagaaggtctatcataattttagagaaacatggctcatttgccagttttttgtgggtgatcgcaactcaaaagagccttaattttaagccctcagtaaatagatgtcactcatttagtctaagacatggataaattaggatataaaccaagaattcaagctgtctcctatcataattaattatacaa

SEQ ID NO: 29442 - DNA, 1414 bp, Bovine  19866880441382
acataaaactgagtttcttggtggtaaatgaccattatttaaacttgcagaaaatactttatttggagaaagaataataaaattttcagatagatattacttcttaaaattataaatgtgggtaagggcataactgccaagccacttagcaacatcattcatttttgacaattatgaaaaaaaatgaaagaaaaaggatcagatttattttttgtactgttttttctctggaagccagtaactctgtcagacagatatgtatttatttacatgaaggacaaagtggattcaaatttgacattaaagactctaatggagaattacaaactccatagggatatgcacacattttgaaggtgattttcttttgctcctggaaaccccacccttcgaggagagagttgtctcaaaaacacatttatctcctttgcgtctgccaacttccttcttcactaaatacccagatataaatatatttgtaatattaagtaggctatctggaaactcagtgtgtatatgaaaaggacaggatttggaaatgagaagtgtgggaatgtggagacttatatctagctgatgtcagaatgagagggagaaaaataaaccttttcttctttgaattcaagcaacctctttatggtggagaattgcttgaacagagaccagacaaagcatgtggtctgtgtgggatcagaagtgaaagatgtgactttcatggtgactaaataaacaaaagcattgttcctttgagtcattcatgaagacatcaaagtgtctttaccaaccagttcttttcattgcagtggggtcttgcccatttcactctttccaattataaaataacgatttcctacatttcaaggctgaataatacaggagtgatcttccaccttttgcatagatacgcacttacccccacaccctcataaacccactgaaagtgaacaagcttcacctggatggttcccgaccactgagcttcatttcaccctgctgtggcctgttgcaacaaaacatttggcttcacaagtgaaagacaggtgaataacacttgggacacgttggaggaagaatacacttttcttctatgatgttcagtgtgttctgcatctgagcatgacatatatacaacaccaccatgtgttgggaaaggtgtttctattgaagtgtcattatctctaatttacaggtggaggaacggagttataaagaaacacacggtgaacttcccagtgtcaacatcgcggttggctttggaatctaagctgtctggatgccagaatctggctccacaccctgagaaataatacaaactcctattgtcctcatcctctcttccaatgtgggtagcttcctggaagcagtggagttccacttgtactggtactggatattattttagccattttggggc

SEQ ID NO: 29443 - DNA, 947 bp, Bovine  19866880444617
atagagaattttatcagaaatatataatcaatttaagcttattttatgcaaattataccctattaaggaagcttgtaagcaagatctctgaaaacaagattctgcaggatttttggcactgctgtgacagacagtactaaatgccagcagacttgcatatttaaaatacttaatgatggagagaaaatataaaattaattatcttggtgagaaaaaaactgtcagacagataatttatttaaaactattttcgaaaattgttacataaaacatttctaaataagagcaattgatctatctaacaatagaaattggaactttaccaaaatggtggcaaattaagatttatatggagctccaatccaaacaatagatgaaataacttgtacctacaatacacaattgattgttcatgaatctattgggccataaaaatggcttggcagcctgtatttgcaaattctaatagcttctatgagtattatttgaggaaagtcaaatatccttagtgttatagccatgccttcaaaggttatttttcaaagaatggtgctgtggtttcatatggtgtgatgattaattttgtgtgtcagtttgactggaccacagggtatccagacatttgatcaaataatgttctgggtatgtgtatgagagtgtttctggatgagacgacatttgaattgagtagagcagattgccctccctaatgtggatgggtctcaaccgatcactgaaaacctaaatagaaggaaaagactaagggggatctttgcccacctgttgacttgagctgggacatcagtcttctctcgccctcagctaaaacttgcaccagtggctctagcagctcttagtcttttaaactcagactggaaatacaccagcagctctcctgtgtctccagtttgaggactacagatgttgggacttcttgatctccgtaa

SEQ ID NO: 29444 - DNA, 2656 bp, Bovine  19866880475069
taataataattttactgcttcactaaggtcagtccatagtgaagctggcacatttttattgcaagtgtgtgttggagaagaattcaacgtttggttccattgccttcatttatgctgagctgtcagccatttgacccaccatttgcttttgtatcatcactgaaatatcaacaaagtgaaaatgtaaataacatgtatcattataaaagtaattttgacctcaatggctttctgtgacacactggtggctcaaaaggtaaagtatctgcctgcaatgcaggagacctgggttagattcctgggttgggaagatcccctagaggagtgcatggcaacccactccattattcttgcctggagaatccccatggacaaagcagcatagtgggctatagtcgatggggtcgcaaagagttggacatgactgagtgacaaagcatacaatggtgtaagtgacatggtattagttttaaggaaaatttggtgatattaccaggtgtgcaacacagactgtcccactcccagtcctggactgagttttaagtgctgaaggaagttctgtacagtgccagcatcatctctctcaatgctcccagttctccttgtctcttcccactaatataactgatcattttatccacaccaatagactgatttggaccaatgatgctgaagtcagaccatcttggctatgccttacattaattgcaactttgggcaaattaacttctctgttcttgcttcagtttctttgcatttgtaaaatgatgataagtaataggttgttttgaggatgaaagagttcatgatataccgtacttagacctctacagaacattgtaagctatcagcaaatattagttgttgccgttactattatttaataatttactcctgctagtgaagtttgcatgttagccaggaatatcttgtgcaattggattgaatatccaagtgatagaatttcaagcatagtcagcaaactgttttgttgttgttttttcagtttttagggtctagtttgtggggacaacagatacttcagaacccctatagtcatccatggtatcctagttatgcatatgaaatgactatgttaataagcttattcttaatgttcagtcaataatatactccaagaggagtccaagaggaggtagttatgtctttgttcagtttttaggctctgctaaactactcacgcagtaatttgtgtatggttgggtcctgataaatgcatgtaaaatatatatactgaaaagaaaaaatatatatacatttgcaagtgaactgctccttggaaaaaattattctctaaaagcaatatctcctgagtttccttgattaaaccaaataaaattttctttaaaagaaaacttgaaataacgtatcttctggctatagctcccagcagtacataacatgagaatgttatcattctcccaccccccaaaaaggagccatttgttgcataagaaaaataaaggcttaaaaatgatttccccacaaaaagaagtatagcttattgcatgtattcatatcagtctctgctccagcagagaatgccttacataattgtatttggggaactttcttgtagagagagatttatagtttggggcttataaaaaacctatttttattttaaaatatagactctcagcaagtgtcaccctgaagaatcaggcctcctggactattttgttacattttaggagataaaaaaccatgcggcagttacactattaagctacagcaatggagctgccactctcaacctcattactcaaggctctctttagttcaattatacacctctacagctaaggaagatagatggaggtcatttgagagctgtaaaccacaatgctttgaatgcagaactatgtttttaaactgatttacaccttgttctccagtgttctacagcgggggcttggattgaaatgcaggggccatgattgaaaaggctttttcttggtttcagcatcacagtccatgctggctagcaattattacctctattaaatggcaagggacgatgaatgtcgccttcattacttcagtgtgagcagcaaaaccaaaccaaaccaaaagggaaataagagttcttagtcagaatatcctttggggaagaaggaatgacatttatgtctcctgtaagttttaacttgattgtgtgtattggcccagcaagaaaggaattgggtaattgaaaggagcaatttgctttttcagcattgacgaaactactgtcatgctgccctgatttaactcacatacatctcccagtgtgaaaggggtaatgtacactaaaggaagttaattaaacaaggcaaatccacatgaacttctcccagagaaatggaagattttatgaatttgtgtgtgtgcttagttgctcagttgtatcagattctttgcgaccccatagattctggcctgccagactcctctgttcatgggattctccagacaagaacactggaatgggttaccactcccttctccaggagatcttcctgatccagggatcgaatctggttctcctgcactgtaggtagattttttactgtctgaaccaccagagaattcaaggtaagtgtatttgactttcctgaagcagctactctgcttcaatgttcggattaaattt

SEQ ID NO: 29445 - DNA, 1302 bp, Bovine  19866880506279
ttcgggtaatgttaacactgttttcttaagcaagagaagtgtaaggagcagcagtagtacgggaatcacacagaacaaagtctaggcgctctgcaggcttaccttctggggcataacataactgttcatgcttgaagacactggcatccagttagtgctagggaataataaggtagcaggtgggaccaggcaggacactgagaaatcacaaggtaggaatgtccttcaggctcaaataaacaggaggtaaaaagtcaagttgcttaaggactttgtcctttagacaaagtggtcgatggggatgtacagtatattattaaagacatgcagcctgatggggcttccatgggcatccccagatggtccagtggtgaggactcagtgctttcactgaggggacacagcttcaatccctggtcagggggactaagatcccacaagctgcacaacatggggcagggggagaacatgcagcctgaaatcacacagcccagggctcacattcttcccctgccatctgcaatccagtgggaccctcagtgaatgacttctctgttaaatggaactagtggcagcatctaggtcatcaggatacctgtgttaaatatgacccatgcaaagcactacacccatcataaacacttcaatgttttgtctgttaagggcaacctgatgccaccaccaatacttcccaaacacacaggttttcatagtctcctatcctcacaagtgtggcatgttttgaatatagctttgagggttcccacgcacctgcagtgattacaaagtttccttgttccctgttgtcattaatttttccatttaatttatcattttccaaatccttctcaggctagctgtcacttgatattagatgttgattgggggggaaagtggctgctccagatgaatgagttttaccttgggataagcagtaaggccatctataatgactaatggatcatctgggttgtagtctggtcaaatacacagagttccaagtaaggtggaaatacaccagaatagtcttatcctgtctctgattaagcagcataaaagggaagggatttatggagaaatatgatgtcttttattagaagaggaagaagaaatgggaacacagtccctaatgttcaacaacgtggcgatcttctatgagtatggcgatcttctaagagtatggctatggagcctaagggacacaacagtgtaccacgcagcactgctttctcccacatccaaaattactaaaataaaaaagtcacactttaataccagcctaagagaaggacaattacaaaa

SEQ ID NO: 29446 - DNA, 1148 bp, Bovine  19866880517568
tgggcctaaaaacctggggttgttacgtttgatttgttcatgtacaagagaaagtagctgatagaatttctatttaaatcaatataattcacacacacatacaaatttaatccagcaagaaaggttttctcgtggctcgtttcagtgacatgagttaagattcagtcattggaggctgctgctcctttcttctcctaaaaagggagattttggccatggacttgtttctctcacaattcttcaactctgtataactaacgcaagaggctgtggctagaactgatataaaccagtgctctcctcatactctttaagggtagcaaccacagccttcggagaaaaaccaaaggcaccatgtcaattacagcctgccttgattcaacaaatggattagcagcaatgttttcaccaccaagcaggacatcttgaaaacctaatatggcaaaatggaaacctgcaaatggtcagcggctactctggtgtagctgaaatgggcttattgatgagcataaacatccttgagccttcataaacatgtaaggcttctgcacctcatgaattgctttagaaatgaaacagaaagaggctgaagcttcagagaggttgccactttctctctccaggctttgtttgacacccaaccaatctctttaatcaaaagcactcttttccgtccacagatgaatctctggaaattgtaaaaaaaaaaagagagagagaaaagaagtgcctctgttgggaaatgagttggtccaggccacctgcttgcctgctccttcatgatgataaaggtaagttgagggcagaggatctgcaaacttgtgtgtgaaatggacagaacaaatggcctggcatcaagtagcttctggatgtgtgcccaaaatgtccagaaaaatagctctcctgaaacaggagctgccacgagggtaagtcttactgctttcacatgcatcaacagtacaaaagaaggtcaaggaattgccatgccacagtgaaagggatattctttctataggaaacagaagagtatccatcacaagcattcttaagggtggtaccccattcacataacaaactgatctgtagtaaacccttacaccttcgatggacacagatccctcatcttgccttgcagctaaggaatttga

SEQ ID NO: 29447 - DNA, 1686 bp, Bovine  19866880521751
ccccagggctttgaatataattttacttgatgagcttccaatatgcttgtccggtttctaaacacagcaacagtcttggacactgcattcctcttgcttgtgttcctttggtctcgggaaaggtccagccttactctttagtaaatctagctgaaaatgctgtggccttggaatgttttacaaacctttcccattctctaactaactgctctaatgaagagaaaaatggtaattgaaatgagactaattagattgtcaattacctgcctcctcacataggtaattgaaatctccctaattatggtgtctgtgtgtctagatgctttgtactgaggaattattaatggaaagcagctttagatgaagtaacaggaaatcttgaaaaatgatttagagcaaatttgttctatctaaagcattcatttttttcaaagcaaaagatgttatatatccaatccagtaatgaattcaccaaggaagaaggaaaatcattctagtatttttcggactataaagttcaggtttaaagaaaataagatgagattaaaccttgaccttgaccttgatttttgtttactgtttatccctggttttgaagatactccctttgggtccacaggttctttttgtttgaagaaataggtttacatcagcaggcaattagagaatctcaagataaatatagaaagtgagatttgcagatgaggtgcaaaaatatacacgaaattaaatatatatatcacacaaatgacttcctctgagtgcccactaggaagagcctttattgaagtggcttcaggggtgagtagaaaaggcagttttgattctggaaaaaaggttataatgatgaaatccttagagttctcattgctaggagggtggtttcctactttaaacaaagtatgttcttagcaacaaggcttctttctcttcagtttcaattttttagtgaaaggtttccttggagagagctataaggtcgcatggataatcatgttatgtttgtattaggatcatttaagaactttttccagccctgcaacatctgatgtctcatcagttttacaataaacttgaagttaggtggggaaagttatgatgacctctgtctgagaagcagagccacagcaacgcagaaagatgaatagacttgacccaatatgaattattgaagatactttaacaattatcttattaaagagaatcttactgaatagagtcttggtccttcctctcttagttcttcacagagaagcaggaagcctactgagatggttggatgacatcacagactcagtggacataaatttgagtgaactctggaagatagtggaggacagaggagcctggtaggctagagtccatggggttgctgagtcagacatgacttagtgaccaagcaacaataacaacaaaagcaacagtgggtgagatacttaggtgagtatcttagggtgatatctctacttaggtgagatatcattatccatgttttactccagtgaggttgcaatacaagatacacctgcctcttttgctgtctaggtagtggtagctcagacggtaaagaatccacctgcaatgctggaggcctggattcgatccctgggttgggaagatctcctggagaagggaatggctacccactccagtattcttgcctggagaattccatggacagaggag

SEQ ID NO: 29448 - DNA, 1292 bp, Bovine  19866880544051
cattttaagtttggatgtgactccaaaaagcggtcagtccagatggaagagacgatgcaagagaccagcatgcttgagaaaagatgacttgatttccccacagaacaaagttaacacttaaacaacttaattgtaaattttaagtcacaaaatttttaaaagagtggagagagcaatgtcttcctccctcctttcttaaacaagaaagcccagtttataataagtactttaccaaggcatctgcttaaacttttgctattcactcaagcatctgtctgaaaaggagtctggtcttctctagccatgctgcaagatactggtaaggaaagctgtttgaacttcctcagaacactaacatttaatactccttaagtatcccacaggaaaagaaggtaagtcaatattttctcaagttgatacataattgaattagagttttacttaacttaataaattgccacctgggataatagaaccaagaacggcattcaatttcggttctggatcaattgtgttttctcactggaagtctaagtgtctgttaccatgactcccagaggcatcagggcaaaaaaaactgttttcagggaagtgcttggaacaagctggttagtcacacctggctcaagtgaagggccctcacacttatcttgaccaacccatgtatagtgaatcttcagctgcctaggcagggaggagagttgaatttccaaaagttatgatgtgacttcactcattcagacttactgtcaccaaacctactggtgagattcattatgaagatctcagaagcttgcccttctgacattatcagagcgtgtctccaatctctctgtgccaacttcctgctgtaacctttagataagtaaaccaaatttgatttatccagtgggtgggctctgcctggttactccatcaatcccaacctacttttgatttatgttcatgataactcctccataacccaatttttaaaatcaaaaatgtcttcattcagataataaattagaaggaacatcatgactttctacaattcccttcaaaagattaaacccaaaaggctaggtgtacaaggccgtttggttttgtttcatttttccacaatgatacaagtaaacactgatgacatggaataaacccaccaggaggtggatttgtaagttcttatatttaccatacagtatatattataactaccacaaaagacgaggagtagttggaaagcaaatctttactgaaaaacaaacctttaacaggaggtctaagagtttcccaaaggaagaatttaaaag

SEQ ID NO: 29449 - DNA, 4603 bp, Bovine  19866880550579
ggttgcaagacagccctagaaattagttaccatttctaagttgattgactttagcaaagcattctgaaaacttcttgagtatgatcactgactattcaatgaattctccactgtcaaggggcttgtgatcactaatgaaaatggaacagccattctctaccagtctttgaaatacttctatttttagatgtttctgcattatttctgtgtaaaaaagctgaagggttgctcagcagtgaaaggattggcatgaatttccatttaattcctgcaaacaggaacacttggtgatgaggccaaagattctcagtcttggatcttcctgggcagaggtggtccctgatttggaggttgtgaatctggaccaaactctagtggatatattcctgatctaaactaataagtaaaaaaaaaaccactttcaagatccccagcattctgcaaaagaaagagtgagcaagcatctgcaataagacttcagagactttgtaagtctgtaaggctttgtaagcctgcatacaaatagagcaatagttttgacatattcttgtcattgaggagaatagtgtttcagcgactgtaagcttactcaggtgtgccgtttgtttcatgtgttgtaacgcactgcttaggtatccggatggtgcaggtttacggggtaattacctcactgaaaaccagatttcttattgtttggatgtcagttattgaaagtatgccaaagaactctcagaccgctgggaaacccccaacaatacttgcctgatggaggcgcctgtatttttcatgtcatttttcgtgtgtattttttgcgtgctgccagggcaggcaaactagttcagggacgagaacttcacttcttactgcagtaggaagcccctgtcccctgcaaccacctgcactccagctggggaaacatcaaaatgatattgtctctgatggtgtggtgctctgagacaactcctgagccttcaaccaagaagaatgaatgatctgacatttgtccctctgacaacctcctctgcttggaaacttctgccgtcctattgacagcatgacatcagaaaatctgatcttgaaattagatcagttttgaaaacttgaataaacatatattttatagtagttataaatatgtatatgtacaacataaatataagtcttacaaatgtttgtctgatttttgtggtggagggttattaagtcaggagttagtttgctggattgaactctgcttcaaacttctacttgttacttaatctctctaaactaattttcttcttctgaaaatgaggatgaaatagtaatttctcatagttctttttttttcagaattaaatgaggaaaaatacgcatacaaatatctgacaaggaatcgtgaattagttttgaacaccaaccaacacattttgggcttccctgctggctcagatgataaagaacctgcctgcgatgcaagagacccaggttcgattcttgggttgggaagatctcctgtagaagggaatggctttctactccagtattcttatctagagaatagtatattttgggagtttactatcaagcaagttcaaacagaaatccaatcgaagatagatggggacttctatacctttgtgattccaccctaccctgcaacatttcacaatgtctgggaacattattagtgtcagaacttgcagggggtggggaatggagctactggcacttagtgggtagaggtcaggaatgctgctaaacatcctataatgcacaggacaatacctccacacccaaaagaaattatcttgtccaaaatgtcaattgtgtaggggttgagaaaccctgatctagataattccttcatcctcgctttcatgagttagattctatgatgtggccaaagctacttgaaataggttactaagcctgagatgatgtaacctggcaatgtttctttttgctccttcacgtctatagcaattgttttaagcctgtttttattgtacacggtagaccaggagagaccagaaaaccatgctttacagtctgcagacagagccgccctgtttgtgttcaacttcatgcagccaagtgaatcatcactattcagtcttagtaaactgcaaattgaaacagtcaattagaacctcttcaactgcccagaaacactatcttacagaggtctgcttcctactgggtgttagtggttgtttcaggagctcatgtcattcttagtatttctggtttcttatctaatgctgtatttcaccaaatttaataagccattgattctaagatgcagcattctttctttcccttggtgtatattccactgagaaagagcgaaaatactgccattttcaactgtaggattctattgttggtaagatatatgccaatttcagatatgctaaaatgtggaaaaaatgtgcatacttccttaaagttgaggaagaatggtcactattgtccatattattgaattacattaaacttactttgcttttagaatatattttttgaacatttaaattttacttttgagtaacttcattatttccaaactgcagtactctaaaatgtgactattgtaaaagtgagcaaaaattgtgttcaacaataatagactgcctttctgggtgaagggtacatactcagcaattcttatatcttgagaaatataatggtgaaagtatttcaaaattcctgggaaaattatattatactgtaatgtgtgtatagtgttacatactttttatatctattagtatatattcttctactagctgttagagtatgactccttcctcactcattttgacattcagaattctattcatttatttgattacagttcctcaatcttccataataatattgatctattcccaaaaattccttagccttttcttggtaggccaaaatcagaaacctgactaattttggctgcaatgagaagcagagctagaatttgaatcctttgggctcatctcttctatttgtgggcttccctggtggctcaaatggtaaagaatctgcctgcaatgtgggagacccaagatcccctggaaacgtgaatggctacccactccagtattcttgcctggagacttccatggacagaggagtcaggtggaccacagtccatggaatcgcaaagagtaggacatgactgattgactaacacttactttcacattttgcagttattattgcagttattggagaagcacagagaggcagaaatgtcagggtgtataataggtgatgattgaaaatgaagtccatagaaagggagccctagtgagccatagaaagaacagcttgtgctgttgggactcagcctaaggttaaatccggaaacctgaaaatgatgatgtttatatacagcaaaattccttaacaggtcatttcagagtcttaccagaatctggacccattggtccaacatcattggctgttcacacacagttatagtttagtttctttggacagtctttcagactaactagggaaatacaaattgttctttttttggtctttttggggttgatttattcaagctgggcaggatccaaacaggaacccacatttcatatttggttgttaatatttttaagtttttgaatctagagcattcctccccccttttgtaatttgtttttctctaccactgacttgttgaagaaaccaggtcagttgccctatgaaatgtcccacattctttgtctgtttccctctttctggtatcattcatcatctgttttgtggcaatggaatttatctctagaggattctgttactggtggggtcagggtataaagtgtgaatggtgagagttgaggatggaagttaaggctgggttaggttgtagtttgaatgcagggcggagctacctgtggcaggacaattcagtggttagcaaagactcagggctcaagatttccaggtacaaattgtgctctgccgcttaagagctattgaccttggacaagtagtgtaatctctctgtgtcttagtttcctcatttataaaatgaggataacaagaatccttacctcacagggttgctgtggaatttaaatgagttaatacctgtgaagcccttggattggtgctgggtgcatggtatcgctgcacagtgtttgccattctattgtttgggggttagaggcagggtgcgggggggtgggggttgggggctggcctttagttgcagggtaagggtgatttcgtgttcatgattccacccagtaccagagcttctacctcctggtcagagaagcttgggggtggggagtgccagaaccacccctccttgaatggccttccctcactgcctttctggagaccaatttggggttgaatgagggcttcccaggtggctcagtgggtatagaatctgcctgcaatgctggagatgcaggagacagctgttgcctccttggattgggaagatcccctggaggaagtcagggccacctgttccagtatttggacagaggatcctggcagactacagtccatgggatagaagagtcagacatgactcaagtgactgagcactcacgcatgcacgcatgaggtggggagggggaatatatttttttaatagctt

SEQ ID NO: 29450 - DNA, 1824 bp, Bovine  19866880551606
ctgggttgggaagatcccctggggaaggaaatggtaacccactccagtatttttgcctggaagattccatggacagaggagcctgctgggctacacatgaagttgcaaagagtcagacacgacttagcaactaaacaacagcaatcatatattaatatgatttgcagaataagagtcagaattcagaatccttgaggtgcacaaggctttttagcccaagtatccttaattttcggaagaatccttttgagtatagctaaattttacacagattcttacggccatcatctattatattttgtgaacaagtcaggaatgtaaagaaaaatattggattcacttcacaaattaaactaattgatgtaaatagcaattgatggcgattgatgccctgtattctgtcttgtgtactactgaaagtttccacaaagaataaggagattcagctgcacattgtcataactacaactcaaagagcaaatctgatccttctctgaaacacctgactttgggcaagatagataccagcgccttcacctggggagtgctacagaagcagctctggtagaacaaggatctcagagtgtggtttgttggtctctgtggatgcagaagtccatcatatatggtctgcaggcagagtgagggcttcagaggaaatgccaagaaatgatttattcacagacattgctgaattcgaaaggtacggttaatgattatattctgaaagactcagcttattctacgaggactgcagtggccttttcctccctgctggttcattcaataaacagggtgtggtttaatttgtctaactcattctcacctcatttacatatagttgtttatatttgttagattcccacgattcattcttccttttctaaggtgttatattcctgagtcacagaaatggatcagtggctcaaaagttgttaactgaagcatgaaagaagtgatgaaaatagtgaagcacatactacaactttgaataacatcgtaaatacaaatagtgaacagggcttagatgagaatatagaatgtgatgctgcatgtgctgagataactgaatttctaaacgtgatgaattttcatgagctgtaaaagcaaagtttaaataaggacacgggatgtctgaaaatctggttttgttgggctgaccttccattttcctttgagatgtcagcccttgtttgctgatataaaactttgtcaaatagtggcatagggccatcagcttttcaaatcatgctgaagtatgatcaacacactagaagttttatcaatatttttttcagaacaaccattaaatcatgctttccactatccaatggacacattttatttctgaaggctgagaaaaggccactaagaatttctctccttgttggcaaaaagtaaaagaaacaaaaacaaagcactgttccagtaacaatatggttgacaagcttataaaatttaatgacaaatattttgtttggagaaaaagtagtatgagtatccctttatcaaaggatacgattgggtgtcatataatatcagtggcatggcagcagatattgtgttttacagttactgagaccattgatgtcagagtgtgtgaaccagctcttgccaagtaggaagagacattagagaaaatagagcaaatgtttactgagagcttcctttgtactgtgtgccttaggtgttctatttcattttaccaacctcaaaatctatgggttgttggttatgtgtgctcagtcatgtccgatgctctgtgactccatggaatgtagcccgccaagttcctctgcttatgggaatttttcaggcaagcat

SEQ ID NO: 29451 - DNA, 1536 bp, Bovine  19866880607116
tgggcctcaagcctgctggccttcacagtaaacataggccatcctctctcctggatctccagttttctgactcatcctgtagatattcacaacagcatgatgctccaagataacatgaaatcatatcttacagcagtacttccaaaatgtcccatgcccattgtagtcatttggggccacatgtacagatcctctgaattacagaataatcttttctgccccctatggtacattggtgttgtggttcagttgctaagttacattcgattctttgtgaccccatggactatagcactttaggcttccctgtccttcactatctctgagtttgctcaaaatcactgctcaaactctgttgagtcggtgatgccatattaataaaaatattgacaaacgctttacctccacacctgtgctggctgtgctggcagtagctagcacagggcatgctacagaaaaagcacttaactgattcaactgtgggttgaattatcctgtgccttgttgatatggtcttacatttgtatccctgataagagtcaggcagacctcagtctgaatttggactcttccctcacagttatgtgaccttgagcaaaatatttaacttctttgagatccagtttcattgcctgtaaaatctgggatatagcgcccactacacggggttattataagatttaaaggaaatagtgtgtcaagcatgtagggcaatttgtgatacaacgtaggtactcaagtaatgagagctgttaccatagtaacgatgatactggggatgttggtgatgttagctcaatcttaaccactggaagaaacagtgaaagagctataaatgaacagtaatgatggtgggggaacattttcaaaaataaatattttttactcaacatcaaatatcagttttattccatctagtagaaaaggtagagcaaaactgaggtatgctgtaagtccactaagaggtgctaacttgagtgaatgaaaccatcaatattctctttcctaagtttaagtgttaaatggaaatcccaagtcttactcatatttcctaagttaattatgaatcagatacaatcaatgatgttgtagggaaaacactaaaaataaaacaaatgagtctagagggataaggctttaaacagagctgtgagagatggaaaccaccagcatcatttttctctttccattttcgtgagaacattttaagatttttttttcttttcccctaggcttgcttatcattatgggagagtgataatataaaataatcttctctcagccctcgagcatctaatgaaaatgtacaaccttctgctgtcagtacagcaaggacatcagcaggccgtgtcctggaaagagaccattctttgccaccctctgtatccattcagtctgagaaaacatcactttaacctcagcccaccaacaagggctgtactgtccatgttatcaaatccacattatcagtttttaatcagtaacctccatttccgaaacggctcatgtctgtcacagaaatgctggctggatgat

SEQ ID NO: 29452 - DNA, 2234 bp, Bovine  19866880614766
ctggggatctagagccccggattattaagctgatggcttaataatctgcttgatgtactgtaatttattgtcgtcttttcttgaaactttttattctagaactcagtcattttctaaaatctgcataagaagaaagatattgttaatatctaacaatcttggatcttctcaaatgtacagggagcctgcatagtcatgaaagtcttcaaattattcccccaaaagtaagaattttgacttgacagagaggctatgtaaatggcaggaaaccggtgacttttgaccttgactctgaaaaaccttggccaggaaagtcctttggggaattctttcaggaatctataagttgggaggatacctggctgtggagggcttatctgggcaaagtgatggtacactggtaaatagattgcatagttttgaatttgccagaaagcttcagcttctgtcttatgctacttggaccagtcaaggtatccctcctcagatggcaatactgcagcaatcgagttaaaaagaagaattaaaaaagaagaaaagaaaagccccttaagaaaagagagacactctttgatttcttcagtgctcagggttgctatttttaacttaagaggttggtgccggacactggggtataaacactaaatctaccttgatattcaaagaacccatactgtcacaatctgtgtcaaaagaactttggttttgtgttcaaacctctctattgtttgaaagcttctgtgggagccttgctttagagctgcactctcaaaaagatacctgatttctaccaaaatctgaactggaaggtaattgctatttatattacctactgcctatcagacactgcaaagaccggctgtcactaaacgttaaccttacaacttactacttgacttccagtttgactttctgttttgttctgtataaccaacacacgccatttattccctaggaagaagcttacgtgtatatttagacatctatcttttttttttaagtggcaatgcatgttctgtccacaacttgcttcctatatcagacatttagtaatcaaatattttcccactgatttttattatacatttaaaaatgctttgctttaatttctgatggattcaattggcaaaggctcctactgcttgaagcatcagatatcctcagcctacaacttctgtgtcaggtcgttaatatttcataggatctgaacatgctctaggagcttattaacctatataatgagatggagagtttgattcactaaaattccagggccttttctccacgagattaatagcgttcagaagacttccctgggggctctgcaggaagctgggggtcatgagctggagtggattacatgaatggaatggctgggtggggaaacaggaggggcgagtggcatgatggtggaatcagagaaaggaagaaagtcatacagacacaaagaaatgcacacatagaaaaactgacatagacagataaacacatgcaaaaagaaccttctgtgtcagagcagctactgtggagtctcatagcagatggatgtgtccttaggaattttaggatgtttcactgtgtcatgtgctatttaagctcatatacagctctttcgggcttccagctggtgttagtggtcaacaactctcctgccaatgcaggagatgtaagagatgcaagttcgatccctgggttgggaagatgtcctggaagaggtcagggcaacccactctagtattcttgcctggagaatccccatggacagagaagcctggtgggctacagtccatagggttgtacagagtcagacatgacagaagcaacttagcacgcacagctctttcaagaaaaccaaatataaagatttagactctttgtcaagactaatgagatcagatgtatgttgtcctgggcaatgcatcaatggatagagactgatctcaaggccgtcgagatatatttgggtttcatttaggatttaagcctcttcccctccttaccaccccatcctacctggtctccagttgctggagaaattttccttaatcaaaagtcctactttccaatcccttttgtggaatttatgaactcctcatctgagttttcatacctatcatggaggctacagcacaagattacaagaagtgagtgaaaaaatgcttgtaaacattcctttcaccatgtctggcatgtaatgagtttaatggatctcatatctagatcagtggagaata

SEQ ID NO: 29453 - DNA, 2044 bp, Bovine  19866880632561
tcagctcattcagttggacaattccctgccttgcatactcctctgacttttctggtcctgaagtgtgtctttcctacatgacctgatgtggcttcttaagacacaaagcttcttacctccttgaaaaaaaatctgttcttctcttagagtaacttgtttctgcagaatcacgcccttcaatttgcactgtattatgacatcaccggagaaggcaatggcaacccactccagtactcttgcctggaaaatcctgtggatggaggggcctggtgggctgcagtccatggggttgctaggagtaggacatgactgagcgacttcacttaatttttcattttcatgaactggagaaggaaatggcaacccactccagtgttcttgcctggagaatcccagggacgtgggagcctagtgggctgccgtctatggggtcgcacagagtcggacacgactgaagcgacttagcagcagcagcagcagcatgacatcaccacgtccaatgattacctggttgtgaataagcccatcccaataaggagcagagatttgactgtggaaggtgatggagttgctttggaagaagaccagttcctttctagatctttctctaaagctcctgctagaggcaactggaggaaacagaagaggatttaaagtcagatgacttgcagagaaattcccgttgttattcagtgcttaagatatgtacaactctttgtgaccctgtggactgtagcccaccaggctgctctgtcctccactatctctcggagtttgctaaaactcatgtccattgagttggtgatgctatccaactacctcatccctctgctgcccccttcttcttttgccttcaatctttcccagcatcagagtctttcccaatgagtcggctcttagcatcaggtggccaaagtattggagaagagaaagcttgcagattgtaatttttccaccactttgattctcccttagcattggggcaattcctgtaaaatatacaaatatttagaaagctaaatgaaatgaacaacagctaaaataggctccgctaggattgtgtttcgaacaatttcagttggcacagccacccaaagtaatgagatttttaaagaactccatgaggtaatcaagtttatattacaaaataaataagtctgcactaaatcagacatcacagtaaactacactgaagtagtgaccaatgagaccaggtaccaaaggttctagtcacagttgtggaggaatactcaaaatggaaaagatgatatctataaacttaattttccctgggacatgggaaatgactgctgttaatcaattttaatgataatttttgtggctcttttgaggaccgctgtatcaggttatcaaggtttgccaggaaaagagaggtaattagaaaaagagtagaagtccataaaggtaggtgcttttgaaaaaaaaaaaaaaaaattaaaagcctctactgtcctgtacaaaaagtttcacttagaatgtacagccgccacctccccctcaacccgccaccgccaaaaaaagaatgtacagcccagaggctggtttcattccatggctgctgtgggattgcttcctatgaatatcatgtcttaagccatagaatccatgttggaaaaggcaggtgcagacacgcagtcttttcagaccctgcatggtcacagattgagggcaggaggagaaggagggtggggaacagaggatgagatggttggatggcttcaccgactcaatggacatgagttgaagcaaaaacagatggggaatcctgggatgctgcagtccatggggtcgcaaagagttgaacacaactgagtgactgaacaacaacaacaacagtggttacaggagaatatgccttgagtctagatcatttccttatagagatacagagtccttgcagcctgtgctgggcaaaagtctttgggagttttttttttttttccttgttttggacttggtgtatacttctttgttctgcttaagtgtgtgcatcacatgacacctggccaaccccactgctgta

SEQ ID NO: 29454 - DNA, 639 bp, Bovine  19866880649160
tatagcctcaatatttgtctgaagacacttaaattctgacaagtaaaggaaagttctagaagcaatattttcacttcttaaacattctccaaacaacatcaagcattgatacacactgaagagtgcatttatttttttgtatcactccaagtatgttggaatatgcaaggactgtggttaaaattagaatgtataaggcatattataatttagttcatactgaagaagaaattaacagaacaatgcttggttcatacatgttccaaaagttgaacaatctcttgagttagacatagagattttctattttgttttaatttgtcaaggtatttttcttcccttcatgaactttaggtacacataacttatgtcatttatttatggtcttttatacctagtttgtaaattgtaaaatagcaaactaaatgcaaagagtttgcatttgaaaataataaagtagttgctgtatacaaacctggaatctagttgtctcttttcaacagtttttactgcatgcatgatgtttctaaattacttacttactggttgtcatttggttagaacacaaaatcttcaattctaagcatacttatttagaaaataaaaagcattttgacatctaaatggcccttgcccttg

SEQ ID NO: 29455 - DNA, 2524 bp, Bovine  19866880652511
ttgctatgggatcctgtgggctgccatctttaaagattctgagactctgaccttgaatgagtgattcagagaatgccaggggtggaaaaaactctccagatcaccagatgccactttttattacagatgaaaaaatggaggctcacagatgaagagtactttgtgcaaagcctgataacccattaatgaaagagctcactccagaagcccaggtctctctgattttggactctacttaacagaatggacaaattgctgtggaagaaattttgtatccaccagttctgagtgacagatctgaataaagcaatattttttaagggtttgggaaagaagaatgtttgtatgagtatatatgtgtgtgtgtggatagggaatcactgggaagacaaaaggacaattctttctttttctctagtacaatagcattcatgagtaaatgataaagatcaagagatgaagattttttaatttgttttattactgataatgttgataggaaaatattatttcacatgtgtagccacaaggcttgctttaactgtgcacctcaagaaagagttcatgcaaggagagttttagtctgaaaagaaataaatatctaagatcacctcttgtccaggacaggtgtagaacaaagagaatcaatctccagtgtgtatggcctttggataactggactctacttagctcctatatgtggactgatattttacccaccgatccagtgagttgcttttcatctgttagtaaggaaaagggggcttagggagctggcagaagtgactcttacgagtagccaaatctttctgggaggaaggaggtaggcaggaggactggaataaagtctggatgccattgctgagctggggagagtagacctgtttgacagaatgcattgatggaatggacctttgacctttcctcagtagcagaattcttactacaccaagattattttatgagtgataaaaacaccatcctcatattatatcgttctctactttattgcatatgcctaaaaggtatgggtccatctttgtatttttctttgactccctggaaattaacatgctctgattttatgcatgcagagcagctatttgctaaaactttgagggaactgatggtttcagctgttcacattttctctccgtctctcctaattccttattgagaggggctctggcataataaggcatgagttctaatccccaaactccacttcatatgattatgaccttataaaacgctctctccaataactctctgtgttcttcttcacaaaattaagattacaatatttcagggaagattaaatgagacaatggatgttcgttttcccagtgcctagaatatagaagtcactcaacaaatgacttgtaattatacatggggctggcttcatggatgaacagcatgtgcacatacttggtttaatgctctgttgcttccatctcgaaattcttaatcatttttgaacaaggggttctggattttcattttatactgaactctgaaaattatgtagctagtcctgattaaagagttatacgggaataatttgggcacaagttacagggaaagagggaaagacagggaaagagataagagaaaaggaggaaggaggggtagggaaagcatttggtatgatccaatttccactggaaaattaaaatagtaaaaataagaataaatcccctcttctgtacagcaatatttccatgaaaatggggttacagtgggaggaaaaaaaaggttacggtgcagatcaaaagactggtgagcttctaaagcaaagtataactggttttatcattatgcttaagaattgaccagaaaacggagcaaaatcaagaaattcttttgaatagacaaatcaagaacacaatacctagaaaatcaatgcaatattatagaagcccttgactgaaatacttacataacttttaaaaaatggagaataatatataacttatctatgcaagtgaaaaagcaatttttataacattgtacattcagtttttcagaactccagagaatgatttaaaacacaattacacctcatcgaagagataggcaatctaaaatcatgagaagatagtaggctctttatcaatgcttgttgattagtttattaatcactccttcctccatcaggagggattctcacacaaagtccccacctgcctgagagtagctagttgtcttgctccatgtcctaacctgctccgacaatacagaatagtgcatgccttcaacccagtccaccgtcaacatggatagttctccttcatccctaagtaatttttccttataataaacctgcccagccagtagtcatagtttctgcatcctgcattatcttagacatttttttcctaagtaaattctggtttttgagtatccttttaaaatgtggtgcctgaccttcaaatagtcctctagatatatatgcagatgagctcaaaataaagtgggtgtcaaatttctatttctttcgctttagatcacatttatttta

SEQ ID NO: 29456 - DNA, 2855 bp, Bovine  19866880659351
ctaatcttatagctatgaaaattcctcctgggagcaaattaattttttgaaaggcatttgttttggttttgaatagttttggaaaggagcgagtgaaaataaaataagcctatttttatttcacgcaaaattaatgaaattatcagattgcagatttcattctattacaaattcttcctctatgtaaagtgctcagttttagtgaaatggttggctgtgagtcagagaaattgagcagagtcaggtcttcatgagagataaactttgaaacaccacatatgtttaacctgctttttgaattggtcacgcaacactcagaatcagtttcagtctcaaggaaggcatacgtaaaacatttaatgtatgttcatgaagaacaggtcaacctgcccttggcttgtgtatcatttatttaatttatacagttttaggcctttgggtcctttcaaaacatttgcaaatgtgcagcattatggggtttccaggcaagtcttcatcccgtgagttaaaaactagaacaccaagaactcaggaagggaagtagaagataggaagttttgctttctttttctggtttgaaggaagaaagaaattcaccctctgtcccactttagaagaggcttcttagaaagatgtcacaatcttcttggaatcttttccttagagtctggaacttcattgcaaaattccagtgaactttgactgtcatgtccttatgttttatacagaatgatatgtttgccaggtattagtgtgtttgtcctatccattttctaacacttagaataaaatgaacatttaacacttattaagtcaatgtgagcattatgaaagtgaacttaaaatataattaaggattcaacacactaatacctggcatacaggtagaaggttgattttttgagggatgctgttaaaatcaattatcttgaaactcttggcagctcattatgtgcataccgggtctgccaaaatagttcagtttgttgatctaaattttggaagctttgggttaaagtctgcttatttcaaggttactctttaaaaactgtatattgagatgaatatccaaggttaaaggtttatcaggttaagtaattttagaaattttacattgagaagtgaaggatgtggctacttgagttcattctaatcataccaagtctaggtggctcttgctaatgctctcttacattgagagcatcatttttaaattttgtgtttccagaaatactttttttcgttcctcaaccaagaccttatggtgttgaaacatagctacaggtaaatgaacattagtttttcgatttcttagttaaagactagataggcatgtagttcagtgaaactaacaccattcagcaaataattataatgctttatttctctgcggttcctttacatgtagtttttgtttgccacttcatattgtgacgtgctgcagaatggcatggctttccccacctcagagatgaaagtgagcctcagagaagtggtcgatctgaagtcattgagctaggagtacgtagcagaatcagcctgaaaacctcattctcctgaggccattttacttttaaataaaacaaattcctatcgtatatctgtgagaaaagggagagaatgactccagaatactgcagttcagattctatggcaaaagttacttttgagttgttccattaaaactaaaaggacaaaaatgctgaattctgtagcatcagctctggctttgaagtattttaaaaaacataggcatttgtatttttctttctctaaacacaatcagtgttacttcccagtggaatttctctgtttgggctagtagttataaacccttgtattttgatattcttaatagatgttgattggtataacgctatgccaggtctttatatttgatgtatcacatagtacctgcaaaatgcttatttgttttgtacaatcttttggtcttaaccttttgatctagatataaaacaggcagaagcaatgtaattcctgcctttaatgtaatatgatgacaggaatcaggaatgtccattttagaatgtatcaggaagtggggactgggtttattcaacaaccatgttgtgttggatacagtgtgttggttcctgccctgtgtgtgtgcttgtgcacaagtgtgagtgttcatttaaaaacagtaagaataggttcttcctttcccaataagccattcttggaaggtagatctcagcagctgtagatgagataaaatatagaataaattaggtttaggaaaatttaaaactttaatttttttaaaaaggaacccattgaggggcaaatctgcaggaagaatttttctcattctagtttccttgctgaggtcagtttagtggctcacttcacagaatgcctcagggtttgagatttttatagtgtgtataaaatcagtgccatgcactcaatcccagatctgacccaagagaataagacccagggggaaaatatctcagcattatcaataagagaactactttttttttttttttaagaactgaattgcagatccacacttcagaaagatagggtcagtacccagtaaaactcagattaaaaagaatcctccatctgccccaaatattccctaattgcaaacaatatgcaagggttaggaatcaagtccaaaggttaaaggttcttgctggcaagtgaaagagggaggaaagaggtatattgatgcatgtcagtttccagattctggggtcaagctattgtgcctaaaaggaacaaggcatcttcagaaaaagtgtgattatcaaacaacaggtcaaagtttatctctaggtcaatgaaaagggtgggggggagggtcatcattcagattctga

SEQ ID NO: 29457 - DNA, 1070 bp, Bovine  19866880666060
tctgtgatttagaagtcaaaaagtcataaacctgtgttcatttacatgactggaaaattaatttctctcctctggaggaatggaaagaaggcatttttctcagctctttgtctgtggagtcaatggcctgagaagataaagttcagaatggaagtgatgtccttattaatatcttaatgtgagtctaagtaaactccgggagttggtgatagacagggaggcctggtgtgctgcgattcatgggatcgcaaagagtcggacacgactgagtgactgaactgaactgaactgaactgatgctcaatgttgaatctaaatgttagctcgtaagtgttaggttgaaaagctaaactaagatttgaaactgaacttcatcttagagctcctttcagagaacatttaatggacgctgatatattaagcgtccattaaatgttcaggctatacttttaaagatgaaaacaaggagaaaaatgatagaggcataggatgtgggggtggggaaagtataacaggtttctaccttgatcaaattaacctggtgactataaagagcacctgtgtgagcacagaaatgggtcagtctctaaaaactattgcctatggaataatttgggatttctagctctagaaatctgtaaaagagctgagccattagatcattgtttgagctaaaagcaaatgaatagagtatcagtttgctagggctgccataacaaagtaccatagcctgagggacttaaatgacagatatttattttttcccccacaattctggaggctagaagtccgagatcaaggtgttggctgggttatgtcttctggggcttctcttattgtcctatagatggctgtcttctttccggttcttcatatcatctttcctctgtgagtgtcttgtgtcttggtcacgtcttcttgtaaatttaccagtcatactggattagagtgcaccttaatgaccattctataggccataggccttttttagcttaacctcattttaacctttcacctcattttagcttaatgacctctttaaagaccttattgccagatacagtcacatt

SEQ ID NO: 29458 - DNA, 1299 bp, Bovine  19866880686934
tgagcggtttctagtagaggcccttgatgttagggtggtggattacacccatatctgctttaggttgttcaactgtattttgaattccagcttttaaaatagcttactaatggctcctagccattaatgttgttttccttttaaaaagctccactgcatgctaatgagcagtttaatgctaacagaagctagtgcatggctatgcaagctgaattctgccatatgcttaactcctgtttcacacaagcactaagtttgcagaatgcagggttgccacaaatatccaagtgcagaattaggtcccatggacaagtatgtgagtgaagaatttggctcatgtatatacccttggaaaaaattttcccatagttttcttttctctaaggtattgaataggccaacacttgtcctcatgtttcaaacatttcagcccccctgaaacattttgattgcctctaacattggctagaattgcaaaacattatgttccaaatgatatctttttcactggcttcatataattccagaataaaccctctgcttcatccactatacccttatgtatatggcttctatttttactttgcttcttcctctgttttctttctactatttcatccaacatgttttgaatttgtgtagttgtttatatttgagacaatcatacttgaaaccaacaatacttactttatttaaaaaatatttgtcttgatgcaattcccaatttggggacctggcacatcaaactcaatacaaagaatgcaagtcttgggaagatgaaataaacccatgatgtaattgacagagttgaagtgttgattccactcatgtggaattaagatctttattttattatcttcaaaactcaacaataacagaaatataagagtagtcttacaatagtaaaagccaatttttttttacatgaatgaggagatttgaaaacgcacattcgtgatcttgtttcttgttcatttcattcagtcatcaaatatgtgccttaagatatgacaagagtatctgtatatgtgtgtgtgctttcattttaaaggactcagatgtttactggtaggttaacaacatatgttactcagaaattggaagacctacattctagatctactcctaaaacacagaagctattatgccccattggagagagagatgctcatggagcttggcctcagttcattaacaaagtagaattgcaccagtttctttggtgcaacttgactttccagggaaaatccagttttatgaccccattttcagctaagactctactataattctgtgaaa

SEQ ID NO: 29459 - DNA, 943 bp, Bovine  19866880721970
ctttctggagtccatggaatgctttgcttgggtttgtatatagacagacacaggctgttgcttttctcagaagtgcattcttcctttagcttgtacttcttcactagagggaactttctttttctcccaatgatgcttcctgagtgacttagattcaaagaaaatgaagctctataatttggaaataaatcccatctttcagacttggcagtaatcttacctttctgtctcttaagcacctggctattataaattctcgttagtctgatactctccctcctctgttagaaccttattcacttttcaggtgtttgcatcttctcttcccagctagaccatgaactccctgaaggtaaggactggtgtgatttgcatccccacagtgcctaagctcagcacctaacacatcacaggcccctggttatgacctttgatgaatgaatttactaggaattaattagtcaggaagagctactggctgaacacaaatgtaagctccaacatggagccactgtgtcttagattagggcttctcacacttgcctgcacatcgcttacctggggattctgttagaaagtaacttctgattcctcggactgtgttagtgcctgagagtctgtgtttagcagggaatgccaatgctgttgttttgaggatctcactttgagtagcaacatcttagacatgaaaattaggcatgaataaatcatttagaaaccatttctttgctttctatgctttttcagaggcatacatggatcacatttctggttgatgtgaagctatgccacttagagacttttagaaatattcaataaccaataaaaggtcttctgtacaataataatagctagtgtggcagggtaattcaccgaggtataatttgcatctgttcccctttatttttcattcatttgttacgagcaggtagtcaagctcatt

SEQ ID NO: 29460 - DNA, 662 bp, Bovine  19866880762991
atgaacttgagcaagatcagaatagaagcgatagcactgtagttccacgttttgtgcgacacccccactgccttcgagaaccaaattcttcattttctcatcaaacaaacaaacaaacaaaaaaactcaggcaaagagaacacagtcaacaataatgtcatgaaatctcctttcatttcttgatttttatttgatcagtgccctaggttctgagttgaaatctctgatacagtgaaaccaggtagccaacactgccatgtagagtcattttaatagtggtctttgtatattattaccttttggcttttttattatgtcattttgatatcaggagctaatcacttaaatttactttaaaatatagaaagtgtttcagattgtattaattttatatcaaattgatttgaacatcttaaaatggagtatttagtttatcattaaatatgtgtaggtattagactagttgattttagtcctggtgaattcattggcagttttttcattatgtttttcctggtccacatatttgctttggctttttttggtggttgtagttgctgctcctttaacttccgttaactgaaaactaaagattttttaaccaccaaatcctaattgccaaatactacttgctgaaaaatacaaaaactaagtaacttaga

SEQ ID NO: 29461 - DNA, 863 bp, Bovine  19866880765566
ctggagaattccatggaaagaggagcctgtcggggtcgcaaaaaagtcagagatgacttagtgactaaaccaacagcaataacaatctctctagtaggttctgtagggtttaaaaacagaaatgaaccagttatgttagaaaacatgaaggagataccaaaactgatatcatccgttgatcttgaaaacttgagtgtctgaattgcccttagatttcatactggatctcttgtgaaggtacatatgatcaaaaaacatgtaagtcaaggccaaggatggttctttgaaaaagaaataaatgtatctgaaactgtgtgaacataaaaaatggatctcactggggcaactgttgtaagaacgtatcttccgtgatatttgcttgaggctgaaaccattttcatttactttaaagagttaagtacttgaaacagcactatttccttatgttaagattcacatgacttaccacatgaaaaacaaaaaggataggatgagttttgttggagacccctatcccccaagttattcctttaaaaacatgttttcacatggctagagggagaaatcgcatacagagaaatggttaaattcttacggggacttccatgggaattagcagtctgtagaccaaggctctggccgaaaatgtcatggttggaccatgacttcctatggggttgctgttcatggccagtttcttgtttttctttctgcagtgtgtacataggcccagaggctatttgtaatgggagaattttaagaaattcataaatttaaaacaccccacacatacaaaattctttctgaatgtgtcatcctaaatttcttttcccaaatccacataaaataaaacagcataagag

SEQ ID NO: 29462 - DNA, 1650 bp, Bovine  19866880772670
tcagttgcctcacatatggatactgatctcaatgggaaacttctggattagacaaactgtaagataatttatagctcttaagattccaagatagtaggatagtccttgttacaaagattgcatatttcctatagggtaggtagcccaggtttaggatcctgtagttgtaggcagtcggagaaggcaatggtatcccactccagtactcttgcctggaaaatcccatggatggagagcctggtaggctgcagtccatggggtcgctaagagtcaaacacgactgagtgacttccctttcacttttcactttcatgtattggagaaggaaatggcaacccactccagtgttcttgcctggagaatcccagggacgggggagcctggtgggctgctgtctatggggtcacacagagtcggacacgactgaagtgacttagcagtagcagcagcagttgtaggcaatggcaccccactcgagtactcttgcctggaaaatcccatggatggaggagcctggtaggctgcagtccatggggttgccaagagtcggagtcgactgagtgacttcactttcacttttcactttcatgcatgcaaatgtacaccatagcatcacaaagttagatcatctatttccccaataggcaccaattataggaggagatggggatgtcttctggaagaaactactcacattttataaaagcgtctgtaacgatgaccatcaaccaagttccctactaacttacttacttctaaaacagctttatcaggcaggtagagtgttatcatccccattttacagttgggaaggctgagtcatggaaggatgcccagagttctgtaccgctactcaaagtgatttgaaaccaggtagactggctccagcctctaagttcccaactctgtgccatacttttcctgggtaagaactgttagaaatcaagaaacatcctcctaagttaacttaacaatatggaatctgctttgcattcttacaaggtaagaagaacattttaaatgcctgagttataaacttatgtaaacagtgtcctgtattgactccaagatttggcaaatattcctctgtcaatgggtggcctttgtattatttcagatggcctggcaaagaggaaaatgtgactttgcaattgttaaagctgaagaccttgtcatagaatgtattactgagcaaattattcttattttgactctgaatcacagcaccgagggaggttataagcatagacccaagtctatacaagatagaacatcgtctcctcttaactggaggatagctgaaccgaataacttttaatttctcagaggtggtacgataaatccaagggctatttacctggaaaatcaatctaaaaagaggatgtacttttgataatctaaatgttggatttgtgcttttatgctggttcagatcccgtatttatttgcaaatgtgtgcaggaaaaaaatggcaatggaatcttttgtaatgcaattcatttctgcagttgggtgcaaggagaaaaaaggtggggtcagcattggaaatggtggttccttcagtacctacacagctattcatcctccttccctcgtgttgtgacctcgggcttcagtgaaaatggctcacctttcaacacctaacaccag

SEQ ID NO: 29463 - DNA, 1481 bp, Bovine  19866880776272
cccaaggccatactcttagcagagaggccaattcaaatcacttttttgttggaaattctcagggactatctattgtccgaaaggccttttgcaatgtggagccagtctgacgttccagctgtagccctgcctcacccagcattcactccttgccccagtgtccagccacactggacttctgcttttctctaaacacagtggtttctgtgcctgtgtgccttggcacaggctctcccatccccgggctctgtaccataaaaccccaccctccagaactctgtcaaaatgtcatctcccttgaaggaccttctctttcttctcaacactgagccatttatggccctgtctgtagtcttctgttgtttgggacacatttcggtggacatgggaagtggtgtggtccaacggctgaaagatcagactcagattggtgccaactgctctccctttggtaacaaaagtgcaattgcaaattaagatgaggactgtggcagaaaggaacatggtaccaaagagccaagcctagatggcactgagatctgacatatgaggaggagataaccagtgatctggaggtgagagtcggtaacagggctccaggagcaggaaaccgtgcgtgcagtggatccacagtaggggcatgtgtttctgtgaacagaaaggggctcatgtggctggaatggctgagcaaggagaatagtgagagaccaggctggaaaggtagacaaaggccaaccttctaaagcctgaaagaccactcagaacactttcatccttaagaacaatcaagaagcaaggaagagctttatacctggggaatgacaatgctacttgcattttgaaaaataatctagcatcagtgtgcgtaatagaccagactaagaccacagaagacatagggaggcctattaagagttattaagtcctattaaggcctattaagccctattaacagggacttccctggtggtccagcagttaagactctgtgcttccactgcaggggataccggtttgattcctggttggggaaataagattccacatttctggccacgcaatgcggccagaaaacaaaacaaaaaagaaacaaatttggtggctatttacaaataaaagaaaatataataatggaagcttcagttgggaactgatggagcagatgaagagaatttgggtgagttcagattgaaatctttctcagaacttctaagaaccaaacagattaatcactcacattaaatactcaggtggtataacagaaaagtgtcaccctaaagctgtgattactctatggagcttattataaaataaagtcatttaaaaggaaattggttaaatgttactattgagaagaaagcaaagggtgaagttgtatctgggtaatataatagaaatagcaaaactttcttttaaactatctagttaaaagagcatttgttgccttagaaagctccaaggagcctctggaatatagaaat

SEQ ID NO: 29464 - DNA, 955 bp, Bovine  19866880785334
gttgcttagtggtgtccgactctttgcccacctatggttataactcatcaggctcctttgtccaggggattccccagccaagaattctggaatgggttgccatttcctcctctaggggatcgtcctgacccagagattgaacccacatctcttacgtgtgtggcctgcattggtgaattttttttttcttttccactagtacaacctgagaagcctatgttttggttgcctattgcctattagattctgctctaggctctggggatacattactgagaaaatagacaagaatccctaccctcattgagtctacattctcccaagggaggcaatcaataagtaaatcaatatgtcaatatacatagcatgttggatgctgccctactgaggaaagaaaaaaacagggaacagaatcaggagcactggagggagggcgttgaaattcaaaataagatggtcaggaatggcctctctgagaatgtgctatttgtgtagccatgacgtaatttgggcaagaacactgtaggcagagcggacagaggctgaggggttggccgaaactcaggactcattcagtgcaccccacacttgaacttgaactgtttttttctaaaggcgcaatattaaaaatgttcgctagatacagttgaaatcatatttttaaggattaggttctgtattcaatttcattttgggttcagtaccctattgtgggctgtccagaaagccaaaccactatgaataatgtttccatgggaaaatgttttctgggtttcaactcactgacttaccaatgaacttagagctggttagtaagttgagaacgagctgtattaattaaggggcgactctcctgccatggctccctctctcagcaaggatagaatgccattgactgagcttctgcctctctcacattcttttttctgtccttatcctttctctagtctctttg

SEQ ID NO: 29465 - DNA, 830 bp, Bovine  19866880796773
aattcctgggtcaggaagatcccctggagacggcgttgactacccgctccaatattcttactggagaattccatggacagagaagcctggtggactcgagtccatggggtggcaaagagtcagacacagctgagagactaacacttttcactttcgctcttggacaacctgagttatataccaagcacaactcttctgcaatcagattatttctgcagttaccccactgtaatccaactctcccacttgacacatacacaaataaaaccattcttttcagctacatcaaaaccatttccgttctacgcagctcctgccttcactaaaactgtcctccacgtcactgttcccctcccccgctcagctccctgcccccaccacttcctggccctcctaccattccaccaaaaaaaaaaaaaattacccaggcctccagccaggaaaagttgttaaaccctctcctctgcaacttcacagcacatttgctttaataccaaaagaggattcatcttggccaatgagacacaaatgaatatgcagtgattcgccacttgctgtaaagcactgccaacaattcccactgctgtgttctcttctgttttttacaatcaattaaaaaggttcagttcattaggggcatgtttctttccccctcccgaaaatggaaagacgaaacgagcagccctcagaagtgggcacaaactcttctgagaaatacccagcagacagagcttcttacagtaacacttgattttaatggttctttaatgcagaattgacaatggaaaccccccactgaagccctcacagcagcctcaatcaccctaaat

SEQ ID NO: 29466 - DNA, 2031 bp, Bovine  19866880837782
cagcaagagactatatttaaggaactctagcacctccctttttgttgtttgttgcttagttgctaagtcatgtccaactcttgcaatcccatggactgtagcccaccaggctcttctctctgtgggattttccaggcatttgcctggaaatgggttgccatttccttctccaggggttcttcctgacccagggatggaacctaggtcttctgcatcgcagacatattctttactgccaagccactggggaagcctccatcttaggtactggctaaagaaggtctacttctgctttctggccagcttggaggacttgtctcagtgctccctgggcctctgtccttattactgggctcctgacttggcctctgaccttgacacttcgccagttcatcctcactgagatagaagatcaaagagacagcattgacaactgcccacacaattttagttcaacttttactagtctttattttcataacccagaaatcagtaaaggtatcatccattcatgtttggggtgtaaaatcatgcaggcacacccagaagaagactgaggaaaaagtgacatgccgatttcgtgttgtgtgtgtgtgtgggagaggggcggggcatggtgcggggtgctggttggaagaccaaggctgagtcttctaaccctcctggtactttctctgttttggaggttggagttccagaccgtgaaaaacaagaccagaaaatattacatttcctcaaaaaagtagaaaaatcacagacctagctttagtttcagtggcaaccggagggctttttattacaaataaggaaaagtattctaaaatgaagggtggtgaagcatcattatacattcctagagggggtcgttgaattactgtaatggttggtctttcaaatgcagaatgtctcctctacttagggtcatttaagtatagttgattcaagtctgaagtggagacaaatgtgggaagacttattaaaagtatatccacccctgtaatttcagtcttcatggatcagcagccatttctcagtgggtttaccaatttctaatagttgatattattttaggcttaccagtagctgattcttaaacatgtttcaggcatccaaagctgtgcataccaagatttctggtaacagctggaaatccataattatagttcacggggtacaatgctcgtctggcaaactctgtaaataaagcttagaaagcaaatatctcatttatataaacagtttctcaatactacacgatcgattgccaaaggactagagagctagcttttttcaattactccttttcctagatttgagggcaacactttattacttcctgtgagagtaaataaataattttctaaaatatttaaagacttggatgtaaagagtgaaatttatctaaaaatgtttccccccctttttttactcttcatataacatgaaaaagtggtcgacccacattgttgaaatatcatcagaaagaaaattattgcttaaaagcaattttgtactggaatctattccccacaggcttattttaaggaagtttcaggattagctgccaaagactgtgaggtctttctgtcttaatgactttttaaaatcatttgaagtactgtgaaccaacatgaataaaatggtatgggattgaggaagaaataattttgtattcctaagtgaaaaacaacccagtgtatgcactgaatttgaaagaggcacaatatataatttaaggtataaaacagttaaaagtttgctttttaaggccacacttgaaaagtccctgactttccattttattccaagtatttatttgaaaggggattttagtggaaaatattttaaactgaatgaactcttaagtaattaatgattacaattctagtagaagtgacacgatataaacccacaaacacaccacaagagacattccagtgactgcttaatatttgtggtggcagaggaatgagagtgtggttatcactcattccaaaacaagcaattacagggtcaatcacgctaaattcc

SEQ ID NO: 29467 - DNA, 1059 bp, Bovine  19866880842597
tcaaaaataatttatggtggtttttgtcgttagttgctaagtcatgcccaattcctttgcaatcccagggactatagcctgccaggcttctctgcccatggaattctctaggcaaaaataatggagtgggttgtcttgtccttctccacggaatcttcttgacccagggattgaacccacgtctcctgcattgcaggtggattcttcaccactgagccacaaaggaaacccaatttatggtggtagaggtcagaatattgattacctttgaccagagcaaatgaataactgggactgttatagcctatacataacaatctgggtgatggttacacttgtgttagctttgtaaaaattcattgatctacacaaaatgatttgtgcccctttctgtatgtatttatgtcacacttcagtaaaaacagctcactttttaaaaagtggcatgggaggataaaggtattaagagaaataaatgtgatcgaaatccagggaacaaaagcccaagagaataatagaactgtaaaatgtaatgaaatatgaagagaataaaatatatttattttgatataaaagactcaagtaattttaccaaaatattctataattattaaactcctattattaatgggaaacaagtgacatcttgctgcattatttattttcataaatagcttttgatgggtaaataggttctgtatatttattctgaaaaggattgtgcagaccaatattagcttaacatagcacttcttgacttttttcaggctgacacaagtgaaagcttagaaaaaccaccattgtggtattccctttaattgagcttgcataattctttgcataataattgattactaattactcaaatttcatctttataaagtgcttccccacactcaacatgcagtttcttttttcccttggtgaaaccatatgtagtaatggtcccaaaatgacaacagaatagggatagaatggggaaaatatatggactatatgattgcagtttagggaggtattttagaactcacaggaagtatctagactcatgtaacctag

SEQ ID NO: 29468 - DNA, 922 bp, Bovine  19866880858277
cttggcaatcctgtttttcacagtttatagaagacttagcacatgagaaaaataagatatttctcaatcatgtgaaaaaacagatcagatactagtatgaaaaacagtcttttctaaataccaagaggtgttctatgttacagatactggctatctaattttaagcaatagcctctgaaacaaaatgtttgcctaaccaaaaattttgtacagtctcttagatttcaacagaataggatttgccctggattgtacaaagaatctcagaacccattacctgtgttggttgtgacttccaggggctcgctgaaatctccatagccagctgctgtcctggctcggacatggaaaacataggaagtcagagggttcaggcctttgatatctgtgttcctggcggccgtcctgacgatccgatagcttcgttcattctgatcctacattacaagaggataagatgaaggaaggtggcaaaataaatcctccacttactccagacacaatgttaaagcagctgagccagtccactcagaggctgaaagtaaatggagattgatgaactctaaacactctattcggttcaatgttagaagtactattgtgacttagatgttgaaagaaatgtgaagttcaggtatgatcgctattgacattgaccatatccagatcttttttttttaaaagaacattagatgatggttggtggctttactcactccacacccagcaatttaacagaaataacagctgtaagaaggtcccttttctgttttctattttccatctagaaaatgtcaaaaatgttataatctggtttcaatggggaaaaaaagcctgtccttttcctgcttttattaaggaaaccaataagtgattatctttaaaacggaaagagaagacaattgttcatttttctcgacaa

SEQ ID NO: 29469 - DNA, 2847 bp, Bovine  19866880897266
tcgtcggctgcgatggtgtcaattttggcaaactggctctctcggataaaacgctctttgtcattgtctgattcatagtagtacaggttaaacgtctccttgcaagtgcccatgacacccggaagactgttgcagtccctcaaggtgaacttgatctcgatatacaccctctgagccccttcccgggtgatccaatcagttcgcagccagttattctggctgggctccatcacgttgcagacttggtaggttcggattggtgtatttttttcatccataatactcacttcctcccactgcaaagagccaaaggaaatgcatcaattgcaaacatttcatcatacagtgatttatcagttctgttttcccctcataggacagtgataatttttgtttcaataagaaagaaaactacccagcactaattcctcatcaagatggtactgtattggggagctgttttcattgtttcactcttttgcctaaaattccagaggtattactagattgattgcttctgagttctcaggcagttcctggtggtggtctaacaacctcaaattcacctattacaacagctgcaatttcaagtggcgacagttcaaatttactcataaatgaaaaactagggatgtgtattgttccaacaactgagcatagacctgcaaattaagagcaggaagagcagagtttgccaaaggaagacaattatcagttaattagtggtgctcctgtcagaactttgctctctaatacctaaaaaaaatcgcagtcagttttgttttttcttttctttttggcattgtcattactctttaaaggggtaaagaaaatctcaccattctggtttcggtaatcctggaaagacagagagtaaactttatggttggatttctcaaatacactgtcatttaaaatggtaggacacgtttcaagagcatgtattcagtccaaaagtttgtatactgttcttatttttaaaagaaagccacattaagtaaacatgaatgtacacatgcattgcttctaaatagtctgtggatattgagaaaaaaatactaagtggtatttatgatggaaagcccaagaaaattaaagtatggtagggttttctttcaatctactttgtaacataaagattctcacagtgggataatctgagttcagcaaaattcactgtgactagcattctagtttcatttttgctatgcttttaaaacaatcctaaaagcagcaagataatttgggggctcctaccagactaggaggcagcctccaattcttcattagcatctacagtaatggctttatatagagctggtataaatcagcttaaatatctaacacatgaatataattagaagaaaaaagatagtttaaaaaaatcatattctataatagctccacttaaagctccattcaatccaatgaagtacatagaatcataatgtatcttttaacaggtttcccatctgtgcattggaaaactattaatggatagaaatgttactatgtgaagggccataatacataaaattctgcatccctttcatctgccaccattatgaaagttggaactgaaagagataagtgccctgtggagattaaaatttatttttatccactaagcaataaatcaccagtaatttacttatttggggaaattcatgtaaatccaaaaatagatccccaccttcaaaaaaacctactcagcatgcttctcatctcagaacaaaggatatatggaaaaacacatttatcaatgtaaatgaaagcacgtagggacatatccactgttcatacagataattcagatctaattcagattttccagccaaacttaattgtctaaacacattgatcaattcaccagaacaatgacaaatctccccttagttttgcattttacaatcagtgtcagaaactcaatattctcctttaaatgaatactgccaagaaattaggtttttgctacaatgttgccatcaggagtcatcactttccattattttcatgttctgcttagctgttctaatgaaaaaatgaaaccatagctcatttttgacctggtggtattgtcaaataaggtttctttttaaagataacaataacaacaaacaaacgtatggcattattggtcaaaattataatttcaaatttccaaccaaggtgtgaactgttctaaggataagtagagatttcagaataaaaaaaaaaaacaaaacaaaaaaaactcaaatatgcttttacactaaagaaagaacttttaaaagccaatccatctcctacttggtacacatccaatttatcccttcattctaagtctgcaaatgtcttctttattacaaaagctagaaattaattaaactttataatttgtcacataatttttcaacggctactatatattttagaaggactaattttcttacagacaagttcatttcttacctttcataataatacttaaaacattacacatacatggcatttcaggaaagggaaagagaacattctatattcagaagtccacattctgcccataaaaagttctgggttgtgtatactcagctaggcacagtattttttttaagggacatcaagacaaccaaaagaagttttgtatctagaaaaagtgatcagatggtctttcaacagttctcaggagctggggtgtggggaaggagatgtctgtggcatattaaattataataaaagctttccagaaacaggacagaccatgaactatactcaaaaaatgtgctactccttgcttttaaataggtcacatgtacattgagagtaacaggtcaggtccaaaatcacgctagatatgtcccctcttta

SEQ ID NO: 29470 - DNA, 1419 bp, Bovine  19866880982757
aatctacctgcgatgcaggagatgtgggagactcggggttgaccgctgaattgggaagataacccagagtaggaaatggcaactcactccagtgttcttccctggaaatcccatgggcagagcagcctggtgggttacagtccatcaggtcagatcagatcagatcagatcagttgctcagcggtgtccgactctttgtgaccccacgaatcgcagcacgccaggcctccctgtccatcaccaactcccggagttcacccagattcatgtccatggagtcagtgatgccatccagccatctcatcctctgtcgtccccttctcctcttgcccccaatccctcccagcatcagagtcttttccaatgggtcagttttcattccaatcccaaagaaaggaaatgccaaagaatgctcaaactaccgcacaattacagtccataggatggcaaatagttggatatgacttcgcaactaaacaacagctgaagagtaaggccacttcctgcagcatctggagtttctaaggaaaatctctttcctccatcctgcatttatattagctttgctatggacagaacactttggaggcttctattgcatccattttcagggattttagaaatgttaagttagggcgaaaaaaaaaaaaaaaagacactgtatcctagccaaaaagaatagtgttgtactaccattgatcacaaacactcttggcaccgttttcttgagaaactaatacagcagtttggtaaaatggaatagcactcctctgaggggtgcttatacaacagtagtagttctcaactaggaataaccctacctgctcccccctacccgggcacatgcaacaatgttgggagatatttttgattgcccaggagggtggggagtgctccaggggtctagtaagtagaaaccaaagatgctgctcaatgtcctcaacacacaaatcagaatcctcatcaaaaaagaagagctcaacctaaaatgccaacaatgcagaagttgagagactgtgtattatatggtccccccgttttttctccacttgtcctttggtttcataggcacatttttactaagagataaagcttatattttctttaaacataatcaaatcacaaattttcttgggtgacaatcagatattcataatccatttactataatgatgcttcaaattcatggattgaaaatttaaagtttgataaatattcagcttgatttttcggattcattatttagtgactgggctccagcccaaaccttttgttagaatgaaatggtaccctgcatggttatttcactcttgcctccctctcatgattagggatctgatgcccagaaatggcttggcagctctatgaacccacagagctacattttcctttgtgtgtggattttctgagagcccagca

SEQ ID NO: 29471 - DNA, 1175 bp, Bovine  19866880985951
ttggggaacagactggccctgaaggcaggacagcttgtgagaaatacaggaagatcaaaatgttgtcaggagtaagacatatctagaatgggccctggatactgtgtgattttagggctttgactgttgccagtatcacttcccaggtggcgctaatggcaaagaactcacgtaccaatgcatgagacacaagagatgcaggtttgatccctgggttgggaagattctctggaggagggcatggcaacatgctccaatattcttgcctggagaatcctatggacatgggagcctggcgagccacagtccacagggccccagagtcggcatgactgaagtgccttagcacatacagtgtcactgtagatatgctaattatgaatgcaggtccttaattctcccactactttgtccctgcccaccccccaccagatctccttgatttatttatttattttgccatatcgtgtggcttgtgcgatcttagttctctgatcagggatcgaacctgtgttctctgcgttgggggcgtggagtgttaaccgctggacagctagggaagtccaccaaaactcttctttagaccacaatggttgattcaagcatttttacctgagatgccccttccatctccgtaggggagggtcaagaagaaagggaaggtgcccaagatgaggtcaaggtaatgatcaatgcagaatctggtttaatagctcctatggatcctaagcctacagttctccacagtgtgcacagctgatgtgcaccctggggaagggagaaggagaggagagctttcctttgtctttgcttgtattttataggaaagctgagtccggaagaggctcagcgagttaggagagaaaattacatctgttaacactaagctaagaatgagaacatgagctttctctactttgggtggtgatccttttattgcagtcagggcaaacagtgatcagcgtaaaatcagaggatatatacagcatcacttgcccctgagtcgatgagaactttcatttctgcattcattgaccttagtctttagcctttttagattcaggacataaggtgacatttttgtgtttactgtattctgcccctcaatgaatgcaagaaaatcttcagtgaatgttttaggcagctctacattgaaatactaggtggcagtctaa

SEQ ID NO: 29472 - DNA, 1381 bp, Bovine  19866880988463
tagtagaagagattagacagtatagtgtctaattctagggcagctcagcagtgaacatggccctttaatgcttcctactggagtggttcagtggccagaccacacaactgacctaggatgagtcagttaacctgcctgtgctggtcctccatctgtaaaatggggctcatcctacctcacaggggtgtcaagaggatacatgagataatatatgcagaaactcttttacttttttagaagaaagacactatataaacctaaggtattattatcattcattttaacttcggaatagcatcatcctgtcatttttgattccataattacaatacatcaggtaagcatggatttaaaatcaagggagcactgtacaatgaagggagacatgaaaactttgtcacatgagaacagccctgacaacttctaaagtgccttagggctgcatctatttccatattaatgtaagccacatacatcattaaagagaaatgcaaacgcgtagtagcggctagactgtatctctcatttgacagatacacaaaaatcatctgttctggctttgtaggaatgactaaccactagcaacaagctttccttcttgagacaaggaagtgaaagtgcttttcgtttgaagctgtgaaccactactgcccggctgggacaatcagagttccctgattctaaagcaaaatttgaaatctcgcaatacttaacatctagtttccttttagataaccatgcagcctggtcttgaaggttttttttttttttttaatatggcaattcttagaagctctaaattctagatattgcaagtttaatacctttttataaagaaaatattttatttttatttttttattttggatgtggaccatttttaaaatctttattgagtttgtttcaaatattgcttctattttgtatttgggtttttggtcaccaggcatatgggatcttaactccccaaccaggggtcaaacattcaccccctgcattgaaagtgaagtcttaactactggacaaccatgggaatccctaaagaaaatattttagacaggtttgatcaacaatttttttttttaatctttgtttgcctttgtccctataaatgggcttccctggtggctcagacagtaaagaatctgcctacattgcaggagacctgggtccctacaaaagcccaaatatttctgttaagtgggataaaaggaagctctctagtgtaacaattgggagaccttagttttacattgagtgatgtcagccttatttccccattatgtcaaaagctaggatgggactgaagtcctgcggtcctctggcttggtcaacagaaaaagacaataccctgtttaagacatatgggttgatggtgtag

SEQ ID NO: 29473 - DNA, 1582 bp, Bovine  19866880989331
ctcccctgtgctatatagtcagttctcattgcttatgtattttatgtgtagttagtgtagccaatcccagtttcccaattcatcgtacccctctttcccccttggtatccatatgtttgttctctatgtctgggtctctatttctgctctccagataatttcatccatactatttttctgaattctacatgtatatgttaatctgcgatatttgcactcttctgtatgatagtgaagtcatggttcttgctctgatctctcatattgtttgtataccgcaccaaaaacagacagtgcacatgccccataaatttcacttagtctagactaggcctcttgcaggagttccttgggattttgtttttgctctcctcagatgtgagcaatgttgaaatagttaaacatctataatattcaattctggcagatagttaaataaaatcattgatctactacatgcaataccaaaaacaaaacaactgtttaacccaatcatatccattctgtataaatccctttttagtcatgagtactcagaattttaaaactccctcaaaatattcaatacaatacaataatattcaagaagtaaatgtgaagagacccacaatcaaaaacctcagcagagaattgtaatgcgttggtaataactgcaatggtgaatcttgtaaagcttctttttcttcctcttcttctgagctcctctggccacgtcaacataacaaaaaagacaggggggcactgagcagttattactgtagtcatttcagccacataaatcatgatttgtgacaattcaggctggcaagtcgtttggatgacaatgactggcgacgctgttggagttaatcaaatgatgatttaacatgtgtttctcttggtctggccttggctttggaacatatttcattcgttcccttataacctttgcttctaaatggaaaaacagcaagtgtaggatgtacattgagttaatgagagaatccctaactgggctgtgatccccctaaaaagaggggacttgtctaaatcagttgaataaaaccttagagtgcccaccaccatgatctgtctctggctagcagtcactaagtctcgttttattttcttctgggtagaaccaactttgtgaccaaactctttttccttcaggaacacactacttaaagggtcatccattcttatagatgccgtctttctactgaagttccttctataagcagatagtcttgggttaggtgcataggaaaggcccccataaaggatgccctctgtcagagagcatcattgagacgggagtgtgagccatggtcttctcccttccaaaaggcaacagttttcacatttcccctgttgcccttagtatgtgctcggcaaatacttgctatcagtgttactaatactcttatcataaaggcttaacaaaagtattataataataattaataaatgtttgttcgaacatgaatggtcaaatgaatgaacagatgtgcatacctactaatggatgacttttttacgtaatgattcaagtattaaattcagaccattgtagtgtgaggcgtggaagaaaacatagctg

SEQ ID NO: 29474 - DNA, 915 bp, Bovine  19866881134255
ctaaactctggggaggtaaataatttccgggttgacaggcagtcaaaggcaatccaggaagatagatgaaccaagttcagtaaatcctagtgtaatcctcatgccagaagctgctttgacatgaaggactggtatatattctaggaatttatcacatttctttggctagagcttccatgcagaaatctgcctgaatacactcataactagctcctggggaggttgagtaggggaggaaatggggagggagattagggggatatattagtctggattctccagggaaacagaaccaagtgataagtgattgattataaggaatcagctcacatgatgatggaggctgagagattccaaaatattcagtcagcaagctggggtatacttccagtctgagactaaacatttgataaccaagagatctgatggtctaagttccagtctgagtctcagtatgaagacagaagaagacctatgtctcagcttaaagatcatgaggcagaaagagaaagaatcctctcctacctcgcctttgttgttctattcagggcgtcaatagatgaagtacacccatctgggagaaaacaatttgctttactcagtctattgactcaactgctaatctcatccagaaataccattgcagaaataatgtttaatgaaatatctgggcactctgtggtgaggttgacacactagtcatgttgacaacataaaataaaccagaacagaaactttaggtcatcacctcttgattcacatagaagagctctggttggatcattccctaggatttgacttgaagaaagggctctggctatagtggaaagtttgcaggacactttcagagctcaaattactgaagcatttacagcatttgctaacgagagtccacttgtttccttgtttgtgccc

SEQ ID NO: 29475 - DNA, 827 bp, Bovine  19866881169026
tattctagagagttcaggggaaagtgagaaaagaatggctttatattggaatactggaatagttctcactatagaatcaattagtacagatatattttacttaactattgagtgcacttactgaaacattcatttcagagagaagtgcagcaagaggcaatagggttcttagcaatttataatcctttcccagtaaagtgtgttgttcttaatagcttcataaaaggataaaccatggtcctctcttcctccacccctttaaatccccaaaattaaataacagggagctggcgatgtgaaacatgtggtagaaatccagaatggaaaattagtatgagaaagtatggagactgctttaggagaagaatgggagtaagtgggtcaggggcagagcctagaaatctagattctcattcacactttggaaaatctgatattcaagactggataacagttctgaaatgaactcagcagaaacaccccaggaacagaatctactttctagtcatctgcattagaagagaaagtgtgcaggaaatgaggcaaattaactctcctctcccacctgtccagtgtgaatgttactatgaaagtggctccaaaagtaggatgtatttgaaggaaaattttgtcaaccacacagatcaagctcccctttaaaccattccttgttcacaggcttatagggtaattctaacaaagacctatgtggatattaaaaaaaaaaaatcaaaactacagctgctaatgtttttgttgaaaaatacaagtgtagtgctctgcatgctaaaaatcaattttgtattcctaaataatctgtaaatgca

SEQ ID NO: 29476 - DNA, 1274 bp, Bovine  19866881207947
acattacaagtaaaatttcctaaagttttcattcaaatttccatctttaaaaatgatactgtcattaaaataaggggaaacaggaaccaagtgtttgataattactattagatctttgatggtacttgaaaaccatcttctcaaaagatataacaggttataatgggtaatggtctcattcacttctaacttttatcaaagtgtagtaataatattattagaagtgtaataaacagaactctattctgcaaggctgaggaaatctgaggccagaatagattttctgacctctttcataaatggaaaaagatattaattagatgttcatggccacttgtgctcatttgagatcccataacctctgtcataaggatcaagatcttaacctcaatgccctgccaaattcctgctttcataattaaattctctatatctaaatctccttataattcaaggtaagtaaatgattctccacttcctcttctaaattaattttatagctttatcatttttttaatcagctttttctctctcccactgtctcactcttttcctctctcaagagttaatgattgctgctctataccatttctacaccattccttaatttgaaatttaaaaaaaaaaatcataaataaactggcatataatctaatgtagccctggctttatgaactttcatttgtaggagataaatacttgacagagtcatcagcatattttaaatcttttctttaaaattcactttcagggacccatctttattttttttttttttaattttaaggggcgctgagtctcagagccccaaatcccacgacccggccgcagatccgggaccccaggacccccacggacccctcccccaatgcacccctccagggacccatctttaatttcttctattttgaaaggtggtactcttttcatttgagtcttcttttctctctttctctacttagatagctatttaggaccatgggggagtatactacaagaagaagatattgctagccttggggtcaccgtgccaccatgtgagattagactctgcgttgttctctgcaggaaatgatagagcacatgtagattgcaaagcaggccacttggttctggtctcactctcagttctgttaataacaggtacaggccctggcctaaagtatttatgttccctggacttttacccctttttctttaaagagaaaacaattgaactaattcctttgagctctgacatttttgttaaattcatccagctaagcagaagcaat

SEQ ID NO: 29477 - DNA, 1650 bp, Bovine  19866881213150
tggaaacacgggactgacctgaggtgaaaggccattgccaatggcggggttcatggggttggagggcccggatggaggcacaaagctgtctgtatagctggaaaatccatgcctggtgctggggaggcagtaggcagagctgctgtccgggttggaaggaagagtgctttggtgtacagtgcttggaggaagcggctgaggtctgtggacggtgctgctggggtctgacacggctgcaaggaagaaggttatcggccataaatctcctttgaaggctggcagagaaggttcagtgcaaaagttcacagtcaccgagccatcagcatatccactggtcaagtaaatgtaaatttcatactgtacttcttgatatgtaagtatagaaccactcctaacaaatagagccacatctcttctgcacgtatgttcaagtacatagtttatttatatacttccaaggaacacttaaccagaacagaaattcagaaatcaccttaacagtgagaacaaacctatattagtagtgaatgttactaatcaacataaagattaaccagtgtaagaactgcatcttaaatttctttttttttaactgtttttttttttttactttacaatattgtattggtttttaaatttcttatcaaataaactcccaaaacatctaaatattagtgtgagagtatagtttcaaatgcccacaatgctatcttttgtaatccaaaataatttagtcttcctatttatcccattcacctctatgcactaacattttgttgctgttgttaagctgtgtctgactctttgcaaccgtgtggaccgtagcctgccaggctcctctgtccatgggatttcccaggcaagaataccggagtgggttgccacttccttctccaggggatcttcctgacccagggattgaacccaggtctcctgcatggcaggcagattctttagcactgagccacctgggaagcccatgctctaacacagaaggactctatcaaagtttacctaccctcaattcctaccccagtgaggagccatcagaacttcagttaattgcagactggagtacaaacgtagaggttttaacaaaggaaaagccaattgcatgcttattttgggagattgctttggttcattgtttgattttgttttaaaatcctgaaacaatattatattacaacacagtttaactagagagattcagacatgtcatagaacaaactatgtttctgaaaggtgacaggtattttcaggacaacctgatataatgtaacaaacatacagacagccacagggacatcacagaagatttcaccatataaagtaagcaggggggaacaagactggggattacattttaaccccttgactgctttcctccataccttgtggaatagctgtgggctggtaagaggtctctgacagctggtacgttggcagggtcggcatggctgtgggagggaatccccccggaatgagatggttgaaagccatcagttgattggccccagcctgcttcctccatcttgcacggcggttgctaaaccagacctatggatttaatttaaaatttgagaatttcactgatgaaataatagaacattcttaatgaatttttcatgctaaaacagattaaaggcc

SEQ ID NO: 29478 - DNA, 1747 bp, Bovine  19866881237754
atgctctgttccagtgaaagacaaaagcaaataagggagagattgatctccgagcgcttttattgtcggtgctatacacatcataaagttttggcccgttaaaggaagttccataaacaacattagttaataatggtgaagtcactgtggacctttctggagcttctgctcaactccctttccgcttgcccgttagcagagcatgattaagaaaataccaacaggatgtgctggagggaggaacagacttcaactggaagccatacggatgcttgtcggatgagtaacgagatggggaatgtggccatatctctcagagaatcacacagttctgtggatctctttttatcttctggtttgaataaaatctgctgactgctggcacggttggtctcttgcggtggtcacgctaatggaaaagggccttctcccagctgatatttttgatagtatgaaaacacccaaagtatgtgataaatgggaaaaaaaaaaaactgagagtgaatcatactggaaagattgtgagtaactgtcacatttttaatggtacctctggtcttataaaataactgtatttttaatggccttgtcactgtgggtttaatatggatggtgtgggtcaatttttatgtgaggttgagactgatttgggaggtgatcttgaagggcataggggagagaaaaagggagagcaagaccctactaattattttttattgtgaggtttcccagaattattgaggttttccacattagtcaaagcagccctcagtgtcagcatgatgtttataaagatgaagtcatggaaagcgggtcaggtgcgtgagggactatatggtccatgttctccccaccagtcactgggctgtgtgtgcagagggagggaggtgttgaaaaatggaggaaggggaaaacaggagggttttatgaagttgaaaataaacatggagtatctgctgatcttaaaaaaacttaacatattccaaaatgttctgtgggtagtttatattactttccccctgaaatcatgatctacgtcttaccagctcttttatgcttggttgcttatgttggtctttcactttggctataattaagaaataatcacctacaaatttttggttggcactgagctacacttccaactggttggttcaagaccgtgctcttagattccatagcatggggccaaaagtacgggctttgggggccgaacacttgcagtcaaagctggtccctgacatttaccagatgcgtggtctggtgccgacaatttactgctcaaagctggtattcctcatttctaaggtaaggttaataacagtgcctgtggaaatggagagctgtaaagatcaaacaatgttgtgcatatgagcatgtaggaagcacttgggtaaactttaggtgtgattttattgatacaactggttttaagaaaattttttcatagggctttgccacctgaccagtcatgttaaagattattaaagagtggttgttatcaacaaatattttgggttgttttacctgcatctccagccagatgctcacttgttgttcagtcactcagccgtatccgactctttgcgaccccatggactacagcaccccaggcttccctgtccttcaccatctcctagagcttgctgaaactcatgtccattgagtcggtgagattagcaaaaaatatctctttctgaatcaaggaagtgacatcttgctttgctttgttaactaggggtttata

SEQ ID NO: 29479 - DNA, 754 bp, Bovine  19866881239052
taattttgatgcttgacagcattttaaaatgcaccaacctttgataaagagcaaatcagagctgaggcgttaaaatgagaaagagggaacaaaaaccacgctaagctccaagtaattcattttgaatatgctatttgtattaagcagagatatgtataagctgtgggtttatttttcttatcagggaaagacctccttaagtaaacatctcctctttaaattcagatcctggggagggagacaaaaccctgctgaggttaagacgtcatctccctccaaaacatgggctttgggagccactgtcatcctttactttaggcttcttaaggtccataaagggctgtttccagtcttctttgtacacaggctggagactttttgttgcttctgtttatttcctgccttcctccctcctcccccgccctaattagagccagtagtgaaatgccacgtgtctgtttcagctatttccctacccaaggtcccctaaactgtttttaattcaatgcttgtgatgtggggcccttgaaaagagttttcagcccacaagtgaaggactgtagtgactccctcctccctttcttttccccatgtctctttttctcttctccatcctatttgggtgtcacaaggaccaaactgctgcagtaaaatgacttgtaggtgtttgatggcaagtcattggaggaagtgaataaaagaaaattgcagcattcacatcagtggggtgcgggaagaactgctgagctttgaa

SEQ ID NO: 29480 - DNA, 709 bp, Bovine  19866881334701
tacctgttggagtgcttgaatcctcccacgtcctgtatgctctaacttccctccaacttctttcccatctacacagaagtcactttttgctctggcctcacagcagcctaaatctatgctttcttgtttcatttgttcataaataagcccagtgattttttttttttttttggttcttttacatgatgtcctcaaatgctcttctaaccacaagtttattccattatctagagttattttcctgctatatgcattcctgtttctgatttctggatagacctttggagaagcagtgggttctcagttccagctgaagtgtgcgtgctaaattctttcagtcatgtccgactctttgggaccaaagccccccaggctcctctgtctgtgggatttcccaggcaagaatactggagtgagttaccacttcttctaggagatcttcttgacccagggatcaaacctgtaacttttatgtctccagcattggcaggcaggttctttaccattttttaccactagcgccacctgggaagactggctgaagcaactgagcccaaagattaaagacaagttctggtgttctgtgtgtttcttttctaagaatcttaaagtaaagcaaaggaattgtaaatctctctcaaaactttgcatgcccctgcccccacccccgcaataggcttctctggggctcagctagtaaggaattcac

SEQ ID NO: 29481 - DNA, 845 bp, Bovine  19866881337361
ttcaggcaagaatactgagatgaattgccatttcctcttccagggaatctttctaacccagggattgaacctgcatctcctgcattggcaggcagattctttaccactgtgccacctgggaagccagtaatcttagttcttaccgcctttcataaattgaacattcaaacccatactgctggcttccagcaatagagcccatcagactaggggtttcagctctattgtccgatccttaacacccctttctgcttttcatcagtggatatttcaagttatgaatttatggagtcatcctgcatagaggtctctggattctagcaattcttttcaaaattcattcacattaaaataagagattatgaattcttgtcttttaaaaccatcttgagtaggaataaagtaaatgtctaagggatcatctaaattgaattctaagcagattcaacaaattctgctcttggcgtctttgcatatgaaagtatttgatgaaaataaaagctacatactcatgaagccataaaaaatggagtatctgcccattttcagctcctgactgtctcctggctaaccaacacagaacacaagtatctgtacttgacctatagcagtggttttcagactgtattctagaaagtctgtggagggcaagttgaagagctctttttgttttgggggttcctgtgtaattttcattttagagacagttccactgctataagggcttcccatgtggggctagtggtaaagaatccacctgccggagaaggtagatgtaagaggtgtgggtttgatccctgggtggggaagatcccctggaggagggcatgccaacccactccagt

SEQ ID NO: 29482 - DNA, 1757 bp, Bovine  19866881375342
tcagtctcttgtggggtcgttgttcctttcttctgggtcctggtgagcacgaaatttgtttgtgccttccaagagtctgtttccccagtcctgtgtaagtttttgtggctctatggtggggttaacggtgacttcatccaagagggcttataccatagccagatatgctacacccagagcccctgcccctgcagcagtccactgctgacccatacctcctcaggagacacccaaacacagttttgtctcagtctctgtgggctctctgggtcctggtgcacacaaggtttgtttgagccctctgagcatctctggtaagtatggggtttgattctaaatgcaattttgcccctcataccatcttttgcccttagacggggcatatctcctcaaagtcactccagcactgcacagcccttttatatcacttatattcttgaagattcctccatgatcctagaagacattctttaaaaatacttatatctagagatggattccatatcagcaactcaaaaaaatatttattctccctaaaagctaagttgcttactttgttcattggataagtaactaagtagcatacaatctaacaggaagtaggagacagctagtaaaggaagagtctgttaatttgtctccttactacacccagaaaatctctggagaccataccaaaatggaagacacttgttgatagtcttgggtcaaaatcaacaacctggtacaccctgctagtacaaatagtacaactggtacaactagttttaattactcaactcaactttgccatctctatcagcatttattctgcaattaagaagagagcttttaccatttgcccttcagcatacttttttcttctttcctgctgtcaatggtgctcagtcaggcagttgtgtcagactctttgtggctccatggactgcagcctgccagacttctctatccatggaattttttgagtgggtttccattttcttctccaggctgctgtcaataagaccacttattatatccattttcctctaccacaaactgatctgacctttctcatgaatttctggaggacatgcttgtcacctcacagaaggggaaccctggtattatctgtcctcagcacacaccctcagagcatgaggaaggagacacagtgaatgtcattcccacagatggcctgttgagaaaccaaaaacttacgaacctcgaataatgactgttatcatgaagtatggcagattttgaaacctccagtttctcttttgcagtttctgataggaaacctcccaccacccatctgcccttactttagcttgtactgttaagcaggaggaattgctgacctgggacacagtgtaattatcttgatattattattattctttcctaagagaaattagactctggtactgatgaaggacagggatgagaagagaaacaaagcttccagattgttgagttggattgggctcttttgagtctcagaaacctgtacctactcatgctgatatatctaggtaatatccccaagtagctcaagtgagctttttttttttttttttcctgttgtaaaccattgtgaaacttcagaaatttcttcttaaatctcactcctccatgcttcctcaccatagttgtttttttttttttttttttttttgctttataaattgtttagatttcaaccaatctggtccacggaagagattttttcaaacacagagaccacaccttatatatctgtagccatcagaagc

SEQ ID NO: 29483 - DNA, 703 bp, Bovine  19866881457094
ccaaaaacttgcccctacttgccccttcaattataaataatatactcaagaaacaaattactcatccgcctaagaagaaaataaatttttataaaaggtattccttccatactttcagtttttgttgccttgacttttttgtctaatgtgaattcaagtaaaaaactcgacagcatttaaaaactgacctaaatctctcctctgcctgtgagaactttaaatctatgcttgcactttctcttactctgatcccattaggataatagtatgtggaaattttcatgtttcctttgggagtctctggggctattaaatcctcccaagtaaatatgatgtgccatgcactgtcaggtcaattaatcaaaatcaccgctagtttctagagaaaaatggctgcttagatgtacaagaaccagccagagctaattctgagggtcaagaccactgtttcaacttaacaattaatgcccgtccacctctaccccgcccagaatataaactctgtgagcttaagtcccttcctttgacttgttcattgctagaactactgctgaaacataatatgtgctcaataaatacatgctgaatggctagaaatacaggagaaaaattcagttttgaactaaaatttacttctctgccatcattttagatctttaaaatggaaattctgctcttatgagtcacccaccatttagatgag

SEQ ID NO: 29484 - DNA, 962 bp, Bovine  19866881662757
tttttcttctaggtctggcaacaagtcttgtctttattataaagacaagtttattgatgttgagacaagcagagttcctacttccacttgtgtttgaattcctgagccgtggctgaacctctctggaaagcagcatggaatcactatcagctgctagttcagacctgattgtttggagttcaaacttctttctaatatctcaagacatagagcaagtaataagtccatcagtgtttgataaaatggcttttacttaagagtaatgggtggagtagctgaaaatattttcaactattgtctgaaattgaaatggcagatattgttatcaatttaagccatcttcatagtgttagaaatacatttagtatttattctctctcctgatttctccttttagaaggactccaaccccattattgttgggagtagacacaaatctttttggactgccatcctgagtcatatttatgatagacaggactaaaatttcttgaggatcatctttacatgttcctcttggaagacaccttaactaaactacacttgggaaattggtcaagaccctcccctgtacagtgagcagccaaaatgcctcataggccctcaaaagctttttggagaggggtaagatctgtttgttttcctaagataagaatctcttcaggatcagtcttagagttttctttcctaataggatgccaaggtaggaatgaggacccaactcatagagggaacatgcctcaacataataaaggccatacatgacaaacctacagctaacaccattctcaatggtgcaaaactgaaagcatttactctaagatcaggaacaaggcaagcatgtccactctcaccacttttattcaatgtagttttggaagtcctagccatagcaatcagagaagaaaaagaggtaaagggaatccaaattggaaaagaagaaattaaactgttcctgtttg

SEQ ID NO: 29485 - DNA, 1920 bp, Bovine  19866881694271
gggaagtcttaattttcccaagatctgtctagaaaatctcagggaaggactgattggtttggagtaggtcacatgctcgtccttggacttatcactatggtcagggggaagagtcattttgattggcctaacttgtgtgatattctcatatctgtggcccaggaatgggagtgtataatcggaagcctcactctaactacctaatggagggaaagagtgtttcttctgaaaggagcatcattcaatgaaacaagattcagttctaaaagatagggggtaaggcataatgacacaatgaaatgccaagacgtctgctctgtggtgtgttggtaaaactttaactaccatcctcctctcccacaaaagaagccctgacttgtagtatttgccaatctctgttgagtgaacattgctaccttagctagagtcaagctacccatgtgacctcactggatgtagagttgggaagataatcacaacagcatgccatttgagtttttcccctaaacagatacaacataagtaagtaaccccaagaggctaaatcatgggacaatgcagtaaagtaattggaagcaacaagtttgagtacttttttaacctttgtttttgatataatctatttaattgcaagtttatataattcattagatttgccatgtccaacaactggttcaaagatttcctgaaaatttaacacgtggccatgcaagctggctccagcataccatatgagattaaaagaaaattagtcctccattcatcgcaccctccctttccctcttggtgtccatatgtctgttctctgtctgtgtccctatttctgctttgcaaataggttaacctatgccatttttctggggactgagaaagtaaagaatctgccagcaattcgggagacctgggtttcatccctgggttgggaagatcccctggaggagggtatggcaacccattcttgcctggagaatccccatggacagagaagcctggagggctacagtccatggggtcacaaagagtcagacacaactgagcgactaagcattcacacatactgtttttctagattcacacagatatgtaaatatgtgatatttatgttttactttctgattgggattgacatatatacactgctatttataaaacagatagctgatgagaaccttctgcatagcactgggaactctactcaatgctctgtggtggcaaacaggggatataagtgtatgtataactgattcactttgctgaatatcaaactaacacaacattgtaaagcaactaaacttcaataaaaaataaattaaaatatttttaaaagcaaagctagtcaaaatatgatgtcaaattaatcaaaattgtcacacacacacaaagatagaggcagtcacagttaatatacataacaaatactctacccaagataaccctgaagttccttccttccttatcccctttctccttccctcccttcttcttgccttccttccagacttattgatagcttactatgtgtctagcaccttatcagagatagagttgtaatgtggtgtgtaaatacaagtaccaccataacagaccagatgaacatatgtacatatgtcttatacaatacatctgaaatgttgccattattaaaaatattatgtcttataattctcaccatctgtaggatgtgtatttcttattgcacagatggcttatcttgaattatccataaatttccttaaagcaagaagagttgtttcctattttgggtcgtatggcctgaattttgaaaacccttccccagaaattattatacatcggccaagacatctggtcacttacctggtaaatataaaactccccacaaagtccacttgacacagggtcccatatgccagatttacaaaataggtctgcaaggccaga

SEQ ID NO: 29486 - DNA, 826 bp, Bovine  19866881716154
tgcacataattaatgatctttgctaagagtattttgggagattttattcaacaaagtaaaaaagaaatacattaaatattagtcctcttatatattataggacattacatccatttgtgtgcccataaatcatttagctatgaataccgtaagaagagcaagaaagtgataccagtgtactctctgagataatattgtcttagtatttgattacaggcacagtgtccttaatggacagattcttgctccatatccaatgtccagttggagctggggtactaagaaatggtaacaggaggattttagagcaggatcaaccaaagttcaggggtgtgaacctgttgatgaaataaaacttttactacccttgttagaagactctctctgtctctcttgttgtattgccttccagtgatcagttttgttgctccagtgtgggtgttttgtgtatgtgagtgtgtgtgtgtgcttttggggaaggaagatattaaaaatatttgacctggtttcaccatctttttattgggtcaaataaagatagaagggcaatggttgcttctgcaagaactggaggaataaacctgccttttaaaacaaatagatttattctttctgaacagctacaaaaaagtcgtttcaatgtgagttaaaccagagctgaatctctgtctccatacacaaggtaaagtacacagcttaagaagaagcagaagaaaaaggaggagaaagaggaaaggaggaggagaaggggaaaacagaagtcagttcagttagtcagtcagttcagtagctcagtcatgtgtccagctatttgcaaccccatgaa

SEQ ID NO: 29487 - DNA, 835 bp, Bovine  19866881744272
caactttcactttctttttcctcccatagagtagcatttctggacttaccgtatagctaaacaacttatctcaagagttggttgagaattcccatcttttccagggaaataagaatagcaaagatgtctgaacctctcaaaatctagaccccaagacctaaaggaccctaggtttccacaacagggtagagatttgagacctgattgatgtcctaggacaaaaattacaccttcatgtgtggatacaaaattttttttgcatgcttattttatgctcatcttcacaaaagggtagaaatggaaacatgtttgactgggtaaaactaaaggacacatttgttatcaaggaataatggatatcaaaatgaacttccaaggcccatcacgcaatcaatagatctctacttttccttcccttcatattttcagtttatagtagcaataaatacattggtgcatgaaatttactggagtctaatgatcagctggcatttctgaccagaagctgaactgagtaactgcatcccttccccactgtcatcaactcagacaatgccgcaagcgtggttattagtccccaaatgacatttaattatagctctaattggaggtctcacggttattcttctaaattgaggtatgctctgtgaggtctttgtaaaatgattcaaaatccattaagcagttgaagaacattgcatttgtgctttggtttatctctctgggtaacagaaactgcttggcttagatttcattttctaaaccttttccttcaaacttaggaaataacggaactatgtccttcattgctaaccccaaagcatcagaaaaacat

SEQ ID NO: 29488 - DNA, 1374 bp, Bovine  19866880518953
ttgctgaatcttctccactcttagcgaacccatggactgcagcccaccaggctcctctgttcatggaattttccaggcaacagtgctggagtggggtgccattgccttctccatggatattttactgtctgagccattaaggaagccctttaagccccctaagtctcggaaaaatttattattccttcatttctgctgcagatatttctgactcatgaagtataagacagtatctattgagtccttttctaatatagaaaaatgggccccaaacgggtacttctaataataaatataaatttagtcttgaaattttcccatacaaaacaattgtaatgttactgaaaattgacttgaaaatgaacacttgaaaagtactgttttgttttttttttttcaatttttcagaggatgtctatgtagatccttatttcctaggtaaaatccttaaagtgtatagacaaatagtctgcttaatgttaaatctgattcaaacatgttattttttttaaaaaaatagtccttgtgtttgagtacatttgtttctcttttttgggcatatagtttttaaatgttagaataatttatgtttttaaaaaactgcaagtgcggttgcaagtgtaataaattttcttcccaaatatacttcatccagttccctaattattaaaatattacattactatgagtcatttatctcaattagtaaagcagtattaatagatcattgctaactaaaaatcaaaccctttgacatgcccccatcaaagctgatggtatgtttgtttttaatataaaatatgttttaatttctgtaactatgagctgtttcaggttcatgtggtatatttcctgcccagtgtttcatttgatttagaaatgatatttatttgcattattctaaaaaaatgttggcaggtcttaaagaggagagagtttgtattcagcttgaatttgcccgtgagagtatcccttatctcctctttatctttgctttaaaaggatatgaacctaagaatcatctgataacattcatattaatgggaaaaggtgttacagtttttacctatttctgtgcactgctaaatggaaaacatgtctatcaggaactcgaaagggagatttgggtttattctgagaaaagtagccactctgacagccctactcctatagtatctacagaggtttgcagcatatctgaatttgaaagcaaaaaaaaaaaaaaaacaacccagcatgttaagctatatttgtaaaatgtgattcccacagatgtcaaaaataccgtctccctaattttaccttcattatgaaatgccttcgagctcaggctgtgtaacttttctatgaagcacttaatctctacccaggccc

SEQ ID NO: 29489 - DNA, 837 bp, Bovine  19866880611513
caaggtttacatattagctatgaattggttcagacaactttctagtcatttaaaattgctccaaaatacataaaagccatggttgttccaagggaaagctcttttctaagtatgctatgttcttgatttatgaagtagagtagttaaaaggatgtttacatttaaacaaaatgtgtctttttttaacttgaacttatttatttagtagaattcttaaagaacaagcctacaaataaaaggaaaatgatagacataagtaaatattgttacacttaaaataaatgtgtattttttgatacttataagaaattgatttaatataaattaagactaaagcaggtgccaaagtcatttttgcagaattgtgcttttgttgatggtctttttcttatatttgtaatggtaattttcttatattgtgttatatataaatacatatacaaatatacatgtacaaacacacagaaaggaaagcactagagtcttgttattttacattttaactttcaatgaaaagatatttttctcttttcttatcatcagaaaatcttacacatctacactgtcattaccacactgaacaaattttgcctctctatggagaattctgctttgtcatagcagataaaatagatccatgagcttttagcaattgtcataacactgtagtcttgcatttcatttggatgaatattcatgtcaacaatttaagttaaaatttattaaaaaaataaacctcaaaacgtattttatatttcatttttggttttccactacaaagatggaaaagtcttattttttgtcaaaaataataaaatacaaaatacattttacatg

SEQ ID NO: 29490 - DNA, 951 bp, Bovine  19866880614874
tggcttatcaggtattagtttaaaaaaaaaaaaacctacgaaattatttgaagacactgaaatgacttgtttaaataggatgacaaataaatcaccatttgataatttcatcaaatttaactcagtaattcaactacaaacttaataaaggtcttgctaaattgaccagatttatttttcccagaagccactgattcagtagtcctttggcttctagtggtcccaacactttaaaattcaaagttccttatgagtctttgtcagtatagtattatagctacatacaaccaagacagaattagctttaggactttgtaatagaatttaatctaatttttaagtgctttaaataaattatatagtcatgtaatgtgaacatagtttcttttttgtgtgtgtttttgccattgtgtaagaaatcattccttttttcaattatgctttaaaaataaactacagcacatccacaaatgcctatttccatctttgatatatttatgtaggcataaaagtgaatgagtgaatcctactaacctaactatatggatctgccagcatttttagaacctgtcctgttgataataatgagagtggcatattttattagatgtagagttctgtgcttttaaaaaaatatcatttatttcaccaatatttatgtaaatggattgtaaaatattcagtgagtgctgcatttctgtccctttcctttccagttactgatcaggatgttagaatgaattattattgccagcttactaaaatttttgaataattgaaatattatttgctttctctcctatgccataatttagcacttaactacgttaactatgtgcagtgttagcaaactagaggtaaaggaattcaaaactgattcattttggctcatgtatagaactctctctacaaaataatacacctgtgttagaattttaatgttcttttatc

SEQ ID NO: 29491 - DNA, 1807 bp, Bovine  19866880799504
actatgttagtacactgcattggtgtttttctttctggctgacttcactctgtataatctgcttattctaacgcatgtatatggaatttagaaagatggtaacgacaaccctgtatgcgagacagcaaaagagacacagatgtacagaacagtcttttggactctgtgggagggggtgggggatgatttgagagaatggcattaaaacatgtataatatcatataagaaatgtatcgccagtccagtttcgatgcaggatacaggatgcttggggctggtatactgggatgacccagagggagagtatgagaagggaggtgggagaggggttccaggattgggaaaatgtgtacacccgtggcggattcatgttgatgtatggcaaaactgatacaatattgtaaagtaattagcctctaattaaaataaataaattaaaaaaaaaaaacactatgttatattgcctctcttatgctccaaatttagagaagaggtgttttttgttttggcttttgttttgaatattcgtaagcctgagtttcacccaatttataagaaggaagatcatggcatttaccttgcagagataatccaagggttcagtaaaatcatatgggtaaaaaacttagaaaagtgattgacataatcacaggcataaaaacaacagcagggttgatatgcattaaatgcttctgaatccacattgcttgaaaagggaatttattttttttaatttaatttaatttatttatttctttttttttcttttttttttctttaatagaaaattatttaattagtatacatgtgttccccatccttgaaccctcctccctcctccctccccacaccatccctctgggtcgtcccagtgcaccagccccaagcatccactatcgtgcattgaacctggactggcgactcgtttcttacatgatattatacatgtttcaatgccattctcccaaatctccccaccctctcaacatttggaatatgtgtattttagaaatgtaactgattctccacaccactataagtctgattaacatattcacaaagtgtgaattagactgtttgccaggaatcaaaatcaagatatattttgatatttcagacactttgagaggtacttgcatcttccaaatttagttaaagcatttagcctgtggttgcttaccatattttaataaactactgggtattattttgcaaatagatcacagagttaacatttttcgcttatgatatatgtgaatttgactctcaagtttcctttgtttcaaggacacttcagtgaacaccttgaagatataggcaatttaaaacgaagctcttcccataaaaagagaagctctgaatggacaaatctcaatgtcatttcagagttaccagcaatgaaaggggatatattgaaggtctttccctgtctttcagtagtgaagagagctgtaggttggtttacaccctgactgcttcatttacaattcaattaggatgaatgtcactggaggcaaatattgtgaacagcatttctagattcatttttaaagatgcctaccacataatgcagcttcagtttcaggagttaggttcctatggaattataggtaggctagggagaattataatcccttctaatcattaaaatgcatgcatgaagtacttcaaatcagattattcatcactcctgaaacgctgacaaaatgcttaagggtctacttctttactaaggtgaaaccaaaaaagtcgctattctttaagggttggggtaatactgtgccttggtaggtcaatttttaactg

SEQ ID NO: 29492 - DNA, 1770 bp, Bovine  19866880885124
caaaaattctcacaaactcccaaaacttctctatagtttggtaatgaatttgttaaagataatggaaatttattcagatagtttcatctcagcaacattttattcaacgtattctagtggtattgtctacatcttttgatattccataaacccttagaaatttcttactgagtaagcagacaaggcaattctagatgcttctaattaactagaagttgatctttgatgagtatgtattgggggagtccagacaggagagaagttggcaggaaggagaaaaaggatatgtgaattcaaatgatgcataaactcaaaatagcatctagtcaaaggttataccctgattggacttactaaggctgaaagaaacaatttaagaaaattgaaagcaagaccataaagcctgtagagaaggcagtcaaagcatggcacctttatattcaattgttacctttaccaactatggagaaaatcctatatgcttaacttcactggatcatttgtggaggttttctgtgatgttggaacctggccatacttagacaaatatttatttatccttgatggataaataagagattttcatacatgatctgacaccattgggaaagtccttctctctcatctgagtaacactgtgaaggtaatttataattggtcatattttaaattgaaggaatgtttttttagactatttctatctgaaaatgtgatatgcctagtttgagaaggctataaccatatagatggctatagccatctatttactgtcctcattcaccttcaagcacatgtgcacatgccttttcaggtttgcagagtggtcatttgagtattactctctgtcaggagcaaatagaaaggaaactgtctcgttttcttctcccctgttttctgattgctcattagtagcttaacactttatgtattcacacttgtatctgtaaagaggtaagcatccctggtctcaattaagagcaattacatagatttctgtctgattttgctaagtgcatttttctgctaaaaccttttttctatatttagaacttcaaaggctagctgacctaaacttctaagggaacatgtttatgtgtcgaactgagcaataagtgtagaggtgcattattctaattatgttgacaagtgaatttgtaatcaatgaattaattcaatttcagatagctagaatcaaaagtatggctttacataaaataaaaactcaagggaaaaatatgaactactaagagcactgagaataactaattggtattacactttcgacattattttcaatagcaatttgtgttatttaagcattttgttatttaagtatccatcagcattatctcaattatgttatttctacataatcatatctccaaatttatggtgaatcatgaaattaagttcaatgaaatttcttctgcaattaaaaatgtacttttttattgtttaccttttgttgttttgaggtttgtagataccttgaaataggccaaattgcataaaaaaaaaaaatgcagtgagtcttcttttagtccaaaggaaataccagcatgtaaaagtttattcaaaagtttactcatgtttctctgaccatgataatatcttatatttgaatagaatttgactaaaacgaataatgtcatccatatttttgtggcaaagctatttctgcacttctgtaaagtgatcagtacgtgtctataaatttacaaagaatgagggtactgcagttatggacatttttgttatgatggttcttga

SEQ ID NO: 29493 - DNA, 1812 bp, Bovine  19866880906272
gagagaaaaccactgctaagatgttaaagctattagatagcatgctctgaatattacttttataaacatcattattctgaagattgtatcactccctgaatattctattcattcttaaggttaccaattctgagatagtcacacttgcaaaataatagctattgttttaaatttatatatccaatttattatttagtgaaataatacatctactactaatacatccatattgtattaatgttaacttattgtataatgcactttcttacagtagcacatactggtaaaacatatagtagacaatgtaaaatcatttggtggcacagttttgatagaatcagaatttctctgaacttcccttagcctttagtctgacattacaaattataatcagtggaacgtcactgattttcctgaaataaattgtgaatgttctgaaagttagacttttgacaaatatttcaaaatatgtttgcatgttaaatgtatactagaaataattgaaaaattaaacagtatcaaattagtttatttatcaaaaaacttccatttttaaaattggaaatgaagttggagtgattccaacaactctagatctttctaatatcattcctcaccaaagctcagatcacctttaaatgaaatgcttataaaaaacactaaagtgctcttagtaattttcaagcagtatgtacaacattgcccagaatttgaactcttccagatttcatttccaataaatttgaactgctttgtatagtgaagagtaatttaaaattattgaagtgctcccagagtaaagtacccataaaaatgtaaagcctttcaggattttaatcactatgcacactttagaatcatttcaacacataaaatgctttgatttttagtttccattgctttaatttgaaagtatgaaaaatgccaaaccaaaatggcatttataatcaatgaaaattgtaagtaacctgaatttcaaaattgatataaagagttgaatatgggaaatatagctattattgatagggggaaaattagcaaccattataacaattatctataatactaatttaaatacccttgtcagacaagattgaattaactattatagtatgtttctataatgtaccaatagtttactttttctattttacacattccgtgtctgtgtggaaaattgatggtgactgcttatagatacccaaaagtgttgctgttaagatttgaaagcaatcagaattgatttaagattgtaaaaaaatcttattcaattacatttaaaaatctttaaagaatgaccaatgaggactataaagctatttaaaaatgttggataccagaaaactcctattttgatcctaacacaggtaatattttattgttttagctaaaaaattaaaatattgcatatatgatgaagtagaattgattgatagtacaaacaaaaaattagaatattgcatatatgatgaaatagaattcatagagttgataatacaaacaattaaaagtgataaaattctgatgttaaaggaggcaaataaataacatgcttctgtatgcccaagttctgaactaagtgagaaactgggtcagaaaaaggtagaggtgaaattaaatgtgcaccttactagtgattttctgtgggcaagggggtttataatactagatctgagaattaaatagagttataaatgtatttaaggggaagctaaaatcagttattcctcaggaactggtgctttcccaatggatctgagggaaaagcagaatatatggcctttcaggactttctagcttcaataaaaggag

SEQ ID NO: 29494 - DNA, 3226 bp, Bovine  19866880947701
tggaataggtgttactcaaaatactagaggtttagcatgaaaaaatacaaatttcagtcaccttggaaatcacatattatttgaggaaatactgttctacttgaacacataaatcaagaaaatttgagtcataaatattagaaaatattttctaacagaaacaaatacaaattccataaacaatttgtctaagtgaagtaaatatttgttttaacatttctagctatttccaattatctatctcaaaatagataaataatatgaaaggcttttttttttaagttgttggtgagcttcaacattttgttggacaaaatatacatgatgttaagtcttttttgttattttcactgtgaaaaggcattaaaaatatcatgatgatattactcacttctgagaccactacaatcagtgtctcaattcaagtaccacttttctctcatttgttttctaagaatactttcagttgaattgaaaaaattgacgctgagattttaatcgaagcagtgtaataaagacatgaattattttcaattttagagctgtattcccaactttgaatagctagaactagtgagatttgtgatagaaaagtatgtgttcaggtaatttttttcaaatatttcacttctatattcatgggtttctctaaattatttatacattatttaaaatgtaggttgcaaagaaacagaacaagagaattataacttaatgatacattattcacagggcaatgcacaatctttgtgaggtagtttagctttcttgatcattggagagtttctctttagatgattaatcagtgtaggctttgattgaaaagatatagtggagttagtagcaagtcttcttttttccttcaaaagaaacctagtaaaagtgaaacagagaaataagaaagtataattaggacttagaattagatatgactgagacagagagagagaaggaggaagaaaggagcaaaaaataaaacccatatgtacacaggacccctttcaagaagatgctcccttgtatagctctaaggagtttgggtaactggtatgccttcttggacagaccctggccaatgactaagcaaagcagtggtaactatagccctgtctttcttaagtggcccccagacaagggacaaggaccatacaagtcctttgttccagggcttagttagccattaaatctaagattgaactttgctccagaattctccttggggctggcagagactgtcaagttcgctttgtggtatgagggctgcctcatacattcctgtatatcacctattccttttctggtgttattccccaatatacttgtgcctccaattatctctctcagtatctacttcccaggaaaaacaaaacaaaacttacaacaaatatcttttgaatttagtaggaaataaaatgtatttcacaattgtatttaagaaattggagttaaaaagaattaacgttccttattgttacaacctgacatcaacacatgaggctgaaagacttgattaggtatacatggcagttatgtttctagcaatttcaatatttctaaatgagtaaaaaaagttgctcaatcgtctccaactctttgccaccccatggtctatagcctaccaggctccgccgtccaagcgattttccaggcaagaatactggagtgggttgcatttccttctccaggagatcttcctgacccagatattgaacccagtctcctgcattgcaggcagacactttatcatctgagccaccagggaagtgagtaaaatgagtaaaaacaacaccaactgcctaatgcctgatgaacactctcctagcatatcacttgtggtgttatttttaatatccttagttttcaactgacacatttcaactacaatctaagtaaaaatttaagtatgcaaaattatattaattatacttataattatgttgctataaatttccactccagacagtgttcagaaaaagaaaaaaaaatgtgcccaagtaacactgtataattttgatgttatttaaaatcaaattaatagatagagataaaacaaacaatccacactctgtaatttcacagtcttgatagaacctgtcacataatggaaaatgcctcttaattttgtgataagacataagcaatatttattgaccagttgtctttttcagaggcataccaaaaagacaaactagtagctaaggagtgctagagaaaatgagtcttggaactagttttaaaacagtatccaaagtattgtacatgtcatgctatagtcagtaacctaatgcttctcatggcgctgatagatttctactgctaatattcggttatcatcacaccttgtcaactagtagcttgaagcatatttatcacatcagatgctagttgtgtaaaaaaaactgagaatatcaaaaaagcatttttagtagttgcattggaaatagcactctattacatcacccagcactacatgctctttctctataatcttgtaaaacttcagcagcagagaaatagactcaagaattagtattggttctcagatacaagcatcatgttgttgtcatgacaatgaaccacagctacaattgtgttctcattagaagtgatacagtaaagctccacatatcacaccacacgcacagcggcttattctgcttacatgcaaaaccatcagagaagaaggcagtctataagagctttatatctcatctctatgccaactgcaaactggatgtggactagaaaattggccaaagtatttgttagcctatgtgacctgtgcacaaactgtcagattggtacatttatcttaagccatctgtatcaaatttttcctattctttttttcaccctaactccagaaatcaaacagattatcctaagtggttgtacaataccaagtgagctaatctggataaaacaatgtgattctactacagagataataacataatgaatgcaataagtttcaacagaaaatagattcttataccaaaggatgtactgtaaattgtaaataaaacaatccacaattttcctatatgcacacacaaataaataaaacaaccactgttcttagtgattaagttttataaatgtcttcatatagatgtgtccaagcactttcaattatgacaaggctatttgcaaatgcaaaattactattttaaatgaatgcaaatattgtttctatatttcaatgacatatacactgacatatctg

SEQ ID NO: 29495 - DNA, 1219 bp, Bovine  19866880966105
tcatgtaaagattactttaaccacacagccaaaactaaaaattaacctaacaatatatattaaagcatatatctttttaaaaaaactgaaaaagagtatatacgtatgtgtgtataactaaatttactgtgttatatgtctgaaactaacatgatgttgtaaatcaactgtactttgataaaaagcaaaaaacatatatcccttttagcctatgatattattattaattagcactttctatactacagattttagagaaggcagtggcgacctactccaatactcttgcccggaaaatcccatggacggaggagcctggtaggttgcacgtccatggggtcgccaagagtggggcacgactgagcgacttcactttcacttttcactttcacgcactgaagaaggaaatggcaacccactccagtgttctcgcctagaaaattccaaagacaggggtgcctagtgggctgctgtctttcgggtcgcacagagtcggacacgactgaagcgacttagcagcagcatactacagattatctgcttattaaatatataaataaattgatccatcacttacgtattatcgaggccacataatatactgtgctatacacataaacatatgactaaagtgaatccttaaaacctgatgcatgagatgaacttatttttcaagtacaatttaaatgaatgtaaaatacacatttttattgctaatcatgtgtacacattccctcagcataagaattatattttaatacattatgctaacaaaaaatgagcaaaacatgtttcttttcaagataatttatattatcaagtcatgcatgagagtaatgagattaataatagaaagtatagatttattcactctctgggatgataaatcatgacaagtcattaaagtcatttaattctgatacagtaaaaccatgtgatggcagagagaatggataatactatttagaacagttcatgcctagttgatgagataaaattaagtcagagttgttagtagtgttttaaaattgttttgcattaatagaaatctggtaactttgaatggaatgtaaatcataggagaatagaatgctccctttgatgatttcaataccacatgtgaaaagaacattccaagctagtatctcttacagtttatgactcataatgattgagttctttcttacataacacaggtcaatagtctcccacaacttaa

SEQ ID NO: 29496 - DNA, 1819 bp, Bovine  19866881021559
cctttgactgtgtggatcacaataaactgtggaaaattctgaaagagatgggaataccagaccacctgacctgcctcttgagaaatttgtatgcaggtcaggaagcaacagttagaactggacatggaacaacagactggttccagacagaaaaaggagtacatcaaggctgtatattgtacactgtttatttaacttatatgcaaagtacatcatgagaaacgctggactggaagaaacacaagctggaatcaagatttccgggagaaatatcaataatctccgatgtattgatgacaccacccttatggcagaaagtgaagaggaactcaaaagcctcttgatgaaagtgaaagtggagagtgaaaaagtgggcttaaagctccacatttagaaaacaaagatcatggcatccggtcccatcacttcatgggaaatagatggggaaacagtggaaacagtgtcagactttattgttttgggctccaaaatcactacaaatggtgactgcagccatgaaagtaaaaagacacctactctttggaaggaaagttatgaccaacctagatagcatattcaaaagcagagacattagttttctttttttattattattattattttttaaattttattttatttttaaactttataatattgtattagttttgccaaatatcgaaatgaatccgtcacaggtatacattgctgtttcaaaaaatcctgtgagttatagaatctttagactttgaatggaaaagatattgcagttgtttgtgtgtgctgtgtttgtgagagcaagagaaacaaagacagagagatactaaggactgtaaaataattgtgactttacctcatttttaatttttagttacataaagaatcaaaatactaattattttctgaaaaatctgaatgatgttgtgaatgacacaaattacaatttcataaacttaatataatttactatttttgttgttttcaaattgtataattcatacaaagttaatctgcaattttttttcagaacttcatcaactagattatttcatagcaactgattgtaatgcaataattcaaggaatttttttttctttagaaagcacaaatttgcgtatgcaaaaacagtttcaaattttattttccttggatgaaagcttcttttatagtgcaaatgtattttaattagaaatctacacttaaaaatcaaatgaaaggagaactaattttttttcttttttactgctatatgccagggggaaataatattaatgttaaatacatgtcttttaagaaaagattaaaatggactgtgatatgtctttgtgtaagcacaaagttccaacactctgcaattgtcctttgaatgaaatttgaatcgtattttctttattctagaattgaatcagagcatttaaagaggtaaacattgattatttgatgcttcacttaaaagcattcagaagaaattaatcaaattaacccatccttctttctactggtaaatatatatataatataatatatatattatattatatatataggtaaatatatattttttatttatatttttatattttgtatatatatttatatatattatatattatatatatataattttatattattatatataatatatattggtaaatatatatatttttatttatatataatatatatatatacatatacatataaatatatatatattggtaaatatatatactatattttattttatattatatatatatatttatatatacaatatatatataaataaatatatattatccatatatatggatat

SEQ ID NO: 29497 - DNA, 1688 bp, Bovine  19866881397103
aaatccaaagaaagtcactgcactaaatcaattggcaccattttatcattctacatagaaggaaaaatatgctcttttatatacaaggagaaataggtaaatgtaattactataaaaataaaatagcaagcaataaaacataaaaggaaaggaaaaggaaaaatttgattgtacttactaaaccttatttagagctccctaaagaacagctgttgtttcttttctgtgataatccttccttgctcattcatgttgctgctcatgtaacacctctgtcccagcactttaattcacaactaaagattccatgccaaaccctttacttaacacagtaggaaagcattaacttatacatttcaataatacacagtacttaattccactattcccccatttaagctgattttcttaaatattgcataagccagaggtaatttgatttcatgtttttatttaaattatatacattagtaccactgaaattaatctcaatacaacatttaaaaataattagaagcagattgggagtaacttaaactaaaacacatactgaaattatatggcttcctaagaaagaatagtgtttataaataattacatttatgaagaaaaaagactaatttgtatcctttctaaattgtgggctataggttaccatactacatacaagaagatcccctgaagaagggcatggccactcactccggcattcttgcctggagattcctgtggacagagaagcctggcaagctacagtccatagggttgcaaatcagacactattggagcaacttagcgtgcatgcatatatatatctatatcaatatctatatatatatatagagagagagatatatatatatcaccttagttcctttattttaactttgaatttaatttttattactttttttgcttatctttaatacttttggagaatatagatttttatatcctgaaactacgtaaatagctatggcccagctgctctaataattaaaggctgtgtgatgtagtaaaagtaaattgaccaagtcaagttaagtgacttctaatcttcattggtacagctggccggatatgtcacttgatacctcccaaactgtttcatttccaaaatattaattttgtatcccttcatcacttctcaagggctaatccattttatccctcatgtgatatataacagaagacatttgaaaacattagatgttcttgaaattctttgacttttatttttgcttgctaacctaactataatatgttggaaaatatacatccttagaacaatttctcatcatataccataaatgagaactgtttttttttagcggaatttcaggattagtaaatggcttttgatattgttcacatgcagaagatactgaaagttccccttgattgctataaaaaatgactaaaagtggaaagtgttttactattttatatttgtagagtaagtacatactttgttgccaaagccagggctcttttgagagggagatgaggttaataaaacatacaccaaataggcagtagttaaatgagagtgtcctggtaaatgtgaagcatatgctcatcctatgactgtgtggatcacaataaactgtggaaaattctgaaagagatgggaataccagaccacctgatctgcctcttaagaaatttgtatgcaggtcaggaagcaa

SEQ ID NO: 29498 - DNA, 836 bp, Bovine  19866881702467
cttgaattgtcacataataatacatgttacactgaaaatattttatgatgaaagacctttggaataaaatacccttggaatattataaacaaagttgcaacagattaaaaaggaaactttttagcagaagtacttagtaatttcctcacaacttgacatagctttaaatccaaacctcacttagaatgattgcttctatcacagagcagtcctacactaagatctattccattattgaaatagctgaaaatcaatgttttgttgggggatatatagtcagttgcatattcccatttttagtatgctttacagtaaatgttcaaggacttaaaattattgttgctaaatgatttgtccttgaaattcaaggagtaactattagtgtattttgactctggcattttagtagtaagtagtaactgcatttggttcagagtcttaaatacttccaaatgactacaattttttaagtgccaagtagtttggaaaataattgctttgaatatcaattttttaggactcattatctacactatgccacccagacaagagaaaggtgaagtaaaaaaacattgttgatattttggttacattgcaaagtcgtctcaatagtgtttattgatatggagcttttttttttttttttaagtgcaaggactaagatcactgaaagtataaaataatatgccttaaatttgctgttgctattaatcagcttctgttataggaatgctattttgaaggttagtcacaaaaatccacaaaatcagatgcataactcttaaatggatttgaatatactgttgctgttgttcagttgctaacttgtgtccaat

SEQ ID NO: 29499 - DNA, 1203 bp, Bovine  19866881753936
ctgcaggaattatgagtgggaagaacaggtgttctgagagattctacagtgcttcggttgctaaggagaccactttcatcagttcagaaaggctgataacctggacttttgctgccaaattggtacaacaaaggttggaactgatataaacatgcacacacaaataaaaatgacatgggtagtttaaaaaataattcaatgataaggttgcactgtacctggcaaaatacttctatattaaataagaatagttgcataattgctaaatcatttgaggtggactaattggagcacataattccaaaattaaagtataaaaacagaaaaagtttatttatgcccattatctcattaaaaacaatgcaactaatgacatatatgctttagtaattacattaaaaagtttgttatattttaatgtgatgttaattatacaaaatagagaaaagtgagtactagataacttcattagacattaataaatactaattaagtatttcttgggcaagttgaatatgagaagcatttataaacaatgtgatataagtggtattttaatatgcaaatatgattaacattgcactgcccccccaaatattttgatgcaagtaactggtttttaaaagcattacaattatctctgctgagctgttaaactgtttcttaaaggatgttctatcattttttctttataacactaagtaacataaagcatgtacctgagaaatgaggaaatagcaagcaagtattaagaaaaaaaaaaaaaactcccttcctaggtttcattagcacaggactagaaatattcaacatttaatacataagatctttctatatttaatatcacaaaaagtaattaaaatatgatttgaaaactaatgtttagtaaaaactgtatctttcagttagaatacttttgtgattctttttgaaaagtttcaaaatgatgaaaggcactatggtaaatttacctttaaaatatcaaggaatactaccaaaccttaatatttggagtctaatagcaaagtatgatatattctattatataacacagtcactttttaaatttaaacttaatactgaaattttgatcattccattacataaaaataaaacaaattggaggtagagacattgcatttttcactttgccattttcatcataaagtcatttgtttgaaacagttatatattttggcaaag

SEQ ID NO: 29500 - DNA, 1425 bp, Bovine  19866881837022
cttatttctttcccctaaaaatattcagctgtaaagttggtttctaccagcttcagactttcattttactacaactacctctagcagacttttgtcaaagagaaatgcatgtttttgccaaacaaaatgtacatttcttttaagaaatgtgtttcttagtctgtctatttccctgttgacattgtaagtctgccagaacaaggcaaattcaacattatgtcaggcagtgggtattacttttcaatatgtgtatgtgtctttatctgtatctgtgtaatgtgtgttgatgtttaatcatttggatgttaactaaatgctgtatttctccaaggagtatctgctatagatgttaattatagataaaagagcaatattatactgagaaagaagtcatttttgttgatttaaaatagcatcattgtcatttgtgagaatagcttgctgtttattcctgattaccttgaaatggaaaagctgttatatctgtataattgaatgtttcaggttaatttggctgtaagttgttcaggagtaaattttagtcacgtatcctcagttttgattgttttaagcacatgccactgaattgtagagggattgaattgtaataggggagacccttgcatataaaaagccaacattctctaaatttcactctaagccaaaatcatgaaattatataatttaaaatttacaatgctctctatagaacttatgtagacacagaaggagaaggaagaaaaatggaaacagttctggtaagtcttcaaacctatcttgagaactgggtctacagctatctttgggaaaaccgttagccttcagccgagctaagtcatgagcagaggtcatttccgatgtgaccttcaagcccatgttgcatctcatgggcgtgaagtgagagattcatcttaaggaactaaaaggatccttgggaattgaagtcagaattgcaaatatttagacatcttttgggaaggaagaatttgttatactacactgtgttcatctgatcctaactttggagtgtcagagcttgtgttaagtttttaatgtttaggagattctggaagagtgaagaatgaattaaaatttttataaatggaagggtttacttttcattgctcttattatattgtatgggcttccccgatggctcaagcaataaaatgcccacctgcaatgcatgagatgcaggttcaatcccagggttaaggagatcccctggaggaggaaatgacaacccactccagtattcttgcttggggaatcccatggatagagaagcctggtgggctacagtacatggagtcgcaaagaactgggcatgactgagcacgtgatgggtggatggattatattttatggctttattcattcaaaatacatatgctaaaaagggcatagtttattcttctatcagaa

SEQ ID NO: 29501 - DNA, 1408 bp, Bovine  19866881867392
aaaaaagagtttctgattttcttttccggtcaatgatttttttaaaaataagaaataaatttcctttaaaagaagttaaatggtgaagattacatataagattacatgtttctgaatcctcagtcttgactcaacatatcttatctgagttaaattatgcaaattaaccacaatttctatacttggtttttctcatctctaaaattaggacaaaatagcttttcttcccatataaaattgtggcctggattatagacagtgatacttaagtaaatcatgtataattgtaccaacatgtaggaattaatcactaattagcaatgatgatgataatgatgattctatgaaaatttgattttaaatataaagggaaaagtaagcatcattaagataatctctattgttattaataaaagtgataaattattgatttatggttctagatttcatttgataaatcaaaattaatttggattctatatagactgaaaagattcaagtttacaatttagatactcacctataatttataatctaatttaattcagtcagtagttaaatcatataaattcttgtctttataatggtgctataaactatttatttttatgatttctctgtttctactcatgagaacaaatatgggatattattcagcttttatgtattttatttaattaaaattaaattggcttctttgttactttttaaaagtgtgtaatttaacattaacttgcctcaaaatgttgacatatgcaagttttcatgtcttctttcatcttgaaatgttctcagcttaagtaatgatctcatcctttttactgagtttatgactgattataattccttgaggatttaaaaaaaaggttaacattttttatatccaatatgaagtatgttactttcactttaccattaacataagaaatagctctttaagtcaagaaagataataatttttcactaatctccataggggtaccaagtaagatcaacaaagaacattatgtttcattttacactggagatccttgaaaggtgcatagttaaatgtcatccttttgtaagtaaatcattcacagtttgggaagacagcttagagcttcttaagcatgatttactgccaagacctctacagtttttaaggagtcagaccaaaagcatagtgtattaatacattttatcagtacattcttatactgaaagtttgcaaaaagaatttggagacatataaaatgaaacaaatttttaaaatttgtcctaacgttacctctctgagacacaaatcaatctaattataaacctaacaattacagatgaaaccaaaatgctttatgttcatacaatataaaaattcatattctccattttaaactcatgtaaaatgaattgatttattcttttgaca

SEQ ID NO: 29502 - DNA, 1137 bp, Bovine  19866880423786
cactggagaaatgaacactgagtcactccccagttctccgttgtaagctggactttagccagggcttcatttattgtaaagagccaataagttctgactttactcaagggccatgataatgccttaatgtcgactcagaccgcagtcctcccagctattctggtgctcctcctacctcagtgcacagtgagctgagtaaatggccatcgctgcctctgagggaagtactgggagaatcattgcagtcctgtaatagctgcaagttccctcttctaggcaccggccactttgttagtcaatgggttccagatttgaaaactggctcagggaaacgagtaagagctcgttactttttattggagcaattgccctcacgcctctgctcctgcatttttgcctctttcggttatagatgttaagcagcacccttcttgacagctcatctgttttgcccccagggatgctatgtctattaaccaaatgtctacagctccctgaggatgacgccccctctgctactctgctgacctcgccttgcaattattgtaattgcagcctcctggcttctggtgattaaacagtgccacctggcttctacgggtggggggcatcgtccccatggaagctaatgagctcagatccacagcagctgcaagtgtcttcagcctcagactgcaaaggtgagctactggtgaacttctcaaggatgctgagcattgtccacagaaggcggtggatctcccctgtcaccagagcaggcctagtgtccttggcaaatggtgtgcccttgtatccctcctctggaacgctgcctcagtgggtctccttgtctttcctgtgtctccattccaccatatccactgacctcagactctttgtttccttctctggcatacattagggttactcgggcatttctccttttctgagcataggcctttgttttctctaggactccaagagagaaccagcgtaatagggagtttgcttcattccttggggctctgtccaggaccagggtgttcagtcttgtgtcataaaagcagtaagtccaagtgcataaattctgatttgtccagccttaccttttagcccccttaagcaagctcccttatattccaaccccaggaatgtttt

SEQ ID NO: 29503 - DNA, 2859 bp, Bovine  19866880443515
ataaaaaaagaacataaaaaaaaacttctgtgtctatgattaaaatggccattattatattttaacaattcatgtatcaacattattggaaacaacccacaatttttgggaaaaaaacataattttttgaaaaaagccccttttcctcctaaattaaatgaacacaaaaggaattttaggaaagtactactttaatgccctgtcgattaaaagttatccattccctctgaacaaattactgtttttagtgattttaaacatgatggaatttagccccaattttcctgtgctataaacaaagtcttgactgttgcaaacatctgacaaaattaagtttaatgctcactttgttttcattattctcactctgtcttgaactctgctaaatgctacaaaagaaagaagcaggaaaagaaaaaaacaaaacaaaaaaaacccctgaacaaatagtttcagttagtcaaatcaaattgctgaaaacagtaaatatatgtattaatgtcaatataaattgaataatacatattgaagtgattcttcctctggtttactaattgtcattttgaacaaaatcgtccagtcatagttcattatcagcaagagtatttaagataaaatggcctgggaaccacagaatatttgtgtgtgtgcgcagaggattataacatggaatgaaaatatggctctgattctgtttttggtgtaattttgttcttccttagatgtcaagcagtcccaatgattcattatcacaacaccttaggaagaaatatagaggatgcctttttatctacagcttctaggtggggaaataaaatgccccagtacaatttagtaatttaattttggccaataaaagaagtaaaaacagtatctctaaatgtctcacgtcctttttttttttcttctcaaaagacatttcccccaaactaattgttatagaaacataaagtacaaagcccgtgctgctttagataattggttatgtggtgaagatgtatcaatagaatagtcattccataaaagataatttagtacagataaaattaggaactagtaaaggcattcctgtgttatcctttcttttctgaagagggatggacaaactatagtcctagggccaaatctggtctactgcctgtttttgtaaataaagttttgctggaacatagccattcctattaatctacatatttactaagctgctaccatgtttcacctgcagaagagttaaggagttacaataaagatcatggggcctacaaaacctaaaatgtttactgtactatctggccctttagagaaaaagttttcaaacctcagttttagaaaataagtctcataccacatcattgattacaaatcatgcttaagcactgtgactgcttaactctatttttacttctttttcagtacctaaattcaaataaaactttaataataatagaattaataattgtctatatttagcacctgacttgtctaataatatactaaaatggggattgattaaagcgtttagtctgtggtaattcattgttgtgttactgtagtgcagttgttaaatcgtgtccgactctttgtgaccccatggaatgacgccaggctcctctgttctccactatctctgggagtttgctcaaattcatgtccattgagttggtgatgctatctagccatcctcatcttctgccaccctcttctccttttgccttctatctttcattattaattcattattgcaatttaaaagtaatgaaataggtatgctagaggtaatggagctacccgagagctaattgaactagaaaaaaatctatatatttagggtgtgacgctacatggctgtctagtttagaactgctttgttattaaccagaggagcatgcaaaggaagttagagattctatcctagcaacatctggttacttgaaggctaatcaaaagttgggtagaactttctggagagtcttcttcctcaatgctctacacctgtgtttacagagaaccttgagacaacttctcttcccatgagatatcagaagcatcatttggatgctgttcatctattttgtaaagagtgttttattcaaaatttcctaagcctgggaaattgtaaactaactaatcatagtgtgagttcagtatttaatgttaattcaaaatctaaggcaaattgcaaaagttcttagttagagccaaatgttgacaatacatcaaaaactgagaacaaaactttctaccaacagcaatttatttaaagaattagtatgcttcctctgtttgtatgttttggaagaaatgagtgtgactgactttaaagtttgtattcagcaacattttactgacatgcacattagaatacacattaaaaactcacaccagataatttggtttatttttctcatctaattacaaataaattttaatttttataataataaacaaaggcacaaattatgggaaagtataagataatagagcctaataaattttgcaagaacaatattataaaatgtcataaatgctaactttttttaggatatgactaacatctcaattttgacagctttttaaaaacttgttttcaatatttgggaaaattaatccatgaatgatatgaaacaatagtattttgttgatatatgatatgaaacaatattattataaatgttttgaagataatttcacttcctattaattgtaattattgatcaatatcttcatgtactattatgaagtcaagattagagactataaggctatatatacaaactttaggagttatttaaacaaaaactttttaaaagggaaattttacttaattattggaaagtaaataaagattatgtgaataaa

SEQ ID NO: 29504 - DNA, 1254 bp, Bovine  19866880446821
tgtctatggggtcgcagagtcggaccgactgaagcgacttagcaacagcagcattaccattaacgtgctaaatattacactttttgtataagttctgtaactgtgagattgttatttaatagctcagccagaagagcactaaggaaatcacccctcttatgagtcctgagtgaatggatggaagccatctgaaccagccagaatttgtagaatcctggggttattttttatttgacaggcattgaatagaagagtattagggtggattgtggagaaaatcatgtccaaaagaaacaataaaaataatagatttactgagcatgttatttataattattgatttcttctgaatgaaataaaaaaggatggctcagtggtagttgcaggttttatctacagtgagtttcaggagatggcaactcactctagtatttttgcctggagaatcccatggacagaggagcctggcaggctacagtccatgggtcgtaaagaattggacacaatttagtgaataaacaatgatgcagaaaagccataatacattttggagagaagtggtcagagagcagggacgataaaatgtttaataatattcatggcaacatctccgagcaaatttaaaataaataaaaagtaaatagactcatttcctgctactcttacatagatgcagaatttcaaaccatttctccttgaaaaaatattactcaaattgggcttgatagaggttgatattaccaagaatgtgctttatggcattagtggttttgagttaggagtacacaaaacaagagttttgaatattttcttgattagagaattatctttaccatttttgcattattacttgaaaaggtcaattatagggcctaagctatactattttgtggtatcatgagaacatgagcagtttgcatagggaatagtacattgttattttacttttttccccctacttcataatatgaaggacactcttgtaagcatttaggttttcagtttgttcaaagaggttttttttgagtttattgtcttcatgtctttgattgttgaatccatgggctgtcccttagaagtggtgatggggcttcctacccaaggggcacattccatctggcaaagatcttggaactttaatatattgttctgtctaataaatggatctctgttctgtggaaacaaacagttagagctcttgctccaaaatgactactgtgtgatacatgagatacattgcgcatggtgggcata

SEQ ID NO: 29505 - DNA, 880 bp, Bovine  19866880528354
cccattgatgttgtctagtgaatttcccttagctaaccacagagtttaaatgttctgctgccttttattttagcacagttgagttcagtctcttcccttattgtaatagttttgaataaagtcttctttggttaacttgtttgcccaagttttcctttgacagttccacaggtaattttcattaacattcaaatattataggaaaaacatttctagatactgaagagtaatcttcaaggaattaaatagtcattaacctgcagcagaaagatcccctggaaatgggaatgacagctgactccagtattcttgcctgcgaaatccaatggacagagaatcctggtcgactagtctgtggggtcacaaagagtcagacacaactgagtgactgacacacacatcaaatagatagtgtccttccaccaagacccattactatttctgacctagtattagaagggattggtcttttattttttatttatttttttttgggggggattagtcttttaaatggcttcttcaatgggtggattttgactaagtgaaaactcctatttagtaaacccaatggtagatgcccatatttgtgagatgactggttagggaaagtagtacagtctgtagtaattgctcagaatgatgctaaataaacatatacattagatattactgtaggagtagaatttgtttagaataaaattagaataaattatcagcacccaaactttgccttattatcacataagctcaattattttccatattttcctgaagaagcttactccttttaaaatctttcggcattctattccgtgggagctgctttatccaacatatagcacctcatattgatgtacagatggttgccacaaagctg

SEQ ID NO: 29506 - DNA, 1276 bp, Bovine  19866880541599
atgagtcaactcttcacatgaggtggccaaaatactggtgtttcagctttagcatttttccttccaatgaatacctaggactgatctccttcagaatggactggttggatctccttgcagtccaagggactctcaagagtcttctcccaacaccacggttcaaaagcatcaattctttggtgctcagctttcttcacagtccaactctcacatccaaacatgaccactggaaaaaccatagccttgactagacggacctttgttggcaaagtaatgtctctgcttttgaatatgctatctaggttggtcataacttttcttccaaggagtaagggtcttttaatttcatgactgcagtcaccatctgcagtgattttggagccccccaaaataaagtctgacactgtttccactgtttccccatctatttcccatgtagtgatgggaccacataccatgatcttaattttctgaatgttgagctttaagcccactttttcactctcctctttcactttcatcaagaagctttttagttcctcttcactttctgccataagggtggtgtcatctgcatatctgaggttattgatatttctcccggcaatcttgattccagcttgtgcttcttccagcccatattagtatggccaaatagtcaaagaacaagatattcaatgtagaaaaaataatataaacttcttgctttgagtttactagggtcaatatatgaattatattaatatgtgatatggtaatcacatttatctcaatatagttaatcagaagaagaaataatcattaaatcctgaatcctattcctgatcaggactcaattacttgtgttgaaatctcaaaccatgtaaattccaatataatattttatgtcacctggaaagtttttacaactgttaaccctaatttttttttttaatttagacgagagtaaactaagtgatttctccaggttcttacatcttgtttatttgattataaaaaattgactcattttattcagtttccctcagtatttataactgcttttcttcctgtcaaggataataaaatgtgagacagagtagtattttactggcaagaatagtacagaattctattcatgaaaactataagcaatctttgtgaaaaatactattacactgtactcaggtcaaaatgaaagcttttagttcattatattaactcattttttcaaaagtcattttatatccgaggtctttgcagcagaatgctgttatcagaaatttgattcacttaa

SEQ ID NO: 29507 - DNA, 1109 bp, Bovine  19866880566665
ttgacatatatttatacattactatttaagataaatagattagagtcttcttcaatcaggaggcattaattaagagatataaagctgggaaattcccatttctgttgggttcattagaaaagatcttcagcctacagacccatattccaatgttatcctgctcctgtgcagagtgtaagaggaaacactccccaatggtggtctgtgacctccagaactctgatcagtgttataccgtaatattagaaaaatgacaagtagaatattgagaaaaggatgaaactggtaataaaaaatgatttctgtcagaatcaagtaagagcgtgtatggctattaatcagctaaggattcaacgttcatagtaaattgagtgcatcacctaaaaagaaggtttacttaaactctgtttagcagctacagctgggattgtaggtcctgctacagatcaccatagcaaataccacagatctgctaaagaccaccaagaaagtctttggccttctcttctgagaagcgctgacccatgcagatcatgtgtgagtcaggccagattggctagcaaaacaaaactggacatcaggagaaaaaataatactgctcaaaaaatcctcaaagtctccttagtaatgttctaccgctaatatgtgaagaacaaagattctctttgtgaaaagctagccaactgggatttaccaatctttcatctcttctctgaagaactctttctcaaaaacagacgcactccatccatcacagaatactacacataatttaccataaaatagtgtattaattcataggaattcaagatatcacgtaacatttaggctgtcaaaaggtagaatgtttatattattaaattaatttggtttaaaaaagaatctcttatctttaaattcagaatatttacttcactgcatagaaaaatataattattcagagcacaacaatagatggaagtggcttctgatctttgtcctgaagctgtgtcctaacaatctgtgtctcccacttaaatttaaataaaatatgttttgaaagccaacacggatggatacctattctttctcagtagaacgagacctttcattcataaataccttcaact

SEQ ID NO: 29508 - DNA, 1190 bp, Bovine  19866880614950
tcggacacgactgaagcaacttagaagcagcagcagcaaagtgtttttaatgttgggaagcacatttataaacataatatgtacagatgtaagtaaaccaaagaattttaaatattcttaatacatctcctattcggaagctaaaaggcttctgaaattccactttttatatatttggactttgaaaaacctaaaacatggaccaataaatatactttctcacatggtaaagtggaattcacacccctacttctagtctatgatgtttttatggtatttttttcagctgtcatgtaattcatcaatgaaaatcattagcatctgaaaccacttagtgttcacaggatttttctgtataatttcaagttattaagatacataaacctaactgtggaacccatctacacaaaacccactcaccacacttcagaattttaaaagattctactttaaaatgaacaatacacaatggagaagaaaatatctagaagtacaaataggataaaatgagcagtgtggctttgaagattttatttcattgaatcccttcaaattctgaatttcctgtgaaaatggctgcatttttaaatactaagttaatgtaaaatatgcaaataaaactgtctaaagtcctcatcgcactatttgaaatattaattagtacttagaaagccaatgggtgggggaggaggactgcaaagcagttcacaggaagaagtgtcaagaaggaatttcatagagaaatgggtacttggagttcatagttcctttctctgaaagccatattctctagtaccagggcacaagtgtaacatgcgagaccttccactctttgggaatagtgtggaaaggagtgagagtccattattccatctgtaaggcataatttaaatccaatatttccctatattttctctagttaccttaaaacaggcttaataaattaggcctttggccatctagaataccttatgtcaaaggaaaaaagtgagctgagattccaaacagttttcctccctaacatttaccactgttctatgaatcagcacttcaaattctcaagggagtttgaaaatgtccttttgatcttattctttaaaagcagtgccatgcagagccatttgggaaggatgtgtgaagaaataagaatattgatcctgtctttatttaaagattttatatactctttg

SEQ ID NO: 29509 - DNA, 2216 bp, Bovine  19866880645757
tcaacataaccagaaaacacattcttctcaaaatgcacatagaattttcaccaagataggtaatattctgggtggtgaaataaatcttaaatttgaaagaatgaaaggatataaaggtatgctcacagctggtaattaaatttgattacatatcagtggcagaaatattcctgtggtatcagtatctgaaaaattcctggatatttggagactaacaaagtatatttctaattagtatgtagatgaaagaggaaacctcaagggaaataaagatatatatatatatatatatatatatatatacacatacacacacacacacacaaaactgaatgaaaattcagcctatcaaaatatatgggatgcagttaaaatagagcaagaccacagatcaataatcgaagcttccactttaagaactgccttgcttaattttcaaatgtatgaaatcttctaactttcgtttcctcattgaattccatggtgtttagagagcatattctgtgtaatttaagtataatgatttttttgagatttgtgttatgactcagcttacatgcaaatatgttgtaaatctatatgcatttgaaaatagcatttacttttattagatgttctgtctactagatcaagtacattagtcttatttaactatatgcttagtgatttattacctacttgttcttccatttaacaaatggtttattaaatgcctatgattgtatgtttatttcttctttgacactatttttgggtcatccatgctgctaaatgcatgcatttatcccttcaaattcaaagttagacttctgtttttagatagattgtgtgttgttatttagttgctaaatcatgccaactcttttgccaactcctgagctgtaactcaccaggctcctctatccatggaatttctgaggcaagaatacctggtgtgcattgccatttccttctccacggaatcttcctgactctaggatcaaacccatgtctcctgtattggcaggtggtctttaccgctgagccacctgagaagccttagatggatactcacagtttcttttacttgttcctcaaaaccatgatgccttcatgtttttaatttatttacatttttctgtgattaatttttaagtagggaggcagcaacccaaactagttttccatttgtcaggggctagaagccaggtccataggtttcattttaacacatcttctaggaactcattatcaattatgattgtgtacacacacacacacatgcatgtatacacgcatgctttctggtggactcacaagtaaagaattcacctgtacatgcaggagacatggatggatccctgggtcgggaagatcctctagtgaaggaaatggcaaccccactccagtattcttgcttgggaagtcccatggactgaagagcctggtgggctacagtccatggggtcacaaagactcagatacaactgagtgactaaataacagaatatatatacccactcaatataattatatgtacccaaacacacatattagaagtattgacattgagttgtaggtgtattagttgctcttctgacttttttggtacacaaaacttcaactttttaacccatatgtagtgtcctgctgaatgtttttataggaaagctaacaaaatataggactgaattttcaaaggctattacttgaacttgtgattggcccaatgcctttccataagtagatgtttccttgaattgtaaagcggtaattggacactggagagctgttatttgttgggcctctgagtaaattttgttttaatgcaaagccaaagtggagggctggtgaggggtatctggaaatgtggctcagtatatctgaatatagtggttttgtatggaaaacacatttcctttgcagtagggcatagcatctaaaaagttggcaatctgtctaatccttggtatccctggataatgtcataatcagagataaaggcacataagtgcattaacatctccaaagctgtgtaccatttcttacccttttttacttatttttatcatattttattgtacaaaattatactgtaatttaaaacccatatttaagagaagtaatttagggaatatcttactagtcatggactttatgagaacccttttgagacaaactaagctactaactaagtagtttagcatggaaagttttatgtatagtaactgcttccc

SEQ ID NO: 29510 - DNA, 1414 bp, Bovine  19866880656478
aggagcctggtgggctgctgtccatagggtcacacagagttgaacacgactgaagcgacttagcatgcaagcatgcatgtgttgaagaaggaaatggcaacccactccagtattcttgcctggagaatcccagggacagaggagcctggtgggctgctgtctgcacagagtctgacacgactgaagcaacttagcagcagcagcattgtgtttatcaacattaaactttcctgactatgcatgcatgctcatatatagtcatgaacatacttttgtatctggcatagaaaatcccttaaaaggaatataaaacaataaggaacataatactgaattgtccctcaagagtgagaaaagcctagagaagaaaatgaaatagaatctctcaaaaggagggagagctcctagtcataattgctagatttaccaaatacaaatttaattggcttcccaattaaatttgaattacagataaatttcagatattgcatggaatatagctatactgtgaaagtactcattgtttatctaaaattcatgtttaatgaaaacctgtatttgatctggaaaccttcgtataagtaggcacgatttgtggatcattttctcttggcaagtagaaggtaagtggctacttctgagaaggcagattcagggttcagaaattgttgacaatcccaggataaaattcaaggaaatcccatcttcagcctggagaggagtgtgtgtgaggcctagaatcctaagtgtttcctgttgtgacggaattcctctgattctcttgagagataaataaatcagtaggttggagagcagaaaaataggtgattcttagaaatgacctttctaggagagaaagaacaatgacagcaacagcagccaaaaggcagagagttttgagagtaataaccttatgtgaaaaaatgaaggagaaataacaaaagtgcccaggttggttatcactgaatcctcttctttactgtaggtccttccttgaagaaatgagggagattctttgaatgaaactacatttcccaaaacattgtaagtaagagtgaatggaataaaatctggatttattttctttctttttcctaattattttcctttgcattcatgtgtattcatacttaatacatatgtatacccacatagtgaaaagtagtataaattttacttttcacttggtggtttaagaaggtagtaactgtaagattagtgaaaaaatgaagtataaactttaaatggagtgcaggccaatgttttggtcatttttttctctcagttgcatttccttattctcttactctggattctgcaaacataatccatagtaattaatttaaattctcttttgatgttgatcttcatcagctcttggtttaaataccaaacacttcacacaccacacatt

SEQ ID NO: 29511 - DNA, 1071 bp, Bovine  19866880758350
acacacacacacacacacacacacacacacacacacacacacatacacatatatattttactgttcttgaagagagtaatgctatgaggataaaatgagtttacagtttaaggctaataatatattttactgaggttgaaaacattgaaaatctaaagttcataattcacagttgcactgatgaggttccgccaggtgagtgggaatgaaaaagaagacaaggagttgaaacaatgagataaagaaaggaaaagaaaagaccaatgaatccaatgatgacatgtatgacagaggtctgccagcataggagtcaacaagtaactctcttgttactgtttgtatctgtggtgatagagtggacagagaaatctgcaagaggattttttttttttttttttagagagaaagatgagattggatttagttgctaaattgatgttattatttgaattttcaaatataaatatatcaactcagaagggagtaaatatttgagactcatcatcttgataagtagttatgagataaatgctgcttctgtgatcacctttagagtcctgcagttaaactagtgatgtggattaaatttgaagggataataaaatacaatcagcagttatctcaatctttatacaattcttttgtatcttgcatattgtaagttgtgaaattctaaaaataggttagataatgaattatcctggtaaatatttggtgtgcaggataatttgcttttccttttgtatctctctactgcacttgtattttctaagcaaagaacattagcattataatcaccacttgaggctttaagctgaaaatattttattggttgactgaacttaccacccattaggaatgtccacatctggtcagatggggagctcaatgtttgcattaccctgtccacactgcagagttcagatactttactggctaagttacaaaactttgcttttttatagctactcgatgtacaggcttatatagcatatacctccctggaagcagtttctttctcataccatctggtaatgagagggatcatttacactacataaaaccatggca

SEQ ID NO: 29512 - DNA, 1443 bp, Bovine  19866880824491
acttttaaataaaatggtaattttaaaaacgatgggcatgacaatcacaaattttgcctattttcttcttttggggatttttcaaaaaaaaataaaaggagtaaaagtcagtactggataaagaaaattaattaagttgggtcaactgatgtattgggacaagtgtgttaaaaaggaagggagagaaagggtaggttgtatgatgtaattcataccttttaagtgaaaagggtttttatttttaaagaatgacattgtcaaacagcaaatacagtaagctacacacaaacctcctggtttctcacctcatcactctctgcataataagccttcatttcagatttcttttaggtaccaacattaccagttcctttggctctaccccatggcccttatctgacccaaaagcccttaagcacttaggattcaaaaacagcatatatttctacagcaagccaaccagcctagagccagtaataggttgttaagatttaacaaggaaaagtaagggacccattagaaggttacaatggcttggctgggaggggagagggtgggagatggaatccaaagtttaaagacactgcaaagagtcatgttaaaactcactttaacaatcaagtttaaaaatatactttattaaaatgctttaaaaagtacactgtggaagcagaaacaaaaaaaatccaaaatcattcattgcttattataaaagtgaaactaatataatttttcatcacctggttaatgcatatttcctcctacttaggcatctatgtgaaaatttgtgtatatatatatatatagaaaataattggttgctcatgtcacagaaatacagcatttaaacagtgtgtaaaattttccacaatgaagattgccagtgttacctcatttgactctttttaaaaatgaagatggatctagatttttggaggaacaagaaaaatacattcaaggaagttaaatcaaaatattccatttatagcccatgctaagttaaactactggtattgttttttccagtgcaattttttcttattgatgtacttgatcttggcattaatttcaaacatatttcttacacaacttaattcaacaaattataaaattaatttgctttactgacaacttcagagatgctcagaacaatgattactctctcagtagtctaaaatatggagagcgactttcttactaagattacatttactacagtaaaactcacccatttgagagcacagttctgtaagttttgacagatgtatgtagggatgctaccagtgcctcaatcaagacatagaacagtttgatcacttccaaacatccctacacttataagaatttaataagagctacttttaaaaagcctgatccatgacaaaaatttaatattttttctttactttggctctgattaatagaagacattcaattatagga

SEQ ID NO: 29513 - DNA, 935 bp, Bovine  19866880850243
tgaatattttcatttctaacaagacttcaaaccatttttgggagtcatggggaattggaaagtgaggttcaggctaaggactctccaagataaggtttcagaatctgataattaagttctaaaaattaagatccttatcttatttgttaaagatttcctaactggcccagctcacagtgaggtcacttttaaaaatgtattccttaacattactcaataaatacacagtgctttgcagctttctaagaacttgcacatacatgaagtattcttcacagcatacctgaaaggggagtgtcacagataaactcatatccactttatcaaagtggagagcaagaactgtggaacagcagggccaggacccacgtgactcttgctagtgctttcccagcatgctgtaccatgatgtctttaaagagcaggtaatgaaaagctcctcatttctgatcttttccatatgtacataacagtatgtagatggaagcaacccactgtcttggctgtatactggcccttgtcatcacccagttcctcctctaaaaccttaaacatcagtattctacccaagagaaaatctcccatcttgtttccctcccactgctactgctgctgctgctaagtcgctttagtgtccgactctttgagaccctatgactgtggcctgccaggctcctctgtccatgggatttcccaggcaagaatactggagagggttgccatgccctcctccagtggatctttcagaccagggacccaagtggcatctcttacatctcctgcattggcaggcaggttcttacctgggaagctcttcattcccactcagtttggttcagtcgttcagtcgtgttggactctttgcaatcccatgaattgcagcacaccaggccttctgtccatcaccaactcccagagttcactcaaactcaggt

SEQ ID NO: 29514 - DNA, 1061 bp, Bovine  19866880884579
tggaatctatcaattaacatgagagtaatgagtctttatagtttttaaggtttctaatcctaatgacagatataaaaggaaggcaagagtccagtttgactaaaattaagtttcaattttaaagttgtatatcatgttatattaaagacaaaaatcacagttacaaagcacctctgaggtacatccttactttagtgacaccatttggtgtaactgctacaaaaaaacgaaccagccactatgaagggctaactagagggcatattgttgtgggaagttggcctgttttccagctgtgccaaattacccaccctgctgcttgaatctcaataaaagcctttcgtaccagatacagactttggcaaagttcatgtgacaaggttcccaggaatctttccaagaagtcaaatatgcccagtctttatgaaactcctttcaccatgactgctaagagggacccaggaaacaaagggtagaagctattataactgcagttgaatcaggaggtcactgctacagttcttaagctgtcatgaaaataacagtgaacccaaataatccccaataaagcaaatttaagtgtctgaacaaaaataaagaaaaaagaaaacaaggtagttttagtaaacctgtttgtcaaagaataagatcaaagcgtcaggacttttttatatactacatctctctattgtaaaaattaaaaatacaaatgaatttttctaccgcattaagtcttcaaagagaaaatcctaaccttatctatgatatgagtagcattactcccattttgctgtcttgtgttttttttgaaagataaataataaagttcttaaggcacaaccatgaattgatagagtagaaaacttgtttttaaacaaagtaggctatacaggttctaaaagaaaccttaaaaagacaacaaaacaaatgtatgttattctccaactgtagataaaaatctacccactgaattagtgcacactaggctgaaagaactgggaaagaaaacaaacttatttgtgaaccctaaaatacagaaagaatccacatagagccttttt

SEQ ID NO: 29515 - DNA, 917 bp, Bovine  19866880888531
ttccctctctagaagcttcagcaaatgaacagaaactcttctgacatagccttttctttctgtatttctttggaatgttatcatttttctagaatataccaaaagttaaaataaacatgctggtatgaataaagaagcagacttccaaagtaggattagaagtccagtaaatctcacatttaaaaaatagacattcattatcttcaagcattctctgccttactcacatgtggtacgaggcaatgccttgctggattgtcccatcacgtgtcctccagccttggtggacacacaccaggcacacatgacttttgaatcatagagtaatctgagaggcccatgaggtcattttgagctttctgctgccagggctgcattgttctttagcaaaaagctttaagcctatggcctagttgagactgaaacagttctttctatacagctctatccttcttctcttgggctccctctttatcctaaatgaggttcatgaaatgtttctttttctcattcttcattcttttgagttccttctttgtcattttttttttcttcctacccgttatatggaatttaatctcatccttttgttttctggtgtgtctgaagcttaggcaaaaacaggttgttgttaatttcagcaacgcatctcaggggagtttgcctttgaaatgttccctttgctaggtggtccgagaatctggtctctggggttggtatattgcactaggttgtccttcagggctagttggaagccttctctgagcctgctgtccacctgcacagggctacttggccacattttctccctctgcaagtgtgtctcctggaactactctttggaaaattctggtcatgggtagccaaactaaagctatttgtaaaggggggtcctcttctctgttttcatggtaagt

SEQ ID NO: 29516 - DNA, 2682 bp, Bovine  19866880903771
ccctctgtcttctttatggtccactctcacatccatacatgactactgcaaagactacagccttgaatatatggacctttgtcaacagagtgatatctttgctttttaatatactgtctaggtttgtcataactttcctgccaagaagcaattgtcttctaatttcatggctgcagccacagtccacagtgattttggagcctaaaaaataaaatctgtcactgcttccgcttgaagtgaagtgaaatgaagtcggtcagtcgcgtctgactctttgcgacccctccatccatgagattttccaggcaagaatactggagtgggttgccatttccttctccagaggatcttcccaacccagggatcgaacccaggtctcctgcattgcaggcagatgctttaccatctgagccaccactttaaacccttctattcaccatgaagtgatgggactggatgccatgattcttagtttttttaatattgagttttaagccagctttttaaatctcctctttcacttccatcaagaggctctttaattcctcttcactttctaccattagggtggtataatctgcatatctgaggttgttgatatttctcttggcagccttgattccagcttgtaactcattcagcctagcattttgcataatgtgctctgcatataagttaaataaacagggtgacaacatacagccttgtcatagcgctttctcaattttgaatcagccaattgttccttgtatataaggttctaactgttgcttcttgacccgcatacaggtttcttaggagacaggtatgatagtctggtattcccatctctttaagagttttccagttttttatgatccacacaatcaaaggctttagtatagtcagtgaaacagaagtggatgtttttctggtattctggtttgtaaatctgtcagaatttaaagaatgagatacttctttcatattgaccattgtttccattcttaagagaaaataaaatgcccattctacttgccagtacctatagtagcagtcagttctacatttaattttgatgtattatgtcccactgtatttttatattttttcttttatgttttaatgttatcaccttatgaaaataacatagacatcctattcttgtgtgttctcgaaacttatcttttggtcaaccaatgactcttcaaaaatgttctctgcagtgaagtgttttgaggtcaaacatcttaaaatgacatagaaatgaaagttctgagtttagaccactaatggcttctcttctgtcttttaaaacaaggatctcttagttgagcttgaacttagatatctggttcttgatattttcagttattattctgtgagtttttccctctgcatttcccctctcctcatcccattactccacatttcctgtaagcagcggatggatgtgtaatacctaactcagggaggctgtggcagggcaaactgtccagtctgaacatgtaaagggcttaaatgaatggcagttactgattatgaaataattatcttaaagaatcatgagacagaaatgaattccctctgatctatctttaatattttcttggaggaggagagagggaaaatatgtggccccaagaacacagtagacctgccctgattttttggcagcatatggctagatcttagaaaccagaggcttcatggggcatctaggttggcaaggccataggaaaccttgcaagaactttccaagcatggtagaaatcatcagacttttgatagacatggaaagaccaggctgagaggatcactaagcatcttggtgctaatttgtttgctagttttgctgaagagatactgtagttaacctcagctttccaaccccttagtgctccctagagaatctttaaattttgttatggaccataagtttcccactgtctcatggggatgacagcttgaatgtaacttaagttgctttataaaagtgttgattatttctcacatgcttgagtttgtggcctgatatttatattctttgtatatatggatagtattctcttagtcattactgccataaaaaatagattaaatctcataaaatgaacatcccaaagtcttaaaggacctccctctctgggacactttgcaagagcatcctctctacatattaggtgcttaggtattttactttaggagaaaatagaagctcaccattcctttctttcatgaataacgtccctacaattctggccattgtaagcctagctatggaagcaactacaccacaggaatcatcctcttgaagcatctagggtttgtagaagaaggaaaaagcaagcattatatctaatctaagctatttgggcttctggctttcaggatatgtcatcagggcaactgagaaaaagaatttgttttttaggaaataactttgacccatacattcactagtagaatccacgatctaccaattattttggatgaactggcattttgatgtgtactttctaacatatatatgtgtatattctttatcttaaaagtcgaaatgtgttaaaagtcgaaatgtgtgtgtatatgtgcatagaattttctttctgaatcttcactggtcttttagcttcagtgcaaatagagaaagcataagggaaaaataaagatggagagagacagaaattattggcttctctt

SEQ ID NO: 29517 - DNA, 1968 bp, Bovine  19866881014443
tacatggattatgttatcatttaataatttaacccatgacagaaatatagtctgctgatgtatttcataatttaagaagtaatgtcaagtagaattagtaggaagctgcctttggacaatcccttgtgttccttgtgtaaataggcattatttaaatttgtttagcaaaatgccactgctgacaaataatgcttgtactttttgagactgtcatcatttgagaagttgaataaccaacagttgcattccagttacatgcagaatgtttcatttgttacttctagtaacaaaatatatccatgtacacccattgactttggttagtggttataaacttgatatattatgcaagtttgttccttttgttggaaaaagaaaagggaagaattatccatctggctcctttcctgaaggttagcccaagaagggggtgatgtagggtgaagacttagaatcctcacaccaaatcagtgtcttgctgacatcgtgaagccgtgtatacttacgaagtgccaaggttctctgcatggtccctgttacccacctctaattctttcacacacaaggtcttccagatgttcctgaggagaatgtgtctctttataataacagttatattagctatcattttccacatattcctatggtacccatttacaagaatttgtagtacattcccaaacatctgcagatagtatctccataattacttttgaaattactagccacctgtcagcgcagggattactactatgaagaatgtcaaatgggaattaaagttttgtattaggtcaccagcattctaccatagacatattgtagatggataagactgtttcagcacacagttttattagatacaataaatttggaggcgacatactctcctgttactgcatatgcatatttatagtgtgcatatttactcagcactaagtgaaaagtgttgaggatagtagtagtaccttggggtttgggttttagattaaaaagagatgtttggcttcttcatttcttgatcaaaatatatttgtttaaagatcaactggagctatttagaaagcatgcttttttgactcatggaagtgttgtggactttaattttgcaaacaaataaatagattgagaggataacttttaggaattagggtgtgaagaaaacagaagaaataggaggctgaagaatgagtttgatggatttggcacaactctggaatatctcataatgcccatgtgagaagtcagagcaagggttattggtttgcctttgatgtcttcctactcttctgggactaatagataatatttgaaggtttgcagtctgacaagtgctgtgttgagtatttaatatgtgatttagtctgcataatacactttgaagtaggaattaatcttatgatcatcatctcatcatgtttaaaaaagaaaaaagtttttccacagtcatggctagtcagtagtgacactctgacttctgtcatcgacactagtatttgaagtcaccaatggtctccatgtgctaaacctcatgggcttttcatcttatttgactcaatagtagaatttgaacaacagaatacatactccttaaagcattttattttctcttggcttcaaggataatatatattccatacttttctccttctggaccccaggtcataggtgatgtttctttattgtcccagggctcagtcctgagcttcgctttcctagttcattcactgacttggtgatttcatctagtttcaaaacctgcaatgccttctgtaagcaaatggttcgttctgtatatcttcaggctagacttcaccagacacaaggcctctttcagacttcccttcttctctcttttcctctatgtgactgatcagagctaaaagtaagatctgagggttccagtttgggctcagaggccttttatgtctatagcataatacattccaaattctaactcactaggatagt

SEQ ID NO: 29518 - DNA, 913 bp, Bovine  19866881033721
ccaccaggctcccctgtccctgggattctccaggcaagaacactggagtgggttgccatttccttctccaatgcatgaaaggaaaagtgaaagtgaagtcgcttagtcatgtctgactcttagagaccccatggactacagcctaccaggctcctccgtccataggattttccaggtgagagtactggagtgagatgccattgccttctccagagcatgtactagagaataaaattcaacagagtttctggaatgctgggaacaccaggaaaaatgtgtgaaacacaacatatcacaacctatcctatattggcccatctctggttgtttgaaattacatgtaattatcttgtaaggatattgttttgaccatctgtgtcaaataattcagtggcctaaaagcactaaaaattatgcaattaataaacaggaatgatattaaactatgaagaacctaagttctgctgtaatgggaaagtagaccaatggagatcaaaacccaaagaaatataaaacagaaacctttatacaaaataaaaacttagccatccaacatcctgtccgataattaaaataaacaaaatatccatttatcatgttgcactgtctggacttcttagtggaatagtttctgacagtgttcagagaaatttcctttgttcactcacactaaataatctcaaaccagatgtatgatgaccagccaggtttaggtggaggaagactttctttctcgttaacctgttaacagatagtatgtcagtaacaccctgtggtgccatttgacttacaggaataaaagaatacattcctccagtttcaataattccttcataaagattatgtattattcttacaacttttgatttaaatacagatatactttcatcaaatatttttcttctagaatcta

SEQ ID NO: 29519 - DNA, 1064 bp, Bovine  19866881100270
attgagttgatgatgccatccaaccatctcatcctctgttgagcccccagtccacaccctttctctcagtctttcccagcatcagggtcttttccaatgagtcgtctcttcacatcaggtgactaaagtattggagcttcagctttactgtcagtccttccaatgaatattcagtgttgatttcctttaggactgactggtttgatctccttgctgtccaagggactctcaagagtcttctccagcgccacagttcgaaggcatcaattcttcggcactcagccattttcattgtccaattctcatatctgtacacgactacttagaaaaaccatagctttgactatatagacttttgttggcaaagtaatgtctctgttttttaatatgctgtctaggtttgttatagcctttcttccaaggagcaagcatcttttaatttcaaggctacagtcagcatccacagtatgtacatatatgtataactgaatcacttttctatacagcagaaattcacacattattaaccaactattcttaaataaaacatttttgaaaagaagatatgtcttctaagtttttctcttgcaattttctaaaactaattcttgtggcctatatgatatatataggaaacatttatgagttcaactaaaaaaaaaaatgaagatgtcaactaaattttctagcattacagttagatcccaataatactctgaaaggaaactgctttagaaaattttatatcctagtttctgccatcctgcctctaccgtctccaaagttctgcaaattaaagagacacaatctcatttcatctttaaacttgaaacataaggaagcttcatttccttaaaagtaatctccccttctaaaaatctggacacttttcaaaagcaggattgtgaagatttggcttcaaacttctcaacatgttaatcagacttgttcagttagaactgtctaggacttaaagaaaaacaaatgcaggctgtgtctaaattttttacaaaatcatgcattcatgccagaaaacagcacagaactacaaattcaagcaaaat

SEQ ID NO: 29520 - DNA, 844 bp, Bovine  19866881111959
ttttaagactcaaaatttatttacgtttcttttttttccccccccctctgtagtcagggagagggggatgtgaatggcacatcatttttagccctctacaacatggcccatatggaactctttttgtttcacaattcttttgatgctaaattggtaatgattaatctcttttaaattagatgtattattgcatcttgctgtcaaagccctttattttaactttttaaagcttttttcactttttaaaaattttcaatgacttaaaacttacagtgattatgacactgaatttttcacttttttaaagtaaaaatttattaagtaaaaccatttttcagccctgctatgtgtatgtgtcctcagtcgttcaatcatgtctgactctttgctgctcaccagactcctctgtccataaaaatttccaggcaagaatactagaatgggttgccatttcctactctggggatcttcccgactcagggattgaatgcacttgtgcaaaactctcttgtgtctcctgcactggcaggcagattctttaccagtagcaccaccttggaagctctgctgatatcagagaacaattaaataaatgaacataatatattttaattattaaaccagacttagtgactcctctgaagacatcatagtaaaatttcccttagggcaaaaacacactgagttatgttgtaagacaggaggacatttcacctttacctgaaaaatggaatgtattacaggatagattcagtttgaaagactgttgaacttaagtgctgtaattcattatatctttagagagctctgagtagtaatgaatggtaagtagacttttctatag

SEQ ID NO: 29521 - DNA, 1523 bp, Bovine  19866881131737
cactttcacagcatcatctttaggatttgaaataactcaactggaattccatcacctccaatagctttgttcatagtgacccttcttagggcccacttgacttcacattccaggatgtctggctctaggtgagtgatcataccatcgtgattatttgggtcatgaagatctgttttgtattgttcttctgtatattcttgccaccttgtcttaatatcttctgcttctgtttggtccatatcatttctgtcctttattgagcctgtctttgcatgaaatgtttccttggtatctctaattttttttgaagagatctctattctttcctattctattgttttcctctatttctttgcactgatcacggaggaaggctttcttatctctccttggtattctttggaactctgcatccaaatgggtatatctttccttttctcctttgcttttggcttctcttctttacacagccatttgtaaggcctcctcagacagccattttgctttttttgtatttctttttcttgtggatgatcttgttccctgtctcctgttcaatgtcataaacctcagtccttagttcatcaggcattctgtctatcagatctagtcccttaaatctattgctcactttcactgtataatcattagggatgtgatataggtcatacttgaattgtctagtggttttccccactttcttcaatttaagtctgaatttggcaataagagcttcatgatctgagccacagtcagcgtctcggtcttgtttttgctgactgtatagagcttctccatctttggctgcaaagactataatcaatctgtttggtgttgaccatctggtgatgtccatgtgtagagtcttctcttgtgttgttggaagagggtgtttgctattaatttaatattaattaacttcattattattaattatttaatcactattgacatggccactcctacgcaagaggaaattttgtgcttaggagtttcaagaaaaagtccctaaatgtcctaaactcatccaaagacataaaaatcaaattgaaatgaatatcaaaatagacaagtaaacatatcaagtataactgtaaaaataatactttacagatgacttctcaaaagcatattatgagatggaaggtaaattttcactattttatcacttaggaaaaaaggtatggtatttaagaattggtcaacatgaaaaaagatgcacagaggtaaactgagagaccagagatcaagaggaataagagaaacagaagaaataggaaaaaagagttcatgaaaaaacctggtccatgggtaagtttttctgtaaattggctaaggccactatgctgtctggataccacttgaaagacacagcaggcagctgcagccctcttctcaatttttaaaacaccttagattaacaacagattttaacactcaggtgggggcattgtttctactgcatgttttttcattattattattcactaaaatataatagaaaacgcaaaggagaaggccta

SEQ ID NO: 29522 - DNA, 851 bp, Bovine  19866881143210
ttgcgaccccctcctctgtcctggaattctccggcaagaatactggagtgggtaaccattcccttctctggggaatcttcccaacccagggatcgaacccagggcttcttcattgtgggcagattctttaccgtctgagctacacgggaagactatatatatacatatatgcacacatatgtggataaatttaacaagaattgtgcatgcctatatgaaggaaatggctggattttactaaggggcatagaaaaaatttttgagtaagtgatgagagagaaatttctggagaggaagaagtcaattctctccaagttaacctataaacttcacacatttctaatcaaattcccagtgggacttttttggaacttgtcaaatgattctaaacttcatctggaaaaaaatttaatgatcagccagaacttttatttttaaagaagagcaatgcccccaccagattgtaaaatgtactcttaaaccataaaaataatatacaataggattgtgccagactagacagaaagatctgtgaaacagaagagaaacccagaaacagaacaactatatatgggattttagtgtatgatagagatgacatttcaaactcgtgaggaaagaatggataactgaataaatggtgctggagccaatgggaaacaacctcacaccttttaccaaactgaattccagatcagttaaatatttatatggaaaaactgaacttagaaatctgctggagcaaaatagaagtgagtatttatacactgaaacagagaaaggattttctaagaccctaagattttctaatacagaaagaagaaagatttataaatctgagtacataaaaa

SEQ ID NO: 29523 - DNA, 1023 bp, Bovine  19866881160847
taacaacagtgttaatacatttatctgctatatattacacctgtggagcttatttatcttttaaaaagttttattggtgtatagttgatttacagcattgtattagtttcacatgtacagcaaagggaatcagttatacatatacatttatatactcgttttttaaaaagattcttttttcatataggccactagtgagtattgaatagaattccccaggccatacagaagtttccttaaatcagggggtttgactttgtgatacactctctctcagtctccatcactgagaggagggagtggtttagagcatgaatctcagtgttggttactgaatttggatctgtcattcatgagctcttgtgacctcaggcaagttacatgcacttatctaactaagactcagtttcctaacttggagcttgtgaggatcagttaagataatgtaaaagaaagagctgcgttagctgggaaccaatgggagagtcctggagaaggaaatggcaacccactccagtattcttgcctagagaatcctgtggatggaggagccttggtgggctgctccacccacgcatatgtgcaaactcagatcaaaattctacttctattatactgtatatggaatctaataagattcagtagctccattatgcattattttctcagtatctgttagccacaatttctgaactttaaagccttcttcccttgctattaatgtcctgttcatttgcaaattttttttgtaacccagtaaaaccacccttttgcagcccaagtttaagttatttgtttgcttgcctggggctgaccatgcacacaagctgagtggtcaactaaagtgttaggttattctagattcttgattcataataatcatctaaaaacactagatggcacaggagaggtataaatggatcatagagagagcccagtgctcaaactttatgtgtttctaaagaattcttatggttaaaagagcaacattttaagatattcttgtatcacctatatcttgta

SEQ ID NO: 29524 - DNA, 1896 bp, Bovine  19866881208442
ccccatcccccaaacacaaggaaactcaagatcctggttatttatatgataagtttagatgataagccttacttgataagtgtacgaattgaatcaaaatattcagtatatttttggttttatgcatcgactgatactttctgaaagatgagtaatattgatcctcacatttcactattgcctttaggattagtagagggaattgttctcatggtgtcaaactgctttggatgaagctctctctaaaagactaaattgcaattatggaatagagtgtagtgttagcatgaaagaagattggataggccaaagtatcatcattaaatacgatgcacgaaacatactggctcatgttaattagtctttcactgaaaagcaaggcgctccaagtgactgtgggaaagtgacttggtgatttgctactgctggtcagtctcacaaaaggagaattgtctattctgaaaaaaaagaatctgttagaatttggatatggtgatagtaagagcaacgagtcagaggaaatctaaaacctgtgggattgatttcctaagaatataacttgaatttatctgtggggttccaaagaagactagtggttagcagattgacatcatgtgaactgttcttttatactcattcacactattcaggtgaacaaatttaagatttggtggaaaaggaaaggacccacattttagatgttagaatcttttcagtacagcacccaaaaatagaacgtagaacagaatcaaaagaaactaacttgcgatggaaatcctttatttgcttgtaatttctaggtgcggctgttgcctgcacattacttccttggtttggacacatgtagtagttgtaatcttgtaataaaagttaaaattatcctaacaaatagaagccatactcaaataatacattctgacttttagtaatagcacaaaaaagcttagatgaggaaatggaagattggaattcccatactaaggatctgccacagacaaaatgtaggttgatcgcgcaggttttaggttcttagtatagttaacgtccattcaatggctaatgaccaagatataaagaaagaagtagagcacacttttatttgagcaaatatgaatattttcctgtgaagcaaagtattaataatttcttctgtcaattatttttattttatagtgtttatgctccaaacagcttgaaataaatgagttgctgaattcgttgggtcaaattagtccttttcttacccttgtttcctttattctcctctccctcctcctttctttcctttcttccttcatatttattgagcagccaactaatttcaagcgtttgggtaggtgctagtgacataatgattaaaattatttcccaccttcattttttggatgagtataatgcagctggttttagctacaaatctcttagtctaatgggactgtctgcttgggttacaaattttctgagcactgctgacacagaatcatgaagaaacaaacaaacaaaaaaaattcactgcagttgtgaatggacaagccaaatatctctccaacacattgatttgtttcctcttatattatttaaaaaatagcaaattaaaaaaaaatcaaatactatgaaactcttggatataatctataaaacggtttttcttttttttaaaggagaatttgctggggtcatatggtaagctagaagtgcaatcaaacttaatatgttagtgattttgcatttgaagtgcatcaaattacttcattcaagtaagatatctctagtctaggacaaaaagggctgtgggatattaaagagggtgttaggtgatgattcggaaatacattttgtattaagagtagaattgcatctgcctcattcagtgatctaatagactgtgtttcagac

SEQ ID NO: 29525 - DNA, 1556 bp, Bovine  19866881260463
acttagcagcagcagatcataaatagtattggaaaatagtaaagattgtcttttcagactcagaatatttgtgtctgttttctcttctgcccttaattctcttcattgtttcctcattctcaggtctcctcttaaaagttacttcctcagaggtgccaggaagatataaaatgctttgggcatagactctgtagttaatctgcatgtatttgacatctagctccatcacttactagaggctaacctttagcacattccttacccattctctgccttaattctctcacttgtgaaatagaaacaagaagagacttaccacattagtaagttatttaattcttttgaataatatgtggtacgtagttaagcactctacaggtgctacatatgttgaatgaggggactacagtgagggtaacttattgtatgtctccatcatgaacttcatttcaggtcttactttgaataatcaggaagtaacaccttgtaaagtgcaacaatttataggaccattaaattgatgttagccatcatacattttattctgattgtcataatcttttgatatagtttgggcagatattacctttctcactttataaggacttcattatcttgagtaaaagttccaacaggaagtagctgaactagcacctcagtctatgccttctttctgtatacagtaattattctatatcctgtacaccttggcagattttaatgagctcttaaccatgttcatgttatagtttaattagtgtcccattatatctgagagaaagtaatgaaaataagaattaaaaattactttcattttagccttcaatcttcctttaacactctgggcaaagctgtggtttaattaattaattaattaattaaagtttttttctctgctgaaatgcaccttagaaatctcagcatttagaaaatgatgataattatatagaaaatgcaagtctaaccagcatttctgttcacaacacctaagaaaacgaaggtgactattttgaaggaaactgagatacattctaaaggagatcagccctgagtgttcttcggaaggaatgatgctaaagctgaaactccagtactttggccacctcatgcgaagagttgactcattggaaaagactctgatgctgggagggatttggggcaggaggagaaggggatgacagaggatgagatggctggatggcatcaccgacttcatagacatgagtttgagtgaactccgggagttggtgatggacagggaggcctggcgtgctgcgattcatggggtcgcaaagagtcggacacgactgagtgactgaactgaactgactgagttactatataattgtcccagttttcacttcatcttaaatttgtgtatgctacatagaatcactaaagatttcacaagtattacattagatttaatacatagctatggtgaatgtaattacagcttactttccaggcctatgttattgtcaacagtttacaatattctacatttatgtcagcttttgttaccagatgctttgctatgtttatttgctatcaat

SEQ ID NO: 29526 - DNA, 792 bp, Bovine  19866881266445
gacctgggtggatctaaagtttatcttagtacaatctgttaaagacaattaataaaatgaatatactaatagtgtaaactatatgagactgcagaggagattggatcaagatggaaaaatgaacacatgcttctatttttcctcccatctcaaatccttaaacagagaaactagatattttaaaataataagtctatagtaacattataaaatagagaatgactataatcaaacatatgaaatcagttgactaaggaaactatagcccttcaagtacacaagagggcagggcaaaatatatgaggaggagtctaggtaatttcttcactttaagaacactggatctcagagatgtctctgagaaaaatcaaagcagttagttgaagcgtgaaactgacacaagctggtgaattgctccacaactgactccagagttccaagcctgatattttttctttggcatagtgtgcataaggatttgggtcagaggagggctggcccttgatggtttgtgatactcaggtagaatagaaagcctgttctcctgtaaaatgatttgctagtactccttggttaggtggtttgtcctagtcctttcccagagtgggaagaccacagtaaatatgcaatcataagcttgtagcctgaaagttatcaggcattaatgacaatgaactgaatgaatataacacctgaaaaaagaaagccagtgaagcatacaggtaaaggctttgaaataagtgtaaataatattcccaaggaataagagaccatatctcatccataaacaag

SEQ ID NO: 29527 - DNA, 815 bp, Bovine  19866881280709
tatatgtcactatgtacacacctaaccattacaaattgttttaaactgaccaataaatgatgaatcttaatataaagatggttttaaagactgatgttcactcaaaatgtatatcacatgctaattatgaatcaagaatgtattttttatgttgcaatctgtattttaaatggaatttttcaaagttttgcctattgctacaatattcttaaaaagggatggcatgattttaatcatgagactgcataatatagtaaactcatcaaaagaaactgtttttgaaaacacataataaaacacaaggcatacatataaagcagggcatttgaattacattaaaaggcaaatatggaaactcactaatctagaatttatattttacaggaaagcatagacatcttgaaaacctcaagaaggtgcagacaagagcttgattatttggacatttgctgtacactctccaaaattttcttagatagcatcaccaccgaattttctttgtgtatcattgtaaatcttatcttttgccattgctcagaaaaatttggaagctctctaaacacactgtatagaattctaactttaaaaataatatattatgtatgcacactaagtatgagaattcacaataagcaatcaactataggaataaagtcaaatttgccaatattaatggagtttctccttcatatatatagagtagagtacatgtcctcagcttctgtggggacctgtctggcactaaccatggtgtaatggtccaatggaatcatctcaggcattcagtctggcactatagtcaaatccttatatca

SEQ ID NO: 29528 - DNA, 1427 bp, Bovine  19866881367408
gggtaaaacacctacttgctaatgcaggagattaagagatgcaaatttgatccctgggtcaggaagatcccccggagaatgtatggcaacccactccagtattcttgcttggagaattctgtggacagaggagcctgatgggctatggtccacaaggtcacaaagagtcagacacgactgaagtgacttataatatgtaatacaatgtaaatgctatggaaatagttataaatacaatgtaaatgccatgtaaacacaaattcaagttttgctttttggaattttctggatttttaaaaagattttttgatccaatattggctaaaaccactgatgggaaacctgcagatacagaaggccaattgtacactgtttgaacattctgattaaattagtaggcaagtaaatagcaagaaaattttaggggaaaaaaaaaacccagcatttttcttgataaacagtctcccttctcatcttgggtcaattcagtcaatatggcctcactagctatgcacatagatatgtgtacaatcttgatttttctgtcacagaattgaggaatgtaaagcacaaaaacagcattaaattgtctagctatatttggtaaccacagacttgatgacaaagattttggctgcttgtccaaatcattctgaaattccaagcatgtaagacttttccctggtaatttaatcataatatctttggagaaatttcgagttacttcacagtaactgaaaattttcatgcagataaaattcttaagaaaactttaagaaattaacttgtggataggaatggaatgtgttttgcaggactgcagacgaaaaaacaaaatctaagaactgataggtattatattttattttatgttatatgctctcccttccaaggtcatatttatatggatcataaaatagaattatagaatttttaacagagccaaatttaaattaacaaaataatctgaattattattctaataataatcattactagattacctctagtaatcatcattaatatctgtgtgcaaaaataagcacttttctgccatataactaggtgctagaaggaccaaaagagaaagtttagatgtataactgaagattaaatattccagggatttaaccagagttgatataaaataactgtgtgtgcatttaagtttcaaaattaatgtgtgtaaaaatattttactattgtgtgtttatcctaaccaatgatttttagccctttagtcagaaaaatacatttaaagaaatttttatatgagagtgaaatatatttttttaatgacaagctggaatcacagaaaactaatcaaaatgatcacatggattatatcctgtgtctaactcaatgaaactatgagccaggccgtgtagggccacccaagaaaaatgggtcatgatggagacatctaa

SEQ ID NO: 29529 - DNA, 740 bp, Bovine  19866881391626
ttatatcatattttcgataaacatgtctcctcctacagaccacaaagactagcagagcataaaatgtcctattagagacattctaataggtgcaaatatctaaatgacaaaaattaaatgaaaggcagctatgtcatcacaccattccccagtcctctactacgtgaaaaactaagaatgaaattagctgggagcaaatgtgacactgactagcctattagaattaacccagtgctactataattaatagaattaaaataattaacagaatttaacagacctagttccaaaacatgtggtgggaaacctcttgctgacagaaagatactggagagcattaatctcagcattccactgaactttaaagtaaaaaccacaactcagttgtaacccaaataatatgagaactgaagtgaaatgaaatgaaagtcgctcagttgtgtccaactctttgtgaccccatggactacacagtccatgcaattctccaggtcagaatactggagttgatatcctttcccttgtccaggggatcttcccaacacagggatcgaacccaggtcccatgcactgcaggcggaatcatgagaacaagaagacattaattaccctactttaaaataactgtctgactagaactctttataaggatcacaccctctcacatctagtgcttgataaagaatcacattttttggtctcgcatttagtgcttcttaaagattcacatttttttggtg

SEQ ID NO: 29530 - DNA, 1025 bp, Bovine  19866881393571
ttatcagtgtaaactgaccagtagaagattgtttgcttgagattattgtggttgtttgactttagctaagaatattattaggctctgtaaaatacaggtattgtcaactagaagcacttgtacacatagaggccagatttcagttgtctatgcacaggaagaaatatgaacttcaaaggaagctctcttgttaagaaacaatttgaatacacataaaaataatggattgagaagaccagttttaagaacgaacaataatacaccaccatttcatcttccatgaaggatcttaaagatatatttaaaaaattagaatttgaagttagaatttctgggcacatgactgttgaataaaatttactgcttatagattcctctgtcactgtcataatcggtgcttaacttggatggccgtagatatagccttaacacttacgaaaatataaatacttttaaagcttggcatttttctaataggtccgatagtcagtggaaaatatgtttgtagtactgaactttcaagtcgcttaacttttatgagggagtaactttggtgccgggaggatctggttcacattttcgtttctttttcttgtactgtatgtcaatacagagggtgtggttccccactcaattagacacggtccctccccagtggatttaacactaaaagtaaatgggtttccaatcaggctggtgttgttcattcacaaaaggaaaataatttcaaatcggagcatgtgtctgggcaaactcatactgctgatatgtacaaaaaaagaggtttagttcacacatgttttttattgccacacagggatacaaatgagaaaattaggctataagacttgattaaagtttcagtatatgggcatttttaaaaaagtgtccatggaacagcattctgacgttttcccctggctttgctatcctgttgggtagcaacaagcccctctatagcaagcaagcttgatgctattggtgccaaaatctcttcccacgtggtatagatctgtctcatttct

SEQ ID NO: 29531 - DNA, 1048 bp, Bovine  19866881452460
tgtatcatattatgttgtatgtttatttacatagataaaaattataagacattttacaaatattaaaagggtttatctctggaaatggcatgtgatgtttttccccaaatatagtgctaaggaatcctaatctaattaaagaaaccaaaatgaagaagtactcctgattgtcatcagatgtaggggttggtttagataaaggaacatactgatcaaaaggagcggaccccttgagatgcatttgacctggacaattccttcaataatctggtctagcaggctcaatttctccacattccctctagtccagtcccattaaatcattctaaaggggttaaataacagacatcccaacccagatgccaaaaagcatttgatgatgggttagatctgccaagcaatcattgctattcatcggtaaaattagatgtccatatgaatgtgcgtatagaaggaaatttcagtatgtattgtaactgtgtgtggcagtctgttgccatggaatgctcacttctctgatatttactgtcagacttcattcacagatatttcacaggcagatggtttctttcactggctcaggagccacttcaaagtgttttgattcctgaccaagtcgtatattatacttcctttaggaagattttcttcccagctgccgactttaaaataaaatcaagaataatcaaaaggttgcacaaccctttcagcttaactatcttcaaagagcagacagcaaaatcttctttaccatagcgatgtattggaaattaaataatatctaacacttctttaaaggcaacattagcatcatgggagaggctcttattaagacaactgacagaaaatgtaacaggaaaatccacagagatttgtgtttgtcatttccattactttcaaactaaaactgaaggcgttgaatatactgttttttctcttaatttgcattcagccaacccattcagccctgaattctttcagcattagaacattctcccctgctgatcagaatcggaagttgtaagatatattaactttttataatata

SEQ ID NO: 29532 - DNA, 2365 bp, Bovine  19866881494563
tgcgtgtgtgtgtgtggttgccgctcagttatgtgtgactcttggcaatgccatagactagcccaccaagctcctctgtccatggggattctccaggcaagaatactggagtgggttgccatgtccttctccagggatatgtcctttatcccacggataaaactcaggtctcccgcattatggcggtttctttactgtctgagccaccagggaagcacaaatatttacatatgtcatattatatattgtattaaaaaaacattcaaggagaagaaagcaacaataaacatcttattgcacaaattttcaaagacaaatattaaaagttgttcgaaagagtatttttactttaaataattattagaccatttttgaatgtctgcaatcttttcaaaggaaaaacagctatggcaaatttgtctatggatacattacttagataaatatgagcagatggcttggtaaagctagccaaatctccatccaagttatatgctttgtgtgggtaaattttacataatgattagatgagttgagaggtcgatattgaaatgaaagtagaaaagcatttctaaatcaggtatatgatatgttagaattaagtcagtgcatgatattgagtgcaatatgtcacagtatttccactcatttaattaggcataattatggtgaaattgtaaagtgtgcaaaatgcagagtatcacacagcatatctttagctataaaaatgtacatacactttataaagagttctctgttaaggtaaccatggaggacttttaattctatatctttctcatgtagataaattaatgttgctgtgggaattttaacttcggaatttcctgactctcacatgcttaatttctcagtgttaatgttccaataccagatctgaatgactacacatcatggatatttctatctgctcaagatgtttctagaatgtaatgtttaacctttaaaacaaatatttgagagggcagaggcaaaaaaaaaaaaaacagaaacaatgagaatctgttcagctgattagctaaaaaacctctttatttacagttgaatgagggcatgaaaaggaatgaactcccacagtagagacataaggtggagaaataacagaaaagtaatgattataagtgtaaaatgtgtgggaaaaaaaccctcagactggaggaaatgtccaaattatacaacttaataatcaatacttgagattaaaaacatagaacttcatcttaataagtttcactgagttaaacaatacaaagcaaaaagaacattttgagataatttactaatatatgctcacaaagataacttagaatgagatgtgatgctgatggttggcaccgtagggagattttgaaatattagtatgcctccctcaggaaggatttggcataatcaaccatgtatggaggtgctctcctgtgtatacagatactgctggtattctgcttaattgtttaagccaggaaagtgggcagaaagaaatgtatcattatgatctgtcatatttataacagaacctcatgcttggagactatagtggctaactggacacaccacatttttaacaaacgaggctcataagcctgccttccatatgatccggtgcttggaggattcctggcacctgtctcacagacatctgtgagaatgacaccatttagagagttggatgataccagtgagagcaccctgactcttacttggtcaactcctcctctaatgggacaccatttctccttccctccagttctgttcgatatgtacatgtgatttctatctcattcctaatcatcattcactgattgggaaaagttgaataggtatctcaaagcaagggatatgtgtgttaggattagtatcccaaagtttttgctgtgataggaaaatcttcatttctaaaatttattcatcatttaaaaattttaaacactttgtaacgcttttcatatcgcctatttcctgactttaatacaggtagaatttgtattgcatttttaaatgagaaacaaaaaagtgtctttctgtgtgtgcatgttgcattacaatgaattaaaatgaggtttaaaaaaaataaatgaagttttaaatgctggaaaacgtctgacagtaagttctcacaaggaactttagaaactaatttgttcaagtgaaacagataagcactgagtcttatcaccaaataacctaaccaccaaaaaaagaagtgccttgattaaaaaaaaaaaaaaaacattatttttatatcattagtaccatgtaagtatttattatatagcccctgggtttgcaaaatacaagctgactgccttggtcctataaacgtaaatcatcctagggaaaaaactacaga

SEQ ID NO: 29533 - DNA, 2016 bp, Bovine  19866881517416
aactagatgaactacatttcttttaaatatgtcctgagtaattattcaaagaataaaagggagcttttaagagaaataactatagctcttcaaccacaaaacaatagtatatgtctccagactatttgtttatgaataattcagcttttatcaccaaacatgcttgatcatttcaagtgtgaagcccatgaaatgtcatttcaattcattcttcaagtgtcttcttggcagtcagaggagagaattataggattaagaggtctggctatatataaaacaaggcagaaacattaaaagctcttcttcaaatgcaagactgatgtaatgattttaatgagttgcatagtattgttcttcattcttaggaatggattatatttctggaaactgacttgcctgattaggtttcatccagtctctctggattttgctgctgaatacagtcatttctatcacatgaacagcaggatccaggcatctgcctctttattgtggcttccatggtattattgttgaatgtgtgagccagtaggctcttgctgaatgaagtgcacaattcaaatcataaagtttttcatacaccagagaacactttggaggcaacccaatggtgaaatacaatttctatcccaaggagctatttgctacagacccataaggcacaaaaagaataagctttaagaacagtgttctcaaagtgaagtctggggaccaactccttcagaatcatctacaatgatgaataaaaggagattcttgggtatctctttagatacatgcaatcgtattctttataggcaaatcccaagcatgtacacaagtttgcccgatgatcctaaaaatttaaaagccactgtttttaaacctatgcctgccctaaaaaataaagtcttaatttttaacgttattccaactttttctcagttctaaagtctcttttaaaattttatttatttatttatttttgactgtaccgggtccttgttgctgtgcaggcttttctctagttatggagcatggggctaccctctcattgtggtgtgcaggcttcacaatggatggcttagggcatgtgggctcagtagttgtgatttccgggctctggagaacaggctcaatagttgtggcatacaagcttagttctcccatggcatgtgggatgttcctgggaccagggatctaatctgtgcctcctccatcgacaggctgattctttaccactgaggaaacagggaaaccctgttttaaagttttgagtccacacaactctcagtttgcagtgacggtcccctgaagaagacttatgtagcacttttttgaataggaccagtatcttactacaggctgtcatgtaactcaaatgagtagggtataacaatgctggggaaatgtcccagtaaggatgccagacataagacttgaatgaaataggttaattcttatggcatcaagagaaatcatggcatagagcttttcaaaaatattatacaacatataatatgaatttcagtattcttattgacatttctttcccaaactagattgtagtgccaatggcacagttgagacataccacacacagcatatgttagaaaaacagttgcttttctgcaatatccacacttgccacacatcctggaacttattaaaattctgttgaagtggtcagactgttcttagcatgcttgttttttcttggggaaatccattgacctttcaatgaggaaacattcagttaccacgctattcctggtttaaaaataatctgcaaactctgccttgtaaacacttacagatagaccacagaagtccccagagctaccttggaagcagaccaaatttatctcaaacatatcttgttcatgtaaaataaatattgaaaccattattccagagaaactatttttctaaaccagttgcttttccaactgaaagtcaaagcatcatcatggaggttggaaacacaaatgaacatgtttgggaaattgccagcacagaagagggaggaaggcacag

SEQ ID NO: 29534 - DNA, 984 bp, Bovine  19866881611647
cccatgaggaagccttggacataagctgtacagttcattctgattgctaccaagtaattctttgcagacctatacatcaaaactatggctgattttcagcagtatgccgtcatgttttagaaattggctaattaaaactttatgagtggacaattaaaagcaaagttatttgagaatcaaattaattgtacatacaagaacacagttgtttttttttaaccatagtgcatatatatttttaaaaattacttggaataattgctttacattgttgtcttggtttctgctgtacaacaatgcaaaccagtcataactatatatatatgtgtgtgtgtgtgtgtatatatatgtacatcctccttcttgacatacgtattttaaatatactttttttttaaatttgtgagagggggaaatgattagtaatataatgaaatgattatttttatttgacccttaaatcttcttaaagtttcatttggacttgcaccctataaagaaatctgctctattctttcaattatgctatggtatgctgtgccatattttcctgccctgattctctaaatttaagtgaaataaacatggatatcgagggcagaaacacttcagtagtatttctgctgctataaactcttacaaagagtttagggggaacattttttttttcctttttaaaatgtgttcctaacaaaaagggaaagataaacatttcaagagaagaaaagggtcagaaacttagaaaggttttttgttgttgttgtttttttcttaagttcgatgtttgactgatatcactgagacaacttaaaacatttgcttgatggttaattaatgataagcctagtatcagttgcagtgtatttatttgagtatcctggtgggcgttcagtttagattttcatttacaaagctgtttcaaatatcaacaaaaagagtcatgaaataaacaaagcagcagggcagtatttatagtgtgcttta

SEQ ID NO: 29535 - DNA, 1980 bp, Bovine  19866881668141
tacttgacttaatacctctcagaggacaaccatttttactgttttgtaagttattggggagggggtgtctgactattaaccacatgaaccaccaacaccaacttgtcaggatcaagacctgtggcccacccatactggccccataaagaccgcacagcatattagctcagtcacatcttgatattccatctgggccaggcattatttaagtgtgtctatcagaagacctggccctaaaacgtcagtaaattaaataatccaaagtcaaaggtggtgtactttccctccactctctaatttataggttccttgaggacaaaaataaaggtgaaagcgagtggttggactgagctggtttagggagtgtgaaggtggcctctttcagagcagggggtcagacagtagtctggaatctaggctttaaccataaagccgccatttcactgagcctcgggggtcactttataggtgttctataaacattttatagctagactctggctgttccttttttataactgcccatcgcatcccttctggagatgctgacccagcagggggtgaagtaatagccagttatgaagatcagaatggattgctttcttcacccactcacctttcacctactgtttaatgaccacccagccattccctgcacaaccaagagaaatcagcaggagcagctctgaaaggacaaacaaagaggagtttaggcctgaagttctcactgctgccactgcgtgaataaatggcccattctgttgtgctttcttgaccactggcaggattgtattttattcattaaaaaaatcaactgaatctgatataggaagaaccatgggaaggtacagaagaattggtaaggcttcctcccttgtcattctgagagaaaagcaaaattatttttttctaaaaatgaagtatagttgattaatgcatagcactcacataacagttaaggggaaactcagtgctcatacaaaattttgagattgtgtataagtctttgctatggagggaaaaatatttaaacttataagcttgtcttaaaatatcacagaatatttactttctttcaagtatagttctgctgtattttaatgtcattgtagataaaatgctgtagataaaaatgaagaataaaaagtgatattttggttactggggtggtaagtctttttttaattttcaattttatattagagtatggttgacttacaatgttgtgttagtgtcaattgtatagcaaagtgattcagttacacatatacatctatccctttacagattcttttccatataaaccacattgatataacttttcatacagtatattattataatcatgctattttattagttattgctgttaatctactgtgtctccttcataaattaaactttatcatatgtatgtataggaagaaacaaggtatataggggttggtactattcatgttttcaggcacctactggggtgtaagaatatatccactatggataaggggggactaatgtattgtgattttcttctttttgtcacagtatcaattttcttgcattcctctgttttggaatgctgaggccagatcaggaaaggactgccgctgaaaacacagtttgttactcagagtccccaagaggaggtgcaccccaagccatgcaaggccattgaaatgtgcttatagaaggtagggccagatgaaatactaagaagatttaaaaaacaaataaaattgtaatttggatgtatgaattacattatctcctcttctttgcttccctggagaagtgccaggatcgtcaagagggagaggaaccaagggaagatgtgttgaagttttggagggaaggaacaggtggggcaaagtaggtagctgagtagtttgaatagccttagcacctcccagggtatgggagctggccttaggtgcctggtacctgatcctgggatgattagggcaggagaatattggctca

SEQ ID NO: 29536 - DNA, 776 bp, Bovine  19866882055158
aaataagctaaagagatcctacctccttcacttgatttcctcccagtggttacactcttgaatatatacttgtataatactactatcactaaccaggaaattaacattgatataattcactcagcctgatttagatccatgggttttttgtggactcacctgtatgcatgtatgtgtctgtgtatctagctctattcagttttattacatatgcagagtcatgtgatgcagaacaattgcatcatcatgagtatccctgctgctagttattagttcttgatgggagaataaatcaaaagatttattaccaattaaatagcttctctaaggctatgttctacctaaaatagctttgaaagtatgctaagtgactaagaagacagaagtatttaaccttcacactcattctaagcaataggctgaagctgtgtgagctggtctccctgtggagttctctggaaatataaacaacaaatgaccatgctgctttagaaaggagaaattgctgagcagagtggaggaagattttaatgatatgcacagcagaataaggcagggctttaaggacacaggttaataggtcttttgcacagttttaaaaaaaggaagttaaaaattacagtcttacattcttttgtgtaaaaaagaaaaaagcaatgtcagcaagaattaaaaagaattgttgctggtctgtgctgtttgaaaagagttttctccccctgggaaaacaataaaaaattatttgcctctgtatcaagtttaggaccacttaccaa

SEQ ID NO: 29537 - DNA, 804 bp, Bovine  19866880473176
attgcttgatagagaagctgctgctttattgtgctttatcaggattctaaggctacaatccatgccttgattgattagcaatgtctgtaatggatatgggaagggatgatggcagtgtgcccataatgcatttgccaatcctattttacagtcttttttattcttgtgcagacaataaccttttttaaggtacaaaatagcagactgaatggtttagaggagcttttcttagaaaagtgataaaacataaactaaagagatactcatccctacctaagcagagtgttttatgatttcaaattggaggattcattgttatgtgtgcaagatggattttcttggtgcttatgtctacatgcaatgaaaaggaaaaattgtgtgtttaaatgtgcataatcaatgtcctagcttttacctctgtctgctaaagttaaggtttatacacttcaagttttcaatcaagtttttactttccttggggggtgtttgcaacagtcttctctcccatagtgggacacatccatttctcctttttctctccttaccctcatctatgctgatgtctgggaagccacttgatggtgtcgtgctgctccaggtacccatggaaaaagtttgatgtcagtgccaaggatgccatcttcagatgctctgaaaccataaatctttgcgggcttgtggcagttgctattcagtggggagatggacacattttgcattctgggcactaaggcagcagcatttcatgtggtgaatatacaacttctgcactgcagcccttgtctgcagagggctcacatggca

SEQ ID NO: 29538 - DNA, 1558 bp, Bovine  19866880521764
ataaggtcctgcacatcacaagatcaagtatagacatacagaactgtggaaaggcttaggagaaacttaactggaaagaatatgagtgttgtagttgagtggactttaggagatatagacatatttgtggaatgcatcatttttataatcatttctatttgtgattcaaattcaaggaagcaagaaagttgaaaaaagtattgacctccctgtatcactaattctcaggctttccatttatgtggggatttatttccaataatgatgtagtttagatgtaagctgattcatgctttcttagtaacagctggagtggcatgggctttttttctatcagcccaaatatttcttaaaaagttcacatacatcattgtatcataaagaattcggtattagccctgaccttaaatatattggcatagctatttattcagtcctgagaattgtcagacatgttgatggtgctccgctgagacgcactgtggctctcaccacacagcagagctgagtttgttgggattggtgccggatcatctctgccacaaaggacagcttctctcgttcccttttgactttgccttttatccttgtaattaagacttctttgattttgtttggcaactcaccatccatggaaaaggatggcaagcctaggaaactgacgctttcataatttcacagggtccttgattaaactctgttcaattctgagagtcttaatcaaggtaattgtctgactgagggtgtctgcatgtgcatgcactcctctggtgggttcctccaacagctggaaggtgctttggatgtggcggctctccataatgggcccactgtggaggagcggtgtgcctggatcagtggctctttttagcgtagtcctgagtgtatgtcttatattgatttgtttttaaaaccttccaaatgtgtgcaaagcaggctgcttattttgtgccagaagactagattaggtaatttgtgataatgctacattcaaccctttaatatatttcaccataattctcacaccagagtgcactagttacttatctagcacactcactactttccccaaaatacaacaggaaattcaatccagagaaaggacagagggcatcagtcattttgtgccattacaggtttaccaaatgctacatgttttaactttgttaattagccaacagtgcagaaaacacaaattaaaataaattgtaatgttagaaacgttgctgtcaaggaaatataaatttctgttggtcaaaatagttttgggatctagtattgcatacaactactgaacttagcagtctgttttgttatagtgttttgtccaagaaagttcatctggagttgggggtctaaagattttcttagaaataatccagtcttttccctttgatttatacctcatacatgaatctgtctaaccagagctattatctatttctgttttccatttctttccatcaaggccttcagtttgtggatggaggctagatgagaatcctttagtcatgacatttcagaagaggaaggctttggagagcctccaaaccagaat

SEQ ID NO: 29539 - DNA, 1615 bp, Bovine  19866880566454
accccaccatgaagagtgctctttctgagtttgctattacttaagctttgcaagcctaaaagggtattctcatggtatatgaagaaataatctgatttctccctcttctttgttttacgtctatgaatatggtttttttcattatatataatcagaaaactcgatgtctgaggtgaggctggaaattaacaacagccaagtattgattgatttgtttttcattttgtaaccatttgctaggttattcctacttttttttaaggtaacttgaagaaatgcttttacagcagccagctacaacagaagtcagtttctttttaagcaaactagctctgcttgatgcttttttttatgttaaagctgaaaagaaattcacacctagtcacaggatatataaattgtagttaataaaccattactctctgtgaacattatattctggattcctactattatatattccttaaattaaaaaaaatttttaaatctctttccattcaatgcaagtaaaataggcttaacagtaattgctgattatttttgccagatttttttttattagaattgcatggtaactatcaaaatgggtttgcattttcttcaagaacattaattttcagattaaataaaatacatggtcttattttaaagcagactcactttatacaacagaccaattttttaaatgagctaccctacacttaatgtcattagtaaacaatgcatttattcacataggaataccaggctcatacatttaaaacactttagcatcttgttatgccagctgaacccctacacagtgatataacctaacaatagatacttatataatcaaatgagcataggagaccagattttccagcacagatgctgcctcttatctaacctgtctaggctaatgtcaaaatagtgatcattatctctatatgttgaatctctatttggtatttttctggaaagagtaaaaaaatggattgtcatccacatattttcacagaattccatggaaagtctaccaagttaaatttcccagaagaaaatatctctagggattatatcataagagctatggtatgttacactgcttttgcatggaggtaacagtctaccatgttaacatcattctttattacagctaacaattattaagcacttatagggaaacgtgctaaatccttcatatgtttaatctcattaaatacaaaagccctatggtagatactatttccccactttccagttaaagaagctgagattccaaacagatacacagtgctagaagatggcaaacgcaggattcgactaagtctatttaactcaaagcagaaaatcacctcagacaactttctgactttctaaaatagtgacttttttttggtcttactttatgctttctgtttttctttaaaataaaagcactagcatttgctggtaaacagaaagctttgacattaacttcaacacagttcaaatacccatataagttatttgcaggtaaatgactttctttattttaaacaactgtcatattgtgatgcttctaagagataaaataataaaaattagtagacgctcaaaagttgcattaaattcaatttcttacttgctatta

SEQ ID NO: 29540 - DNA, 1200 bp, Bovine  19866880590059
aaagtatttcaatattttagaaactggtagggccatgaaggtggtacagcagtgtgatatcagccctggagatgttcccagtaacgtgactggactgaacattttaacactcaacaagagtatattgatcagacgagggaggtggttagtcacagagtcaaatgccagtatccaggcccattctgatgctgatttaatttctctaatctaaagagattttggtccattcagcaagactaatcaacggtggaaactgacccagcttgctctctgcacctgtatctattaaacactcaagctacataacattctatttccatatctgttttaaaatgttttgtttgaacttctctgctgcttttgctctgttaaacagctaagatgaaaatctttttatacagtcaagtgcgtgttgagctaacgtgaaagaagtaggaataccatctctgctttcagcacccttccccaatcaagtttaagcccaataactgacacagatcttgggcgaggggatattcccaggaaaagcttgattttgccatgcctcatatgtttaatctggtgagtcttgaaagaactgttagggtgacaccagccaagtcttacattaaatttgagttataaggaaaaataaaaaaagacaagtggaattatttccttagcgttggtaatgctgaaaatgttaacaggttcaaggaaggtttgatgaggccaaggatgtcaaatctgagcagattagtgtcttctcaagtcctttgacatttacgtgatagagagatactgtctttcagaaagacggtgctatcaagggggattactgggctggctgaagaataagatgccaaatcctaaccaccaggccaccaaggagcacattaaaggaggaaattggacccatctgatgacatgctatgggaccatggaagctgtagtcaaactagctaacagaaccaagcccataccccagcgtctaaacttccaacattttaagtgttccagacacgaagggtttgaatccagagattcggaggcttgcactgtcactgaacaggctcataccaagcaggaccctgcggagctccaggccacagaagggcttctgtgttcccccacttcttgattacaggaaataggcttcatttagcctccaagtccttccctagggtccaagagcaggttcaaatagttgctaattaggga

SEQ ID NO: 29541 - DNA, 1290 bp, Bovine  19866880615357
tttctagaccaatttctatccacaattatagcaattcttttttaatcgcaattcttgattctgatttttctatagatttagagctcaaactggtgccctgctttaatttttacctagagaacgactctagggctatccgaaacttcaaattgttaagtctgtctttgtggttcttcaaagaccaaaataacactccatggagaagagccacgagatggttttgttttatggctatttctgtattagaaatacttcaataggatgaacctccagcatatgttccaggagggtcaaaacagcttcttccttcaccaaatgcaaggtgttcttcaatctgcaatcactggattaagagataggtttggggttttacatttcactgccatttaaacaggtgaatatttaatgcctgaggagcaaggttatgaaatgtcaaaactactaagtgaaggatctaatttaagaggcagccagagagtctgcaatttaaatatttaaagatgatacagaaagtacaacactgaacaccaatctactccaaagatagcattttatatctcaggtttattctggaattcctcacaagtgtacaagtgatattataaacaaagacaagcaatgctgaaattacttgaagggaaaggaagggagatagaagtaccaggcaataaatgctctagtcaatggcttctcaagctgttcttcacaaaagagacctgactggacaaaatagaggtaaaaatagatttatcaaagtaatcaggtcctgaaaatggaatagtttgagacacagcatattccttgtaattaaaaactcacttcttcatcagcacgcacagtcactcaatcatgtgagactctttgtaaccccatggactgcagcctgccaggctcctctgtcaatgggattttccaggccagaaagcggagtgggtagccattcccttctccaggggatcttgccaacccagggattgaacccaggtctcctacattgaaagcagattgtttatcatctgagcaatcttcatcagcaaataaaactaattatacattaaacattcaaggaaaagtaacacatacactatgaacgggctgtcaaaatacaagttaataaaaatacacagaactaaaaggaatgaaaatatggacaagaactggtactttattacaggtacataataaagtttaaaatccctgcacatcactttaacagaagtatgtctaaatgcttctgtccaaaagtacaactgctctcaattctctccacttcaccaacagaaagatcag

SEQ ID NO: 29542 - DNA, 1417 bp, Bovine  19866880628938
agataaatatgatgctatttccattctatggataagaaaattgaggctcagaggtttcaagtaactttgtcctaggtttcaagacaacaaagtgacagagttaggaaagtgaaaaataaagtgaaagtgtgtctagctcttctgtaaccccatggactgcagcccaccaggctcctctttgcatagaattctccaggcaagaatactgcagtaggttgccattcccttctccaagggagtgtccctaaccagggactggacctaggtctcctgcattgaaggcagattctttactgtctaagccaccagggaaacccgacgggagtcaggactctaacccaaaaccactgcctctcagtgctcttaaccagggctatatcccaactcccaaattgtttgtttaattgtttaatcacctaatgaggcaataacatgaggatccctggagttaggatgatggtcccctaacactgagatacaagtctgtgttcagcaagcctagaaaggacaaattctgatgtgcgtgtgtgagttaaagcaggtttctcagctgccagcgaaggctgttaaatactgaaatgagttaataaaggttatagaatctctttcaagggaaggatttcttcccccaacgggggatagattctcatctgtctgagatggttgaaatataatcctctgtgaaggtcaataaattgggctcaccaagtcctttccagattccatatgatactcagatacatgagcttaatgtggctcagagtggggcctaaaattgggaggggcctgatcctccagccggacataatctcttcttcctttaaatgctctcagccttctgacttgaccttctttatgacatatgtagtgatttttctatgttgttgtgctttccgaaagagaaacacaattaaaagatgaaatgtgtgtggttcattttcatatctcccacagcgcctctgttcagtgttacatttaaaaattttttattttctcttctttcctgttctgaaagaatcatacagtcccaaactgaaaataagcccctgattttcatccaaaatccattatcaaaactcagcaattcacaccatggggcaaagttttctaaaatatgcttttggtccagtcattaccggatacattttttttctttctccttgcatcattttgaaatatggtcattcagatgtaaattcctttcaggtaaaatgtctgaaaaataaaccagcatttcagccaataagaaagcaatctggctagattactaataaaagataacacattcacatatctaagtgttccacaattcccagttagattcaccaccaactcaaaataattacaatggaaaaattttttccataattgtcactccacagaagcataatttttcatgataataggtacaataaga

SEQ ID NO: 29543 - DNA, 3068 bp, Bovine  19866880705603
gcatgagttctaaataatgttccagatattattattctccagctatattagtaagaccactgaaattcagagatattgcatctgaccaaagtcacactgctatcaagaggcagactgttgttcagtcactaagtcatgtccaactctgtgtcccagtagactgtagcctgccaggctcctctgtcctccactatctcctggtgcttagtcgctcagtcatgtccgactctttgtgatcccatggactctagcccaccaggcttctctgtccatggggtttctccaggaaagaatactggcatgggttgtcaggccctcctccaggggatcttcccaactcaggaattgaacccagatctcctgcattgcaggcagattctttaccatctgagccaccagggaagcccactctctatctcctggagtttgctcaaattcatgtccaagcaagaggcagaggggacatgcaaacttagggttttctgacttacaggaccacactagatatggtggaagctctctcagtagatctactttcaaacaccctaatgcagtaatcgatatccttcatcacttctgtaaactgtgcagactggtactgacttcattttcagtactcatgcctagtgggctactttctagtatacttacatatttctgctcctgatagtttagttgtgtgtttacagttgtatagtttctaaacctgtttatgccagttgaccatgttatatagttattttaatgactacgtaaaccaatgaaaatgaatgtggaaatagaattattatttctatgaaaactaaagtggatggaaagacttaataagggaagttgaaaacaattttttttttacctaaattaggtgtgaatgattccattataaagaattggggaaaaataataaagtattggataaaatttttactaacagttgctttgcaattgtgcttaaattttcactttcactttaaataaattctaggctttcaaagaaaaagctttgttctaaatcaaaagattgaccattgagtggatatttatacatgtcagagtaaaataaaatatttaatatgcacttatcattttatgattacataataatgcccaataagagcatttcttatctattattatcctttttacagctgagaaactgaggtgcagggtcaataacctagatcctatcatctggtataacggcagagctaagacaaagttgcaaaggcagacataggatataacactatggttctccatggcctatgctttgccctttactgtcttgctaagatgataaatttgagggttacgaaacatatgccaggaaaccccatggaaagttattggactaaggctgaccttgaaaggtccccactatattccctgctctcagaaagaacttcccttttctcagatagatattaacctgtttgatttttcaaaaactccagggaaaaatgtttcattgtatcacgtagtgattatcattgttataagaattttattttccttagagactctaccaatatacactacttctaagatatagagcttttaagcagtaggaaagaacggaaataacttataatgacatgacagtattactgaagatgtaagtcccagaacttctctacttcataatgtcttcctccaactacttacttgacactttctgaattattcataagtgaaaaaaaagacgctgttttagacttgattattaaaatcatttgaaaaataattcattaaactagtatctatttgttgaattagtagaaatatcagctttcctggaagatttactagagagtaatctatgaccacattttctggagaattgaggcagggttatgatgaacaggggggtcattgctatatatactcccttgcctcaggatttgccagtataatggccaggttctttgtattatttgctatgactgcataaaaaatcacctcataacctagtggcttgcggtagtaatataacacttatttactatttcccatggtttctgttggtcaaggtttctgtggcttacctgggagattttagctaagggattttcaatgaggttccagtcagatgttgaatggggctacaagcatttgaggggtggactcagtttggaggatccacttacaagttaactccctcacatgattggccatttggtgctggttgtgggttggaggccccagttcctctgtacatgagcctctctgtgagacttcttgagtctgctcatggcattgtggctgctttctgtcagaatgatgatccaagaaaccaaaaggtagaagctgcaataccttggcctgtccatactctgttggggtcacacagggttgtaaagggcaaggatcataaggggccattttagaggctgattaacacgttctctagaaaaaatccttctagaatgatggcagtaatcaaaatctgctgttgttgtaatgaaggctttctctctttcagaatgtaagttcctttgctgcctatattctgccatttcttttctttttttttagtgtatagattttaagaagtcttttctttttgacccttgtctatcccttcacccttggtctgaatttggaggctgtattgttactgcagaacaaaccataccaaacctagtggtttaaaataacaaacattaaaaaaaaactttttattttgttttgaggtatagctgattaacaaacaatgttgtgatagtttcaggtgaatggcgaaggaattcagccatacatacacatgtatacattctgccccaagttcttctcccctccaggcgctatataacattgagcagagttctatgtgccatatggtaggtccttgttaattatccattttaaatatagcagtgtgttgtacccatccatcctaaactccctaactatcctttcctcccaatcttcccccagactcttggcaaccggaagtttgttctctaagactgtgagtctctttctgttttgcaagtaagctcatttgtatcattttttttttttttttagattccacatataagggatatcagaatatttctccttct

SEQ ID NO: 29544 - DNA, 1791 bp, Bovine  19866880718088
ccttaccttggttgcagcccagtcacggactgatggaaaaaccaagctaaagttttctttccgtagatgtatttttatgaattacttaactgggctttgtccctgcctttgttaattgcactcaccggaaagaactatggagtgctggcattaagaaccctttaaaagacaaagcagttgattattcttatcatcaaagtaggtactcacatcagcacaccaagtactgcatagaaatagcttgttggtagaattatactctcaagggcagatatcttcaagccatccttaactctccagcagaaaggcaaccacatacaatgctgaggagtagggaaaatgttgaagtgaaggtagaaggatctcatgtgaaattacgagtggcctttaatgatggctgtcagagaagagtcacagtgcttcacttttctttccagtgttggaactgctatcctcaggaaagcccagttcgcttcctggcacaggtattagctaatggtttgaatgaacataatcttttcacctacttgccttcatatgcactatttcctctctgaggaaagcctacccctcattccccagccctacccccacctcacttctagagaatttcctacatgtggccttccttacctaagtaataacaatactagtattcttgcctggagaatcccagggatggcggagcctggtgggctgccatctatggggtcgcacagagtcggacaagactgaagcgacttagcagcagcagcaacagcagcagcagctagcctttatatagtagttactatgcatctggtagtgtagagggttgaatggtgtggcagtgggaacacctgcttcagatcttgctgataaggagttgcattgtctacagagaattaaaaaacatattaaaaacaaaaaatggattctgcttttttctgaccaacctattttggcagtcctaaacaacatcagtaataaaacactcctccccatgggggcagacttctcagccccctttatccttggtacccactccgtgtgcccagcaccttcctaagcttttatatatattaacttccataatttgtccccattttacagctgagggaactgaagcacagagatcatgtgcggtttggtcatactgcctaatccagcagtattgcatgatttcacctaaatatctgccttgtgaaatatctaatacacaatataaatacatatgtctgtgaagacaccctgatccacccaggaggtaattaatagctccctacgtgtgttcctcaccccctgtttatatttctgtcatagtatcgctgtgctgcagggaggagacggagctccctaagcctagtccagtggctgccttgtaatagatgttgaaagaatgactgaatgcagtctttggttgcagagctaggggatctgcatatatttatgtatattacatgtatttcatggcagattggtagaaggctctagattttggtttgcattcaagaacagctttcagttctgactctgttactaattatctgtgaaactcagaatcaggaattgaatacatgtgaatatttgtttcctagtctgtgaagtaggaggtaggatagtctatcagtgatttttcagtagtgataacccacctttaaactaaactcaagtggatttctttttttttttcccatccccttgttaacagtcatttttgtaggaaaaaaccttttcatttatgtgtaatatactacagaaagcacacaaactagaagtgtacagcttaatcaattatcacagggtcagcac

SEQ ID NO: 29545 - DNA, 1794 bp, Bovine  19866880733854
taataaagtaagacttttttctattgatttcagtttgttttgctttggccaaagccaataagagccagaaagggaggctattgcatcattctcaggaaatggtaatgaaagtataaatgggactagccaagaggaaaatcaaggagagacaacagaggtgagaggtatttcagatacattatactagacttagcaaataactggatgtgagaaataggagagggagacaccagagattgtcttaacccattgtagtgaacaacagaaaatgaaatgctgaacagagagctggagcaagaatgtagagagttaagactaggagaagatggaaaacacaaaaattagttagagaaggtgattgtgcaggtgatcagagagaagcttagaaaagagagactggagagaaaaaaagttgaaaagaaagcaaaataccatatataattgaacatatgacatatgacagacacagaagtgaaataaaaataaaacttcacaatttactagcatttctttacctctggtgaaggcaccacaatccttcatctagaggtaaatggttgcctgcagataaagatgccttccagctccagcaaaaggaatcatactccctttcctttttcctctctcttcctaaattctgaatgcaaacccatggtgtgtgaatggcagaaccaatccctcaattcagccatattcattttcctctggcaagattttaaagctgaaaatagaagttttcaatggaacatggaataaaaagctaatctttacagcatcttgtgaacatgacacccagactatattatggtcatgaaagactttttcatacagaacaacgatgtgttttttcagccacactcattgtgacatcctgagactgcatgttacaagaatattttttggtagagcctaatcattttctaacagctgtgtgctctatacagtttttgaaggttagtacctgaaagaaaagttttcacttaaatctggtaaatgttacatcttagcaaagatgtctttaaatgtacataaccatttattctggcttaccctgtaataatcttttctcagactaggtgccattccttaaagaactgaataatgtttattaagttttagttaaatgtatgacctggtcaggtagagttattttggcaatataaatgtggagaaagagagagaatggaaaactggcagaaagcaatgatctgttctgacatgtgactttatcaagtttatatgagtcatcgtcatcattcacatgttttgtgaagagatggtttgttatttcaggagactgattattaattgaaaaagcttttgatgaactggtagaaaagagaatttacagaaaaaggaagggagcacacacagaggtatttgaacaaacctacaaattgaaccttgaaatccaagtgcttaattgccatttagtctacttgaatacagattgaggggatgcaatcaccaaatgtaattctagcttaaagaaactgtctatccaaatgttaaacatatactcccacttctttgtattttgtacactagcattttgcttcaacaaaataatttgagtagaaagattaaaattatttctcctttttgatcaaaaataacaagtcttgtttttcctgtattactagtacgcactaagtaagtactacagacaggtttaaaaaaactacttgtcctaggctttgtgagttgaaagttaattcagcatttgtatttactaaaaaatgttaccattacaggaattttataattcggtaaaaagtacccaaaattccaccc

SEQ ID NO: 29546 - DNA, 1799 bp, Bovine  19866880744559
tttctgagctaaatgaagacaagataaattagccccttccacaagtactaattttttttttctattgctatggtaacaattctccattttaggagagggaaaagagtggaccataaaatctgagcttaaaacttgtcaatgatgtatcgaaaaatacttcagtgtcttttatcatatgactgctaggaaattttccaagagaaatagtctgatatatgtgcaaatatgtacatataagagacttacgatagcaccttattaaacagtaaaattggaaaaaatatttaagtgttcagcaattaagtaaactatggtacactggtacagaggaatattaaagagtaattttgagttagtatgtagatacatattgacttacatgggtgtgtgggatccagacatgtatttacttacattgtgtacctggaagtcagtacctaagtgacaggatactatctagcatttgactatgttatataaactttccagggaaaaatttctgaagattatttacatcaaaattctaacagcagcagctatttctagtgagagaaactcagggtgactggagatgtttgccatgtgcccttctgtattatctatgatgattttcatcatttgtgtaattaaaaataggggaaaatgtgaccacagttgactgtattattgattaaaaaatatgtgctgccccaaaggagctctttgctggtgcctcttcttgtgagaggaatataattctcatccccacagacacgaggcttaactatgtgatctgcttgactaacacaataaagtaaaataaaacagccataggacatgtgcaactccaagcagaagagctagcatgtgccttatctttcctccaccctgagacaaggctgttctagacagagctgctccttctgcctgaccacgaaatacagaagctatgaagcagatctgagctgacttgttaatagtcataatatgagtgagaataagtcttgggttatcataagccactgagattttggagctgtttgcttcaatagcataataaattctaagcagactgatgcatgaatttttactatcacttccaaacaaggccaaactaagatttaaataaaagagccccttagctacctatctctgattagctctaaaatattatgttcagtacaaaccttccaattaacagcattttaaaactgttatctgtggcagagttgactgcatccagacttccatttttcctttctgcgtccacagtctcttgagtcaagttgattatttctgtctttcatgactgtttctttcaggtcccactattctgcctctggtctaagtcttgctcatgtcacacctacacgtggaggtcatggtcaataccgtgctctgtgagttcagtcgctaagtcatgtccgactctttgcaagaatactggagtgggttgcccctctaggggatcttcccaacccagggatcaaagccatgtctcctgcattggcaggcagattctttaccactgaaataccaaggaagccccatggtcaatgccacagtgcatcaatcctcttcatacactgttgtgagatgtcttccttaaatactgtcttgtgacctaccatcactagttcaaggcttcctgagcctttagtctcgaattcaggccactgtttaattcttcaagctcgctaccctcctaacacaaaccttcatcaccaaccaaagtagctcattcattattccctgtgcacacttcacatattcccagaatcagggactccctgaccaaggttatagcaatgatgtcagta

SEQ ID NO: 29547 - DNA, 1418 bp, Bovine  19866880761639
tacccaataatcctctgttaatacatatttctagtagtttgaatcacagggcaaagaaggctgtgggacctcacgggtatgtgccttgctcagctgagtttcaggagaattcaaaacggctggtggtaagcctggggaggactctggagaggccaagacaagggtggcctccccttcagagagctggctggcagctcctggtgggccatgttcaccgaagcctaaaatctgggccgagcagccgtggactcgtgggcctgagtgccacagggcgcagtgcagctgacctggaagaccttaccacagaggcactttaactggcaggaaatgcatcgaaagacttaaagataaagtgtgttccctcctatcacctgcaactcgctgtttatttgtggagatgaggaatcagactctgtcgtcaaggctgccattgctggtggagaggttactccacgcccacacatccctgcatgggaagagaggacaaccggagactgaccggcgatgtctgaattccttgttgtctcaggactccacacacctcacagctgttgtcttgaatgattccagtgactgcctctctgtgagaaacacatttgcctgtttgtgattctatctgagcaagctggtttcaaccaacaaaatctctgcatttgagtcttagccttatttatttatctattcttggaagtttgttttcactgggacacaggggatgggttgtgagacatctccacgggcctgatctgtcagtgaaacatccattctagtcttcctgggacagcttttaggaactttctcatccctgggagctgatgctcttgctggcagcaacctcttcaggtccactggttacagttcctccctgggggagaatctccccctttttcttggggacactcttgtttcctgactcttcacggtcactaactggttcctctattgggaaagatatcttcctctgggaagacttccaccgccagctgtctctttaagatcactactaaccagctcctccttggaagaggatttctttttcttgggtttggagaaagatacagatgactcttccattctatcctcccgatgggcctcctgaggcttccactttcttcttttcggtcttgcactcgtctcctggcactcctcctgagcactgctgtagttttccaaagatgtgaagggaactgcaaccagcctttctttttcttcttcaagcatttcttctcctgtttctccagcttcctagtaatctcagcgtcggcttcctctgcctgaacaattatctctatcacaacatccagattcctgcagggcacctcttcagtctcatagaaggacagctgttcctcagcttgctcttcaagtttttccacaaatatagctgagggcacctcagagaagcaatcagtttataa

SEQ ID NO: 29548 - DNA, 1271 bp, Bovine  19866880763744
atatacatgtggaatctaggaaaatggtactgatgaaccgatttgcagggaaggaatggagatgcagatgtagagcacggacttgtggacacagtggggacacagtgagtaggacggatggaaaaagttgcatcaacatgtatacattatcatatgcagaatggaccgtcggtgagaagctgctgcataacacagggagcccagtctggaggtctgcgatgacccagaggggtgggttgggggaagggagggaggctcaagagggaggggaatataatatatattatggctgatatgtgttgtatggaagaaaccaacaaaacattgtaaaaattaaaaaacaaatcagaactagtcagaaacattctaaggttctggtagctgagagaaacttatttgcagactttctaagagagagacttcagctgacccttaaaactcaatggttcccaaattatgaaaagaagaatctggaagaaatgatgctctttgcaaaatgccacactctgctgaatgccttaaaatatcaccagcgtgaactccatcaggcgaagtaccaataattttcctaggagaaaaattctatatgtagaactgggaacccgcatgtccacaaagaaacaagctgtcaaaccaagcattatcaactgtctcagaatttttccattaatattcatttgctgcttgttcatttctttggtcgtctgctagtgcttgctaccagacaagtgggagcaggcatcaaagtttaagaataacttttgggataaatttgagagaaaatgatcttctttaaaatgacagggtattttccccctgcaaattttgaaaggattcccactatcctggactaaccccatgccactccagctcagtgttcccctgggccgtttgttataatgcagtggatttgggtcaaccacctgaaagagtattaaagtgctggcctgaaaaatattttacaggcaaaacaatggtagtatcttgtcacccaattaccccaataaaccgttcctaaagaagtaacattgaaaggtgggaatctttacagatttttccaagcctaataagattccatgaactgcacatctctacaagtcccatgctaaaaagctcttataagtggctccaaatcatggaaatcttctgaactagcagacaaatgtcaccaaccctacataagaaacccacagtgagggaagttagaaaagagtcttcgaccagaaaagcagaataagcatagacactgagaactaagagagggagagaga

SEQ ID NO: 29549 - DNA, 1076 bp, Bovine  19866880776053
cttttttttcttttcttttcatataattcccccaaaagtttcaaaatcaacttggaagataaccctatgccttaaaaagtgaaactgcctcacacttgctgaacaattaacatggaaatgtaaatctgtagaaaaaaatgaaaccttcctttttggttgtttgtgaatgtaatgttttatataagtctagacttagacaattggcttctaaaacatggctctctaaagttttagaggagagatccgtttcagaatatttcatttaaccagagagaattgctttctcccagctggaagcttgaacagctgttgacttgacacttttctgttcctctgggtgagagttcatggaccctcctcatgccattaggaggacagtcagcaatgtatgtggtcagaaatacgtcccacgccagcccatttccaaggctacccttctatcctctccctaggactagggcacagataactcagagccctgggtcacctagcggaaatagtctctcagttgaggaaaaccaacctccacaaaaatctgctttctgacccatggttaggtctcaggcttatgtgaccataaagattccttgaaggacttttgatattgaccagtctcagaatttggcttttttttttttttacactttataggaaatttcccttttatttaggtgtatttctgagtgcttcttaatgaattgtttgttgttgtttaggtactcagtcatgtccaaatctttgtgaccccacggactgtagcccaccaggctcctctaatgatgggattttttaggcaagaatactggagtggattgccatttccttctccagggtatcttcccaacccagggcttgaacctgcgtctcttgcattggcaggttctctttaccactgagccacctgggagccccagtatttctgttgctgctgctgctaagtcgcttcagtcgtgtccgactctgtgcaaccccgtagtcggcagcccaccatgctccaacgtccctaggatttctccaggcaagaacactagagtgggttgccatttccttctccaatggatactaaataataactc

SEQ ID NO: 29550 - DNA, 1621 bp, Bovine  19866880830504
ccctgtgttccttggggcacagaggttgctgggagtggggtgatcgtcacttgctggctctttagtgggaactaaaacgtcctggttgtattaggactagaagctggcctcccattgggctgaagtgtagcgtccttatgtttcctttctcatgcccacccacccacagctccctgttgcttttccatgtggctaattcatacccagtgccatgcaagtttcactcggcacatcacagacattcagatacttgttccatgtatagtgaattgatacaaataaagtaccaaaatacaggaaactacctaccatcaacaagcccctccacatacacaccattaagttgttactgattgatctagattctgtttcctggaaacaagaaagactttccaaggttgaaaatggattttctttaaagaaaataaaaaagaaaagcaactctacaacaaaaaaaggaattttaacatgtgttgaattaaaaatatcatctatgccatatgttatagagtgaaaggtcacaggttgcttgcttgtgttgttcgttattacttttctttattttgataattttgggtctgcacttcaactcctaaactgatggcagaggcaggggaagcagcccgcccaggaaaggctttaatatctgactggtagtaggagaagcagaagggagatggcacgacgagtcaatgtaacagtgctatttgcacaggcgggtgcaggtgtggatggctgacctttaatccaaaagacagtctcactgaggacggaaaatagatcagtctggcaggaaggtttcagacagttgtgccaatggaaggagaaaggctggcactaaattgtataggaagctgctgaccagaaaaacatggcctccaagaaaagggaacaaaaccatcaggtctccaaataaacttcctgccacagggctggacattggaatggtagatgtcgggagagatctacatggtcaaaaatttaaggacacagatctagcaacgtatggaaatttatatgccttaacttagtacagtttgcttttctgccccaagataaattacagtattatcattaaaaagaataacctgaatataaaaaaatttgaagtccaaaaattactgcataccaggcctcttgcaaggaacctgccttcattatctaattctcagagcactactgaaagcaaattaacatcatactcattttataagacaaaaacacaatggtttaggtaagcaacttaaagaacatccctgttccccaaaaggaaaaattgaaacctaaagccttcatatgacaaagccaatgctctttcaattataagaaaagaagactacaggataaaataaatttgaatttgcttccagctctattgcttactgggtgactgaccttgagcaagtctgttctgtagtcgcactaccttattccgtaaaatggaactattagattctcccattagcagattcaatgaggttaaattgagataatttatcttaaacactctgcaaattaactggtcatagtattcaataaaacactagacaaaaacgtctttctttctcataagcaatctcaagaagtataaatattttatcattttaatgtgacttttaat

SEQ ID NO: 29551 - DNA, 1132 bp, Bovine  19866880843214
acctactaaaaagcaacaaggagaaagacatcgtctttttgaaaaaacgttctttcgtctctttctttgttccttcgtttgtttttcttgcccctttttgtttagttgaaaggcaataggagggtagtctctccgtctttttaaactctcttttttaagtttcccctcccctttcatatttttttttcgccatttcttttagcgttggactttggggtcgaaagcatttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaaggtaagtttcggtttggtttctttaatcattagttgcagcgatgcgctggcaaacccagaaaacctgtaagtgagcggaatacagaataagaagttaattgcacatgtttgtctcatttcaaagctactgctctgctttttaattctagagagctagactaaaagacagtggacgcatgcttgacgtattgaatattcgcaaatgtcaggggcaaaaacttaagtggtaaatgtggccagtgtataacaggggtacagcgggagtctagatgatcagtgaactgggattgaggttggaagttcatttcgtgggaagagagggataacttgggtttaagggaggatgcatgcctctactttcgcgaagcaaccgaaggaccgtagaggctttagaaccattaaggggaatcagaagcctggacttggagattagaccagcgaaaaccccatacttaattgcattaaccagataacatgtgctggggagataggattgccagatggaatttagatgctgcaccaggcagcgagttgtagttgactgaaaaaaagtacatgccgcccgagggctggggctggggctgggctggggtgggtagaagctgtcaaaactcatcattgcgaggtatacggactctaaatcacggtcgccaattatcgtgcttctgttttaaaagaagatagccaatttagggccgaattcttaagcctgtaccggatatgagattccctttgttcagaaaagcgtaaataagat

SEQ ID NO: 29552 - DNA, 1333 bp, Bovine  19866880856441
ttagcacagtttgattacagagtaggtggccggatatgaaagacctgatcaggatgctgctttgaatggattgatcacctgtaactaccattgtaattccacagttcattgcctgtaagccgactgtcctcccttgccttgaacaaaccttagatttgttgtcttggcttgatcttttagataatgagccaatattgttagaggcaacctaaacactgcatcgggtaaataaaaatgcagactagctacgatactacttggcatgcattagttgctcagttatgtggaaagaaagtagtagggaactcaagctcagtccttcttgggccaatcattcagccagaatcctcactgtgttctgaagctcaacctggttgtaataacagatttgttttccttaacttgtgcttcttatgtaaacacttttcatgctatttgtatatttctatatgtatctccatcagagggcttctctggtggttcagggataaagaatccacctgcaaatgtaggagacacaggttccagaagatcccctggggaaaggactggcaacctactccagtattctttcctgggtaatcccatggacagaggagcctggcaagctgtagcccatgaggtcacaaaagagctggacatgacagcgactaaaacaacaaacaacaacaatctccatcagaaagtaactaccttgcagcaaggaactatgtattcagtacttctttcacctgccataggaccaagctacagttttatacacactgagcactcaaacatgtagaaaaagaggtagtaatgagtacagaatggaaaaatgaatagatctaatccctcaggtgcttgataacatacaatgtcacataaaagcttataacaaccatcactcttaatagcacagcaaaaggaacagagagataaaaatcaaagagaacatctgaatcaaaagtgagaggaagagatgagaagcttagccataagaacgttgtataactgaattgccaaactcaagggaaaggtttagaaaaatatgataagctccacttacagggaacttggttttcttagcaaatggattcggtaattggaatttttgttccttcttttcctctgggagcatgtggatgagagttaattaatgtggtaagattgtgcagtatctttgaaaattgtaacttgttaataaagacccaaattgcactacagctgtgtaatttgggtgatgatatgggaatggctaaagatccagacctaccaaagctattcccactgagatttcagggcccagacttaagattatatataacggagaagaaataaaaggaggaagaca

SEQ ID NO: 29553 - DNA, 715 bp, Bovine  19866880897090
tggcacaaacttttgcaatctctaaaactggtcacttaaaagtgtcagaaattttctactatcttttctatcacatgtatacactcttcactatttcccattttctaggaggatattcagagaaggcaatggcaccccactccagtactcttgcctggaaaatcccatggacggaggagcctggtaggctgcagtccgtggggtcgcgaagagtcggacacgactgagcgactccactttcacttttcactctcatgcattggacaaggaaatgacaacccgctccagtgttcttgcctggagaatcccagggacgggggagcctggtgggctgccgtctatggagtcacacagagtcggacacgactgaagcgacttagcagcagcagcaggaggatattttgcacaaacaatctaaaacatagtgtcacattacagaaaagtacaggatgatgaaagtgctgcaaaatgctccctggcattattactcgtatttcccacttggatgagatttggggcaatgctcgtacagaccccttctccaaaacacaggacggtttgaagaaagtatgaatgaacaaaacgaggggctgcatggtgtgactgccacatctgtcagcagcgcatttgggaagccttctcctgtcactatatatattcagaaataatgacatagaaatgtagtttctccaggcaaacgaaaggaggtgcaaat

SEQ ID NO: 29554 - DNA, 1997 bp, Bovine  19866880920011
acactactgcccagaaaaagaaaaaatataactgcccctgtttcttacccagacatacagacacacacacatatttatgaaacaaacccttctctacacttctttaccctgcttcctgccgtaggagtggcaaagaaaagtcatctagcccaacatacaaaacacaaacgaacagcatcatcttgactaaaagtctccatgcattttctggaatgtatattgtatatttattgcttcagacttttaaagttgttctgagtcttcacagtgacaaaattgcataagtttacatactttttatctctctcacacacattttgtcatggaaaggatccatacatttgatttcttcataaaccagtgtagaggtagtgtatggttaggccattctcttctcttgctctgtgtacattccctgctcaatccggcccttcttcactcacatcactacctaattctcttgattactaggcttagttagtccttggtaactgatgagcccacctgacatcaattccctataaatagtaacctccttctctctcagcaaacaaagactgctgctgtgtcctacccaccgcctgctgcacagggtgaggtgtcactccaggactctttgtgttaagagtcccctgtcgagtaaccaactgaggtctctgtggctgtcttcaggctcttcggtctcaaggctgggcaactataaggcttgcaagcctgcagggtgcagcccaacagtaaggtaagaggcaaattgcccacatcaccccaaatgagtgttctgtaaaattgtgtgtatgtgtgaaggagaggagatgctaccctggaattttgttctttgtctgtacaaaggacaatcctgtcctctttcctcctgcctccattgacctttcctcatgccttaacgtcctactccatactgaaatatgactgttctggaaagtgacagtatcaattttgattccctacaccctgaaaacatctttttcagtggtctctttttaaaacttgccttgcattatcctaatttgagcataccatctgtttcctgctggaaccgtgactgataaaagcaccatctccccttcttctaagcccacagaaataataaagtataaaatgataaaaagtgaaatgaaatattggtgtccaaataggaagataagcactgctatggtctcacaagtgaaagagggacgcaaagagtaataatctgtccccaaaagcagacctatggaacctcaggcttgaaagtgaggtctattcctttggataatgagggttaaaggtttttcacctgagggcaaggcagactgggtctaggtctcttacatgaaaagtgtggttgcagctttccttctctacctactaaaggaggcaaaaataacctctcaaacttgccctgaattgtgactgcttacatgaagctgagagtttccctggtggcccagtggtaaagaatccacctgccaagcaggatacctgggttcagtccctgggttgggaagatcctctggataaggaaatggcaacccattcttgcctggaaaatcccacggacagaggatcctggtggactacagtccatggcatcgcactagagttggatgcatcttagcgaccaaaaaacaacatgaagctgaaaactcaggagagaaggtagtgggacatatcctggcaggtaaagacttgagacaagctagtatctctcagtggctgcagtgttccaaattatcacctcatcaagaactttgagctatgaaggtgtgattgcatctggattgggacccctagggagacaggtagaaacatttacaaaatttgtagacattgcagtgtttgagaaaagaaggaagagcaagagaatgtaggtttccttgttgatgagcaattcaaaacacatgagtaaaactaactgcaagtgaagcaataaaatcaaccagctgaattctccctggaaaaactgaaaaccatagaacaatcaaaaatgacttttaaat

SEQ ID NO: 29555 - DNA, 951 bp, Bovine  19866880935278
tatctttttagaaaggttgctaaaacttaaaatataaatgctgcctggaaaatgtactttgtcctctcatacttgcacactctcaaaaatgcacaccagtgaatttgcaaactattcaacaaaatagagaacaagatacagtgcagagtcatcagtgagtcaagacaacaaggtcactggctatattctggttcttttacatttgaaacttttttgccaaacatttatttaaataatgcatagaatttcatgtcccatatccataaagcagaagtgtgtagatgtaaagtgtgctgagagaatcaggtgatgtccaaatacctatgtggaatttcttgagttccgaaacaacccatagtgattatctgggtaaagagggtggcggtgggatgaaatagaactcttattcttgtaagtagctaaagcagattcgtttctgtggttgacgacttctttggctattctaaaagccaccctggaatctctcctgtgaccccatcacttcaacaaaaaggtcaggtttacctccgtttatggtacgtacactcctctgtatctggttaatctacttttcttacaacaaaaggaaaatttgggagcccatttggaatcagagagcttccgattctaatactggagtcagagagcttcctctgtcctacgctctgaaaaagacggaatcctgtttttttaatctgattggtttaaattggcccttaatctgtatttacatcaaacttcacacaactttattttgttctaattgtttctacatcgtaactatgactaggaattatgactaagatgttgtgtccctttgcaacttttccttacagcttcctctccccaaataatttttaaaaccggtggacttctctcaccgctcccctccccccattaaaaaaatagatcccgttccgggcgccccctctctgcctgccgaaagcatta

SEQ ID NO: 29556 - DNA, 744 bp, Bovine  19866880962904
tcttttgaggtttgacagaaaacacaaaattctgtaaagcaattatccttcaataaaaaataaataatttttaaaagcaaaaaataaaataaaatggcaattctaactggaaagtcactgggtaggatgaagtattggagacaatttgcaaattagatagattcaaggaaggctcctactggggcttggcttagaataaatcctgcctgagtaccctgaaattctgagtttaaataatcaattgctattgatttttcacttgtgttctgccaaatttggttattccctagtcacattgccttgtcatttgagccaaattcagtaaagaatttattcattcattagaatcagtagaggtagaatgtaatgctgaaaaattgcatttaagattttctacagtaagtatcagtcatcttgtgtgaatattaatttgctcacatataaaaaatcatgaagtaatgtcattatcttctttattattcttaaaagcatcagatacaaatagagcattgtggtctggcttctattggccaagtccacttcagtgataagctgtggctaagggcatagaagagacacaaaaggcaagggagaaagggaaaaatataccaactaatgcatagttccagaaaatcaggaggagagataagaaacccttcttaaatgaacagtgcaaagaaatagaggaaaacgggaacatttcaagcaaggatggatgtaatataggacagaagtgataaggac

SEQ ID NO: 29557 - DNA, 824 bp, Bovine  19866881005027
cacttactctacaaagtaacagataaccagatctattactgcaaatgaaaaaatacaaattctagttgaactggagtggagactggggatagatacaggacttgtgagctatataaactcccccttcaaaatcaaagtgttatgtagaaaacagagtttcaacaaaaagtacaatgatgaggaaagaactcattaagagctaaaaataaactctaattcacaatatgcataaggatttaacaaaaaaaggaaaacaagatgtaaaattgcatctgctaagttaaccatgccctcatggaaatcgccacccctcatttacacaaactggaatctgtaaagtctgtgatgactgaataaggcaatgctttaaatattttcaatgactatttcaacaaaagaaaatcaagggacagcgattttttttccctaagtcctctgatctcctaacactacaggaacactgggcttcttaacatccaaacacacagatcccttcatttctcttcttcaaaatcttacttgatgaaatcagaatatatagtactggtatttatgatttacattacaggggtattaatcttaaggaagaagctatcagtaacagtgaaaacaagcctcagttagttttcatctgatacctcatggctcaatttaacaacgtgctgaccttccaggccagttaacagtccactggggggaagcttggctgagagtaccttcatattttaagtcaagctaattcattctgaataacagttacacaataccacacagagcaataactctacactccagtgctccagttcacagaggctggtgtaatg

SEQ ID NO: 29558 - DNA, 1677 bp, Bovine  19866881094365
acctctttgaaacttgagatttttatcttttaataaagtaataatatctatctcacaaaattgaagaaaagattaaataagataatatatgtaaaggacttagtacaatgcttggcctgtatagagaggacccaataattgaataagtgataattattatagtaattcttattatagctatgattaccattttctgttacaaaagttagaagatgggccttttactcctcacagggaaactcatggaggacagtttgatgtctcagagggtatactgtggtctgttgcaaagaaaccagaggacacggactgaagttctcaaaatgcatggcaggcttccaggtccctcttgggaggctctacaacactgagattgactttgctgctataggaaccaagaattacctcctccttcgttgctctctctctgctccccacagctgttgtcataatagaggtatcattgtctttcttccctatatgtgcaacaactttatttgcattatttttaatcactattaaaaatgtgatctgtaatctagatgttacccagtttacagctgtataaaaatcactagctggtgggtagcagaaccaaggattcaacctgggtctttctggccactgaacctgccctttttccattgtcctctggcctcgtttaccactttagcactatctccaactctaatcttaacaaaggtctctaaaaacatttataaagaaatatccttgaggataatttttttctcaacttgagatgtgtttttcttcctcccctagagagtacaaaattatgagaatccacacatatgcatacttgtgaaactgtagtgcgagtcactactcttgagtgatattacatgtagtttggctgcaagaaaattaaaccctgtcaagaaatagttcccaagaccagtaacttctgtggggaaagaaaggaagaaagaaagtgaagtcgctcagttgtgtctgactttttgagaccccatggactgtagcctatgagactcctctggccatggaattttccagtcaagagtactggagtgggttgccatttcctttgtggggaggggatgtataaaaacagatgcccaaaaaacgagtgaagaagaaaaaagcctcccaaccccagagaataaataagtatagtatatataatatttagttcagtgttctgaaaaggttgagacatactcaaggtcagtcatacagtaaattagtaatggaatcatatccagcctttggacattcattccagtactttttcctgattctactttttcctctgcagcttctcaggtatcgggagagaaaaactttttaatgaaaatgaatggtggaggaaaaagtgtttaagacactccaggaatagtgttaactgtagagggagggtcttgtaagttttgagcccttttgaggttgcccacatgcttgaatccatgtatccgtgcatacgtatcgtgcttacacagcatctttcgctccaggcctcctctcagtgctgagcgtatatctatggacgtgttgcaaggaccattcgttccaaagaaagacctgcaggggcaacttgcgacggagcaaaatgtgttctctgtcaacatccccctttccctctcatgccctctaactccttttgatatacgtacgagccctcttacagccctccaaatc

SEQ ID NO: 29559 - DNA, 1641 bp, Bovine  19866881106872
tgatatactgaatgctgatctattttcgaatttggttgttttgtatactaatacagagattgccataagtaaacataccaaccaatatacttagctctcataacatttaaaaaaataactattgtaatcttttggaatctatcaatagtacaaagatatcatggtttgattatttgcctgtttctgtcctaagagttttctaccttaaggtagaaagcacttaatataattgacaacctaagattatcactatgaacacaagctttgtcttctgaaaaaacataggtttaatatttgttttcatataagtgtatgactttagacctattgctaatgtctctgactttcaatcttatcacttataaaatagcaactgtaatatatacctcatagagttatactgaagattgaatgacacaatgtatgtaaagctctttcttcaataaatggtacctattattatttaaaattgaagctggtactttagatataatttcagtggaggaaattagtaggtggtatggtttattcattgacagaaatttaatatcctcccacctctttcatttggttagtttgaaatttttcattctgatttttctgctgtggtttttggagggatctcatttatgtattttaattccaaagcacaagagagtcccccttcttatggtatccccataaattgcacttatctgcttttaccaaagggccaagaaaagtgctagaggttactatctatctagattgagcagtcagttgagcagaagtaggcttaacacttcatataacataataattttaggcatataacttggcatgccaagataaacacagatgttttacagaatgttatctatcttttgttgttgtttagttactcagttgtgtctgactctttgagacccccatggacagtagtccactagactcctctgtccatgggatttttcaggtaagattactggaataggtgggaatttccttcttgaggagatctttcttacccaggtattgaacctgcatctctgtgtctcctgtattgcatgtgaattctttacctctgatgcaccagggaagccccatatctatcttattagttaagtaaatataaccagtcctagatgacaatagcatccaaatgtcaaaatattacttcctgatattttccaatatcagattatgcccttcccagtgtgtgtgtgcttcagttgctcagttgtgtctgaccctttgggacaccatggactatagcctgccagacgcctctgtccatgacattttccaggcaggaatactggagttgggtaccatttcctactccaggggattttcctgacccagggatcaaacccatgtctcttgtgtctcctgcattggtagtcagattcttacccagtagcaggtactaaattaatccaatagataaaatgaaaagatactactttcataattttcagttactattgtcatttaatcattcagttgtgttgaactgtttgagatcccatggactgcaggatgccaggcttccctgtccttcactatcttttgcagtttgctcaaattcatgtccgttgagtctatgatgccatccaaccatctcattactctgtcacccacttctcctcctgccctcaa

SEQ ID NO: 29560 - DNA, 1008 bp, Bovine  19866881167306
ctcctcagtccatgggattttccaggcaagagtactggagtggggtgccattgccttctctgtctttcttcactagtaattaataaaatttgatgggagtatcacagttaattctgtttgaaaaatatggcttagaaaacgatcgtgaaatgttatttctagtctctcctccccaccagctagccctcattcttgccttattgtcagtctatgttttagcactgtttaccccaaggaaaatttggttttctccaagtcattgtcttttcctggtattgggctgagaggaaagagacttaatccccactgcctatgacctattaatagattactgttataaaaactaaagcaatggtcatcactcatgaaattagcagctcacatcctcctgggatgcatgagtaagagatgggcaagaggccaagagcattactctaggaaggcccacacagaacaggagaaatgaagaactggcatttagttctcataaataagtatttgactattaactccagagatctaccattttatcaaaaatcttcaatttataaggcatatcaggatattattatgaacatgtccactatagctcatagttgcagaacaagcgctattcatttgtcttcgggagaggcggcatgctttctaacctgttgacatctgtctgcggaagtggtgaaaagaactgagcaagagcagggaagctagaattgtttagtgtggagaatagcaggctggaaaaaaattgtataatgatggctctttgcaagaaccttaagagctatcatatgaaagaggcacttaatttattgtgtgtaactagaaaaggcagaaataagggcaacatgatagaaggttcagggaagtaggcttaaattcgctaaaggattattttttaataggaactgaaaaaatgaaaagggcacacttgcaaaatatgcatcttgtatcatttgtatgtgggcagagactgggtaaatcaggaaagctagagggagaagatatggt

SEQ ID NO: 29561 - DNA, 488 bp, Bovine  19866881223125
tattccataccctaccccataaacaggtttgttatctaagtctgtgaatctgttttataaataagttcatttgtaaaaagatagatttttaatataactgatagtgaaagcaagtaaaataggcatatgagcaaaatcaaagagacttcttggtttttatatttctttcaaaatgggcaaattcaaaatggataaaacctaacccaaggacattgtagtgaacagttgacagacaacaggattcagaggaaagaagataattaacagggaggttttaatggtcaagggaagcctttgaaaggtccagaacatgagatacaacaggaagatcctaaagtttctgtgggtggcaagagatgactgatcaatgacatgacgatcccaaaatgagtttttccttctctaccatttattctcaggcagtctctaacctctgtgtgcattaatctgctttgacaaagcaaaaagaaaataaatccgatgatgca

SEQ ID NO: 29562 - DNA, 1146 bp, Bovine  19866881251742
aataggctgaaatttggatatgctactgcttccaaggacaaagaagtaaccatctgtaacacacaactttatttagcaatgaagaacttgctcctaagaggaaaacacctcttgagctaaagcaaatagacccctccactagaagaggggatttggcctctcacttgactccccagaagtggatttcacaagtctacacgcaacccagaattgagccacattatctactcacaataaaaaaatgtgggccttaagtacccaatttttatttcttcatgttgcctgatagagctcctattgatgagccaaataattgaggaaaatgtggatgacctatggctgcttccttgtcacaaaaaaaaaaaaagaaaaagaaaagaaacggtctccaattatacacattagccttaattttggcctttggatgatcagataatgtttctacccatgaaatgaattcttgtggtgagcccgtgcttttcagtgtcaaaaataaaagcttccaattaactgtcaaaagcttttccagcatctggagacaggagtaaattggagtcttttatattggtagctttttgacattatattaaacagtcttctagggttgtcacagtccattctcctttgtatctatccccattggtttgtgtttaccaattgttttattaagcaatctaattttttagctcaatttctacatttcttacactggggtgaaatcaagggacacttctgctactgtgtaatctttgcatcctgttttcaagagaataaggctgtggctatctcttggagtgcatggtgattttttctttttctccccttaaaagtcactcctacaggggttatgtgcagcagtggcaaccctagagggtgctatgtagacaactaatcggatattgtaggttggtgtaatcttttccacaagaaaaggtaaatatcagagctattgatccatgcttatgcacttctcttcaactctaagagattttctttttaaaatagaaaatgctgcgtggaaacattttccatttctgcatactttctctacactcaaggattttctttgttttacattttgaaaaggtaatcaagtcatataagtgagctaaggattttcttttgctcttaactctaaaacttaag

SEQ ID NO: 29563 - DNA, 804 bp, Bovine  19866881281118
tttatcatgtatacattaaaaattttagtacttaaatcctatctttggctacatcttcaaaatccttactttggctacattttcctttttaaataaataatgaattctacaccattttattcaaatttagattatattaagaaatttttaaactcctgctcccggtatactcttgtcttattattcaatatataaaaatctatcactttcaacactgaaagtgttgagtttccaacactggaaactcagattccatatcagccctttagggctatcattaaaccagcaaaacactcattaatctctacctggattaagaccagcatctatagaattcttgataaaatgaccccctcttatcagttctctgatacaacttgataccatatagattgccccaaatgtctcagataaataaagaagacatagtatctttctacagaaattaacatccaattgctcagaacttcctgccaatgttaaacttgatagaaatttatttatttaaataatcctagaattctgcatgaaatcactaacttccaagtgaccaatttattttcaaaacagtgaaaggagatgttcagtttaatcgagaagattaaacagcaaattttaaataaaataaaatgccaaattgagtttgctctttctcaaattactcacttaaataattttagtgaatgtaggcaacttaaaaatgtatatacctcattgtttctcaaatctgagcatgcttaagaatcaccaggagaatttgtaaaaatacagattcctacattcctcccacagagattctaaacg

SEQ ID NO: 29564 - DNA, 1318 bp, Bovine  19866881310142
ttgtcactaccgttttttccccccatactgctctcattcttggcccacgtaggaaatcagaagataatttaaaattcaatgatgagggctcggagcttaacacatttagaagaagagaggaaagaaaagtgtcacatctggacaggactgggagtgatgttggaaagctcgccaaggaggcccggaaggactgttggcaggtggcctcatggtgctctgtgtgaccacagcagacccccaagacgttatcttttctcaggccatgggatcgtgactgaagtcatgggagcataggagagaagttgagagagattttatgttaggaaaattaggttgaatctttgatttactaattactattttgtaatagtaatccttctaaggatttcttcaatccttctaagcatttctctctgtacgtataacagtatcctcatagaatatgagaagtaaattatttatatgtacaaacacacatatgcatatatataattcttagcatataaaaagttctttataagtaataatggtatagattattcttataataggatacaaaggcaaaggcagctctttgtttatctttgctttcacttgcccctatgtggtgacacacaaatcagtgaaaacggccttctattttccttcaagattctcggttagaagtaaaaagaacataggtgtcagaatctcacaaatcagaattaaaatttgtattctgccacttatgaactatggaacctggggagttatagaacctgggacgtgttaccttgttggtttcagagttcacatctgataatgtcattacttattgtttcacaacatgactgggaaatttaatgaagggaaaagtatgtaatactgctgagtccattgcctggtatataacatatacgaaatcagaggttggcagagatcttctttcaagggccagattgttaatattttaggctttttggcccaactgctcaagttagtcatcattgcatgaaaacatccagggtcagtgagtgtggaagggaataaggatagctgttttccaataaaactttatttaaaaagacaagtgggccagctttggcctctgatctgtactttgctaatcctagctcctaaccaatattagtttcttcctcttctccaatctgtcatctttgaaatttagcttttttttttttcaggtatataatgttgaaaaagcatctacctaaagtttagtttatttattgaatatctgttgtgtgcaaaggactgagttaagtggaatgaagagcagtgtgaatataattttcttctacttttagaggtctaaagg

SEQ ID NO: 29565 - DNA, 1284 bp, Bovine  19866881390934
attctataaatataaaaatactgcagaaaggttatctaatagcgagaaggatatagaagatccaagaagggtccaaaatcataaatttaagactactgggttcaatccctgggttgggatgatcccctggagaagggaaaggctacccactccagtattctggcctggagaattccatggactgtctagtccatggggccataaagggtcagacacgactaagcgaatttcacttttacataataaatcatggaaataagtaagaatgtgtgtattgataccttcaattggttacattcaaagaggtttctaggtagaaatcaacaaatgactcttaaatgtctgaaaaaacaattattagatgacatgatgaaacagaacctcaataacttaccaaaatattcttagtaatatttgccatcttcatatacttagaaagaacaaatttgatattattattggaagtgattgatagagctatagttttctgcttattgaaaagcactttggtgtttttggtattttgcataaaaattaaagagaatacttagagcaaatgtaataaataagaaatggataaacttttcctagttattcaagatattttcacaggcactagttgtaaccagaagacaaagtgggaactatgatactttgatattgctatagaaatctttacttctatacccttattgttgttcagtccagcgctttatgactccaagtactgcagaacaccaggctccgttgtcctccgctatctcctggaatttgctcaaattcatttctattgagttagtgatgctatctaaccatttcattctctgtcgcccctcttctctttttgccttcaatctttctcagcatcagtcttttcctatttcttcttatcaggtggcaaaagtcttggggctttggcttcagcatcagtccttccaagattattcagggttgatttcctttagaattgactgatctccttgcagtccaaggaactttcaagagtgctctctggcaccacaattcaaaagcatcagttcttccatgctcagccttctttatggtccaagtctcacatacaaacacgactactggaaaaaccatagctttgactatatggacctttgttggcaaagtgatgtctctgcttttcaatgtgctgtctaggtttgctatagctttccttccaaggagcaacaatcttttaattgcatggctttgttcaccgtccacagtgattttagagcccaagaaaataaagtctgtcattgtttcatgtttttc

SEQ ID NO: 29566 - DNA, 1364 bp, Bovine  19866881527957
ctatgacacttagcactggcatgaagtcagtttttaataaatgtgtctcagactggaatgctcttcccttggagatgcactccttcacttccttcatgtttctgctttaaatatcatcagagaaggctttcctgtaagtggcatcacctgctttaccacctcaacattatgccgtacgtcatttgatttttcttcatagcacttctcatgatctgacatctttttatttttttattttgtatctttctggacttaaaccttggtctgtttttttcatgtccacattcctaatgcctgggatagtaccaggtatataacataataaatattggctgaataaatgaattgctgaagcagtgaaggaatggatgaataagtttctttttccttcattgcctcttttggcaaatgggagtgatgcagctgtcctcatctgctgataggactaaataagaatgtgcatgggtggcacttaatatagtgctgtgagcttggtgatatttgatcaatgtttctttgataaacctgaatctaaccgaatgtgaaaagaaaatggaaattcatatgagggtactggggggctaatgataacttttgtgccagagttttccagtaccacaaagagaatgctaggtatcatgatgccatttattgagtagtaattttataaacagaatactaatgaaacaagagtcacacgccttctctgaaatagagtgtatgtttaatcagagactgagataatggttttttatcctacagttcatcctcttataggacagtttcatgagacgaccttaggtatttagacactagcatccgagcttgaattctggctctgccatttagtgaaagtaggtgatttcagagaagtcacttaccctctttttgagccttagcttcttcattggtaggagagtgttgttataaatagccgtgtctcagatttgacgtaagaattgcgtgtgctcattttatacaacagtgagtgttgctgctgctcttactactgctattaccatgatcgccaccgccactgctaccaacgctaccatgactactgagcagcatccaccaggaatttccaagccgagctgtaagggaaaaatgttacccactatttatatctctcataaacttttatcaggtctcaaagtccaaagggaagctggaaccaagaccagttgcagtcactgatcgtatatactgacagaacctggaggctgctattgccagcggtaagccgcccttcagggcctgtaactctgatctccatgcccccttaggactctgctgctttctcagggaggtcccagcacagtctgactgtcttttggaccatgccccttagcgagcaagaaggt

SEQ ID NO: 29567 - DNA, 1456 bp, Bovine  19866881553425
tttagtattccctgcaatgagtacaatcttacggataaacagcaataccacctcctgcctatactgtttggctaacttgtccccttccctttgttgataatacaattgctgtttctcttctccttatcatttgcctaggcaactgcaatgttctattaactaatccagatccccaagtcctttcctcatagtgatgattcaaatcctgtctgaagtgttttcacttgttatacttttgataataccaacatgactgaggcattcaaaaaagagtagttgctttatttttgcatctttattttaaatagagtaaatatgtgttttgggcagcgggagaggcgtgctgggggtatggtatggaaagcatcattgaaagcagcaaaattccagaagaaacaaaatagcattaagaaaacacctttaaaaacattttttttttttattgccctgaaaatttggagaagaaagcatcacttatcttttactataactgatataattgtgcagtcacatttgggaatagatcttaattgatagctgtatggaaggtggtaaaagctccatatttaagataaacccattttgtcattttagtttgtagcattgtatatgtttcatgacagtgggtgatatttagttttctccatcttagaagatttgaagatgtttttggcttaagcataaattcaatttgcatcttattaaatagtaaacaaaaaaaatctgctaatatgtatattatggggatcttttcatgtgctttcaatgtacaactagcttctgtcatacacagatagcaattatctgctaatttatgcagtttaaaactcatttggaaattaaaatgaccccataacacacatctcaatgttattcatggtggtcactttgtgagagtgaagataaataatattttataaatttcttagcattctcctttctaggtcagatctctttaaaacaattatgtgactttcttttaaacaaactatttctactattacacttaatagtagaatttaatacttaatattcaattttattttttaatgaaaacatctatttctttaaaacattcacataattttccataatgattccaaaatacaaataatgctagtattttatgactaaagattggattcatgattttggaaaattctgaatataattttagaatcaatgaaataggatattaaaaagcatgactaagaaaattcaagatgcatgtttcattgcttgatacaaatctacaaatgcacttctaatttctgtttcttaaattttcagagtaagcaagtttttttcataatatatgttacttcatcatatgttacagatctgctaatattaaccaatataagagtttcaaataataatattaaattttatttacaaacagaatcacctgtgtatatatatatagcactgcataataatattatattcattatta

SEQ ID NO: 29568 - DNA, 2136 bp, Bovine  19866881609897
tcaaaacggaagggcagtttacagaatttccagaagagatttttagatttttaccatagactcagtcttctccctttagccaaaataattaaagcaagcagtccccaaccctacaaacagtatttcttccttcacaaagataacacaggagcaaagtctgcaactgaacaatacagctgtagtttcctgtgtctatactctatatgccaacactttatatatattaataacacacatatatatgttatgcaacatacatacacatatacagttgacacccgaaccacccaagtctgaactgcatgggtccacttacaaagattcttttttcactaaatttgaacaaacagtactaactgaggatggttgaatctgtgggcacagaattgcacatcaagagggcagactgtaaagttacaggaagacttttgaccgcatggggattaccatcctcagccctccatgttcttcaagggtcaaatgtatgtgggtgtatatatacatatgtttatgtatatgacttcacccttgtaacaaccctagagatacctgttatgtctattttgcaggagaaaagatctgaagggcttaaaggacctgaatcattaacccgaagtcacacagctcttaagtgtcagaccctacatgatatccagagttggactccagagcctgggttcttagccactaaaccatcctgccatcctcaagcctaggcagtattcagagattgcacaaaagctggctacaagtatctctggtcgactcagggatctgaataatatatcatgaataatatatcagaacggtattaattccaagtgattttggaaattagcttggagaacaaaatgagctctgaatgtgcttaactctgcaaagttgattttggtttggtttggttggttgttgtctgagcctagtgtgtatccaactatttttcagatttttagtaattatgaaaaaacatacacttcctagggtttttttcataggcaatactatttcactcctatctatttttccactcaacagagagcaggtgcaacaatcctcagtacattctgaactccaaaagaccaagatttggggctatggcagcctggcctcccaaacatgcagccaggtcggggtcagcctctcggcagcactgctgtggtctccatacctcagccgcaaacacttgacccagtcaaatatcttccacatgcccaggggctgacctgtcagcttgaactccatgagcaaaaaagcataaaaacacaggatgaatatggaagggagacccaggtggcagattccacatgttatttttagtcagaccgccaaaatcttttcacccttataaatagaacgtatctggactcagccttattcctttggagaagctgattaaataagaaaggagttttgctgctaataggcaatgcccaacaaaacgaggctctcgtggctcatctcaaaaggaaaagctacaagaaagccctgaatttgcaaagaagtgaacctcataaattgtgtacaaaaaggttttgaagattcagatgaaaagctcagttccaacatgaccatctgttatttccccctaaaagaagagagctagtagtttataaaagcaataaaacccttccagagctcaaaagcaagagcaaggacttgcagttacaaaccagggaacatacagactgataggcagctgagcacgcttctcctacccctcacctcctggccaaacagaaacacagatttttctaataactgacatctgatctactctttttttcctccctcaataaggttaggagtggtcaaacttactttcccccttttttattctatgttcatcacttcttaaattttttatcttttctgcacacatgtatcttctttgaccccttcctcatcagtatgtccctgtccctttcaattctcatctagttctcttagaagattctctaagtggtaaaccatgaatggaatcaaaccctgactggttggaaggaaacattaataatatacaggcatttggcttcagcagtaaagaatcctcctgccaatgcagaacaggcagggttcgatccctgggttggggaagatcatctggagaagggaatagcaacctactccatattcttg

SEQ ID NO: 29569 - DNA, 820 bp, Bovine  19866881642686
ccatgagcaagtcattccatcttctttcacagagataaatgtcataatagatcagtgctctgcctctattttatatatttaatgtatattttttcctcctctattctttggggttgaaattactttagagaatagttggagaaaattgagagtgttttggaatatgtaggaataacaggttcagactgtactgaaacctttaataacttgtgaattatgtcatctgtgaaataacaatagatgacaaactcagctatgaggagaagaaatgtatccttttctttaaaaaagaaaaaggacagtttcattctggaatcacatcagctttagaatttcaacaatctttgtgtagttttggtgccccataaagtatgtcataagtataataaagatatcatcattcatacagtctggggttcaagacccagtttctgaagtgttaaattttggtggtatatggcaacccacttcagtattcttgcctggagaatcccatggacaggggagcctcgtggactgcagtccatggggtcgcaaagagttggacacgactgagcaactaaaacaacaaccacatgttaggaaggaatttagattgtctatacctagattgttttactaatttactaattgattatctctgccatatgtgaactagattttctgataaagaggtttcttattagaaattcatcaggtaatattacaaatactacccacttgatattatttcctgtcacttgattgataaacatctcatacttgaaatctccaaaacagatctatttacaatccaaatcagctggcagcagaattcagg

SEQ ID NO: 29570 - DNA, 1217 bp, Bovine  19866881772837
attttaatagttgaacaagcactggcatgtccgtagcccctcacaagatgtagtcttctagatagcctgtgctatacttattttagtcatgcatgatttttcaaccccctctgtcattaaattagaatatgattacctcccacagccaaaatagctccctttggtactaagtaatataatttatttcataaataggatcaaaacacctttattagatggtggtgactggggaaaaacagcattttattaacattttagtattgactctattttattatgtttaatcagagtgggattttgacagctactgggagatgtattctaaactttcatctgtgcttcagctaccttacttgaaagatgcttgttttctcttttaacacagaaaccagactgttggtgacagattcttttcaaaaccacaagggctgcatgttgagtttgtctgggatctgggtccctatggctttctttctcttggtaggttcacgtgaacagggtcacagagagcatgatgtgcggagctctggggagaggacccctgaagatacttctccccacttcccttcttcccgttcttttctgttttccacaaatatttatttaacacctgagtatccagcagtcaacaaaacagacatcttcccttgtgggtctggaatataggagatagacaataaaaataaagacacaggggctgtgccgtggggcgcgtccctcgttcagcccaggtgttctggatccggtttctgggtgagtgctgcgtgaggcaccacctacagctttccccgcgtggtggccggcagccatgtttagttgttctgtcacagttttccctggggatgacaaaaatagaatatcacttcatttctagttgacggcatactgtgaaacctagaggagacattaaaggtcattaaaaaaaacccaaaaagaaccactgccactatccagaaagatgatcttggccatgttattgggcttctgcatctcagttttttctactgtaaaatgatgacagtacctgcctccacgggttgtcatgagggttaaataagtagttatttttgatagacttccagtaatgctgctagcatgcagtaggtaacatccacacggtagtgttttggtctcatctccagtacgaagcttgagctttttgtctctgttgggtggtggccggtttctgctaaacagctctgctataaagtcagggc

SEQ ID NO: 29571 - DNA, 1819 bp, Bovine  19866880220533
tactggagtttcagctttagcatcattccttccaaagaaatcccagggctgatctccttcagaatggactggttggatctccttgcagtccaagggactctcatgagtcttctcccaacactacagttcaaaagcatcaattctttggcgctcagctttcttcacagtccaactgtcacatcccaacatgaccacaggaaaaaccatagccttgactagacgaacctttgttggcaaagtaatgtctctgcttttgaatatgctatctaggttggtcataactttccttccaaggagtaagcgtcttttaatttcatggctgcagtcaccatctgcagtgattttggagcccagaaaaataaggtctgacactgtttccactgtttccccatctatttcccatgaagtgatgggactggatgccatgatcttcgttttctgaatgttgagctttaagccaactttttcactctcctctttcactttcatcaagaggctttttagttcctcttcatctataagattaaaaaaaaaaaaaaaaaaaaaacaagcacagttctctctgtgctagacttttcatatggtgaatagaatggaaattttcacaaaatttattcaaattatcatttgaattattttaaaaaatatatgtttatacatatatcgatatacacacatatgtgtacatatttttgccttatttgcctaaaatattgttttgagatcaacacgcttactttttctcaatttctaaatttttctaaattcttcataaaactttaaaaaataaactgtttaaccctgtttcagttttccctaacatgttgtttctctgcaagccatagaatatttcaattaaacttctgttccactgatacatactctattgtaattgatatttctttaaaagtgccttacattttttcctctaacatgttctaagcatctaaaggcactgtactttattttcctagctttgtacatatccttaacatctctggagatatttgccactaaagcaagtgagtgtttatatactgtttgtttattcatgacaactcctaaatgtttggaaagtaataaaaaatgtcaatagtcctatggtcattgaaatgctcccctaatttcaacttcagttttatttatattctcaacattttatgaacactcacagcaactgaaacatcatctcctttaaaaataacctgggaacactgttgtcacaaccactgttctttaaacagcaggtatatcagtgagacagtggtcctctggctagcaccaattcagaattacagacattcctatatccatgtcatctttcttcctccctaaaatacaatcatgcacacatatacagatgcactccatgttttcattattattccatgacacatattccttttctatatgttttcatatatcagctttgtaaatatacctcagaggcaatcaattcaagatcatgtcaaaataaaagttattttaataatggcttgttgtgaaagaagtggatagattaatcaactagtcttttctcattgttgtcttagcaaagttcttcaattatacaatcactgatattagtttcctgaggctgtataaacaaatcactacagtcttggcttaaaacaacagaaattcaccttctcaaagttctggagaggcctgaagtctgaattaatgtgtcaacagtgttgtcctttctctaaagactctagcgaagaatgtgttatttgtcttcagcttttaatggccattggcattcactgacttgtggccattactctgcctccatagtcactttacggccttctct

SEQ ID NO: 29572 - DNA, 1624 bp, Bovine  19866880413136
ttagttaaacatttaaaaaaaaaattcttcatgcacaattaattagaaggaaatttataacaataagaaattgtcaaactccttaggggtagaggttggcagagaaacggtagtgaagacctcaaaactgcttttgaatgtacacgcactaagtttttattagtcattttattctgatagctatccaggaggttcaaatgcctaaccactggagaccatcataaatacgcaagacagcaaaattttcacataatgagcataaatatcctttcaagaaaaaaaatcataatctagctcgctgtaatcaagtcggtattgttgcatgaagaatgctaagcagctgagtataggaaaatgttgttgaaagaaaaccagagagaaattactttgaaatgtttttcaaaaaatattttaatcccttgttattcagctaaaagtaattatgatataatttataatgagaacagagtctgtattcttactaataaaattctgaaataaattttaaaataactagaaatgtatcttctttatagtcaatgttttataggatttttgtttgtcttagaatgtatttataaatctgaacttccaaaagtattaattagtgggtatttttaaaatttagaatttttaatattaatttatgattagtataaaattaaacatatttaatctgaagtaggctttttttcctaaaataaataagcattgtgatcatatttcctattttaaaatatctagttgcatatgttttcaggaacaccagaaacaatctgaatagcacttgaaaatgagaaatgatgctatcaggttcctagatacattttatagaattttatttgtaaacctggccatttagatattgtaaaaatatccttcccatagtaaaatcctctttggacttattttcttttatataaatcaaaatttgaattctataatatttagatatatattaacataagcttttttagataagattgaggcctttttaaataaaggaataaacagaaagctttaggttttgtaccttaaaaaatgaaagtgaaagtcgctcagtaatgtctgactctttgtgactccatggactatacaatcattgggattctccagccagtatactggagtgggtagctgttactttctccaagggatctttccaatccagggattgaaaccagatttcctgcattgtgggaaaattctttaccaactgagccaccaggcaagcccaagaatactggagtgggtagcctatcccttctccagtggatcttcctgacccaagaatcaaacctggatctcctgcattgcaggtggattctttaccagctgagctaccaaggattacatccctattcttcttgtcaagtacctttcaaagaaacagtatcactaacatttatcctgtttagttgataagttaaatgagacacatggatattttattttgtcatacatatttaataattcagaatatttgagtttaggtatccacctatattcaataaagtaaataagaacaaaatttaagatacaacagagtcaaatcagatgttttctttagaggagacattggtaaggcttattcaaatatgccataatgtaacttcttatagta

SEQ ID NO: 29573 - DNA, 1160 bp, Bovine  19866880616270
ctaaagagaatctaatctttaacttgttaccaggtgaatttactgagcatgcctatgtagaattcaaatacgaccagagagaagggaaattatctgaggtgggcttgaaggtaaacagctgttggtgaaactatgaatcatctcaaaggaacattagctgaactcattttaaaaaagaaaattgtttttcatgttcaaaggaataacctcaaggactctgcactcattcttaatttgctatttaacttatagcttccttggggaagcaatatgatagactatttttgtttatttatttatttattaatctatttatttatttttaaataagttttctattttatggatacccaaatgaatttggagaggaaaactgaaatgtccttccacctagaaaggtagaaaaacatccatactcctgtgactaaatactgacctaggtttaatggcttaaaactgttctgctgattatgttttgtttattcttatttttcaaagtgaaatattccaggaaatttaggctactatacatgacacattattttatactttaaaaatcaatattattttatattttaaaagtcagttgtgtctgtgttaatgtaaacaatgaattatgcttctcttttgttctttctttgaatccacggagagtgagacagtctgattcactcaggtggacagttcaaattaaaaatgcttttctaacattgtgtcttatacttttaaaatacaatttggttaaacaaatggcaggaggaagtttattcagataagctgtaacaaaaataaaacaacatcaaacggttaatgcagctgcggaaatttaagactccaatgggttacacatttatactagatgcatttaagcatgtgtgtttgttattgctactttaaaatattccaaattaaattgaattagaatcaaacactatgacattgaagcatttctgaggaaacctaaatttctacaaaacacatttgcaaaatgctgccttaaatattgaagagctgtgaacataggttaattagataattaatttatcaaaggcaatgtgaaattataccaaaacatagtttaatcttttttaaaaaatgatatgtcaagagcaacatgatttcataatttcagttcagttcagtcgctcagttatgtccga

SEQ ID NO: 29574 - DNA, 2367 bp, Bovine  19866880824388
ttccaaagttaatctataaaatctttccctaaattaaactttattggtataatatttcaaataccccctttatccaaaattttgaattctaaaactttctgaaaaaaaaaaaaaaagacttatttttcttctttttttctgatatatcaggcagggagtagaaggccctttcctgaatttaatttggtggcaaaatgcaatcagaagggttttgaggctttaatgtttaagttcattaaaactatgaatctttagttcatagttttaatgtgaacatgtatattttactgatatttactttgtttacagggtattagacacaatgccctagatttgctgggtaacaagcttcaaaacgaccacaaatatattgaccagtatgtatatatggaggatgacatattcaccagataactggagggatttgaaatattcatatcacatttgacaaaaggatgaataacttcaaatacagaaattatgtaaacatgtagtctagaattaactacagataatagacatcttatagaagaatgagaattaataaacatttatttgcttaaaacttattatgctaatagtttatttattcttagttttttgaagtctgaatatgtctgctaaaggaagaatagatgttttgtttagacttgaaccaaaagtgttggtgacacatttatactcctttattcatcttaatgatttcaaagaaaatttaaaagttaatatcaatattcaaaagtttaactctctggttatcaccttaccatttttctgttcatgtgtatgtatctctttctgtgtacatgaagttaggaatacatatgtttgtgtatgtgtgtatatatgtctgtgtgtgtgaaagtattagtcagtcttgtccaactttttgtgaacacatggactgtagaccccaggctcctctgtccatgggacttcccagatgagaataatggagtgggttgccatttccttctccaggggatcttcctgacccagggatcaaacgtgggtctcctccattgcaggtagattctttgctgtttgagtcatctctgaatatataataaacatattagaaacataagcatagagaaaataatttaaatgtgatgagctattactagttcagtataattaagctataaaatataatttatttcacagcctattgatttttagggctgaattttatgaatgttcttcttgaatatgataaaatgaaaaggggaaggaaacccctatatatcagtaaacatcttttttctgccacagcttgtatgtaacaataagctcactgaagttttcattagttttaggctttgtgacaatataatgcaatttcatttaacagaaattgtttctgaattatttcatatgattgaattatatggaaaaacaacacattaagaaactcctattaattgatgtattatcactaattagattatattaggtaaaaataaaattaatatcaatgtattttgatagctcagatcatatttgttacataaaattatatagtctaaccagtaagagttaatattttttttcatattgctccatttctcaaatatgtagaaatatgaactgattgaatcaagttgaaaaaaacagaggttgaagaaggacaagtacttaacttttaatatttgggtaaccttcagtgaatggtatgtcaaaatttcttatatatttgctccttctgaatctaaaattatataaaattaaatagataacataattttctgctgaattccattcacagtggctagccttcctatatagttggtaatcttgctttatgaagtaatatatcaattttctttatggaaccccagcatgtctattttagaatatgatttattcatagagaatttatctatttcttctgctgctgaggctgctggcaggtggaaggaggttcctgcttttgctctcagttgggatgactcactttggcttccctggtggctcagatggtaaagaaccggccctgcaatgcaggagaccaggattcaatccctgggtcaggaagaccccttgcagaagggaatggcaacccattccagtattcttgcctggagaattcaatggacagaggagcctggtgggctattgtctatggggtcacaaagagtcagacgtgactgagcaacaaacatacacattccacaggatgatgactcagaggcctggctagagctacgaaactctgttgacttcttgcctcatgctcagatttttattgcttgttgtttgtttgtttatctgggagatggggaggaaagttcactggcagtctcctttcattgagaccagcaacccttcagagcatatcttatatgtagacacatcttggagaag

SEQ ID NO: 29575 - DNA, 3502 bp, Bovine  19866881006948
tttttatgatatctcaattagttttacttttgttttattacctggtgattttaactgaacttctctaaaagagtggtttgtacaatactccatggtatttactctgctgctaatggaatataatactcaaggccagaaaattgatgtggaattgaaaactccagctagattcttaaatttaatatttactcaaatctcaaaatgtatattaacttgagcaagtacttaataggttattcaataacagataagctgattgagttattgaaataaatctatcactctaggagtttgaaagtattttaacaataaactgtacagacttttcatttctaatataagtatattggtatccagtaccctcacagttataatgaaataatagaaataaggttgccataatacatatattgtgacagtcaaatgaaattcctatattcatactcactcttgaaacagactattgtagcaactctctattcgtattcatttatttgtaatcatgtcccaaagcatggtagctgaaaatgatcatgtatacagttgactttaagaatgttagaattatgaaatattgattaattttaaaaggaccacgttgaccctattttagacatattgttcacatatatacatttggaaatatcattgatactgtacagttcaaggcaccatctgttctataagctcatagattttcatcttacaaaccaacaccaattgctttaaattggtaccaaaaatcaatttaaattgtttttaatattttgcctgtaagaaatattaaatacagaaaacataaatgcagtattaaaatcaccaagaacagatataaattctccaagctttatagttgcctgctagtgtaagtgacattatacagataatatctcgcagagcagcaaacatattagtatgtgtaatgaggggtgacagaggatgagacgatgggatggtatcattgacacaatagacatgaatttgagtaaactcagagataatgcagaacactgaagcctggcatgctgcagtttatggggtctcaaagagttgggcatgacttagggactgatcaaccacaatgaaagtacattattgattttcagtgtttatcttcatttgacagaaatgtatgttaaaaaaaaagccatgaaaaaaaagaaaaaaataaacattgggtcttatttgcagttttcgtttatatcctcaagtaaattgtcagaattgttcatggtagtttcaagttaaagtattttttgaaaaactttctgaaagcagtagcatgttctgattggatcacaaaattccactcctttaagtagactagcctcattcctcaagaagttatattatgagctttgtgatcattcaaacttagaaaagatgtgtgatagcaagtcactgtctgctgatatatagataaataaaagatgcgtaaataattgaagagtttgggacagctgggtgtctgtagcaattgaagcagagaaagtcacactgtgaagctttgaactaaatcatcttgttcacataaactgatggggtaattgagagaacaaaaaagggacaatacatatattacaggaaatgcttgtctctgacatatgactcactatgctatgctatgctaagtcacttcagtggtgtccgactctgtgcgaccccatagacggcagcccaccaggctcccccgtccctgggattctccaggcaagaacactggaagtgggctgccatttccttctccaatgcatgaaagtgaaaatgaaagtgaagtcgctcagtcgtgtccaactcttagcgaccccatggattgcagcttaacaggcccctccatccatgggattttccaagcaagagtactggagtggggtaccattgccttcactaagtaggaatttattattaatacttatattatttatgtggattgtttttaagttccttataagtctaccacaaacaatttagaaaaattcacagtatgcctggagagggaatagcactatcatacccatcattttgggcttccctggtagctcagctggtaaagaatctgcctgcaatgcaggagacccaagtttgattcctgggtcaggaagatcccctggagaagtgataggctacccactacagtattcttgggcttacctggtggctcagctggtaaagaatccgcctgcaatgcaggagacctgggttcaatccctgggtcaagaacatcccctggagaagggaatggctacccactacagtagtctggcctggagaatttccatgaactatccatggagttgcaaagagtcaaacatgactgagtgactttcacttcacattcacacatcattttaaaagcctttgactgttgttaagtattaagttttctgatactcttttttgtacatcttttctccacagaaagaggaaataggaatagaaatttaaatcatttgtccttcagtcatataataatattgtgattctcattctgcaatagacttaatagggtatcactgagggagaatgcttctgattagtcatattccattatttcagacattcattttctttcacctcacaaaaatcatatcataaatgcatttttaatgtacctgtaaaaattgaattatttatccagtgctttgtatcattctgataaattagatcatcaagaaataatttttatttccaaggcaggaagtcatatgaagaacaattccaggactcaaaaagtctgtgtatacctatgtctgtataagttaggtagcatgcaaaatatgcttataagcttttaaattatttacatatgttgtgtccatatttgtgtttgagtctcattctcatatatatatattatattttcttgtatatatgcatgcacacattatatattaatatatgtattcttaaatgtatacatgaatgtatagatttattatattcctcaaaagaatcactccaagtatcaaagattcctatgaattttcattaataactgatactaaattttaaagaatatattgcatgcatgatttatcaaatacaatataaaatatcatagaaattgctctttagaatatattttatgataaaaaccacataaaattaaactgtaaatgataatagaggcaatgggcatattgatgttcattataaaattacattacctactttgagtgtctgcaaatctttataatgaaatgttttgaaagaagtacaataaaaataagtgtatagtatggtgcatttttacaaaatattgcactattataaccagctcccaaatcaggacataaaacatcaccagaatcaaataaaagccccctctattcactttaagtaactgatttcctcagtctcaacttcttattacaaaaccagttttttcggtctaaattttatatagatagacttgcacatattttactctttgaagtttatctcaatattatatttgtgaggaccatacctattacattctcctgttagtgaatttttttct

SEQ ID NO: 29576 - DNA, 924 bp, Bovine  19866881055022
acctttgatttttagatatatataccacctagtaagtttcatgtactaaacaataaaaagtaattatatcctgattctatttattttttaaataaattacaaaattaagaaaatatacatcactgcacagtgtggcataagaaaaataggtacatatgtaggcaatgcctaaaaatatgcttctattccacaatatgataaaacaatacattaatttatattactaagactaagatgatccaagaatggatcacagaaaattattaagtgaacaaaaacaaaataatatttgaatattacagtatatatattatcaatgataatggcttttaaaatgttttcaataatttgtgttttagttaacataattttacattgaactgttacttaaataattcaataatttatgtttttaagaacactacaaactgcattactttatcaatacatttattatgttgaatatcatcttacctgattactcttttaatatgtacacttttggtaattttcccttatgtatgtagtcttaacataaattatatttagctgtcttgaataaagaatactaatcccccaaatcccaatatataaaagacttctacgatatgaagttaaatttttttatcttagaatatataattttaaactatcctaatattgagctattgtggatatatttcaacagttattaacattcctctttcaggttcatatcaagtcatcaaaaatttgaagtactcctgaccttttcctgaatgtgtaaattagtaatctaatggcaatattcagacaggcaaatatagaccaagctccctttgatgaaaacaacatgaggtaaggcttccctactgagaatcatcttagtttgtgaaatagtaatttggaacggccctatctgctaagtatatgaaagaaagaaaa

SEQ ID NO: 29577 - DNA, 544 bp, Bovine  19866881328171
attgaacactatatattttaaatctcaacatatgtattgaggttgtcctttatttgctctatgtgtttatcttaacttttactaagctattcaaataattacagtaaaaaacaatattgctatttaacacagttgacaggttcatctttggcacataaaaatgccatggctgtagttcaatattctgcaaattgtatgaatattgctcccacattactagaaggaacatgtctaaaattaaagctttgtataaggtattggaggataaaaacatttataaaaaactcaataattatcaaaatacaaaacaatcaatagaaataatacaatttttaaaacgatgagctttgtaaaagcatgatggagaaagatgggaaaagtttatctctagctaagtacaaattatagatgagtaagacaaatgtaagaacctaggaaatgatttccatagtttaatcacttgacttctatagctctgttgcaatatgaatgttgattactaagtccatatgggttataaaaagtatcactaaaaacccaattg

SEQ ID NO: 29578 - DNA, 834 bp, Bovine  19866881348553
ctagaaaattaagattaatgtattattttattatatatgttattactaatgcatatgaaactcatgatgatgagaagattaagtgaatatagaaagaaatctacaagatggaaataatttacttaactctttgacagaatattaaaaatgcatctcctaggtagatttattgaaagaaatataattactaattataacaggaaagattagaagatgagagcatagttaataattgcatacaaattgcttcactgcatttaggatttgcataaatgtttcttaagaaatcaccattatgctattgttcactgaaaatttcctatgtcttctttcttggccaaaaatgcaatatgttattttatagaaaactaatacctgagatttctgataatctccaactgaaggcaaaactttaattagagatatgtaggtatagtatcaaagtgcctggatttatagggctcagaagtctcagatctcagaggtattgtggattctaattgtctccttattgttcattcttcttaatatgctctctctacatctcttctccaatccttctcttctttatttttatccaggtttaaaatctttgtgggaaaaatcttatggtgaaatatgaaatgatactatggaatctgaaagtattaataagtaagactaaaaatgacctgatgcctgaaaactcggccttaattcttcactgaaaatgaatcacagtcagggatactatctcaaaaccttgtgatatttagcataaacaatcgttaaaaatgaatcacggatataaaaataagaaaatagtatatacttattttttcacaattaagtttg

SEQ ID NO: 29579 - DNA, 2411 bp, Bovine  19866881465092
tttctcctgattatttgattttattcatagaaaatagagtttctgtgcactgttcatatacagtagtataatatagaatgctagtttaaatgctttaatgaaaaataaggatactctgccttcttttcttactgcttaaactgtctagtgaaattttatgtcttaatcacgttaggtctcacaggcacaataatatttgaatttcaccatttattagggaaagtggagcttcattttaagttgaattcccttcagaggcaaatgataggctatggttttgtatttgtaaaagcgtatgctgtttgagtgccaccactgttcatcattatgaatagggcatggttaagcagacaccctgtcacagctgaaatacatgatcatcctttttttttctttatgtacttctggatttgtgtttcatcgtatccaattactagattatatcttgccatagaatcattcaccattcttgtctttggttctttaggtgaggtgacaaccaaagacactgctattgtaaaagtcagtcatggaagaaagtgtagaaaagttcaataagatttttgaaataaaatgagatattcttgaaacttagtgaggcagaggttttttaaagccatttttttttttgccctttaaagtgttcacattgtgatttaaccacattattactaggcgagataggggaatctcatttgatacacttcattgtattttatattaaaattcagggattctgaggcttttaatgcatagaaatgtagcagaatttacatcttctactttagtaatcagccatgttattgtctgttaccctttgctgattccagtgtcagaaacaatacttctatctatgtttcaaactgaattcatatatgacctagggtacaaatgaaattttgcacaatcttactttagtcaggaataaaacaaaacccaaacaaaaaagcaattaactgaatataatttaataatatcagtaacttttctccacacaattttgacatcattatggcaaaataaaatatatttgaagtttatgtcaacctatatctcggtatatatcatctctttatatagaaacctatatgtattttattcctgaaaaaattaggataaaccttttatttttaaaaaaaatcactgtattttatagttaaaaatgttcatttcttggaacaaggtagaaacttttagatgtagttttttttaattgaatttgaataataaaaaccataaaatgacagtgtaggtccagaaagctgtacctgaaagtaaattcagttttgatttttcagaattaaagcatctctcagagtaggatgaagatcttcaaataggttctttgtggggaaatgggatataaacattgttaatttttatctcttttttacatttaaggaataaatattttaagcacaatgccacactttttatgtaatttagaaagttgatttgaaaattcttctgtaaaaatgtcattggcaaattgctttgaaaaaatggaaacagtgttgcatgcgctatttgataccaaaacactataaatcagtcagaattaacacacactgggattggtcaggaacacacaaacgcatggggaaacaaatagataacccagggatagactcaaagagcaaaactggcctacaagtatttaacagtttacggagaaagtgtacactttagtaaatacttgtaggctattttgatatctattttgggaaaaatcaaagtccttacctaacattatgttcaaactgaactaatgtcatttctcttgtaaatgtttaaaaacactttaaaataattatagaaaaaccaggagactattttaaaattcatttaagtacatataatatgaaactcaaaagatactgtaaaacaagtaaaacactcaagtggcagtctggctacataacattttcaacatatgtaaccaaagagttcttaagataataaaattacaagtaggaaaataagttaaaaaaatatatgaataaaatctgacacatatacacaagaactacaaattgttagttaacatataaaataattagctttactagcagttagggatatgaaacctgtaaaaataaaaccctatccttcccatttgacaagcctttaaaaaacttaaaaatctaaaactgtagaaagtgtgggctaaagacattctcttccaatagtagcgggattgtgaattgatggctaaattaagttttcagacacagatttgtttttaccattaattttaaaaatctataaactcaaccaagcagttatcatctaaaaaaaactagcatatgtgcatagatgattactataaaagattgattattgtaaaaacaaattgctaaaatgaccttaatgtccatcaaaattgagggatttatttaaacacggcacat

SEQ ID NO: 29580 - DNA, 1697 bp, Bovine  19866881730382
ttactctgtagttcttcttgattaggttctcagaattgtatttaagcttttcttttctttcattttgtgaaagaaaaaagagggggaaaaaaagcataggctaactggcttctttgagttctgctaaatgatttgtttcatttgggattctcaaattatcaaccccatttgcaagagaacaatctgatcatagctgtgctgctctgcagtttaaattagaattttggaaatctgaggatttaaattaaagctcatacctaagataacagaaaactctccgctctacactcatagagagagtaattatatatgaaaacctgaaattagaagctgaaattagagctatattcactcagtcccaaagaacagctattttttcagacctcataatgaaatgattccaggtaagataatatacatgccagggccattctgtgccacgtttgctcagcccttattttcttctctcaagtatatcgaatccctttaactgcctttgttggtaaaaaatgctttaaactatttatagattacaatatttgacaaagggtttttcttaaatttagaaaaagaggtaaaaacgggccatgtttaaataaattttcttttgggttttatttaatattcctattagcaaatactaataagaattaacgggtgtctccagtatagttcatccagtgataaggaacatgatgcttttatttcaatatatacataatgtttcagttaatgataaatgattttatgataaagaatatgcagagaatataaaaatactattaagaaaataataagtagcacttgctgagcccttgttctaaatcagacagtatgctaagtatttcaccagtatatctcataaagtcttgacagaagctgtgatatgtatatttatatatatacatataagcatttatatatatatatagcaagtttttacaataccatacatacacacacacatacacacacacacacatatacccacttattggacataaaatgatgactttctttaaatcacaaagatagatttccagagctcagattcttcacctaatatagtaaaatgtgtcactatttatttagttttctgaacacagaaaaatcattttattaaaattatattggtctatttctagtacattgatttcatgttttatgtgatgctgcttttatattagcatgcaaacacatatacaatagtatatatatacacacatatacacatatgcaaaagtatatagtataaataaaaactgaagaaatgcaaattattaaattgagtatgagaccaaatttaaacagatcaactacaaccatatttggcaagacagcaactgctaaaaactagcacaatcttgaagaagtaatattttggtatcatcaatagtgataaaacctattgatgatttttatcatggatgaatctgtttgtctaatctgccttaactaatccagtgggttatcaaagatcacaatgtgtgtaaagattcactgacatctttatacacacacacacacacacacacacatatatatatatatatatatatatatattataattccagtggaatcagtcatgtctatataaaagtttcatactttggtattgccatacactttcttgagcaagaaagggggtttgattatatagctactgcccattaaattagatataggggtatagaa

SEQ ID NO: 29581 - DNA, 2447 bp, Bovine  19866880124101
agttgcactgtgaagaaagctgagcgccgaagaattgatgcttttgaactgtgatgctggagaagactcttgtgagtcacttggactgcaaggagatccaaccagtccatcctaaaggaaaccagtcctgggtgttcattggaaggactgatgctgaggctgaaactccaatactttggctacctcatgcaaagagttgactgattggaaaagaccctgatgctgggagggactgggggcaggaggagaaggggacgacagaggatgagatggctggatggcatcactgacctgatggacctgagtttgagtgaactccgggagttggtgatggacagggaggcctgacgtgctgcgattcataggatcgcaaagagtcggacacgactgagcaactgaactgaactgaataagagcaaagaaattctgaagaatgaaaatataactcagatggccttatgctgacaaaataagcattgtgatggatgaaatccacaacattcatctgagaaccttgttccattgatctagagagttgggaggtgtctattctactgagtgggacataggccatgaatattcatttccatgttgtgtagcaaggtgggaaaaagaaaacatctgtttatcatagtgttttcaaatatttgataatgaaaggtgttcataaatatatatacaaatgtttaatgaatgcatataccttagtgcatatgtatagttttcaaatgtggttttcaaatatgaaagtaagtctttattgaaaaacttgcattttcttctgaaattaaaaaaaaaatgggttttgagaatgttttttttttaaaaccacaacttagagaaaagtaaaatacattcatcttcattacagagaaagttaaggtcactctgtccttaggaagtaagatgtcattcaggaccaccagggttggatgaatcttcattccctagcaagatttctctctggtaaatctaaccaccattttcatctaattcacaaatcctttttccatttttctctttaacatttgtgttcctatgtggtctaaaagttaagagcctagagatcatgctaatgaataccacaattctgctttgagaatatgtcctggaaaggaattcctaaattttcaacattaaaaatagagaaatcctaatagcatctgtttctaataatacactctaaaccaagcatgctgcaaatggtctattttggttatagttactaaaaaaagaacacaaacacttttctatagaacttgcattaaatcagccagcgtttttagaaactgatgggcaaactgaggtgcagaaaggttatataatttgctaaagctaacacagctagtgacaaagtcagactgaaaaccaaagtcttctggctgtcatgatgagaaaaaacttagtcaaatgagagtgttagagtatgtaaactagaaaactaattgcttgaataattaagtattaggttcatacaaaagtaacagtggtttttgcattgctgaaatttgccatttgatattggaatacattcttaaataaatgtgattatgttatacatcattttaatgtgcatgtatcactcttttttgctaatgaattattacttgcttattctatatttattttagactatggaaatgataatagacaaaaagaaaatttgaacgattttcttattcaaattcaaaatgggttgtaaagcagagacaacttgcaacatcaacaacacatgtgaccaggtactgctaaccaacttacaatgtactggtggttaaagaagctttgcaaaggagacaagagccttgaagatgaggaatgcagtggccagccatcagaatttgacaactaattgagggaatcacggaagctgatccttttacactaaatgagaagttgctcaagaactcaacgttgaccattctacagtggtaaggtattttaagaaaattggaaaggtgaaaacagctcattaagtgggtgcctcatgagctgactgcaaatcaaaaaaaaaaaaaaaaacaaaacacgttttttgaagtgttgtcttattttatgcaacaacaaacatgtctctttggattgtgacatgcaacaataagtggaatttatatgacaactggcaatgaccagctcagtggttgaaccaagaaggaactccaaagcatttcccaaagtcaaacttgcaccaaaaaaaggtcatggtcactgtttggtgatctgctgcccatctgatccactacagctttctgaatcccagcgacatcattacatctgagaactatgttcagcaaatcaatgagatgcaccaaaaactgcaatgcctgtagcaagaactgatcaacagaaagaatccaattcctctccagaataacaccttaccacacatcgcacagctaatgcttcaaaagtgaacaaattgggctggaagtttgcctcatctgcca

SEQ ID NO: 29582 - DNA, 937 bp, Bovine  19866880378777
atgtgccctacctgaggttgaaatttgagctccatagatgtgaatccgatatcgtttataaacaattgtatccttaattaagtactttttaagggaaagtgaccacagattttaaattcacaaatggtcaggaaaattaaatagtttaagaattagtgatccatgctactttttcaggcatgaaggaacagtatgtcctcaggggaaaacaaggtaaacatgtcaggcaggaaaagctaccttttcaggagagtgaagagatgagagtctcttgaaagcagatgtcttcctaaatttctttccaatcctaaatctcacagtaggtaggcccactgaattccatctctgctgctatgaaaagcctttacctgagtaaatacgtggggcctgaaagatgtaagaaaaatgcagctttctttgtttttttctttttctcctttgctatcacctcctttattgtagacataaatggaagcaaacgaactctctatgaagacagagtatgcatggcttctttttgaaactttggtttcttttaaggatgaaattattttatggacactgagaatacattaagcacataaaaagcacagcacaatttcatgaaaatgcagacatgtataatttataaatcatcaactttgtgtcgtgattcaaaattctcatctttttatgagcacaggtcttggaaaagatctctgatgataaaaactagaggaattaaagccctatttttggtttatcttgacataatagttttactactatgaaaaattaagttccatattgactggacagccacttacaggcacctcttgaaatcatttccaaatgaatacacttttgtgtacaggtaaaacaatgcccaatatttgcttgccttcaatggactttcatttgtttcctctgtaaggagcaagggctctgataaaaagca

SEQ ID NO: 29583 - DNA, 1067 bp, Bovine  19866880385787
cgccgccagagcgatgttcccgcagagccggcacccggtgaggcgcggtggtggcggagtggggggaagggaggtggcggagtggtagttgttctttctgtgcggtgaggagatgggtggctgctacaatctgaccgagccccctggcctccaagggtacaagacttgggaggtcccgggccctctcctcctgtgtgggaagggggctgaaactctcaattcaacccctttgctctaggctccctcctacttgacgtctagactgggcgggcggggcgcttggggagactggggtttctcccgcggccgtatcctctcccttccccaggcgggtagtgcgcccccgctttgtttctcgtctcgcctatttacatatcaatgaggccccggttccggcgcgcctggaggtggccccggcgactctgggaacggggaacatcagggagttttctcctctggtcccccgggtcattatcgccccctgagggaggaggcggcgtcgtcgacgacagtctggccaggtcctccacggccgccgccgggaacccttgtcccttcaaccaggtgacccaggcgcacttaccgcgtcccgccctggaggctggaagaggctgcgagcgtcatttgaggaccttcggatctgggaaggtccaccttccctctccccaagtgaagcgctaattggagttcgggactccgtttggtgccacttctaactttatttttcgtttatgtcccacccactctttgatactccgactgctttatccaaccgcccgcatccccgtcgctcggtccccctcgctggtcgcccttagacgccgcaccaggctgcaggccagcccttcaagttcactatcccggaatccctggaccggattaaagaggaatttcagttcctgcaggcgcagtatcacaggtgcgtgtcgcgccgcgcccggggaagtgggtcgcccgggcagcgctgtgccccgggtcgcccatcctggtggtggcggcagctgtacttagtacttgcgtccaggcggtggcgcgtggagtcacagttaagacctgtcattcacgtt

SEQ ID NO: 29584 - DNA, 3815 bp, Bovine  19866880388877
taattctgtggccctgggttgggttatttagagagttttggatctctgcaggagaacagagttccccaatgcttgatcatgagttacattctcaagtcaggcatcacttgaccaagccttcctttgtgctaagctggtcagggcagcagtgctgagcctctgagagcctccagagcagaggctgaagtctgagttttcaggacccaaagtcctatctgagggacacagatgttgactgttagcctcagatgctatgccctccttgggcaggtgacttctgactgagactatcaagggtgggcttcagagacaaaagtctttctttgggttttttaaagaaaaaaaagttgaaaacattttaaacctttaaaattggcaaaaggaaggaacacaaagattagagtcatattattcctggataatgaatatctgagttttctagagaggactgagagaaatgagccccagcacttcattcttttcgttttcagtgtcagagcagaaccaggaggagaaggaaaggtgtcacactgaaaggtaaggctctgcctgtttcaccggatctctccaagggtgacccttcctgccttttccatgagatcccaggtccgtgacctctgacgatgtcagtggctagataccatttctctcagaaaccagaggtatctgggaggaggctcatggggaggcagtccgagtctgagacacttcttggattctctgtttttctcatggctcggcatgaagccatgatggacctgggcaatgggtgtttctccacaggtggccatgtgagatgtcaagagtcagaacgtctgtgtcctgactttgtataagtcctctgacttcctggataatcagattgctctctgaggccacactgatctctgtgtttcacatggtggttttgagcatcacaggagatataaagcatgtgaaagtactacaagtgaagcaacatacatataaagtaattgaccatttgatctcatctgctaattcttgggtctttcagagtctagaatcctaagggtttcccataaggggactcttacattatacctatgcttataccttccttacatgtaacccactctcctggtttcgcaggttggagatttcaccagatagaaacagaggaaaaaacgaagctgatttctattctgaaaaggtgactagtctttccccttctttcctgatccctccttagtatgttctctgcaattcctgggattcagtgcaacctactgtagtcatgggagggggtagcataggaatgagtatgtgatgaaggccttaaggtgagggttattgagcatgttgtgaagtcagggatgtagagcaatataaagtggcagcaggctccagcccacccctgccaggccagcaggtcgccctttccttattctggtcctggttgcatctttgtacttcctgtctcctgcagccacctgggccagcatgatgataccatccgctttcgtcagctcttatgtccagatcccttctgtgaggtgtgtaataatgcaactgctgaagtcaattggttgctgttcccggagaccctggaagattctgcttcctctatgtcccctttggcttccacagctcctgtggccgattcatcattgactctgtcccctgccttctcagcagtctctccaggagatctactaccagcctctctgcctgagccttccccgttgcccccctccattctttcacctagctccatgacccctttagctgactttttgtcaccctcaccactgggtcacactctggcattagagccttttacttctttggattccgaattcccagtagattattcctcaccccaaccccttgcctttccccctctcctaccacatgacatgcagacagcagatcctgttctcccaccagaggccactttgtctctgaataccatcttttcccttgaccccaccctttcccatgatatcaaccgcttatcagatttgtcccaagcaatgaagcccgctgattcttttgcaccaccaactctgtctgttttaccacagccagactgcactttaactgtcactcagtctaaatcaattgccatcttactgacacctgttcctgagaatttgcctaccgaaagccctggcatgttgtccacttacgtcccaacactcacaggcattgatcattcaagcctgtcaatttcagacttctcctggtggcaagctcatgccaaagacttaatcccttccacgttggcacaatgtgatttcaatcaagagtttctcgccctccactcttcagaggcctcttttggcggagaccctgcagccaacctcatagagcctggtaatctctcatgtctcagccctgatgtcctggcactcctggagagacaagtacaaaagaggagcgatttcctgatgtggaaagaaaaggaaaagaaaaaagattcttttccagaacaattgaggccagactatcaactaaattcctcagggataaagttagagtcagttgctgataagcctgtgcatcaacaacccccatatcctaagaccttggaggaccaattacagcaaaaacctacccagctcttctggggtctcccatctctacacagtgagtccttgccctctgctgttgatatctccagtgacaattcctcaaactttattttcaatagaaactcaaatgcctctacaggccaagaatccccaggacttccccatctccaacctctgtccttgcctgagattcagcctgaatccttgcctcaaaccctgcctcagtctcagcccctacctctcactcaggtccagtcccaagctgacccaaaatccccactcctggtcacaccacctggtcctctaccccagattaggatctgtggagtgtatttccatagacctcagaatgaatcagaatctctctcctcatctgaaattcaacagctggaatggaacgtgttgcagaaacaacaggaaagtttgtggggtttaccctctgtgatccaaagatctcaggaagacttctgtccattagctcctaacacttctcaccaccagcaccctcaggcccatgtttcagtctccattcttcctggggagtttgttctcagtgatgaacttcggaagaaactagagcatcaccttcgaaagaggctcattcaacaccggtggggcctgccccggagaatcaaagagtctgtgtcactgatgttgcctccaactggttttttagaggcatctaagtcagaaagcagtgatggagtctcactgatctctgtgtttaagggtcagagtagcaaacatgtaaatgttgaattgattcaacccggaagcttccatgagagaagctcggaaatgctccagctagagaaagatgtggggaaagatcaggaacatagccaagagaatggacaggaagatcacctgttgaaagacccaaacagctcttcagataaggatctggggtatgactctgagaaaaacataaacagtcagatcgtgagtctctcagagaaaaatttaagggtgtcagcagagagtctacaacttgaaaatgtcctaaaagtacatttgagtaagaagtttgaggaaataaatgagggtcgactccctgggactgtgcatagttcatggcatgccatcaagcaaacattgattctttctgcgaaatcccacaccaaaataaaagagagaagtttgacatcatcagtgggtgagtcctattccttgaataccttccaggacctgacttttgttgatcccagtgcacagcagatgcggaagcacatattaaaaggtttcgtataggatgttgtg

SEQ ID NO: 29585 - DNA, 1342 bp, Bovine  19866880451285
catgcacacacacacacacacacacacacacacacataacatcatatcacacagaaacaggagctattctaaaataagacagttgagattccttcagaattcacatgaattatttggctttagtgccatcccacatgtttaaaaccatgtaagtcatttcagtaaaccagaaagagttgtgaaagtcatgatttcatctccaataaaatgtgaactgcatgtacctcttcaatttacaactatgcccattgtaagcaactttttcaagttagagccctagagaaagagcacaaagaaaaatctcagctcttaccaccaagccaggactcttggacccaacaagcatactacttcacagccaagggtacccctgggtgaatttctacccccttcttcctctagaactgggtaaagtaaagtgaaagggcaactaggcatttaaacaaatggcttatcttagaaaaagaccattttaaaaccacagattttgacttttctgtttgaagaaaatgttgaaggcctctttttaagtcttcatcatcaaataatgacaatgtctctttcttacatactttcaggcttatagagagttttccagatccttttttcttccttatttgtttgactttatggcgtctacccaagcctagtaggtagtgttatctcttcatctacaatgagccatctgaacctcagatattttagttgatttgtcaaaatacaccaggctggactggaacctgggatgtctgtctctaatccagggcttggtagagaccattttttctatatatgcataagtatatatttgcttgctgcaactgttaaatgctatttagaaataaaatgctcccagcactaactatgtcttcagggcccacggctattcatattcctccctaagcacctaatttacctctctgagtggcttggaccagagggagtgtctgggtcactgatgattagggcactgtgcactccccagtcactgggtttaatgttccctattttatgacccagactcagtcccacctctctgctggattgcattgtcctgaaatatgtctatatgcacccagggactccagtaatggacccataaaaaattcagtaaggaaatgttttaatcaaaagacgctgtctgacatcacagaatcaccggaattctcatttaaaattggagcgcatcactgaaaaacgttgattgctgttgtaacctcactggtttctaaatgcattctgttcatgctctgctgttgatggaactggctactgatgtgtatccgtagtatcctttgtataatgaataaaaatttcaaaatatatgaaaagggcctaccct

SEQ ID NO: 29586 - DNA, 1198 bp, Bovine  19866880535234
aggataaactgacatgtcctacaatgtcacacattgctctctgcgtgaactagatatcccgaaggatgtggacctccttggcagctcatgggtttttcagtttccatgaaaaccttacaaagtgagtccatgtgggtatttactcagtatatttctcaattagagtccgacatggacctcatgcaaatataattaatctgtccatgctgaataaaacagttgtagtatcacctatgcgatttttatataagaagttaaacatgggagaaacaaaattacaaaaatgatgactgtttcaattataggtttgttgagtcagttactagataaactcattgacagataatattatgcagttagcaatatatttatttgagcatatctatagtggattatggaaaattaataccttccttctagaaacaaccacagtggcccataaagggcagagagatggtggcaatatcaatctggcttcccatttgagtgacatggacaagcttggtacctgaaagtctgctatgaagtcaggggataattttcacaaagggcaagacagacaggccaccctctaggcaggtttctgtgctgctcctatcaaaaccaccactggaatgagtgacaaataagactgtctcaggaaatgaacctcacacacaccctgtcttgaaccagctttatccaaatagctagggaggttctctaagatactgatccctaagctccacctcaaaatctagggtaggccctgaaatctggactttttaaagttctgctggtgactctgatggacagcctagggtggaaaccagtaagttccacctggttccttaggtgacctaagtccttactatgcaatggaaaatagatggggaaccagtggaaacagtggctgactttatttttgagggctccaaaatcactgcagatgatgactgcagccatgaaattaaaagacgcttgctccttggaagaaaagctatgaccaacctagacagcatattaaaaagcagagacattactttgccaacaaagttccatctagtcaaagctatggtttttccaggagtcatgtatggatgtgagagttggactataaagaaaactgagcgctgaagaagtgatgcttttgaactgtggtgttggagaatactcttgagagctcctggactgcaaggagatccaactagtccatcct

SEQ ID NO: 29587 - DNA, 3503 bp, Bovine  19866880592095
tgcatactttgtctacactttctttgtgaagggcaatgagatgtttgtggttgtattttgtgacttgtaaagtttaatataaatgatgttattatgtgagaaaatatgaagcctagatcaggaatgagaaggtgctacaccaggtccaaatgtgaccttcacagaatctctctgaagcccaaatctgacttctaggtgaggggtcagtgcagggaagtgccagaagaactaaactgaatctggagatctaagtcttagccttggatcacaactaatagagctatgtgactttggatgaaccactaagcctctccaagtttagatttgctgttctgtaaaatggggtttgaaagggggccctctatgtgaatttcagcattaaaattctatgaggtcagccaccttgatttcagaagacattgtgtgctttgtctgaatatacaatacagatttctgctgtggtgaagagatggttaaatgtatctttgacaacaaagtcaaataacactcagtaatgaaactccctgatttcattttctccctcctggatgtgatggtgtacctgcgttctctctccttgtctagctgcttctcagaagtgatgtccagacagaatggcctctagacagtgaacttccctcacacagcagagttttggggcctcctgcggcatgtctgcccacctcatctccccacagcactcactagagcagagaagattaactttccgaaaatgaaaaggacagagagaagacgagctgcttatcaaatatgcacatttcagatggaacttcacactcagtagaaagatgttagattgctgttagctctctggagcgctcctgacaatgtgttatcaggtcatgtttgcatgacagaggcagcccaagcaggaaacattaagtcatatgacttctaagacggaatcaatcaagtgagcagtacagctcctgaaaactaatttcaccttcataaggtctggttatctgtgcagcagacatgaggtttgtcagccccatttcagtctgaccaggttcagcactgcatcaagaattttaatgaaccgacactgtaatatgtatgaaagatgacactgagatgaattcatgaaaaaccaagtccccatgaaatatgaacaattacttgcgggcttctccacctacttagctcatttgaaatgtccatttcaaaggcctttgtctttctggggttcatttgcaagtttgtgcacagattttcatcatatttaaccagattaaaaatcaaaggagctacttacaatcaaacagttcagtgaactctagtttgatgggggcagagccaaggctgatcagagcttaaatcttcatttggctgcagaagcacagatttccttgtatggggagaaaggggcctgaaaagactggatccttatgcccactccattctaggctttcagtgtggccctaaaaaaggtcctaagttctcatcctaatgacagcataccctctctggtagtagtaagatttatagttttcagcttcaagatagcactaccagggttagccttattttagaaactcttaaaatttgttagtagatacatgttgaaattacaaatagctgaagattatggttttctcttggtacgtggcatcccaatccattctccagatcttgtatcccttttatgaataccgctgccatggacatgcattttatttgctgatctgtataatttagcatgtttcatatactgttaaccacaattcttagcttattctcagaggttacgggccatatattactgtcctcatttagccgcactttcactgtaagctccttatccttcagcggaccttgcttcccacattacagacacactttcatcacctagctcgaggacatgatatatatctctcttctatctttctttaccttatttctttatcttaaatgtaaaatatttcaaatatacagaaaatacagagatattttaaaaacaatattcatgtatttactattcaagcaaccttagccagttttactattttgttgtatttggctcagatcttttatctaaataagcaaaaacctccatgataaggacagtggaagaccccaatattctctgcaattttttcttgccgcctccaacaaaggtaattactatcctggacctggcaaatacattccccatacatgctttattatgaagaaaatgtttatgtgttccattaaacaatatgtggcactgtttccatgttatacaagtgttatcatgctggatacacacttttgtaaattgatttttctcttactattatactaatgataattcatattatttcatatggttttatttcattcatctctattattgtatagtattccataataataattttataaataactagttccgtttggaaggaaattaagtgttttatgtcaagtattgataaaagacaagtgaaagtgttagtcactcagttgtgtccgactctttgcaacctgtgggctatagcctgccaggctcctctgttcatgcaattctctaggcaggaatactgcagtgggtagccattctcttttgcaagttacaatgaatattcttcaacatatgaggaagaagacatctagggtgtatggtataattagaagtgtatactaggttaaatggcatgcacaattcaactacattagattattctctaatgtaattaaaccaatttttagatcactttttatttatttttcagctcagttcagttcagtcactcagtcatgtctgattctttgtgaccccatgggttgcagcacaccaggcctccctgtccatcaccaactcccggtgtttacccaaactcatatccattgagtaggtgatgccatccagctatctcatcttctgtcatccccttctcctgccttcaatctttcccaacattagtgtcttttcaaatgagtcagctcttcacatcaggtggccaaagtattggagtttcagcttcaacatcagtccttccaatgaacacccagaactgatttcctttaggatggactggttggatcaccttgtagtccaagggactctcaagagtcttctccaacaccacagttcaaaagcatcaattctttggtgctcagctttctttatagttcaactctcacatccatacatgaaatccatattcactggtatggagtgaatgagatggagtgaatctatctcacatccaaagtactggaaaaaccacagccttgactagacagacctttgttgacaaagcgatgtctctgctttttaatatgctctctaggttggtcataactttccttccaaggagtaagcgtcttttaatttcatggctgcaatcaccatctacagtgattttggagccccccaaaataaagtcagccactgtttccaatgtttccccttctatttttaatgaagtgatgagaccagatgccatgatctttgttttctgaatgttgagctttaagccaactttttcact

SEQ ID NO: 29588 - DNA, 2812 bp, Bovine  19866880604393
ccacctcagttgccaccacacaaccatcaatttctacctttaatacctccctttccttctatattcatctccagttttgttattgctgccccagtttacattctcattataaatatcttacctggactattgtggtatctcccccgggaaaacactctgcattcacattttccttcagattaccttccaatgttaagacagaggtattgtcatgtcatttacttgcttcagaaacctttggaagtaccccattgcctaaagattaaatggatacacattgtattttttcaacttcttttcctattatccactacatttgacatattgcagtcaaaccaacctattggactttcacaggacaccctatatgtaaccgtacattgttttgtctttggtgggattacttcctccaatccatgggtagtttctactaattatttaaaacccagatctaatgctgttgtctttgcatgtcttccctgttgcataattagaactaatcactttcttcttcgtgtttccacttacttttctcatgcctctgtttcaacaatatcttactattctgtaaacctttacatgcctgttttgcccttttgactgtgagcttctgcagggatgagaccatttttcattcatctttatcatctctctgcctagctagcatgttgcctggaacacaacagatgctcaataaatgtttttaataaattaatgaaataatgaagctatattattatatcaaaatagcaacaggacagtgttttcaattttagataatatgtatcttctcatctggtatctgctgcacagaccaagacttcagtggggtacctaattctaaatgatacctgctgctatggaagcaaaatttgattttttttgaaccttattatctttttctttaaaatatagctagaaatccctgattcttagttgctatagaaccggatgagcaaatataaccagcaaattatttgttaactaatcatggtagggattttaaaaattgcttttcttcttatttcaattacaatacatatttgaaatagtaaatttagagtacatagacacacacacataaagtcatgtatcatatcactatcactctgcaagataatcagtattttggattatatttgtataacatttgattacaaaaggagagtcagaggatatatactgttttgtattcttggtattgaaagaaatatattaaaaagaactattattgaggatgcatttaactattatatgttttatagcataaatatggttatgctattataaacatgataatctgttgatagcagaaagtttcaaggcaaactgtcctaagcagtaaagaaatttatttctttcatcattcttaaaggttaagagatgaatctggctggcttatactaaggatgatcactccctggaactggacagagggtcaacttttctgagttacatgggtgaggggtggctaggattaacacattcaagagtttattcatcttatgagatgagataatattgacagtgagtaacctgcagagtcagtcatagtggctatagatcttcctcctttttaagtaagtgttgaagcctttttcacttaaaattgctcagtttcctgttgttgacatttaggtatttttccttcaatttttcagtgttataaataacacagctgtgaacaatctcatggttgaatcattgtgaaatccatgtttatatgtacagcttcagaattgtattaagcaacctgttaaaactttgtgagatgttgcctgtggggaaattacaccattcctaccagcaacaagagacaatagctgtttcctttaccttggacaacaactttgggcatttaaaagagtctgccttggccagaggcttttaaactatattagggaaatctgttcttctgcagaactcactttaagccaatgtgggttatttcacaagctgacttagctcccagtgcttgatatgattcacatggagcttgtatcagcttatcactttctcagttcagtgtatgttaattttcacgttgcacatgttcttttttcaaaattaattttgagtacagttgtttttgcacatgtgttcttaggagtgatcattagcagactagcaaacaaacaaaacaaatacaaaactaaaaaatacaaactacttgcacattaccaagtttgggaaaaaccaaaaaccatctgagaaaggataaattttaagggccaatctttttttttctaactctcaaaatacctttctcctatagggatagataattgggcccaaaccagtttttataagtgtgtacatatattatatatatatatatataatatatatacacacacacatacatatatgtgtatatgtgtgtgcatatatatacacaccatatacatttatatatacatacagttattaaaaattatccattgctcatggttctgtattttaaagattcattgtttcaaataggtttctaatccctaggccaggtactgagttcatatgagaccaagatcttttttaccatctgcaaaagctgttaagacatttaggtgtcccagtggtgatgatttatttttatttctctgagaggtcactctgatttaggagtgggtgactgtgggagtggaatattgtatctcttctccagccagttttccagttctacataaacttagaatgtttgtaagttttcttgccaactatatgatatcattaaatgtaataggtctgtacatttgcaagtgttacattttggtttcagtatgtgagacttatgaatccatagcataaaaca

SEQ ID NO: 29589 - DNA, 1124 bp, Bovine  19866880616440
ttcactcagactcacgtccatcgagtcaatgatgccatccagccgtctcatcctctgttgtccccttctcctcctgccccccaatccctccccagcatcagagtcttttctgtgtcaataagtaccttcattttcctctttcaaaaaaaaaaaaaaaggtctgtttcaatgcttagccctcatgaaagagggcaagaaatagacaaagggtaaactaaaaaggtgccatgcctaggacaatatcctgaatagtatataaggagtataaagaagactatcaggacatgtacatagaagtatagagtccattgctctagtaaagcagggaaatttttaaggtagtaggagacctttttaacaccttccttttcaaaaaagctgggatgtgtgtaaattctcttctattgccactgaagaaaagagagaacataagaggagataccattaattaactaataatttcaaagcttaggttggagagcagatttcaccaactatattagcattgtactggtctgtttaaaaaccgggctaaagatagccagggctatcaaaatattattaaaactgtatttgatctatgaactttgagcaattatagatatagaggcagagaatatgtgttaattaacataaaacctctgattcaaagtcatgttcactccaacagaggctgtcatagaataagtctcacacatcacatcagatcagccgataatataggagaaaaggaaataggaatctgagaacgattatgacagagacattcccttatcactaactagctaataatcttataaattatctagggaaacaggagtgatgttttgcagtgtatgcaaatacagagagaatttgtcaacagagaatttgtcaacaataccctttatatagttatattaaatacaaatatatatatatatatatatatatttccctcttaagctaacaatgcattaaattcacacagcacatgttattatttaaattatatcattctctttaaaatgctttcattgtctacataaagcctcatatcagaagaagctggccaagtctttttaaatatgaccattttggatattctcatttgtcactcgatccactcttcatttacccccacc

SEQ ID NO: 29590 - DNA, 1428 bp, Bovine  19866880672234
tgatttacattgaaatacttctttacaaatttactataaaagagatttactaatatctctttcatagagttgctatgagaagaaaaaatggcttgatgtgtgtagagcattatgtataaaaaaacccctgcccacatagtaagccgtctgttactgtgattctctgtttcagggatcattctaccagtggctccaagtaagaataatgggtactagtttaaggtactagtttaattgcaatatatctcaatctaggaatctaactacttctcctcagggaagacaaaaatcaatggtttaatgaaatgaacccactttctcctctcttaccccacaaatattaaatagatctgcatagagaatgagataccatcttttaggaagtactaattgtttaaagtacctggtggctcagacggtaaagcatctgtctgcaatgcgggagacctgggttcgatccctcggctgggaagatcccctggagaaggaaatggcagcccactccagtattcttgcctggaaaatcccacggacggtggagcctggtaggctactgtccatggggtcacaaagagttggacatgactgagtgaagggaagaaaaagaagaattgtttaaagtagtaattattccatcctccataagaaaggattaagtatttgttctctgaccttcccacagggttgagagtgcctaaattgttttttcctcccactccatatataagtcacagatgaggaaagatttgttagaaaatgctaagcaactgaactgatcggtcatctgttctttaggcttgagcatggagaatagggccagagatgggacagagttgaaagagaaatgccagggtggagcccatatgtctgtgtttggtatgataaggatgtgtgagtggaatctgactgaagtgaggtgactgagaattaggatttttttctatcacaactctctcccaggggccacattttgcttaaaggaagtaagaggatgtggcatgggtcacctgagatgggcctgaggtgagggaggaaaaagctgagccactgacagaaaccccacgtcagggagttaggcagggagatccccctggaggtcccacctgaggatctatgaatgcctctcatgagcaagtcagcatgaagctgaaaggggaaatgaggctagacagtgatctgtcaacaaggaagagaagccaatttaccatgtgtgattgcttgccgaatgccatcctttttctccttcattcttgcttcaatcccagaagaggactgacagcaaagatgatgagaagtagcatgagagaagacccagacccatccataccttcccaacctcctactcccagcctacagaacattgtctagcctatcatgtgtagttgttactgttgttcaatcgctcagttgtgccgactctttgcaatc

SEQ ID NO: 29591 - DNA, 1519 bp, Bovine  19866880672395
acctgtcctagcaacatttactctgcataagcttggatatggccattgtaataggctaaacattacatgggcattcacctatcctgcccattgggacttttattactagaatcaaagcatttgaatggctctctttaaccattaagagaaaaacaactttgagctagactaacataaggtaattactaagctaagccaaattcctctgccatactcttggcactgaggtatggaaactctacaacccctataagaggtctgaagggggaaaaaagcgtttaagacaaatttcaggggtctcaggttctcattaaaaatgcattttagaaaattgttttaagttaacttgctagggcagttgtatggcaaggaaacatgtgtagcaatttggcaaattgcagttctcatctctcctttaaaataaaatggtaacaataaaaatacaattaaaaataaaattaaaacataatctgaatgagtatttttattttttttcctaattaaagctttgcagttaaagttttgctggagaacaacctgtgtttttaatctcacaaagggctaatacatgcacaggatttgagatgtctgctaacactcagatctggaagtgaccttggagaaccttctagtctggcattctcattttaaaaattggaaactgaggccagagaaggtttatttcttttttccttaatcctttattttgtttgtgtgtgtgtgtgtgtgttttctcttggaagactttgaaacttggtatctgcacataatttagacattatagggcttttttcttttcagtatgaagacaaggactctgtatacctgtggcggattcattttgatatatgccaaaaccaatacaatattgtaaagttaaaaaataaaataaaattaaaaaaaaaatgaagacaaggactcaacaaacagcaaattttatccagtactacctcaaaaatctgtagcttttgcctaagtgaacttcacaagcaattaacatgctaatgcttctttgtgaaaaccaaatggaaatacaacatattccttcatgccttctgtaataaagtaagctgaatgtaacttcaacactcctttatgaccccagcttagtctaataaacagcagtagtatttcaaaggagcaggtgtaggtagtatgggacatggacacaaatatgcattgactccagcaatgactcccaagcctgctatcagttaaaaaatccatcacctgtattttaagtgtttacttcttgttcatataaacacaatgactgttcatcaaatatacatacacagtgcaaaagagaactgcctttagtagatcacatggctgccctaagtagttaatgtagtttggatcacttttatcccctcagtgtgggtgtagggagtgagggagttagaaaagaaatggaatagaactaagatttggtggatacttaatttgttacccaaactttcattcatttcttaactatcttgggagagaatatttctctcacttcacagctaacaag

SEQ ID NO: 29592 - DNA, 3110 bp, Bovine  19866880700885
ttgttgattttggatgtttaaaagtttcctgtttgtgtgtgtccatttgggggagaaggcacacaaatttatagacacaacagtattgatggagtaaacaactagaagtatttctcaagactttctaactgaacttgttggtaaagatggagtattattgtcccttaatctcccatccattacctgcaagcacataaactattcaattacaggcaaccatgggtggctataaacctcccagttcatggacagtatcagtcacattctccttcagtttctgctgtgagtgaataatcatcatgtccacaggaagcacgcaatacaaactgcaaaaaatatatatatgaatgtaaggcttacatggttttccatttaaggcaagcagttttaaatacaactcacacaagaaacaaggatcaaagctgatcatttaattataaaaactataattataacaatacatttaaaatagctactatatattcaacacctactgtatgtcagatgtgttattcagggctttactcaagtttctaagtaattgctctagagcttctaagaatgcataactttttggaaacatagataaaactcagggaccaggaagaggaaggatgagaggtggggaacagttagaaataggacctgtagtcacagcgcaagttcctgagaaagatctatcaaactgttcaaatgtgctaagtatatctcttatgatccatgaaactattgtaaaggtgatgtgcatttatcattgaatagccagatctcaatatcactcagccattttccgttgaaagtcttatctatggttgcagtctaccaagctttatttaatgccccagaaatcacaaaataattatttttatcattgaacatagacatgctaccatgaggttatgttcaattgcattctgaggggattgcatacctctgaccaaaggactctgatgctgggagggattaggggcaggaggagaaggggacaacagaggatgagacggctggatggcatcattgactcgatggacgtgagtctgagtgaactccaggagttggtgatggacagggaggcctggtgtgctgcgattcatggggtcgcaaagagtcggacacaactgagcgactgaactgaactgaactgattcacacagagcagaggatttcacttaatttagactatcatcccaggtttccttgtatgggaagtatgaatatataaagcaaggataagcactcaggctattgtttccctgtacaattaaattcatacctttgatataatttgcaaattattccatggagttagccaacacaggcaacaagcaaaaacaaaatgcctatgagagatgagtacactctgtatttcatgggaacagcaggagaccttttgaaactcctaaacttgctcaaatgttttaactgaagaactttaagattgccacatcatgttaaaactttggtggagataaccagcaaccttgacctacttaagacaaattgtggtttgtgtgcttaagaggacagtgcaattaaaaatatttatataattgctcttcagagaaccctgacattaatatgaggttatgaattaccagaactttcaaaaatgcaggaagaggggaaatttctcagaggggtggtcctggaatttatctacataattgttgcatctttagcgacaatgaagtcaccatgaagacatttaggcaactgggaagttactggcgggctgataaagcaattgaattatgatatggatctaattctttcgtcagcagcaattgtaagatctatatcagaaatctatcacctcttttttgagagatcttgaactaaacaactagccctgctatctttaatcttcctggcgtcagtggtagtctaaataactcatttctaaacaaatatgtttaaaacattttattctatttaaaatgataggcttgactaaatgagtccttatcaaattatagtggtgccttttgccctgttgctgtctccattagaaacctctatttttagaaatttgtaactcagatttccttaagggaggaaccttggcactcaaactactgagagagaaagtgacggttattcattgttattgcttgctccatttcttttttttaaattgctttgtttccaaactgaattatgggaaagcaaacaaaagcctgaagtaagtttagggcacctgtggtttttttttttttttttaaaccaatatctctagctttaatcacatatcttaaagatcaaaattatacactactgagaaaatacatcctgtctgtgctggatatggaaatattttctgactcctttttcatggaatcaaccaaaattttttctttctctgtctctcaagatctgaaggatttgtaattttatttgacttaagttcttcctcaattcgctctgctatctatatttttggattcttttattaatctctaagatcatgtggataaaagtgtttaaaacatcttagataatttgaagcaaatggtaattttgagtttaaacattgcattgtttgaacactaaataatttggaaattgtatagaaatgtttatctcctgtcccttgagcaacattgtatgggaatcaatgacttcataagcctgtctaatggagccaggtagagttttacctgtgaagtaattcttatccaagaccatgcagtcggacaaaatgccagaggttttatactggcagcggtgctgttgtgaaagtgggttcaagcgagttctcgatcaagaggattggttaagaaatgggaggcaagaaacagacataaatgcgtgaagttgaaggtagagatggcatgagaaaaaggtaaggtgagagaatagacatatattgattgtctggatgagttttggagataaggccaatgcctcggctgcttttcctatgttccagtatgtatttccatgaggacctagattgatttaaagttgtgagtgtaggctaggcactgtttattttttccaaaacttcaaatttcaaattgtattggtactaccacttttttttttagatggcaagtcggtacaatgtggcttgtcagggtgtgtgcatgtatgtgtgtgtgtgtgatgta

SEQ ID NO: 29593 - DNA, 2325 bp, Bovine  19866880714148
ataaaggtgtgtaagaataattccctcatagctctgcaagacacttaattctttgaatctcggttttcttatgtgtaaaatgcgattggtagacttgcccacaatactctcgcaaggatgatatgttatgagaaatggcagttactcccttttatggttcctcaattaattagcacctttcccttcaccctctagaggaagcaaagaggcattccctttccacacaccataccatctacgaccaaggccccctgctactgtcatccaaagaagaatgaccacaggctgctaacacaagcagtccatcgtctgtggggttacaggaccccctgggatctctagttccatcctcactaatgatatgctggatcgttaagaaatgaacaactgaccctgcgtctccatccataacattaaggcttattaaattgtcccagggaatattctggaaggaagagtcttccaatttataattaagaaagggtctgtgaaaggtttatacattgttggacataaaatgtagacgaagtgctgtgatttttaacgagcagtctttcatgtcacacttaaatgtctctagttctttgaataaacacttcagcctccttgtccgtcagctggtccctgtcatgccagcagcagggtcaaccatagaaaccagaggatgagaacaaagagaccaaaaatagggaaagaaggcagtttaccaacaaggcaaatatcttatctcagcttatttccttttcttccccttcagagatatgaagaataacattttccaatatcaagcttctgttgttagccaacattgttaaaaacaagggactccaaacgacaaataagaaacaagcttacacatgggtggtctgtgtcattctgtgatgcagaaggagctcaggatgctgagatgggaaaggtgctttcaggccagcggcctgcctgatgatctccaggagatggcactcctcagtgaactcagactcagtttcccaaactctgcataagccagataagaatgaattgtcccctatatgtttacagaactaaactcctatgaatcctggagtaatgtacatagaggctaacaccgagtagaacacatgctttatattcacagcactgagggcccataagcccagagatttattactatcttcacagcttctgagatggcattgttcacttcttagaggtaagaatgagttttatctccctgagaaaaatataaacttgtgcaagaacaatgtatttcaacatatctgtattgtaacaagtttcccaggtacttcagattagaaaaagatccaaggaccacaatttgagaacctctggtctatacatgcatattctcaaactattaaacaggaagaaaacaaagggcaagaaaagacatctttactatttgaaagaaaccagtagtaaaaatgccacttaaacatgattattctcaaaatgtagagggaaatttttgaaaacacagattcctgaaccctgttccttatctatgaaatcagacctgtgtaaagggggtattaatggcccatatacaggtatatttgcaaagcccctaaggtgatgctgctgatggcccgggtttaggaaaccactgttagaaagtaaagccttggcagccaagtctgccaaggatgtcagtccatctcctctacacccagtggaagtcatctctcccctcacttgtgaacatctgtgatcatcatcgtagagagcggctttgcttgttaagggggggtgggggcagggctgggggaagaaaaagctatttacctagtttgcaagccaagggagagcttaattaacatcagagcagataccatttcctcctctctccttgccctaggaactcacagggatgatgagaggatttttaattaatgtttgaaaagcattctgagatccctggacaagaggctgtggagaagggcacaacatgattattgttgttattaatagtagttgtattaataatagaaataatgaagttctccaaagtgattttttagaaaacctgtgacagccatcaccagtgtgtttttgtgccaagagttttttgagagaataaaagaaaaatggaaaaaaattttaaatgctttttcccaattcttttcttacctactgacttagtcactcagtcatgtccgactctttgtggtcccatggactgtagcacagcaggctcttctgtccatggaattctccaggcaagaatgctggagtgggttgccatttctccaggggatctttccgacccagggattgaacctgggtctcccgcatttcaggcagactctttaccgacagccacca

SEQ ID NO: 29594 - DNA, 736 bp, Bovine  19866880746353
acaactaggaagctaaggcattttcctgctagaaataaagaggtgagttgaatgttgtgtggtaaaaaagaaaggggtgagaagaagagcaagaatagggtttcttcctaggaagaaaaaaagctgtttctagagaaaaaaaaaaaaaagcaaatgtgaaaataaattatactaatctatccgttaattccttaaattcagcacccattaaaacatgcctcaaagaaagcctgggatgacctgttctgcccaattaattctgaagtattggaaatcaattagttacaataaacagacccattctcattatttgaagcagtttgcaattagcttcatagaaagatgattgtacatagggctttgagtataaagacacactgccattaacaaagaatacactgtaccccgctctttctaaaactaaatcttttttgtattaccagaccaacttctgaaagggaattcaaacttttaccaagtggtctgctttttatagaactgatttaaatatcgaaacattgcatttttcctttgcaagtatgtgcaacaaaaactgaagttctactgtgaatgtacacatgacatggtaccagtttttgtttgctgtgctttcagcctgcaaggggctgtgtttaatccttttctcattccttttaaccaccaaggcccttggctcaccaaggtacccctaaccagagccccaaatggactcattgttcccaacatattaaatgca

SEQ ID NO: 29595 - DNA, 1662 bp, Bovine  19866880789209
tgtttgtatattctacttatatatttatatgttgtgtgtatgtgtgtgtattatgcatgtgtgcatgaaaataagtgactaatatgcttactaacagtactaagtgtagggatttttttccttctttataaagtttattttttaaatgaagtatagtcaatttacaaagttgtgttaattccaggtgtataaagtttttcattatgcttttcccaatgatataattcaaaataatgacaaatactgtatattaatccatgtgcatggaatctgcaaagatggtactgataaaccttttagaagggcagcaatggagaggcagacatagagaacagatttgtagacagtgtgggagggagaagttgagccgaactgagagagtagcatggaaacatacattaccatatattaaatagccagccaccaagaactcgctgtgtgacacagggagctcaacccagtgctctgtgacaacctagaggggtgggattaggagggagatgggagggaggttcaagaggtaggggacatatgtatccctgtggctgatggatgttggaaaaaagaaaaattagtattagtttaaaagaaatgtcttgtgtgattcactcagctgctccaactatgtacattcatttcatcactatcaaatttacaaacattttctattgtgtgccaggcactatcagtactaggatctgtgagaaaaaggcctggcaagcattaaaatattgaataagatgctgaccttcaccttagggaagcataccatagtggaaaaaaataggtctttacagaactaagtatgatgccctatcctcagttcagttcagttcagtcactcagtggtgtccgactctttttgacccgatggactgtagccagccaggctcctctgtccgtgggattctccaggcaagaatactggagtgggttgccatatccttctccaggggatcttcccaacccagggatcgaacccaggtctcccgcactgcaagcagacgctttaacctctgagctaccagggaagccctatcctcagagctctataaaaagtaatgcatactaagatcagatagctattacacaatccaaactttttccctcagtgtcagttcttttttttgagggggaggggggcagcgtcatatggtatctaagttctctcaccagggattgaacccatgcccgcagcactggcagcataaagtcttaaccactggaccatcaggaaagttcctaccttggtaagttctgattggagcaaatacaagatttgcaaggccaatgatctgtgcagtatagataggtctccagccaaaagggaaatgtagacagaatgcaaaagactcaatgttgtatataacataaacagtgtcattcactgctatgacgcacaactatctatatcattgctgtatggtcctggttttctcttaagtcatccctacattcttagccctgagggttgcaatagttcaagcttttcccattaaacataagaaacagtcacaagccatgcttgtctttctcagcctctctgccctgttccacatcaggtagcaccaatccaaaccaaccttggaggttttgcttcctgagttacatgggcagagttaatggagctatcacttgctcttatctgcaaacagggaatga

SEQ ID NO: 29596 - DNA, 754 bp, Bovine  19866880858503
tgttcctttgctctactgctgaacttaaatgtacccgtccaataaagcctattttattggatgtccttccataaaacattcacattttatcatatggaaaagtcagaatttatgctaaatatgtcactatttccctgaagataaatccaagtgaattaaatagtaaatgatgtagcaaaatgtactactgtaaaacaaaattcctctaaatgtgttaataatctctaatgttgattaagtaagtggctgtgatttacattaacattttagtctcactaagaccaacagtctaactctctctcattcctgtcagttcttattaggtacaaaaagaagcacattgtgcttatgagacaggctttcttttctactcagtgtataaaagctcttattattctgtcgtaaatgttactgaatttacctttgaaagtttgataagacaatgatgggcattcatcaataagagaccatcatagcttgcatattttaattccccaaatcattaaactcaagcacctaaaggcataaaagttccaacgaatttaaaattcttgtttttcagctccagtttatttccagtaaggtgtgagcgtctataaggaaggtaggatatattcatgtgctgtgtaacaaattaccaccaaatttgcagcttaaaataatgtccttttactaggttacagtttgggaagtgggaaatccaagcaggtgcaacaaggccaaaatcaaggtgccacaaaaagggttcttaagt

SEQ ID NO: 29597 - DNA, 844 bp, Bovine  19866880864909
atataaaaataaatatatttcattgaaggatccattaaggaagaagtaacctttctcatttaagggttgggagtaaggctgtaaaaatgacaaatatgttatatcactgcttaatgttttctctttttaagctttatataaaaataaagttgtatccaacccagaagattttagtgaatgttgatatatcaagacataacagaattcattgtctgctgccatagaagtgacatcaaaaaaaggagggctatttgctattttaatatggactttgctaagaaggcagagaaaattgatctaatggtgaataagagactagtatcatgagctatcagtttgacctgctttattagacaaaaatttggtaattgcacacatgtacagacacatacacaaacaaatattttaggaaaatattgttacatacttatagaccagcaacttggtgctctgaaacaaaaattcaatctacatcaaggcagactgcattcagaaatctactgatgaacctcaggacatggtaaagagagttttgtctaacaggggccagagcttttcattagagggcaaactttaatcagtatagacagacttctcaatattgactctgtgctgacttataaaactttcccatgaaaataataatacagatatataaaagaaagggtaactatattcaattttttggatttattctttaagactggatggctacttcttgttacagtattggtagggtgtgttatgtgttgtgttctgtgtgtgagcattcacatatatttgaaagagtgggggtttcccacatggcacagggtaaagaatgctaagaaggagacataagaga

SEQ ID NO: 29598 - DNA, 1737 bp, Bovine  19866880889193
aaaataagctctacagtgtgcagtgactgcactgggatagaaatagaaatgagatattgtaggaacagggaagctgggttattgacaggtgtatctacatggaggtcagtgccctccactgcttctcaccttttcatgttccccacctcaggccccatcccaccttttgtccctctcccagggcctccacagaatctgccttctttctgtgaccataagcttcagatattgtaggatcaacgtcataactctggataagataaaagtactgagagaaggctgtagtggacatttattttagtttagttttttgttttaacacccagcatccgcaagtctttctggaaaaactatcttaagtgctcactaggctactcagcagatttttgagtcccagtctgcacaagtgaaattgtcctccctctctagatgtccttgtaagggtgggtgtgtgtgcagccttggccaaaaaaaggtccatggtgaaccgcaaatatctataaccccagggcatagttctaggactcacctctggttcatgagctgcaggtattctgggggaggtctaccagggctccaccaagactattattatcaaaggtggcaccttaatcctgattggtgaactatacacactaagggcagtatcttgtatattgccatcaaacaatggcaagatggaaggaaagcaccacgatcaccttcatcgccttccccaaagagggggatgccatcttgatgacatcattggagatgctgtttcagtactctaagatgccctcatgcctttctgatataaagcatcagtgtgctgtgctgttctctggtcagcctcaagcatgtggtgcttggatcagattgaggagtaggggagcaggacagggtcacagtatgggaataatgaggcattaacctttgttccaccagcaagtatattctttaagatatctcactttaagacatcttttccttactctcagctgtattttaccctggaagataggtgactgcctagtcaacattcctaccactgacagctgagtggtgattttgctctgtaaaaaaaaattcatcaattgagcagcctgaaaaaaatacccaaggaagggaactacttccccaaagtgtctttctcatagggaaacctcaatgtcaagtttaaagtatgctttcctgaccagcacattacattaacatgacccacgtgaaacagattcttaagcaggttttatgctgttcctggacactttggcaaccagcccagcatccagtacagtaacatccacacccaaacactgccattcaagggattcagctccatgtaggagcctctggtcactgagttctcaataatgattaagattgatttcttcttcaggattattttcagaaagtaaacccatccttaagcctcttcagatagagaagacctgtctttttcctacttctctaaaggagtgtaaaacactcagtgagggaggtgtgtggtctactatacattttctttaaggctaagctaagaggggcaggagacaaagcccatctcctcaaacgtcgtcaaggaggaaatggtcttttgcagagggtgggagttgggggcacatggtatctgtttctcaacaagaactccagagggctggtcacctttgcaccaaagccaaaaggaagcagtaagtaagagcaaaactatattcttcccttaaatatatccctagtaccaaacccagcctcaacaca

SEQ ID NO: 29599 - DNA, 1210 bp, Bovine  19866880922522
caggaatcgatactcccattgccctcacaaaatgctatacaagcatattggcatttcacttggcagtgaagagtatcgacatcaatctcgccaactgcacacttcactaaccctgctccacttctcctgcgtctatttgtattccatctgggctgtcctcggctgctgaatttgaatgggactccttagcactgccctgacacgtcctaagataaggaaatggaaaagcatcatttacccactcacagagacagtccccccctccccgacccctgcccattttgtacctagaggttttgcagcatttaataaaacacccatttcccaccaccctatggttttacaaaattgtcatctcagagctcttcattaataaccaaatgtctgcttctaatctactgtgaattttaaagtaatttctgggctcttaaagtagcagatcttaaaaaatgaaaattcacacatgtgggagtacagtgtgcacacagagccacggtgggaactgcggctgcatttgttctgaatgctgaccatagacacaccatggttgtttagtaaacttagtaaaaatgcgtctcacccaacatgtgacttcccctttaaacatgtagttctatggtaatgttgaaatggaagccactgtagggaattctgtcatatcagtcttatgttgggcattatcagtatgtgacagatgttgtttgattaaaaagaatatctagaatatataaagaacttttacaactcaacaaacatgatctgaaaaaagaaaagtgacctctttaaaaatggacagtggccacagtgggataccacttcgtgtccatcaggatagctattatcaagaaaaacaaaacccagaaaatataagtattggagaggatatggagaaattcaaacccttgtgctttgctagcgggaatataaaaatggtacagctgttgtggaaaatagtttggcagttcttcaaagagttaaacatagaaccactgtatgatccagcaattccactcttagatacataattggaagaataaaaagcaggaactcagacagatgcttggacaccagtattcatagcaccattatgcatggtagccaaaaggtagaaacaatccacttgttggcagagtgactttggttacaattattattactctgagcctcggtctcttcctctgtccagcggcagtgacagtggtgtggtgat

SEQ ID NO: 29600 - DNA, 881 bp, Bovine  19866881023722
atgatgaattccttaagcattcaatgataatcatgcttgatttgacaagactttctcatgctattttagggccttaattttctgtgaagttctgtcaagtgctcatcaagcacccacttatctccgtatcttaacctggcagccaatcacaaggttgcctaacagtacagctagcgagtgccagcccattaatattcgagtcacgtgactgtccaaggagagaaaccaatcaatggctgattaacattcaggtcacatgactcctgaggagagtaaatgagttacacagtaagacatcaaacaaattttcatcttgaaagagtgattgctttttctgctgctgtgatgtttgtcaaattcgctctagccttgtccaattaagctccatgagctgaattaataatgaagagatgtaagccctgcgccagcatgagagctgtgagtggtgccacggaataagaactgctaaaaaaaatttcttagaatgattgaaaaatcacatctggataactggaataattatttttgcaatcttgatgctattttgtactctccagtgcaaacgtgtgaactggattatgctgggatgtggtacttgttttgagttctgctttgaagatgaaggtggtttggggtttagaatgattttgaaagcattacgcaaatacatgttaattggattattgtttgtgaccctagtaatgaatttcatttgcacactcaattatgttctggggacttttagagataaagatctctcaagatttttaaaactatttgtagaaggaaaggagattattgtgtattctatttcttgtcctggatggaagaaagggctaaatcaagaactttagagaaagtttgtgtgtattggtgtgtgt

SEQ ID NO: 29601 - DNA, 1015 bp, Bovine  19866881055670
acaaatactagaatatttcaagaggcaatgcgtctgtaatcattaagaacatatctttagaatcaggtcgatatggacctcggtcccagctctgcctcaggttagtttctgactttgggatagtaagtccttcctgaacatcagtttcctcctgcttaaaaattagtagtaatatacacttcataaagtggttggaggaattaaatatttaactgctgatcttcttcctgatatttgcttgcatgctaagtcacttcagtcgtgtccaactctttgtgaccctgtggattgtagcctgtcaggctcctctgtccatgggtattctctaggcatgaacactgtagtgggttgccatgcccttctctaggggatcttcccaacccagggattgaacctgtgtctcttaagtctcctgcattagcaggcgggttctttatgagtagcaccacatgagaagcgctcctgatatttgatgagtgaaaataaatgggagttatgattattgtaagtctggttatagttatcattaaacctagtagtcaaggccaccttaaatgtgattctaattcacctattcagcccagatgttcaccatgttcccttatttcagtccaaagttacctcccatcatccccagaatattcttaatgttttaatgctttctcttttcccttgttagcccatatgtttttctcaggttagaatacctcccacccatctctgcctatcaggagccctcatattcttcaaactctcactcaggtcctgttcttttctggaatgcttcctttatcacttcagtcagatgcagttttaatcttcttggaattcatttaactctaataactgcactatcaatatatctctagtacacaccacatcaagaatatgaatctgtttacatgatctatttccttgaactacagtgtgggttctaagaggttagtgatgtctctcccaccttaaaggtacaacagtcctttggtgttggtagatgatgatgttatttctctgg

SEQ ID NO: 29602 - DNA, 958 bp, Bovine  19866881086130
tttttctcccctctttttccttcctaacattttccaagaaaacttacagaacaagaatttcaaaaccagctttctcatcctttcaccattatctattcccctaatatactctgacacataaagtataccaagcttggtcccaaagaaaattcttaaaacagttactattctacccagaaggtggagggagaggggacctaaacttttcaaactgaaaaaaattacatatcttccccccagattcataagaaagtatcagagtgatttaaaagttcagtagggcttccccggtggctcagagggtaaagcgcctgcctgcaatgcgcgagacccgggttcgatccctgggtcgagaagttcccctggagaaggaaatggcaacccactccagtattcttgcctggagaatcccatggatggaagagcctggtgggctacagtccatggggtcgcaaagagtcagacacgactgagcgagctcacttcacttcacttcatctcatttttaaaccatatttagattgaagatcatcaaaatactgtcatgttcagaaagttaaaaggaaggagggaaggggtaaaaacttcaggttatcttagctgaaaaggggccagtttctcactgtttgctccacaacatgagaggtgcattctagagacaggcaaccccacaagtaactggcagatatgtgaacagatcaaatagtacataaagtgggtttctccattttatataaccattaccatgagttttctataataattatgcaggaaactcaatatatactgagatttaggctggtgaaaaaatgaactcaaaaagcacagagctccgtgaactcaattttcttggttttgagagattactcgaagactcagttctttggactaaaataaagttcaagttcacactccaaggacgattatgaaaagaaaaccagatatagaaacctagcaa

SEQ ID NO: 29603 - DNA, 748 bp, Bovine  19866881109076
tatttacagggctcttgtcttgtcattcactctacaagtcattattgaacacctactttatgccagttactttcaaaaagggaatggatatagcaatgaataacctaggcaagactgctactgtcatggagatggccttcttgaatggcaaagactgacggtaaacaagatcgtaaatagacaaatcagataacttcaggtagcactacgcactgtgaagtccattaacgccaaaatgttgtggagagagccttaggaaggccatgctattttggatcgggtagccggggaaggcctttcaggatatttgaggtgcatcctgcaaaaggaccccaccttgtggaggtctgctaaacaaaatgatggaataagtgaactcatcaggctcaatgttagagggagggccaggccccaccacttctgtggttattcattttgtgtccttttgtggatattcctaaaatctctccaggagccctgatgtattgcctctacaatggaggttactaattctgatcaccttgacaggggtgctctgaggaataatgggtaaacaattgtgaggagctatataaatgctaaataatgatcacagtaataaccttttattaaagtcagcactgtgataggcagctcacactcggatgccttggcaaatgtggaaatcgatgcggctgctccctgcacaccccagcaccatcctttaaaatagaaaaaataaatgagccgatgatcatgatattcaaag

SEQ ID NO: 29604 - DNA, 1718 bp, Bovine  19866881145548
tattgtaggatgtatatctgtgcctcccctgttgtaacctttctgaaatcagaatgaacccaaaatctgtggcatcttagattcagtgacagcactggatttcaaccctggagctgcctagagatgggactaatatgtgagggcttacttacctatccaagcttgcacagctatgctctcagggtgtgagttaggccagaaagtgacaatgttagtctgaagattatgttttgggaagattatatgatatcaggtaactaagcagatgcaggcttttgatggactgaacgtactaaccacatttttttttttccctttcctccctctctctctctctctctttgctgtgtgtgtgtgtaacctcctgatctgtctcctccatcctctcatgtcatgtctggtttctacccggatgccaccaccaccgccgccaccaccactctttgtttctctctccctcttcctctcaaccaccacctccaacagcagcagcagttgcaagctcagcatctttctcacggccacggacctccagtgcccctcacccctcacccttcgggacttcagcctcctggaatcccgcccctcggtggcagtgccggcctcctggcgctgtctagtgctctgagtggccagtctcacttggcaattaaagatgacaagaagcaccatgatgcagagcaccacagaggtgagaggccgggcaagccagattaggaccttgtcctaacactcttacagtgctgcaaagtttgtgcaccgctaaagaaagccccaacccatacagagtgcaaacaatgagctaagaggaactgtctgtcgcaaagcttggccactgaaacacagttcaccctggaggttttcagggtttaacgtgggcatctgtagatttctccatctctttagatggcaggcatcttgacatcttggcaactgcctcgttaatgccagtggcctgtaccatattatggaaaactgttaactgcttaattgggtaattttcaaagaaagtaatgttgttaaatggggcgaaataagaagttaaatttgaaagtgaatgtgttcaaatgaaaggtttgataattgcatctgttactacttagtttcataggctttaattctagtatgcattaaatattgggcaaaattgcacttgactaattttttgaaaaaaaaaaaaaaagagtaatttattctgtcaagaaatttaaaaaaaataggcttttgtgtatggttaaactgtaaatcttatgtttacaaaatactgtaattttcaggaaatcactgtatgaggaatgtgcaatgacttatataaataaaagccatttttaaaactgtttggggcttgtgttctaattatcccccccttttttttatttctgttcttgcctctgtgtctgaacgggcatgtctgtgcgtttcttggtaacctcgggagcagacagagaaccaggcacagtaagtaccccgactttatgtgcctgctgcacataaaaacacgttcctcctcccacccccacggtgcaccccagccgcctttctgtacatataggcacagacacgtgtattctactctatctctctcagcaacttgtttttttgttttttttttttagtatgtctgttctctcccccaccccccatcttttgtataaaactttttatcagatgagagggaggcaaagctaagattactcacttaaaatacacttgatcct

SEQ ID NO: 29605 - DNA, 1605 bp, Bovine  19866881321438
aactgggatgttcatgcatttctagtctctgccagaccactgcttctggtgaacagagggtgagtcatggaatccttctgtgccttccttccacctccagcaaagcagggtaattagagcttgtcaccgattctatgtcaaaagggtgtggtgatggtaaccttgtaattatggggttctgggaaaatataaaaaaaaaaaaacctaaatagcagtaatatatcaccactcatccccggttggagattggcttattgagttggagaatttgccgcccagcaaatggttaccacttggaggcttttaagtctggaatgttagcactggaaggaattcctagagattacctagtgtgaaccccacagttgcagctggagaaacagaaacctggagtggtgcagggattgtatcaagtcacacagtgagcgggaggcagaacccaggtctcccgcctcccgccatgggccccccttttcctcctctgtctttgaccatcctgctgctttgggggaggctctgactcctgtctggagagaggggctgcagatgacgggaggctcaggatgcaacagctgctggaggctgcctttcaggtcggacacacaccattcactttgagctgaaaaccctcattcaaatacaactgggtgagccaggcaaaccagatgggtaattgactggagtgtgtagggagatggtggagagtgtggttcactgagtacccaaggaggtttggcacattatcgttccagccatccagaatatgaatgaccaaaccccagtggtctgatcctgtcacattagttttacttaatattgctatgcctgagctaagctgtaccctgtactttttacacatcaacttgaagagataaaatttggttgaaggagttggaaagagatgttagaaaaactgtacaagtagttttatcattacttttatgaaaaaaatcattaagccctattttcttccttccttctctcctctgtccatctctccctcggaacttcctactttctgcacagattttatttagtgtccattatgctctagatgggattcccaggtggtgctagtggtaaagaacctacctgacagttcaggagacataagagatgtagattcaatccctgggtcaggaagatttcctagaggagggcatagaaacccactccagtattcttgcctggagaagaatggacagaggaacgtggcgggctatggtccataaacttataaagagtcagacatgactgaagtgacttagcatgcatgcatgcatgctctagatagtctaggctctaaatatagtgatgaaaaatatgtatacaaagtctctgggccagagagagctgagagatgaaagaaagcaagtgaactacaaggaaatgagcaagacagatttttttgtcttgagagtgatcagtgctatgaagaaatgaaagcagggtgatacagtgcagaccaatggggcctctgtgaagatggaacttgagctgcaatgagaaggagccaagcatacagatctaggagcagagtcccccctgcagaggttaatagcaaatacagaaccttgaggtagagaagctttgtgagtttgagga

SEQ ID NO: 29606 - DNA, 1451 bp, Bovine  19866881329448
tttggctttaaacccttgcagtcacctaaagacagagtaaggaagatcttggttatgctgccaaaaaaaatgcaaacattaaactttatactatgaagctcacagaaagtgggaagtgcaaactgaaggaaatatgaagagaataatagtatcattgacatcctcaacttctataacgagaagtcaagtctcctataacaagacaagggtaggaggaacctacctcaacatagtaaaggccatatatgataagcctagagcaaaccttattcttaatggtgaaaaactgaaagcattccccctaagatcaggaacaagacaaagatattcaagtttttagaaagagaaattgaggcatgacataatatttaaagttacaagggtaaccaaaacaaaacttaaaaataatgacaactgccccaaactgggaggagttggcaggaagaaaaagataatgtgaatgagctaaatgtttaccttttgtaactggaggccattcataaccaagaaattgaaaagaggaatcaatttctaaacaccccatatattcaaagaatgagtaattcaggagttattttttataggcatcaataatcttaaggacacattatagtgctgatgatcttgtagtcatggcattttttcccattccattatccatgtccagttataagattatatttgcaaacaaggtcatatctgttttaatgctttttaagttttttctcagaattatctctattattccacagagtactctttccaaaagtcatagcatagtatatggccatgtggcctcttgatggtattttattatatctaatttctcttccctaagaatatattctcagaattgggattttgctcccactggatgaaagcttagatgagctggttataggataaaaactatttttaaattaatccttaaaaataatataaaattcccttgaattacttctagacgtttgtatagcagcatggtttacaggctcctgttaaaacatggcagaggcaagtaaaactctgctgtaacttcgtaactgaggtacaaaacatcccgtcgtgtaatgtgtgggaccaacttagtgcagagttaatgaaatgaccaacgtgagccggctgcaggaagacaggagccaatcaccaaaattgtcatatacaaatttccattatcaaggagtgtgtaattacaagttccactgttcttctgattactggctagagtggcatgccacatggccacacagataaacacggttgccatacacgttgtttgctagctttaaattatgcaattcttgattactcttggcaagacttaaactatttcaaattttgcacaaaattggtacttacctaataggccaattacactatttcaaatatgcattattctaatttttctaaaatatgagtatattgtaaaagaacagtatttacttttttaa

SEQ ID NO: 29607 - DNA, 1286 bp, Bovine  19866881365460
catgcacacacaaaattattgttgtatgatctctgtaagcaaacattttttatgtctagttttttaccatatgaaattatcttctaatttattagtctgcttatctattatctgtttttttttttttttttcacaatggaatataaacttctggagagcaaagactttactttctctataatttgcgtttttcatgacatttggaatcttggggattgaaagaatttacagagaccttgtagaccaagtgcataagagggtgtaggacataactctaagagagttaagtatttaagaggtgaataatagaaggaagcttggcagtgcagaccaaaggaacatctaagcagaaagaggagtataaaatcatgggaagatattggaagatagtgttttaaaaaggaggtcagagtcaatagtataaatgctgcctagaagataaatatagtatctaatggttgtaatgacttggaggacactggtaaccttgggggaagtatgcttcattgaaatgatgggatggaaacaagcctggagtggacacagagagtcatgagagaggaagaagctgaggcagtaattgtgaatgacttaactccttcctgaaattcggcaaggatgtaactagagttggacatggagctgagaaaagaactttttcttttttttaaaagtagaagatagttgagctaatggactgaggctggaagagaagttgaaggaaaaagagagatggagaataatggatgtcactaagtctgtgagaagtcagaggggtggaattggaagatggggagaaagggttcagaaagagtaggctactgcttctgttctgataggagagaaggcaggatatatactcaacacctgctgtgaggaaacaacaaggagcatgatccccgtcctcgagaagcgacagtccagttggagtggcaagacattgcaacagaaaagaataatactctgtgataagctggcaggcaatgagtgctggggcgtttgagaggagagcgagatgagctcctgatgctgtgatcaaggaagacttcaggagaagtggcatttgattttgaacttgaaaagcagagtaggattgtactagctggagatataaatggtaagagaaaataaaggagaaaaaagtgcatttcatgtagaggactggcatgaacaaaggattgaagtactgaacttcaattagtttatccctcagcaaagaaacagggacttcttttttggggggggtctgtactctcatagaacacagcaattgagaggaagaaaag

SEQ ID NO: 29608 - DNA, 910 bp, Bovine  19866881520859
attgttgctttcacaaactgtaaattaactgtatcactaaacccactttttagtgtggctcttggggctaatattgttattattttttctttaaatggtagctgcttctgctgttgctaagtagcttcagtcatgtccgactctgtgcgaccccatagacggcagcccatgaggctcccctgtccctgggattctccaggcaagaacactggagtggattgccatttccttctccaatgcatgaaagtcaaaagtgaaagtgaagttgctcggtcatagtggtagcaaaactttttcaaagacagaaacagtgggttaatttacattcttccatcatggtcttgtactttgagcagtacaagcctgtatcttctgtttacttcctttattccatgacttagttttttacctttggaccatctgttttttttcctagttcttaaaagtagttgcttctttggtgtcttcatttgtcttgtgactgtctatccattcctttgcatagttttccaacttccagtattatttggcacattgatggctgtccattttcctccttgtaaattcttgattttatcctaaacatactatttaaggttaaatcactgggtttccttgcagcctgttctttcctgtttactaggaggaaatattttcatagttcatatttattctaaaaatagcatggatggtgtgcaaaaatatacatttaagactctgggattcagattctccttggatccagcctttctgtaatatttggccataggcagtcatgtagtcatctaataaatagaattggctgcctgggtggagatttgtagaagatactactgtcagtgaataggatgggatttggaaagaaatgtctaaactgcttctcagccgaaataaccggatatttaattag

SEQ ID NO: 29609 - DNA, 663 bp, Bovine  19866881645875
tcttcctgacccagggatcgaacccaaggtctcctgcattgcaggcagactctttaccagctaagtcaagaggtgggaagtagtgcagaactgctctgacaacaggcagcctctcttgaaagaaaaacaagagaaagatgccagggcttgaaatacgaattaatccagaaaccaaataggaagacttttgttcatatactggaggaagtaaagaaatatacccactatattcctataacctagaaatattattttcatgtgatagggactgaatccacaagcaatctttcagtctgctgtttggcagaatccaaaaagcgtgagttgcagggggaaccaaaagagatgaaaaagatataaggatgtgagcatgaacgattctgtgttcacagacttctcttcgtgtgcccatactctccttagataaaaatcaaaacggtatctaacagaacaataacataataccatcaaactataaataccaaagttaactaaagtttaagtttcacatttactgaaaatctaaacaaactccttgataattaatctccgaaatgtatagctctgcttcagatatgggcacataaattataataaagaacgttggtatgcaatttgattctaagtgctttttagtaaagtacataatgatgcatgctgagg

SEQ ID NO: 29610 - DNA, 2074 bp, Bovine  19866880596483
ctccctttaaatgtggggttcgtttgctacctcaaacccaaaatggcacgtggtaagtattttcgcctgggtaccatttctgtgcctctaatgggtttcagggaaacactgtaggtgggttggggtgcagacatgcggatgagctttctccaactgaggactgcaggccacacaggcctgagtgagtgcagtggcacagatgggactgcactgggaccacacagatgcacaacctgcttcaaatctttcagagccagaaattcctggcaactaagaggaaacagagaggcagcctggggtactggaaatatcactggcctggagacaagggaaggtttggtgagattgtgggctgggtaatgaaagggatgcaggaagtcaggcctaggttccctgtgcccagtaacagccagagctgttccactctgattcttttatagactgggcctctgcaagatgccttctatttaaagagcagctttttgctgctttaaacaaggtttaatcactacaaggggctaccctggtagctcagctggtaaagaatctgccttcaatgcagaagaccctgatttgattcctggaggaagttcccctggagaagggataggctacccactccagtattcttgggcttccctggtggctcagatggtaaagaatctacttgcaatgcaggagacccaggttcgatccccaggctgagaagatctcctggaggaggacatggcaacccactccaggtattcttgcctggagaatccccgagagccaacctgggtggatggatgaggctgcaggacttgccatcagttggatgaccccgaagacaggccagtaggtcgggtggagggtggtggtcaggttgaaagtcaaagacctggcaaacagatggggattcaggacagagaaactgaggcatgggcttattgatggaccctctgcccagtcatgctctggctacaaagtccagtttcttttgtgaagtccaaatccttctgttatggatgattttgggcccctgtcaaacatttgatgggtttcctttgtcactgccacacattggggcaggttgactcctgaaatctgggcaaacagtgccacatgttaaacctgaagacagggaagaagactttgtggtaatgctgaatctgccagccctgtgttatcagttagaggttccttggccattttttggtttgtttctaaagcatttttgaaccctgtatacatcaggagttaaaggagatcttactgtgccccacaccatttttttttttttagatgggctatgtcaatcaatatttaatgtattatttaaacacaacaataacaaattcattccagatcagcaaaaataacatattgtttaaagataacttatatttccccaaaataaaataattactgagtagaatggcatcattttacatgttttcgaatctcattaatatctgccttaatagaaggcaggtgggttttcatatctgcttctatatacaatctgcagcaatatcacatgtaaactccataaccttgtgaaagaaagagagagaaaaaggcaaataatgtcttagtagtattacaaaaacagtttgactccacagacctctttaaaggattctgtggcccctaccatcccggggtctcaaagaccacacttggagctcctgctgtaggggaacacagagttaggattcagaccctgtgaagttaaatgttaagtggatggaaaatttccaagtgatatcttctttttcctcactgggcctctgtgtggcccccaatatattgtctttaccgactgagctatcacggaagctcagttggtaaagaaacaaaagaaaagtttttggattttttttttttttttgacagctttaattttttagcactttatttttttttttatttgataaatttaatgccttttattgccatacctcattttactgtgctttgctttagtgagctttatagatacatgttttgttttgttttcttccttgttaattttctgtttagttgatctatccataagtgtgagtggggtattaaagtctcccactattat

SEQ ID NO: 29611 - DNA, 1179 bp, Bovine  19866880617358
aattcctttagaagattaattttggctaagcagaccgtcattgtgtttcttgaatgaattcttgggatttatcaggctctgaaaaactgccaagatgaatcaaaggcagacttgtcatgggtcttggagaaggaatgggatttctggggctgctgtggatccagtagccaccccctccctcacacccttctccaactcagcacccttactggccagctgtactctcaaggtctctgttgcccaactcagagagtcaaatattttggcaaagaaggaaaacagaccccagaatccagtggttaagccccacttattcttgacataattgcctgactccagagtcctttctgccaaagcacgtgagatgaaaatgtttacgcagatcaactgctgcagaagggttaggaaatacaggcatggtgcttgtgcttctgtgcaccaagtcaaaaaactcgagccagagattttgatgaggagcagccaggcgcatgccagctctcttggaaggataatggtcacaggatgcttcactgggcaagtcaagcacatggaatcctgtgtttgcattcatctacaaatgccaaaagaacatgtcccctggctgagattgaatttttttttaaagaatacacctctctaatcaaatattcttttcatagaagtgctacacagagagaaaacaaaatatcttatcttccaggagcagagaacataatccaggacacttacaggaggacctgcaaaacacaagcagagaagccatagtaagtatcaaagggagcagagggtcccctcaccccggccagccccttccttgcacagctcccagtcacccctccttgcaaggttttgatgcttgtgtcagggcagagggagcacctctgtccttggagggactggacgggcatgtgcgtggttatgacaatccagcaagttttggtttgtgcattcatgacatgaggctgctgttgcttcctgcttggggcacacccatgttgggctttgccaggcagggtaggaatcagatctgttccttcttgaagaatacattttggagctcagtggggggttggttcatttctgtggaaagggagatacttgagaaagaaaacattttgggcagaggggagaatactcctaacaggcactggctatgtgcttgtgtggctgagcagatgt

SEQ ID NO: 29612 - DNA, 1488 bp, Bovine  19866880669717
tgggtgtactgtcctcacttcacagatgagaaagctgaggctcagggagttatgtgcccagcacaacaaggaatcggtgagctagtagagcagttgccctgataggggaccctggaggcagtctagggggtggtgccagctctgcgctggaggaagcacagtccaacctgagcccttgggggagggaaaggggggcggtacaatgaggtctgaccccgctgtttggcttaggactaggggcacaacagtggcttcatatagggagaaagagagagagagagatggagagaaaaaagagagagagggagaagaggttggtagagaggtgcagagacagggtttcagggtcaggactgggactgagattataaccaaggtcagaatctaaatgcagttagagattggggttaagagttgggccagagtctgtaggtgtgagttagggcttggataacagtctgaactgggggtgtggatctggatttggaaatgagtttggggtcgcccctgggtttgattcctgggttgggaagatctctgggagaaggaaatggcaacccattccagtattcttggctgggaaatcccatggacagaggatcctggcgggctacagtccgtggggtcacaaagaatctgacatgactgagcgactaacactttctctttcacttgggatcaaggcctatgttggggtcaaggacctggtttgtgttagattaaggtgtgattggagtaggagtctgggttggggctggggataggagagggtgggggttggttgtgggatcaggggttgggaggtttggtaaccacgtcccgcgtggtccagctccatgccctcttttacctctgggcctggtgctcccctggggccatctttcccagtgtcgccaggagggccccgggccccagggggtcctggaggccctggaggcccagcagctccatcttgccctggatctccctgaaagagatggggcccagcatgactctgagggtgggcggagggagttctggcctccagagagagagatagaggccttctcagaggggtggccagatgtcttcgccttcccagcatgcggccggctcagaggaaagggccttgttattgcgcctcttgctacttcttggtatacaaagggacaggacaggtcccttggtatataaagggacatgacctacacctctgcatgagaggccaataggatctcgtaccctcccccatatgcatcattgctccagctctcagtgcctgaagcccagctatggagttcaggtgagagatgagatgtattaggtgtgggacaaagcacacgtgcccaaacagcccccttccttttggaagggaggggactgtttgcctcctgaaagaccttcctggtcgctcagctctggctttattaagtgctagaggcacactctcaggcatgatcccagagaaacactaaaatattaaaattagaaacatgtccacacaaaaac

SEQ ID NO: 29613 - DNA, 1459 bp, Bovine  19866881050578
agaagttgtggtacatatacataatgaaatactgctcagccataaaaggaatgcatttgagtctgttcttatgaggtggatgaacctagagcctataatacagaatgaagtaaatctgaaaggaaaaataaatttaatatattaatgcatatatatgcattataatgtgttaatatagattaatgtattaatgtatattaataatatattgatacattttagttattaatatattattaatatcaatataattataaatatataatataatataataatatacagtggttaacatatattaatatgtattaatatatgtttaaaattgatacattgtatattacatataatatgtattgatatattgatattaattatattttataattatcaatcaatatattaatattaatataataataaagtatacttatgcattggtgcattaatatatattaataatatatatatggtatctagagaaatggtactattgaacctatttttaaggcaagaagagagatgcagacatggagaacagactttgtacacagcaggggaaggaggaggtgggacaaattgagagagtagcattaacgtatgtagattaccatgtgtaaaatagccagtgggaagttgctataggcacagggagctcaacctggtgctctgacaacctagaggagtgggatggggtgggagttggggaaggagttcaagagggaggggacatgtggatacttatggctgattcatgttgttgtatggcagaagccaacactattgtaaagcagttatcctccaattaacaataaatattattattttctacaaaacaattaaaaacactcagttaacttttgaatggactctgattgatatgaaggaatttgccatgagggaaaagggatgaagactttccagattatgaatgattatacaagtaagagaaatctcatgaagataatttaaaattctgtcatgggctttggactctgatcccagactgccttttccaatttatggctccccttttaatccttctccattttcccattaactgattctcctggtcactcttacactcacactctttaaatgggtttgtttagtattttctccaccctcttgttctcagcttgtgttggcttatttctctgtactgcttaattaaaactcctaagtttttcttattagcttttggccagattttgagaccttatttgaataccatcagtattcagtctatacatttagtagccaaatgctgtatcacatgaaacattttcagttttttctttcctctccaggatggaagaacagttataaaaccacaaagtcaactcaaacacaagatcgttcatttcaggaactgataatgaaaagatccaaaaggagtggaccctgggacttcaaatcagaaaaaccctgcagatatgaaggcagattagagaaaaag

SEQ ID NO: 29614 - DNA, 1214 bp, Bovine  19866881060059
ctggaaatagtttcctttaatactaaatgtttctttaatccttgcattaaaatttttactgtggtatagctgttttactctaaaatttaagcttttgtaatactttaacttagatataactaatgggggggtttgattactgaggcaagctatttaaagcacttaaaaagcatcatatcagatgcttgttttgcatttatattttggggtcatactgaagattgttaaggactcttgctccaaagtcttgcttattttctgaaaaccatttatttcataccatgggaagggtctttaataatcatgagttatcatgaatattcttttttgtagcttctgtatttatgttatcaggcacatcaatcagtcccaaagaagttatttcagggttccgttcccaagggaacaaagacagtgggttccatgttaacagtggcttttgtaggcttatttttatttttctgacatgaaagttgtgtatagttggcaaggatttctcttctctgaaaacaagcttgttggtaaaaggacaagctgcaggcaccatcacatacacaaccacttcagcacaggctgaaaggatgctttctgagaacaattagaactgaaaatcatgttcaagtacaaatgtgctttctttaagagatttttcagttcatcatttatttgtctttgatattgaatagttttttttttaagttatattcagatctatttaaaaccaattaccaactcccactactgcacttctcacagtcccctcatttcagccaggggctctcagggtcactgtccaggctgtatacatttcccatccagcgacatctgtgagaagaatggctagaaggaacagcctggtgccctgggaaagagatgccttttcacagggacacgcaaacagccagaagctcagccatgactgcactcgtagtatggcatctcagatgctccaagtagagactcctccacatcaagtctggttagctgagatgtgtcctatgctaaaggtatagcctgcagaatggaacagcaaatttcaagtgaaaatcccaggatttgacattttccttcaccttactactgaagaagagaaaagagggtagtgggggagagagaggtggaatactctgcctagtaactccttggaagcaggatgaagcaactgcaatctctcctagatctacgtagttcaggccttaatccacacctctcag

SEQ ID NO: 29615 - DNA, 1686 bp, Bovine  19866881167288
ccatttcagctgggcccattggagtgggttgactttttactttggcctcaccatatggcatgtgagatcttagttccctgaccagggatcaggatcaaaccccctgccccctgattgaagtcttaaccactggaccacagtggccacagtattgggggcatagagtcccttctgctccaccaccactacctctctgggtccacagcctgagctggattcagtagtgtcttcttctcctggaacatcagtggaaccctccagtcagaaactcagcctagaattcttcctcttcctgtgtgtagggtgacactttctccctgaagtttagggtaggcaccagagtcgttgcagcctacctgcatctggtcaccatttcccttgcaatagctatctgattttcctgggagccactctcccttttcacaattcaccaactccacccccagatccaggatggagcattatgagcaggtctggccagttagggaactgcattcttatggccgagtgacatttcagcattggcccagctggggccgatgagagttgatgagactttttctcaaagagtaacgagtgaggcaaatgcctttctccaggatttggacttagagggatgcaagtttggagttcttggctccatctcatcaccatgtggaaattggaatgattcaagaggaagaagagacaagagagggtgagaggttgggttgtgttgacatacttgagccccggatctatgtgtcacacatatggagttttcagttatgagtcagtttaaaccagtttaacttgtgtttcccatctcttgcaaccaaaagatacctgatccaatcaacattggattaataattctcttctccttcctgcagtactgccatagctgaagccttatcatctctcaccaggatattgcaacatgctcctcactggtcttcctacctccctactccaatggatccactcaccatcctcggtcatcctccatccgtcatctgtcaagctatcatccatccatccaccatccatcttttgcttgtatccatcactcatttacataccatccacccatccttcctctacccatccctccacccacccatcctttgtaccgtatccatcatccaccatccactcaaccacccatctatctatcaagaaagcacctactctgggctgtgtgttgggtttgcactgtggacaggggtggaaccagccagttgtagtctagccatggggaatggggacacatccaagccatccagagggcagcatgagggcaaaagttacaaacgggagagacccagccacagtggatggtgagctacttacatctagtcctggctccccgggtctgccctgagaagagacaaagaggagatgtgaggaggctgagaaggaggtgttgggaacacaattcacagccctgtgaattgtccacagaacctggactctggccctagggaccagtgaagcgcaggggttgagcccccaggactgagtgataccatagttgggggacattaaaggaaggtggttaccttctctcctttggttcctggcagcccaataaggcctggtgggccagctggcccctgggtggaaaaggaatgtgtcaagagtcatgacaattacagaaattagcccctctgaggatgaacaaggctcatgacactcacaggcagg

SEQ ID NO: 29616 - DNA, 1209 bp, Bovine  19866881313422
aaacccatgtctcctgcattggcaggtggattctttaccactgaaccacgaggaaagtgctcagctgtcttgatatttgctaagatgtggtagacactgttggtagaggttgaactcggattgtttttgctaccatctcagtacatggacagtgccagacatatagtagatgcctgtacatgttgattgatgacaactagactgattctaatgaaaggatcatttggaaacaaacgaagaacctcagttcacatcatttgcttaacagctctggatgtgatcatatgccaatgcttttatctcaggagttgtagaagagagtgctttatgtatcaatcttcttattaagaccagacgacaaaaccttccctgtctctcagaccacttctctaatgaggaaaagtagtaagtaaaaagatggggaggagtggggggaggtacggcatctttccagtttgaaagctgtatttaggctgggacagttgtgcctgtaattatcctgtctgagttgactttaataagcattatttttaatgctttcctctcaaagggaaaaaaagtgatttttgcatccaagtgtataaaacagctttattcactaagcttgaaagacatagtcatcactgttcgatctgtaccgactctgagccagaaacctcatatcagagcctgggccagaaggtaagaattgattgctttcaaagaatcacaggattcaggctggcccaggtcctcctcctcttcccatgaccatctcccagtggtagacatgtgggaaaacagtgctggatgcaaggcaggcaggatcaacctcttgagaacctgacatttaaaccatgtcctcttttcaggtttaaggcatcaccatctgctcattgccccagctaaaaacctgggttagtccctttaaccctgcatttcaagggtccccaccaggctaatcagcaccctccctaccttacttcagacccttcacattctcctgcttccattacattttatatcttcccacctaacttacctcttctttttcttctcttcaataaactgttttttaaaaagaataaaagtaatatgactacatttggaaaacagaacaaagaaagaaataatcatgtataatacatcataacagctattatcaacttttataacatttccttgtagtattttatttatttatttaaaccacactgtgacatgtaggat

SEQ ID NO: 29617 - DNA, 1182 bp, Bovine  19866881540579
cagcctggaccctgtggaccctggttgtaaagagtaaattgtatcttagaaaacccagtgtcacctttttttcaccttttagttttatattatttgtgtcatacatttcctataatggaagtgttaattttactgtactttttggtacctttcgggaatctaatgtattgtaaggtattttacacgtgtcctgattttgccacgacctggatattgaagctatccaagcttttgaaataaaaatttaaaaacccccaagcctgggtgagtgtggggtacactgtgaaggggggcgggtgctccagagctccagtatcctccacgacctcctaaggcatcctgtcaggcataaccacacactgtcttcatctttggttagtttcctttaatgacttggccctgcttaggacttggcgcagctttaaagaaagtggagtggcagaggttggaggcagttgttcaaggaggtgaagacagtacagtgaggattacaccttcagtggggacgctggcccaggccagttggagtctggagtaccctggaacacctgtcttgacttgccattgaaaatggtattctatcccagcgaagttgtgaaacctaaagacaagaggggatacacaaaggaccagctggatctgggcaacagtgtccctcctggttgtcatgtaacagccccatctggcagtggtatttgctggcttggctggagtgccaagtctagtgacctgagacctaagatagctggttttaagatgcagcacttgtctggggccagggtggataaagcctcgcaaaagttctgtattttatagaggaactggctggggaaggaaatagctatcaaatgcaaacttaaggactcaagattttcaggggtgagggatgtggagctcaaggcacccagagcctcccagtgttgaaattaacctgtgggaaaggtctaccacttggaataaacatacgagctgccgatggatggtaaggaagccaattctgggtcttctgggaacaagaagcaaggccacttacctagagaaagacacctctcagcagggctgcctcaggagtggagcctcagggtctcacaacttctcactttcgcttccatgtctgaaaaataccacaggaccactcaaaatggtccaccttcaaaaatacattcccttctcccagcaggt

SEQ ID NO: 29618 - DNA, 1415 bp, Bovine  19866880017277
tggggctccaaaatcactgcagatggtgactgcagccatgaaattaaaagacgcttactccttggaaggaaagttatgaccaacctagatagcatattcaaaagcagagacattactttgccaacaaaggtccgtctagtcaaggctgtggtttttcctgtggtcatgtatggatgtgagagttggactgtgaagaaggctgagtgccgaagaattgatgcttttgaactgtggtgttggagaagactcttgagagtcccttggactgcaaggagatccaaccagtccattctgaaggagatcagccctggaatttctttggaaggaatgatgctaaagctgaaactccagtactttggccacctcatgcgaagagttgactcattggaaaagactctgatgctgggagggattgggggcaagaggagaaggggacgacagaggatgagatggctggatggcatcactgactcgatggacgtgagtctgggtgaactctgggagttggtgatggacagggaggcctggagtgctgagattcatggggtcgcaaagagttggacatgactgaacaactgatctgattcagtaagttagccaattcccacaatttttccaacattaaccaaaatcaactaatacaaacttcaaataattccactattctatatccacactactctcatgtctaccagagaaagcaaacaagtggggggaagcccaaataattacaagcaaattgccgagaaaggcctaaagaagccacacacagaagttgctcagtcatgtccgacttgtagcccaccaggctccttggtccatgggattttccaggcatgaatactggagtgggctgccgtttcctttctcaatctgtgattccagaaccagacgcatcatctgaaactagtgagaaatgcaagttttcaggctctactccagacctatggaatggaaaatacaggccttccaggaacttctgatacagcttttataccacaagcctttaaaaattaaacccaattatttaagcagctttggcaatgttttccactaaagataaaaattacaaagtatataacctataaattagaacgttaaaagtatgttttaattagtctaggttcaaaagcaaaaataaaatgacaaagtttacccaacatcttctcaaaataggaaacagtcaccatttcaaactcaaggaggaaaaaaaaccacttagatctgcctaaaaataaatgggcagattttaaaacttctacagaacaatcatcatcggtagatgccataaatattgggggaaacaatgttggaaaacaagttatttacaaaatttccaagtttcgctccactgggcatttattaatttcaaatacaccattagaggaaaaatcgggatttcataataaaattat

SEQ ID NO: 29619 - DNA, 1160 bp, Bovine  19866880534128
caaacttatttcatcacccaagagcatagaagaaattatgccattgtgcctacatgcaccactgaagtagaggataggagtggggggaaaaaaaccatcatacagacatacaccaacataactatgtagcttagagatcctggcttacaaagtagtgagaaaacaaaaggaacagatgctcacttggccagctctcaatgaaactcattaaaatcatcaccctgtccttggatcattgctcatgctaagattttaccttgtttagccagaagtcacccagttgtgatgaaaactgaaaacaccatggcccaaagataaaaagattattttcaaaggcccaaattattggtcccccatctcaatgtacaaatgctggatataaaacagggtcaatcagcactagatggctgtgactatatgaccaaaaaaataaatatgttaaaccgtaatattcagattttgaggtaaatcattaagatgttctaatttatgaacttaactgattaattctacctatttcaccataatttttaataaattttgacatttctctatggatcattctcaaaggttgtattttgtatgatatatttccagttgataaagtaggtcctttaccaactgaaactacttcatgttttaagaaataaaacaaaataaaaaatattgccatccttcgagttttatagcaaagaatgcagacacatgatacaaagcctggctctaataataacagtaacagacagcctgaatgcgtaacacaatagattaaactagttaaagttgggagtgttgtaaaagtgacaaattcctgaatagttataaaaggcagtaattttgcagatatacagagtaaaagtctggaaacagggcccatatgggaatttcacttaacttctggaataagcaaaatggttgatacctaaatttaggtcaaagttcctgagtaattagagatggaaaacttgaggcaaagttgttacaattattagattgtaagatctctaatacctaagattattttttgtatctagtctattgatacagcaaacatttatacatgagaaacaagtggttccatatgcatgattaaacatacttgtccagtcagatcaagacctccaaagcaatatatttatcaatagctactcaataaatat

SEQ ID NO: 29620 - DNA, 1084 bp, Bovine  19866880536884
ctaatggatataaggtggtaacatattgtagttttgatttgcattcctctcatgatcagtcatgttgagcatcgtttcatgtgctttttaaccatatgtatatcttctcagataatctctattttgcttccctgatggttcacatggtaaagaatctgcttgcaatgcaggagacccaggtttgatctctgggttgggaagatcccctggaggcgggcatggcaacccactctagtattctagcctggagaatccccatggacagaggagcctggtgggctacagtccgtgggggtctgactaagcacagcacaatctctgttcaagtcctttgcccattctgaatagttgacacctctacctttcatatatacggtgaagtcactactgctcacacacttgttcatggcacatcagtggcacttttgggctgtcgctttcttccccatgtctgccttgtccctcagctcccataaatgtagaatttacacataggatctatttgtgtgttgatttttagaaatggggcagaatttgaaaactgcatgacagtatttcagtacctgaacttatttcaaaaaaattctctttgcagacatacaacagctgtgccagactctgcttaaatcaagagacagtatgtctagcaagcactgctatgaagactgaaaattgtgtggccaaagtaagtaatattacacattaatatatgttatgtcacatcataacaatggtttatctatagatatctttactcagtaactaaagagtattatagaattgttaaaaagaatacagcaggcatcattatgttcaaagcagattgcaagttggagtttctatctcttcagtcgcagcagaattttttgattgtgttctctggtcacactttagtctaattcacatttgttgcttgacactaattacggtttattacaaataagatttgtgtgggatatccctagcagtccagtgtttaagactccaagcttcaactgaaggggcacaggttcgatccctagttggggaactaaacattactgtgtgtcagttcagttcagtttagtcactcagtcatgtccaa

SEQ ID NO: 29621 - DNA, 1154 bp, Bovine  19866880539323
caggaaaagatgggactcttatgtggcgttctgagcataggcatatttaaatgggccaagagatgggtccttaaaatggagggcaagaagtgctctgtttattgccccatgccctggaccctgcccttttatcacttcaccagggaagcctgaaaggaatcgagaagcagcccaaataggctggttcgcctccttaccaccacatgtggaggtagagggattctcttccttcttccactcaaaaggcaaggaaggctacaacttctgactgaattggtttccactaagactaggagactgaggaacagagcctataaggggttccctagccaggtgagaccagcacctgggagattaccttaactctgtcatcgaggaaggagttctgagtaacagagattaaggagaagtagaaaagacactagaaagtctgtcccatacaaataaatttttaataacttcaatttgccaccagcttccagctcctgctcctctgaggttcatcaatgtggaaaacactaaatgccccaggctgaactatccatctagtcatcagagatgacccagcccctgatatcttaagaatctacaattattcacggcagcacaatgtggattctctggaacttgctcagtgttggagctggaactctggttcccaggaagggcaagtatcccaaagacacctgaagtggaagagtagcctgggaggtcccagacctgctctcccagctggattctggcatttacttccagattcttcctatgctgcttgctgcctaccatcctgaaggctttaaaaagtgctttagaaagggagggtctcagaggagcagcgacttcaaaggcagctgtggggcagggaaagcctacagcagtagtcccatggaggctgtccagaggaggaaacacaggccaacttttcaaaggtcggcctctccatgatgctcacctggcttgtttcagagcctggccctggcaagctctctcccttgcaggcaccagaccaccgcaggaacagattcctccccagaggaaattctcaggcaggctggatgtaaacaacagccgggtgagggggtggaacacgtggaggggagctcagtagaggcaagagaggctcccagaggagggggggctaaggaggtggggaa

SEQ ID NO: 29622 - DNA, 3489 bp, Bovine  19866880553772
acccgggggtgggggcagcagctccgccatcttgtggatgagaggccaagtgacagcgggagcctaatcggggaggggtctctggggcgcgcggggccctggagagtaaggggcgtagggacagttactgaagagctgaggaggccaggaggagagacgccgtgaggccgctggcagggccttgccggtgtgagggttaccgggtgaggccctggagaagaggttcattcagtagtggggaaggggaacgctggacagtgggaggaaagatactgggagtgggaggtgggtgggaaaaacgggcaaggctggatgcggatgaatctaaggtagagcagagagaggactggtgggagacttgcagtcttgtagagtgagatgggaaagagagcctttgacttcagggtacaatcccagcttggccaaactaatgttgacaaactctgggaagaactaggccttacttaggaaggaaaggactggggacggggatctagggctgtgatgacagtctttgggaaagggaaaaggttgaatagatgccagaattacaggtatcaggaaagggtatacatcctctagtttgaaagaagacagaagaggttcactggttagggaaatccaggtacaggagattaggggcgaaattaatatctaatagtgtaaaccaaagcttaatgcaatatcgtagagacagtaaaatgtggagaccaggtgcagtatcactttctgggaatggaaaggctatgcagattagcatccaaagacccataagaagtaataagatcactggagaaattcaggagataaaagggggaatgcagatagtggagaataatagatgtcagggttagtagttacttaggagttttaggttgaagttttaatccttgggagtctagttctttaactttgtatcatgcttttctttttttgatatgtgtatgtttagcacatttgtatagctatttgatgcatttaatctgatgcttcatttgtatatcccagatgtaaaaccagactttgtggttacagctaaagaatgatgggatgcatagacttctttctgtcttaactggtgtccatagggaccattgatattatttgcagtctatttgctttttcagaagtaattgtaacctgtcactccaaatctttatttctgttgttagatagttgttttgtgtccttgccttagataccaaaacaaatgtaaacaaaccatgaacactaacctaattgaatttagggtttaaactgctgcatttacaagaatataatttaagagtctggtcaaatttactataactttatttattttgtattagtgctttctaaaatgcctaactaacgttcaagtgtatctttaacaaaatactattagacctgaagaaagatcttgagtttctgcccagtgttgaaattctaaaatattaagaggcttcgaaattgttttggacttcagaagtgagacgaagttgctttgtatgtacagccagcttctagatttaagtaagaaaagtgacagctgcttatttttgtttttctgcttagaggttgactcaatcctaatcttgacacatgtcagatttatggaataatgtggttttaacagatcataaagggaccttatgagatcatcttctttactccctgatagacctcatcctaggaacattttcaaccaattgatctctgctttgtaccagtgagttgttttgataatggtctcctgattgagttaaagttagagctagagatggccatgagtagtttgaagcttttgggacaccacacattattaaatgttgagtcagtttccataaggagaaaccaatttttcttcaattttagttactttcatttttgaccttgcctgctgttaatggctgctgtttgcgagaaggccaactggaaaagggtcaccaagaatgacaccttaataactgaaacagaatggagagttaaagatttggtgttctttttcagctcagtgctgtgcttagttgctcagttgtatccgattctttgagactccatggattatagtcccccaggctcctctgtccatggggattctccaggcaagaattctgaagtgggttgccatttccttctccaggggatcttctcaactcagggattgaacccaggtctcccgcattgcaggcggatcctttaccgtctgagccaccagggaagcgcttttcacctcagtaacagtcttattatgaatctaagtcacaacctgcctttggtcccatttaccctgttatgtttgtttacttagtcatttgagataggaagatattttatttgtgcttgcacctggtaattaatgcacagtacacatggaaaagattatccttttaatcatattgaaatttttatatagtatttggctttattttgtcctatcctttccctcaattctgaggtgtgaatgacaatttttgtataggatgccctgatttctacagtttaagaaaatataaaattttgtttaaaataacatgaaatggatattctcttttctgaattttgctcattactgtattgatgtagtaatttgattaatttttataataaaaccttatcagtgagaccgattcagatttgaccataattcacacatggtctagacttaaactttatctttgactatctgtactatatctgtatctgtctatccttctgtattttatctatttatatgacaagttgaagaatggatttgaaatttatttttaagtggacaggataaactggtctcaggatcttagaactagggaaatttgacacatggatgaaataatttcaggatgtatagaatagttttttttattgatagataagtgaaacagtgtaaaggttaacttgctgtgtaacaaacataaatctttcattgattggtgcattttctgtttcgcttggtgttggctggaatgttcaaaatggccacagtctctcgtggctggcccaaaatggccagtttctcacgttggccactgtctgcaagttcagctagcagtaaggccttcttgtcctcctttctccacatggccttcttttggatttccttaaagcatggtgtctgggttctaagaaggggagcattccaggagataagaaatagaagccagccaattctcttaagtcctaggtttggaagttgagaatgttgttattggtcagagacagtaaaggctggcccagagtcagaaggagggaaaataatctctccccgtagacaaaaagagtagcatgcaggaacagagagaaggaaattgctgggggccaggaccttttgagtctggctaccatagatgctgttctagttggatgctcaggctgaaaatacagatgggatcagccacatttgtggctattaacacttggaatgctttggagacatctcatttttgagattaacttcctaaaaaactattgtgatctcctgcagactgtcttaataatgttactgtagcg

SEQ ID NO: 29623 - DNA, 1682 bp, Bovine  19866880617918
aaatgtacatctatactagctggaatgtttacacaaaggaactttcattagaacctaaaagggaattcccctcttaaaagcattttgaaattaactaagatgtattaatatgtaaattagaaattcttgatttgacttgaaagaatgtttagccaaaagacagctggcttggcatagtctttgggacatcaatcatctttctcttccttgtctcctccaaggatgagggagattcaggagcctctctaaggtccaggaggtttccaacccttccagaacatgtgacttgatctcccgccaagggttggccatactctaggaaaggaggcattgtctttgggatctaaaaggctgtatgagttaggggttgtgagtttatgtgtggggaaggagggacaaaaaggcagagacagcaacctgtgcatagccattgtgttttattggatctggtgatttcttattttacaaaaattacagaggaaccaaaaatgcaaagtagtcaacagtgttctcatggggaagggggcttcttgggtgccctccgcctcaattcacagctgactgggaaagtgagctaaatgggacaagcagatatattaaagggtagcagtgtggcagggctgctgacagtgaggtgggacctggatcctatggtccctgccatcaaggtgtgctcaggggcatctctgggtagattgactagagcaagaggaaactctgagtgggctatgaggaggctatgtggggaggcaggaatagagcctgggtatatcaaaaattctcaaaaatgcccccacactgggttcaaatgctatgtctgcctccttccttcctttttctcctaaggcatccacagggtggtccctgacttactccatgcctccaggtctagaggaaatggcaaatgaaatcttaagttgtagtcatcagagaaggtaggctgaaactttggcaggtatcagtcaagcagctcccaccccatcttccccctgctgccaccaccactacccaaacaggaaggaaggagaggaagaaattccagggatctgccaaaacccagatcccaagttctcctgggatactgaggagtatatggaaaatttctgggtatatttccaaggttttctgaagagcctggaaacacatattctgatggcttggggtggcagacctgtagagctcaaagctacagcctggtatgctgtcactgacaatccccaggcctttctgctctctaccgcaattgcctcctagggcctacccactggcttaggcccaaggttactccctccacattcttgaccccctcctacagcactgtcaaaggccctggcctaaaaggccagtcagtggcaaggacagaagagcctttttataaaggaatcttaggggaaatgtttatgagatcagggatggaggaagcaccatagcaggagaaattttgcctagtgttgtggtttctcagttggggggtgggaggggaaggaccactcaattcccataacagggcaacctcggcactgagtttcaggcaggaagggggagctgttgggagtcgagaacacccccacagatacactctgcccactccctaccctcctcagctccagctgtatggaccaccaaatccccaggctcttgggttcctatagcccccagggtagagctaggatgaggacaga

SEQ ID NO: 29624 - DNA, 3533 bp, Bovine  19866880665702
tggcgggtctgaaaactgtctttacactcacgttatttctgttttcttaggtacatcagctcggccagcacctaaagtcgccaacggcaaagcagctagtagcagcagcagcagcagcagtgatgatgactcagaggaggaaaaggcagtagccatctctaagaaggtataggccttaatttctaccagggaagaggggacaagggggtggaagtcctccatttcctggcaggagtggttgggtcaacattttcctgtggtaattgattttctctgtgtgatgcagaccatacctaaaaagcaagttgtggctaaggctccagtgaaaatggctgccgcacctgcccaaaagagttccagcagtgaggactcctccagtgaggaagaggaagaggagcagaagaaaaagcccatgaagaaaaaaccaggtgactggacacggggagtcaagctaccactgatgagggcccaaaggcaggaggtcctctgcagtcaccacgtggaccttggcctgacagctggcctgtcccagagaaaggagaaagccaaaagttgccttttgtgactcagaaatggcatgccatcgtccttgccctagtctgttaggaaagagtcactaatcctagcccaccctcaagggaaagggaattaagctccatttctagaaggaagtggtatcaaaagatttgtgtacatattttatcacactgtcccttttaaacaggtccctatagctcagtccccccgccttctgttcccccacccaagaagtccctgggaactcagtcccccaagaaagctgcagagaagcagcagactgtggagagcagcgaggagagcagcgatgagtctggtgagtcatcttccgtggtgggtcttggaagtgtgtgaggagtagggaaggagatgcttctgttcccttctgcttttctctgaagcaccacagggctgatgctctgtgtgggtctttgcatccttgttgtttttggctgtgtcacatgtcttgcggaggtctcagttccctgaccagagatcgaacccgggccatggaagtgaaagcccagagtcctaatcactaggccaccagggaactccctacgcttcttttacttgcctctggtgggactctggacccagcctaatgccattgcttctctcaagattcaagttctgaggaagaaaagaaacctccagctaaggcagtcatcgccaaggcagctactaaagcagctccagcaaagaaggcagcagagagctcttcagacagctcgggtaaggacggtgtagcgtaggaggccctcagggcgatggtagctccaagggccccctttagcctgattcggggacctattcactctaacctccctgtctagactccgacagttctgaggatgaagctcctgccaagccagctggtaccaccaagaatccctcaagtaaaccagccgccactcccaagcagcctgcagctaagttagccgccactcccaagcaggctgcgggcagtgtccagaagcctctaaccagaaaggctgacagcagctccagtgaggaggagagcagttctagtgacgaggaggagacgaagaagactgtagccacccctaagtccaaggcgacagtcaaagcagccctgtctttgcccgccaagcagagctctcagggtgctgggggcagcagctcggattcagacagctccagcagcgaggaagaggaagaagagaagacgcctaaacccccagctaaaaagccacggaaggaggtaggagccatagccccttccaaaccagcctctgggaagaaagcaaaggccgagagcagcagcagttgttcctctgatgactccagtgaggaggaggaggagcccaagggcaagggcactccaagaccgcaggccaccaaggccaatggcacctctgcactgactgcccagaatggaaaagcagacaggggcagcaacgaggaggaggaggagaagaaaaaggcagcagtggcggttgctaagccaggtctgtatccaaaaaacctgcctcctgggtttgtcccctaaaccagaatgggctgtactctagaggagtggattaggaagccaaagcccctgaccagcttccagttggttggaggccctcaagtgtgggagcctgggaggaggggataggaaactggtttcctgagcctggctttctgctctgtaggttcagaaaagaagaagaagaagaatgaggctgctaaggaggcagagacgcctccagcaaagaagataaagcctcagacccccaacacatttcctaaaaggaagaaggtaggttgtcttgttttcctctcaggagccagcttttagagtagacaaaaactgcagatcatctggacagctctttgcctggcgtggcacacacactctagtgtgtagctcaggagggcctttttgttccatgactgctccatcctgaatttcctactccattcttccccagggagaacgaagggcatcctccccattccgaaggatcagggaagaggagatcgaggtggatgctcgagtggcagacaattcctttgatgccaaggtgaggaaaacgaggggtcttcaccatccttgagggggtggggtggggtgggagagagtacagcatttggtcctggttgataggttctctgagtttgagttgcctggagcaagaaatgacagggccctggggttgcccttctgtgcgctaaccacctctttctgcttaccagcggggtgcagctggagactggggggagcgagccaatcaggttctgaagttcaccaaaggcaaatccttccggcatgagaaaaccaagaagaagcggggcagctaccggggaggctccatctctgtccaagtcaactctgttaagtttgacagcgagtgaccatgggccgtctatggcacagcaagggtgtgcccactcaacgtcctcagtggacctgggaatcctaggctctatcaggggagggtcttggtgaagagagcagtttagaataggtctgaagactctgcactgtaacaccctctaaggtccttttttgtgttcgtggttttgtacagatttgttttttgagtgttgggtagcaaggacaaagagtgttcatttttaagaacaattttagttgtcattccctccatgttctgtgaaagtcttcatactgagaaatttgtatatttcctattaaatcatttcttattgatttttgttgtggttttcagaggtgggttcccacagattaaaatcttagctatctcccaagacttggtaaaggtcacatgtaagaatttttataattggagaactctgcctatgtgagtgctggtgtccacttttcatccttcctacccatcagagccctgatgaggggcagttaacattaaccattgttaatgtatatatctgttaagcatgaactgtgtacctcatttatggggtctaggactgaaatcttcagccagcatggacttacctactttggaggataaaagtcattgttttattcagacaaaattctaatg

SEQ ID NO: 29625 - DNA, 1405 bp, Bovine  19866880733480
ataaaacgtatgcaaattttgcggcgttagttgctgtcaaactgtaggggtataatactttttcttttccttcttcccaccttcttaaaatccttttaagtttcctgtgatattttgttttctaatttaccgtttctagtgttgaagtgctactatgaatgatttcttttttctgcttagtctgcacaatatttcacttttgtggtgagtttatgggagatgagttgaggtgcgtagaggaaaagaattgattaattggaataagaagtagatttcctttagtttcatacacagaagaacaggaataaatttttaaattaaatattttgctttttgacctataacttttttttcttccttttttgggcactagtgctccttttgagtttccatctggggttagaactagtaaatagtattttcttgaagatgtttctgtcataaaggcaagctgcaactggaatattgtatttagccaagctttgagaattcctgtaatctgtgtcatcctgtctcatgctgtcccatctcatagttgtcctctctctgcagtgctctatgcccaggtctctgtggctgggctgctccagcctggcggacagcatgccttcgctgcgatgcctgtataacccagggactggcgcactcacagctttccaggtactttctctgtctctgtgggttatttgtgggcattagtatgtgtgtgttagttcattagtgtgtctctccttctttcccatcctttacttaagttcgcttttctccttcgtgttgcctgtatttcacgtcactcagttctcctttaatttttaatgtagatccagactgatccactcttgagacatttttgttatgattggtttgccaaaattgacagagcacaacttgatttgttggttttcatgtttagtagaagtatgataatgagttttaaagtaatctcaataaatagcattcaatatgtaatgtttgctctggacctacataaaaccaattaatataatcaatcaatcaattgcaaccagttgcctgggcactttcttatgtttttcttatgattactaaaaacataaagtgctcaattcagagtgtctccttgctactatactattatttatgtgtgggtgtatgtatatgtttatgtatctatatgtgtgtattttacatatataagaactgtgtttatttatatcctgattaataggtctagtttcaaggtggaaaggccttcatgacctttgagtatagtgttcagcttgagacagtccagctggtcttgcttggaccatcaaatcctagttccctttggcctttcttagaggccactagggcagttccaggatgtgagagaaaactatagaaggaaagaggaaaactgtagagaaatatgtaagacagagct

SEQ ID NO: 29626 - DNA, 1772 bp, Bovine  19866880771051
gagagaaaaagagtatgaatattagaaagatgatgacccaggtgtgccgaaaaggtttctcagtcattctgagccctagaagggggtgggggcagccttacatctctactgggaaacatatttcccccttttaaatcaggaaagaaaaaaacaacaacatagccccaaatagagaatgttttcttttgtaactggaagcaaacatcactgatggctttaacagctgcctgccaacatggcctgagaagcaggcaagctcaaacattttttgagatcaacacatgtacagacatacagtatattaggtcaaattataaatccaggaataaaagaacaaataaacaagtttcagctttctctaggctttctgagtccaataccagctaaattagactccgaagcagagaaatctagcttccaagaaggcaggtctcccaggagttcaagtcaaacctccctctggtaggaaaagaaggtgccgttgtagattaactggctgacggctgaccaggtccaggctgacggccctgcctagcgggggcttccccgtgtcttagccttacagaccctgaggatgtctgccattgacttgatctttgaccccagtaaatcatttaatgtgccatgtgcctctgtccatatgttcatgttcggatgagaattccagcaagtctgggtgtgccacccattagggctaaatctctccctttggagcttctaggaagaaacctgtggacagctgcattgcagagagccaaagtgcctggacaaaccaaactgaaatgcgtgcagacagtgagaccaggattgcctaaactgcaactaacaatcagaaggacaaatctgttctctggttatcaaaactgacacaagacttttgtgatagttttgccttagcgcaagaaaaccacttaagagtcataggtgggaaatattggattattcttctgatcccacctctatactagttaggtgaccttgagcaagtccattagtccaaggttcttcagacattagtcatcatgaaatcaatgaaatagactagaactaaatattttttaatgaagtcaagctgaacagaaaaatatcagtgtttagtccacaataagttaagctccatcgtatgtgtgtgtggacgcatgttttctggagtcatgagaaataaaaatttcctactgtgggtaacaaacaaaagagcttcccacagtggcttagaccatgggttttgatttcttcatctaatgaatgaaagtcattcattttatacatatctagacagtcatattcatacacacacacacatatatgtataatgggcaccaccgtgtcaggcacagtggcatatgacctatccagggacaacaaggccctgtcttcctcgagcctcagctagcagggaagccagtcataaaataattacataactgtttaccattgtatgaagagtgtatgtaacaccaggttcataacctgggctgtagggtcagagccagccttcctaaggaagtgacagagaagggggcagagagggatggaggcaaagaatgggggtggggatggggtggaggtagaattccaggcagaaggcccagtaagtgtgagaagaacctgaaggttgaacaatgtcagctctacctcaacaatttctatgaagaccacgtgagatgaccatgggaacactttgtaaactatggagtgttattcaaatatggtggcttattatttaaaacagtgattataaacatgccttaaagatgagttgagggacttcc

SEQ ID NO: 29627 - DNA, 1222 bp, Bovine  19866880894590
atccaaagactatgagaatattgtgagtttatatgggctagcaataatgatatcagactagtaatactttacatttaaattctgatttatgtagtgtttttcaatgtttataaatgtttaaaagtgcttaagcacttaaatctaaattttctactagattataatctcctttaaggcagggattcacttttcataacgttaatccagtttcattttagaaggcttaaattaaaaaaacattattttttgagcactgatggcattgttgaaataactgtagcttcccatggtgtttattctggggataatactcattttagacatcgatttttgtcttcattggatagttttggtttccagtaacaacttgtctcttttcatccttaagcaagaaggaggacctattttaagggtacagagatagctcacgggaataaagtgcaacaaggatatggagtcagtgttgaaacacttttagggctcaaggcagccactttgtactcctgggataaatttcacttggtcatgatgttagtcctttttatatgttgctggattttatttgctagtattttgttcaggatttttgcctatatattcatgagaaatttgttgtttcgttgataagtcatgtctagcactttgcggcccatggactgtagccctgcaggctcctctgtccatgggatttcccaggcaagaacactggagtgggttgccttttccttctccagggaatcttcctgacccagggatggaactccagtcttgtgcattggcaggcagattctttgctgcttagcaccagggaagcccttcttggaaaatactggtctgctaatagccattcttttactgagtctatacaatgagttaaaatttttattattttcagttcttatatttccatttggttcttctttatatgtattgtttttttgctgatactttctgtctttccatttctttctagtgtttgcagtgagttgttgaaacatttttatactatttaaagtctttgtctttaaagataattcaacaactgtgtcgtttattattggcatctgttgatgtgcattgagatcctccacactcttctttgtatgcctagtaattttggggttgtatcttggacatttttaatattataagactctgagtttatttaaatcctaatattgatatttttgttttatcatactctcaaccctgttcagttcag

SEQ ID NO: 29628 - DNA, 2500 bp, Bovine  19866880927667
gtctgagagtggcccagactctgtcctggcagagtgagccttgtggtttccacagaatttttactctcatcagtttgtaaaaagaaatcccagaggcccagtctctgaagatagggctttcttccttagaaactataaccccctgcctcaagcagtatccttgttatctgctgtcatgcagacagtctccccacccacctctgcatggagtgtaatttttttccctggcactctctttgggcctaaatgtaggaaaacacgtcataccctttctgaagttcgaggccagactatgctgctctggtcatctgctctcataggaggcctaccagctattgatttcatggacgaggcgtctcttcttggctagccctcaaggtgtccagtgggtgcctggcaaagccctttgcttatttgtcagtgaggacattcaggtggatgagaagtccagtggctactgaattgaagttctatagcagtcaggataaattgtttgtaagtgacagaaaccaaattcacgttaactcgaataaaactgtaaatgtttggctcataaatccaagggcaaagctgagcaatcaagtaaaggaagagcaggagtccagcatcaggagtcctggacccagagccccgcagtctgccaggacttaatgcctctagtgctcatctctgtttctggatctcagctcctttctttttcccagttgaccagcttattccagaggctgccaagagctcctgagtttggcagctcatggattaagtcatggagaaggactggcatccagaaatctcactggccctgcttgggtcagctgcctaccccttgactggttaactggccaaggagggagattatgtaagaatataggaagtctcagaatcagctgtgtggaaggagcgtatagggcagacagagcagttagtgtctgctgttttcataaagggcaaattactccttgacagcccgtcccaaacgtctaggtgatggcgctagtacgtatgtggatggtagcagcttagcaccttggccgccagctctcacggtcagtcagtctggagggaactgtggcattattggctttcacctcctctttctcacttcattactgctctgctgattagacattcctccctctgtaagctgttgatggtgtccttagaaaaatctgccacttttctcacgtgttcatgggggaaaaaccggactgcagacacatgaggttggacaaatgtgcagtggcccaggacccttccagtgggcagagagagacgggagccgagtcctgggatggcacagacctgactgggccgcctccggaggagaacgactagcaggcggccagaattagactccaggacttcagcggaacaggatggaacacacagactcccgcctctctcttctcagtgccattgtctagagggcaggaaatcttggagaggagcagagttcaaggtcaagattgctggtgctgcccactaatctggaaataaggaagtcccttgggatttcaccttcctgagaagccctgtaatgaaagacttgcagagaaggacctcagtattcttacttttctcctatctctagctgtgtaatttttcctcctccccctgtacagtaagcctcagtctgtgccaacctgaggactctggggcccttagtgtctctcatcacagggaaggagttgacatgagagttattgcttaaatctgcacaccagggtttactggtggacctcctctacaatagagactttcttgaggaatcagtttttcctcctgtgtacatagacatagtcctctcctttcttcttttcatggatcccatttctatagccctgttgtgtatagttcatgatgcatagcaggccctactggtctgtccacctccatgatagaaggaaaattcccttcccactccttgaccactcctccatcaccagtagccttcgggggtaatggtggaaaatgccacagcaatcaggctaggtggaggagtacagagcttcatctccacttctcctctccctttttgatggaagaaaagtggtccaatgatgcagatggtagtagtgaatccgtaaatcaactctcacacactcggtctcccttcttctcagcttacttgatgtcactgtgggcctctctttggaaagtcattagggcctctttcgttttaagctctgtcagagttatgaggccaggggatgaggaatgccatgcagtcaggcgataggtagtgtgggtgggctctcttgccctttgattcctcagagagagcctctttctagaaggtcttgattatactttgatgcttgccacatgaaaataccccacattggtgcttatgtgatgttgagaataaaaataagaaccaggccaatcagtctctagggaatgccattgctgggcttaaatgtgaccgtgggtcaaggacaacaccacagagtcctctttgacctgtcctcatctctcttctctctctgtgttgtaaaca

SEQ ID NO: 29629 - DNA, 1105 bp, Bovine  19866880975191
aagattatcagctttagcctttccatagagtccttttgacatgttgctgaatttgtgttcttttgattttgaatagttcaaaagttctgtttctgcttctttaggagcattctggaagagttttccgactccagtttgatgaattccagattgtcagtagttcacatgatgacacaatcctcatctgggacttcctaaatgatccagctgcccaagctgaacccccccgctccccttctcgaacatacacctatatctccagataaatactcatacactgacctcagactcacccaggtatgaaaaagaattgtgtacatagcactgagggtaagcgatggaacactggcggtaaggtattgtgagttcatggagccttctcatgccctttataactccaagtcctgtgatacagaaactgacaccacgagacagggctgggctgcaccctggatgctgcccttgactgaggtaaccagcctcagtccttagataattcttgagctaggtctcgatgatccttgtgtagtagaactaatattcctgcctcagtcacctagtcggattgttaaggaaatgagatttaaatcagtttcaaaactaagagtattgaccccaaagcctgtggctttgtaattcccagatcaaactagtacctacaatggagaccctttaacccaagtagataatctgatgttggaaagaaaaaaatctcttggcaaaatagcacacaaggctgccttctcatagctcttgtcagtatcatttgattataaaaggtagcttttctctgtcccccttatctgcattccctgccccctccaactgttttttgaccttggaagtagctcgagttggtgagaactctgataccctcccactcaaatctccatcctgtctctagggcagaagaagatcctaatattcatcttaacctatatccctgggatactcagatcatacctgatggtcctgagcagatcagatataggtcaacactggtttggaaaaactgtactagctactgggaaatattgccattattgtgatttctcatttcctatacttgcctctgttcttggggcaggagcacacattcagtaca

SEQ ID NO: 29630 - DNA, 1506 bp, Bovine  19866881103536
gtaatttattgttctatgtatacacacctgtcactggatatgtgtatgtgtgagagaggtgtccttgggttggacatcatcctcagaggtccagctatatagcactggagccaaggacactgggtcaacaaagactgaggccaatatgccacttctccccgcccccgccatcttgctgtccccagctgtgtctctttatacaaggtgcccgagccgtcttggtggaccttccgtgcctgtgaaacccactggactcccctaaccggccccagctactctctccaccccccatcttcccccaacaccggggttgatttgtgatgatggggagggtacagggaatggagggacagcggggttaacgttccctcccggggtcttctctcttcccaggccaccctccagggcccactaaaaaagcgctgaagcagcggttcctcaagctgctgccatgctgcgggccccaagccctgccctcagtcagtgaaagcaagtgcctctcctgtgcttccgggggtggggcccgtgtgtatctggggtgtaaggagtgtgagagtgcgtgtgggcgtgaccaacttggcagaggtgggctgggcgctggctgacgagggggcgtgattacccagcgaatgtgtgggcgtggtcagcatggaggcggggcctgagtgtctgtgggacatcagggtctgtgaaatgggcgggatctggatttgggggcgtggtcagtgtgactggctgaggtgtctctgatactgtgagtgtggccacggtggcagaggtgggaccaggtggctgtgagggtctgtgcatggggttgttgtctggccgccctccccgtccttgggcatgttttggactttgagaggtaggtcaccagtgccttgactagacggatgcaagtgtaagggccgagtccaccttccttcagataccaagatacgggagttttctaggaccagcctggtccccagtagagtgacctcgctttgtctgtagacctcagtttcctcgtttgggccttgtccacctcacaggattatacatactgcattttgcaagctataaagactcggtttgtagtcattacttgagaatatcattgtgtttgattctgctgggtcccacatgggggtagattccgaaaaaggataggtgtgatatgcataaggtccgatttgtgtttgtgctcattcgttacgcttgcctttgcgtgcacgaggagatggggagtgtgcattgtaacaagcaggtctgtgagatttgctgtgagtgtgaggggcgaggtgtgtgcagttggccgggtcttccgctttctcggtgacagttcgctcccttcagcattagccgccccagcctccctccgcccccacagaccccgcctgctggacccaggtgacttattctcctggtgggggcgggtgcggggaactttgggagcctgggttgggggcatctgcctggggacttggatgttgggaactggggtgggactgagatgggcctggg

SEQ ID NO: 29631 - DNA, 1272 bp, Bovine  19866881108998
tcctaggggcagactgtcaattctctagatataaaatacaactgtagagtggaaattaaactcaaagcttttttagaaaactgtatttatttatttttggttgaaggaaatggaagaagttctcaaagacagcatttggggagaggcagtataacagaaaggctttattgacaaaggagacttagtaagacaacttgcaagagaaaaatgaaaaagtgattacagactattgttttctaaagtgaggaagaactactaacacaggaagaaaggcaacacgtaaacataagcagccacatactgtcaaggggataataaaggcagtcttcatggggtgaacaaaattattttgaaatctcagggatctgtatcaagctaaggtgatatatatggccaaagacaaaggaatacagtcagaactctaaaggatactcaaaagagcaggaatgggtttctgtagttgaagaaataggagaaagagtgataattagtgctgatcctaaattatttctcagctataccttcacatacccttttaaaaggccaagaagccacctgttcgatgatcttttttttttcttctgtgtaactaatacaagagatctttaaccctctttaaggatttaaaccctcttttagggtttaattaaccctaagcataattctggagccttttatctttggtattttcatacatatctgtcaagatttgcccatctacttcttactctccctgccttcaaaaagagactgtaaagtcccaacatctgataaaggtttattgtcatttacagtccaaatgggaacaaagtacattttaacagggaacaaaacctttataagctatgagaatgcatctctacaagtgaaattttgggtcaggagttatttggagaaagattttcttttcttccccccccccccacgaagggtagaggaatattcctagctgccctaaaattttcccaagcaagcaactgcctcctctatttctaaggctagtcctaacatgcttaagaaaatgatggactttgaattccatatatctatataatcttttactttattatacaatatagtttatttccaaagtatgaaataagttatcaaagatcaggtttccattcttccatacagtgaaattagtgaaagtaagggaaacatactcggaagaagaaataataatatattttcatttatgcaattttttatagccaaaaattccctggtatttgcttcctaatttaacgaattgggagaaattttaaagac

SEQ ID NO: 29632 - DNA, 1106 bp, Bovine  19866881139857
tttgtagtccataggatctctgtcctgaccacccacctctgccattgcagtgtaaaagcagccacagataaatggtaataaatgaggatggcttagtttcaataacagagaaaggcagtggcaccccatcccagaacttcttgcctggaaaatcccatggatggaggagcctggtaagctgcagtccatggggtcgctaagagtcagacacgactgaacgacttcactttgacttttcactttcatgcattggagaaggaaacagcaaacccactccagtgttcttgcctggagaatcccagggacggggaccctggtgggctgccgtctgtggggtcgcacagagtcagacacgactaaagcgacttagcagcagcagcagcagcagcagcagcagcagcagcagcaagtttcaataaaactttatttagagcaggggcttacagtttcctcctgtaaattatactggcattaaattgatagaatgataagactgtagttggctttcactttgaagtttctctgctgtggaaaccatttttaaagctatctggatggtgtgggtatagggtttcagttatttattaagaccttattatctgtatattatgtaatgtgttgggaggtagagggaaccacaaagactgtccagtaagctttcagtcttattgggtacttgagagtagatacaaacattcatctatttaagtgccaaactgtgtggaccaaataaaaatgttaagaaatttccagtaagataagatggaatagttgtatactttcttagaggagaagaagttgaaactcattttaagaatgggtaggacttgaattgattaagtaattgtgtttataattctagactagtgttaataaagatccttctagcttggaaatttcaagaccaaatcatgtttatgagactatgaagagacttgcttaactagggcagaaaaaaaaaagtacgttgagggaaataacttgatataatgtagcaggaaattctggaagatcttgaaaaccaggcctagaactttatatttgatttcatggaaacaaagagccactatacatttttaagaaaaaattagtggtattaagaaaga

SEQ ID NO: 29633 - DNA, 1330 bp, Bovine  19866881167448
acgtgactgagcgacttcctttccttttactttctgcactggagaaggaaatggcaacccactccaaggttcttgcctggagaatcccagggacgggggagcctggtgggctgccgtctatggggtcgcacagagttggacacgactgaagcgacttagcagcagcagactaggttgctttagcatcattccttccagagaacacccaggactgatctcctttagaatgatgctgggagggattgggggcaggaggaaaaggggatgacagaggatgagatggctggatggcatcaccaactagatggacatgagtttgagtgaactccggcagttggtgatggacagggaggcctggcatgctgcaattcatggggtcgcaaagagtcggacaggactgagcgactgaactgaactgagactaggttgcatctttcagctgaagtgcttggtgtcaaactgctcttcctctcaactcatcagtatccattctgataagagagctgtgacgaagaggcaaattttacagcccaaacaggtgcatgagcaaagggattcgggggaattttgcctggctgagaccttccattccctttccaatcctaactctgtggccatcaatagtgaatgtaccctccctgattactgcctgagggtgttccacacctccctctctatgacattcagaattctgtacatagcccactccaaagggtattattctcaatgaacccccttagacagaggctgctgaatttcttttccttagagtccccagcagagtgtacatttaaagcattctattttttttttttttttgagggagaattttttaggatgaaagaatacagctacataagcactaagcaggaggggagagtatacctcagcatcggaacaaaaagaccactggagcaaacagaggactgcaggcaaactcaccaggagaacagttaaaagagacttacaaagaaatgcacttaattctcattccaaaccacaagcttgtcactaaccccagcaatatctaaaaagtcattctcaaagaccaactaaactttggcttaatgtatttcagataaagggaaaaattaatatattaatcacagagttcaaactttatcaccttaagaaaatcatacatcaggagaaaagcccatctgcagtgattcagtctctatttctgtgagcaaccagagaataggatgtgaacttggtgctaataaaatgctcattaagtgaaaagcattaagatgttaacatgaagagattcattaagggcttcaaattacttacctgaaagttgttggttagagaaggtcagatttca

SEQ ID NO: 29634 - DNA, 1166 bp, Bovine  19866881213082
tgattactctaaaatgggaaaggtttaattatttattagacagagaacagaatcaagtatgcctgctctgtaaatgaactaggggaaaatctcacaaccaaacaaaagtcaaaacctagcatccttcagatgagaaacagggctcagggggctgtccaccaggcggccctcgtgtttcagtcagaaaaaaaacactttgctctgctcttactcaggagaacagggcattcagtgaagctggaccaacatgtgggttgaatacagtctctgaagaacctaagatttcccaaagcctacaaccgtcgtatttgttagttaatattttgaaccaaaattttatttccagccattcaaaccaaaatctgaatgttgttttcaaacattctctcttcagggtcaccaagtcatatcaaatctatctcttaaaacctctgaaatctgaaataaatttccctgaaaccaacgctttagtatagatctttgtgatttcttgtctggtagagtagaaaaccaatagtcatgtatgggtttgagagttggaacataaagaaggctgagcaccaaagaatttacactttcaaactgtggtgcttgagaggactcttcagagtcccttggacagcaaagagatcaaatcagccaatcctaaaggaaatcaaccctgaatattcattggaaggactgatgctgaagctaaagctccaatactttggccacttgatgtgacgagctgacttactggaaaagaccctgaagctgggaaaaactgagggcaagaggagaacggggtgacagaggatgagatggttggatggtatcactgactcaatggatatgagtttgagcaaactccaggagatagtgatggacagagaagcacggacagagaagcctggtgtgttacagttcacaggattgcaaagagatggacatgacttagcaactgaacaacaagaagagtataaaaaacacaggttatagaggttaatggggagaagagaaaaatctaacagaacaatttcaaataatatgtgcagatactctcctctttatgaggtgtttagttcccattatcactgagagtaagctagacttatttccatagagtagcaaaagggaaaaatagtaactgacagtaaagaatccggcaaatctacttcaaccaa

SEQ ID NO: 29635 - DNA, 1183 bp, Bovine  19866881244927
ataatgataaaaacagaacagtggttgcttgggactggatttggggatgggattgactgggtaacggcaccagtaaagttttgaatggaatgaaaatgttccatagattgactgttacacaggtgtatacattcaccaaaattcatcaaactgattatttaatatgaaaatagacttttaaaacttctaagtatagggtattcctaaggataaatgccattgtaatattaacttaattcataatgaaggtattatatttgtagagaattctggagataaaggcctttgttatcaagcctcctctctctctatcactctcccttacagatttttctactaatgcctaaagtaaatgcagcaaaatttcaatttgggaacctcagaaaatccacaagggtacagtgaaaaagttcaattattaaaaaatcaaaaggttgtatattagagtgggagagagggtaatggttacttgtggcaatagaattgatttggctttcccagcaagagcctgatgactcaaccactactgttcaaatgtctaagaaagctgacaaacaatctcagtttaatggtaatactaactttctgccaaccctgcacatctcctgttctgctattctgttcacaatgaacagttatctccaaaagaaagaaagaaagaagctgtcaggtgacaagcacacaaaatgaaaggacttaagtatttatacgactgttctcagcttagtcctcaaaagccaagggctaacatttccttccctgaaaatatattaaagcatcactttcaaaattaccatgaatttctctgaagcttctgcctgggccaggaaggaaaaatacacacttgcagataccaactagcctaaccactgccttggcaacattaagtgtgctgactttgctaactgcactgggtgtgtgctggaagatacagcagactggctgaacttaatggtaagatgacagatgtttttagtttgcatgtaaactaaactgctttaatcacaagggagggtgtatattaagtagagaaaaggaaatgtttcagatataggacaacatttggaattgtgggtacaaggactagataaagagaatacattgatgactagagagatgcaaatgatatttaagggattctggtttggtcttcagaaggactccaaggacagactctggtatt

SEQ ID NO: 29636 - DNA, 585 bp, Bovine  19866881279500
aatgctaccctgccaggggcccgagtggcccccatcacccggcacctccctccactgccccaggcagccggcaggggctggggtccccccaacatgccagttcggaccacccccaccctacccaaggaagtcggacagacccagtctagtatggatgcgcccgggatggggaaggatctggacccacctgttgggaaacaccctgggactcccggccagctcggaacagggaagcgagctccctgcccaacgcaggccccccgcccgggccttcctagaagagcagggcgcttttaagtcgggaggcagagcggcccgacccctgacatttataaagacaaattcacggagcaaatgttgagacgacagaagacccgggcacctgatctttcggccagacccgccgccaagtctccccaaagagccgcggagcgggtccctgaggcagtcaccggacctctgacatcgaacgccccctggctccgaatgcccccttcctcggcgcggccgggagtggctgcccgccgagttccccaaccacccccaccggctgggaggcgtggagacagcgccggactccgaaac

SEQ ID NO: 29637 - DNA, 1559 bp, Bovine  19866881289937
ccaaagtccatattttacattagggttcacttttttttttcctgtactagaaggcatttttttaattttatttttttaaattgcttattgtgaactggggtatcgccgattaacaatgttgtgctagttccaggtgaacagtgaaggaacttggtcatacatatacatgtatatattctcattagggttcacacttggtgttgtaccttcagtgggttatgaaaaatgtataatgacatgtatccaccattatagtattatacagagcagttttcactgccctaaaaatggtctgtgttccacctgtttcacctgtgttccctcctccctaactcttggcaacccctgatcttttcactatctccacagatttgtatggtctgttgattttgacaaggatgccaacacaattcagtgggtaaagactagtctttttaataaatgacgctgggacaactagatatccatatataaaaaaatgaagttggacccctacctcacaccatatacaaagaatggatcaaagacctaaatgtaaaaactaaaactataaaactctaagaaaacacaggtgtgtaatctctacaccagggtttctcaacctcaatactaacagtttaggctagatgattctctgttgtagaaggctgttctgctcatggtaggatgtctggagcatctacccaccagatactagtagaactcctccctcttttagcactgacaacacaaaatgcctcaagatattgcccgatttcccctggaaggcaaaactgcctggttgagaatcactattttagaataaatgatgctccctaaacttttcctttccaaaattaccaatgtttatgtcatgactatctgaatggttatttgcttagtagatgaattctaagaactctctggaaaagtcatttaatattccataatccatcattttgaaaggatctcaggaccatcccttagtgccaagagctccattttgaaaagttcttagtcaaactctttccattaaaaggtcacatatcatgattttttttgatatggcattttttaggtaaaagctttattgagatataattcatgtcatataaattcatccctttaatgtgtaaaagtcaatgttttttaatatattctgagttgtgtaataaaatatgatttttgaaaaagatgatccttttgtattttatatacctttgtcccaaccacctactcagcatatctaccagagaactaaaaaccaaaaccaaacaaaaggctattcaccttgacattgtctcctcacaggatagaagagacatcactctgccaacaaaggtccatataatcaaagctatggtttttccagtagtcatgaacagatgttagagttggaccataaagaaggctgagcaccaaagaattaatgctttcgaactgcggtattggagaagactcttgagagttctttggacttcaaggagatcaaaccagtcaatcctaaaggaaataaatcaaccctgaatattcattggaaggactgataaagctgaagctccaatactatggccacctga

SEQ ID NO: 29638 - DNA, 960 bp, Bovine  19866881303826
ctgagttcagcttactttgatgttgtttggctccttaaaatatgacccctcccttggggcagatttgcattagaattgagttctgtgtgccttgaacaattatttctgagcaggtttttctgtggtatgaactgtgacacgtgcagatagtgttgtgtgtttgttttcctttagtctggcctgatttcctcttttcccaaagaaaagagccctcagctctgcattatataaaagtgagacggggctttagtgtaacatggtatcaaacttgatgtttcagaacaagactttgagtcttgttttcaaaagcacaaaatgagacatacattcatatggtctcccttccttctcaccctactcccaagttgaagggcctgggtattcatgaggtgagagttcagatatagtctccaagccagttaaaaaaacaacatcgcctatgctctgctttcccttttttggcatttgcatcagtgtagcccttctgtgagcctcttgctggcagggccagctagccagctgtggtgtgattgtgtgttcagtgttcctaaaagctattccattggccaaatgaggcaccagagcaagcctttgcctaacagacagcttctcagtattccaccagtggctctttcctcagccagatggataggactcaattagtctatcagttttccctttgacatatttattctcctttgtgaggccagctgtgggaatccatccttttacttaaaccactttgataaatggctttcattttcttttttcctcttctgcctgtggagcagccctaagtcctgtttaggactttgatgccactgctctctgtgaggtgcttcaacatcctacctttttcctgttgaaccggttcagatcagttttgttatatcgtttttatgcaaaagaattcaacatcttgagctttgtataggaaagaaacgggactttcctatcaca

SEQ ID NO: 29639 - DNA, 1412 bp, Bovine  19866881380160
atttcctaagaaattaaattcttttcatcactctcctttcatctggagcagggggaaattcaacgaagggcctcaactcattattctctgtcatcatcacaggcacctggaatttaccacccaagctgtctgaagtgtgactggaaactgacaacataaaagtctgctccttttgccagcacctctacccaatgagcacaacaaagaagggtatctagaatgcaaactagaagaagtgtagaactcttaaaaaaagtctttctggggtctcagaaaacgaagcctgtgctctcaaatttgaaagtaaaatatctgactggtagaacagtaaattgcagtacatcagtaatgtaagtgtaatctgtttatatcctcccagtgtctctttcctctttcacaatcttcccctattgtagagagaaccagtagcagctgagcagcagccagacataacggaacaaacaaccagcagaactgagactagaacacagctctcccaaccaactagatgacactgagtaaatcactgtgcttctcagtttccttacaagtaaaactagaggactggactagacatattatctaatgattctctcagcatccctgaaataccacaagcacaaaaggaacacctaaatactgtaaagctctaactgaggcactaaggagttacaaaagggaaactccgaactggatcctctaggagctcaaatctattagcagagacaggcacagaacaacccatgaagtgttaagtcgctcagtcccatcccactctttgtgacccatggactgtggcccaccaggcttctctgcccatggaattttcagacacgaataccagagtgggttgccatgctcttctccaggggatcttcctgacccagcacccaacccaagtctcacactgcaggcagattctttaccatctgagccaccagaacccaaagcacaaggtaaactgtgagaaataaatagagttaaagtacaaagcaaatgctgtggactacaaggaacagaaagaagcattctatgactacactatgatctctgttggtctgggcttttaaatccttctagtgaagaagcaaatacagcaaagccacagcaatccttttctgtgagaaatgtcatcttaggcgtgaacacagtttctgagaaacaagatatagtagacaaagtaataaaaaataatcaggcaacttttcaatgctaatttcacctaccaccaaacttaggaatggcttcaaatcccccaaactcaatggtaaatcaatgaagtctttcattcctaaacctcaggaactgctggtcccatgacctgcatacaacttctctctgaaagacccaagtcatacaataagaactatatcttaaagcaatccagctacagacttcttaaatgcatgtca

SEQ ID NO: 29640 - DNA, 1295 bp, Bovine  19866881426526
tgggtaacataaaatatggagcttattcttacagagagggatttgaaagaagggattctgtgagaaaggaatacttaaagagggactggaatatggagcaatgttaatgttttataaactccaggagctgattgttttctttgtctcagaggaactgatgaatggtgtacggagctactaataaataagtaatttatcacctacacctgttttgctggtgatctggaagggccagcatggtagccattttgatctctgtcatgtgtaattgcctctggggccttattacaacagcaagaaaaatagctgaggaaaaatgctgaaggtagttaaagagagttgagttatgtgtgatattaaagcaccatcatcagtaatgaatattttcagaacattctgctggatgcaggccactctgagaccagtggcttggcttctctgaatgtgaacagaaccctggttcagcccagtaagactttctgaaatgtcagcttgaaaaattggacatggccatggagctggagaaaatcatatttctagagtgaggtatgcatctctggtctgtcagaaaccccagaagaattaatatagtaggtgagggcaagctggtaggcataatttatctgggctttgcggcttttggtataagtcactcaccagaaaccattaaggaaacctggtgaccatggagcaggaacgtttttgacaggagtgtgaggaatttccagatgaacacagcaaaaccaaaagctggagaagttttatgcaaaatacaagagggtgtgcttgggagaacaacattttagttaccagcacatttggtcccatgaccaatggggtaagttgtaacctttccagaaaggtgcagagggtgccagagaggctccgtgtccagctaaatacagagaagacaaattaggtgttgaacttaaggaatgagagtagttcttcctcacttcattttagtcacttaatcttaagagattagaagatcaggttgggaggggaaagatgtagggaagagcaatgaaattttttaagtatggtttcagttcagttcagtaactcagtcttgtgccactctttgtgaccccatgaatcacagcacgccaggcctccctgtccatcaccaactcccagagttcactcagactcacgtccatcgagtcagtgatgccatccagccctctcatcctctgttgtctccgtctcctcccgcccccaatccctcccagcatcagagtcttttccaatgagttcttagaatcaactctaagtaggtttagatcaaataa

SEQ ID NO: 29641 - DNA, 872 bp, Bovine  19866881495896
ccagaaatggcctaatgaaaggaatctgtatcgtttccatccagaaacaccagaggctgggtaagaagagagacttccgggttccctgtccctgtcctacagactaccccggaaagctaccatcaaggctgatgacagacaggacaaaatttaacctggccagggcagcaggagaccttgatccaaccaggggccttaaagggaaggattggaatttgtgcaccctcaaactgaccacagcccccttagtctctccctcgctccccctcactttctaccaccagcctcctggctggaatgcaggggcccctgtgccagaaggcccaggccaggcaggaggccgggaggcacaggtggttctcagaggagatccctgagctccagaaagcatttcccccacaggcccaacaaagctggggcttgttgttggtcaaggcgcctttgcttgtctgggctgcagcccagacggtgaggcggtcggggcaggccagaggactcagggctgcagggtgtgtgtgtggtggtggttgttgggggggagcaggtcagccagccgttttggcaccagctgcctccttccctgggtttctcactttgttcagcatggcaacccaaaggaggctggggaaagcacttttcactacccagcaaataaagacacagggagaaggagaaggatgaaaggtttgggggttaatttggtttgggggtatttacgtggttttaaaaaataatagaagttttttctgcgatccaattaatttcaaacccaggatacagatcatgaatagccaacagtgatcccacagcacctaattcatattatccctcttctgagacttgaagtcccagtggagtgagaggtggtccca

SEQ ID NO: 29642 - DNA, 1048 bp, Bovine  19866881585013
tctgcaaaatctatatattcccaagacccaatatgaagctttcttcttcaaaccttccaaagctctttccagttaaggctaatttcccctcccttaaattctatagcactttgcgcctctactttggcacttaccaaagtgtgccttaagagagatttataaatgcttgtcttctcaaccaactgtgaagttctagagaagacagacgttttacttaactttgtgtcttcatctcctcctgcccccagaaccacctccctccacacgtaacataatgttttgcactcagattatgtttatatttttatcaagtcatggtgcaggccaactaccatggcctcatttccagttgtcaactttttgccaagtacttctaaacaggaaaatgcagtgcttcaacacagttgagaaccagagagttctaaacttccagtgaaaactttagatacatacagcggtttaagtaatataatttatcaattgtgttaacatattcatggaagtttacaatttaaaatgagcttgggggtatgggatgggagagagaaagatccttattaagtaggcaagtccaacagttaagacttttcagttaacaaaatgaggtgagtgagatgtctattcaagccatcactgccagtccactggccagtacacctgctacactgcgctccatgaccaagtgcaggtcttcgtttggggtacttgttttataaacatatacattttttaaagtttaaacataaacattaaatatattaagttttaatttatctgattaaaaacaatacatattcactgtcaaaatgtagaaaacattaaggaacgtaggaaaaagaaaaacaactaagtaatgctttttgtgctgtgtgtttccttatagatcttcagatgccattaaatattttgaaatattacccataatccaccatttcacaagtaaccacattaacagtttagtgtcatacttcctgagaggtacaaggatttatgcatccatgctgcaaaaacattatccacacgctacaactctgtttccacaattttt

SEQ ID NO: 29643 - DNA, 2103 bp, Bovine  19866880388715
cagagcatgaagcgggagggcagtcatccttcctgagtagatgtgcttcccagttgaaaggccaccaatgctatatcatgtgaggctcctagacagaaggtggctgggctggtccttattggagaaactaccatctccttgtagcaagagtccatagagaaaccactgtctacaggctcttaacgtttaactcctgggtcagtagctcaataaaagtccttaagttaatatctcttaggggcagaaggagggttctgagatctactctcttttcctttcttctccttatattcttccatagaaatttcaccatgtagtaaaggaactgagtaaatggacattttgccaaaaaagagaaaataacctcgtccatgatgccaagattaaactcttattcatatttgacagttcacagttaggaggcagcctgttgtatatttagagtatagaggaactaggtaatgaatactggattcttcatgctttctcaaattgaaggttgtaacaaccctgtgttgtccaataatggttaccattttttagcaagaaaagtatttttaattaaggcatgtatatatgtatatatcttttgagtgatccaaattaatattttaaggcattactactgtattattttttgattcctgttgcttacagcagtctgctatatgctaagtacaatgttaggtcccagataactggatagatggatggatggatggatttctttttttttaaatgagcagtaccactgtggacaaactgttctatggtatgaatactataataaatatttctactaggaagtatcttctttttagtgccttttataagatatatttgccagtcaatagttcagtgtgcctgtacacacatacatacatgcatatgcaaacatatattactgtcaatatgatcagtcattatttaaaatatctgaaccattgaaactgaagtttacttacagccacataattccacaaaagagaagttttacatctaaaatgcattacaaaaggaattaaagatactttccttttgcgtcctgtggccgggctgtctgtattttgtttctgtagactgaatccttgaattacaagttgcccttgatggctctgacttcacagtgtatcagcagatgttgcttttggagactaggaaagcactcactcatcagtcatttgaataacacaactttcttacctagtaatgggtgaatgtttcattatgtaccctatgctaagaatcgtttttaggatttgctatataaatggctgttttcattccagtaataaactgatggagagtttctggaagcactgtaatggttatataattttagtacgtgtagcccaaattatttttgccatgttttaactcctcctcaattcaaaactttataaatgagcctacaaattttagttcgaagaagagttaagttcggtctcataaatttttctcttaggtatttctcctttcgtaatttctttattagtcagcagaatatgactcaatggggaatagactgatattcgcaaagagaaaacttaggaagtttgttgcaaaggaaagtacaacagattccccactaatgatcctgacctctaaatagtcaccaggagcagctgtctagcttcctaaatgcaaaggctttacaaatacaaggtcattatacaaaacgcttcaggataacgaagaaatactgtattcctccatgttctcaatgtgttttctaaatttactttctgaaagcaactttatagtaatttttaaatttataatatgagtttttaagttaatatattattggcctaatttttagtgtatatatgagatttttctaggttattaacctaaatatacaatacagtaagacaaattattgtacttttagctacctataaaaagtcctttaaatattctttaatatgtgagtgtgtatatatacatgcacatataatccttatccatattgcatttgaaaaggtgattcatttagctaatccagttaaaagggtgcaaagtgaggctcatgtaagatgggccaccatatatactttccagcttaaatggtaaaaatttccagtactccaaactaatgtt

SEQ ID NO: 29644 - DNA, 4802 bp, Bovine  19866880555549
taaataactccaagttaaagacattaggaaacccttgctgctatttttcaaaccagatggggcaaacaataaaaaatattgctctgaataggcaatctcacttcaaatttatattgttttcaaggctttccaatctcacatctatttttaaagtttcctctccaagtatttttgactcattccatgctcatctcctcttaaaggtggtggccattcagtggctaaatctggcctctccatctatgaagcacttctccatttcagacctttcaacacttaataccctctcagtgtcactatcggtagagctatgagtgagctcaacctttccctggaagtggtgatttaacgtgtgaattatatggttattaggatgggtgtcagggaaacagtgtaatatatgtaatgtggaggctgatggggctggaggagctgaaacagtctggatgatttctggcgcttcttttaatgctgtgtcaattattcctacgaccgatcattcaaagctgtctattaccttctaataataataataatatttttcacttaacgttgcacctttcaccagaggatttcaaagagctttgcaaacattcattagcactttatgaagtgggcaggtaatatataaatacccagtcacatgtccctaaagagcagccattaatagttcccttgacaccacattcaggttagggcagaaacaaaaaatgaaaagcatttatatatgaaaagccaggtgccatcagcagcagcattttctgggcatctgtagaattctagcagagatgagcctcattttcttgtctctcagggtggcagcatggcggtccttttccctgctcttgccatctgtcctcaaacacacaaacacctcttcctaagacacagcacagaccaacgtgcagacaatccagatactggattctgtcagaactcttagaagccctgctaagagaagacatcccaacaggggaaaattctgactgccctagagatgattcttacacaagaatcctaagtaccttcagtcttctcctcaggacaaaatgaaatgagggaaatgtaccccagaggtgaggaaggagaggctgccagatcccaggtaagggaagttagaacaaaaagtgtgggttcaggcaaggaccacctgagaaacacgaacagctggtagctccaaaagctgaggttacaagtacccagtcgagcagtggacggcaaaaggcagaggagggggatttcacccttgaatccccatcctctatgccatttgtctgacttagaagataattagacacagaaccaatggcatattttatacattcttctcaatttacgtgtgtgtatgtgtgtgttactcagaataggctagcttaggctgtggcaataaccatcaccccaaaatctccaggcattaacacaacagaacacaccaaacctattgcagacctagatggctctttgggacattcattctccatgtagtggctcatcatttcaggctttcatcttaggcattctccatctcagcatgatgcttcctggttcaccctgctgggagagggaagatgggaaataacacaccaacacttattgtttttcccaggagggacacacatcatttttattcctagcctattggctggaattagtcacattgctccacccaaaactcctggaggggcaggaatacatagtctctcctatgtccaaggaggggaggaaactggaaatatcagtgggcattagtgaaatctactagtaagtacatagtgctgttttagtttgaaaccagggcaatagaatcatctctaaacctcaaagacctcaaaatatgggataaaagtgttatacaaggcttgccttgccccatgctcgatggacatggttggtgtgaaggtacaatatcttccatgtgatactatccagatagagctaggggtggctttgtgtttttctgcacaaacctttctggcaacaattattcctctcatgctttcttatttttaccaaagaaaaatcttgggttaccatattcctctccttccccaatcccaaatttcttttacatagaggatgttctctgactacaaaaacagcatgcagagagcagaagccctttgagccaatatttccatgttctctaagagagttctatcctctgtccttaaaagccaagaaatgaagatcattacactcactactctgcaatattcactcttgattaaccaccagtgcgttatccatattgcttcctaatcattgttgactggttagaaagatattttttaactcactctctcttatcttgggcttccctggtggctcagatggtaaagaatctgcctgcaatgtgggagacctgggttcagtctctaggttgggaagagctcctggagaagggagtagctacccactctagtattctggcctggagaattccatggacagaagagcctggcaagctacatctatgtggtcacaaagagttagacatgactaagagacttttttcttaaaccagaacagatttgtgttcaccatatcagagtgtgaaacacaaatgaaccaattcctttcctcccactccatttgggctcagtggccccatcccatcaatccttcattctcattgggaagctctttcagagcagggcctactgtgttggagaaatgccaggaaggaaaggagaagtccattaggttccagatgagttcccagcaaccttccattctaattctgtctagcaggggaaagaaaggatttgagagaggtacaggattctctcaaacagagagaattgtttcacaactgcctagctatgtgactttggatgatttacttaatctcttggttaatctgtttacctctctatagaaaagaaacaataatactgctgacatcatatgcttgtcatagggataaataagactgtatatgtgcaatgtcacaaagaagagattaacatttatctccccttcctaaaaaggccgttccacaacagagggcacatagccagagttgtatcacaactataacctttaaaatgtgtgagttactatattgtacaactgtaatttatgtaaaattgtgcatcaactaaactccaattaaaaaaaaagactgatctatcttacaggcaaaatggcaattcttcagtccttgtcctccaaaaggaaagagttcaattgagagacatagagaagtttcacgtagcaagggtttattaagcaaagcaaaatacacttccaaaaaagaatgagagcaggctgtctgggaaccagaaacagctctgtaatgggctatgcatgcgtgctcagtcatgtccaactgtttgagactccctgatctgtagccagccagatctgtccatgggatttctcagacaagaacactggagtgggttgcccttctagtccctaggggatcttcctgacccagggattgaacctgcatcttctgtgttggcaggcagattctttaccactgagccatctgggaagtaatgagggtggagttggatgttttagagtggtgatccctcccttcgtcctgtgttatttgactgacaagttgattgacagctttaggttatataacttttctcctagagcacaggtacttaaacacaagtatgtgaatgaaaccatgggggagggggacagtaaaaaccacaatgctaatttattacaaatatcgcttaatgaaccctgggtcactctgagtcactttttaggtcttggcatgcctgtgccaacctgtgctgttgagttttatctcgtttggtcctgataaggctgaaaatgtagcagtccttgaccagaagcgggagaacctcctggtgccttctgatcactagcatccaggtggagagggaacgaagatcccatccagaattaggtggcgacctactcatgtctgactacttgcctaacacacctaccactccctcttcttttcccaacttctctctctctcgccccctctctccctctcctctcacgctctaacttttcctgatgcaaaaactgagaggcccacagtgaccattcttcccccaaggtctaatcccatttgatcttaaacaaggaaccagtctctcactaatgatattaagaggaatcaagagaggagaattcctagtaacaaatctgcatatatcatttgttgccccttaatacaagcacagatgcagtgatccttggcatctcttccttaagaaaaacagttttaatgttgacattctgtcttctgacttgaagcaagaagtattacataaaacggcagctaagggttttcagatgccacctccagatggtaacggttcccggggaaccccaccttctagtttgcacatttctgttaaagtacccatcttctgggtactttaacccagaaacttcagcctctcctttcagagactggtctcaatcctgaacgaatcccctcccacacaccaatccaaggtgtatctctctaagtctgagaggtgagtgcacagcagcaccttgacccaagcttcaagaggagggtcggaagaggcaggctctcagctgctcaccactgtacagcatccagagggcacagacctgccaaagtaagtccattcatggtcttctgccccatcagtgtgaactgaggcacatctatatattttcccaattttatagctaataactgttgggctacacagacacatcccctaaagacaaagaattctcattcatttattcattcattcattctacaaatatttattgggcacctatgcatgccaggaactctcctagattttggggac

SEQ ID NO: 29645 - DNA, 1037 bp, Bovine  19866880562474
ttacagtgactcacctctggtaaatggtcttatttcatcagagtcaccatcttgctcaaaaagatactttcctgtaatagtatgttgacttttgcccttttggtggaaagtaagtgaaaaccgaaaccagaggtgctaatactaaagtgaaaggcacaggcttcatacacttatcaagccattccgacaagggtcaaagttgtgtgtcttccaaaagtaattaacattagccaaaattctatgcttaggtcatttaactggtggtgaatttatgataaaatgatggtaagcataagtttaccatttgacctgcacacatttaacagattcccaggaaaaatacaggtgctgagttcttatttgtattcagacccacacaccaacatatagtttgaactcaataagtatatatgtatccttttttaacttttgctgtttggcttagcctcgctgatgacaccctctgggataagatgagtgatcgcacatttccttctgtcgctgtaagtaactgcagccttggagcagggtgtgggagccatgacatttaggtgttacatcttagactgtgtgtaatcttcacctcatttctgctggttagactggaatagagtagtcttctagtcaaagacaagaggctttcattttcctctgcttagggatgttgctacattctctactagggtgtttcctggatatgttcctaagtaagactaactgttctataaaccccttaaaggaatcagaaagaaaagccagaagctgaaaagggccatttttatgcaagtgctttctgcaacgttacatttggggccatcagaaacatagttcttaggtggcctaacatgttctttgcacatctggcctctgggttccttaggctgttccaagcagagtttttgccagaatgaaaacgacatcttgcatgctaggatactttccagacaagtcagggctttccgtttatttcactgtaaaatcgtattcattgtctagggtgcccgcaggatttttatcaaggatttcctggcaaaggt

SEQ ID NO: 29646 - DNA, 878 bp, Bovine  19866880571626
caaatacaactacaaatggtaactcaaccacactgaagaaaattactagcaataactgtaatccctttcccccactttctacttgcctttaaaaaaatcagattcaaatcggtatagtttgctacatttctaatttaattttaaaatattttatgtattattttcttctaaagtgtttataatatacaaacctcaaaaactgaattatataaataacctcggccaaactttttcaaagcgccagatttacccagaaggaattctgagtttcaccagaagaggctgaacactattactataaaacacctccaaaagtggatgtcagcaacttcaggctaaacatctgtgttacatttccatagcagaatgtttaacatatacattataaaccatcataaatcaaaatcataaaagacaaaaatacaaacttacggctcctttgcagtaaagtcgtaacttcccggatggagtgcgaacgatcactgacattctttttctagcgctgaaagaaaggttttccacaatgtgtcatcatagtgagaagatgcatctatatgtttgtcctgtcacatattttaatgctcacactgaaaaaataaatttgaccaaattatgaggctgatccctccacatacacaaaccatcgcctgagtgtgtagctgagtgcctttgaaagtcacattatgtttttcaagatatgcgggtaccatctgctgccctaaaggaataatttaccaagtagcttccaagaaacctgcaagagttaatacccaccagggcagagagaggagagttctgatgagccagaaccttttatgatgaattattaaaacgagaaatgataatcaattttaagtatacacccaatcaaaaggcat

SEQ ID NO: 29647 - DNA, 922 bp, Bovine  19866880614760
ctgatgtgttcttataggttattaatgtaaatatatatccactaacatcattgttcctggttctgcatctggtccttaccttatcccacagtggtgatgggcatagaggtaatgactaatattttttgagtacttactttgtgccagacattgtaacaagtgtaataaatttaatctttgcaaccctaacagtaggtactatttttaagatgcagaacctgagacatagagaagttaagtcgtttacccatggtcactcacctggtagattaaaagccagggtttcagcccagatagtctgacttcagaaccctcatgcttaattcctattctctattttattccctgtcttatatgataagcaaattagttgctaatttaaagagttggtgacaatttcttggtcatctctaaaaatcccttatgtaaaattgagcacatccataataacctgcctcaaaatgtcatgtgtttctgaggaagtgtctctaatacccttggttggctgcccaggagctatacccaacagcccttcccaatagctctctcccttaccagcgccctcagtagagctggcaaagcaggaatttgctttcacagactctgagtagcaaggagtagctatgtgactcagttctagcctgggagaatgtgggaaaattttctgagagacttcctggcaacatttctttcctgatgacatgacgaaggcaagtcagggaacttctctttcatttctcctttccaatgccttgctcacgtgggacatggccacgtggaaatacgatgttcagagctgaggtagaccttttgcagtcattcaggggcgactaagagaatttcagagattttgacgtaacccctgatgctgtggagttacctcacttgggaccagccatctccagacttcttaggcaaaaca

SEQ ID NO: 29648 - DNA, 4329 bp, Bovine  19866880618970
ggactgtaacagaatgttttcatttccaaaagacagcccattacaacaaaaactgttaagtagcatcctgctcagtaaaaacaggtgacatttgaggtgtttgtttaaaatctgagctctgccatgcatattgtcagactaattagcccatgtggaaattatagcaggtatgtttggggaactactgagaggtggaagaggtttgcattgaaaagaatgagttgttgtagcatcatgagacaggccattggcataattctgttccagcttgttcacagtccccttcaccaggcatcactggtcatctccacgactcaccttctctagggttatgaagtaagtttactttgggctcaagaaagctgaaagctcagcaaaggacccagcgtcacttcttgcttcctctaaacctggctagagctgggtcaaaggaggtcagtgattaaaaataactaggctgctgtttcagtcaccagtctatacatgtgatatggtttattttcattgttctgtggttggattttaagaaccagttcagaagtaaagacagtaatgaattgtgactgacctttatactcagccagtattcaagccttaaattgtacagaaaccttttctatattgtgagctgtgatttttaactgcaccagaattctgtgttgttctctatatcctaaaatgggtctagcctcaagtttgaagaaactgtgcatccagcctttatttctgtgttccagttctgtatgcaagaacaaatgaaattgggggtaaaatatagaaagggtagaaacatcccagggtctaaaaagcctccaggtgatgctgatgatgcagatctggggaccacttgttgagtacccaggttctgtactacatccaaagatgtgtttctctacctacttagaattctaagtcagtgtaagacattaaggtaatttacacttgtattaatccagtccactgtaactttcagaataaatgccaaatacttatcagattgacaaaattcaaaggactgataacaatttgtgcttgtctaagtttattgtcagtgggactttatatattgctaatgatggtatagattgcagtaggaatgaatctggttgtatctgataaaagtacgaacataaataccctagagccagcggtgctcctttgggaatcttctcctataggatacaatcatgtaaatatatttcagtgttgtttgaggtggcagaaaaagcagaagtcagagtttccattgagaggaggatggttgaatacactatgatatagctgttgtgtgaaagagttgtttcacagctggtctgaaatagctctatgctgatctcaggcacacctggaattgtgatgctgaaacttggccaagagaaggacaagatggactaattggtgaattataaggtgctttgtagggtttgaaactccctggggcacccaaaacttgcttctctgctgggtttaaggatgtagacgagtggaagtttaactgagttgtaacttacctggtttaacctgtaacataatctgacttgtctaattgatgagggggtataaaagatcccctggaaacatcttcccaggcttccctgaagttaagatttatcctccatatcatggagtttaaatccatgtcctcggtgaatgaggaaaaaccctggagggctgtgcctagaagctttttgggctcctggtacttgcctgggcttttaagctaccactccttttccagctgtaccacatcctctagtttgattaaaacttttcttgaatgcaccctgtggagtcttgtgagtctgttcaaattatctatccatttgtaacagatgcaaagatacagggattatttttcaaaaaatagactgtctccatgctttgtcctgaaagtatatgttaagtggaaaaccaggttgcagagaaatacattttctgaaaagaaagaaaataaacatgcatgtgtctatgcttgtctagaggaaagtatgaggatgaatcagttagcattccttaccttgagaaagtggcatgagatgaggagagacattcagcttttcgttttatataactcctgttggcttggatagtaatacatcgattctgtagtttggtagaaaacattattggctgaatatgtatttaaaagtttcttaggcatgtcagtttttgtagtaagacatattttacagtgtgactccagtgatgaatagagaggaaacacttggatggagaggaggagagaagaggctagatggatgtactgttctggtggaggcaggcattccctatgagatggtagaactggctggtttatagggggagggtgctgcagaagggtcaggtaggggggtcgaggatgtagatgggctcgaatgtgcatggagaaaccatccaagcaaggttgaaggggatgagtattggggggggatggagaactgaagcagattcagatggttttccaggtttccatgaaagtggccatacttctaacctccctggtggagcagactccctggcatggtctactgagtttggttagcctgttgtgactcttccagcctgtaaggggaacccagtggagtggttcagagctatttttggatgtgaactgacaatacctcttccaagtggcaccatttcaaggagggttagttaagttccagagctggaaagggtggcgcaaagctgacatcagaggacgttcctgtcccaaacacacaggagcattagtgcatctactggttgcataaccatttccagctgctcgcgttggaatcatttaggaacttctgaagctgagaaggttattttaagcaaatgtttaaatagttcattggcatcattttatgtagctgttcgttattgaattataattcatatactgtaaaattcattattttcaagtgtacagttcagtgtttttaatatattcacagcattatgcatccatcaccactatctgattccagagtattttcatcacctcaaaaagaaaccccagacatataaacagtcagtccccattgcctcttccaagagcctctgacaaccactaatctcctttctatctatatggatttctctattctgggcttttacataaaggggaccatacaatatgtagccttttgtgtctggcttatcttcaggagtcatccagttgtcacgtgtatcagcactccattccttttatatgactgaataacattccgttgtgtggatatacccctcttgtttaaccattcattggtggatgggcatttgggttgtttccaccttctccttattgtgaacaatgatatggtgaacagttgtgcacaagttcttgtatgaatatgttttcagttcttggatgtacacttaggtgtgaaatttctgtatctcatgatagctctgtgcctaaccttttcaggagatgccaaagtgttttcctctgcagctgttttttaaacattgtgtgtatatttttaacaggaaatctactagggagcagggttgtatctttagtaaatctactactatggctttatgtgaccccaaacacataagaacatcaatgcatccactttccatccagtgagtactgactgagcacctttgtgctgctgcatggaaacactgggaatacagcagtgaatggaaagagaacgttcctgagtcccagatcttggagtctaggggaagaaattttttttttctcatacgagcataagcttacaaataagatgaacaatgaggcatatgaggacaataaaactgccaaacataatacagcattgttaacaaactgaaattaattttcttagaaagtattgctatgaaacaaacagaaaaaagtcctaccagaactaataagtgaatttaacaaaattaatggtgacagggtcattgtatgaaagtttaatgcatttctgtataccaccaatgactaattggaaaatgtagtaaaaaaaagacaacttacagtataaggaaacaagtcatcaaatatcaagaagtaaatctaataaaagacccatgcactgtaaaatacaaaaacatactggagaaaatttatgaagacataaattaatagaaaggtatagcttgtccaggcttgcaatgaattgaaacacttgagccccaaatcaaattcttaagagggtttagaggttttgttttgttttgtttttcagaattgacaattcagttttaaaatttacatggaaatgcaaagaactcaaaatagccaaacaatattggaaaagaacaatgtaggaagactacctaaattcagaacttactggtagagttacagtgatcaaggcctggtatatattggtatga

SEQ ID NO: 29649 - DNA, 1042 bp, Bovine  19866880705594
tgcagaaaaccttggaataattcaatcctagaagcaaatagtcattttacaaagtgcatcagcaccctaattagaggttcattttaagaatacatctcagcaaaccaattaaccatattttgctaatttcattcttatttttttcagcaatttgcttatcattgtaatttatttcagcgatttccttaataaccttcttagaatggcactctcagatataaatggcttcaaaaaatatgctgaatccgtgcatgtaaaaaatttacagtcaatttccttcttcacagtataaatgaaatggagtcatttgggcttgtgcccttccgccatctttacaggggtttaatgaggtggagtagaagggcaagtgggagagaagagaaagcacttgctttgacagaggcagaaagtggaggaggaggggttgtactgacaggcagctggttcatttgatccctcagacattttcaccacctccaaagatcagacgctgaagctgagttagacacttctgacagtaaatgagcaagaactgcaatatagaatacctctgggtgggagaagttcagctcacgctgactcattaattgcttcgttaaatattgccatggtatgaactgctttcacctaacatttcaaatctccttgagagaaatgtttctttgaaatgcgttctagccgtctctctttctacctgaagatacaattttttaatatttattaattttttgaaatatagttgatttgtaaagtgttaatttctgctgtgcaacaaagacatgtatatatgtatatatattctttttcattatggtttattataagacatttgaacatagttccctgtgctatacagtaggatcttgttgctcatccattctgtatataatagttggcatctgatatcctcaaccttccagtcatcctttccccagcctgtccctgttggcaaccataagtttgttctctgagagtctgtttctttttcatagatgggttcatttgtgtcatattttagattccacatgatacaggatatcat

SEQ ID NO: 29650 - DNA, 2417 bp, Bovine  19866880759800
catgtttgtgaaacctgctctaaaggccctaatgtctaatcccctctttacaaaccatgagtctgaggtcaaagaacatgcaaggggaggggcacagcttggggctgggctgctggcggtgtctgaaagtacacttctgggcgcctcatattctctagtggtgaatatgtgccaaagcaaatttgagaaaaatgtacctttttcagtatctcagattgacagggttctggattaagagatttatagtaagtaatctaaggaagagaattccaagtcctaggcaaagtaatgaaaggaagggtagagaaaatacatcactcaggaaaagacttgagggagggttgaaaaccttattgtttcttatttcatatctggattcactgcccatagtggaggggatttccatagccaaagctaattgtcttttaaaaattctttattttttttcacttctgcattcctttggccttttctccctctttccttaggatattttagttcccagtcctttctgatgcattcattttgccctgtttttccatacttctctgtattgcttttcttaaatctttcactctgcttcaaagaacataaaacaaagagaagtgaaagggacaaaggtgaaaaatatggtctggtgccaacctcatgatgctaccgattccaagctattaaattttttaaaaaatatatataatttttgttcatacataaaaatagaattgcatttcaattttgcaagtacccttcacccagttacaattatcaacacattggctattgtgtgttagctgctttattctgtcttcacattgacatttctcccctaactttaatttcccctttctttctccttccctcttctctttctctttccttcactctgttttctctctctctcttttcttctccatctccttctcctccttgcttctttctctcccctctaatctccctcttcccactctctctttctctggagtttattaaagcaaatcccagacatcatatcatttaactcatttcctataccatttcccggaggcagggagggccacaagagaatataagctgaggaaatgatctcttatgattattttcttcaccaaaatatggaatttgtgttaccgcgataagggaaaatatagaatttccccaaacctctacaggataccccagatggtgcagatttgattttccatctctaggtcttctgccttgagtctttgaggggggtctatgagaactttttaatcttcctttactattcacatagtaacaaaataacagcaatctttggatgtttataaaccccaaaggaaatgcatgttatcttcttgtttcaaagagcattctgagagcattgcttttgcagtagaaatttgtaaatgtgcaattggaagagagtttctactacaggaaccaacacatttcccccccagtgcaaaccccctgagctgactgttatgatggtttaaaggtgctttggatcaagacctagtaaagaaggcatggtatacagttgctttctgctcacacacatcagatctaaggagtatcaagtaatttggaggtgtggttattttctatgagtaaatgtccaactaaatttgaataaaatgctttctaaataagtcaaataggcaggagctttgaatgagggaatcaattatatatagccagtgtcgtaaggaaaataatcccaaggtggcacagagaatgtaattattgggaggtacgtgccaacaaatcattccctaaaatattaatgctatcaaagaacagctggataatgagagaaacttgacccttgggggactagcagaggttgctgcagaactgtgtgtagttgtgatgtcatgaaattcctctaaatttaacaaaaatattattaagaggtgtggttctgggaaagttattagcagtaaacatgtctttgtagttttgtcatcttatcacgatcattatatctcactggtgctgtgtggttccacactactttcttccttaattgctcaggatttatacaatccaaacaacactccttaaaaaaaaaaaaaccactttaagtctggcaaggacttttctttttgtaagtaaaaacacagtacctaagaaatttctgcaaaaacaatttcccatatgcttatttaagttctttaagtcaagaaagacgtctcattgtttgtttgtagataaaagccagaacttaattgggttttactaagtagcatattattgtcccacataatatctaacagagcaataaagttaaatatttacacagtcctacctaacatctgaaatgttgggcattatttttacattcttataactaaatgctaatccctatatttaaagtcagaaatcagaagtgaatctttccttgtaatatactgaacttatattttaaaaca

SEQ ID NO: 29651 - DNA, 1567 bp, Bovine  19866880772415
ctggagaaggaagggttgtttaaaaacaaaaggaaaaacaattttgggattaaagtcatctaggtcaaaatttaggatcccacatttgctaatcctgtgaacccatagtctccatctgtaattgagacaaacatcatcattcatgtaggaacggaggcaaaaagcaactatgtgccaataaaagagtcaaaatgaaaaaaggaacagaggcgagtgcatacagacacacctgggacacagcttcctgcaaactgtcagtttaataactcatcaaaagacatgggtggcagaggcgcaaagaagtcccaaggcacagcagtctgttcccctcaaaactgcccacaagctgtgaggaaatggcaagagggtagactggttagaaaggatttatcggtaattctaggtctcagagagctcttgaaagagctcagatgtttagccaaaaaaaaaaaaaaaaaagagagagagagagagggataaagaccattcaagcttgtggcaggaagaatttctcaaaacagaaatactatggatttgtgaacaacttcactttgggttctgcacacaagccaagattactgaattttgtttaagaaaaggggacacatttagtttttctgagaccaaacaatggactcgatggaactttttcaaccacaaactctgctttgtggcagacactatcttaaatcagaggaaaagggaacagattatttgttcatatgttattttcatttttgtaatgtttactttttttttttttaagtaacccatttctctcaaatgtaacaaagttcgctttcttcactgagcgctacttgaagcaagctgtgtgccagacagtatttgaacaatcatcctgcaatgggacattacaaaaacatatctttgcttctgatagggacacattaacaccttaaacgttaaactgagctcttaaacattttcaggccaaaaagctgaaacaactttgctaatggtaacagagaattcacaatcctaaagatccaaagctggcagtggaagaaaattcactgtggtttaaaacctgcctgaactatttttcaaagcaatacaaaatgtattgtattagactcatgggacatatcaagacaaaacctgaagtagcctcaattctcctttttccccttctttttctggagccaattcaataacttgcttattctggatttctttcagaagccattcaacagtgattggtttcccaaacagtaaggtttgtctgcataatacatgtaagatgagcttaaaagggtacagatgacaacttcgccatttatgtcatgaatgcttgtaagttatatttgaagcttacatggtgttataaaaccaaatttagctagaaaaaaatgtgcaatcctataaagggctttcttttaccatggtgttgaaaaatacatattcttgtgcttgttaatatcaaatgtggttaacaattcattttctgcaaaatatacaggtgagagaaaacactggtatccataatcaaatgtaagctggcttaagttcatatttgcaattaagcagagaaatttaagtagtgagg

SEQ ID NO: 29652 - DNA, 1451 bp, Bovine  19866880778662
tcttttaagggattcctgctcacagtagtagatataatggtcatctgagttaaattcaccctttccagtccattttagttcgctgattcctagaatgtagatgttcactcttgccatctcctgtttgaccacttccaatttgccttgattcatggacctaacattccaggttcctatgcaatattgctctttacagcattggaccttgcttctatcacagtcacatccacaacggggtggtgttttcactttggctccgtcccttcatcctttctggagttatttctccactggtctccagtagcatattgggcacctacccaccttgggggggcggttcatctttcattgtcccatctttttgccttttcatactattcatggggttcttaaggcaggaacactgaagtggtttgccattcccttctccagtggaccacagtttgtcagaactctccaccatgacctgaccatcttgggtgtctctatatggcatggcttagtttcattgaattagacaaggctgtggtccatgtgatcagcttggctagttctctgtgaccaacctagacagcatattaaaaagcagagacattactttgctgacgaaggtctgtctagtaaaagctgtggtttttccagtagtcatctatggatgtgagagttggactataaaaaaagctgagagccaaagaattgatgcttttgaactgtcgtgttggagaagactcttgagagtcccttggaacagtgaggagatccatccagtccatcctaaagggaatcagtcctgaatattcattggaaggactgatgctgaagctgaaactccaatactttggacatctgatgggaagaactgacatttgaaaagatcctgatgctaggaaagattgaaggcaggaggagaaggggttgacagaggatgagatggttggatggcatcaccaactcaatggacatgagtttgagttaactctgggggtaggtgatggacagggatgcctggcgtgctgtgattcatggggtcgcaaagagtcggacatgactgagcaactgaacttaactgaacaaaagcagaggagtagtaaaaagtcaatttcacagagacaggaaagtatggttccagttctcagagtccaggctgagtgtgagggtagagaggtttagttctgaggtagataagaagactgactagatgggtttgaatattcagaaaggcatcccagagaaacctcttcagctttgaaggcaaactctatgtctccaggattaaggatagaacagaatgcaaagataacataggaatgggcatcaaacccactctttgagagtcagtaatgttagactctgatgctgggagggattgggggcaggaggagaaggggatgacagaggatgagatggctggatggcatcactgactcgatggacgtgagtctgggtgaatt

SEQ ID NO: 29653 - DNA, 1897 bp, Bovine  19866880795772
actgtccttggggtcctgagagtagacacgacttagtgaccaaccaccaccaccacatataaaatgggtgataccacacgtgtgacatattctcagggactacgcctatggacgggcatgcagctagggatacatgcagatgacaggcaatttcaggtgcatttgctggaactctctatgccctttccccatgtctccagaaaacaccctgaaatgtctgtgaataagaatggcatagtgatgaaaatagcacatctactctaattaatttttaacacacaaaactccgttcttcgttattactaacacattactccagcatacatctgttttgacacatcagaattctgtgaaacccagttgctaaggtccattttgaccgaccctgggaacttacggctgaccactgtcacactgggagatgttcacaaactcttccgcacatgacgttaattatgaacggcagactctgacccatgtgtcatcagaatattctcatgcatagtcatgacacagaatgaagctgtactgtccctaacatgttttaaagctcagggtcctggcaggaaagagatggcaaactcaaaaggggatgtagaagagggtttgatgaaggcactgtttaaaaggcttgggtgggtttaagataagccaacaaggatggaaacgaaattgggcttatgccaacaggaagttgatagtacctacttcttgaaggagtgagcacagaatcagctactggaacccaaagaggttgtcagaagaggctgtcagaagaggctgcctgggagatgcaactgccaacaagccctgcccagtggcagtgaaccaggggagtaagtagagcatccctggtggctcagatggtaaagcatctgcctgcaatgtgggagacctgggttcaatccctgggttgggaagatctcctggagaaggaaatggtgtacaccagtgtttttcttcttccccttcctctgactccactggccaaacccagatggaattcggagggtgtggaccatagatgcagtccttaaatgtagtcctctcagacagagcaggctgagagatgcaaagagtatctggggagacaaatggaaaacatccagcacagaagccaactagcttttttcttcttgattctgcattgtgatttggagcctatttttcagaggtactagacacaattagagtcgttttctttccggcctgaaggagaaagccctttttatccgcaaaactaaaaagaactagactcacaggtgttcaactaaaccctggcaatacacgacctcatccccaacctaaatgaaaagaaatctcagttgtgtttcccaggccactgttactaacttttgtcatgaaaattcgaaatgtattattttctttatctctgttttcaggtcatctgctgagcagaatggaaaagataagcctttacagaatttactctaaagagaaggaaaaccctgaaaaagaatggaaatattacaaagggatgtttttcaccctctcttttaattcttgtcgtatgtactcaataggattttgatggctgacagaactaaaagtcccagtattccctttgatgatggatctccagctccagctggaatccttctcaagaggtcaaactggccctccttgctgggcaggtggatgctccactgtcggcttaagctagctcatcctgaagttttgaaaggacatcaagtatttacactttttagtactacatttttatttattgttaaaataataataatatattgtgagttgtgttattagtcactcattcgtgtccgactctttgcgaccctacagactgtagcccaccaggctcctctgttcatgggattctccaggcaagaatactggagtgggttggcatgccctt

SEQ ID NO: 29654 - DNA, 1193 bp, Bovine  19866880838733
taagaattctgacttacattcttatgtgccgaggaatgccctccaaatcacttaacctctccggtgccttgatttctccatttatacggctgcgagagttaacactacctacctcaaaggaatgctatgaagattaagtaggtttttaattaagtaggttgtagattcaagtgctccaaatagcacctggcacacagtcagtacaacctaaaactgtttgctattctgaattcgggaagcaagatttcttgctgtttatgaagcaccaatcatggtgtatccatggctttttggctgaatagccttggtttctttatcagtaaagcaagaatatttatagttgtggtacaaatgatggatgtatctcagtgaacaacgacaggccaggtataagcactggattgttcacttgtacattctttatcattggttatggagtaacacagctgtatacttattacattattttgtattatacatattgtgctgtatacttattacattattttgtattatacatattgtgcttagttgctcagtctttgcaacctcatggactgtagcccgccagctcctctgtccatggggattctccaggcaggaatactggagtcggttgccatgccttccttcaggggatcttcctgacacagggatcgaacctgggagtcctgcattgcaggtggattctttaccgtctgagccggcagggaagcccactgcatctacacacacttatatgcagcttttatgcatgtttatgtgtgggcagagggcgtgtgatgaagacacaatggaagatgttgccaaggagcttgctagactggatcaacctcaatttgatccaaaactgtgaaaagagctacattctataccaagtaagtccagagaatttttggaaaaaactgagttgtcagtgcttagaccagaggagattcaacagtggtgtgtcaagacattttgatttttattttattggccccttgaaacaaggctggagttttctggaaatcaaactttcctcacaagcagaagagttgtaccttttcgattaactcgtagctctcttcgagtttgagcagcctgttctgcacagatgtggaggcacggtgatagacggctcgccactcctgaaagtcgctctctgaaatctcagccacggcaaaacacaaggttcttaaccctaaaaaagg

SEQ ID NO: 29655 - DNA, 1011 bp, Bovine  19866880890169
tgacttcctttatttctctgcatcgaatgacccactccagcccaccccctattgtcaagcttttcagaaatgcccaggtcctccggttggatatttagaaactggggtctcaggggcttccccgccccctattctcacgtcggaaaacacgggtcaagtttccgcttacttcagagcggaataaatcacaaccccagcagaggaactttacaccttaaaaaacaaaaaaaaaacaactttccaccagaatcggaacttcagggagaccatttagagctccaggcgatggttttacggccgagaaaccggaggagcgggggcaggggacggggcgagccaagagagagccttgacaccccagaactccagagcgggggtctgaagccggccaaagacggtccccaggcaaggcaggagaggctggagagatgattaacggtgctggagctccagtcccgagactgacaacccagaggaaaggaggtcccaccttagaactccattagaccttcaaggaattaactttggagtgcaaaataccagtctagaggattgaggaagtggcttctgggggaaggatgttcagtggaaagtagggaactctagggcggcctggcctgtttggaaagtacaaactggcgtcacagtcactcgccctctctgcagagcaagtgctaagtgccgggtctacctcggggaccccatcctggcctcccgcagtgctctgtggcaggaaagggggcagtctatgcacccacccagactggggtctggcaaagcctcaggaccttcccttgccagcttgtcattttgggcaagttacttaactgctttgggccgcttaactctaaagtgggcatgttgctctcagaggagttaggttgtgaaataaatgagtgtatggatgctcagcaaggtgctgagtgagtagtcactttaaacttgccttctgcagggcaagaagtagtaagaagtactagtaaccttctactacttctagcagtagaagta

SEQ ID NO: 29656 - DNA, 1969 bp, Bovine  19866880969996
cttcaggaagatgaatttcagtcacatcttgagccagctctgcccaaaagagaggccatgatattccagtagcatctgatgaccacttatcaaaacgtcatatatggagactcaaacttcaccagtatgactggcctgaggaaactgtaaaacctctttctgacctttagattcaatgattctgaaccagccagttcaggaaggcttccagcctctccttccttgacatttcttaaattctctgattggaaagacaagcagtcatcaaggaataaaaatccatctgtatgccatgactggcagaaagatgttgaaataagattgatacaatgcacacagaagcctctctacatctacagtctttacccttgagaaagacgtggggggagacagacactgatcatggctcaggattctagactttaccaatctaccctctaactattagatactggaaaagtcaacttccttttaattaaattttctaatcaatacaaatagtggagatgaggtggagaggtttaattgatttctaagggttttcctagctgtaaatttttatctaagattgttgatatacgtcttttggtttaattgttcctcatatgtctaatgactatggaagggcctctatatcacacggtagttgtgccattcatttcaacgtttactaaataaacatacattgtatgtcaggccttgtgctggacacaaaggtatcaagttataataacaaggacagactacaaaaaaggcaagttaaaggacagtgtacccaatgataccctggaggacctataggcatttaaataactctcaagttatatgaggaaatgatatggaagaacaaaactgagatggcaaccatcaaggaaatgaaacaaattctccctcccaatcctccttccagagcatcacagcaaccactatgtatgcctcaaacaaaaagcatgctggacaggccatagcttcttcattacccagggcttccccagaggagcaggaaataaaacactggacgatgagcgacacataggcatgggtggcaccaacaggagaggtcccatctcgtgcacctgagacaaaactgagaagaatccctgaaagcttactgatggagttctaggacaccaggaggctgagtgaagatgtacacatgttcgccaagaccttgttagtgtacttgagaaagagaatacagtgacagtggctgtggatgagttttgcagactgggtcatccaagaattccatgtgcaaattcaatccaccctgtgttaatgggacatggtattttctgctcatttatcaacttaatttaatcatatggttttgccatagcagtatttgttctttatgccagataatcccaaaaatgctggcaaagagagatctttccacctggcagtgttctttgagacaaattacttgtacgtgaacaattaaatggaaagaggaagggtttcataaaatgagaaagatcgagttcctgcagtcatggaattcaaacactaactgggtgtgcagatatggattcaactgttaatgtgaaaatattgtgaagattaaacaggataacaaatgtcaagtgtgagataaacacgaaatcacaacacatatcacatataaggtgtagaggtagtagtagtaatagtagcagtaggggtattatcacagagaagttcctatttagactaatttccctaaaatgaaggtgcataacctttttctcctgatcatttgagcagcattgttttagaaacaatgtctgtttctaaaaatcattattctaggcaaggctatgtttgtcattcagctgtgctgtgtccttttaaccaagatgtctaacaccacttcagtccgttatgtaatccccagttttcccccattttgattgtctctgttgtttactgctctgctttcacagaggacttgtcgaaaggtccggatgctttcaacgggccttaccag

SEQ ID NO: 29657 - DNA, 1002 bp, Bovine  19866880973542
gattctaaatcacaaaatctattgctcagaacccctactcttggatagacaaaacttcaattagaatattattttggggtatgccccttgagaattatataagaattgtgagggcttatttggtgattggaaaatgaagagatggactttgcttactatttcccaaagcagtgagaacaaaagagaaaccaatgtctttatgaattttcctgcaacacacatacaagcatcccattttaaacctgggtgtttgttttaatttttaaagctcatatttgttctgctatccgtacattacttctcgtgcttctggtaacagatgtctgactttgcaaataattactcatggaatatctgaccactttggctgccaacatcatcacttgattgaaaattaaaattttatctcactaagaagttctttgagtgatccttttgcaaaatcagcgtcatctgatcccatttctttgacctgaagtgtaagacatggcatgtgagaacggttggaaactaaaggactcaacgaatgcaaaatcttattctcatagctttatgataagttgagtgccacttggacagcttagtagaaaatgcttctcaagatgtccttggtcatcttttagattagagatctctagtgatgatcgtggcatatttctgataggaataagaaacccgaggaaggaataaacagagagtgctagtccattttctggagtgtgtgtttggtgctggctgagcctgggcagacttcgatctatcttgaacagatgcctctaagaagaagttagctgagctttaggggcagctaatgtctcccaggctgcagaatgttattaaggcttgattgcaatctcctgacatgataaaactgaattgaagaacaggaagtgcctgcttggcagctctgtggacagttggaaagctcagagaaggcacaagcattaaagaagaaagagctgacagaagctgggcaggcagacagggctattaattcagagg

SEQ ID NO: 29658 - DNA, 2668 bp, Bovine  19866881016194
gaatggccaagaaacagagacaataaaacctttgtaatctgcagcccattgataaaaaattttgagcatgtatccaccagtgtacacatccattgattatttacctgcatgtactactatactaatatattatgttcaaagtaaagcatacataatacatttaaaatttttaaggctgatccataaacagaagttatgtttttttcctcattcgatgtctttgcatcacaaaatttggcagcttatgtagaaagaaggaaatgttgactaaagttacccacttgtttattagaagtgccaaacaaaaagtctgctttgctcctgtcctttcatttaaagcatttcctggatagtgctgaggtttggctcagaatatcttggagttagattgagtgcagtttgtccttctgggagacaagcaagaggtgaagtaaatccattcttggttgttgcagttgagctctggagttagatgcaaagtcttggcattgtccctgccaggcagactgattacaggagagagactggcggaacccagaacaatgcagtagaaccagagccctattggtttctcctggtcagagagatatgggtgcagctaacagactgaaattttacagctttcacagttgtgtgaattatgatccattaactgtgggttttaataccaaaagggtatgtcacatctcactccccactgctgtttcattaggagagaacacggtgtcctggggtcagccaactgcaggttcttgaattagccattcagcactgtgggtaggggtttcatggtgcaaggatgggtgactcgcacgcagagtactgctgcccaactcctcatcctgaatctgtggcaagctgtctgtccttggtaaacttactcagccaatgtgggattcactccacctgctttttcctgaatctgcacaggtgcaatgtctgtgtcaggagtaaatcatggctggcctgccactaatcatccttttcgactgcccagaaaaacaaaaatgctgcaatttcttgagtcctcttgatggccagacattgaatgactcttgctgaaaataggctaatgatccccactgttagtgtaaacacctaccactgctgctatagagagtcacctccaggaacttgaatgattagccattctacatagagaaccttgattgctttaattagtccatgtgttgttcagtcactcagttctgtctgactctttgtgaccccataaacttcagtaccccaggcttccctgtccttcaccatgttccggagcttgctcaaactcatgtccgttgagtcagtgatgacatccaaccatctcatcatctctcgtccccttcttctgccttcagtctttcaagcttcagagtcttttctaatgggtcaactcttccccatcaggtggcattcagtttcagcatcagtccttccaatgaatattcaggtttgatttcttttaggtttgactggtttaatctccttgcagtccaagggattcttcaagagtcttctccaacaccatagttcaaaagcatcaattcttcggcgctcagctttctttatggtccagctctcacatccgtacatgactactggaaaaaccatagctttgactagacagacctttgttggcaaactaaagtctctgctttttcatatactgtctaggttagtcatagcttttcttccgaggaacaatcgtcttttaattttgtggctgcagtcaccatcttgcagtgattttgaagcccaagaaaataaagttcgtcactgttttctattgtttccccatctatttgctgtgaagtgatgggactgtatgcgatgatctttgttttttgaatgttgaattttaagccagcctttccactctcctctttgactttcatcaaaaggctctttagtttctctttgctttctgccattagggtggtgtcttctgtatatctgagattgttgctattactccagcaatcgtgattccagcttgtgcttcatccagcccagtattttgcatgatgtactctgcatataagttaaataagcagggtaacgatatacagccttgatgtactcctttccccattttgaaccagtccgttgttacaggtctggttctaactgttgcttcttgagctccatacaggttactcaggaggcaggtcaggtggtctggtattcccatctctttcagaattttccacagtttgttgtgatccacatagtcaaaggctttagcgtagtcagtgaagcagaaatagatgtttttctggaattctctgcaatttgatctctggttcctctgccttttcaaaatctatcttgaacatctggaagttctcagttcacgtcatggtgaagtcaggcttggagaatttcgaacattactttgctggcatgtgagatgagcacagttgtatggtagtttgaacattctttggcattgcctttgggttttgaatgaaaactgaccttttccagtcctgtggtcactgctgagttttccatatttgctggcatattgagtgcagcacttttaacagcatcatgttttcgacttgaaataactcagcaggaattccatcacctacactaactttgttcgtaatgatgcgacgtaaggcccacttgacttcacactccagggtgtcggctctaggtg

SEQ ID NO: 29659 - DNA, 1596 bp, Bovine  19866881116282
cgtgtgagattgtgcagtagtttgagcattctttggcattgcctttctttgggatttgaatgaaaatggcccttttccagtcctgtggccactgctgagttttccaaatttgctggcatattgagtgcagcactttcacagcatcatctttcaggatttgaaatagctcaactggaattccatcacctccactagctttgttcgtagtgatgctttctaaggcccacttgacttcacattccaggatgtctggctctaagtgagtgatcacaccatcatgattatctgggtcctgaagatcttttttgtacagttcttctgtgtattcttgccacctcttcttaatatcttctgcttctgttaggtccataccatttctgaaatcatatagaccttaattaacagtagagacaggggtctgttgatttcaagcacgaaacagaactgagagaaactttggcttctggggtcattgtcaagaaaatcataggaaactggatgcacaaaaatcattttaaaataggaaatcagacatcttcacctccatcaaatactctgtattttttctttttctatttttttccctatggaaacaaagaaagcagctacagagaattcctgcagagaaaacatatatattcttctaagccaagtgtttggaaaccagaggacagttaggctctgttaacaatgtattaattcacaacaggacaggcttcataaataataaacgaatgtcaaggggtgcctctaccatgaactagaactgagatgaatatctgagcgcagtgtaaagctctttagtgaaaatgaacttggggttcgactttaaatgagtaagtttacttacttggttaaaggtagtaattaaccgaagagtgattatggggtctaaaggatccatttatttgatagagagtaaaaagtcagtttcactaagctttgcgaaaagaagcattaagaatatttgcaagcaagctgataccaaactgtcacgtgagcagctaatttcagatagatagccaggagactctgagaaaagactctgttgaaataacagtaagaaattctacaacctaataaataccatagggagaaaggagttagaaatagtgatattttaaagttaaagtataatgaaattattagtaagttaatagtaatagagaaggaaagaaaacagtaactccttaaaagagattggccaaaatatcccagaagagcaatataacatgcccatttgttttttggtttcttatcgttataaatgatggaccatcaaagcaacagcaaacccattaatcaagactgtaaacaattaaaatctctttccagatccgggaaagcatccgaatgatcatgacagtgccaaaaaaaggaacataaatttgagtcagctctttggatctgggaagtgtttaggctaccccgccaaaaagtcagagagcaagaagtctaaactaagctgataacaactgatcattaattagaactgaagccaactatctcagtatagagaaatgtcttggctactcagctaagagccagaaagccaaaggtccatcttgggttcacgatgattaatcgcaggcaaaa

SEQ ID NO: 29660 - DNA, 1552 bp, Bovine  19866881127026
ccttggagctgtgggtcctgagctggtagagtccggaagctagcctgttagtgcctgtttatagagaaggaaaattctctgagcaggcttagtcatattttcaaagctgctgttttatggacctcaagtctactctcatagttagtgctgcaattctagttcagcagtcgtgtttccttttgccatcaatttctctgtctcctctgatgtcgctctgcatgctgcacatggcctgggccagcctcagttttctctagctcagctttgggaactgaagtcactcatttcttgattcaatagagacaaaagtaggagactacagtctgtcaagcaatagaagacaagacaaattttgctgccaaaagccacaaaatcagtgctgggtcactaggccctgagctgcacgcaaccttaccttagtatctgcattgttggcccctgcacacggctggatttctacctgtctctgtttcattgcatcagttctgctggattggcccttagttctgaacccttaacgtgttctgatgggtctctgacaacctgcccagttctaacctagctttcttcgctgcctccctctttactggctcctgctttaccatacatggctgaaaacggtcttgtacttactaggtctcacgatggtgtttgttccagagaatgatgattcacgagcttggcccagtccctttacccaccttaacactgcactgaaagtgacccctacctggactctgctgttgccctgccccaactttcccaacacacaccactgaacgtgtctgcttagttgctcagtcatatctgactctgtgactccatggactgtagcccatccagcttctctgtccatggaattttccaagcaagaatactggggtgggtagctattttcttctccaggggatcttcccgacccagggatcatacccacgtcttctgtggctcttgcatctcctgcactgtcaggcagattctttaccaccatgctacctgggaagcccatcaaatacaggcactcatctgaatggaaggtgagtttgccacacttttctggatactgattactcctcttggtctgttttctctcacccgaatgcagtcctttctgagtttcttctcttctcactcccatccctatcctctcctcagtgggtcccttgttcgagcctgcttgtattagaagactgttctttaatcttaaccttttccctggcttctgtcaggcttcacttccattcttgttgttccaaataaaggcacataaaaaagtttggcatcgaaatatgagaggggagaaagataaatgatgaggtaaattagtaaaaccagaggctgtggagcccaacaggtgtggaatagaagggaaaataatggggaagcaggtgatctgcattcatcaagagaaactcataggaaagaatattcaaaacaatgcttatagcttcaagttgctgtatatttaacgatgtacacagcatagcaataaagacagtgaacttaaaactcaacctgagagtgtgaatatgatctttcagccattattgag

SEQ ID NO: 29661 - DNA, 1137 bp, Bovine  19866881142526
tcttatggtcaagatgcttttctttgaatctttcaagattctattctttgggatagaatactagttaagaatgtttcctatggaggattgggattctgattggagactgcagagcagattccatactcttagcttctgatgaggggagaaaacttcttaaacaagtttcttgaagaagcagattattttgaaatgcctgaaaccctgacttctcaggaacatgtcaaggcaacaagtatttattatgctccatatgttaaacatggctatcccagtgataggtcaccatcaaatgaaagacattctccactgtcaaagaaaaagacacatgtatgccgtcagagacatgtaaacaatggcaaagttagcattttctccatgatggaggtagaccgatttctagtgctaagaggtggtcagcaaaaacaaaacttaataaatgctggctgttccatgggacacatttggagaagtaaactggagattatgcagtaagtgacaaagtcagcatcatagacagaaagcactagaggaagaaagaaagcagtggttgaggccaggagaggtccaggagggctttttgcatagtgtgacttaagctagactttgaaagatgggcagaatggtgggagggggaggaagaggaaggaggcttttagatagaatattgtcagataggcacagtcttaagcaagtctcagaaatgaaattcatctccagatgaagagagaagagctttgtgagagcagaggttcatgctgaaggagtctgagatgcgggctggacatgcaatgaaggataagtagactgtatgacagaggggcatgaatgctaggcggaagcatctggcaggattaagaacctttccaaatgtgacctattacagaatgttcttccatgaactttcccctgtggtttatatcattccattcaagtctctcagagggcagcttgtttacaccaatgtataaaatcagatttttgtgcttcatacattgggcaagccttgtatcaatcactattaagaatcagccactcttttgtttttcttttttaaattatgaaaatattatgcaattacaggagacttcaaaaatacagaacacagttacatatagttccactatatattacaat

SEQ ID NO: 29662 - DNA, 875 bp, Bovine  19866881197492
atatgtttaaactaaactgacaactgcagaaaaaatgtaagattctttgaaaggctgccttatgtgaactgacgaggatctcagaaaccacatgccatttaacacacagcaataactccactgcaacgttcccaccctcttctggaggggatattaaaagaggttgaccagatgcttccctgaattaggcagttccaagcaggagacagattcttcctagcatagaagtggccaacagaggtagggttcatccaaagtctgacagggcgagaagtcacctggctcagtggctttcacattggaaggagctgatccaggaagggtgcatgtgtgcatgggcttcacacctttctatgccagagaagctccaatcttaactgctgcagacatctaggctccctggaagacttcactgctatatggcaacctctccattttacaagttacaaaaccagagagaggttccatcaggtatccaaagtgccagagaggtaaagttggaacaaatatttcatgaatcctcaactatacaagctgtaagaccttagggcataaaatattggtcactgagatgagaaattattacctggtacagttagtttgcagaatacctcttgcttttagctgtgtacacacatctccatgagtcttggagcaagcttttcccctctacctgtccaaggagttccagggagcctgtgaaatctctaacatggcaaattcaattttacatgtttgcgcaaaattggtacagacctttcctttgttcttcaaaagtatctgtgatcacactgaatggaaaaaaaaaatcaatgtacttcaagaagggaacagaagggaagccccacaagaggagtagtttataaccaggaaaa

SEQ ID NO: 29663 - DNA, 976 bp, Bovine  19866881521680
tgatattgtcttgggggaaaatatcctcttctacacttgcttgattttctttccctcaacagatttgtcaaagcatctggccagaaatctaaaaatagcctctcagtggttagctgtccctcttctcccttcctcagtgttaccatgggaatagcgtaatgaaggatggaggcgtctgagaaagcgctaagaagccactggcgtctgcagcctgcctgttctgagagagtcaatctaggtgaaggcaagctattgcctcctttccattgatcaaaaaaagatgaatcttcagggtgccccaaagccatacaacaacccacagcaaagatagatgtgttgtcaagggagggaacttgctgtgaatgatactgaagggtttctacatagccaacatatatcttcaagctgcaccttatctggcaatcaccactgtcagacagtaagttttgtagtcatctaggcatctaggaacagttctagaaccccacatccactgtaactcccaccgcctcaggccaagaattagtccccactgctccccaatagagggtcagcttggtgtagactcacctccgcaggcttgggcagatgtggtgggttatttccacttgaccatttgcctgtccaggtggccctggtttgacaagatctcctgaaattgaggtccctagacaattccaggaattccattcttaaacaaaactaaaaaatataataaagactgacattttaaaatgctgatggcagtgtgtgtgtgcatgcgtgctcagttctgtccaactctgtgaccccatgaactgtaaccctccaggctccactatccacggggattcttcaggcaagaacactggaggggttgccatgccctccttcaggagaacttcctgactcagagatctaacccacgtctcctgctatggcagacataatgctaataactttgcatttacttaatcttcccaataattacatgatg

SEQ ID NO: 29664 - DNA, 1375 bp, Bovine  19866881554358
taagatatcacatatttcatgattgagtcataggatattttcaacattataaactgtgaaagcctttttcagtgttaataaaaaatagcattttactgttcattttcctggagtaaaattatgttgtagccatatgaaatttaaaaaaaatttaattaaaaaaatgtaaccaaactgctaatatacatggaactgaattttttactttcataatttttccaaggtttaaaaattttgagaattaatggagttattataaaaataatactgttttactttagccataaaaatttatttgcagtgagtaatactatatgattaccatatgaaacaaaaatatgaataaactgattacacatttcattaacatttatcactaacaaatatcttacatatttatgtacatattacagttactctgtaaaggagaaaaaagccataaaagtatatatgtggttttgtgttgtggctgtcttcagatcagcaaacttgaactccatatgaaacaaatcaaatgagaattgcctctataatctagctcttactaatttcatagccatgcaatttaatatcaaaatgttgagattcaaaggaaggacaaggaacatttaagtggaaatgtcaaaccccaagagtatacttattacagttcagtgaaaatatatagatctaaagcttttgtgcacagaaggaaatttcagaagtcgttgaggaaaaaataatgtgttcaatattaaacagctgtaatctagaaagcttttaatcataatttttacaggttacaaagagaattatcagtgccaatgtgccaaatatcaagtttcatattttaaagccagctatttgaaaggaaggagaaatcattgaagaaaaaaaaaaagaatgtaaaataatttaacctaaaccagatcatcaatatatgtaaatatctttttaaccatacaccataaaaagaagttagaattttactgtaaaacacatctttattaatgtgtaacactttgatctattaattctcaatattataatgcacctttattagcacatagattagaattctcaaaaacatcagtaggaaacagaatgaacacattttattattattttaataataataatttatttataaaataaaaaattaatatctattaattaaaactcctcctcttcttagttttaaagatgaaaagaacttttaaacaacttgtcaattggcaggcggaaaaaattaacatacatttctcctctaaatattatcattctcaaaaagtttattattcagggctctataaaatctccctattatttataaaatgtattcattattggttcttagttatattttcgcacttatttgttagataaattgaaatgt

SEQ ID NO: 29665 - DNA, 4842 bp, Bovine  19866880545441
tcgctcagttgtgtccgactctttgtgaccccatgaatcacagcacaccaggcctccctgtccatcaccaactcctggagttcactcaagctcacgtccatcgagtcggtgatgctatccagccatctcatcctctgtcgtccccttctcctcctgcccccaatccctcccagcatcagagtcttttccaatgagtcagctcttcgtatgaggtggccaaagtactggagtttcagcttcagcatcattccttccaaagaacacccaggactgatctcctttagaatggagtagtgcagtggagtacccaaaattagccatacttgggtttaagggcataatcccattagctgcaatgtggacatgatagaagattaaagagctattttagaacacaaattaaacaaatatgaaataaatataagaataaagtggaagaaatgtaaaattatgatttataactgaagaagtcaaagtacctctccagaactgaaatgattcagcagacaaaatctttaaaagtagagactgtgaagactttaatgatgtgatcaataagcttgacttaataaacacctaaaatatagccatctaatacagaattttatttaattctaatctcatctaatctagaattttatttaatgtgtatctgtataaaaatgtcctaaatttttttaaaatcttgaattttaagggtggattttctgattgtgaactaatcgaattataactaaaatttttaccaactttgaaagacaccaatagataacataggcttccatggtggctcagcattaaagaatccacctaccaatacaggagactcaggtttgagggattcctgggtcaggaagatcctctggaggaggaaatggcaacctactccagtattctttcctgaaaaaatcccatggacagagaagcctggtgggctacagtccatgggactgcaaaagactgggatatgacatagcgattaaaaaacaacaacaatagataacttagattaacaaggaaaacacagaagtgaaattaaaattatctacaaagcaaataacagaatgtcttttatcaaaacatatgatacagaaagagcaattcatgttgaaaaatgtatagccttaagtgcctacatttttaggaaatgatgaaaaataaaggaatttggtatttatcctaaggaattagacattcacagtaaacaaaaataagtttgaagatgaaacttagagggaaatttttcgtataataaaaagaatacagatttttcaagaaatctaaaagctggtattatgagaaaaataacttctttgattaatttaaaaaatttactatgagcttggaaacttagaagaaatcctatattaacatggatcaaacgtggttgattgtttccatggcagaatgttttgaattctatttaaaatttcccaggtttttatcatggtaactaatttttaaaaaattaatagtagacaaaaaacatttgaaagctgaatccaacctgtatgtcaccagtttgcaacttgtacggtataaaatttattaagattgcagtcccaatttttagcataaatgtcaagcatgttaggtaaaatatcacaacattgtcataaaaataattagcctctcttgtagcctaacatctttattctaagaatacttctattaattacttggagctctcagtattccatttttaacttcaaggagaatggcattgcactgacttcaagagtgagagaaataaagtaaaatttcttcttaaaaaagctgatagtttaataatgatgaaagggataaacaaggacaagtttacttagtgattattagttctaaccccccaaattatacttttcaatcattttgtgggattggcaatttatgtctaccctgtccatgtcatgagatgttcaatactttgattcagctactttttccctctttgaccaaagtcatcacagaaacccaaaaatcaatattttgatttatttcagtcaggtaggatggaattagggttacttgacatggatttaaagccaatgccactcttctttctcatcaattccagatgaaatttagcattgccagggattaacaccatagcatattatttaggatgtggattagtcacacaaatcttcttgaatcagttctataaagatgacaaatggctaaaggtgccaagaggaagaaaaggacaatgtacaatctgtgaacaaaaacacaagccatttggctttgtgtgtaactgggtccaagcactttgccagaggagaggaagagctgggaaggtaaataatgagtccagagatccaagccccatctgttcagacaggctgaagctcactgggatgacagtgtttatgctgggcattgatagatgtcatctcaattggctcttgacatgagagatagttgaggatgtctgcattagaaattgatcccaagatcctgaacatgagccaaaagcagtgtttaggaaaatattgtagtaaaagacaactagtgttctcttcccactgtctaatccctctcaaaaaagaaatgtgaaaagaaatgaagaaaaagggaaagaaaaaaaaaaagaaaaaaaatataggatgctacccaaggctataaaatgtcaaaatagcatttgcctatgtacaattactaattattttcatattttttacctatgcattcctttctgtcacacttaccttagttttattgttcttaaacattaatttgttttctcttacattataaaaaggaatttatactcaatattgacaatttctgatgatgaattaatttattaaattaataatttattgttttgttttgaatagcatacaacataatagtccatccttattttaatttatatttctttaattacttgtgagatcaagtagtgtttaatatacttccatatgttagctaatcaaccatttactctttgatgatatttgttggtccaggtttttttttctacatatcttaggacatcaggcactggtcagacctatccaatttctgccaactgtaaatggtatagcctttgacagttttcttaattccttttatttcaatcagttttccagttaaatgggaataatattggtatggtaaaatgtacctctttattcactggagaaggaaatggcaacccactccagtactcttgcctggagaatcccatggacaaggagcctggtgggctacggtccatggggtcacaaagaatcggacacgactgagcaactaacacacatacacacacctctttattcataatgttatatgtatttttaaccaaacaggaacttgagtcttctgtctcctttattttccgttgttgctgttgttcggtcacctagttgtgttcatagtcaatccataactagcctttttggtttaaccccgtaatgtgcttttgtcctatttcagtgagtctaaaaccccatcaattgtaacatgcaccattactttaagtacccacatcaaagaaaaagtgctgtcaatgaatgcatcaacacattgtttgacttagatctggagcaccaggtttttttacacattattgccatcacaaaatttcactatatatcatttctaaaagaatatctctattgtctttttgattttgcaaatttccatgcacttacacaggcaatggcaattggataattaatatggcacagagactataagaagcatcctaatttcagagatgttaaagtgttttcaagtgtgccttagaatttcaaaagatagtatttctcattacctccattgccatcacaatagtcttaactgtcatcatttcttatacaattgcaatagttatagaagcagtctatctgtattcatcctgcctgccttcttctatccaatcctatcctatctctacctagtagccagtgtgaaaatctgataatgtcactagtgctaggttttcttcctctggttcccttcaatggctttccgttgtgtttagaataaagacaaagcttctctatcaaccacatcttgcacggtcaggcccccatctcttctccagcctcatctgcttttcttctcatccttctctgcttttcttcactctgcattctagaggtcagctcatctctgctccctgcctcatctttgtttttccctctgaccaaatgctattcttccctgtaactaagtcatccttgtccttcagatctcaactcaaattatttcctcagagaagcaatctttgacctcttcagtcaggttaaattaccgattaagttcatctatatagcacttgacgcagttgcagtgttataattatttttgtgattatttataatcactataagtcatataaggacagagccatgattacttttttccctcactctattgccaccaaccaacgcaaggtctaataaagaatagatggtcaccatgtatttattgaatacctgaaaaaaggaagactccttattaggactgaagatgataacacagattatgatagtgcatattgactgcttcatagcaagcatgttataaattttacctcttattattgtagtcattggcacattcctcatagagcatctctggcttcccatttactttagaagagttaacacgctttatatatcatcactaatttcaatgtgttcgcagtgcagtggacccaagtgatctcttaattgtaaaagaattgtacctgccctgcaacatttgttttcttgacatcaattatacttaaaactactgagctggaagcatatcaagttaatactatctattaaaaggcccaaatttgcatcgctagaagaatgaggaaacaaagagccaaattcactt

SEQ ID NO: 29666 - DNA, 1553 bp, Bovine  19866880578610
caaagggagtaagagggagagacaaaaatcttaacagtttaataaggaaaccttaatggtttaataaatattccaaaaccaaacattctgaaaccagatctgtaatcaacataaaatgtctttgttttgatggtggtgggactgactgttctctccacagaaatgatgatggttaattagagctagaatacagatcttaatttaatcagagatattaaatgtgcttgttcctatcaaacattggctttaatttttgtataacaataataatgaccaattttagaactgtactgaagttgaaatagttatcattattatcaatatttatagaagactaaaattttggatttccaagggcagtgaagaattaagtaactaatattcatatgggcacaccactttcctaagtatcataacaaaatcttatcttgcaagactcagatattatttactctagaaagccttctcagaattcttagccttatgtctaggttagacattcttcctctgtacactgatggcctgatttatcactccattataatacttttgtgaatttatttatctgcctctgtatggtaagctctctggtagtagaaacatatagtacttgatcatgatatgttccagttattgattgctgcacaacaaatgactccaagaatttgtggcttgaagcaatagtcatttattttgttcacaaatctgccattcggacaggacgtagcatggatggtttgtctttgttcccacagtagcaatgaggtagctgaactaggactagaaaatctgtttcgagatagcttcattgaatggctggtatgttagttacctagtattgtgtaacaatttaactcaaatatatcagcttagaaatgcaacaagcaattgtgtgttgttgtttttttcccacataatttctgtggatcaggagtttgagaattaactgaatggttctgctcactgtagaaccacaggttgatgacactgctatcaaaacactgactagggttgaagtcatatgaagccttgactgaggctgtggaagctgcttccaagatggttcacacaagcagatgatttagtactggctattggcagagttccaaagaatagcaaggagagataagaaagccttcctcagtgatcaatgtgaagaaatagaggaaaacaacagaatgggaaagactaaagatctcttcaagaaaattagagaaaccaagggaacatttcatgcaaagatgggctcgataaaggacagaaatggtatggacctaacagaagcagaagatattaagaagaggtgtcaagaatacacagaagaactgtacaaaaaagatcttcatgaccaagataatgatgatgggagattatgattattataacctagagccagatatcctggactgtgaagtcaagtgggccttagaaagcatcactacgaacaaagctagtgggaggtgatggaattccagttgagctatttcaaatcctgaaagatggatgctggggaaagtgctgcactcaattatgccagcacatttggaaaactt

SEQ ID NO: 29667 - DNA, 1385 bp, Bovine  19866880619737
attaaacattcaggttaaattaaccaactccttatacctctttgtcatccttaaataaacataaaatataatactactataacactactgatatctaactatacatatttatttacacaaaaaattttctctactaaatcgtactgacccagggatcgaaccatagtctccagcactgcaggcagacgctttaaggtctgagccacaaggaagcccactaccatgaaggctgtttcacttatccccagtgcctggcacacaagcagatatttcgtacatattttctaagaaattgaatacataattatcttatcatttgcttaaaatattttaatagatgccctttgtctacaaaataaaccctgaactcatttcagtgggatatcagtttcttcctcataagtttcttgcttagtttagactctttgctatctatatatttattcatgatcacattccactaaggaatgtggctcagacagtaaagaattcacctgcagtacaggaggagcaagtttgatccctggattgggaagattctctgaagaagggaatggcaacccaccccggtattctttcctggagaatgccatgaccagaggagcctagtgggctacagtccatggagttgcaaagagtcagacatgactgagcgactaagcatgcattctactaaaatataagaagttcttctatataaggctgttagagtttcaggcttcaaggccatgggtcacccaggtccatagctgaactatttcagggcctggtcaatcatgccatccttgcactaagggctcctgcaaagagctcgtgggaactctttgttacctatggatctaaagatagtgggtgtgttgaaatgtaggccaacctttaaagcaaaatctaaaatgtccccagcctattttatatatatacctggccttgccaactctgtctctctccagctgaagttctcaaatgctttcctccccaccattcttacatactcctagatgttcaggtctttttttgtggaatcttaggttgcagatagcacccacttttaccactttgtcttcactaccatcccttgactgcctgctaggaagcagtatatataggctacttcatcccccatgaaatgtgtaagcgataagaaataagaagctgtgctttgctttcaagagaaaaggctgggagtgagctttctgcaaattccttacacttagtgagttaacttgacattccttgttttacgtgggctgaagctggcacgcagcaatgccagcatttcctctgctgctagcatgtaattaaatgctttgtgaagtatttggggacattcggttatgtgaaaaacatcacagaaatgaaggttgcctttgccttgtcttttaatc

SEQ ID NO: 29668 - DNA, 1619 bp, Bovine  19866880672800
ttgtttttttttttaattttgaataatttttgttttattgaggcaaagtgaacatagccatgcaactaacattcagttgggaataaaatattgagtgataaagataaaaatgaaaaaaaattgtaatgacttttctacacaattaaatgtatccagtgaaaagtgtgtcttatcttgaggttatttcttttcttttcttttttttttttttccatgtttctactgaggaatgatatttgtagatcttagactttcttagttgatgttttattgtctttaactagacatgataaaattattaaggcaacattggcttccctggatacctcttgaaatgcatgtctttcatcagctattaaacctacagtgtagctaacttcctataagagatgatggaaaagatattcattcattggatagatgaagcatagaacatcttaaaaagtatgctttttttttcaacctggaaatcaaaccaattaaataaaattttatttcaggagctaaaggatactttttttccctgtacttctttggctcatttgaaaaaaaatgtttttatctatctgtttgtttctctgaaagtgagtaattctaaagaatacatttgttttttattttcatttttatttaatgaatgtgttttcttatcttcacaaattttagcatacttctcagtagctcaagggatgctagaatctttaatggtaagtaaattatgatttcacatttttttaaaaagcaacaattacaagcaaattcatttttgtcttaaataaactatgcttctaaatttaattaagcaagcatagtgatttttatgatccaaacatctattttatgcttttaaattactttagagttggaaaacattttaaatagtattgtatactgtaatgaaaatttttttcctgaaaatattattaataacagtaaactgattttccatgattccatcttgtccagaaattttgcaatatgagaaaggatcattgcaaattgattgctactcccagaaaaacaactcaaaatcacattactgatgacatgttggctacattatctttgctttcagaaagataggagttaagagaatgatggttgagcagaactgtttttccaatcaagactcaggcagacatgctttatctagcagccttgagtaatgtcctcattttttaaaactctgttattatgtgtctgctaacgtccaggaatacagttatgtctcctttgtcattttgctacagataaaaagaaaaatttaccaatataagtctagataacagatttataacttatgaatctattatttcgcatgatggcaaaatagatcagaatgagacatccaggaaagaaggatattggacatatggtaagtggtttaaacagataagccgcaattttgtaccacgtgcaactacagcctttgcagtgttattcgaagagtgactaaaatacctgaaaaaaggaaagaaatagtgacatttaacttacgaaattatggtttcagtgtgtctgccctctgatgccctcttgcaacacctacatcttacttgggtttcttttaccttggacatggagtatctcttcatggctgcttcagcaaagggcagctg

SEQ ID NO: 29669 - DNA, 716 bp, Bovine  19866880687034
ctaaacagaaacctccttaagtgataggctgagcctcaagggcactcatcagaccctggattttgacatccatagaaaagatggagccagggagtatagatgtgttgttgttgctgttgacagaaaaataccctgcagtatcagaaaagagaaatggaaataatgaacaaatcaacccagagaacaggtgctgacatgtggcttcctatcagatagaacacttccttcactatgtgacaagaaaattgaggccagaacgcccagccatattacacaaaaacagaatctcaaaaaaggaacagcgggaggcataaaatgatagatgaaaggactctaggaggtggcctgatccagctatttgaagactgctgtggttgaaggctgtgtggtgctttactcctggtctctgttggcctctggggatttcacctcagctggcttttgcattgactgaaggttggaatgcagagttcttttgagtggaccaaaaaggatctttcagttttcagtgtggatttgaagagccctggatttttaaccatggaaaaagggaaaaactagggccaggaaatctattttagtatatcataatactgtattttatgacttatgtattctttccagaaagaatattagccagagattctaaaagtttgatccagggtttcttggaagtgcctgagaccctttaagtaaggatttaagtgcaattaaaa

SEQ ID NO: 29670 - DNA, 2230 bp, Bovine  19866880826423
ttctaatgtgatatcttttaaataagtcctattccttgtcctaacaacttgtctcttgattaatagtccatcaagcagtacaaacttggactggataagagacaggacattggagtcataggaaagcccaggactctcacccgcaaccataaatgctggtcacttccaggatgtctgtgatgacaacactttggaagtgctgactaaggaggcttcccattgaggaaaatgctgagcagtgaatgcagcatgcacgggagacaaggattgtacgaccagtaaaccttgaaatgttccttgttgtctgcaatcctttggacggcactggagatgaacaccaagtctgcagtggggcccttggtgaggacatccttccagggtaccgctcagtctagaaagtacattgtgcagccctttcctataaacctcctaaggcaactccccacccccatcagcagccaccccacgcaggtcgtataaatcatttctcttcccctaaggcctcaagccaactggcataatgacatatcgaacttttcttcccttgtgcccctggcagattatatattcactagcttttaagaggcgagtccaagctattgagtactcttcaaatttggggccaattcccttgcaaggtttcatccttattagaatttgaatggctgttggcactgtgtcgcacaccgtttgcctaaatgagaaaatccttgagcagttatcctgctttaatgcaggtaacatgcagcaaacccataccaaagcctccattaggtaaagaaagaaattaggtctccaaagagtgatgctcctttttaatgtcaagaggacgtctgggacctccctgaggatccagtggtgaagactctgtgcttccaaagcagggttcagattcaatccatggttggggaactaggatcccacatgctgtgcgagacagctgaaagactgagaataataatactattaataaaattaattaatggatttccctggtggcacagtgaataagaatcctaccaatacaggggacctggagttttgatccttggtccaggaagattctatatgcctcagagcaactaagcctgtgagccacagctactgagcccacatgctgcgactcctgaagcccctatgccctggagcccatgctctgcaacacgaggagccaccacaatgagaagcccgagtaccacaactaaagagtggcccctcctcactgcaactagagaaaggcccatgcagcaaaaagacccagcactgccaaataaatacatgagtacataaaatttatttaaaaaaaaaacagcagaaataagaattatgagagtaattatagcacagatcttaatcatttcctcatcttttggatgtgatttaaattaggcatttgttctcccacctttgtcaggttcaatcaatcctgcctgtaagtttaagtagtatctctcttatgcaaattggaggtgacaccataggagataaaattagaagagtttttacggagactttaatggaagctattgatctgctcattacttggcctttggtttttagacatcattagcaggaaaaaacttaacagaaaagcctcattagtataggaaaggcgcaatggcatgagaaatgcatgaaggtaaaaatcaggtatcagaattctttagacatgtatgaagtattccaggtggtctggaaaagtagaggaaatgcctctctaaaaggagctctcatttcacttcctgcaaaatgttattgtaaattcagatttagacatacatttgaaaaggacctcatcttttcctgttcttccccttcaaacctcagaaatttcaaaatgaatatgtaaaatgtatgaaacagtcagaggtagagtccagatttccctgatgctctactcaagtacagggaggcctggcgtgctgcaattcatggggtcacaaagaatcggacacgactgagcaactgaactgaactcaactgaatactgttactttcagttaacatagtttatgccctgaagtcatttatttctttctgagttacctggtaaggatgagtacacactctatttttttttttttccttcccttaagctagtatttcatcgtttactgggaagggttctattttcaagaagattcacaaatcttcatataaatgtcattctcaacatttaatgtcattgtactcaaggtagatcaacttttagagaaattgtaagtcttca

SEQ ID NO: 29671 - DNA, 1239 bp, Bovine  19866880944095
ttcttgcctttcttgaaaacgttacatacaacctcttggtatctccttttctcatatgtaaaattaggagcctgagatttaaaaattcctcaagctccttctgctttataatttgactttattattttatagtgttatcaatataaagatgtatgcaggcaaaaccacactgaccttcaaaaagatgatctttcaaatgacttaaatgttcttgtgttcattttgaagtctagagattgcttagaaactttgatctattttttctcttgtttctttaaagaaaacaagcctctatggggcttcttttctctccacatctctctctacagtttcctgttttttcctgaggtgaaaaaaaaaaaaaaaatcagcacactgtacctatttttcaagcagaaagtttgcagtcatggaaacatccctttaaatcactgttttgccttccacaatgagcagaatgtccaacaattcagcatccatagcacagtcttgtttaaaatcggtcactgacataaaattatacccagcaaataccatgggagcagctgagggtcaggtcctcatttgagacaacgtaaccattttgacctggagaggcctctatccacctgcatccattcaactctctcagaagcctctagtgctgctgtgaaacaagcagtctaagagatgtaagccaccttatttgaaacaccaatttcatgagcaataaaatttcacattttcccatccttaccagttgcaattgcttgagactgatgcttggttttcatgggctgcattttgaaatatgaagaacaaaagcctcccaggccttgctggaggtgccagctgtggctgtactataaggacttgtataatgctgtcttatttcataaaagaaagtgggagatttgaatttgtattgggcattttcccattccagctgcagagttgtttttttttttttttttcctaattcaaagttattttacttatgctgattcttctatccttatttggccattggagtaatttattgaatgtcatctttctagaaagatatcagtctctagaattaacagtcaagagaagtgggcctgtaaatccatcaagcaaaaatatcaagactcctgattatatcaagtttaccctgtaaaaggaagagatgggcccagaatatctactgatattcttaacgcctttcaagatgtcaggtggttatttctctccctggttctgtctcctcccaacaaaggg

SEQ ID NO: 29672 - DNA, 998 bp, Bovine  19866881055943
caaatacctttcaccttagaggataggtctcaacatgtgaattagggggtgggacacaacccaataagaccataataatattccagtctagaaaggagtataaaatgtcctaacataaaagggaatttgagatgacaccaaagagcactatttctaggtatagaaacacagcatactagagagctagaaaagcactctcacaggtttcaaaggaataaaattcaagggtaagcacatttgaaatacctcctgattttggatatcagttccttgttccgaatacccagtagagtccatacatattctatctttctaaaatgttctctgtgtaatatttgtgaatgtgtaaagtcctatttacaatgtaaagaactgtttaaaattttggagttgttattttcataatcataactttggctaggagtagagtgatatggtgaaggcaatggcaccccactccagtattcttgcctggaaaatcccatggatggaggagcctggtaggctgcagtccatggggtcgctaggagtcggacatgactgagtgacttccttttcacttttcactttcatgcattggagaaagaaatggcaacccactccagtgttcttgcctggagaatcccagggacaggggagcctggtgggctgccgtctatgggatcgcacagagtcagacaagactgaagcaacttagcagcagcagcagcagagtgatatggtaatagagttggacaacattgagagagaaattgattccagaagtcctctgaaaaggattaatcatggtagtgaacagtgtcattattccacacctccagagaccttccttgcatttcacagagatgaaccccaggaaaccaaaccgaaaagggaactcagatctcctctcctgctactaaggaatttggcatcaataaatgtggcttattagaatgaacaaatcaactgaaagttgttctgattctaatttgttactcgacacatcaagttagact

SEQ ID NO: 29673 - DNA, 1200 bp, Bovine  19866881076498
ttttaaaattttttctatgctacaaaacctcattaacactaggaatttaagtactaggcggacttaaagatagtattaatgactaacacttgttatgagttatattcaaattaatagtctatatcaatatacatattttcctctctgaatttttaaaaaggcatttgaaggaaccaagcaatctaaggagtttgcacgaacgacttctcttcttgcaagacgtagcaagatgtagtgatttctctaagcacagaggaattaaacttattaaagtgaaggaggaatctttgccaataaatgcttcaccaggattcataaactggcttgggaaggaaggaatagaacatcagaatctagctacgtgccattagtctttctgcccttgaaaaaacatgagtcatacactcacataactcacatgaactcttgagttgcaacaaattctgaaatcttggaagtgtcgataggtgagtagtaggagaaagcgaggattgagggactaaaagaggctgacgggctgtgtcccccacaggctgcagtccagctgatagtgtttaaggaatagaaaaaaacacaggtttggggggagatcttaaccaagacccacaatggatcagatctggccctcagagaaaaaagttagcaatttcaagtcacataccaaaaagtcaggtgtagggaagaacatacacagggttggtagacagcctggagacccaaccagcagagataataagcaccgtcacaaatatgagctggctaaggctaaacactgatgaattaatatgtgcccgtgatccactctacatgcatcaggactcagttgtgtccgactcttgtacaccacatggactgcagcacaccagcttccctgtgcatcaccaaatcccagagcttgctcaaactcatgtccattgagtcggtgatgccatccaagcatctcatcctctgtcatcaacttctcctcctgccttctatctttcccagcatcagggtcttttcaaatgagttgggtcttcacatcagttggccaaagtattgcaatttcagcttcagcatcagtccttccaatgaatattcaggactgatttactttaggatgggactggttggatctccctgcagtccaagggactctcaagagtcttctccaacaccacagttcaaaagcatcaattcttaagtgctcagctttacaat

SEQ ID NO: 29674 - DNA, 1117 bp, Bovine  19866881361055
attacattttatgctggctcatggcataaaccttcagaaccaccagctgagttgtcattgtagtacaactgatttcttgattgatgtacagtgtctgagatggctttgttctcctggcttcccactggttatcagattatagataagaagaaaagaaaagagtgtaacaatcagagcaacactggggtctctaatgatattagaggttaccttctctttaagagagcatttgttattttaaaatgattggatcatccaaatatatcatgctgggcaagtcaactcaactacagactggggctttggaaagctttcttcctgatcccagagttcatctcatttttggctgcaggatatctgtgccctgagaaattagatgtctggaacgatctttaatctcagtggaaagcttttttgttgttgaaatgctgcccaattgtgaggaaaaacacagttttccttatagtgcagagaaagaaacaaaaaaaaaatttttttttaaaggaacatacttaatgctggcctattactttgcaaaaaagagataatattttcctctggctctgagcaaacttcagctattttgtttttctttcttccaaagtggaagaaaattgacatattgagacattctttggaaatcatgtaggacatttagagttggtttggagtctactggcctatcaaaagatccagaaataaactttgatgaagcaaccaattttgctgttttgaaaacttctctgaatccattattatgtaaaacaaataaccgtggcttttctttcaagtatgctttctaatatccactgtgcttcagtacaaattggaattgcaacttcctaagtgcgtatactgtttttctaacacaaatggaaattctatctcctccttaccctctcctattctccatggtacaatggctatgggagtgtgactgggtaaaacacttggtgtttaaaatatccttatgaatcccagctgtgggcttttaatcctaatggagaatgtggtcgtatttgtctcatgcaccagctacttggtgaaggaagctggcgtacagtcgtgacctctaagaagaaaacctcagtccaggttcgatgcacgatactggatg

SEQ ID NO: 29675 - DNA, 1040 bp, Bovine  19866881547654
aggaatcaggctgtgatgcagcccaagcagcttcagctgaccccacaggaagctctagactatacttgtgggcagagttgtcctgtattgggccaaagtaaccaagcctttatatctctgcctcaatagtcattgcatgtgcctgctttgggaagggcatgatcttgggcgaaatgactctctgcatctgaggccgtccttgaaggaactggcagctggcaagtatctgcctgcaacgctgtctatagcttagcaacaaggaccctgaagaggaatgtgggtggaccagcccatgtccaccaaaccatgcccctgccatcctaatacaaaatgatagcccttggtttcctatgtgttaagcaatgttatctaaagtttatgtgtattcccttttccctccccatctcagatacctttgaaagaccaactagacttaagaatcaatagcacatatatcttcatgccaggtagagcatcctactcatccatccttctttctttccccaagaaaggaatttattgaaatagtttatattttttttctaaaaaactttcttcagaatgacagaactatattaggtactccagtgaactggttgaacctgaacactatatttatatgtgcacatatacagtcatatcaaacatacatagagaaatgcacacatatgcacctaagctgttgtaataaacctttttcatacaactagtctaatataaaccctttgaaataatagactcctttatttaaagatgataaacgattattattattaacagtgcttaactatcttgccagatatctcatatagttaataagggcagaaccagaattgtagctcaggatctcaatactgtatagctttcttaagattataaagcccttcagagagctctgattagcaattaaagtaatttttaactgagaaagatgtttaggtgttggtgatagataaggacattatccaggtaatggcattcaccatttctaatcagaacattaccaatggtctctctgtagattgcagttgagaatcctg

SEQ ID NO: 29676 - DNA, 1331 bp, Bovine  19866881601009
tatgaaaaataagtaaggaaaataaaatgactgcttattgcttgtttcacaaaaagttaaatgtcttaggacaaaatctgaatggatatgaaaaagttgtagacgtgtgtggagaaagaatcttgggaaagacattttatgtgtggtcaagctgattaagattagaatggatttatgtacatttttcaagaatgagttttaatgtcaacagtgcactgatgcaagattagaatttggttttctgttaaaaggacaaagctttcttagattattggtctgcttttaatacagaattataaccaaaggtttttctttacctgttaattaatctgcctgaacagcaaagatgtgtcataccaaaataatttactgtttttcatttatctttattgtgttaagtcacttcagttgtgtccaactctttgcaaccctatggactatagcccaccaagttcctctttccatgggattcttcaggcaggaatattggaattgatcgtgatgcactcctccagggatcttcccaaatcagggagcaagcatatccccatcttttacatctcctgcattggcaggtgggttctttaccactaccgccacctgagattgtctttattaggtttttgattacttaagaaaatctcatcttctcaatacttaaagcactagattttgttcacaactatgtaaccttcctatttgtctttaacatcttctgctatcactttggtgaaatagataactattatttcttaatgatgtgatatgttcaaaacatttgacatagtctcaagatcaaattctaaactaagtcttttttatctcaaatgaactttgagatttcctggagggtccctgggaaatctcaaaaggatctctctctcactttgtaaaagagagatattaaactattaataattaggtttatttggtatgttacattacatgggaagcattgtcaaataaaccttcttaggttatgtttgtatggatgcatgttagtaatatattttaggaactgtacaaaatgtaaaaaaatctaacatgtccaggtatgatgggatcagtcaaaattccagttagtatcctaaaatgttttatgtcacagaaataatgaaatttccttatcaattacattgtaatgaactctcaagaaatctttaatcatgggcgtgtttaaaagtcttttgtcagttacagacagttattgcttcactaaaaagcctcttgatgaaaattaaagaggagagtgaaaaagttggcttaaagctcaacattcataaaatgaagatcatggcatctggtcccatcccttcatgggaaatagatgg

SEQ ID NO: 29677 - DNA, 1359 bp, Bovine  19866881723330
cataagtttattgtgagaaataaataatacagagcccaatggcacaaggtaaggcactgttattgctagtgtgagatgatagaacaataatgagggggaggcactatgagttatcagaacatagacttgtggaatcttaaggcagaagaggaccttatcaatcctattttccaagggttttatttttttttttttttttttggtgaactgggaatcagtggcccaaagaggttaacctaggtaagatggtagaaataagaattacacactggtctacaatcggagataagatactttttgacaggtttgttcttttatttttctctcacataacaagaagaaatgtttgtgattgttatagtcatatcacctgagtgacttttacagtaacttcaatccagggagttacctgaagacccatcacttaaatgtggcttttttaagaagtgggaacttttgtatcatcaggataaaaggaagcacagtgcttaaagaacagactctatccctgactctataagtctatttgtatgctttcaaaaggaaattctcttgggcagataagaagttggcagactgaaaggtaatacataaatttccatgctcaacagtcaggacttgagcaggcttgtctgtgatgcggcccataccatccagagctttcccctagcctctcagttcctgtatattactcatggctctgagcaacagatcagggcagtgcttattgttcagggtacaaattcatcatctgaggaggccgttctgaatggaaatctgcccccttctatcctccactctctctcctcctcaagatgcctcacagaatctgaggaggttgggaagcagcagaggcaggagcagttagcactgcattctgtgaccctctgaggcttcttactggacaagggatgctgtgttccctgttctgagtatctgcatcttataaataaatcctttcaaaaagtatgccggtaacttcctaggtgagtctctcttgaaaacctggagcaaggtggagacatgaaaaatccttattttgagacagcagctcagaaatgcaatagagatcagctgtttagttcctgagcatgtcctcacatgatctctgatggagaaatgtttgtttaatctcttttaggttattgggccaggctgttttcagggggaaggtcaaaaaaagaaaatagttttataataaagtaaaaactcatcacatataatttattagaatttattttttaattaaaagtcttcaatgttttatatatgtctgttggatgaaatggcagaaggctgttctattaactatgattcagatatcgggggggatgactttagcctgctgggcctcaagtt

SEQ ID NO: 29678 - DNA, 3896 bp, Bovine  19866880183042
tatggatgtgagagttggactgtgaagaaagctgaatgcagaagaattgacgcttttgaactgtggtgctggagaagactcttgagagtcccttggactgcaaggagatccaaccagtccattctgaaggagatcagccctgggatttctttggaagggatgatgctaaagctgaaactccagtactttggccacctcatgcgaagagttgactcattggaaaagactctgatgctgggagggattgggggcaggaggagaaggggacgccagaggatgagatggctggatggcatcactgactcgatggacgtgagtctgagtgaactccgggagttggtgatggacagggaggcctggcatgctgcgattcatggggttgcgaagagtcggacacgactgagcaactgaactgaactgaactgactctactctgtttgcctttacaatgttcacctgtatccaccacattcatcagggaacaaatgcatcatccttcttctgtcttttgctgtcagtccgtttgaatattggttgtcttctcagccatgaagtttatcacggctttgtccttagttttgtaagaagagtgaatcaacattatttatcttccctgaaggctgttaaccaccttctagtaacattaatctgccatatcaccccaaagatgtaagtcagatatactgtctaaactgagacttcttgtgtatcgaaggagattatccactctcttactaaaatagctacatttatggtcctgaacacttccaagaagagtgagcatggaagaaggtatatgtgggggacgtttaggtggagaggaaggcatgttagaaagcaacatggaggagatcagtgtaaccagtcatttaccatttctgtgtagaagatttctgatgattttcttttggctttctacttcaacttttattttcacaactacaagtctctaaaccattctgtattcaattttgtcttgaagacacatgagttaggcttctaaaaatgtcactgaataattatattcttctggtgcgaaaagtttgtggttttagaataagcctcctgcttcttcaacaggctttaccatacttcaactgttctccctctgatgtaatcagggctgtagagactggtacaaaactttatctagccagtaaaacttttagggtctttcacttattaatagttcatttcatgaaatattcaaaccatatagtgtcttatataattccagcacagtcaatgctgtgctttgtttttatttatctttaatcaacaagttcactatttcgttttttagatttatttgtttttggctgcactggatctttattactgtgcaagggctttctctacttgttgttcagggcttctcgttgcaatggcttctcttgttgtgcagcctgggctcgggcacgtgagcttcaatagttgctgcacacaagcagagttccctcttggcatgtgggatcttcctgggccaggatcgaacccgtgttccacgcattggcaggcagattcctaaccactgaccaccagggaagccctacatgtgatttattcttaaagtgcccacacttatatatagatggatacatcctgtaatacctacctcccttaaaaaaaaattcctgaaactttaatgaatagacagcgtagtcctttggggttatttcagcccttttaagggaaaatcagcatttgcttgtgttcttaatttcagaggcataagaataatatcttctcctccagcacctcaggaggtagcataaaagagtggtagggagtgccatactttcacttgcattcatctggtcccagctgagttagtagatttcccacgaaagccatttttccattcctgaatcatatctgagccaaaggccctataaggcaaagattccctgcttcatgatgaaatgccagcacatgaccattctttataatgagtcacagtcaataaaaattgttctccaaatgaatctgagtatgcctcctcaccgagcaacatgaaagaaacatctttatcaaatcaaaacatctcgtttcctccactgagctcagacagacctttcacttctgtaagcaaaggaaatgagtttccacacaaagtgaaaatccaatctgtccttatttttgactcagctacacttgctatgtagtttgaggaaatgagaatgacgtgttggaaaatgtttggggggtttggtgagtgaggaggagctaccgaggaattctttgtacaataataatgaaatgattattcattagtctagaggtattttgaactcctgagagcctccatataaatattaggtgataggattcatttgtatgcatgattgaatgtgatcttgacctgaaaccacactggccttgctattaggataagtgggaatttattaactgtgcatttctcttctgttgctgctaaggagacttttagtgagcctagtgaggccacaagagatccccaagatgtccacacatcagccatggacaggctcacccttcaggcttgggaaaatggaagtaaagaaagcattgtaatgattgtctagaacttaacaatcattatgtgaaaagcataaagaaaaatttaaggaggaaatgcaagcaagtcaggctcatttaggggacaacagagagggtgtgaatttcaaggctggcttctgtaaaaggaaagaatgtgccccacggaggattcagcaaacccaggtcagagtgagatgcatttaattaactaccatcaaggctcaggggatcagtgacaacacagatcagtaagaactcacctggaccttgaacttgaccttttctcaagtattcccagtaaagttacccagtaaagaaaagaggtgggccagggaattaagttcttatccaaacatcaagaggttgtttgcttaaatttcccaagtgtctttggtaatgctgtgtgcttatctttctaaggaagaaaaaaaaaaaaaatgatacccagaggagggtaaccagaatggcagagaaagcctcccaaatgagaaatggctgaaaaatccaagagggcttggcaataagaagagaagcatgaataaggacaagagggtggccaggaaagagaggaggaagagggagcgtgtgttctctgtaacactccagaagacagagctgcccggcgtttccaaggggctctctgggggaaatggtgatcattcgaagggttgggatttactctaaggctatggtgatgggatatggggaggtggataaagatctaggggttggggagggagaagaccttgttaaggaaaattgactcttttttaaaaaattatttttagttggaggaaattgctttacagtgttgtgttggttcctgccatacaagaacgtaaatcggccataagtgtacatgtatctcctccctcttgagccctcctccgcttcaccccgcccctctagtcatcacagagcaccgagctgagccccctgtgctatacagctgcttctcactagctgtgtgttttgcacatgatagtgcacgtatgtcaatgctacagtctcagtgtgtcccattctctcctgctctccgcctccacggccctccccttccatctcttagtcaacagaccaatgttcattatcttctgaacatgttgagttgtgatcagaacctttcattgactgcccattacctaccaaatcatgttcaagcttttttgcttggtactcaaagcccacagtaatgtgactttaaaatccttctccacctgcatcactatattcatcatctccccataccctttatctttttgtatgtcatgcattttccaggcttcatctcccttccccactgaactcactgcctgtttttcacaaagctcccctcattcaatcctttctcatgccag

SEQ ID NO: 29679 - DNA, 1797 bp, Bovine  19866880220682
cacacgtggagcccagaggagcccggagagaatgccaaatgtgtttccctccgttttaggtggagccttgtcgggatcagtatccccagcttctaggatactgttgaaaataagtaattactgaacgcttgctttgtgccgatcacggtccgggtgtccctgtgaatggaatacagtaaaatccttttaataaagttgttattgaggcaaaggaccaatacccatctcagaatattgcatatatagttgagggtttctcaggtaggtattggagaaaacaacagcaccgcactccagtattcttgcctggaaaatcccgtggatggaggagcctggtaggctgcagaccatggggtcgctaagagtcggacacgactgagcgaattcactttcacttttcatcttcatgcattggagaaggaaatggcaacccactccagtattcttgcctggagaatcccagggacaggggagcctggtgggctgccgtctatggggttgcatagagtcggacatgactgaagtgacttagcagcagcagcagcagcagcagcaggtaggtatatttccgaggaaactacctaacttgaatctgtatgaacggattcaacctgtatctacagggcctccttgatctctgggcttcagcttgagatctgtagagaatgatgagtttagaatagagtttagaagcccctccacccatatgagatcaatttaatatgcatgcagcagcagcagtcatagatatcatttccttggtgaccagctctgagctaaccactttagggatgaggatcccagttttccaggtttattgaattttggaaattaatataggattaccagctttttaaagtgccaattaaaaatataaacaagtcctaccatcttctgttaccaccttttatttttgaaagaaatactctattcttgcttggagaatcccatgggtttgcaaagagttggacactactgagttcacatgcacacactctttaacagcaacaacaaaatacaggaagggcctaatctcagtagaggctagtccttcatattgcatatatttagctttataaaaatttattatgttgaccatagcatatgggaatttctgctataagagatttaaaagcagcttctaactttactagcaatgtaagacaaaaactctggtccattacaataatgtagttggagtcttcggtgctatagagagcttcctcagactcagtcttcctgtctgaagggtgatcattagtcctcttccttctctttcagtggataaatctaattaaggaccacctgggaaattaactattgctaggcagttggcaaatgaaattcctatgcaataattcctttgccaactctaaacacccttttattagctgatgagaagtttgaaaatttatgaagccaagtgctgcctacatttctcaagtggagggagcacgctagaggagtgggcagagataaagagccaacaggtattgcaaaacatatgcaggtaaagggtgatctgaacccaagtgggaaggagttgggacaagtaaatacaattttatagcatttgggtttgggaagtatcttccttacatagatctaggaaatcatgggtaataatttcccctgtggtttaggtgactatttcagaccaggagagtggggctaaactttagttgtggcacaccacagtcttggtaggtaggactgtggcatctaagagtttgaaaagagcacagtctttgagattggaatagagctgggttgcaagctctggagaactgttgcagg

SEQ ID NO: 29680 - DNA, 2577 bp, Bovine  19866880282301
ccaggatgtctggctctaggtcagtgatcacaccatcgtgattatcttggtcatgaagatcttttttgtacagttcttctgtgtgttcttgccacctcttcttaatatcttctgcttctgttaggtccataccacttctgtcctttattgagcccatctttgcatgaagtgttccctttgtatctctaattttcttgaagagatctctattctttaccattctattgttttcctctatttctttgcattgatccctgaggaaggcttttttatctcttcttgctattctttggaactctgcattcagatgttttatctttcctgttctcctttgctttttgtttctcatcttttcacagctatttgtaaggcttctgcagacagccattttgcttttttgcatttcttttccatggggatggtcttgattcctgtctcctgtacagtgttatgaacctctatctatagttcatcaggcactctatctatcagatctagacacttaaatctatttctcacttccactgtataatcataagggatttgatttaggtcgtacctgaatggtctagtggttttccctactttcttcaatttaagtctaaatttggcaataaagacttcatgatctaagccacagtcagctcctggtcttgattttgctctatttcccaagaagtgatgaaatggtcaaagaaccctaaaaagtttgagtgagaaagtagagttcggtccacactcttcatccatctctggccaatccccaaaggagattttgactgtcctgtgacattagcaggttgttataatcccccaacagagtttctgccataaaccatatgaggtcacctcagaaccgtacattagacacagcccttggttcacacatgtgtctcttttaattgataacagatacaaacacaccgtagagttagtaaagtacagcagaaaacatgtttggtaggagagcaaagaactagagctccaagagtccttaccttgtcctgaagaatcccagacaacccctcaagatgaaaggttgttgctgaatcgtgaaatatgctgggattcttgtcctctagaagagaagaaatcaatctggggccagtgatgaggcttgatagctcagaaattttgtgtaatagagttttactaaagtaataaaagagacagagaaagcttctgacatagacatcagaaagggatggagaatgccctaatccctagtcttagcaagggaattatatacttattaactgtttattacaataaatcaaaagaatgtctcaatattgtaaagatcttattatacccagtcccataatatacattttaaggtggcaggattagttagaaggtttttaggaaggagaagctgtcctcaagcaggatacattgttttataatccttgctgctgctgctgctgctgctgataagttgcttcagtcctgtctgactctgtccaaccacatagatggcagcctaccaggctcccctgtccttggcattctcaaggcaagaacactggagtgggttgccatttccttttccaatgcatgaaagtgaaaagtgaaagtgaagtcgctcagtcgtgtctgactcttagcgaccccatggactgtagcccatcaagctcctccatccatgggattttccaggcaagagtacgggagtcggatgccattgcctttgtacagagtttaaactgagtagtttgttgtgtaatcatcagttccgggattaaagaaaaaaacattttatgtgactaagacaaaggaatgtagagaacaaaaaaaagacacatttgtccttttctccttcttgagagccctagacccctctctcctcctcagggaccccagactttctatcaacctgcctaggaattgactctctcaggagcccaagaaaataaagtctgtcattgtttccattttttccccatctatttaccatgaagtgatgggaccagatgccatgatatgagttctttcaaagttgagttttaagccagctctttcactctcctctttcatcttcatctagagcctctttatttcctcctcactttctgccattagggtgctgtcatctgcatatctgatgttattgttagtgttgacctgatcttgttagtgttattagtattagtattgtttgtgctgacctgagcttgttgtattgttggtacagtttcccaaactgagggaacaaatatcttccctgccatgggaactctgtatagtgagacagcatttttggaatttctccaaattcctgcagagttagttcttctcctgagagggtgtatagaacatgttttcataaagaaaacaaacagccttttttttttttttttaatcatccagagtctggaacaaatatggacttgaacaccagagagtagggagtgacatatgagcacaaagcttatgttgaaactgactcacttctcagaagataacagagttgcaatgtcctgattagtcacaccccctactctgctctaatgggtgattacaaaagccatactgtttttatgggcgacacccaatgagccagactgaacagggagg

SEQ ID NO: 29681 - DNA, 2519 bp, Bovine  19866880397749
ccacgttcctaatttcctagaattaggactcacaggactcgggaaaatgctattactaaaacaacttattataaaggacatgaaagaccagccagaggaagaggtacatagggtgaggtctaaaaatggtcctgagcgtagaagcctgcatctctgaggagttggggtgccccagcctcccagcacaaggatgtgctcaccaacttggtacctctccaaaccctgtcatttatggatgtttacagaggtttccagtcaaggattttcctgctttgggtgcatggagtcttaatccctggaatgccaaggaaatgaaccatgtgatggttaattttatgtatcaacttgactagtctaagggatgcccagatagctggtaaaacattatttctgggtgtgtctgtgaggatgttcctggaaaagaatcatttgaaacagtagacttcaatcccttgagggccctcataaaacaaaaaggtggagggagggagaatgctgtcttcttaaacaggagtgttcatcctctcctatcctcaaacatcagagctcctggctcttggatttatggactctgggacttagaccagcagacccctggttctcaggcctttggacatggactgaatcatgccactgactttcttggttctccaacttgcagaaggttgggtgggggagggggcacacagctcagcctccaaaactgtgtgagctagtttctacagtaaatctccttttacaaatatgtctttatagggcttccctgatggcttagctggctaagaatccacctgcaatgcaggagatctgggttctatccccgggttgggaagatcccctggagaagggaatgtctacccactccagtattctggcctgaagaagtccatggactattggggtagctccaaaactgtgtgagctagcttctacaataagtccctcttacatgtatgtctatatatcctattgtttctgtttctagaaaaacctgactaatatgcacacttacattattcccagcataaattacctgatggaagttttaaggaggcaagttttaattaagcatcagaaaagagttcctgaaaattagaattccattagttgaaaattggttttgtctcttgagtagttagacaatgaactctctcgtctccagatataagcagagggaggctaaatttatcagggttgtagagattctcacctttttttttttgcaatagttaagcctcaaaacttggagctctccttaccaactttaatagtctcgactataaaaaaaaatattcaaagggttaggatttacattttcaaagagccattcttttaaactgtcaaagtagatatagatcacatggagaaatttcaggtttttcaggtaccttgccaaatatcaaaatgacagcaggggttgtcctcaaccacaagccggctaagaagaaaaaatacacagagtcagcattccatgtcaacaccacggctattgcttcaccaatgcaatccccacccccagctttgtaaactcctgcacgaatttctcacaaacaagcaaagagttaagtctgggggaagtgtgaaggatggccaggaaaatctgactaataagaagggtgtagagaatcttccctgcaaggcaaacctactggtcaatgctttcttttgtcttcagaaaaaccctttaaacgaatttggtctgaaggtgtattagttgctgtttgtttcgcccctgattcctctccaagaatgcatataactatggtcaaatcaaaattcaggcgacctttgttaaatgataaacaggcatattaaaatttttaagttttttttttttttttttaagcaaacgtcaattggaattgatgttgccaaacaggaagtggttaggaatgttccaacaagaaggggcaggggcaagactttgataggccaaaggtgtaattgaagccaggaaattatttgattggctgtagcttaagttttgggcttccccagtggctcagcaggtaaagaatctgcctgcaatgcaggagacgccagtttgatccctgggttgggaagattccctatagaaggaaattgcaacccactccagtattcttgcatggaaaatccatggactgaggaatcaggtgggctacagtccatggggttagaaagagttagataagattgagtgaccaagcacagcttaagtttgtcttaagtggaaaagctgagattttgtgtctgtgattggataacctgaggaatctacagggtccttggatttgctcacacaggctgctatggtttgtattagaaccttctcagtctaatggcctccttgttttattaacattttctacttctgtggtcaaacacctttgattactggacccacaagcttcttcagggaatcactgatctttaatcagctccattttcagagtatagaagtagtgagattgttcttcagggggcaagctaacaaaagtgtggccaccacatgctttagaacagaaagtacacattag

SEQ ID NO: 29682 - DNA, 1997 bp, Bovine  19866880419085
ctgaccggcagcactggcgagaggatctgcagccggtggttgagcaggtactggaagtgggccttgcgccgccgaaggttcttgtccgacaccccgtagtaggccgcgtgagggctggcggagcggagctcaaagtcccgggccagcgcctcgtccaccacatgggccagacggctcagcccctcggcgtcgtgcttctcctgcagggcgatctggcggtggatgtccagacacttctcctccagctcctgctccccgcacaggtcagcgtgggtgcccacgatgcacaccacggcgtggggcacccgggcccccacccgatgcaagaaagagcccacggtggtgggaaagcggagtggctcgtaggtggccaagttcaccaccagcacgtacagggcccctggggagaggaagaagggctggatcacctcgtagcgttcatccccggataggtcatacacgatgaaccgcaggccccgggacgcatccgccgtccagctggtcacctcgatgcccttgctcccgggaggcggtgaaggcgggtaggtcttctcctggccccctcctccaagcttcccctccactctgtcctcagtgaggcagtgccggagaagggtctttcctgccgccttctgacccatcagaagcagtttgaggcgcggctggaccgccggctgggaatgagccagctccttctggtaggcggcgatgtacgggatccccttcatacagacctcgtaggggggctggatcagagggttgtccttgatcttccacaggcccacgcgggagagctggccaaagttgtctggcagcacggcgatctggttcccctgcaggacaagctcctccaggccggtgagctcgacgatggaatcgggcaggtagcggatccggttgttatccagccacagggtgagaagacggcccaggcccgagatcagggatggcaccgaggtgagctggttgcgactaaggtagagctcctccaggccagccaggggcagcagggcggccgggaactcctccaggaggttggaggagagattgagcattttgagtcgctgcaggcggctgaactgggcgggcagagcccgaagcccgttgttgtccagcatgaggctctccaggctggccagctcgcagaaaccgctcggcagggtgccaagctcagccccactcagccagaggatcttgagggcacgcagggcactgatatcctcgggaaggccccgcagccggttgctggacacgtccagctcctccaagggccaccagctgcaggagctgccggggaaaagccgtgagctggttatggtccacgtcgaagggtgcgcaggcgagagaggccggcgaaggagtcgggcaggtgcgccagccggttgaagctgacgtccaagctcttccaaggtggaccagcgcacccaagctgggctggcagggcagggagctggttgtggctgaggttgagcttccgcagctcgcgcagggcgcccaccgcctcggcgcccaggacgctcagccggttgtggctcacgtccagctccgtgaggtggtgtcccagctcggccactgcctggggcagctgggcaaagcggttccggcgcaggaccaggacacggaggctgcccagcgccgagcccagcccgtcgggcacctcctccaggccgttgttccccaggttcagcacctcaatgtccccgatgttggccgggagcaggagctggggggcgtcaggggagtcgagctggtcggttcccgggcagcccccggccgagctgagggtgagctggcgcaggttgctccgcagcttcctggcgcgcagggcggcgtcccgccacagcctcaccgtcttcaggttcccgctgtccgtccctgccatggcggggccccgggccgacaccctcgcgcgggagcccgcagctacatgccgcgctgcgccccggcgggcgccagtctccggggccctttcgctcccgttcctcccttcccaccgg

SEQ ID NO: 29683 - DNA, 2094 bp, Bovine  19866880459710
aatgatgctatcattgggtttgtccttaggacactttgaatgttgttaaccaagccagcaccacaaaaatcagagctgtttagagaagagttccaaataaatggacccattctcagacacttagtataccaattaaccaggctcacaaaatccccctagttttggaattcttccactcacctaaaacattaggggaaaaaaaaaaaaagtcttctggaaaacactccccaaagagaggggaaaaaaaacacaaaacttgtcagtttcttatccattccatttcttacaaagcacttccataaagctccactctctaacacttaaccaaaaccaggcttaaagatgtcggtaaagcacaaaattaccaggaaatacccccaaaactccccttagagatttcagtaatctttcatgccccagagtgtactgggtgaaacagagatcccagaactgagtcacgccttacagactgacatttttgtctttactaatcatcattcaccctgattacaaaacattcttctctggagtttaagaaaatggtgcaataatttctacattatggtcacagtctgaacgtaaacaaaagaatatgatgacagatatttcaaatttggagcaccccttggatatgtgtctaacaagcattacagcccatgactcaacatcagacaccacccatctgctgtgcaaccatttgaaatttccttccaggaaaggcggactgaactgggaagacggaaaaggtgatccaaaatgtttggaccagaacccacttcagaagtctttcttctagaagagtagaatcctaaggactgtatttcatattgttcacatactgactgcctctttctggtcgccaattcccctctatttacctcgaaaagctttgctgggaagcaggtgagattaagcaaacagtctaacacaggagaaacaaacatcttccccaaatgcatattaagacaccccgcagaagaaccaggtccctctgacctcttacctgggaaagcgtgtggattaggcgaccctctcttaaggcacttagaacagagaatgtgcacggtgtagtgcagtccaggccattcctgaagtaggacattcagttcctctaccaagggggttatggcttgccatgccgtccatatgttcggtaaggatgcgtggctggcaatggacagggtgtccggctgcaggacccccttggcaggtctgtagctcaccaccaccggggactttcccccctgtaggcgaagatctgaagtttgccatccgacctgtgcaccacgtggttgttgatctggacgctgtagcgggcgaacaagccgggtggaaaggtgaaggggaaactgtattcaatctgcagctgctcagccacaaaggactgcccggccaggttggtcccgttaatccaggcttccgcatgcggcacctcgttctgcacgtagcaggggaacttgtaccacgccgtggacccattcaggggcttgcccttggctttgttgaggcaataacagagtcccatcttctccagcagctccagcagcagctgcaggtcctgctgagcttggacgtgaggcttcagcagcaaccggatgacgtgggctggcaggagcccgtgcagcagaaagccctccacgtagtgatggagctgggtggcccgaagcgcgtcctggctcggggcgggcggcgccatcagcggggagctttcagcccggccctcggcctcggcctcgccgctggtccccaggagcagcttgtgcagtagcaaggaagggtccctctggaagaagacgttgaggatgtcgatgaggcgggaaaggttgtggaagacgtgctccttgagggcggggctgtcctcgaagtacagcagcttgccgctctcgtgcaggtaggagagggcgctctgcagccggtcctcggtcagcccggcctgcagccccagccgagccgagtcccaccagctgagccagagccgctgcgcctgcgggggcttgaaagtgcagctcctccagcacctgccaggaccgcggcagcacgcggtgtaagttggggaagatttcgcggtgctcggccacagagagcagtttgtcg

SEQ ID NO: 29684 - DNA, 727 bp, Bovine  19866880483107
agagacggttttctcgtggtagagaccatcatgctcactcttaccctggattaccctccttcggccccaggccctgcactctcgcatcccggctacaagcctttggctcaaactgtttagaaatgttcctctccacagaaacacctccacctgctaaatgctacctgctcctcgcagcctcccaggatttccgaggcaagacggttcccctctttcttatactacctagcactcctgtggccattgcggccacacttctgctgcagggctcattgttcacacgcctctctcatctttaggaacttgaactcgttgagcacaggatctgggcctgattcctatgcctgaaccttccccatgggccgccccccctccaatgcatactggtgaaaccaaattcaactcgacctgtaaggagctaggggggagacagtgaggaggacacatgccctgtggtgatgctgtgtccacattcaagtccatggtcaccgtgtctcctgggaaagtacaattacaccgatgaccagcagctaaagactctggtccagttgccttcctccacatcatccctagctcatgggcgagctggttattttccagccctggcacgtggtcagtgtcgcccagccaggccgaaggcataatgaaatacttccaagtgctttgaactgggcaaactgtgtttatacaattacatgcaaacaagctaacgtgaggctttgctgag

SEQ ID NO: 29685 - DNA, 1812 bp, Bovine  19866880542493
gggttgtgctggattgtcattgctacacgtgggcttctctagttgcggtgagtgagggctactcttcgttgcagtgcagggactgatcgtttgcatggcttctcttgtcttggagcacgggctctagggcacactggcttcagtggttgtggctctcaggttctacagcagaggctcaacagttgtggtgcagtggcttagttgctctgaggtatgtgggatcttctcagatcagggatcaaactcacgtctcctgcactggcaggtggactcctatctattgtacccccagggaagtcctctcttacattttctatcaaccaagggcctatttaggctaacaaattactcttttaagaaacttcattacttgctgggaaagctaagccttatttacccttcagtgcaaattattctaaatagaaattttgctgtggaaagccacatgctgggggcagtgagaatactttgttgtttgcttattgaagtataactgactcacaatgttatattagcttcattttgtcttttatttattgaagtataaatgactcacaatattatattagtttcaggtgtacaacagaatgacttgatatttttgtacaatacaaaatgatcaccacatggagaagcgtactttgaatggaggactctccaggcatataggttacagctctaatgctaattagtgctcctgcactgcaatccacttttggcccggattcctggcctgtgcaaagccattctccatggtgtaaagaatccgggcatctttgccaggcaaagctcatttcaaatcttggctctgtcacatcctggctctatgacttgggtgcattactcaaattaaagagagactattttttcacccataaaatgtgagagtggtttggtggtaggatgggaggcctcgtggataccagtcatgtacagcacactgtggggccctgaggtttgatcagctgggggcgacacactttccaggagctccaggagaatcatcaacccacaatctgcccctgaccctagattctggagggtcttgcagctaaagatctcttccattcctagcctacttaactatggaaaccactgcactttataaagctgtgaaatactcagaattttttatttcagacataaaacgccaggatcagttttgcacctgtaaacactctatctcacctttggaagtgaagcccatagaaggttatttctcaaagtgggtgttcagagcagctacacctacgccccatctcagactctctgaatcacgatctctgagatggggatgaagagcctacactgagtcaggtcctcccaggtaatcctggtgcacaccctgaacccttgcttctgcaagtgcatcacttgagagcttgtaagaaacgcagatgctcaggccttgcccagacctactgaatctgcacttttaaataactgcgctaaaataggcataacacagaatctgccatcttaacgtctttaagtgtacagttcaggagtgttaagtctattcacattgttgtgtgaccaatctccagaagtctttccatctcgcaaaactgaaactctgtacccattaagacaactctgcatttcctccctgcccccctcgccagccagtggcaaccacacagaacttcagtttgacaagctccccagctgattcatatgcccattaaaggttgagaggcactgccctaagtatgagacccacacatcataaaatcaggagccactgtgactttcttgaggcacccaggctgtgatcttgagtcaggcaatggaaaccagccagcagagcaa

SEQ ID NO: 29686 - DNA, 1279 bp, Bovine  19866880586775
tcctgttttgaaattgtttgtactaggggagtctcttgggttcctctccatcttagaggctgtggctatgttttaaccttccattccttggcaaaactggaagcccctccctacaattctttctgtaccaaaaagcattctgtactccccactacccatgtgcttctgtccaacaagtggctttgtgcttggaggtcagaggtgccgaattcacttacttccttattcagcatccagagaacttagctgggcctctgggtttgttaaaaacactcctgctgctaagtctcgtcagtcgtgtccgactctgtgcgaccccatagacggcaggcagcccaccaggctccccagtccctgggattctccaggcaagaacactggagtgggttgccatttccttctccaatgcatgaaggtgaaaagaaaaagtgaagtcgctcagtcgtgcccaactcctagtgacaccatggactgcagcccaccaggctgctcagtccatgggattttccaggcaagagtactggagtggggtgccattgccttctccgaaaaacactcctggctggacacaaattggtgtaattcattttatagctgtacagttgggctctcagtgtcctatgggtatccaatctgtctcatctctggacagccaaccctgaaaaatggatgatctctgcagcagccgtgataggcccctgaccaccccccaccaccctcactaagagctttcaacatttattctgcgtatcagttcgcccagacagcgacggaatctgccacctctgcggcaggtgtgagggtcacctcaggtttcccggcagccaatgctcagcacgccgctctgcttgccagtgcgtctcctgcaccgaggcggcctcatcagatagtgagtttcattatgcactgtccgctggggactccactaaaagcaataaattcatttcactgtgctagtctctggactactaaagcattttagtcctgtttctcctttaacctcccaggagccaaatattcactctgacaaatgctattcattacaaagttaagatgactttgactctgtttctctcccttataatacaatgaaggctctttgtcctggattcatctacagcctgacggtattagggataaaaacatgccaaggcaggcagccttctctccaaaatggattgaaattacctctagcgagctatgccttgcttagataaagggtagcgaaaaaaaaaaaaaaagaaagaaaaaacaggttttctgctcatttttaatatcc

SEQ ID NO: 29687 - DNA, 1622 bp, Bovine  19866880621744
cagaattggattgattgttggacactagttggtatccagagaatcagagaatatgataaatctactccatcttttacaggaaaatccttcaactattttttagccttctcatatcaaaaatcttttgttcttcaaactctcacactgatgaactgctcatcacccatatcaatcttctccattacttatcagaagttctggtttgtaaaaagtctatcttaaaatgcaatacttaaaatccagcacacttctctagatgtggccaaaagagaacattataggtattctgtgcttagtcactcagtcgtgtctgattctttgtaatcccatggaccatagtccaccaggctcctctgtccatagaattctccaggcaacaatactggagtgggttgccattttctcctccaggagatcttcccaacccagaaatcgaactcgtgtctcctgtattacaggtggattctttaccctaggctcaggttaataattttatttctgttctaatggacatgccctaaatatgtgtctgttacatggagtggggctggaaggttgaccagcaacaatggtgatcctctttattaccctgatcagttcaggtcttgcacaatcacaaacaccctatctggcaaacacagtcctatagataactgcacctacctccttgaaagctagttagtgaccctcaattataactcaaacatgtcttagagacctcagtcctcatgccagtgaacttatcagaaagtatgaagttcagccaagaaatctggtaaatgacattttctccatcttcttacacatcctgtatgttaagcattttatagtctggagccctgaataaaatcataactgacacactctttaattcagcactagttctgactgattatttcctgtatgtggggttactatattgattgtgtggatttaaaaaaaaaatcctatcacaatgtagctcttaggagattgtgaccaagttaaacacagatttttcttttcagatgaactgccaagccagtctcctcctactatatttatatgcctgacttctatgagcctgaatatagaattttacacttagtctagttgacattcactttgcaagaatcaatgaaccattttaatttgtcaaaaacattttgaattttattcaaatatgtcactctaggatattttaggcaattagatttcctcattaacaaaaacttggaggtagaaatttgatcactacattaggaaaatttctttccttacattctagagctgtgccatctaaacagtagtcactagcctcataagacttttgaacaacttaaaatgtagctagtacaaattgggaagtgctctaagtacaaaatagacaccagatttcaaaggctgactacaaaaaatgtaaaatatctcattaacaatttttaaaatatcaattacacgttgaaatgatatttggggtacattggattaaataaaatagattatgaagaatatgcgggctgtattgttaaagtgtggctagttgaaaatttaaaattacacttgtggctcacatgatatttgcatcggagagtgtagctctagaggctgaagtgacttctgtccatagttgccctcttctg

SEQ ID NO: 29688 - DNA, 3400 bp, Bovine  19866880665689
tattatcgtgctatataattatttatgtttttctcccaggccccacagaggtctcttcagtcctttgcacccgccttccacactctcccctctgtgctcatttctgcttcgggccactcctctgccggtcgcggccgcacggaacctagacagaccccgtctcttcctgaagccttccggccgcacatcggctctctaatacactgtctcctctgtttcactcctgtggctttgtgtttgcatgtcttatctcctctctaagactctaaactcctgcccaagggggttcttatctccttttctgctcttcagagcacttagcagatttctaggtacataacaggcacttaataaataattcgttcattggtaccgacattcttcacgttctgagagatgaaactgggatcctctaatcttggtactccaagctcagtctggagtaacagcccccttggcaccttctgggaacgtggtagaaatgcagaatagccagcttgccccagaacaactgactcagaatctgcattttaagaaggtccccgggggatttgtatgtgtgagaagcactcactgctctaaatgacactatttgccaagtgcttgaactttccttcctctcttggtccacggtttctgcctctcccaaacctggctcttcccatatcctccccacgccctccacttcccttccctagtgcattactttaactattttatttccaatatcctcaattcacccactcctcaagtttccctttcccatctacaaaatgccagcaattcacctcctccattcctttctcattctttgatcgcccagtgcctacacactaaggtctcctgttttgttgactcaatacacaccttgctcatcaaacagctacctgagagaaattcagagagaaacctgagcccaatcttctcttgaatgggttgtagctcttttcactgtttctgtttatcagtttactcctaactgaataggaattaagaattcattgacccacaaaaaatgtaacgtggcagggaaaactgtgctcgtccatttataggctcaactgcttaaaggaatttgagaaataagcagtcttcatcagttaagcctaaaccttcaactcaaagaaaggtatgcttcacttaaaggtgatcaaacacagaaaattatacttaggagaaggaatgccagggtttgctttaaactataattcacccacttaaaagacttcaaaaggtctttaacggagtcatttttgaagtgactttaaaaactacatttgttcacatcttgataagagcatgggtgtcttaaaattcagaggagacaccttcagtttgagttgttagagtttatgtggaatccaggaaaaagcaagtttggggactgaatttcaaagaagaccacctctcccatattttgtagcaggagctaagcagttaaacaccgctgctgaagatcatatattttctgactcagatttcctacctgaggcttgatttgcaatgataattttctttaggtgttttgaaaggcaattgtttataaaaaagataagttgtatagagtcttccttaaggccaagggtcaacaataattgttgtttgatttctattcatttttctaaaatctctgattgcctgcacaataactttcttcctcaatcaattagtctaacaattcataccagtattttatttttaatggccgactactcatttcattaaaaatgtaagtgcattacctctgtgtaaaaggactccattgggataggcttatttaaatattcataacataaaaattaataaatctgagctcagtgtttgcattttaaaaagtcaggttactgtcagctagatttgatcctggttgagatttagtaaattaaaagccctgagcatcattttttttaaaaattgattcttctttacaataaaacaatacaagagaaatgctatgagaacagtactgctatccaataactcatgacttctttcaacttcatccacctataactagcttcccttcctttctgtctttcctattaccctccacttgggattctgatcactaaatcagcctgtctgaaatcaaaggagttatgtgctggataggaattatatttatttcctgttaattcaatctctctttccactcctcccccaacttgtgtcaaaaaaataataataaataaagccaatgaatcataagagtgcccagcaagaactctagagaaaactgtgtccactgggattcctgctaattggaggaagaggcatacactttgccaggttaaagtctgcttgttgtatgttggttcatgagtgtacatagccttagaatcagcaaacttgataaatctatacattgggttaagatgtggaagactctgatagagtctagagcagaaatctctgataagctactgaaggcttgagaatctcctttacattattcacaaaagcaaacttgaaacggactcaagacttaaatataagatctgaaagaaagaccttataaatcacctagagggaaacataaggaaagagccccttgattttggtcttggtgaagatttttttaatatactactaaaagtatagacaaaaagaagcaaaaataaacaaataggactatctcaaactaaaaagcttttgcacaactaaaaaaactatcaagatgaaaagactacctatggaatgagagaaaatatttgtaaaccatatatctgttaagggtcaatatctaaaacacataaggaatgcatacaactcaataaccaacaaataaataatctgattttaaaatgggtgaaggtcttgtacagataattttccaaagaagacatgcaaatggccaacgggtacatgaaaaggtgctcagtcacgctaatcattcctgttgttcagtcgctcagttgggtctggctccttttgacttcatggactgtctttgtttgaattctcacttccttttaccaaaatagatgcttttcgggatagaaccctttcagatttcagatttccttgttgatgttcagtcactcagtcgtgtctgactctttatgaccccatggactgcagcacaccaggcttccctgtccttcaccatctcctggagcttgctcaaactcatgtccattgaagtcggtgatgccatccaaccatttggttctctgtcgtccccttctcctcccgccttcaatcttttcctgcgtcagggtcttttctaatgagtcagttctttgcatcaggtggccaacgtattggagtttcagcttcagcatcagtcctcccaatgactattcagggttgatttcctttaggatcgactggtttgatctccttgcagtccaacagtatgaaaagatactagtcataaggggatgcaaatcaaaaccac

SEQ ID NO: 29689 - DNA, 2888 bp, Bovine  19866880741747
tttctgactgtattaatccacgcatgtggtctgtgccttgggcctctgtgagtaaaatgaaaccaagtgttatctgaataattcaggccagatttctcattcagtgacttggatgactttgaatttcccacttcagtcgttattaaagattgaactaatgaatgttgctgaagttgcactcattggatcccattagctcaattgtgcccattccattaaagctgtcaacatcctttttatgaaagtgaaagaggaaagggatcaggaatggggaccggcaaacccctgctggtgtggaaaggaaacctgacatgtgatgaaagtggaagttggagtaactgctggatgatcagccttgactacctctctctgtgtgttttccacgcacacatttgaaggtggtgggtgagatgttgcagagcgggcccagtgccagttctgcagatggacgctgtgggctcatcttgctgcctgtcatctgttattggaaaggagcacactttttgcaccagctgagtcagggtatgtcctcctgggtaatctcatggactctcatcactcacattcacatcatcccttgtggatcttagggtactggggtgctctgtcggtgatgtgagtggctgagcacctccacaaaacagactgaacccattccctgaccaggttcttgggggattcacagcattcctgctgtcttctcctctgaagtgcaaacctacattgtttcctggcccacagggtcagaacgtggagtggaaccctttcctaaccgtatgccatttggcaggttccttaatatcagcacatctcagtttcctcaaatgtctaatgcgaacttcaccattcccaccccattctcacttttttccttgtcctccaagtttccctgactggttgttcctttgttgcctgaaaaccataaggaaggagagtgagatggatccaggagactcagaagtgattctcatcttccagcactcacgtggcctccagcatggggcctggatcttattccacagaacttcagagtcattggacaaaggctgaggcagggggttgtaaagcctcttccgtggactgctggcgctttgctggccccccaggtgttgtgacattcacagcgagtatgtgtttccctgtgagaatgaaactcaggggtcccattggctctgggtggggatgcttggttctactttaagagcctaggaaagttctgattttttccttcttctctgagtacttatctcagtcttcctgagagcccccatcatttattgttctccccacctcgtcttcactggcagcacaaaatgacaaggttcagtgactaaagtaatcccttgggtttttgttgtttattttacacccctaggaagaagaaggggattaggcaggagaggccacttagctttggggtgaagaaataagaggtgtggtgagatgggctcaggtggattttgctggtgggaatgcaaataagttccagaggaggaggacgtgaatatgagcagcaaggcagagtccctgcagttaccctggagaacgcctcctgacatgactgatggatggaaaagagggagtgctgctttcagatgaagggtgactggcagcaagatgagatcacagcttgcattttttgtttttttgagttggcacatgtctcactctgcatcacctttcccatctgttccacgtgtatgtgtgcaacacatagatgtccgtgtccactcaagagtgggtaataaaaatcgcaattgcaagcaaacctaatccaaggacccaagatacttgcttgacccaattactcaggaactcaactgctccatcctccttttatttagagagagagaaaaggtagaaggtggagtaatgagaggacatgtgaggtgatcgcaggtgtactttgctgatgggaggggcataccgataccgtatattagaaagaaatgtgcacaaatataaacacctttaaaagtcctcattcattggtccaataatgctagttctaggaatccagccagaggaactatcccattggtgatatagagtggtatgttaaggatactcactgtagctttatgtattatagtaaaatattgagaaaatacagacatgatcaaggatgggaaatatcaaaacacgttcaagtacttctatatgatggaatcagacttccagtgaaggtgatgctttagatgtaattgttttctaagttgaaaagtaattgctctgtgacaacctagagggtggcatgggatggaaggtgggagggaggttcaagagggggggacttatgtgttcccatggctgattcatattgatatatggcagaaaccaacataatattgtaaaacaattatcctgcagttaaaaataagtttaaaaagaaacacaagtaatacatgcatattgtttaaaggtttaaatagtgcaaaagagctgaaataagaaggaggtctctcaactcattggagaagaaaatggcaacccattctagtattcttgcctgggaaatcccgtggcctacagttcatggggccacaaagactgggacacgactgagtgactgagcttgaatgctttcatctcagactcatcctctgcagatcagttatagattgtgctttagaaaagaaaggggtgaaataagaaaatgattccagagagaacaagaaggtggaggagtaggttgttgtggaggacatctctctccacagatacatcagcaatacaccttcagacacagaagtgcatgcaaaacaccagctgagagcggacaggagtgcctgacctgcagaaaagaacatgtagacccacgcaaaactcggtagggtgaaggagctagggggcaaaacagcagtggaggggacggaccttccctcggc

SEQ ID NO: 29690 - DNA, 2635 bp, Bovine  19866880754060
tactttgcatacctgcttttttggctaatacagcttccttgttcctgctctcctttgcttgtatcattcggagctcctatctgctcaattgggtgctgcccaattcaggggctgttgaataaagccacctgttagtcattcagtcgtgtctgactctttgagaccccacggactgtagcccaccaggctcctctgtccacagaattcgccaggcaagaatactggagtgggttgccattctcttctccaggggatcttccctacccagggatcgaacctgcatctcctgcactgcaggcagatactttaccatctcagccatcggagatgccccaaataaagccaataagatcttttaaatttactcatgtgccacagctactgagcctgtgctccagagcccaggaggtgcaactcctgagcccactgaccctagagccacgctctgcaacgagagaagccaccgcagtgagaagcccgcaccccacagctagggagcaggccccactcgctgaagctcgggaaaagccagtgcacaggaacgaaggcccagcacgatcaaaaataaataaatacaattataaaatttacttggcagactaaaaaaaatatatatatcttactgccctctgaaggaagcaaccctatgaacactttaccattgaattcctagccaccagaacttgagaaaataaatgtctgttgttgaagccacccagttagtggacctctattgtgtcagcctgacctgacttaataaactggctgtactgtaggcatccagcgccctgcgttgttgcacagtcacagaagctataatacctgatggtaccattttatctgtaaagcatttatgattagagatgtttctttgaaattacggttaccaggaaggaagggtagtgggggaaggattgttagagagcttgagattgacatgaaactctgctatattttcatgtaatataaattgcaagtaacaaggctctcaataacatgactttttaaacaactttttacaatttatggctgtgtggggtcttcattgacgaaggagcttttctctagttgcggcgagcggaggctactcttattgtggtgcgagggcttctcactgtggtgccttcttttgtgcggagctctagggtgcctgggctttggtagttgcggtgcacaggcttagttgctccacggcatgtgggatcttccaggaccagggatcgaacccatgtcttttgcatggagccaccagggaagccctaacatgattttttttttaagtgacatggtagtagaaagtgagctcccgtaaactcctgcctcagtatcacctgggaaagcccttcccctaccctctgtagtaactcagcttccttgggtgagtcttgtggccattgaaatcgaagaaccactgatctaggctgcgcatcagtagagatacagatatcaacccaagcgtgcacacacagcagatcagctgcatcagaaacaatgacttctttcttccagatccattctgctcgtgcgacaacaccttctgagagcattcgttatcacagcaaagaacgtctcctccaggctcttggctgtcactcccctgacctgccaccggtgtggtatcccatcaggcgcctgtcaccgactgacgtgcgctggagcagaagcttcacagcacagggtgagaagaagaagaatcagaaacaaaccgggacacagcttttctagaaaatgctctccaatacaaccaagtctgtgagataggacttcagggcaagcatggtcgcggagggaggcgaagcccggcaggtcaggtctgagactgggatgtcatgatgatgggggagaaagatggttggtccaggatgagtttctttgacgtgtatttccctccatgtgtgctgtagaacactacttctgcccagtgccccaggaacatagggactcatggtgaaaacccttttttagatattctaaatcatttttatctatttttttaaaaataattacaggctctctggtttttgtctctcttctgctctgagacgtgggcattggtccatgggctgacccgaaggacggtgtccacagctgacactcacctggctctctgaccttgactcttgctgtaagaaccaaagggtgccttgcttgtcttcctgaggcgcttcagcccctcttgcaaacagatttcctgtgggctctcttgtcatttagaaatacttttctttatctgaatcaccgttccggttccagccattcccaaaagaaccggctattcccaatgtatgagaaagtaaattctgaaagtaagttggtacaccagtcatttagaatttgggcctcacctcccagagctacaaactgatacataatggcaaagttcccaggccagcccacaaaagcctaacttttccaaaatgaaacattggtgggtggtagagtggtgagcatggccgcctttcaaaatgtagctgctgcttctgctgccaagtcgcttcagtcgtgtccgactctgtgcgaccccatagatggcagcccacgaggctcccctgtccctgggattctccaggcaagaggactggagtgggttgccatttccttctccaatgcatgaaagcgaaaagtgaaagtgaag

SEQ ID NO: 29691 - DNA, 1864 bp, Bovine  19866880831567
tggtgctctggacagtgctgtgcacacgaaagtgtctcagaaacgacttattgaaggaatggcaccgtgattggtttagagcatagacttcacacaaaatggtgattatctttgctcctgttgaaagtaaagtcaggagactggaagattcattcaaacagaaactcagaatatcacgtgtctggtgcagtattctaaaccctcaaccctggtacatggtctccccccatgatagcaccatggcttacatttggcttttttttggttttatgctcccttatcagtacacccattaccacatacacacacacacacacacacacacacacacacacatacacacactatgtacgtgtacctctctgctttgcttctatattcttcatcttcccttttcctgaaacatgcgattttacaaaaactaaactgagggccttgggtgaaacccattgaggtgatatttcccaggaaccacacatttagggagtggataattaagatctaaaaattatattttagcattttaactaaacagatctagaactttagagcaccaaggcttcatacattgtatacattgctttgccttttatacaaatacaaattttataagcactggaagagccaagaaagcagagacctctttggatgggaacatctattacacacgctcttatagcaccctaggctgtctgggacatcctgaacaatggaggcaattgaagaattcaagtgagtaggtgatcgcttacatctttacaaggcatctctggaataccccagcactgggttttcactgggcctgagacttccttcctctggcacgattttcccaccatgatgggccatggttcaagactttatactacacatgcccaggcaacttctgaatttattctcaatgtctttagaaaacaaacaaacaaaaaaaaacttattttaaaaagaaatttttttgtctcctacacacacaaaaaatgcactttacttcacagtacctgttatggctgaattctatctcccacgataattcatatgttcaaattgtaaccctgactacctccaaagatgactgtgtctggatctagggtctttaatgaagtagagtaaggtcatatgactggactctaattcagtatgtctcatgtccttacaaaaagagagtaagatacaaagaaatatagagggagtaccatatgaagacacaaaaagaagatggctatctctaagccaaggagaaaggccccagaagaagccataccttctgacatcttgatcttggacttctagcctctagaactatgttgagaaaacaaaattctattgtttaagccttcccagtctatggaactttgttatggcagcttgagcaaactaatatagtacttctgctcattttctcaacgtctttgagaaaaattcattttgaaggtgaaaagcaacccaagaagggatgtatccaaagccatggagctaaacagggctagtaacaatgaggcttttcaaagtcctatataacacttttgtttccattctacattaaaaaaaaagaaggttatttgaaacactaaaattgatttctgtggaacaacggttctcacccccagcttcacattacaatcaactaaagagatttggaagaaaattaccggtctctgggctctacctccagagtttctgggtgattcgtttgcattgggtggcagtactccatccacccgtatggtgattctaatgtcagttagaggtgagaaaaagtgctctaaaaaatcagttgattagaaaacatcagagaatttacaaagagaatcactctatctcaatcttttaaaagcctcagacgtcctaaatcattgtaaattgt

SEQ ID NO: 29692 - DNA, 1687 bp, Bovine  19866880873681
ctttggagtatattagaggtgagacataagcttttattctccaatgctatcccaccaaacttccagaagacaaggctaaggagaagaggatatcacgacactggatcctttcaattttttataagtttttctttttcttttttttaaaatgtggaccatttttaaagtcttcatatttgtcacagtactgcttctgttgctcatgttcttgttttggggccatgaggcaatgtgggatcttaactccccaaccagggatcgaacccacatcaccggcattggaaggtgaagtcttaaccaggtcaccagggaagtccctcctttcagtcttgaagcacaaagtaatctagtgattgactcataacattagctcaaaagagtaccatctaatctccatcaagtggaaatcacaccacttttgataatgaacagaaaaatgaacaagtaccacaataagctctatcacttatgagaaaatttatcctggtttttatgggaggaaaaaatccccttatttcttgagttgagaaattacaccaaattatattcaggctctttaattgaagcccatttgtatcagaggctattagtctaataaagccatttcaaacaaaaagtacagacagttgccaatctacatacatttgactttcaaaaataatacatggccccattccgcttagcagtgatgcttttaacaatttcacctaagtaagctttctattgccctgcgttttgtgccagccctgagcctcactttagccatgcccccaaaccccatcccagctcccagatgtgggagacactgccatattttccttatatcttatatctcttacctattcgtacatcctcacctatgcatcttgctacggaccggagtgccaaggcgttgcggccaccaatactgttagaaacactgcaggtttacgtgggcttcgtgcttcagtcagagcatcactgcctcaggccgtgtcttctccttcagagttaaagaatttttggaacacagccctttgtacattaaggacaatccatataatccaaaagcaaacttcctctacaacccacaaatctatttacagagcttccaaggcacaagcaatggcagacattcatatttcaactctaagtgacaccagtcttctatacctagtttttgctcactacatccctacctttgctgcagtgctagagctatcgagatttctaattctctaagagagaggagaaagatcagaaagaacgtaagtactctgacacactcagaaagttagctctgccgcttacctactgtgtgaccttaggtaagctacctagcctctctgagcctcacttttttcatctgtgaactgtggatagtaaatgtcaaatacatacctcacatatgtgtgctacaagaattaaaatgataatatttggaaactgacctaacccagcacctggcacataatagcagctcactacgaactgactgacgtttatttcttcctcacaaccttgccatctgaaacataaaaaacaaggtttgagcaaaaataaacttctggaaagagaagagccttagaggagcagttgagaaggccctggctttcctaatgccttgtctaaaattcctgttgctgcttttacacgatacccatctccaaggcagcactgatctcgaagtctgtctagcacttccgca

SEQ ID NO: 29693 - DNA, 1086 bp, Bovine  19866880916702
agttctttatttaaaagctgatatagtagaattgaaattagaaaaggaagtaataatgactttgaatgttaagtaaaaaatgtattttttttgtcatagaacatttcttagaaagtaagcagaaatctaataggtatccagagatctgtgtatattggacttcgtaaatttaacccagtccatagaaaacctttgacattttaaagaattatcacaagacttcccctacctcccagtttagagcataatattgtggcatgtaatttcctctacgtgtgcatgtgtgctaagtcacttcagtcgtgtccaactctttgcgactctgtgggctgtagccctccaggctcctctgtccatggggttctccaggcaagaacactggagtgggttgccagtgccctcctccaggagatcttcccgacctaggatcgaacctgtgtctcctgcagctcctgcattgcaggtttctttaccactgagccagcgaggaaacccataattttctccataaaatgtagtgaaactgaaaacttaaaaaaaatagaactacccatcatgttgaaatggatctgctctgctgggtgtcctcctaattttgaggctgcctcctgcacatcagccaagatacaggtgtgagtcaggcttttttccttctagttttattgagataaagtttgctttatcacactgtatagtttttaagatgtatggcataatgattgatttatgtatgtcatgaaatgattaccagagtaagtatagtgaatatctgtcatctcatataaatagaaaatgaaaaagagacaaatgttttttccttgtgatgagaatgtttaggatttactctcaacatctttgatgtgtaacctagagcagttgtaactgtatttgttctgttgcacattacatccttcatacttacttacagctggacttgtctgtattgacaatctttattcagttccccttcctgcagccccacccgatctctgataaccacaaatctgatctctttctctgactttgtttactttttaaatacagttgacctacgaataatgcagtgaacatagtggtgaattccgt

SEQ ID NO: 29694 - DNA, 1481 bp, Bovine  19866880936170
ttcttgcttactaaatgtaagaaagaatttcttctggggagaggccagttgtgtttggttcaccattggattcctcaggtccccatacagtgcctgctccaaaggcaaactgtttacaagtgaagaaggaacggaaaatcattaaaggccaaaagtgacggccgcttagtcacgtccgattctctgcaaccccatggactgtagcctgccaggctcctctgtccagggaattctccaggcagaacactggagtggattgtcatttccttctcgaaaaggtcaaaaagtaatatggaaaatatgtattctactctactctactctagtatactatactctaccaggggagggagaaagagccgtgtgattgaattgtcataaaagatttcacgtgtagagaaagcatgaagtgtcctcaaggacgagaaggtgtaaacagtaagcgaggaaaaaggtacctccagggggagcgacagatggagccaaggcacagacgtgatggggccacaggtaggaacaggaggcttgtctagattggggccaccctaattcccatcccaaaggcggtattcaggacatgcaggatggactggtgagaccgaaggaaacagactgcaggcctcagacggagaatggcaacagaggggaagtgacaggcacttcaaggacaaaatgcacagggctttggattcactcaggggtcttctcacagtgaaatgcatgacccaaagtcaagatgctggactgcacttcccaggctggccccagacctccacatcctcttccttatagtaacgtttggcatgatacagcgtgctactgtccaagtgtgtacatatgtgttctcctggcattgccacctccttccacgtgggtaatgccctttaccccatggaaaaatgtggcaattgtcttgggggtacttggccctggtttagggcttgagaaaaggccagtcccttaactaagaaccaggtgcagctgtctttagatgcccttgttctgatgtcccactttccccctcctctaaggtcctgtgagctggggctagatctgtaatcccacatctctttctcaactcagcaggaaggacttaaagggcctggctttgttgtaaagggtaaagagaggaagcaaagcaactgcaaaggtactgtttacttttcattcaatgccaaagccaaacagaacgtgtttgctctctgctgaacgccgaggaatgggagagtttgtatttgaagctcatgaatgggacagagtaaatgttcccggagcctcacgtccgcagcagtgcgttcagattgtgctccaagtttaccaagtactttcacagacattatctcatctgatccccaggtccaccctatggggatgcttgtggttcccatatcagagatgacccagtgccctggagctggaggcagggtctaaatgggtgtttctttaatgaagttactaaggccaagtgacatgccccgggt

SEQ ID NO: 29695 - DNA, 1604 bp, Bovine  19866881089273
cttttgaagaaatgatctgatctaatgatgttactgtagaaatacatcacatattttaacatcagtaagatatgacattcaaggggagagccaataaacctttgcattttaaacccaaaggaacacatgttggacaccttaaattataaaattcaattctaagcaggaactgttactgtgtaacaaatactgctcatatcaaaagtgctggtgacaaggaattcaatatgccctcccacggaatctgttcacatatgtatgcgtatacctattattgtaataagattttaaatgtttaaggtgcttaaattttgcactgcaggactaattcaataggtattcatctgctacctctttgtagcagctccagttacagtgagtgatccacaggcaaaagggcaaaaatgctgttattttctggaatgtggcatttgtggcgctggagtgccctctattggtagtgaagaggacacactcattagctgccccgcatgcatcttctcgttaacccggagttcacatccatcctgcagcattcgaactgctattcgtgcaatgttcttagagtcatcaagaccactgtggggccgcccgtcgtaatccattccgagtttttcaagcattattgtcagcttagtttggcttcgaggaacctgaaacacgaacagctcagtgaataattctttagtattttgtaagtctcaatgaagtggaaaataagaggccgaaaattaacagtaataggcaaaatagtaaaaatttaggcaaagggcaaatactcctagatcaaatgaagcaaataaaattctcagacttagaaaaaaaatgatcttagagttttaaataaaaatatacataaacagatggagtccataaaacaaaaagtttgcagcttggtaacttaattatttatgaaaggaaatacattgttctgaacagctaagttgaagccctactgttttaacacaaactgttttgcatggtatttttctgtaatgtattattttaattgactgacagtatttataatttttatatatcaaatgatactatcaccacagggaaaaggcagcccacagaatggaagaaaatatttacaaatcacatatatgaaaagggattaacatctagaatgtataaagaattcttaaaatgcaacaacaaaaaaagcaaacaatctgattgaaagttgtgaacactctccacagtcattagaaatgtaaacactgaataatgattataaagctaatgtgactgggttagaaagatgcagggaggggaaggataggcaggaatggtcgctttttaatggagctaaatcttcgctgttcactgcatgaactcaacagataactcagactgaaaactcaagaaatagcataaatatataatttagaaataggaaggttaatatgagaagaaatagcttaaaaaactgcaagtgtttgggagaaatggaaccagtactggtaagagccatggggggaagactgctatttaagacctgcagtattatttagtattttaaaaaaattcatactgcacacacatattaattttgctaaaattaaaaatcagtatgaagtggtttgttccagaagcaa

SEQ ID NO: 29696 - DNA, 666 bp, Bovine  19866881136769
aaaatgccttctttatttttattagggaatacttctactaaaacagtctctattttgtctaccgtgacatctctactggtgagggtaattagtacccatgccaaccatgttttgtttctctctttgagaaaaaaatttttagtagaaaggggtatgtgtaaaaaagcaggtggtaaaacttaggagttcagtttagctcagcttagccaccctcttctgaactttggtttctcctatatgctcgcattaagtcactaggctgtgtttgactctgcagccccgtggactggagcccactaggatcctccatccttggcatttcccaggcaagaataccggagtgggttgccatttctttctgcagaggatctccagggatcaaacccgcatctcctgcattggcaggcaggttctctaccagttagccaccagagaagcccctggtttctcctatactcatatccaaaagacccaagtttcctgcagttttccgtatagacaagttgagggataaaaaaaggagtgagtatgaaatcattttgctatgagtatgattcattattaaaattcaatttagaagcgaaattacaaacgtgacacttcagtatagccttgtaagaatctaaagtgattcctctgtctttccaaatgaaccaaactttacag

SEQ ID NO: 29697 - DNA, 1175 bp, Bovine  19866881161410
gagccccacagtcgtcggctgtccgtaaggttcccagggatacctaacgtgatgaagtgtttctttgatgtttctcagtctcagtctttgctggattcttggggctttgtttccatgcaggcccttctagcaaatagaaacatttatatcattatgtcccatggcattgctgaagttcaacaaacagcacttttgaacaggagcagatttgaatggctagcatttatttgcctgggtgatgataattagctctataatttacttctttgtcttggttagtgctgagatctctagactgggatctctaatcccctggactgggattagattccctaatcattcaaaggaaaattcagagattatctctacttcactgtggatacgagcatctgaaggacgtgtgtgcatgctgagttgtttcagtcgtgtctgactttttgagaccccagggactgcagcccaccaggtttctctgtccttgggattctccagggattgaacccacgtctcttacatctccagcaccggcaggcaggttctttactgctcgcactgcctgagaagtcccatgctctcccctaattcttgaatacgaagcaacagctcttacaaatccttcattaaataaccatttagctatcaaggtcatgaaacagaatgaaatgaaggacttagtcatttaaagctaggctttatttgtttatttttaaaagcaacattcattgtcactgttataactgcttctgctgacggaaagggaaatatcactacctagtttctttctgcccgagtgttagagtgaagcgacaaggtaggtgattaaatagttaatcccactgggggactgtaagtaggagaaactatgggagactcctataagttaatgattactcaagaatccaggcttgcttgaccacaaaatcaagcaggcttgcttagcaacaaaaccatgtagcaaaggtatgagacatgcccccaaacaataaaacaagggcggcatgagccccacctcctgcccagtgaactcagtgagttaatgatccttaggacataaaaaacaatcatttgtggacccagtttgaccacgtagggacaaggaaactctcctgcccaacctggaggcaaagctgatgatggaaatatgatctctactcaagaaagacaaataaattctt

SEQ ID NO: 29698 - DNA, 1428 bp, Bovine  19866881239827
tgtggaggctccatgctgtttgtgggatagataagttgttgatacagcaaaccctcctcctcctcctccctcccttctcttcttctaaccttttctcctctcctttctcttgggggcccccttggccttgggcacagaacccaaatgttttaaaagatggttaatatttaaaggaagaaagtcaggcatagcccaggcgatgactggttgctcaactgacaaacaaacccaccttcttctgttatttcctaagccagcaggaagcagccaggagactgtcacctcgcagccacgccaggcccgccggcctccccacccacgcagcaattgcgaaatgttgctgcaaccacctgaggctataaatagtctttattaagaagccacgttggggactgagcaggcctgatgggcggcccctatttgctgccccttcaaacaagtggagaaaaaaattttaagtgtcacttacaataatccaaacctggggccaagccttctaagtctactttggagttctgtctgcccactcccctggcccccaccccaggtgccaactaccttttagagtctctaaggctttctgcttattgttggccaatatgaaacttcatcttgctgatgcaatgatcgtaatgaagataatgataacgaagtagtttttttagcagattttcctttccccccaaccattcctacggcccccatacttgtctctaatctcatgtgcagagacctctatagtgttttccataccaattcatgccctctgccctccagtctacaagctcaattcttctacacactccctttctttcatggtctttccctgttcagaatttttcagtgacttcttgtatggaacagtagcctagaatgttttaaatgcataccttcgttcttaatgtatataccaatttactactctagattctgataaaatattaggaaagcttattttcattgttcatcttttggcaagcacaaatagcagttctaatattttttccctgtcctccaatggatcattttgcataccccactgtggaaaccactgacaatggctgagatagcatcattttgctgggtcactaaggccttctaagacctagtcccaggtcattcattcattcactcaacatttcttagtgactgtgatggccaggcatgggactaggctcagggcgtaataataagtaatcagagccccagcagatcaggagcttacaggccagtggaaaaggtagactcgtaaataaatagctcctggagagacatatctatcatcacagtttgcacaaaaggagaatagggaaaggaaaaggcttcatgaggactactttggctgggtcttgagctaggttttcatttctaaagtgttttccttcatatggaaaatggtgcagatggtcaccatctctacgatgggtc

SEQ ID NO: 29699 - DNA, 3175 bp, Bovine  19866881324289
ttgtcaggttcacttgagtctgggctacaacaaacaaaatatcctatttatatccacagactggttaattggtcaaatagatactgatgttagttactccagtttcctcttgccatggacaaacagataggaggctcaactgaagatcacgtggcatcaaatgaacaatgtttctcccttcagtccttcactcacttaccactttatttggataaacatgaaggttgtaagtggatagtgccagcaaccttgaggaagcagggctatgggcagtgatctagaattagttcaaagttttacttcctcctaatttgaattcttgattcctggtgagatatataatatatatttatagacgtactttgtattcaattgctagggccactgtaacaaaaatagcacagcctgggtggcttaaatgcacagtaatgctgtaggaagacttcaagaaaaactccatcacccaatcagggtccagggcaggccaaactggccttcactatgcttatctcccttcaaaaaatagttatacatacacacatgtatgcacacatcagtctctgttatacgttgaattgtgtcccctaaaaatcatatgttgaagtcctagcctctagtacctcaggatgtggatagaatagggttgttcagatggaattagttaagatgagctcatcctggagtagagtgagcccttaatccggtatgactggtgttctcataaaaaggaggtatttggagacaggcacacagagataaaacattatgtgaacatgaaggaagagattacggtaatgaatctacaagccaaagaatgtaaaaaaaaagaaaaagaaaagccagcaaatcaccagaagctggagagaagcatggaagagtccccagcccccatcacagcatagaaggaaccaagcctgctgatacgttgaacttggtgtgcactacatacatttgtggcatagctgtgcaaacatacattgtggcattgcctttcaaatttgatttctcatgtatttctatgtttttttggcaataattatagccacatatgcacgcataactagcacatgggccagttaaaaagcttacgagatgttgtttatgatttcacagaatttctcccgtttttcacagttgatagtgtcatttacttcttcattttggtttagaagttttatttattccacacgagtttagtttcaacttgggcgatcatgtatcgtcagagcaggtgctcatgctctgggtcaggtaaatgatagagatggctcatctagaacttaaaactttctacagccttgtggtgactgggaaaaaccttttatggcttttctggttggcctcctcacagcaaggcgcccatgggtaacaacggaaatgctgtgataatatcctgccagttctgatgaggcctgatctcatctgttctttgaagtccttcatggagaagctgatgggtgcagagtagctgttacatgtttcctggtaccagtccttcagagaactaatctagattaacttcttaccaggggtcaggaaagcatcacgtctgttcaagagagcaaaatacacgtctaaggaaacagaacataagtcctcaagtattctagacagcctaatccaccagaaaacagtggatgagtgtaggattacaaatagcgctctgtgtgctcagtcactcagtcatgtccgactctttgtgaccccatggcctataacacacgtggctcctctgtccatgagattctccaggcaagaatactggagtgggatgccacgccgtcctccagcaaatcttccccatccggggatcaaactcgtgtctcttacatttccggcattggcaggcgggctttttaccactgagccatctgtgaagcccccgggtacagatatgagaataccaagtgagaaggcacagcacccatataataagagacttcacaaatattttttcaaaaagagaggtagttctgatttttaagagagagtgttaatgcactttaaatgttacttattattcaaatacagaaaaaaaaaaaaaaaaccttcaaagaacttaggtaccccacacacctatctgctagcttccacagttattaataattattataaattaattgtttaataatcaccatcacaatagcagtcattagcgatctaaaagttttgctgaagaattttacaaatagcaaacaaagcattgaggaaaatggaaaaattaactgagataataagctccaattccagcaacaatagcctgttacattatggacactgagggtcactgtagactcttttgtaaggaatccaggcgtctggcagagtctccaacagcgggggatctcaccctcccttgggcaacagcccagagccctctctgcaggacttaagacttgatagtttgcctagcaatttctccccctgcagttgctgtatgtactgcatctcttagacttctgtctgtgaacctctttgatgaagcaaaaccccttcaaccatctaccctacctggtagctctgaccacaaggggaacttgcctttgctcattctttctgtccggtgttttgacagacgatgcctttccagcaacccaactgctcagaataaagaccacatcttcttttctcctctctctttgtgcttggcaggaacagaaatgtgtttctcattatttggtctgttttacaatgtacgttcctgctggggttcattgctgtggggattactaggtatttcatctcatacaagactggcccttccttaatgtttaacagcagcagtccattccgagacaggaaatcctgaagtgctttgctgaatttaaagactcaaccaaacattaaggttcagaagatctttcctgttttttttttttttttttaaggtgttatttccttctggctggtgtgtatatgcattatgagggtgttgggcagggtatgagggtatttgaaaaggggaggtgagtggtaggaagaacccagagataatttgaaggttaaaagccattatggcataatggaaagaagacaggccctagagctagaagatcatcccaagtctttcttactggctcttggaacagctagtgactttgggaaattgactttaccttttgggtcttactttatcatctgcaaagaagatgatgtaacctactcctgagggttg

SEQ ID NO: 29700 - DNA, 930 bp, Bovine  19866880347742
gctggccgcttagggggcaggcccagaccctgagttagggtgtggcacgtcgagtatccagtggccctgggtagaagtcctacagccaggagcccaccgtacactgaagagagaagggaaagcttcagttctgtcctctcccatcacctgcccctcaatctgaagatgagcacaagccttcaggaataccccttctgttaaacacccccatccatccctctccccctgccaggtgatggatggtaagactcagttcaagcttttttttccccctgccccccaccccggctttttctcaaacccaacctaattgtcaccagggttcctaagtaattagggaatcccagcccttgcccacctagtgttcttcttcatccctaggttctgaggacgctcaaggctcagtttgaaacagttacatatctctgcccgacctggcgggatctggagatcctctagtaacgaaaacctgtgagctggtgaaattcctgcttggtcacgtattatttttatttttcagtaacttgacaaacttggactagatcaagaaaccttctatgggccaagcctattctaggtacacagcgtgagtcaagttcagttgggttttttccaacagaaaaaatctgtgtttggacaactagagcttaaaatgttatgcaaacaaaagatgaacctacatcagcccaggagaaaacttgatagacttgctactgaaataactttcagtgactctttgggggaaaataaagccacttactgcagctctagtgttgagggggaaagctgaagtgttttgaaggtgtaattatggggaaaagtgaaaacctaccagcattctgtaatcaaaaaggccagaggtggaaggaggggtttggaggagataatttgctactttgttcacagcatgagaacacaggaagtgaaatg

SEQ ID NO: 29701 - DNA, 1726 bp, Bovine  19866880362119
tgttttgcgatccccaagggtggctggaggaaaaagagttgggaatgaaagtttagcagcagcaggagggaatgagtggttgagggccttgggcatactcgccagtggacctcttggccagtcagaagctggaccgtgtgaagccctgctcttgacaaagcactgtgcaataggggctgtttctcccccaagtctggtgacctccccgaccttgccagccacacttctggtaaccgtctcctacgcagagagcaggaatccttaaagccaaagtcttctgacttgcaccggattttgtgtcccttcgaagagactctttcccattgcctgcatgccaagcaaacaaaccagagtcccttactgccaaggctaatcacaggtgtcttgtttcatttcaggatgtggttagtaccttgaggaactgcaagcaccagagagaaagccttagacagccaggctggattgagagagagcagatgcctgggaagagctcagtttaaccccaagtctctctttaggagggaacaaaggaacaaaagtgaatcacaccgtgatgccaagacgagggagttggagtgacccaggtgattctgagtgagtcagtcagggaggccttcctggaggaggtgagtcttaagcacctggcagcatctgataactaagttttgtaggcatatggtgttttattgtgctttacttcatcttgcttcacagatacagcgttttttacaaattgaaggtttgtggcaaccctatatccagcaaatctatcgctgaaattttcccgaagtgttattttttcattacagtatatactttttttttttttggaaataatgctattgcacacttagtagcctatagtatggtataaacataagttttatatgtcctgggaaaccaaaaacttgtgtgacccactttcttgccgtggtctggaactgactgcacagtaactcccaggttatgcctgaaccatgcctttgtttctaactgtgctccctctttcttgttggagcggaaagtagacagacaggtatcaggggaggtgccatgttcagatggttcaacattgttgtagcaaacactttcccattctgcggcgctcggtctgtgcttagctggggcagttgcagaattgatgagatgtcaagttcaggcatcaaccagcccagcaacccctagacaggacaccgcctctacattgaatctctgtttcctccttgaagccgtcttcaagccagcggggtactctccttgtctgtgctcttactcagttcgaattgtattactttttgaatagataatgttgtcagtgttcaaagtgcaaaagggtatttagaaatagatttttttcctgttcctattccctcctgggaccggtgctccctgaacccagtgccaccagttcttggtagcactccagctagattttaaaatctggtggggaaagaggtggtctcacacctctctgtgtccctctgtgtcctggctaggatgaactgtcccgcctcatcacccaaggaagttcccctagcaccacaccctccctcctcatccgcactgctgctatcttgggtcagacgcccctagttcctcttaactggtcatccggctgccactcgggtgcatctcctagacaccctccaccagctgtcacactactcttcttgtaatgttgggctactaatccttactgctccccatacctcgggtcaagggcaaa

SEQ ID NO: 29702 - DNA, 1532 bp, Bovine  19866880410052
tgcatttttaatgaagcacttgagatgattctgctgcttaatagtgtagtgagagggtgcaccggagcacagagaagggaaagcatggggagaggattctagaaggatgctggctatcatccttattgttacccacgttttccttcttgcttcatcccctctcctttagctgctttctgagcaaagactgccaaggatggattcccgcccttaccccagtgggcaaagccagcttgtctggggttccttctccagccaccagccccactgcagagtgcttgccagagtccccactgtattgcgggaggggcatgagacaggaggtcaggcagaggctggggacacagctgcagcagaccagggctccgtttcctcccccagccctgggcctctggggcagaggaagcccaggcaggaagaccagagctgccaccagtcagtgaggcccatgaggcaccccccaccccccagtcatcctgccctcagagtctcagcatcatggatcttcatttggcatcattcttagactaggggccttctgcagcctatatggccctatgcccagccctccagccttaccatgttacgccagaagacagttctcttccctcatgtctgctgcccctacctgggcattccccaggcacacacctgctacttgccaccattcagaaagttcttcttgctgtctgacctcggtccttctttctgcagcctcagccctaatcttttcattctaagcctttgagagatgaagatggggggtcacttctgaagcactagctggtctgggacttgagatgggactatcatagaccagaattactcccctaataatccccaccaaacttttgaaaaaaattcaatcttaaccaaccacagaaggtcaaacattcaatgtctaagtatgtttcacttcccttccacatcactggccctacccccactctttcccaggacctcaaaggacagagagaagcaggggagtggctcagagaggacatcttatagtctaatgagggtgcagggaggttccttagagacagtgcggcctggcactgtccaggcttggtatggctgatagaaccccacaagctcagacatgggctgtcaccccagattgggatatggagtagaagcagcactggactggggagtctggacacctgggttgtactcctagcactgccactgaaccccatttgaccttggacaagcctgctctcctggctgagccttgatccccatcttctctgaaataaggaactgggctctgtgattcacagggtgtacgaggattccgtcacgggggtgtcccagccccaggtggctcctgcagaccctgtagcgactccagcctgccctgagaccatgtcctgagctccctgatgtgcgtgactcctgcctgttctatccagaccccaatctaaacaatcttgattcctgttcccagcttggcgggaccctgaatggcaggaagtgaagacaggagcctgtttatgtttgaggcagccaggcctgagtcggggggg

SEQ ID NO: 29703 - DNA, 758 bp, Bovine  19866880519243
cccttctttcttgctctttcttccactgctgaaagcccactggctcctcttccatctggtcaaaataacttgggaagcttgatcttgatacatccaaacaccactgacctccactgagccacccacataaattcgcatggtaacagacccagaggctgagtcagcctctacagctttgactctcccaaccaaaggacaagttttctctggggattgtacaactttgatgaaaaaaaaagaaaaaacagcacgggaacaagcagtacagagagaacatttcacatgctgtctcaatcattagaaagttgctgtatcatagccttcaacgttgcaggaaatgctatagagatttcacaaaggcttctgagccaaatgtgggttcgtgttaaagttatcgtggacacaagcctttctttaataaaactgagcatcaccagcactatcaggacactaggctctgcgggaaaaagcaggaggacagcacatgctggtcatgtggggagacgggggtggggaggggaagaagagcctcgacagagagacagatggacagagtaggtcaattaaaaatgcctcttccttcccttccacttcagtggatttttatacaactctgtgctgtgggccctcagcaaatatgccacaggtgtgtgtgtgttttcccttttcttgtttagatgaaaacaccagacagaaatgggtattaaggggaaaagcaaacattgcaaatgggataaaaataaggttttatgtttaaa

SEQ ID NO: 29704 - DNA, 1951 bp, Bovine  19866880578412
atgataaaaaaacaatgcataatccctattaaattgcatttagagagatactagggattttagctatgtctcttgattaatcagttcccctttgtatgagaattagagcccagatggtccttgctaggaccatctactcaataaccataggctagggatgaagtgaaaatgctgtcatcaagtagagccttcagattatccagggccatttgaaaactgtcagaccctgtgatataggtccctggacctggtacccactccatgttttgggatgtgaataggagtgattttctgcactgaatgcctgcgagtctggacttcgtaggcacacacgctcagaaggtatccgtaggctttattttggatccagaaccctttaaatgagtgggtttcctgtttatatctttgggctcacaaagaatgtagacccgctggactcagattggtggcccaaatagctctttgagatgccactggttagcacactgccgtcttcctgattggtcctttgtcacctttgtccacttccctcccatagctgccctctgcccaatcaaccttgtcttttcctttcagcctcctcccccgggatgccctcccaatgctgctcagctggcagtcatgcagggagccaatgtcctcgtaactcagcggaagggaaacttcttcatgggtggttcagatggtggctacaccatctggtgaagaaccaaggccatctctatgccgggaaagacatcacataccttcagcacttctcacaatgtaactgctttagtcatattaaccctgaagttgcagtttagacacatgttgttggggtgtcttttctggtgcccaaactttcaggcacttttcaaacttaataaggaaccatgtaatggtagcagtacctccctaaagcattttgaggtaggggaggtatccattcataaaatgaatgtgggtgaaccagccctaaggatcttcctttaattcctctggagtaatactgtaccatactggtctttgcttttagtaataaaacatcaaattaggtttggagggaactttgatcttcctaagaattaaagttgccaaattattctgattggtctttaatctcctttaagtctttgatttatattacttgttataaacgaaccgcattagttgtctgccttttcctttccgtcctttgcccctggtcctaccctcaacccgtgtcttccactccttcccaccgatctccattgaatcaatggtgcaggacagaaagccagtcagactaatttccttctctccttgcacttccccccacttgtcatcttttaactagtctttcacaaaggatcctctgaaacccgctctgtgccccaagcacaggacccattgcttctgcttttgcatctcaggcaaaagcggagggtgccttttggaccctcctcataggttttctcttcagacatgaaccaagcccaaatttgttttggtgccagaaaaactgaaccttgttttaacaaaggatatcagtgcaaactaccgtaaacagctcctgaaagtccctctgaatgggccaggacaggagtgcgggtgtcttggctggcaccccctccctttcgtcataccctcctgaccacgaatcacccctgcagtccttcacggagacagtgtgctttcttcttggtgatcagtaactctggggtcaccaggacccagagaatgattaacagggaagaagggacacgggtctggccagagaggagaccctatcccccgcccccgcaaacacaggccctgggaaggaccccccttgcctgcacaactgagacaggcaaactcaactgaatctaaaggttgagtcctgaaagctccctgggttgagtggtggcccagaaagtagactatctaaccctaatccagctgagtggaaacagattcccacaagagatgtctcagccctgctactagt

SEQ ID NO: 29705 - DNA, 1926 bp, Bovine  19866880589031
atgactttcttgtattatgattgcatataataatatcactcagaacattgaatgttgttatcttcttcctctgaaatttcatggctaaactgagattcactgagagaagcaaagaggttattgattttctttactccaaagttttgagaatggtagtccatatctaactgaagaattcagtctgatctcagaaagaaactaggatcctaatctgcccatttagtggtttcaacatcaggcttgtggcctcaagattcatttctgaggtaagtctgggaacccacaaatctcctaagtacaacctttctctgattgcctagatcccatggctggatttctgccttggtttcctgaagaagtgaagtaaaatttgttcagttgtgtctgactctttgcgaccctatagactgtagccttccaggctcctctgtctgtgaattctccaggccagaatactgaagtgggtagctgttcccttctccaggcgatcttcccaaacaaaggatcaaaccaaggtctcccacattgcaggaggattatttgctgtctgagccaccaggaagcccaagaatactggagtgggtagcctatctcttctccagcagatcttcctgacacaggaattgaactggggtctcctgcattgcagatggattctttaccagctgagatactagtgaagccctggtttccggagtctgctccaactcttcctactgaatctcatcctttttggcaacagttcaaatacactgtactctttcttctcttttctgcttgaacatggtccttcttcttgtcccatacaccatccccaaactgagtcagagtacattcttaattagtccattatgtaattatcccagtaagagtacctgtcagaaaaaaaaaaaaaaagacaaagagaagtaattgccttaggttcaaatagtttatgtaattgtgaacttaggtcagctcttattttcttttagcctcatttttctcaaagtaacctatagatagtaattatctgagataagaatcaaatgacacaaatttgtaaaatgcctagaactcagtggtgttcaatggggcagaacctggaacaaatactgtgtataagagtaataggaatcatctcttctgacagtggtaaagactgaatttatgcactattttatagacttcaaaggctaaaattagaacttggatcctttggaacctaggagttaatgtggcatttaagaatttgtttgactcagaattttcatatatcatcaagatggacgagtacaattaacatttacaactcttagagaggcattggaaaagtataagaatacatagaccctgtaagaaggcccctttaaatgaacaattcaaagaaatagagaaaacaatagaatgagaaagactaaagatctcttcaagaaaattggagatatcaagggaatatttcatgcaaggagaggcatggtaaaggacagaaatggtaaagacttaaaagaagaagagattaacaagaggcggcaagaataaacagaactatacaaaaatgtcttaatgatctagataaccatgatgggtgttgtcgttaacctagagctagacgtcctggagagtgaagtcaagttggccttaggaagcattactacaaacaaagctagtggagattatggaattccagctgcattatttcaaatcctgagagatgaatgctgttaaaagtgctgcactcaatatgtcagcaaattcggaaaacttcagcagtggtcacagggctggaaaaggtcagttttcatttcaattccaaagattgttcaagctacaatataatggagttcatttcacacactagcaaggtaatgctcaaaatccttcaagctaggctttattagtgtgtgaactaagaactagcagatgtacaagctgggtttcaaagaa

SEQ ID NO: 29706 - DNA, 477 bp, Bovine  19866880612949
ccacctacccctgcagggcgcgcccgttcgctcgcggcgctccgcgccgttcgccggtccgctcgctggctgtcaggccggcgtccccgcgccgcccggaccggatccggggcgagggagcagggcgccggtagggggcgccgcgccggagcgcctcgcaagcgtccccgggcccgcctccccgacgcccccaccaagccgcgcgggaggggcagccgggcagagcgccgggacgcggccgcctaacacgctggcgggctgtcagccagcacgcgggcgttgaaacccgaaaggtgctatgtggactccagggccccgtgatccttgtaaatgccaagtcttacctttttcctgaacggcagtcgcagaagaaatgtccagcaatattgcagtgctcagtttttggaatttctgacatctgtaaacacgaggaactcaatttatccgatcttggccatcggaggaaaaaaaaaaaat

SEQ ID NO: 29707 - DNA, 2279 bp, Bovine  19866880622974
tgttcattgaagccatttattttatgcaggaaagggctgcatggaattgtatttctaggaatccacacaaaccatgaaaagcatgagtagttcttcactgagctctgttgttacctggcttgggcaagtccctgttccaggcttatttcagctttccagtctgtgaaatattctgtgtacatttacagtcccatttgagagaaatgaggtaaggtgataaaaacgttgagtatatagaattatacagatgtgaagcactgaatctgcagcaaccttaaggatatcccaggcctactggttaaacatgaaataagaacttctgtacaggctcaagagatcttatccccaagaagataagacagggagtaaaaccactgtaaacacacttgatttctaagcagggtgaggtttggttagaaacggataagataaatgtatttaatgaatacaaatgtgttcaaatctgatagcaagtacttggcaagtggtccttggttaacacctacttctcctgaattcctgaatagacttcctatgtggatctggaagtcccaaagcttctttcttcaaagcttacttttctgtttcgttctaatctctttctgtttcttatctaatctgtttctgttttgtgctaatccctctattagtcctttccttctgcctctgtccaaatatctcagttgtgaccccagagaaaggagaaggaggtttttgccagtttgaatgggttctgtctaccagagcctttctggggcaagagtctggagcaaggtgtaaatgagtacagtataggcaattccttttctttcacctatcattgtatttcatatttatttatttttggtgctcgggcttttgctgtgagtgggggctattctgtagttgtggtgtgcgggcttctcatttcagtggcttcttttgtttcgagcaggggttctaggtgctcaggtttcagcagttcacctgggcttagttgtcctgaggcatgtggatcttcctgaaccacggattgaacctgtgtcccctgccttggcaggcagattcttatccattggaccaccagggaagccctctttttaaatatatactttattgtttgtttattttaattttagttgttctgtatcttcctgctttgtgtgggctttctctagttatcgctagcaggcactactctttgttgtggtgctcaagcttctcaatgctgtgacttttcttgttgtggagcacagactctaagtgctcggccttcagtagctgtggcactcgggctctagagtgctggcttagtagttgtggtgcctgggcttagttgctccacggcatgtagaatcttcctggaccagggatcaaacttgtgtcccctgcgctggcaggcggattcttagctgctgtaccaccaaggaagtccagtcctctttttaaaaacttttctggccatgccgcacagctagcgtgatcttagttctccaaccagggattgaaccccaggtccgtggtcgtaaacgtgccaagtcctaaccactgaacccgccagggaatcccccagtgtaggcgatttctatggatgatgttgatgatgacgaatggagggagagtgattttcgcaggcaagagtcagtttgtgtagcattttgttgtttttctgtatgatgtatagtgtcccagggctggcagcctgctgtgaactaagaaaactgtattctgtagtctctctagatatgctgtgacttggcaagggctgactgcgtaccgtgcacctgcatggccttttcagcttgacaaagaatagtgtctctctccggctccccgctccctccacaggaaatgctcccagacgactgcacaataagccctaattaagtctttcctcgaatcctgatgtcttttcctccaacctttccttggtttttgatgtataattaagaggaatgtggagaaaccaaaccaggcataagatgcagctgggattgggtcactacctaatggcaagtaaagactaaaacctctgccctggcagctcttttgacagtttaaactgggcaagaaacatggtacatagatggagaaattaagatgcttttgatggaaaaattggttgcaattatgtgagaacatttcctcagaccttttgagttacttgtgttgcgtgccttttttgtctctgaataagagaatctcaatgttttccagccaatatttaaaaataatacaggtaaggtggttagtgcttccctgggcaggctgtgaacacatccttacaatgagatgcaaaa

SEQ ID NO: 29708 - DNA, 733 bp, Bovine  19866880714872
actggagaagcagctgctgctcctatgttattttattggggtcactggggaaagggtgggaaaggattgtagaagtattttttaaagggccaacagaaccaaggagaccagccccagctcgatcaggggacagtcttggggcagaggaggctgcatcctgagctttctgggcgttcggaacaaagaactaggatctcataggaggagctgggtaattcaagcagcaattcacgtagggaccagaacatcagtttgaacagcatgacaaagccccttcctctcttctgagctccaggcagggttaagctcaccttcctcagcagttactctgataccccactttggtgtatcatagtaatacagttggaatcgtcagctggttgagtctagagaggggctgagagtgtctctgcttctgtacaaaacccctaagatctataaaaattcagcctaccttccctgaccccccttttttggtaaataagttaatatttgacatttttgttctctgacctgttccccacactggggattcctggtcttaacttggaagtgtttctttcacacatttttaggtactagagttaaacttgtctttcccccgcccccgctttgtcctttttcctttgaagggaaagagctagattggctgggatgtggcatcaagagctagtcttccctttgtgtctaaccgcagctccatcaggcagcttaatctggggctcacacatcc

SEQ ID NO: 29709 - DNA, 1784 bp, Bovine  19866880728339
ttataaaatgatactaattaataaagaactttcaattcaaagctagaactgatagcttataattaatatcagggagaatgaagtgggaatatatagatggagccaataaagaattttaaagtgtgaaaagaagcaccagaagaagcttacatctcatgtataatttgttgcattctaaaggtttttgttggacaatatattttaaggggagatgtcatagggataaacaataagctgagtctgggaaagaggtatatgtctgggttctcttccagttcttttttagttatttttttttttcaaaagagaaaatgtggtccctgaagtttgtttgtttttatttaaagaggagattttgtgagcctatgcacagaaataaggaacacagtcattcttggcaaagacatgggcagtgaatggcagagaggaagcatgcaaaaaatagattgtaatatataatcccatttggtttctgagttaaagtactcatttggtattgaaagccctccaaatgatttattatcttggtgggagagaaaatattagaaatacttatcttctttttttgctggttgaaattatctatgatgacaccaataaacaggttcaaggtgaagaaggacccaaagatgatgaaaataacaaagtaaagatacatgtatagactttcctcatacttaggctggagttccacctaccaaaggagaatactttttagacattataatacatttgatgctggaagtaattgttgctttttcatgagaatagataataaaatttttagtaatacttaagcagtacttttatttcttataaatcagctacttctaaaaataatctctgaaattagcctttaggataattttttaagtaaaaaaggaggtgttatgtaaaaaaataccataaaatgatttagaaattattttttttctaactacaaatacaaccaatatgttgccatttgaacagtagtatactaaatttggcaatttttaacatactacatttttataatttaaaaattactagtgaaaacattttacatcagtaaatatgtatagattatgtttagaaataatcattcctgatgtgtgaatttatttagcaaacaatttagttatttatttatttagatgtttgacatctaaataaataggcagtttgacactgcctataacagtgtaacagtcactgaatttttcagattaagtagacattaactggcactagtggtaaggaacctgcctgccaatgctggagacattaaagacttgggttctatccctgggttgggaatatcccctggagaagggcatggcaacccactccagtattcttgcctggaaaatcccatggacagaggagactggtgggctacagtccataggattgcgaagagtcagatccaactgaaggggacttagcatccaactggacatgccatctgctaaatcctcaaccagtaatttaatctctagagtgtactcatgagaaataagcatttgagcttttacttagcatgtaacaaagacataaatgagtcactataagacaatgccctaatatattcatgtcctcctaaagatattagagttaaaaaccaaccaaacacacaaaacaaaataacaaagtaaaataactctggaggatatcaggaaggtactcaacacaaaactagaatcatttatggaaaatgtatatcaggaaagataaaagggagcttcttaggtcagtttaaagattatgggggcaaaggtcatccatcatgtttataggctaaa

SEQ ID NO: 29710 - DNA, 666 bp, Bovine  19866880735037
cccccacccccccaactcccgctttctttagaagaataatcagtgtgaggtggtatccttggctgaacatcttcctccttccaggtccttccacacctctttgctggccaggctgagagcggcatatttgctcctttccaagctgtgtagagagctgaaggtgccggcagcctagtgcctggggcctggagccaacgagctcgccttctttgggacggagaacacaaaacagccctgggaggggagagcctgtctctgcagacagacagctgcctcagggcagtcttgcagccgcctctgcagccaattccttttgtaatttgcacaagagaccagaagatggggctcttgaccctggagtcaaaagccagaggctctgactttttctacatttgaactggagtcaaatcagacttgtagagctcttagtagtaatcctctccctcctgcttcttctctgtgccctgacaactcgtgcccactctcatgagagcaccatgagctggctctttagggagtggcaaatggagggcacatctttcttctggtcaccatccttggcccctccagaaatgccatgttgccagtcagcctaaatgaccccctgcctcagcttcccccctttaatccaccttgcccccaaggcagatttcaccaagggtacca

SEQ ID NO: 29711 - DNA, 2438 bp, Bovine  19866880741969
tgagcagacctgtcttatcccagtgacttatgtagttatggcatcttttcctttcgttacaagggacacatacttagtttacaattgttggagccctgaaggagcacggtgcttttccacagttggacaccacactcttgtatcaccaaggtgaccatgagatgactgaccccatagagaagggactaaagtccttaaaagatctgaaggggcaccgtgtctcttgtctttaaatctcagaaacctcaatggcctcatggaggtcaggaggaaggagcccaacctagcttttaccagtcagtccaacacaattgtttgctggaagatttcagagacctttgtaattaaggataactcccccttagatctaaatcaggttgtttttgtaggtcagcggttcttcaagccacagtaactgagggctcatcagtcactcagtcactttcccctgtttgggtgtgtgtgatgtcatcaaagggtcatgattgaactcagtgaaccaggatgtatgtggggtctctcacatttcatgtggtcaattgtttgacctctaggacttccagctgactctaactcatgaaatattacaaggaaacttgtttcagctagtcaaaaaatgactgttgctattacctctctagtccagacaggtagaccgagccaataagcaggaagttcaagaagccaataagtacttcttcattgattcctgcattgctctctttgtttcctttatcatcaacatctttgtcatctcagtgtttgccgaagcattttttgagaaaaccaacaagcaggtggtaagtaagccagggacctgggtagtagtgaatgtgagggtaaggaggaggctaactggggcaggaaaacgtgacagtgacttagagctcaggggaaatggatctcagtgctgcccctaagtcactgcgctagtcaggcttatagtctagggcagtggccaagtccacacccatcattctcagctttggactgggaagtcagataaagactgcctcatgctgtggtcagtggcttcatgtctatttgctctttctcatccccttttgcttccaactcctgactgctttccagccctgccatttggtgatgacaggttgggaggagtcaacacacaggaaatagaatctgtggctagacagactgttttatcacgctgaattctctgtcctcttgactcctgattgccaacctagttttgatcactcctttgtttcccatcgtaggacctctgattcctggctctgctttgaataaggactctattctgggtgtcctttcatatttgaagccttctaaggaccctcacttcatgtcaccatttaaattgacctaacattcatgtattaccatgcatactgtaactcaggaaaagtttttgatgacctgggagtgtagaaaaattatcaaggaagacctcaaggccattgctgccagtctctgctgtcatcaatccatgcccagtgtctcaccttcagcatccatctcttagatgacctgtgtgtgatctataggagagggcttcttatctgagtcctggactcaaaattaaaaattgttcctaaactgctttggttccaggttgcggtctgtaaaaacagcagcagtgcccatgctcaccttttccctgatgataactcaacactgactgtggacatctacaaaggggtaaacctgttcagatttctgatctctgctcctggatcaatattcttagcataatatctggtctttgccgtgggttcacttcagagctcagcatatcttctctgaagtgttgttttttttcagaggtccagataccagataagacttttggattatgtagaaggaaatagaagatctgctgaaaagatgagttaattgaatcagcaattcccaaacttgtgctgctataggcattaattggggtgactagagaaagtgttcttagtaaagtgatttattttttatacttgttccccacctagccccagtggctggacactttatttatttaggccgtgctgtgtagcatgtgggacctagttctctgaccagcagtcaaacccataccccctgcactgggagtacagggtcttaaaccaatggaacaccagggaagtccctgtagagtcatctttattgtggcctctctgtccctttatgctggttacattatgaatttccaagagtagaatatgtagcatctccaaaattcatttgtgctttctcttcattcctattaccatcttccagaatactgtgttaaggaatataatgtgggaaatgtgttgtaggtttttttaatagttaacatataagttgaggataaaggctttaggagcctagagaagagaagggactaggctgaagaggaatgggggcccatccagcagaatttaggttgaaagcctctagaatggggtcaggacccgagt

SEQ ID NO: 29712 - DNA, 1088 bp, Bovine  19866880757236
accaactcccagagttcactcaaactcatgtccatcgagtcggtgatgccatccagccatctcatcctctgttgtccccttttcctcctgcccccaatccctcccagcatcagagtcttttccaatgagtcaactcttcgctagggtggttaggctgcttcagatgagaatgcagcaggaaaatactgaactagcgccttatagagtatttaatgagactgtgctttgactaatccttcctgattctaaatttctctagacttagcattctttttctgtaaatttcctccttagttcagtaacacttaaggtaaagtgagtcagttccctatagaaagaaaactgcaaagatatcttggtaaccctgagattagagctttgtggttaaaaataaccatttgatggctacacacactgagtttcctaactttcttgtcccttaacacttttctctcagaccctctgtctccctgcatttaaaatgagcagcaaaatgcaggaggaagggaaacaccgatgattagtctgtgatgaaccctcctgtcctgagggtgataactacgctcctccccaagctgttcactgcagatcttagtcagatggcaaagggttcctgtttggtggtttccttgcagcttctgattttagcctgaaatgtggcaggattttgcaagttaccaattttgggggaagcctgatggagatataatgtccaagggtgatcctttgagttcagttcagtcgctcagtcgtctccaactctttgcaaccccatgaatcacagcacgccaggcctccctgtctatcaccaactcccggagttcactcaaactcatgtccatcgagtcggtaaatcctaccaaataacggatggagggtggaaagggggagtgtcccattagcctatttccttctaaaagttaagattttaggttatcagtgaggctagtctgggggatgttatatattgagccctagacatcagtgattttagaagaaaatgaaatgattctaaaaattggcaaatgataatagaagtgtgaaagtagggggaaaccgtttgtgagattaatgttgaaaactgatgt

SEQ ID NO: 29713 - DNA, 2444 bp, Bovine  19866880767225
tctcctgaaacgttcttcctggatgtctgatgtgttcaatgaatagagaggattaaacaaaccaattaacctcataccaaacaagaaggcaattagccttaacactcctgtctttgcaaacttctgaaggtcacacagactttttaacaaagaaaaatatgatcattttattaatgtgatttgtcagtgtatccaaatgatatagattagatctatttttttagttgtacaagtaatgcatgctcactgtacaaaatgagaaaataaggataagcaaaaagaaaataaaaattaataccccagggataatgaatataacatttggtgtcttatatatgtatgtgttgtattttaagattttcctttcataaaaatggaatcaagctatactcaattttgcagtggtttgtaacctacttatttcacttgccaatgcatgctgaacatatagattcgattacaggggttcagtgtgattattcaggtacctttctttgtgacctacattaaaaatcctctcctaaaaattcttcattttctgtttttggcatctctttgtcatgctttcaggtggctgaagtttgaagaagatgtcgaggatgggggagaacgatggagcaagccttatgtggcaaccctttcactgcacagtctctttgagttaagaagctgtcttattaatgggacggtccttctggatatgcgtgcaaatagcatagaagaaatctcaggtaagattaggggagagaaagcagaggatcgtttgtggtgtggtgtggaggaaagaaagaagaatgtggctgtttgtgcttgggcaagtcacttaccttcctgacctcagcaccttcagctctgggatggatttcttccctgcctattccacaggcttgttctgggatgcaaatgacatggagtgtggttttccatttgcctgtttgtttagcaaatattattttctatctatgcttgattatgtactaggcacaggatacgatacagtttctaccctcaaggagctcaccttctagtggggaaaatgtgtgtgtgtgttattctctcagtcgtgtccaactctttgcaaccccatggactgtagcccaccaggctcctgtgtacatggaattctccaggcaagaatactggagtgggttgccatttccttctccggggggtcttcccaacccagggactgaacccacgtctcctgcatcgcaggcagattctttaccgtctgagtaaagatgaagcttttactcagggaagtaaagtaaagtaaagggctttcctttatcagggaagccccagtgaggacaatagccatagggcaattaaaataagtgcaacaaccaagctctggtttggtaataagtgtgactgggagctctgcagagaaaagtgaaagaaagatttttcaatatggcaactaggaaaaacatgtatgaaattgagccaaaggactccccacttcttcagcatgatgtaaaggggagatacctgatggagtttcctagtacaggagagtataagtcattgtgtttggggaatggagtttgagaaacacctgggtgcatgtaaggcttttcctcggcttggctctgtttggttggacagatttttaagtttcttccagcttttcttcattacaagtatccaagtaattctgcctgtctgggatcacatagggacctgaggagaggtcttaccgatgggatcttgtgttagcaccttagttacatctgtgaagactctctttacaaatgagatcatgctcatgggttctggggagttagtatatagtacacagcatcttttgaaggggcgccattcaacccacaacaaaagaagagaggagttcagttcatcagtgtcggatgctgcagagaggtctgatgaagtaagaactggaagcatccaccagatttagcaactggaaggttgttgatgattttatcaaaagcggtttcattgaggcagccacattgcagcaggtgagaaatttttcttttgagaagaaatagagagcaagtgcatgtgcgagaaagggaaggcaacagataaagggagacctgggatggatgttcttcttctgttttttctttcccaagatgaagtatcctgaagcatgtttatattgtgggacaaggagaaccaatcaatctaaaagttaaagagagagaagcttggatctttggcttgagtatttgaaatagattttcttttatttattgcttctaacacttggatagtcatggatggagctggagttgagaataggttggagtttgagagaggcggtggcaggggggtggatatgtagggtttaagtaaaacagctatggttcttcacattaggaacctgaggtattcatgttagtgataagggtgggtaaatggtctcacttgtagtgaatcagcactttatatatcttattaatttttcacaa

SEQ ID NO: 29714 - DNA, 840 bp, Bovine  19866880839796
ctcttgcccactgccctctgtctagctccctggggtggcccttacctggggggcagcttgtacagccagtggcgtcagggtctgtgatgcctgaggctggcatggagcttggctgaaggtggcaacggcaggggcagggctcgaaggcatccccggaagtgacttcacttcatgcagcattgggagagagagggacaaggagtgaacctggcggagtgggacgactctgtgccgcactgcacttctgcacaacccgaggccgatctctggtcttccctggcccaaagagggagttcccccaaagttactggtagtgagcatgggaggctgcaaagccctatgccagacctggaaggtacaccaccctcgtcacacatgcagatgaagaaaatgcagacccaggcacagctgggtatcagcctgtcatctcctggcttggtaggatgctaggacctatcacataaccagcagtagaaatgaacatgggtcagggagagaaggtgccagaatcaatgggattgattggctcatccagcaactggatcaatggtcactctacccccaggctactttggagatgcagtgttggctcagggaaggggcaggatttctgcagggtgaagcctaggaagtgacatgtcagggccacactcaggatcccggggctctccaagataacttttctctgctgctccttgaggtctgaagtctgatgagcagcttttaggaggttctaaaggagcttccctgcagaaggtaatggcactccattccactactcttgcctggaaaaccccacgggacggaggaagtcgtggggctgcagtccatggggggtca

SEQ ID NO: 29715 - DNA, 760 bp, Bovine  19866880844024
aacatgggctctaggcatgtgggctcagtagttgtggtgcacgggcttagttgcccggcaacatgtgggatcttcctggatcaggaatcaaacctgggtcccctgcattggcaggtggattcttaatttttggaccaccagggaagtccctagatgtgattttaaaggcaatgaattggaagcagctgtcactaccagaaataagagatgaaaatgctgcttgaggaaaataattcttcctatataatacattttgaggaaagggaaagggggaaataagcagaatcctcaaagaaaaattacttatgaaaatttgattaagcaccttggcaagtgtcaaagccttgaaatctggctgggtagtttgggagtaatatttatttattaagttcacctataaactggttgcacgtgaaaggtagggcacatgaccagctggtccaacttctggaaaacgtcactcactttgaatttccgtgaaagtgaaagtcgcttagttgtgtccgactctttgcaaccccatggactatatacactccatggaattctccaggccagaatactggagtaggtagcctttcccttctgcaggggatcttcccaacctagggactgaacccaggtctcccgcattgcaggcagattctttaccagctgagctatcagggaagcccaactgccttaatcttgtccttcttcttcctgttcattttagacacccaagtccagcttcagacccaactgtatattcactgttttt

SEQ ID NO: 29716 - DNA, 918 bp, Bovine  19866880859853
tctttacttgagtttaaaaacagtgcttcatgcatttacaataagttactacgggtcactgaaatacacagagaaaagctgaacccaacttactaccttagtgtagacctctggggctgggcagtgattagtaccttaacaggactgatccatggaccaaagaaggcagccactgtcagttacagatggatcgctgcgacacagtggaggtagcaaagagtttaagatccacaggggctgtagtacagcccagaaattaagacaagggaagtgaaggctgtaaacacttggggagaaagtcaagaagcacttgcatttccttttatcttttccattagaatgttcccgtaagttattcacttacagaaaaaaaaaaaaaagtgctcaaaggatttgaaaaaacaggaagtggttattccagtcccagtgaggggaacaacagaagcagcaaatccctatttttggtcatatcaaagtgttgagggggcacccaagtacatgcgtggatgtaaaggctccagtataagcagtgctcctcccctcaccagccgggacctgtctggaacaaaaacagctgtgaagattagagcagcgagtaagtcctaggccaaatgaggattccctcctggggcaaaagctcagcctcctaggatctgaacttaaaacaccacagttaagaccagtagagaggctactgccagctccagcgaattctgaggaagttgggatggcacctctcgtgggccaccccactaggagggtttctttcatttccagctcccacgtgggcaccacgctgtgaagcccatggcacgggttcctctgtctcccagacctaacagtgcatgcagacttcgctgacaagtgctgtttggtcccacgctgctgggctggactgcaggacgccgccagccactt

SEQ ID NO: 29717 - DNA, 951 bp, Bovine  19866880888097
agtcccccgagactgagggcatgtgggacggacatccagcaggtagtggttttcattctctaggctttccagcttgcttcaaagaagaagaaatgcctctgagaatcaaaagtatctgcctgaaaacttcactgttcaggcccccaaatcaataccctagaaggtgaaatcatttgctagagaattagctattccttttgatcaaattaatcagatttctagtttcttatgggttttcttcaagtggtcttacttaattttttttcttttcatgaaactgcttccaaagaatgaaagtggaagttgctgagtcatgtccgactctttgcaaccccatggactatacagtccatggaattctccaggccagaataccggagtaggtagccattcccttctccagtggattttcccaactcagggattaaagccaggtctcccacattgcaggaggattctttgccagctgagccacttgggcagcccaatggatatttgggatagaagaaatcccaaatgggatggtacaagacggggctcaggaagggggcatggggtaacagccagtgcaaactgcactccccgtccccctcacccagcaatagaattctgccaaggtcagcagaccctgcaccacgcgatggagtctggagatttaggcccccagaggctgctccccctacattcctgggcataactggaccacattttctaccctctttgatcatccttcaacacatggtgtgaaataggcagattaaaccagccatggtctctcatcagctcagccaaccaggagaaggtgtgagcctcacaatctccataaaaaacccatacaagaggcacacagccgttgacacaatagtcccactcctggctccctgccagcttttttctctgatgaacacaggtggtccaaacccaaacaggtcccctgctgccatgtataag

SEQ ID NO: 29718 - DNA, 890 bp, Bovine  19866880958401
ctactggaaatgccccagcacagcctccctggtcagcttctcgagcgttccttcccaccatcagagcagcactttcccaggctgcctcccagcattgtgcaaggcccagaggagaagcaggaagtgaaactgggtgaaacagaaagctgcatgaacctgccaggttcccacaacatcgcaggatactttgcttcctggcagagtcatgtcttctgggtcactggaacccacctagaccaggaatccccctgaaggattttatctgtactggatttggggggcaaaaagtctccttaggctccaagccagagactgaaggcagcagctccccaaagggtggaaaatccctaagaagagaaagtctgaggcaggaggccaagtgatgggggagggttgagagaaggggccagagttgggagaacagctatggccagagtaggagacattggtgaaagaagtctgcataaggctgctgagttcaggatggtgttccaggcccaatattggtctcttagcctggaggtactgtttgtgggagtgcttaactcctgcttagcacatgagtgagtgaaagtcactcagtcatgtcctactgtttgcgaccccatggactctgcagtccatggaattctccaggccagaatactggagtgggtagccattcccttctccaggaagattttaccatcccaggaaaggaaccaggtctcccgcattgcaggcggattctttaccagcccaagaagcccaagaatactggagtgggtagcctgtcccttctccagcagatcttcccgacccaggaaccgaactggggtctcctgcattggaggcagattctttaccaagtgagctatcagggaagccgcttagcacatagtaggtcctca

SEQ ID NO: 29719 - DNA, 847 bp, Bovine  19866881034682
gagagggctgagaggacggggcgggctgggtgggatctaagtagactctcctgctgaccatgcccaggtacactcccatccatctcaagtcttcataccagactcatccgaacaaatctgccaaggagaggaaagaacccaaaagaaaccctcccccgactcccactccttcccacacatggctatttccacagtggtgatcaaacttaaaaaatcctttttttctccaggtttcaagaccatctccatggctcagtggtctttacctgctgtgttatttttcaggctgaagccacgtcacctataactatttctcactccaccaggaactgttccttattggactttctaactatgatgagtgcttcttcttctgtctgatcactgaagcttttttcttctagtcaaatcagcatttgaatgagaatgaatgggaatttcaggagcagggacaaaggtggcttcacttccttctgagggtggagaaggggagtgtttggcggctgggttggtccttttaaaataggtttcattggtgaactgcctacggagcccctctgggctggcacgaagcagcacagaagtcagaggcaccaggcactccgcaccagggtgatctctgctgggttaatgcactcctttcccaacacagcatcctctactccttccgagagctgtcactgtgctccagtggggtgaaggaggtcactgcccttagagtgaagagggaggtcttgccccagggtggccggcatgagcgcctctagccagaggtggcagccccttgtgacggaagggcctctgcctcctcccacagatgggaagcatgagttctaggaggtgagga

SEQ ID NO: 29720 - DNA, 990 bp, Bovine  19866881035310
tataacaggcctcctcctctttttttttttccctatgccattcatgtgtagaagaaagtaggtaatttgccctgtagaatgctgaatgactctcttcaatgactccactctttaaaaattgcccctgtctggacatactcctccttcttggtgtaggacatctccctcttgatctttctcatacctgggaagtggagagggatcttgaagtcctgccaccaagtcctcttgattctgcctcctaattggcacccgattctcttcccaacccatggcctccagccttgccccatgttccattcatgacactctcactggagtgatcctttcagaatgcctgcttacttatgctgcttccctgtttaaagtccttcactgcttgacacactgttgggataactttctgattcctttttataaggcccttttgtgacttagcttttccaacatctctagccttgtctattgatattacccctcacattgccttatccagtcataactctttcagcaccttgaacgtgccaagcgctctcacctctaggcgtcatccacgccagcccctctgcctcatctggtgctcctggtccattcttgagtcccagctgaaacgcccttcctgttctttgcggccatggcaccctcacaacactgtctgtcctctgtgccagactgttcaccctagagagaaagggctgtgtttgccttgctactgttgcgtctccagcacctggcacagtgcttggcatgaagtatctgttactacttggcaactgcatgaatgattatgctgatttctcaagtaaggtgggtagttcagagtaagaatatacatgtgataggggctttttatctagaaaacatataataaaactaacagttttaataccatgatagttttgttcattgcttcctaacagctcagaatttgaagtttgaagctaatacttcatttcacgttaaatttggaaactttttatgaatgggtgt

SEQ ID NO: 29721 - DNA, 1142 bp, Bovine  19866881070905
cccaggaaactcttactggtttcttttgattctttttagaaacatagggcagagaaggagtcatcctgattttagcaagtaccataaatagtaatttttcattatattatgaagaggttaaagttattttaaaagcaatcaacttattgagctttctctgtggttctgatagatttccagtggtctctcttgggttttctaggtagatagaatatcaacagcataggatttttgcaaagtgaaaagagttttggagtgagacctgggattgaatcttggctttgtctgattgaatcaatcaaacaactcagttgctcagtcatgtccgactctttgagaacccatgaaccgcagcacgccaggcctccctgtccatcaccaactcccggagtagcctttaaaaaatgttggcactctgcagtggcagcccataagtacagagggggcctttcctccaggtgcggttggcagagtgggcagaggccacaccctgccaagtgctgctcctctgccctctcctgggtttgttttacctgaatctgcagatacatccggagggctttgatctcaggcatttctaaacactcagccatcaggagagactgaaggggaagtcctaaactaatacaatcatcttttctttctccctgaatggaatgtgtgttatatttgctgagggcagattaaaatagattttactgttgaaatcatggatttatagttctttaaagagttgctgattatcagcaaagtctacaaccccaccccacctgcaacataacagtgggaaaaaaacagtccagcgcggtgggaatgtgtaaatgttttctcacacatgggacctactgccagataggaagatggtggtatttggtgaggagtgatactaagaaacacctatagttagtgaggaaaaaacccacattcttacttactcatagaattttataagtttgaagggatgccccagaacatctctgatccctttttgtactccatggaaaagatgaatggggatgtagcttatctagtttattggaccttcaaggaacctgaatgcactcctttacatctgacaccaccaggaaaagacaggcccgagtgtgtgcctgattgaagtgcatcctccagactgcaggaag

SEQ ID NO: 29722 - DNA, 877 bp, Bovine  19866881088538
taaagtctgacactgtttccactgtttccccatctatttcccatgaagtgatgggaccagatgccatgatcttcgttttctgaatgttgagctttaagccaactttttcactctccactttcactttcagcaagaggcttttgagttcctcttcactttctgccataagggtggtgtcatctgcatatctgagattactgatatttctccccacaatcttgattccagcttgtgtttcttccaggccagcatttctcatgatgtactctgcatataagttaaataagcagggtgacaatatacagccttgacggactccttttcctatttggaaccagtctgttgttccatgtccagttctaactgttgcttcctgacctgcatataggtttcatttaataacctttcttaatcaaatgctatcatttgttgaaagaaatatctatctcataggagaaatacgccccccccaaaaaaaaattcccttgtttttccatagtatgcaaataatagtttcttaaaagtgtttagtttgacttcaaaaagtggaaaccataagtcagaccataattaaaaggagattgctagagaatttgagtgtgcatttctcattccaagaaatcatttttacttactctacattctttgtccagtctggaggattactcaaggtcataaatacacagttggtcaagatagtgcacatgataagcatgctgaataaagtagattatagttaaggaacaaatgctagtacaattttgtggcaatttacaaataatccaatgcaaagaaaccaagttacctgtaaaattaattttaccttattttgttttaaaaacaatgacaaagaaaaaaacgaacctccgaagtctat

SEQ ID NO: 29723 - DNA, 1256 bp, Bovine  19866881116739
tgttatggaagttcagcgttgtatgtctctctctacactgtggtgcacttaaccttgtggattttttatactaaaaatgtagaataaagactattttgaagatttgaataaagtgatgaagttgcattacacctcacttcaaggattctttactcaactttttagatctcttctgtatataacgttttttatatctcacctagaattcagataagtgttgctgtcattgttttgttttttttcttttaatgaagtctttgaaataaatgcaggagtacaaggctaagatttgaccatttttatgagatccattctagatttttagatttttttcattttatttcctaagcactttcagattcttaaaagcctattaggccagaggaattcagaacataaacttagaaataagggaacaattgagtctcctcatttggaggagtctcctcctgcccttaagtttgacttgaggaaaatgtttttttagtttgacaacttgttaagttgtaagttgagtgtgatcttcggtttttccaaaattctgtttggagaaatgctgaaaactggaatataagttgctaagatgaatttctcaactcttaggtcttaccttgggtggacttgagcttgaaaaatgaacacaatatagttaagaccttgaaggaggtttagtttaattccaaagtaaacaatgcatggagagttaatgatttctaccaaaacgctgtaccttttaaatatgcctcattttgagatggatgaaatgagatagaaagggcactggtgggaaaagtcacaggttgttcctggttccctctgtgtgtacacagaatggatcagggacatcctggcccttgccaggatggaggctaaacaactcatctcccagggtctatttctaatgatcctcttctaggacaaacttcccaggaccatctctgctgcaaacgtgagattgttctgggaacttctgaaacttccctggggccccctttgcttgggagagaacacaggtaagagttgagtaagcaaaaaatggacatgaacttgagcaaactctgggcgatagaggacagggaagcctggcatgctgcagttcatggggtcacaaagggtcggacatgattgagaggctgaacaaaaacgacagagcaaactgtcacaaaagttccagcaaagataagtcgaagtataaagatggtgatttttttgcacatgagaatctatttctgtatcaataaacaattttattccga

SEQ ID NO: 29724 - DNA, 749 bp, Bovine  19866881154733
agcaacttaagaagcaacaggaagaagcacaggttggtgatcaactctttgccgtagtccttcctgccagatcatggtgactaaggccccatctgattgccactccagttgatctttttaggcacactgtctaacagaagtcattgatctgattgaaataacccaaataacaactgcagatggtcagtccaattgttacatttgtcttaatggccaaattgtttgtgaatgtgatcttctgttgaatctctcgaccgttcagtgcacaactcctgtgatagctggagagaggaaaaaaaaaatgaccagagcagtttatataatacatcatgtaagcataggtgtttttgttgggggaaacattaggatctccttcagagattgtctgtgttcataacgagtcctgaaaagaagatacaagtaaaatattgaagtaaaatttaaaaaagaaacttgtgattctactaataccctaacatcttacttttttaagaaaaaattatgaaagtatggtgatatttacaggagacttggaaaataccgaacaaaattacatatagttccactgtacattacagttatttttaaatagataaattaagatttttagttagagtttcaatatcaaactttcaaaaattaatagaacaaacagataggaaagtagaaagatacagtagacctggaaagcactatgaactaattcaacataattaaggtttatataattttcactcaacaacaggatg

SEQ ID NO: 29725 - DNA, 1294 bp, Bovine  19866881186480
catcggcctcctgctcttcctggtctgttctctatgccatctttggaatgtccaattttgcctatgttaaaaaagaagctggaattgacgacatgttcaactttgagacctttggcaacagcatgatctgcctgttccagattaccacctctgctggctgggacggattgctagcacctattctcaacagtgcaccaccagactgtgaccctgacacaattcaccctggcagctcagttaagggagactgtggaaacccgtctgttgggattttctttttcgtcagttacatcatcatatcatttctggttgtggtgaacatgtacattgctgtcatcctggagaacttcagtgttgctactgaagaaagtgcagagcccctgagtgaggacgactttgagatgttctacgaggtttgggagaagtttgatcctgatgccacccagttcatagagttctccaagctctctgattttgcagctgccctggatcctcctcttctcatagcaaaaccgaacaaagtccagctcattgccatggacctgcccatggtcagtggggacaggatccactgccttgacattttatttgcctttacaaagcgtgttttgggtgagagtggagagatggatgcccttcgaattcagatggaagatcggttcatggcgtcaaatccctccaaagtctcctatgagcccattacaaccactctgaaacgcaaacaagaggaggtgtctgctgctatcattcagcgtaatttcaggtgttatcttttaaagcaaaggttaaagaaggtagtaaatgagtataacaaagaggcgatcaaagggaggattgacttacctataaaagatgacatgattattgacaaattaaatgggaactccaccccagaaaaaacagatggaagttcctctaccacctctcctccttcctatgatagtgtaacaaagccagacaaagaaaaatttgagaaggacaaaccagaaaaagaaagcaaagggaaagaggtcagggaaaatcaaaagtaaaaaaaagaaacaaagaattatctttgtgatcaattgtttacagcctaagaaggtaaagttaatgtgtcaactgaactcccagaggaggtctatgccaaactgactgttttaacaaacactcatggtcagtgcctataacaagacagtgacctctctgtcactacaactctgtgaatcagagtatcaacactgacaagaggttactgttttctttaccagctgacactgctgaggagaaattcaaggctacctagaccataggg

SEQ ID NO: 29726 - DNA, 1856 bp, Bovine  19866881265834
ctttccttttcctttcatgcattagaaaaggaaatggcaacccactccagtgttcttgcctggagaatcccagggacgggggagcctggtgggctgctgtctatggggtcgcacagagtcggacatgactgaagcgatttagcagcagcagcagcagtggaagaaaccagctaatgccaaaatataggattaattaatttggggattgctgtttaaaattcaacaatgatctcagaaaactggggtatatttgattaacctctgtgcagaagaattgtaagacttttaaggctgtgactgtgcagtttctgtgacgtgggaaattgagactcaaaggcattccgaagacatagcaaggaccactgacctgggatagggagactgtcttgatctccctgttctgcagaactttatcccagggagacatctctaagcaaagtattgatgtctctttccatagttctggcaggatttgtatggtttgcaaatatgtccgtatttgttccaaagcctattcatgcactccagaggtggtgataggtgattcagagtcccgttaattatggaatattcagatgtccaggacacaatttagactcctctgccgggcttgatcatttcaattgccttatccttctcctctccccatcattttcttattagagccatgaatgagatacagataatcttgaatttgccatgttttgaaaaaatatcctttctagagcaaggaattacgtctatggaaaccctgagaattataaccactttattgaatggagtcgtacagatagcttccaatgactataggagagctattaggtcaaggctactcagattgctccatcattagtttgcttcctttttttgaagttactatgataaattctgtttgatagaaaagagaaatgttatgttgtttggagaagaaatttccttatatttccttacataatttccttttccttacataatttcatctttttttgtgtgttgccaggtttttgtttatcctattgggtccagtagggaaaggtcagcagtatcatgagattggcagatccatggccaccatcatgacagatgaggtatgcacaccacttctgcttttcatgtgttcatctcataaatatttattgagtgtttactctgtgccaggcattgtgctagttgttgggggtataataattattgctgagaagcaatgcaggtcatgtttttgaggatcaaggcctcttggatttttcttcctctgtcatctctcccttttggaataatcaaggatgcagagaaatctttttctgggaaaactattgccaagtaggataccaagtgggaaagatattaaggctgacttaactttctagagaaaatagttaatgaagtatacccaagctatttacataaagaaacctcactcccatttcacgtaaatgagctgtaaatgagaccagcttgtcagggggatgctcttgggcattgtcatgtgaatgtgctagggttactagacatttcggctgcccctgctgcatccctggtgaggactgtgctgctcaggttagttgcagagtagggccttgaaaagacatatgtcttagaggcaaagggagatggggctgtgttttatcagctgtctttggttggaagacatatttcatggaggacctttattagtaattccatccgttttttctacccatcatgatcaggaaaattcctcatgcatcttggcttttgttccattctttgaggagataacagaattacaaaactttagagtcatgtcttatctctttctacactgatagacatatatttagtttttttttactcatctttagattcattttaaaact

SEQ ID NO: 29727 - DNA, 1329 bp, Bovine  19866881328157
tgctgactggaataagtaaagatatgaccttgtctcaagagagcagatgtccgtgctagtgactcaggggcctgctttctgcacttggagagctgtgtgcatagacttgggagtggtctgtctcaggactggagcgctgattcctcttctcccttgggcagaatcctaatgcacctggctacctgctggtgagcaggggctttggggccgacgtggtgggctcccccaaggaaacccctttgaaaccaatggatgcattcacgggctcgggtctcaagaggaagtttgatgatgtggatgtgggctcatcagtttccaactccgatgatgagatctccagcagtgacagtgccgacagctgcgacagcctcaatcctcctacagctgccagcttcacacgtgagtgagccactccctcccagcctgcacccaagtcccccaggcattggagccctttgcagctctcaccacagcttctgtccagcttggggttttgtccttagttgtaatctctcccactcttagctccatcgtgctctttggaggacctcattgctctaatatcatagacttaagtgggatttattctagctgattttacttgggctgtggtttttgggtccccagaatgggtcgaattaaactgaagaaggaggagtccaggagtttaccctttcccaccagaatcccatatagttccacaaaattgtagctctagcaagaagtaaatgcttactgcctgataaggcaactggggcatctcaaggcttcttaattcttacagctcagttagtttcttggaaggaacttctgaattctgtaaatcagggcttatctgtggggtaaatctggcccactgcccatttttgtaaataaagttttattggaacacagccacaatacccagtgtctacagtggctttcatgctataacagcagagttgagtagttacaacagagaccttgtggcccacaaaacctaaaatatttattacctggacctttacagaagaagtttgccatttactgctatagatcagcactgtccagggaggattccctgctgatctggtggttaggatttggcactttgattgctgtgacccagactcaatccctggtcaggaaactgacctacaacccgtgtaggccaaacatactacataacctgtgtggtatggccaaaacaaaacaatgcggtccaaaagaattttctgctatgacagagtgttctgtatctgtattgtccagtatggtaggcattagccatatgtggctattgagtgcttaaagtgtattagtgtttacctgaggacctaattttaagtt

SEQ ID NO: 29728 - DNA, 1368 bp, Bovine  19866881337310
ttgtacataggttttccctagataataatatttttctctaaggacctgtcactaaccttctcctcaggaacggcgatcttctcatcaaagtaggtggtaaagggctcctctgtgtatacctcgggggactgtggaattgaggagttactgcgggcagggttgatggcaccaagactgacagagaccccatggtctccagaagcactttctgaattaacagatttgagaagaaatgagttaaaattaacagaatacactggtattagtaatcatcatagaaatactgaaattaaacctttttaatacctaaatgcacaagattaacctgactctatatcaatttttggttcagatcagttcaatcgctcagtcgtgtccaactctttgcaaccccatgaaccgcagcacgccaggcctccctgtccatcaccatctcccagagtccacccaaacccatgtccatcatatcggtgattccacccaaccgtctcatcctctgtcgtccccttctcctcctgccctcaatctttcccagcatcagggtcttttccaatgagtcagctctctgcatcaggtggccaaagtattggagattcagcttcaacatcggtccctccaatgaacacccaggactgatctcctttatgatggactggctggatctccttgcagttcaagggactctcaagagtcttctccaacaccacagttccaaagcatcaattcttcagtgctcagctttctttatagtccaactctcacatccatacatgaccactggaaaaaccatagccttgactagacagacctttgtcggcaaagtaatgtctctgttactttatttttatttatatttctaataaattaatttttgaataggcaacacattcacatggctgaaaatttgagaaatacaaaattgcttatggtgataaagctccctctctaccctcttccccggtcactaagctctacgtgagttttcaacactaagctcacaaatggtctccccctactttcacgcttcttttgtactgcactgtgaaagacactcagtcatgtctgactctttgtgaccccatggacgatagagtccatggaatttttcaggccagaatactggagtgggtagctgttcccttctccaggggatcttccctacccagggatcaaacccaggtctcctgcattgcaggcagattctttaccagatgagccactggggaagccctcacgcttctactgccacttgccaatttttagaataattttcttctaaaatcactgatgtctagggcttaatatagaacatccctagactagccgcactgataaagtgaaagtgaaagtgaagtctttcagtcgtgt

SEQ ID NO: 29729 - DNA, 1129 bp, Bovine  19866881361556
attttacttattcctagagatttggcctttttcctccctttatttgctgcatttggtgcatgatgttctgactgacactgctttgcatatatgtatgtcaggtgcaaaatggagcccaacttcgtctagttgtgggcctcttcctttcttcggtcttataaagctcttggtctttacaagagaattagcattttggccattcctccatagtgaaatgtttggtttatttctaccagtttgtccctgttgctctgtttctctgcagttctgtgactacgggaaccttttatttcagcgagcagccttgtaaaggacgttttagacatcagttaagctcatctgcagtgatgccagtagaagagctatggccaagttcacacatgggaagcagtgacacagctgctgccgggccaacagtgactataagaagattctcgatttcagagatgttagaatgtgaaaaaaaaagtgcatcttagaactgatgaatcagtatgttgaaggaaaaggcagagtcagaaaattactatttacagaattagaggaagtcttacatacttgcataatttgggctgaaaataagaagtgatgtatttcaaggacctagaataaaatcagggaaaaggttaaaagaaaatagcacagtttgcctaaaataagtatactatgtttgatggaggctggtattcattaacttgatctagacaagcacagttggtctccctctcccattgggaggcaaggtgatgtgacaacttagagtgctgaagggttgataaatgttcagcaactggctttctagaaaaatgtgcatatatatgtttattagaaattttactaatagaaaggataggtagcacacagcttacaaatattattaaatataccactctttgttgtaaatgaccatatagcaggaagtgaagaggaactaaagtgattcttgatgagggtgaaagaggagagttaaaaagctggttaaaagctcaacattcaaaaaataagatcatggcatcagtcccatcacttcatggcaaataaatggggggaaaaatgaaaatagtgatagactttatcttcttgggctccaaaatcactgtggactgtgactgcggacatgaaattaaaa

SEQ ID NO: 29730 - DNA, 808 bp, Bovine  19866881365317
ccacaaagaaatggaatcgttggtccttaataaactttctgtaagttgccattcaaggagccagagacttagcgttctctgtggtgaagtgggagccatgctccttttctagcaggtgctttctcctctcttggccttttagaaggaaacggtctggcatgaggaaaacttcagagtattggggggatgggggtttctaggagaccaaggacaggattcaaggtcttgattttccacttatgcatgtttgaccttggacggtctcttaacctctcttaacctgacaagctttgttttctacatgttcagagtgaggatgttaatcctctctgatgctgtaatcgttaagataccacattgtaatagacctttgtaaactacaaatggaaaagatctggccatgtaaatgagaaaaggaacaaagagcgcttagccccatgcctggcatgcagcgagcactcagtcagttgtagctcctggtgctgccactatgggcatcacagtgctgtcaccagcatcgccagaggggcccttcagaggtgagcagaagtgtgcaggcagggctggccccttgccagcaccccagcccagccctcagctctgactcacgggccaccttgcctgtcgaattccaaccatctggttcctagtgctgtgagagctatgagacgagccccctcagacttcatcttttcccttccgctgggtggcgggcatcacagactgaggtatatgtcttatttatatatgtctgacactgactgtgctaagcattgatttcagatgtgatccctctgagattaatata

SEQ ID NO: 29731 - DNA, 1298 bp, Bovine  19866881410064
tcttggtgccctcaaccctgcctacagtaattcctcaattcctcagtcctccgggggcctctcagaggagcacttcaccacctatctggatgagaataatgctgttcttgaggagaaggttagtgacaggtccttggaggaaaacattattatctggggaaaacctatgaattcagagtctgctggacaactcaaaatcaacaacctcagagtcagttctggcaggcaatctctgaagactgaatttttgtagtcagaataaatggaaactgttaaggaaactaaggtccttgaaaaacacttgccaggttgtactagtgagtattttttgatccagaaacgagaatttcaggttccctttttacggtgccttttgtccaatttggatagtactgatattcttgctggggttttagaatgaaaggctgttggaaagggcaagtaagagaagggttggactcttatttggacagagttgattgtcttattgataagctgtggaatagatggcaattaaacttggacacacccatgtccaactttggaaatcctttgtttatgaaactgatactgttgctttttatgtgataaaataataaattagatcagcagtttggaggtgggtgataatttttttatttctccaagagacactttattattattattttttaacgttttattctgtactggactatagtcaattatcaatgtgacagtttcaggtggcagcaaagggagtcagccatacatatgcatgtgtatccattctctcccgaaggtgacattcattttgctctgttttcctctctcgtacagcactcttgttttagctttcgtaaactctgggtcttcacgggaccaggacttcttatgagcgttgtggatccaggaaacattgaatgtgatttgcagtctggagcactggctggatttaaggtgaacatggagtcctccctctttcctttttaaacacacacagcgcaccacagccttttcctctgctctgcctgctgggtatcagcccttggtggctacatgctgatacttcattggccctgacgcttaggtgaaaagtacttttccatctgtttttaaactttattttgtcatgtagttggtttttaattttattttacccaggtagtttccttgaacaaaagtgaaacagcaaatgggaaaaaataagactcagaaaggtgcaagatgacctagcaagttctgtgcagaatgtgatagagaactcagtcattggatccctgaacggggcgtctttgctgagtgtactgtttcccatt

SEQ ID NO: 29732 - DNA, 683 bp, Bovine  19866881469074
aactctgtatacagagtctctgtatacatcttaatagttcctaacagactcagtctaataaactgatttggctgctactgattctgaatcattataggaaagttacagtctattcactcaattctatttagactggttgggaagtttttaaaaaatttttttatataaaactgtaattttattttttatatttatttattggctgtgccaagaggcatgtgggatcttagttccccaattaggcattgaacccatcccccctgcactggacatgcagaatcttaaccactggaccaccagggaagtacttggcaatgagtacttttaaatagactgtgaatgaaaatgaattaaatggaataaaaatctgatgcttcataataataatagctaacatttactgagtatttgtcatatactaggaaccgtgctgaaagtttaactcatacatgcatagcagggcttagcttcaattatctgaaagtattcaattatataaaatatttcaatactcaaagatactggtcgaggtattattgtgttattacagttctacagtatccagtcaaggcttgtacttacctacagggacaaatgggggagtctctagattttctgatcagtcgggataactggccttcgtcttcatctgctgaccactggttatctgaagacattcttct

SEQ ID NO: 29733 - DNA, 1331 bp, Bovine  19866881491755
gggatgtgagtgaaaaagcggtcccccgccctctcctatgtgcacgtccagtttcagaagaaccgaaccaactgagacagaaggtcaattaatgaaaaattagaaaagtggaaaactagaaacacgttgtaacaaactgacaggaggcactggtttttgacaaagttattttacattattaaacttataaaatgaggaggctgaactagatgatgtctaaggccaccatattctaattttctatgattctaggttgactccaatttgcaagaaaagacagacatgagaacttgaaggtaaactgaactttaggagaccatatgtacttttttaatgcaataggtatgtaccctatttaaaagcacataatcaatcctataatttggatttttgtttataggactttcttacaagagagcatatccactgaacaaaaaggatacacataacagtcactggttttcaggaacaggagaaagagtagaagctaactctgaaggccttctttcaacttaatccatagattttcttgctgccaacttaagacagctcttagaaatatacaaggccgtttaaaattcaacaaattgctataagcaaacatggcccattctttttaactttgcataatatttcataaaacaaaaaaatcaagagtcatttaaccactcactatacagaaaataaataatttttaaaaattcaacaagttattattaagaattggagagtatagtttgtagtgaagacagaaagactaggagcaacagagaaaaagtccttggtttgattcactaaagaaagtgtggaaggggagaaatgaactgaaaatttaccctgttaaaacttaagattctacagtatgaaagaagggaaaacaaataacaaaattaagactttaattgactttaaaaaataacagaaagaaaaccaagaacaaaggcattcacgtcagttcaagttcctaaaaataacttgtttgtttttgcttgtacatatactgttataaatagcttccctcatagctcagtcagtaaagaacctgcctgcaatgcaggagacctgggttcaattcctgggtcagtaagatcccctggagaaggaaatggctacccattccaggattcttgcctgaagaattccatggacagaggagcctagcaggctacatacagtccatggggtcacaagagttggacacgatttagtgactaaaccaccaccaccatactgtgtaaagaaactctggaagatactactaacagtgcttacctgttcagggaggcaggacatgcacagatgagagatgggtataaacgggagacttttta

SEQ ID NO: 29734 - DNA, 2124 bp, Bovine  19866881511791
agaattaactcctgccctttactccctgatccccttctttttttttttttcctgatccccttctatctaaggcacttgtatatccatttacctctggattcaattatctattaactttcatgggttctgtgggtaacatcatacagacacactgcaggtgtgagacagaaagtacaatcttgtcagacctcattctcactcaaactaatcagctttggtgaaaggaactgtggtaggagataactgttaggaaacatacaatttatgctttctgtaagatactcaaaaatatattcgtgaattaagtagacttctgggactgtgtatacatatcatctgaaataatacctacagaacaagttctgaggaattaaacttcaatggtctattagctagattgaggggagccattagaaagctctgtgaaacacatcattggttataataggatagagcttaatataataggataaagctgaagaaatttctctgcttatacaaatctttagaagtatattgagacaaatattttaatatgtgataattgacattgcaccatgattaatgttataaaaataataaaagtataaaaatgtaattgtattattatataataaatcatactataaaaaatgtaagcctaaactgtacaataaaactacagtatataaacatatagttcatggtgaaatctaatggtcaataccattaatttatagctagatttatttctctacagcagaatttattcttttttattttatagaaattgagaattatggaactatcccaagttctcaatattagagctgctagaaagctcagatccaagggaaatttatgaaaatacaacataataaaaattcacactgttgcaactttctgtatatttgagtggttttgaaataattaaaatgaaagcaacatttcattgccaaaaaagaacaatgctcttagccttatttcaacctattagcaactacagaggtattcttacttgcatattcttcttcatcgagggtgttcaatatgttttccattgtttcattatttgcaagcgaactctgcacgcatttatgcttcaggttgcccataaagagctgcagcccaatcagggcaaacacgctcagacagaacacagtcaggatcatgacatctgagagctttttcacagactggatcagggcccccacaatggtcttcaggcctgaatacagcgaagaaaaggtgttcaaaatgaaataaagtttctaaatgaaaaacaaaagcaaaatacaagctttcctagaagtgcatgcactttatcaaatcaacgatcttaaataacctagttcaaaaaaagtctaccagctcaaaagggggatctgctgttttatatattttgtttatgtatattgcagcaagtgactaaaaactttaaagtatttccagagaataaccagtcaaaatgaataatttggttgctcaaatcatagccacactcacttgaaaaaataacttgtgtcagttcagtacatgtctgtcagacaaaccatctctttgtaatgaccaaaacagaggctgaattacaggatacagtgacaactgttttcagtaaagaaatggtttgttgaggaaagaaaaaagcattgtgtcatgcaatcctccccatgctaatatttttatatctcttttcttcactctaagaaaagcagtaaaacaaattgaaatttttattcctggataagcaaaatggaaaataaactgttaaacaggaggaaaaatttcaagttgagatgtgaaccaaatggccatcttcatcctctaagactcatgcaattgattaaactcaaaggctgacttttcataacaattatgaaagacatgagatcaaatttaattaaaattatgttaagattaagtttttattgttttttccttcaaaagatcaaagtcagccctggtgtttaaccccactctcacctggaatgactgaaattgttttcaaagctcggagaactctgaaggttctcaacgctgagacattgcccaggtccacaaactctgtcacatatctgaaataggggagtttatacacaaacacgggacaacacacacccacacacacacacacacaaagaacaa

SEQ ID NO: 29735 - DNA, 1024 bp, Bovine  19866881577545
acagcctcttttattcccatgccttagacttcgtggtgctaacttggaagtgaggacccaaagacagggggtctctggccctaatggctacccctttttgggtaggccagatattaatggcagtccagtaggggactgactcttcatgataggaaatctgattttggcctttggcctcaccacagggtaaatagtttatggaaaggataactttaattgtgtttttaaaattctttaaaaaaaaaaaaaaactgaaatacaccaccatgcagaaaaattcttaaaatataaatgcttttatatatatataaaatataaatgcttagtttaatgattattataaagcaaataaacacccatgacaagagagagcattagtagcacttcagaggtattaattttatttttaaataaggactttttcagttgattaaagaaataggcttgtttaaattcacttgcatatcttcaccagcattactaatacttcttactaaataggcctttcactgggctggattagcaaggtctcccctatgaggaagcacactgggaatcaacccacaaaccaaaacatcctgagaggagaaatgaccttaagtaaggacattctttctgtttgtttctcaagggctgccttaagtaattcttgcaaagtaaaatctcttttctttgcttaatgctacaaatggatttcttaaattttttctttttggttctcgttttctacctcattgatcatttttgggactcatggaaactggtttctcatttccttctctctttattttagaggatgaaggaaaactagttccctattagtaaagttctggtttcatccattgtagactttacagtgtccagggacacagggccatgagatatgtgtttcccattttcaaggtactgttgtacaagctggccctggtgtgagctgtcgtgagttacgtggggccctgaacagtggtattcatggaacttttcacctgacttccccagagggtcctccacaatccagatcacc

SEQ ID NO: 29736 - DNA, 1057 bp, Bovine  19866881593963
ctctagaagaccgagcggcctccaggtccccctcctggataaacgagtgtggagagtaaaaatcaattgtttctcatccagctatgggctcagtggtcctgaaaattctcccggggcttctgggatgatgggtaggcatatttgttctcaagactcacagctccaaagaaggtgggcttcaggtcagggacaaacatctccgggtaaacgttgtccaggaaccaggaaaagttgtgacagtttagtcgctccctcagctgcagtcgttccgaaatgtcgccaaaggatttctgtcaattaaggcagcccccaaaaggtcagtttcactagtcttggccttcctgcatgggcagatgtagcctaggggttctgggactactttctcccagaatgcgtctcatgctcattcccagtcagttggggtccctggctcagctccacatctaatcccaaaccccttgccttggctttgggatccccacccatagcactccccatctcctgtgaactctcagttttcctccagtcttcaattcctagtttctcagagcaaagtcattcttccaataagaggttcttcttccaaatctcgtctccctccccttctaaaagatgctagggctctccaggcagggacaacaaagcctgcccttcctcattctctagcctccaaaatagagcctgggctctagctcccaaggcctgaggggtaaaggcaccaggtggaggagctgagtgggcctccatcatcatgaagccctggatcagggtctgcaattatgcccttctcttcatctgaacatctcctgagcatcccccctctcacctctcgggccatctgtgctgcctgcagatttctcctgtagaaaatctccttgtagccatccatccagacctcagccaggcgcacttggttgcgagcaatgacattgatgcccttggggaaggtgtgggggctcttggtacggaacacgtgtccgaccacagagcaggggataatctctagctggccgccgcactgccacacctgccgtaagatgagacgggatgggggttt

SEQ ID NO: 29737 - DNA, 695 bp, Bovine  19866881643214
caaaaaggcaccaaaagaggaaggcttatttctcagttggcagggtgacagcaccttgcactgtttggattcgggtggagtattgcccaagcaggtaacagcaggggttgagaaatttcagatgaattagctgatagtcatctatcattgtacctggttgttattttagcagtgttacaacaggggaccagagagcatgggcagaggggtaggggatgaggaggaaagctttgctatcagacagaggctgccagtccttatgggactgggctgagaacaacaaggtgcaataagaggaatcagaatagaaagaaaagcatttcttttcccagggtcatgccaaattctgttccgtccccatttccaggcctaccgtcccagtttccagccccttctcagctgctttctcagcgactccaaggccacggtccccacctggcccacacccctatccagcactctccctgtctgtggcctctgcttttcagtgagtctgtgggtgacaattccccttctttgcacctggtgattctccctattaaatcaacagcccagaaagccgccccaagtgctacaggtaagccaggccaaatgagaatagccaatgttaacatggtctgcgatggcatgttgttgggggtggggccagtattaatatgatgaggcagcttaatgtgagtccccttcgcacaggg

SEQ ID NO: 29738 - DNA, 1007 bp, Bovine  19866881806567
agtcttctcctacaccacagttcaaaagcatcaattcttcggcactcagccttcttcacagtccaactctcacatccatacatgaccactggaaaaaccatagtgttttggaggtgactaaagatgattcttttttctttttcttacagcagaaaccaatgatagctatcatatcatactgaagtagatgtggctgctgcttcgttcacctatgggaaattctcctcttggaggggatcacaaatggagatttgaacggctgtagcaacctgacctgtctaagttggggagtcagaggcataggcagaaccccagccatctatgttggggcacacatggatttctgcctgacatgcatttctgcaactgtttcttagttaacatttctggattctattgttgttgaatatcaatagaaactccacatcatttagggtgtgtgtgtagggcataatgatgatgagaattgtgtgatgtttaatggaaagatgttaaattttgtggtatgcagcccatgtaattttttttctaacataaaagcaaacatctatattccataagactagatcctcaatcttttttgcctgtgaaaactttatcaaagaagagaaatgtggagaaagaacaaaattcttcttttaattcccccctaattcaatgacgaatagtaattttggctaacatttattgcacatttagttgtgccaggcagtgtgataagttctttaaatggattatcttgtttaaatcctcttaataaccccatatgaagtaggtaatgatgatccctaattgaaggtaaggaaatggagacacagagcggctgaagagcttgctgagtaacaggcagctggtagatagtgacatgaagcgcagacccaggcgggctggctcgtgttcactgctgtgactgccccctcacagtcctctgtgcgtgccatcatttcttactgtggctcccctggtgaatcacactctaacagtgagcaagaattgacagagtaaca

SEQ ID NO: 29739 - DNA, 946 bp, Bovine  19866881811542
ggtgggggtggggtgggggcggccgactgggtgggacaggaaaagaggagagaaaccgccctctgcaggttccctctgcccgccgggccgcctcttgctcccccgggaggaaaggctgcttttccttctccgtttgtcactttactctccatccggagccgcttcctcccccgcctcgaggcttctgagggcacggaatctgatgagccccgggttagtgcgatccatccgctttccccgccaccgacattatttgaattttcagcaaatgaaaagttacatttcacttgagtttgcatgtcatttacgtaaataggtctgtgtgcagaagcttggaaccttaagctaacgtagtgggcacacctcgggccggggagcatgggggtgcggtggggagaggaaagatgcccgaattcttctgaagagatgtggtacagaggttaagagactcgtggacttgggactcaaacagtcccagctccgctgcttcttagccatgtgactttgggcagattagttaacatgtctaaaatctgatccctcatccctgaaatgggggactgaaaaatcatgccgtttcagtgtggttctagcacctgggaaacacctccatttgagactaattaatgccagactttagttacctcttgactcacttctttgtggcaggaaatgttcccaattagtgagctcgatgagtaaggctgtaatgtcagtgttaacacaggctctggaatctgccctgccgtttgatcttggacagttctgtttcatttctcttatctgggagcagtacctgtctcatagaattactgtggggatgggaacgagttcatatatttaaagcattagaagcttacctggcacaatagtgagtgctcagtacatgtcatcttggcttcttacttactagttagaactcttacgctgctcgtcttccctctaa

SEQ ID NO: 29740 - DNA, 906 bp, Bovine  19866881869988
cccacatacgggaaggcaaaggcccaaccactggatcatcagggaagtcccctagagtatattcttattggcaaaaaactataactgtgacttatcaaagtttagttcttagccattttattaataaatccatttgacagaaaatccagctcattctctaggtacctttctgaagcttgttgatggcagcctaccccttaagcaggccttgtctttttttttttctttttgtaagacatcgataccaccaagtctttactgtcatttttcctttggtctctttcctcctctggcctcttttaaatatgatgccgtgttttctgctcacttcccccagtgtactccgcaaggcatctgtccctttatgttcttgtgatctcaaaacttctcttccagaactaaattggaaagctctgctctcctcactaactagggcagcagatgctatctctgctccagctcttagcctctgtctctgtctctgctgtatgattaacttctgaccacagcatttctgcaagatagctctgactgatgtcacgttatttatccttaatgttctagttttataggtatatattaatgtctagttttacattctgtattataaatatatatctataaacacagtgcctggcctgtaagagccctctataaatgattttagcagtagcaattataaagaagaaacctaaacccaaggaaagtttgtgtgaagatttagacaccaacttcacagtttaaaataaattattggattcctatttctagaagcacctcctagttgagctggctttgggagatttttgacaataactttaagggataataaagtcaaagatatgggtcagttcttaaagtgtgactttttatcccaagttcttttgctcttgattctacttgcgg

SEQ ID NO: 29741 - DNA, 819 bp, Bovine  19866881894325
actctacagatccaaaagatgtaaatacccttaagagcatagacactatcacaggtagtgataatatttaggaagtgatgaattttcagtattctcttgttttaaatataatttaagtgtaagtttgcatcacttaagttttgcattactgaagcttgtatctcttaactgcttgacaaacgctcacgaaattcctgaaattttgcctatcggctcttgcaaggctgtatgtgtcagtcctagcacacctctgctttggagtcagacaagttcaggttctacttcactttgtgactctctattctcggagctgtgggcagtgcataatacccagcctcctcaagtcaggctgtttctacaatggggctaataacaccttcatcacagagctgagtgagagcaaaatgagatcaagtttatgaagggtcaacacaaagtaggaacataatatcagttgttttattaatgggtgtggctggtcaggaaaattaaagtaaaaatttacccatgacactgtcagttccaggggcccagcacggtgatttgatgtttcgaaacactaaaatgatcatcacacagtattggtttttttctttccctcgtctttctgatctatcttgaacactgcgtattaaaattatcttcctgagacagagctatgcaatgtcatctctctgacttacactggtattaatcacaaatttcaatttgctgtcagagtctacatctcaccaatctcgttttttcattactccacaggaagcggtctgtgccccaaatacaaatctgttgacatcccccagagggtccttagggatc

SEQ ID NO: 29742 - DNA, 1887 bp, Bovine  19866880408157
ttgatgtatggcaaaccatacaatattgtaaagtaattagcctccaattaaaataaataaatttatatttaaaaaaagacaaatgccaaataagcacatgaaaatattatcaaaattatcagacacgaggaaaatgcaaattaaagtcgaatgagatgccagtataaattcattagaacagttaaaagaaatagacactaccaaacgttggatcaaatctgtagtaactggactttttatatattactggtgggattttgaaagcggtctaatatttttctattttttttctgtaacaaattactatacatttggggcttaaaataacacaaatttattatctcacatttttgtaggtcagaagtctgatatggttagcagggctatgttactttcagggggacctaagtgagaatccatttcacttcttatttaggttgttggaagaactcagtttcttgtggtttatgactgaggtcaccatttccttgctgtgaactgagagctattctcagcttctagaagcagattgtagtttttgccttgtgaacctcttcatctcaaatccagcaaaagtagatcaagttcctctcatacttttaatctttcctgcctctatttccaatgccacatttctgacccactctctgccttcctctttcattttcaaggttttatatgactatgtttgaaccactaagataacactaagaaatctctccatctcaatatatttaacctaatcacactgacaaagttatatttgccatataaggttacttattcacaagttctcagggttaggtcctagaagtgaacgggctcttttctatcctaacacaaaaggtacaatcaattcagagattctgttttcttaaaaagttaaatacatatatgccttattacctagaaatcctatttctatgtacataatcaaagaaagagaaacacacgttcaccaaaaaaacaaaacaaaacccacatacaaaaaaggtcacaaaatgttgttcatactagctctaaacttgaaagatcctaaatgtctacaagaatgagaatgaagaaaagaagtgatgtatatgaatttatgaaagggaatatacttctgattaatgacaaaatgtgaatgaaacttcaaaatatatactgagcaaaagagaacacaaaaatatgcatgctatattttcccattaatatcaaattgaagaataggcaaaattggtttatagggaaagaaatcatattactagtctttctaggaggaggattgtctgggaagaggcatgtgaaatgttatgtatcttcatattattcatcaaaattaaattgatgtgtcttcccatcagtcatcgaacctgattaaagaatatatttaggatctgagctatcagtgaatgtaaaagctacctaaaaaaaataagatctttcaaattctcagattctcaaattctgcaaagaatacagtttccttttacttgttgttcctaaaaatgaagtggaaatttataaatgaaataaattttcttggatgtttagaaagcattatctttttaaagcatgatgaccaaattttaatgtccgaacaccattagcaatcggtgagcatttctttagttccatccttttagtagccaaaatgaaaattagtgaatgtttggggggaccaaaaaatattctttttctcaaatgtgagatttagtattaaaagcagttcagatcaagaaattagatttcgggggaggagtcaatatggcataatacgaggattaccaaaatggtctttcctcacaagtacatcaggaatacatctacagacggaacgattctcacagatacctgctgaacactcgtggaaggctttggatagatgaaagggaagaaagatcc

SEQ ID NO: 29743 - DNA, 885 bp, Bovine  19866880348284
taaatgggcacttaaacggagtatggactcgctcatttctcctttagctcccaccattgaaaatcagttagaaacagtgggactgagcatagatcagagttgcagaatgcacagagaaattgagacatagccccctgctagaaaagttattaaaagttattctataattgctgtaactgttctatcaagctgaataataccaatttgaaaaatatttgtattttcattagatacatatactaagatacgcaattatattaactgtcattttactcttgtttctgatatggaaaatcttagctaatcaacatagatactgtaagggtattttatatgtaccatatgttttccacatattagccagatgttggtatattaaaagtaaaattgaaaaatccaacctaattttaggcttgttgaatatagtaagttactttttagtcattgaaattttttactttgaaaactcagtagttttattttaatagaaatggtcatttagaatatttggaaaatgtataaaatttcaagtaaaataaacacatgaagtattcataattccagccaatgaacataatcatgtcattatatttccttttatgatgcttttccttttattaaaaaaaagaattaatatgaaaaatggaatcaaatacatccaaaattgtaacctatttttttcaactttcccatcagttgtgcttcagaagcagtacttttatgactgtatagatttcctcttagatatatgctataatttaactattatccaaatcttagaatttatgggtatttctgttttttcactattagaaataatgctgcagtgagcatctttgtctgcattctggccagtttgtaagacaggatagtctatcttgggtt

SEQ ID NO: 29744 - DNA, 1739 bp, Bovine  19866880490717
aatatgtatcacctctactctggtcatcactgaattttataatgaataaccctgattctctctttaccctttcaaaacttgtacaccaggactggtcagtccaccagaataaattctactcactccagatgacaatttaaaagccctgagctaccatgcattgctcaatcaacctctaacaggaagaacaaagaaggctgagaatgtagaggacagagacataaaaaccaagttgccgtcattctccatctactaactgagaagaggccagcaagagtggggcgtgtgtttctacatattcgagagagagttctgggaaaaacaatttttcagtcatctcttacaactggatatttgtgggtgctgcctcctatgaagaagcattttgtaaaaccaaaagaaaaaacaaaaacatttggtatttgaaggtatttttcccatctcacttttctacttttggaggctaacaagaaataattaaccagttaaatgaaagctctttctcgccattccttaaaattagaccatactaaacaacagtgactaagagtgtttaatctaaatttttaaaaatcccactatccagacacagctattttcatagtcacatattacagtctaatccttattcatacacacatttatatgcattcacatgcatagtcacaataattatagctctgtattatgctatttgcattgtgaattagatcataagcatttttcatgtttctaaaatgtttataattatattagttgcaacacaacatcccaaatattactgaaccataaactgttgcctttaaccctaaaattgggcacatgaattctcttttctctcagttttgtcttacaatttcaaagagataacccaacttttgtgcaaataaaagctaaaacaaagccaaatgcataaatttcaaggctcttataaaattgctgcattcagtaactcattaaattgcttataaaatcattcatctgtcaatgatttgccaaatcaagtgagtaaaaagaaatacatcaatttcatttagggattatttacctaggatacaagaataacacacaaacccaacaggaaattagctgaacctgcaccgtagaatgtgtacttttttctttaataagtgaatggaacatggacttggaggagacatcacattctctgcactgtaatttcgccaaagtcttagctttcagtaggtggctgagtacttataggtaagaatccacagatgaaacgctgcaggaggcaactctctgaatgttttaagaaatgtactacattgggcttccttggtggctcagcggtaaagaatccgagtgccaacgcagaagatgtgggtttgatccctcatcccagaggatcccccacactgcagagccactaagcctctgtgccacgactactgagcctgtgctatagaacttaggagccacactactgagctgcaactaccgaagcccgagttccctagagcccgtgctccacaacacgtgaagccaccgcaatgagaagcccacgtgccgcaactagagagtagagcccgctcactacagctaaagaaaagcccacacagcaatgaagatccagcacagccaaaaataagtaaattgttaaaaaattttttaagaatagtgcattaaaatagttcacatttaaatacgtaagggtaatttagaactatacacatagagataaatgttgtatatagagagaacactgttgttggttt

SEQ ID NO: 29745 - DNA, 4454 bp, Bovine  19866880498484
catcaaattaaaagacgcttattccttggaaggaaagttatgaccaacctagatagcgtattcaaaagcagagacattactttgccaacaaaggtccatctagtcaaggctttgatttttcctgtggtcatgtatggatgtgagagttggactgtgaagaaggctgagcgccgaagaattgatgcttttgaactgtggcgttggagaagactcttgagagtcccttggactgcaaggagatccaaccagtccattctaaaggagatctaaatcctgtctctatgagtgaggatgcctgggttagaactgcttataaatggaaccaaagcctgttgcttttataactgaaaagtcaagggcgtagttctgaattctagaagtgttcaattctttttaattaaatttacaaatttaatcaggaattgatctttttctcagctcttcttcctcctaattgactttattcacagcagatcttcctttagcagtggcaaatctggcaagcagaagctcaagtactatgttctgtttaataatctcagtgtaaaaagaatacttctttctttctatgtaattgataggtaattgtagcaaaagtgctaagtgtaattcttattacatttacctggagaatatgcttatccctgaactatggccagggatatgagatatgctgattggtcaagccagggccacgtgcctctgtcaggatctaggagatgactctagccctgtgtgacccccatgactgagaataaggagtagtgacatctctagttattttctcaggagactgatgtccactgcaaagtaataaaccaagcatcctagattctagtccagtattcctaacaccacagtactataattcagcacctgggacaatgcacagtatcccagagacaatctggtcctccgttgccagaatgtgattacgatatcctatagctacaggatggagggactccagccctactgacagggaataccggtggcagagctaactggatgagacaacttcattgtcatgaagattagcaagcagagtatttgcatcttttactccattttctaaaatttgaatttacacaattaagcaaagcatcaatgaactttgaacagtaaatagagggaagccacaattcctattcatctgtaattgtttcatgtccataagcacaacgaatatgaagagaaaaagaaaagtaagaaaaatgggagactggagaactatgtaaaagaacagtttcttactcaacacatcactgacaatgtcgacaagcagtcatttctaaatgtcaaaaatgtaagtagaacagctcgcttaggaaagaggaaggcaggattattaagcctaatctgtcaatcaatgcttgcttgattattggtagagaaatactagaggaaaggttttcaaatttaaaaaatatattcagggggcctccctgaccaacgtaggagacctgggttcaatccctgatcagggaactggattccacatgctgcacctaaggatcctgcatgctgcaacaagaataattcagccaaatatatatatatatatatatatatattcatatttgcaataaaattaaaaaccaggactttgagagtattctacttctgtatttctatgaaaatataaaatacattatatttaacaacctgggattctattcttgttttttttaaatctatattttatcatggaaatataaaagctgttactaaatgagttacttcccaccaaaaagaactattagtattactattttttcatatggtaaacatagatagcagtacccttatttcaggcaagaaatactagagaaaagatatagatcatgaaactgtaaactctaccatcaatgaatttaaatctaaatgatttcatagaactgcacggtttctagaataaagaaaagtgaaaatatttcagaggttcgaaggagggatgggggaaagttgcctgaagttaaggtttgatggttttgaaacctgactgcaatcttgaacacttcacacaccaaatgatgtggatgatgaggtccatgtttcttctacttgaatttgagtgggtttgtgattgattcaaccaataaatcaaaagggaagttggacttccctcatagctcagttggtaaagaatctgcctgcaatgcaggagacctgggttctatccctgggttgggaagatctcctgcagaaggaaatggcaacccactccagtattcttgcctggagaatcccatggacagaggagcctggcaggctacaatccatggaatcacaagagttggacacaacttagcaactaaaccaccaaccagcaccaggttggtggcggatggactaaccaataaaagacagcagtcacaaggctgtgtgactttcaggtcataggaattctggggttctcagagcatctatgaaagaccaactacgctgaacctaccttgttgcaaggccacttataggtactccaaacacagtcctagaggggctcagacatccagctgtcctcatcaaggccctgatcatagaactgaaactgtcttaggtcttccaggctactgaaagacctttatgacaccatgtagaacagaagaaagacccaaccaaaccctgcccaatttgtgacccacaaaaccatgaaatataataaaacagtcttcattttaagtcacaaaatttgagggtagtttgttatgcaaacaaaagaacaaaggggaaatcattttagaataagtggtataattacttttcttataaaacaacatgttcttaaaaacaagaacacaataattcttggtaatggttaaggacaaatgatccagcaaaatactatagcaataagctgatatggagtgtttttgctttgctttcaggatatttttggccctaagggacaccttcaactataagaagagtaatttgaaaaggaaatatgggggagagaatacagtacaattccttaatataacatacaattaactgaaacttctacgcgtctaaagttcaagcaatcaaaaagctcaaatagcagataaattgtatcttgttccttgtctctctttttatgaaaaagagatgagaaacaagtaaacagctgatattatcattttattggggaaaaaaaatcaagcagtgtcaggccttctcaccatgacataaattttagaatcctcatattaggtaaaatataccagaaacttatttttgaataactggaaaaacaacaaaatctgaaactatagctataccttccacctccgtagtactacatgttggcaagacgtgtttatctccctcaggacttgcctcctggtctagtagctgggactccacacttccactgcagggggcccaggctccatcccaggttggggaactacgatcctgcatgtcacatggagtggccaaaaggataaataaaatatctttttttaaaagcccattattctgataaaaataaaagagagatgtttatttccctgaagatttatacaattctggggttcaaaaagagccagtaaagataattagaatagtttccagaactatcttaacataggacatttatttttctaatctttttcaatttactcgtttcacagactctccatttgtttagttttcaattcaaacattatgttgaatccactgaaagataatttttatttgttgaacttggcttcttaatatgaaatgcaatactgcacaaatacacatctgaaaccttctaatcttctgcaaatgaaagcatgacaagttatctaaacacaagaatgcataggagaaaaagccaaaaaatattacgtatatattttttttaatcagaaaattgaaaaatacagaacacacagaaaacactatgttttggttaaggatcaaaacaattccactaataaaacaaactgccttccatgcagaagagatgctatagataatggtaccattgagttgattaaaaataatagttacaggcactaaaatcctgattaaaaagcagtcagtatgacaatactataattctcacctccaaaacaatattaaattttactgatagaatgttagttaagaaagctaatacctatcgcattctacatttcagttcagttcagttcagttgttcattcgtgtccaacttttgtggccccatggactgcagcacaccaggcctccctgtctatcactaactcctggagtttacctaaactcatgtccattgagtcggtggtgtcattcaaccatttcatcctctgtcatccccttctcctctcaccttcaatctttcccaaatcagggtctttacaaatgagtcgcttcttcgcatcaggtggtcaaagtatttggagtttcagcttcaacatcagtccttccaatgaacactcaggactgatctcatttaggatggactgattgggatctccttaaagtccaaagtgaaagtg

SEQ ID NO: 29746 - DNA, 2147 bp, Bovine  19866880617445
aaacatagcaagattaatcataagatcatagtgctgagttaaaaacagtaaaagatagtaaaagctagcatacagtatgaacttaagacatgaacaaatgtcctcatgtgctataataaccatacactctatatgtgattcctgtgaaatggtaaaaaacacttaaaagagtctgtcacattttaagcacttaataaatatcaactattattagacaaaaagatggtcacaacatattgtaaaccttctattaaaaacttcatctatgtatcctcctttctcctaaagggctttcttttcctctattaaaaaatgcataaaagagattagaaagttatgtttaaaaatgtttacagtggttacctctgaggagacgtgtatatgtgttttagcttgttctccttgcttggctctatttctacaatggataaacatatgtaactttacaattgtctttagtccttaatgtccctttcagtatgattcatgacacacaaaaaagcagaaatatctcaaaaatgcaccccatcaatggggaaatacttctatcatggtacaagccgatagcagaatattttatagccactttttgtcaatgtgggaaacagcatatacttgttgtatggaaaaaagcaggcactggaattgcacatgtaagagatctgaaaggacacggacaacagtggtcagcagaatgggctctggagctggcccactgtctggtcacatcctgcctgcaggataacatctcctgcaagatggagatgatgacagcgcctctcatgaggctgctgtaaataaatgcaaaatacgcacaacaagcaggaaaaagtatgtataaggtccactaggaaatgtctgccttctatttatggagattaaaccccaataaagttgattcaaaaacacacgcacacacacaaaaggtcacaatattgtgtaacttcatttgtaagaactatccaaaagaggtaaactcttagaaatgggaagcggggctcttgcctggtggcccagtaaccaggacgccaagcttccactgccggtgcctgggttcaaaccctcgtcagggaactaagatcccacaagccaggcagcatgatttagaaaatagaagagcacactggtggttgccaggggctgagataagggagaagggagaggaactgctgacggggctggggctttattgtggttgatgggggtttgggaaccaggcagaggctgtggttgcatgatgtgaatgtactaaatgcaactggactgatcgtttttaaagggttaattttatgtttatataattctgcttatgtgagtttcacctcggtgggggaaaacatgaacacaaaacaacatttgtcaggaatacatgtaaattaataaaagatgaaaatacatagtcataaaggttcaaagggggaaaagaatgattaaggggattaagaataagcgcaagccaaaaaataatgtgacgcagcataactcaaaaacaagccctgctgacagtgtgttccctgaacagactctggcgtggcttaaccttcatcacctggggccaaaacactgtcttggtctgctgccacttcctttttaaaaaagaaatggtattcacctctattcttcattttgccatttgctgttcttacctactggtgtgtatcttggagctctcctcatgttagtacatatcatcttttgtcactgcttcaaagcgctgcagatgtattaatatcaagatccaaacacttttaacttgctttatttgatcatacgtggtattttgcccttgagcatacatagcatgccagttaatgacagtttcataaagaaaagttaaacgtggtatgcaactgcctataccaaacaaaaccctgacatacggttagcttttagagctagcttacatgcatccttcagagacaaatgcctcccacaaatcattaatgctacaaccaaacagccaagggtgcaatgatttccccccacctccacttccacaccctccaaactgaggctgatttgatctgatttcataggggaaggaaaaaaaaaaaaacatcttaactggataggagctcattgtatgattctttgacccaagatggcccttccctaagtccagggactggcccggcctggctgcttgg

SEQ ID NO: 29747 - DNA, 2059 bp, Bovine  19866880623909
tgatctagaataaaacgcctatagaaaaagaagaaggaaaaaaaagcaaagcaattgcccacagatgggtcatattcaaggcgcattgttgttaaccggctgtagacagtctgtgtcaaaaccagaagacatgttcaaattccatgagcttatatggaatgatttactataacagtatttgcaagatatgcagtgcatggccggaaaagtccagctaaggcagtagttggttcagtcaatatgcaaactttgctgaattcctttgcacatatgccctggactgttcttaattttcagaaccagctttttctatccataaatttaagacctaaaattgtagctacaaagtttgacaccaaattcaaacagggatccatcccattgctttgttttgcctgttacaaattcactttctaccgaaatcatttgtgaagtaactcatttatatagactaacatttcataaatagacataaattagagcatttatattcttgaaaagtatcatgaaattatatcaaacttttgaaagggtcataacatatcagatttttgggaaagccacttgaattttcttcattgctcttcatatccccaggacctagtctgtgaattgtacataaaaggataatgaaaatattgttgaactactgaaagactaactcagatgcattccagcttaaaatcagggaaagattggattgtttttaaggctccatactacattccttcagcctcacagtctcccgtttatttaacagaaacgatgttgtttagtcgctaagtcatgtctgaatctttgtgaccccatggactgtagcatgccaagctaccctgtccttcactatctcccagattttactcaaactcatgcctgttgagttggtgatagcatccaaccatctcatcctctgtcactcttttctcctcttgccctcagtcttctccagcatcaggggccaaagtattggtgcttcagcttcagcataagtccttccaatggatattcagggttgatttctcttaggattgactggtttaatctttttgctattcaagagactctcaatagtcttctccaacaccgcagttctacagcatcaattcttcagtgctcagccttctttatggtccaaatctcacatctatacatgactactgggaaaaccatagctctgactatacagatctttgtcagcaaagcgatgtctctgcttcttaatacactgtctaggtttgtcatagcgtttcttccaaggagcaagcgtcttttaatttcatggctgtagtcaccatctgccatgattttggagcccaagaaaatctgtcaccgtttccattcccccccccctctatttgccatgaagtgatgagtcctgataccatgatcttagttttttgaacactgaaacattagttgcattcatattcttcagtcaagagaagttattgttcttatttattaatagtctgaacacctattgagagaaaaagacatttgatcacacaaaagacaaaggcagttacagttcaaggtctctcctctgtgctttagtagctccattactatactttactgtctgaattttatctgtctcaagaagaatatgagttcctctatattttcagcttctcctagaataccacaatatagaaaacattcaacatagttttgttgaatgaaacaatggatactataggagaggaattaagtagctgattagagaatccaaacgtgactaggctgtctttcatcttcgagcaaggtgttgtgtgcactcagtcgccttcagtcatgtccaactcttggctaccccatgaactgcagcccaccaggctcccctgtccaagttgctgagagaggctaagttcctaccctgtggtaggccctgtactgagttgtgatgtataagactgagtttgcaaccagtgattctatgtcatcatagggcatttgttcggagaaggcaatggcaccccactccagcactcttacctggaaaatcccatggacggagaagcctggtgggctgcagtctatggggtcgcgaagagtcaga

SEQ ID NO: 29748 - DNA, 2158 bp, Bovine  19866880648222
tcaaggttgcatacttcaaaactgcaatatctgctgatcccaaaataaatccatttctgcatttctgcgggagaaataactggcagtctatctgttttaggtcaacacagtgcaatctgtacccattaggtaggaaatagccaagccctaatgctgaagtcaactgtctttcatactacagtggataaagactactattaaagctattttggagcaaccattcattggacagtgaggtccagagcaccgatccagtgagctcttgataggaactagatcacagcaagaatgggagatgcacagaacaggactgatggattaaattaccttagtagaaacttccagagtcctttctgagtctgttctctttgcctcacctggctgagagatatcaatttctcagtaaggacaattggaagtatatatcagctctccactctttagcattaatattttgtgggcatataattttccttaccacattatggtactcatatagcttcaataagttcctgagttgccttcacacaatactgaaatactccctgttgccaacttgttatagtttgatacctcttctccattattgcaatcaagatttttggttgccatataatcaaagaacagatttctttagaagtcttatttctgaaagagtgaactttgagctacaaagatgatttagtgtgatttaagaggtagtcatttaacaatgatgccccaggtctggaggcctgaggcagtgggtatggtccatcctgacagggagaaatattctatccctgtatcagcattatttaaaattgaccgtgtgtggtcataattaaaaaaaaacacttttagtcaattttatagtttttaaaattgtctttaaactctgaacccccttattgcctgcatctatgatggacattctcagtatatcaccaccgacctgggtattcactttctgtttctcttaccagattgcaacttctttgagggcacgaaagagatgtaaattacctttggataatagagcctaaaatttaatggattcttcgtataggtttgttgaagaaaggaatttcacttattatgatccatttggtgacacacaaccaaacatccagtttacactgatattaacaacactgcagatacactgaatcacaagagaaatttggttcactgacccaacaatgttctcaaatacccactctttttttcctctccactctgctttctggggtgtcacatcactcacacagacaaaaactggcttccagtaactctaaagatgacaaaagtcttcctccatgactggagaaacccaggagtaattctagaaacatctttcataaaggcaaggaggcttgatttccaaatcttgctctccattctcattgttctggcctgggtcacgtgcttacccctgaatcaatggctcctagagccagggaagaagcgagctcctcccagaaactggaaggaaggctggagtgtgtaccaggggaagtgggcatggaggttgagaaggcctgacagtgcctacccaagggataaagtataataggttgtatattgggggatgaatgcaggctttcacctggaacagaggttatgatattgggcaaaatctaaaaataatcagctgcatatgaaccatttctaaacaaatttttattatttacatatttgattatttgtattgctagtattttattttcagggtatttgcatgaaactgatcttatctactccttgttatcattcagagggctagccaggtaagatatttctactccgtacccttcttattctaatttatcatatgggctattcttgtaaagtatttgcaaagtattgaaaaaataataaagctatttattagcatgctatagtaatattgttttacctgccacatttgactttgactaaaaggaagtccaccagagttttattgaagattattttgcatccaagtgacaaaagtaattttcatatattgaggtgtgggaaagacattctggctcatatatgagttatcttgaattttatgctgactaaaacagcctatttgtggactttcaaacatacactgtacatctgccttaattattaaagaaaaggatgcactgaccagaagtaaagaaaatccatattaaaaataaagatt

SEQ ID NO: 29749 - DNA, 1619 bp, Bovine  19866880666576
atttattttgggtaaactctgcttcattagagtttaatatgctatatgttatgtatttcagaaactccaggaaggaacttaatgacatacgatttgagtttactccaggaagaggtaagtttcaattgaaattattattttattgctacagagagcatttcagaaattgattataagcatgtggttataatttggtattcaaaaatgcattctctaacaatagaggagggaaggaaggaaggaagaaaggaaggatttgtagtaattgcagagaatccaaaccaaacctactactgattgtatgaattctaatgacacgtgctgcacagaatacccacacttataaatcaaatctattagctcaagcgtgaaaagaagtgctggcatggtgatgcagggcctaaaggacattatgatgggtgtgatgagatgcgcatagcagtcctaattatggttgagcaacaaaccatgacatcagaccaaaaggtagcatacttggcctctctgttgtccgttctgattatacaaagcctgtgttgagcagtgtctgggctgctgcttgctacaggcaccactaggaggcttggtaggaacaatgccagtctggcagaagaatgtaattttagtattttgagtagttactaaaatagcgtcagggctagactggttgctcttttagtgctgggatgcatggaagtcatcgaaccatgtcctgtttctaggtgtctctagcacctggcaagcacctggtacgcaggagaatcccaagtcattttggttaactaatggattcaggctttagagatcacaacactagttgttaaacaaaattgctatttccactctttagttcataaccagaacagtctaaagaagtgaaaatcaggtgctaatgctatgactgtactgtccttgacctctggtttcagacttttacatgaaaatagccttgatatttcattaatctcatacatttgaacatataacacgctgtaattattttatgtattagaacgccatgtcaaatttgacttgattaaataagttgaaattctatgtgctaaaattttgaaaacctgcaactttcctgacttgatagctggtcagtcagttaatggcttgatctccttgctgttaccacctgtaagaggacacaaactcaaatgcttacaggagccaaagtgaattgtgggaaccagagagttctaagtacattccagttcagttttgaacgaaccctgcccaccaaacaaaatatgttcctgggccataggtggttatggactcagtggccctgatctctagtctcctgtaagcacaaagatttcaagatttccagaggacctccctggtggtcccggtggttaagactctgtgcttccagtgcagaagacacaagttcagtccctggttgaggaactaagatccctgcatgctgtgctgtgtagtcaaaataataatcatcatcatcatgatttctaatgtatttgaattcaacatatctttttacaaaaaaacatagtaggtttcctaactgatctttctttctgggggcaatctttgacagcttagagtcagtctgtgaaattgaactgttgccggttgctgttatctaaaag

SEQ ID NO: 29750 - DNA, 1666 bp, Bovine  19866880668408
cttgggggtcttcccaacccagagattggccccacatctccggcatctcctgcattgacaggtgtattctttaccaatgagccacctaggaagccacactgtccactaaacttcttattaaaaattctctgcatcatctttcattttttccagtcttatggcttgattccactattaaaagtgtttgcaaatagtgaatagatttgatgggtattcataagtgattatttgtagaaaattcaagggcacatgttcttcaagtcaaggtctgtagagtttctggttgccttgaagtttcccttcacttgactatcacccaggctactattggttcctcaacacttgcaaaaaatgaaaaagcttactattgagtctttattgcattacactctttaaaacttccaatagctgatgcattttatgtgataatgtcaaaaatagtagcttggcactaaaaactctttcaagtcaacgtgatctccagcctacatttccagcatcatcacctactgcttcctgacgcagattgtatgatttggccaaagcagttcatttacttttctcctaatgtaacttatttcacttcgaagaaattcatggcaaccaaaacacaccccccccccaaccatttattttcttcaaaagcccattcaatcttcataatatcatcactcatcaatgtcatcattgctccagagtacttttttaaatctgaattccaattttaaaaatcatataagctctctcttgccatattcctgggtgcctgtttgcttggtaacacttataaaattgtgttaaattgtttagtgcactttgtttattttgttcatagcttctatttatgaaacagatctatgtattgtcctaaattccagggatccttttcatagtttaaattcatctttctagcttatctttaaagccttgaagtcagggtactctgcctatattcaatgttcaataaatgcacattggtgggttgatgaaaaagaacagatttagcaataccaccaagcagaagaagtgctgtgtcatcaccaggaactttctggctccgtggattaatatgctgtgggtacaattccataacagattaattgctacccatcatgaagaagttaaaatactctctgtatttagaagctgtactagaatcataatgaagtttcctaattttgtgccaagcctgtagatggagtatctacagttatttagctggccttatttatttagtgatacttgtttcctggagactgttcagatcactgaattggaatggatacaattctagcctatagtccatatcctactatgttataagttgcttagaactagatattatatcctattatacattaaccatggaaataagcactagccagtcagttttcattgatagctggctaattaactaaaggaaggtacatctatgcaatgtaatgcatacagccataaaaaaagaatgtatgtttctctatgtatgtttctctatgcactaaaacaaagagatctccgaaatacatgaagtgaacaaagcaaggtgcggatcagtgtgtgtgatatgctatcgtttgtataaatataaataaaaaaggatatggtggatctatatgtgtgtgtaaaagatatatcaagaagattatacagtgtgcagattatgcca

SEQ ID NO: 29751 - DNA, 1902 bp, Bovine  19866880678313
tgactgggtgactgaacacaaaagaaatactatttggatttcacagaatttcttttaaaatgtaagcatcagaatattaaagttacgaaaaggtcaaatagagtaataattttggtattgggtataaccaactgcttttgaatatatgtactcacaaaactcttgtcaagtttgattcgagcttttaataatgaattttagatcttcatgtttggatctggtctatctgcaatgtgaaaactaaccttttagaaattctgaaaagaaatttgccatttttagataaaataatctcaggatttaaattctgccatttgtttagaaaacaaattctgtcattctctttatatacaagcagcagcaaagatttttgcataaaaatcaaatgatacagtgattccttttaatataattgctgtaatggaagttatccttaattattagacttttgatttttttaaagaaattgcaaatatgctggattgcaaatatgaaatatatatccaaccaaacatgtgatgtcatcactcaaggagaatgtaaaagtttctgttttgtgttttcacacacaaacatttgaaaattcaaagaatagggtaggcttcttacttatagctctaagaagtctactggaccatcttggtctgggcattcgtgaggttcatagttcacatgcttctaaatgtgtcctcaagtcactcccaggaagaatgcgactgtactgtgttggcagagctgaagcagtttggcttttccttatccacacgtggaaggctctggaggtggactgagtcctattagcacaagctgggatgtattaagagagtatcactgacgtctatacactgccatgtgtaaaacagatagctagtgcgaagctgctggtgggagctgagctagtgggagctgagctggtgggagccgagctcagctcggtgctgtgatgacctagaggaatggaatgagggcaggaggcaggctcaagagggaacggttatatgtatatatatagctggttcactttgttgtacaacagaaaccaacacaacattgtaaaacgattatactccaattaaaaaaaaaaaagcttgtttgtacactcatttctcgttccactgccatcccaggtagctgagctgattatctggattctctaacatcgtctgcaatattcatttatgttttgatcaatagtggaaacgcctgcatatttcagtctatcctctgacacaaacacattatttatgtagccttctaatgcctccagtgcttcacagtgaaataattagagctgttctccttgtttctttattcctctcatcctaaaatatccaacccacttaatcctaggagcctgggaaaatgaaatagttacattaagtctcagaggatcgacacaacttgaaaattagtaaaagaaacaaacaaaaaatttaactagtgtatgtctttagtatctgtgctatatttaccttgctagcgtcctcagaatgttttggaaggtgcgtatgttagtttggatgtccccagaatcagatcttatgaggaagatttgaatgcaagtagtttatttgggagctcatctcaggaagtatcaatgagggaagacaggtgccagataaagaagccaatacagggtgtatggttcatatgtagaaaacaaacctatggttaccaggggaaacagggggagggacaagttgggagatgaggatagatatatacacaccactatacagaaactggataagtaataaggacctactgtgtagcatagggaactctactcagtactctgtaataacctatatgagaatagaatataaaagagtggatatacgtataactgattcattttgttgtacaagtgaaacaaacgcaacattgtgaatcaactacaca

SEQ ID NO: 29752 - DNA, 1370 bp, Bovine  19866880695035
cataactgggtgtaaagaatgtaccacagcccaagctgcgttgaaaacttaattaattgctgctttttcaacgctccctaaaattacctcatccttaaaactactctgggtataaccatagggcttcctaattataggtgtcatatttaacactgagtgttctctgtgttccccctggtagagatgaccacgattgcaccatccttttcttaagctgaaacggtgcagtgacccaatggtcataatggtcattgggccaaaattatcgtgtgtagttgtcgtgatgagaactatcggataagaaaaatgagcattttttttttaaagaaaacagaaaaatcgtgatactttgtctcctctatttacatataaaaatctccttaaaactttttaaaagataattcagatgaaacccagaaattcattaggagaaatgttacaaattctaatcaaaatattgatggaaactgaacatgagtatgcttagtctctcacagcatgatgcaacagttggggtaaaggagattcggtgctttggtctacacacagggctgtatgctgaacaaagaagctgtacattgttttatgaaggaatgttccaaagcggtgtgtggattttaatgtctgtcaggaaacagacaacttcatgaacaattaaattctagcctttgatgttttaagcaggggaataagagggaacaggaatgctccaactgttcacctcttcgagtgctgttccctacctgaagaacttttaaggactgtttttaagggaaaagaaaaatgcttaaatgaatatgaattccattttatcatatgaatttttactttgactttcgaaccatgaaggccgggaaactctgaaggccaggaaagttcttggaacttaataagaaaatataatgctgtcaagactaatagctcagatttaaattatatcgcttagtttctcacaaagaacaaggttctgtagtcatataccagatatctgtaccgagctgactactttccacgtggctcccaggaagatgacttgaaagaactgatgactcaatgcagacccatcactattaccagtaagtcggtctgaagaagaatgtttactatcagtggcctttggcatcatttttatataggaagaacagagcatgatttatagttttaacttagagaagcactggattagaattttaagttaatgtttccataaacaactgagtaaaatggcacttacaacttggaaatatgtgtatttaaaaagtattcaactgatatgcagttttccctcaaatcccatttctaaatttaaactgaaagatgacaggggaggaagcctttaaaataacaagggtcatttcagtacataaaga

SEQ ID NO: 29753 - DNA, 1481 bp, Bovine  19866880700153
tcacaggtgcagaaccagtgaatgtttgtgtctaaattttacttttagaacctagaataggaacatttacaccaatgcactgcccagaaagaggaggtatttgcacacatccacaacgataggttctttttttttttaaactattgcccactgataataaccagtttcctctgatgatctacctggagtcagaagacagcatgttttggatggtgctttatgaagcagacacatgtttactacttataatttagtaaaattaaaaaaatatatattgaagggcagatgcagatacaaagtcacaattttaagacaggaatattactctctacatattacccaaaactcactggtatggaagttaaaagagcagagcatggttcagaaggcagaactgtgggcttctcttgtcttcctagggttggtgaactctctgtaaactctagaacagaaatgacccttgtgaacaggtgtgcatgtgtggtaagtatttgatgggtgtgtgctgaccaataaataatactactttctcttgactcatttggctaaaatgagggctgctccttctcactgcaacatagacttgtgttgagcaatcctgccacgttaagtaacagtcttgagacagaagaagggcattgggggagagaacagttgagctttgccttctgggtaaatctaagttaaaactttcctgttaactagatttatcgctacttagtaatcttttgcctagaatattgaaggtgtgagatttttaagttggcttgagaggaactaaacagtttgttcagtgggattagatgaccatagagagaatggctgattaattatccttcctttaaaattatataatgcctcctcatgcttggaatttcagtgagaacattttcgcttcgtttcagaaagaccagtggaataataattatattgtatatcatattatgtagattgcctttcagatgagaagaaaaccttccctggtgttcccacagaaaacaaggaaattaaagttttttttttccgagtgtggatttaagatccattattcaagtgtgacagttgcttaactggtagataaaccaatgggactgcgtgtcttgatgtttttgtgcagcttatatgatctgggaaccggtaatgaaatttgcaacacctataagctagaaaaattttatgaaaccgcaatacatattttctttcatagctctattctgagccagcatgtgtgggcccctttcaagaaggggagggaaaaatggtgataaatgacctttgaagtgaacttttgatatttgcgttacaattctgtgggtttaagcttttaatttttacaattgtgggcgatatttgtgaagagtttccagtatgttctgagtagtggcattctgacccttaaaaaatgtaaagcacatttatttgcctattttatctgtttggatgagttcaaacttggcatatccttgcagtaagggtgatga

SEQ ID NO: 29754 - DNA, 1681 bp, Bovine  19866880745893
tggaggacagaggagcctacaacacgggggttgcaaagcactggacatgactgagtgactgaccaacaaccaaccccggagatacaggcctgggactgtgtttccttccccagcaaggtcatttctgaggtcatcaagactgtcaaggggaaaagcatgctgaagagaaaactctgttctctgagctctactcttaacttcatcaacagacacagaagcacagtgacatgagaaatgagaagtcgtttaaaaagccacactccttttttaacaggattaatatttaaataataggtaaccctgactctataaaagagaacagctaaatagcagatccctttggagttgaattctacatatgtcaaactgcctccataaaaagtttggaaaagtaggaggaatgatgaaaatgaggaagggaagaaagtgagagaaggtatgagaaaaatcaagatgcacgttgcccagttgattttagggttttgcatgttttgggcttacgttatagagattactatgtgtgcatgctcagtcgtgtccaactctttgcgaccccatggactgcagcctgccaggctcctctatccattggatttcccaggcaagaatactggagtgggctgccatttcattctccaggggatcttcccaatccagggatcaaacccacatctcctatatttgcaggcggattcttgaccgctgagccacctgggaagcccatggagatgaccagtgcagggttaatgcaggaaccatcaatgctgcctgcctcttagccgagtactacagtagaaagaattctgcaagcattgttatgtcttacaaggccactaacaattatcaagcaatacaatattacaagcaaacagcatattacaagaaatgctaaattgctataccagcaactgtaatgatgtcccaggctttgaatactgactcaattttaaatccttaaaaacaatgcggaaggagtctgcaagcagcaacattctcagaagaaaatcccttaaaggattcaaatacatgtggataagccaaagtccaccaagacttaaaataatgttcaaaggattcaggatgaatatgatacagtttaaatagttctgaaaatttgtattttaacttctaacaatacattcacctccggcagagctgtatttctcaccctgcccccactcccaaagaaatatttaagttttatttgcttccaacggattcatctatgcaacatccactcctttgtggatggaaaaatgtgcccaaaaaatgctagttatttttatagttgccatccatataaaatatgtagcctctaagagaaaggatttttttaagaatagcaaaatgttctgctatgcaaatacaagcaaatctttgtctatgcaaatgcagggcacagacttggaggaggcaaagaactctgacacccagctctcaggcaatgggaagttccaagagttcttgaggttgacagaaagcacagctccttctcagctagcctgagggctctcacactgcaatgattccgtctggtcactgttacccagtgatatgttttcactcattgctaaaaaaaggcactcagtaaaaccaaggtgttggtaccagttaactgcttttagaccacaagcagaggatctatatgctggcaacagaaataaatataaggatcaaaatt

SEQ ID NO: 29755 - DNA, 1183 bp, Bovine  19866880760881
tgttcttgcctggagaatcccagggacgggggagcctggtgggctgcagtccatggggtcacacagagtcggacatgactgaagagacttagcgattctgaccaaacctgagaccttcaaccaagctggaccagcctgcagttcataaccacacagaattaaaacctactgctgccctctactgggcagacctggaacaaaactaacatccacccatcaagtatttgaaatcacctaatttcttctctggtttcttgataatgtataaatttcaacatttataaattaatgataagcttccaagaagagggggagcaattttacaaagattcagacccattttccctctttatcaactaaaagaagcgacaaaatggtagcaaactaggagcctggcttcagacttggctactatatgacagcatgaacttggtcagggcccaaccaacctaggtctcaattttcaggtctgcaaatgaaagaatcacaaaccaggagatatttatggtcctggttgctctttttcattcatttttcaaaatgtatagctttttcttaaaaagctgtaataatctaacatattatacctctattctgttactcaggacttcactgattattacaaggactcaatggacatgagtctgagtaaactctggtagttggtgatggacagggaggcctggcatgttgcagtccatggggctgcaaagagtcggacacgactgagcgactgaactgaacttagtaacgagatagatgtaaaccaagggttttgcattgcatgaagacccacagtaagtatgagtccccctctctccctttcccacgttccccctgggaccagctccaagacattttctattcttgtaggacattctacacccatatccttaagtatttgttctctgctgctctctgagttttccaggtctggtgatgcaggcactatattccccactgaaaggcaagcccaacagctgcactgtatccttttatctgtctgcacaccctgtgtccattattggcagcagtggttgtgacggcagcagcccttactgcagcagaaacagcaatggtagcagtggtatccccagcggccggagtgaaaaaggttacagaaaagcaacagtgatattaaaataacaaaactgtaacagtaaagccgtgtgcgtgtgtgtgt

SEQ ID NO: 29756 - DNA, 3349 bp, Bovine  19866880829895
acatgtactatgtctctgctatatacacacgtaaatacacatgacattgaatatatatattgaatatataaagtgaacatatcaaatattctgtcctcatttgagggcaaaccctttgtgtttattatgttgctgtaatggtctagaaagcagagcatacatgatcatttatgattgtttatgcatcaggacatgttagccttaatgaaaaataagttatcagttacctcaagtttttgttctaaactgttactgacatattacttaacatgcatgaaaaataactgctgaatggcacacacacacaaaccaggaacatttccatttttgaccaacgagcaccacccatgtgctattttgatatgactcatttggtacccaacagtcctgaaaatagtcagagatgccgcacactttaatgatgtgggaatgttctttgcttcagtactgctttagtgctagcccttaatgtggctttgtttgattattccattctcatctgacttctttgattatagctccttactaaagtgtaagatctgattggtaactttagagatggtggtatcacatccagttgctttaacagatagtagcatgtaaccactgcctactgtatgcctggtgtctatgaggcaggcactttaattcaatatgctgcttttcctgaagtttctagtggcttccaggaagatggagattgaggctgaatattctagctgactttataaagcacatcatattcagactagagccttttgttatgctgtcctaggttcatgctgtgggcttccctggtgatagaataaatattgctggcttcccagcaataaagagtctgcctgccaatgtaggagccatgggtttgatccctgggtcaggaagatcccgtggagaaggaaatggcaacccactccagtattcttgccaggaaatcacatggacaagggagcctggcaggctacagtccataggatagcaaagagtcggatacaacttagcaactaaacaacatcaaggttcatgctttgagattgttttatcactgagagaattttgtaaggtgtttcttgtacttctaatagtgaggacaaggtccaagataagcccaccttaaatggaatttcattttttagtaagattcccgtgtttttcttttccatttccttctttgatttcatttcatcggatgagtaaagtgatagaataccacagtttctctgaaagtacaaagaatatacatcaactctcaaagtcttgttggcagtttggaaaattgagccatgtatgagagagagaaagaaggtgcatttcaaatggtctctggttgcctcgttatcatcacagttaccatgtgctgagtaattactatgagtcagacaccaggctaaacatattaaagcccgctatgaaaggtaattgtaccttcagctacgtgctcatgttgagtatgagtacacacttaaacacacaacacacactaagcccacttacatagtcatcatatttgaaactcagattaagcagggaaacccattttctgatgaaggcagcctttggcatagcaaactgtagttcaggttaggtagttacttgattcaggagctgtactttcccagtttcttcttatctaactctagtactgtgtatttgtaataatatcaggctgccatggagagcatgcagtctcccttgtgaaaacatcaaggttcataatggttctttgagcacgtggcaatttatcagtttccctttacaaagtcttcaaacagacgtctcactattgtcatgttcacgataacctctcaattaagtaatttctgttatattcacttgctacagcctgttcaatctcatctttatgagattgctaacgcctgtcaattatcattgagaggctacattcttttattcaaccacattttctaagagaatgagtcttttgctatcgaatgatcaatgtcatgttaaaggattttcttaatagcattcatttaaatagctcatcttaatagtccaacaagctcacaggctgtttgtaccaaacataaggttgtatcaaatgctacctcttcaacctttgccataaattataactcagtagctactaatgataggaaaggattgatggtggctggaattaaccttggcaagaaagaaacgcattgtcatagggaccagttatgagctaacttctagaggtgcatttgaggactaattcaggtagtagacaaaaggcaaaaatttcttggctcaccaaaaatgaagcagtgattttgtagaacctcttttgaacaaagacaggatgcaaattgtatgtggcaaatgtatttcacattgcttctgatttttcctcctgatagaacctgaattgttgaaatacacatgaatgatttttctaaatgaaaagtatatatattttacattgtactagattgttaatttttattgtgtggtttctgatccaccttcatttcacatttgggcagatactgcagacggcgtttctcaggagctcttctctgccggcttggttgatgggcatgatgtagttataggtgagtcattttttaatgcatgtagtgtcatgcattttgtttatatatcaaatggaactgcacttagaaacaaaagtttttagaagggaataatttattctgtgaatttctgaaaatttcttcaattcctatcttttatgtgaaagaagtatatttaagagtcatatttaattttctgttccaaaggcacttaatataattctgtcccatttgtccagacatgatttatccaatgcaaaacctcacttactggagataaaccaaagaacctagaaaaccgaaaagtccatgacctagcaagcccaagatactgtaaattccatacacagaagtgtggaaacttctggggtcctttctctgagtttctctattctttgtttggacacagttctaataaacttaggtggtggacttcctagctcttagaaaaattcattcattatgaagtttcaaggttggatgaaacttaacccatcattcagtccagttctttcattgtgtgaataaggaaacaaattcctaaagtgattcagtggtttgtcgagggcctgcagctgggctatggcagaaccaccacactttgagactgtggctttttctactactgctactttttagaatcaagaaaaagctgcgtgaaaattggggagcctgctagctacagacacactaataggagcaagaaatgactgctggcctcctgccaaggcagggaaggcagaaaagctgtaagaggtagacggtgtcatctaagaaaaagtgtagcctgcatctacctggggtgagggtga

SEQ ID NO: 29757 - DNA, 1930 bp, Bovine  19866880926263
ttttagtgcccagtgcctgggtcacaagaggaatttaataaatgtttgtgaaaccaaaattaaagtaccttttcccccatccatattgtctgtagcatttcctcccatcctgtatgtctcatgcaccgattattgccaagttgtcgtgtactcagctgttcttttccttggtttttgagggcaggctttccacctctgactcctaacatcttcgtacctagtatgtagcagaagttctcaaacagttttgctaaataacagccagtgagtgagtctcttattttgcctgctatgaaaactgaaggaatatctacccaactccacctctggcacttttgccattctgcacattttcaccctggggtctgggagggaagctgaggtgtggtttgcatcagcctgaagactggaatccatttatagctgaatgttctctttcagttctcatatatacacatatacttggacatcactgtgctttatatttagcataaatgttgatgttgggtttccttggtggccaagttgctatagaatctgcctgcagtgcaggagaccccagttcgtcccctgggtcaggaagatgttagcttgtatcttcattttctttactttgtcctttccagtttgcatcccatgtgtatcgttagatgaggcagaatcaaaacatacatgagatcctcttaaagcccactatttcttggagcattggatattatttgatgaacaatctagatggacttgaagtgcctgaaatgtaacaacaggagcaatcaaatgtgagctatatgggaatggtttcctgatgggcattatacactattttttatattagctcaagaacagactccaaaacagttgtggaatttcttgactacaggtagtttctggggcttcagataatgaattacagttgagggattaaaatgagagacttgcatcaaggatctttcttggctcacctccctttgcagagaaggaactgaagtctaagaacagtctccgagtgggatcagaaagaattacgttcttcctgctctttcagcctggagcagttggtaaagctatttggaaatttggcttccaaagctagccagaagtcttcaggttatgtttcaattattcttactaaattccccaaaacttattctactttggagggatcagagatactggctcttgcatatctcttcttgcttttgctgctgtcatgataatatctttcttaatcacccctagtttgcagaatgttgaacaaaagatataagaaaatcatatttctctcatattcataatattagatgaacacacactcactctaaattgccttttgccaaattctcaagaagaaaaaaaaactgctttatttttattatttttgcatctttgttttctttcattttatttcttctgagtgaggatataaaagtagattgccctaaaatctctaacccataaaaatgaagtcatatatactactgcgggcacatgaaagaaacgaggatgataatagtgacaataattatcgaccagaatttattgaatgcttttgtaatgcccctaacaataagtactcacgcaaaacagcaaggcagaaatagttatcctgaatttatgtagaacgaaacggcatctccaaatgattaagtgactggctgaaggcttcacacatgtgagattcctgtgttccttttgtgaagcaatttggaaaacatcagaagaaagagcgcaatgcttgcagagaacattattgggaaatgtcttatcaaagacacattgtaaagtttgcagaaaagaatctgagagactaatgatgattttgaaacactgtaatttcttctctaaagtgaaagttggcccactatgtgtacgagtatggcaacatcttgtttatgaggtattcagcctgctgacagctggggttcaccaa

SEQ ID NO: 29758 - DNA, 879 bp, Bovine  19866880930464
ccatagacggcagccgaccaggctccccatccctgggattctccaggcaagaacactggagcgggttgccatttccttctcccaaatgcatgaaagtgaaaagtgaaagtgaagttgctcagtcgtgtccgactcttagcgaccccatggactgcagcctaccaggctcctccgcccatgggattttccaggcaagagtactggagtagggtgccattgccttctccattggttgttatttcagaacaacagttactcttttttgtgtgtggtagagcagatgcccccattgacgcaggaagatagttttgaagtttgaattttatcttacccacttaattcttttaggatgtcttgtgattactgtaaacacagaatcctcccaaatgaaatccagtatttttagaagtatcaaaatgttacatttcctcaagagatctcttcagagtcttggggttgaatgcaatagacagaatcacttcagtttatcttcttttaggtaatgaagtaagaaagaaccgagtaaatagtattttttggtgaaattaacaaagaccttgtcaagttaactccacttacaaaaaatgatagctatatcagttttagtcacttcaatggtgagtctgaatcatggtcctttttttccccttggctttaaaacattttggtagttgagtgattaaaggatttaatggtttcgtctaagttttataccacaaagcaaataaaacatccagtattgaagtcagaaccttaatagaaattcagactcaatcaccactgtttgggtaggacacctgctttattaggagagggaattaatgactgagggatgaagaaagtatctgtgtagggagattaactgggtttaaatttggg

SEQ ID NO: 29759 - DNA, 2288 bp, Bovine  19866880975293
acacatttaccccccaccaatgttcattgcagcattatttacaatagctaggacatggaagcaacctagatgttcatcaacagatggatggataaagaagttgtgatacataagcacaatagaatgttactcagccagaaaaaggagtgaaactgaggcagttgtagggagatggataaacctaaagtgtctcatatagggtaaaataagtcagaaagagaaacacaaatatcgtatattaatggatatatatggaatttagaaaaacagtactgatgacactattgcaggacaggaatagagacacagacatagcagacatagcaaacagatttgtggacacagttggggaaggagagggtgagatgaattaaaagagtagcactgacatatatatactaccacgtataaaatagatagctagtgggaagctgctgtatagcacagggagctcagctcactgctctgtgatgacctaaagcggtaagatgggtgggtggggaagggagcttcaagaggaaaaggatatatgtatactatagctgattcacatttggttgtacagcaaaaactaacacaacgttgaaaaccaattatcttccattagaaaataaataataaataaatatataaaagataaacttgatgattaaaaaaaactgttaaggggaggattgaaacacgcatgccttttctggatgagcttgtcaaagttttgggtttttgtacagacaaaaacacaattcttgctcttgttgcaagcaggctggtgtcagtgagagcttcctgtcccccactgtctgagtaggaatggtattgagacctgaggagttcagggttcccatcacttccttagggtcttgactcgaaggtaccgctcttcccacctcaaaccattggacaactgtgtggaaaatgtgatggcaagtgtgcgatctgtgagtctgagtcctctatgcatcctgcaccctgatgtgcatatgcaatgtgtataactatggctgttaccagggatgctctgtgattggtagaggccttgagtttgatactggagttcatcacccaagagaaagatagagatggttacccaaagattgtcagtttgaggagctctaaggcaaatctcttctttaaatacaaaaagtatggcctcaagaagaggcgattgatgggctgccacttcctttcctcatcaaactgctgcagctgccaagacaaacgcctatgactgcaagcagaaaggaagtggaacacagagcctcaactgaattgcctattagtacactagaacctatccaccctttcctcttctctcactcagaagtggtaagaatggaaaaaagattcttcgcagcacattctggcaggcggtatcagagaaaaactgatagattagtttcatagtgtttcttaaattcaagaagcaaggctgtgttatccacatcgaaaagttctttacaccaaaaccctctaaaacagaagtatcatttcagtcttctgtttgaggagttgactgtgacactatctgcagtgagacgcatgtcttacagcagctctgatagcagttgtccttgatgaaacatctgcagtgtggtggagagctctaagaacaataaatatagacatttcatcttgcaatcatatcacttttcttttagaaaattgaaaaccctttctgctgctcttgtattttaaagtagcacactgacttttaaaaaatttttactttcagttcagttcagttgagttgcttagttgtgtctgactctttgcaaccccatggactgcagcatgccaggcctccctgcccataaccaactcccagagtttacccaaactcatctccattgagtcagtgatgccatccaaccatctcaacctctgtcatccccttcctttaaattctatttaactcattagtgaatgggaaaagtgaaagtgaagttgctcaatcatgtctgactctttgcaacctcatggactgtagcctaccaggctcctcgtctgtggaattctccagacaagagtattagagtgggttgccatttccttctccaagggatctatctaacccagggatcgaacccaggtctcccatattgcaggcagacgccttaccatctgagccaccagggaagctatcagacagtaaaaccagttctaaaagcaactgagtctgcatgggctatcagaaaatttcctttaaaaaatcaaagaatatcagaataagatttctaaggtacacaaatgggaaagtcctataagataataaaaccataacctttata

SEQ ID NO: 29760 - DNA, 1770 bp, Bovine  19866880990997
ccttaatacatcttcatctcaagtcagcaggaccactgagtttgattagataataacattaggtagcctagagaaagatggatcagcacaaggtgagccaccctcaaacccccaagtcgcaactgctgtgagttccaatcactggaaaagtctcacaactctgaacttagtttgcctgtccatcatgtagtcgaatcaaggcccagtcttatgccaacgtcttgcgtttaccttgtgctcagtcgagccaccttcagtgttaaggaactgcacattataaacatcacatgtatacatctgtgggtcacttataagtgtgtgtgagtacattatgaatagagccctagtcttgaaaaggagcaaaaatcgagaatcatgtcttaaagaactatttcctaacatttttatgctaagtagtacccatgtgacaaacatgtaaatattcatcaaaaaccatatgtatatatttttaaaggcatttttttcttcttcccagctgtatgtattgctagaatctgcttgctatgtacatttcccttctgcatggaacttggtgaggcaaggtcatttgtccagtttcaatagcctaaagcatggttgccctttgttttttgaatgttccaaaaatgtttaaatcaagtgatcaggaaaaagctctaattttctacttttgctaattttatgacactggccaaattagtattagttaacaaatcagtgatttgttaagccatttttaaacttattattatttctttgacataaaatagtgtttcagacagcattttaccagaagtcaattcagacaattttaggaaaaccttctcactgtcccccaacttgttttgttcattatgcatcagataacaaaagatatcaatacttcatgtctatactcttaaattttcattaaaatttttttttggggggggagtctgtctttggtggctagtttgtgtggctttgtgtcttcttatattggagcaaatgtcagtttcaatatatattattgtatttttaaaaaccaaaatcaaaaaatgaagatcgttttcaatttgaaataaattcagaagaacaaaacccctttgtgtgacatgacatggggaaaagaaactcgttacagagaagctaaggaaggagtttttgaatcaaatctcttctattaaaagactgaaatatttccataaaacatctgggattcattttctacctttcctaatatgtgggtttaggggggaattgattatgtaatttcttctgtaaaggtgaagatagtttttataagcaacaaagtaacttgtgaatgaaagaagcaatttactagaaacgcttgttgatgataattgacatttaggtatgtcgttatatatgaatgattgtatttatgtatttatttgtcaaaattgtacatactgtttcaccaaatgtaattgtctgtaaaagtgcactctccagttttgtagtacaacttagggttacatgggttgccaatcgagctgctaatcagaatactattttttgtatcagtgttataaaactgaaaaatagatgctgaaaatgtctttacattcagtttcttcaccttccttatgaaatgtaaagtgttgatttgaaagcacgatgctaatgtataagcccatctgtcatgaggaagattatggctccataaagctgattttttaaaccatggggacaaataaacagaagcagaacagactttccacttggcttcttttctgaaagaatctctttggcgagatgtgattattg

SEQ ID NO: 29761 - DNA, 1730 bp, Bovine  19866881000595
tgaggtgatatctattgtagatttaatctgcatttctctaataactggtgacattgagcccacaatagtttataagaacatcagttaacaatagctataccaacaatggttattatttttttaaccatcacctcattttttaatcattatctcatgagataaaatgtcatctcagtagtttatttcacttcagaattgtggaacttgaatgcttctgtgtattcattggcctttgaatttcttcagggaagaattagaattgtttatgtcattttttttcctgttttgctattcaagcttttcttattaatttgtaagctcacatttacttcatgctcactctcactctccccacccccacctgtgtgtgtgtatgtatgtatttatacatgtatctatatctatatgtatatatgggtacatgtataaatatatatatatatatatccattttctaaatatggtgtcattttctttaatgtaactagaccctttcagtcttttcttttatggttttggtctttattgttttgtttaagagagccttccctaccgcaagtgttaataaaagtacacgttacttgtaactgttttgtgattttacttcaaaattaacctaatcaaaatttattttgttacaaggtgtaaggtagggattgaaaagtaattctttaaaaaaacacgatgtaattattttaatattatttattaaataatctacattttgtccacaaatttaatatcccaattttatcacaacacttctaatataattggttctatttctaaacttttatttcattccattaatctatcttcctattctgacattagtaccactcattgggatttttattggattgcattaaaataatatattattttggaaaaagttgccataacctactttaaatttttattatagatataaaatactgacagttttctaatagcaaaagataaagaattttactttcatttattattgaaaaccataatcctctgaatgataagctcagcaacaaaattggaatccatctccaatcaactctgcagagcttgaaggtgtacattttgtatatcagccctatcctgagcttaatttttccccatctttttttcctattctgtctccattgactaatttaattatttatttttgtaaaatctttgcattgtgtttacaactgctaactaccttcctccagttttaaagtgatttggaagtaaaactaaaagcttttaatagattatcaaagaaatccatgaccataaacattaaaaaccacagttctagatcatttaaagtggctcattaatggccaaaattgaatgtaattttacaaatttctttataccatgctattttatgaaatcaacctgacctaaatgatcctgacatcatttgaagaagcatatgtgaaattaaattgttaatgtccagaagactgatgctgaaatcaagtactacccacaaagtccacagcataacaccttgtgtttcaggataactgcaataaaaactattcaactttaaaaagagagaatgtaaaacaatagagattggtatctagtatataccagatatataccataatctggttgatcagacttcatttattcattcattccgtgcctgcataaactttgaaagtgaagtcgctcagtcatgtccgactctttgagaccccatgaatcacagcacgccaggcctccctttccattaccaa

SEQ ID NO: 29762 - DNA, 756 bp, Bovine  19866881015070
tgtctacattgagagtgaatgtctctcattctttttgtcaagctaattgtcaaacgggattctccgcgactagctggatgctttagtcttcctccagggcacttttcaccaggtaattctcactaggccttttatgaaagtgctaaatgtcactgcagcgggaggaaggagacaatgccacgctctctctttgtgcaacaatacacgtttattgtccttttacctctgcagtcatctttgagtaattgttgtgtaaacaatagaatggaatgaaattacattaagttgtatgcaaatggctctagaacaccttaacaattatgacaaggcaattataaataactttttttttccttagtaatatatatttgctttttaaagtacattaaagagctgccatatctagggttagctaggaaagagcaaatggtaccatctgggagccaccaccctgaaagtttagactccaattttgaaaatctgatggtttactattccataatgtatagtcaagcagagggcgatttgggttgaaagtatgtattcttgaaacttaacagcgttttaccttttagtcattgcacaaaaccctttctattatttttcactccatctgggtattctgcagaatttcaagtaaaacacggattctggtatttttcaagtttatcgcctttggaacgacagattctatcatttcaggagacatcaaatcagaggtgggtacagaattagcaatctaacagaaggcgccat

SEQ ID NO: 29763 - DNA, 1053 bp, Bovine  19866881017695
attagaacataaattccatacggacagagagactgaatgccagacttacagattgtttccattaaatatttatagaattaatgaaggtaaataaatccccattcttgtgtatttctttaagggagaggaagcagaagtgactctctttgtctataatgcaagcttgtatatgtatgctaagttgctttagtcctgtctgactctttgcgaccctatggactgtagccctccaggctcctctctccatgggattctccaggcaagagtatcagagtgggtagccattttcttcttcaggggatcttcctgacatagggatcaaacccaggtctcctgcattgcaggcagattctttactgtctgagccaccacggaagcctcataatgtaagcctgctactgctactgctgctaactcacttcagtcgtgtccgactctgtgtgaccccatagacagaagcccaccaggctcccctgtccctgggattctccaggcaagaacactggagtgggttgccatttccttctccaatgcatgaaagtgaaaagtgaaagtgcagtcgctcagtcgtgtctgactcttagcgaccccatggactgtagcctaccaggctcctccgtccatgggattttccaggcaagagcactacataaaatatataactagtaaggacctactgtatagcacagggaactctactcaataccctgtacagacatatacaggaaaagaatctgaaaaaaagaagtagatatatgtataactgattcactttgctgtttcccaattcacttttctgtacacctgaaactaacacacccttctaaatcaattatattctaattaaaaaaaaaattctcatgttgaccagccaaataacgaatccaaaaatggattcccacttccctaccccccaaaaccaacaacagaattatggaacaggttattaaatgacactactattacttgttggcacagcatggcgaaatctttaccttcattccgtaactttccacttaccaacttaaatgtcaatgtttttaaagctttggg

SEQ ID NO: 29764 - DNA, 1553 bp, Bovine  19866881032639
cgtaggacaaagggcccgggtaggtgtctcttactccccctcctcccctccactcctctctcctgcagggccaggctctatctgactcacagggtgcagtcttcacttgccactgttatttttaccacatgctcttgtctgggcttggtttctagacaaattcagactatcaaaacgttgatagttcttcttgctttttcgtgctctcattaccttttaattcactgtaacctttcattgttcttgcaatgaaagtgagaagagggaatgaggaccactcacaaaaaccagaagtcagctccaggaagataattttgctacataagtgtttcttgtttgcatccttctcatcttcagcaggagctgccatctctgaacaccacttttccatccctagctacttgctctattttctcttatcttcctcttcacttctttttccatttccatttcttcctcttctttactccttgtccatttctttctgaagcccacataggctctgtcctcacagcaacaaagattttctgtgtttaggtggcaattctgttctgttccctattgcttgtcatcttgaattgcaggcctctgaaactggcactggttgcctgtctcccattcagcaccatgagcactctgcttatatgtaaccccctttcatcctaaaggctgcacacggtgttccttccaggaggtcctgctgtactcttttctccatcctactgggcttttcccgactgtaggttatactcagatgatttactgagcctcatctgtaacctatgatttctatatactcgctgagaaccttctgtacccctaaatgaaaagcacttggcaaggagttaaccttatctttcctttgccacatttctatttcatgcctgtgtcaatgaaaccaactcctcaactgtctgctccttttactgaaccatcccatatgtcacaatttcttcttaagatatcatagaatctctgatccttaggattgaaaaggatcttaaactaatttagttatatataatgacatgaggataaaatgacataaacgtaaacaattatgatgtgaaattaaatatacaatatgaccttgtgagtgtgtatatgtgtgtgtgtgtgtcctgaaggatgcagacatcacagtggtaacagggttgtctgcgggtggtacagttacctgtcggtattaaccttctttcctatactcactcacattttctttaataagtaatacaagaaataataggaaacactgggagaatcattttttaaattccaagggggcattttttccacctagaattctataccaatcaaattaattatcaatagcacactagaaggcgagacgtgtcagacatgaaagcactgaaaaatttatcttcaatttgtccttttaggaagctcagtgaaaatgattacaaaacaagggcataagccaatgaaacagaagacatagggatgtaggaaacaaacaaacaaaaaaaaaaacaaactgaaaaagtctttgaaaaaataactattaataggaaaggggacatgaaaatagtcat

SEQ ID NO: 29765 - DNA, 1030 bp, Bovine  19866881082732
catattagttttccatggctattattagctaaagttcaaatttaaatactgacatcccatgcagcaactatgcactgacaacattgtctctagtaataacttactcaaagtagaggacatttgaaactaaaggaggtacattctttgttattttttaaattgttaggatcacagctaccaaatgaatactcaagtctactgcggcggcctgaaagaattaattatataccccacatgctcaagttattacaagaaaataaattatacaggaaacccagctggtcagatatttcttcacaaaaggaaatgtattttgggaaaggtttttattgcagagtgtgtgtgtgtgtgcatgtacgcatatgtgagtgagtgtggtgtgcatgtgggtgtatgtgtatacatgggtgtttaaaaagtgtagcaaaggaatggatgagagaaagagactctctagaaatgactttataaactccaatcctcacagcatattacctatatcccctggtaagacctgcattataggaagccacagaaatgatatcctatgactttcctgtattgaaggtatttttcagttaaaattaaaggacaagttcaccttcaactagagttttataccaaccctcatgtaacgctgctgctgttcaacatgctgatcctgttctaaccagccctggcttctctgcatcctaatcctacctgtggcagaaggacagggagccaaggagggaagaaaaccgagagagctggaggggaactgtgcccacctagccctactggatggcgaagggatttccaggcagaactcaccctcaattgtggctacaagctgaggttacaattggctatggatccttgagagaaaaggcttcaaacctttaaaattattgtatatcactaagtgatttaagcacaaataaaataaaaattattacagagcctgtatcttccaggttacagacattatggtagactggtaaagagctaacaacaacaacaacaacaaaaacattttaaaagtaaatta

SEQ ID NO: 29766 - DNA, 756 bp, Bovine  19866881115739
agaagatccaagccttgagggccaccaggtggtaacccctagagtaaaaaaaaaaaaaaaaaggaaccgtcaggaatcggagtcagggcagaagaaaggatgtgggatggattatagactaaaatgtgcttctgaggcgtggcggtaaaaacttgaagctcaacagatttcaattttggtatgccgacagaggaaaaaaattccacaggcatagaaacactcaattaaaactgcctaggctcatttcctcaagaactgtgattaaattaagacctgagatagaaaatgcaggctgaagtgattttaaaaaccactttttcacagttggggacttatatttttttttacatattcaaacaaaaggagtcatggcttaaagtcagggggaaaatctatgatacataatgaaggctgaacttctgcataccaaatgcacttaaagaaatggaacaaaacaacaccatcagcaatgaagcaccaagggtacctcaacctgaaaagcaggcttgcctattcaaaacaaacttaaccagcctgcaaaacccaagaaaaggggtgcagaaacaacctagattttccttctctgtcaagtatcttgacaaggtacttgcccatgaaatatgagcacaaagggtagcatattttggggttttccttctctttaatatttcttgcttttgaaaatgggctgcaaatagcacacctcaatagaacatttgaaagaatatgttatgctgccatggcataacctaaaca

SEQ ID NO: 29767 - DNA, 1390 bp, Bovine  19866881130066
tcctaggattgactctggttatgagataaaaagaaggaagtctttggttttatcagctaggtcagctttatctcagtgtagcagtagatttgatacgaaaacctaatcaatatagtacttgccttaagaactcactgagaaatggaatatagaaatttaacaagagaaaggagtataatacacttacaacaaaattatagttttttactctgaatatcacctcagcctcaaattatattgcgagaagttgaaattaatggtttgagagactgcattttgttttgcctagttttgtttttagactattcttctccttcagtgattatgtaattgcccaaaccattgtggaaatagccacatctttaaaaaaagaaaaaaaaagaagaagctaaaatcaatctaaaaaacaaaaaccacacactgcaagtactttcatgacacccctcttcaaattggagataaaaccgaagctttaagaaacttcatttcagcctcagaagctgacaaatgaagaatttaatcatagagaagttctgcctgagatgtaaaacacaaatcctgggagtttgttatggagattgtttcagagaaatggttttaatttcttaagaggctttataatgacagcttgtgtctccacatcaactggtaaaaggacaacaaaaactcaaaagggattctagtaaaatccacactaaaaacactaatgagacagttaaattacctattgaaggagctgaaaagcaaaattgacaggtttttagtcaaaggaatgttcatgtctcccaagtaaacaaagactagggagtgaatgaaaggaagaaaaagaacacccggttcctcggggagctattctgtgaggaattcttagcagctacagaaattcgtaggtcaaagaaatctacacgcactgggccttgaggccagagggaaccctaggaaaaagccagccctccctgttccgggcaggcagagggaagcctggagggagagagagagagacaaagagagaacagtgattgagtttcctttccaaagtcttaagtgaagtccctcaaccgtgtccgattctttgcgaccccatggattgtagcctaccaggctcctcggtccatggaattttctaggcaagaatactggagtgggatgccatttccttctccagggaataaaaccaaatactttatagaactctactcagaacgctgggggtataagacaggtaataaggagacctatcattaactgttgccaggtttttagtgtcaatttactagacaatggacttaaattttttttcatttttagaaaaaataataaatttagagattaaaaaaatataatgtaaataataaaatatagaaaagcataaagaggaaaattaaagaag

SEQ ID NO: 29768 - DNA, 1222 bp, Bovine  19866881162698
ctttgttataccttgtgtaacatgaaaccagagcgtttaataaactatatgttgcaaattttctcattagcaggcacccaatttaactggtagtttaagattttgagcttctctaaataagccaacagaaaaaataaataagcaaaaagctttcttgtgtagcagttattttcctcaaccttgacgtttatccataaggcacttagtaagccccctttgatataacagaaaggtcaacttcattgccactgtttttctaacatgctatttgttggacaaatcctttttatttctctcttttaaaaagtttaagagggaattcactaatgtgatcaactgtggactttcatcctggccacccagttccacaaagtcaaaatgatcaaagactctgctgtttcgcaccttgctttcatctcatggcttccggggaagatggaaggtaaacagtctcacagagctccaattacgaatatcaagataaagaggagatgactttcctttcccacctttaaaattatctatggattgatgtaaaatagctttcagagcctcaagtacttgcttgctctctgattgcaaacaatgggttctgaacaagaacaaataaacgtgggaagtggaagggtaacccggttaagaggcagcctcagtgagcactgggataagcagagccaggtttctaccatcaaactcagctctccttcgcttttctgagtattggggttgaaattccactgacaaaatgtaatttgcattttcctaagaacctgtgtagcagatagatggtaaagagaattaaaagattatccaaagagatctaagattattaggaaagaaagaaagagtttgatgctatagtgctatagaacagaaataagaagaaaaaaccaaggctcccttttgaaaatttcagttagggtggggagggagcctttgaagaactctattttgcgtgtgcattgctttctttttgtccttcttagagtcattttgctttttaaggctccattgcccatttagttgcctgaattaactgaaataatttcttatatccatcttaaaaagaattcccccataaaagcatttttttctgtgctctatgttaacatttgggatctttattcaaatcttagaatcagtcacattatgtctccggagaatcctgatttctgtcagctcatttctgtgttaagaaggaagggcttctatatcctgtaca

SEQ ID NO: 29769 - DNA, 2181 bp, Bovine  19866881190260
tgtgggatcccatgtttcctgtgctcacctccaagaagccttcagtagaaagggaaaactccagagaagaatttataatgacagtagcatcagctttcagctcttgcacttgagttctaaaatgacatataccaggtggtaagaaaatctgtgaaattattcacaatagtcaaggggtgaaagcaaccttcatatccatcaacagatgaatggataaacaaaacatggtgaatatataatggtatattattcagcattaaaaaagaatggaatcttaacatatgctacagcatgaatgaaccttgaggacattaggctaagagaaataaaccaatcacaaatattgcgtgattccttggttaaatatatatgggtatgggttaatgagtgaaaaattcaaattaggtggtaagatcaaattcatttttaaaatgcagtaaactcagacatcatgatggacacaaagagaatgactggacctactctgcaaatccctgaagctagggtcaatttcatgtttggcttttctcaagtgatattttcctagaaaagaaggtactacagtgatgcacttttttttttttctttcagcctcaaatacccctaatatcttctatgtgaaacacgcgtaatatggatacaccaaaaaatacttaagaatccctgtctagacaaacagggttataattcagacctctaaaaagagagatttcatataacacctcaggatttcttagcttttcagaatagctagaagtttcagagaaaagtcaaactctcccttctgattgccttgttgtctgtgtattttccattgtgggacccactcttatccatatttgaaacgaagagacagttgcctttgaactctgtgtatccttgacatcttccattttctgacattcactatctttccaggtttcccgtgatagctcttggattgaaatgtataactattaagacagtattataagtagcccttcctttatgcttagatgtgaaatagtgtgtctccctaagctcaacctattctatatttttaagtttcttgatggttaattccagtccagattttattcctcctgccctcttactcaaggttggattgattttttttttctttcagctgcctaagctataacaattaggggtgtgcaatgaaggataaaatagctctgattctaaattgcatcctagcaaatggggagatttttaaattaagttgttcccgactttactaaacaactgtaatttctaaatttatgattcacatatagttgtgatgtaacttacaggacagcttgatatagtgatgaaaatttaaataattccctaagataaaaaatcaaagagtcatccataagaggtagtagcttccttaatccaaataaagaaagcatggggtcagatggcagagataggaattagaaaacatttgtccatagtgccaaagctaagaattcttcctgaaagctactgctgaaaggattgtggtccaaatggctttatttcccatgttaagaaaaatgtagggacatgatttgtgttcccttcaactacatcctttccaggtatttagcattttctcccttctggttctaacctaccttattttcttcatatatagaatatgttaagtgcttttctccacttcacattatatatttgtgtttattatcagcctccatataactagactataagctccttgtcattccaaagattaaccctttagtaagagttcaataaatatttgtgaactgaaggaatgaatgaacagtgaaacagcctttttattatagtccacattgtattaaaagtgattccattgggaaaccttgtaaatcaatgtattttgggctagtcagattgggtaaatggaacacatttaatagcttctctgagggatccactttttgccaacagtaaagatggatgtcaggtacagtcttcctaacttcatgcttgacagtggaacatgtattttaatgtataaatgtagaatttcctgagttctttgacctaatttttttccagaaatgttagtacatactgctcttgaacaccagtgaaaacaccttgtagtgagatgtctttggcttctttggcattcttaacttctgtcaacaaaaatattaaactatcgatagtaaaagtagagaagagttttatttgagccaa

SEQ ID NO: 29770 - DNA, 700 bp, Bovine  19866881195597
tgagcttctgattgatggtttccagcagtgtttactgtgggcattacccgaggttcctaagagtgagtatgtattcattcaaatgtaataaatctttaacataacttatctttttaagattccacagttcatataattggcttttacggagaacgcccactttgcttatctgcactgacatctatgatttggcatctttaatttactgtggttcttataaaaagcactgaaacaagaagaggacacatggttaattatgtgccacttgaagagaaatgtaacacacatggaacaaaaatgacttccataaaggaaacattataatctaattggttccttggaccttataaattagagctaattagcaaaaagaaatttttgcatctcagaacgcttatgttgcctggccagaattacatggtcagtcaattggcaagtcaagatttaagcttaagtcttctagtttagaagttaatattcaatatatctgctgttctctccagatgcaataagaagaaaactagaggtgttctgggttttcatggaaattgccacaacttaatgacccaagactggacaaaaagaaattgtcttcactgtttgcattatctataagaaaagcaaggctgttctttgaaaacttgaatctttctctttttcttcagttcctttatttagtaaaagagttttataatttaac

SEQ ID NO: 29771 - DNA, 1155 bp, Bovine  19866881200714
atataactgtcatcctttgtcattagcagcattcttaccttactgaaatatctgagttttgtttttttttaagttttgtttctgttaaccatttagtttgtgtttgattatgtttctataatttgttcttaagttttcaacctctttcttcttcccagctggcctcactattacatctaacattcaattctattctaatagccactagaaattttaacctaccatcactatacttaaaaataatttctcttctgtatctgggtgggcaacttggatcatgacattcctgttgcctcacaccctttttagttattgcttctgatgggtgatgggtgtgttttccttttctagttcagaatttcctccaattaaaaaaattccctgtccataatgtgtatgatggaaataacacttaattggaccaagtgactatttcatttttgctcttctttgaaatatgtttttagatatagaaataaggatgaaaacttacaaataatatccttgtaaagtttcttgaatgattattctgcactttggagtccaaaccttcaactcagcccgattcagtccatcacccactcagtgctgcctggccatcctcaccaaggacctcccttccagcagtggttgactatttagcatcttggttttgttttacttgttctttcataaaaatcaggtgaattccctgagccaggtactgttggttcctgagggacagtgggtaggaatgcactgggtagaaggggaacgctacctgaggacagctatttagtagagacagcttacctgacagcttgctctaaggatcagttccctgaagttattgtaaagcactggactttcaaagccacatgcatggtcccacttgaccacattttttttttcattcttcattttagagaatgactggctctatttgttagaggatagagccatccatatagtggttcattatgatgatggcgagtgggtttacaccctgagtgatgggacattgatcatagccctgccctggcgtagtcccacggtgttaattacggggtgtcagtattaggaagaaaagctaacacctgggagtgccgcttaccctgggtccctggtctgaggatggggggtgtcttcagggacgctctcggttcaagccatggg

SEQ ID NO: 29772 - DNA, 902 bp, Bovine  19866881202830
tgtgaaaactcctagcaaactcctagcaatagtcaatgtctttcactgatgacttcaccatggggaagaagaaaaaagaataaattgttcaatttagaaatataattttcaacataaatcccaccaatatgttgttgttgttcagtcgctaagttgtgtctgactctttgcaaccccatgaactgcagcacgccaggcttctctttccatcatgatctcccggagctgctcatactcgtgtccattgagtcagtgatgccatccaatcatcccatcctctgtgcccatctcctcttgccctcaatctttcccagcatcaaggtcttttccaaagaatcagcactggccaaagtattcagtacttagttaattgagatacgtataagcttatgcattttggcaaaataaaagcgaaacttgcttacctttttgaaaatatcaaagacctgttccagagagactgataactctttctatctgtctctttctgtgttacatatgcttgtaatggttattttcattcattagagagggatttaagcttttcaatttttctaactttaatactgctgttatgtaagagaaggaaaagctctgaggagccttcctagaagagataattgtgcagaactcctggtctccttcttcagtcgtgtaacatatatcagttggtaatggttaattagtgtatgcacttgcaatttggtctcctgaggagggaaattacatttcttacttttaacctagaagagcatagaattctgtgaatgtgttcatcttactaagactttacagccttgccttaagcatctgttgaggggaatggaatggaaacaagagaaaatgacaagccatttgctgagtacgccatttataacaagaagtacctaaggtgttaggtg

SEQ ID NO: 29773 - DNA, 758 bp, Bovine  19866881242683
ctggcccaaactgtagtgaagttactgggaatggaagtttgaggacatattgaaaagatataaaaacgacctcccttcatagggttgtgtttcatggcattgggaaatcttcctctttaggtttaaggagctttttattttatctttatagtgtaaggtcattgtacttttgtctcatcattttcttagtttccagataacagcttactaaaacttttattcaggtgcttatttttattttattactacatcagttagcattagttattatattataattgactacagttgagaacatgaccctatttatattggataataaacataatacagtgcaattcaacaagtattatacctacttactatgattagtctactagtgatactcaaaaatgacatatacactatgtactaaagaacttaatgataatgtggatcatttgatattgactgtctttatgattagtgtggatggataactaaccatctggtatctcctcctaatcttcctcaaagaggaataatatggtggaaagtaaagggactctattcgcttttaaatagtccctgcaaggtgatttcaccatgctttattattcattatattaaagacagttcatgaagcatgaagcagtcatttctgtagttttaaaagaggtcacgagctgattcattcaggtttgtaattccctctgaaaccatctttgagccaaagatatttgaagatatatttctatagctacagatacacacacaca

SEQ ID NO: 29774 - DNA, 682 bp, Bovine  19866881333124
caccacccttatggcagaaagtgaagaggaactaaaaagcctcttgatgaaagtgaaagaggaaagtgaaaaagttggcttaaagctcaaccattcagaaaactaaaaactgaaaaactcaacatgatctttcccaaaatgtaattaaattatttcataaagtaaataaagttttaattagtacactgccaataactgaggagacattttttacatgttagaggttttaacagccttaactaattaattagctataaactgaataaagttagcagtttatagtcattgggaaagatattacatctatcccggattagaaaatgttgacccagcattttcatgttatacagaaatcactaaacagtggttaccctgctatgcacaatagatctgcatcctttctacggtggttaatgggtatgtggattgcaaaaaaggtcatggaattttctccttaagggggaagggaataagtttagtttagtgttgtgatttgaagtggaaaaatgatataaatttgtccaacctttccatctatgtcagaagttttacacttggtcatctacagggtactacaagctggactagcttcaggaaagtcagtgtattccacgaattgggtcaggttctacaccactgagagggtgggtggtataacatagtaattacagtaatacaagta

SEQ ID NO: 29775 - DNA, 1554 bp, Bovine  19866881371913
ttctatttactacactttgctttggacaacctttgaaaatcagagccattctgaaaggaaaaaagcaacccaaacaagaaagaaaactcaccactgagttgactcattggaaaagaccctgatgctgggagggtttgggggcaggaggagaaggggacgacaaaggatgagatggctggatggcatcaccaactcgatggacatgagtttgagtgaactctgggagttggtgatggacagggaggcctggcgtgctgtgattcatggggtcgcaaagagtcagacacgactgagcaactgaactgaactgaactgaaggatattaaaaagacagtgacttcaattctaatggcagttccaacagaacagattaaaaatacttaggacaatactggaaatcactacatagcttccaatgtgacttgtttgaaggaaacaatactcttctagatttaggaattcttattttaagttggttccattgctggataattatttatgccatgttaatctatcaatcagggatacttaaaatccttcagctacgcttcctctctcctataaagtatttcacggaacaatggaacaacagaaaaaattattccttaatttattagactcccactcattagctgcagagtattgttaaatttatttctctttcttggacatcagttttatgttgaattcctataacaaattgtggtgcctaattaactaataaagtctctggcatatagtagtctctcaaaaaaatgtgtgttcacttccacacattggtatttgattaggatttgttgctacacccagaagtaacaattaaaaatgaaactcttgagatttcaaaggactgagtatgaaagatttaggtttcaaattaggaagaattttcttttaccaacacctgtgataaaaaaacaaaccttaataggaacatttaaggaaaataatatacaaagacatattgtcagagtttatttgcaaagaatagaattcagtttagctagtttacaagactttcagatttggggaaagggataacgggacttagtctgggttgaagtttcaggaaagcttcccacagccatatttcactgttggggcattaacctgcattgaatagtatcccctcaaattcatgtttaactgaatcctgtaaatgtaaccttttttggaaacaggatcttgcaaatgttatcaagatgaggttgtactggattagggcaagccttaagtgaacatctagcatccttaaaagaaggcaaagcagaagagacactgacccatgagaaaaggacatttgaagctgaagacagggattggagtgaggcatctacaagccaaggaaagccaagaattgtcagcaacccccaaaatccagaagagtcagggaaggattgtccctagagccttcagagagaaagcagagctctaccaataacttgattttggacttgtagcctgcagaattgtgaaagaatacattcacgttgtcttatttttattattattatcatcattttttaatttatatattttaatggaggctaatta

SEQ ID NO: 29776 - DNA, 1624 bp, Bovine  19866881394471
aaagtcccatagtttgagtggctcgaacaacaggagtttattgtctcaccatatatgagagtctagaagtgtgagaaggttctagcaggttcggtttcttctgcaggctgtgaggaagagtctgtttgatgcctctctcctaacttctaggcttttgctggcattctctgttgttccttggcttctgctgcatcaccctgatctctgccttcctcttcacctggtgttctccttgtgtgtgtgcctgtgtccaaatttccccattttacaaagtcagcagtcatattggattagggacccatcctactccagtatgacctcatcttaatttcttacatggacaatagccgtattcccaataaggtcacattctgaggtcctgggaggtaagacttcagcataggaatcctgggggaccagtaacaacacgtgatagcaaattatgatcagaaagaacagtatatgaccttcatgcagttggcctgcttctattgtggacagtgcttagaattcaggttagcagatctaagttatttatctgcaatagcacagccagccaggacagctaaatgtattgagcttttttctaatgtcagtggacaatagttataggtatttattattgctatgatcaggagttcagaaaacatcatatcttgccccctaggttgtggcttcaagttacattcagttctggggcctgcatctttaaagcaactggtattggaagacacaaaaaatgatccttcttgctaaaccttgacagcttttggcgtttgcctttaagggggaataccgttgacacttttgaaattcttttgaccatttagggtcttagtatcttaataaaacattctattctaaagggtatttcctcatataaaaatataggtactgcattcaaaataaaaatttgaaattttatcctctatacctctcactgaaatagtggcttccttaaatttttgagcaaagttgagcgattgattttatcacctgtgattcatatttaattttaattgaaaaatggaatcatcaaaaagaaattaagaggaggcaaagagggaaaaagagagaaaagcgggtgaccgaatgtgaagaaaagaagaaaaaagaccttcatctaacttttcagaaagtctttcttaagtaagtactgtcattttgtaaataattctgtctagagaagataaaaggagcagattggccaattaccttcaaactgtttgatcacatccatgtttttgttaattattcaagttttaagagtcatcaaagaatcctaatgcataactcaataggaggagcaaaagcgaagacatgggcaaattctttttatgtttgagattttgcccacttatgagcacatgtgcttttgagtgttgatctgatttaaaccctgttcgtggagaggagggtgatagtttagtctttggaaaaagaggaagaaggacataaagatgcttaaaaagtcagcaagtagagtagaggtgtaggatgaaagtgaagtccttgacattatgtgacccactctgtctttccccattgcacccacatccttggcccagccacacatctgttgctccagtccaagtgataatcaaccatatacaggatagaacca

SEQ ID NO: 29777 - DNA, 1331 bp, Bovine  19866881412821
ctttttttttttttttaatgtcatcacacagattggcatgaagagaaaaatgtcttaaaaatagtgagtaccttaaattttggcatcatttaagtcaatgttaattacctgataccttggctgcgaatagcccaaaactttagcaaacagctaacgtattttaagttctcctttctgtcactgggcagaggctgtctctcttatccttttttatattccacctttcctagctgctgatgaggtaacctgctgctcttagcattctaaaaattctctccagttttctcagggaagggtgtctcttaggactcgtcctcttgatcagagctgaataattctgaggtctgtttgcaaaattatttcagttctcagttaccatatccctggagataatgaacggtaagatttcttcctcgaaatgttgagtcttggaaaggtaacaagcatatttaagtttggggcctttctttgcactaacatttctttccccattgaaaccagactccctggaatatactttcaacttattttgcaattcccagagtgctagagttctctgttccccttggtaaaattcacatagttgttagctggtggtatagtgggaaatctctgctgtccagtgaattgcattggttggtctttgtattagttttctatagctgctataataaattaccacaaacctactggcttaagacagcatgaattaattatcttatagttctgcaagtcagaagtctatatggtctcactgggctaaaatcaaggtgtcaggaggactgtgtccttttaggagcctctagagaagaatctgtttccttgactttttttttttaagactttatttttcagagcagttttaggttcagagcaaaattaagaggaaggtatgaagatttcccatttatcgcttgtttccacacatgcatagctgccatgactatggggggcacaccccaacagtgtggtacatttgttatagcctgtcagcctacactgacacatccttattcttctaagtccacagttgtatattacagttcactcttggtgttacacattctgtgagtttggataaacgtataatgacaggcaccaccattataataccatatcgagtgttttcacatccctaaaaatcctgtgttctgcttgctaacctcctcccacttgcctggcaaccacggatctttactgtttccatggttttgcttttcccaaaatgtgcattggaatgtgcatttaaggtttctccatgtcttttcctgacttaatagctcatttctttttagctatgagcactgtgcattttactgtatgtttcatag

SEQ ID NO: 29778 - DNA, 1588 bp, Bovine  19866881475818
accgaggcttcttatcgttttagcggtgctgacgtgacacggagactgaacaccctggaatgtgacacaggggaaaggagaaggcggaggaaaaggcacagagcctgctctctccggggcccacagccacttgcaaacacaagaaaaggtgacaaggtctgtagaaccaatccgtgttcttaaaatgcctgtgaaaggcagtgcctgcagagcagaacaactaactacagcgtttctggagagtttaacagaacaggctacttgccaatcagtgtttattaaggcctaaacacacaggtgttctgtgctgggaacggcacacagcaaggccgccgctcctggccttgccccttggattgtacagctttaaaaacaggcatcggagagacacaagccataagtgttttgtgcccacctcaacattccaccgccaccacctaaacaagagaaagaacatgtcattcaaacaggaaggccacagaagctctgccctcagagtcggaggcaaaagcaaacagggaagagcgttcgggggccacagggcagctgggagtcagccgccccaccaggagccaaagtgcttttcctcctaactcggccatccacgatcactattcacccagcgccgggggctctgacagcatagggaaccacaagtgaaagaagcactggccttgtccccacgctgaagtctgctttaggcataaaagcaggtgagtgaggtggatggagacccttttccctggttcttcatctgccacctcagacgctaatgatgcactctgttacaaggcaaagtttaaatccctggatgtcctttctcactacgctcaacaaaattctcccggcatgatgtctgggctttccttcgtgtgtgctcagagaatacaaatccctttgaatattggtataaaccaaaaacaattatgaaggttaaaagcaatacacggcactgaaatttactctgaaatgcaggggggaagtagtaatatggattgatgaaatggacagaaaaggtagagagatggacaagtgatgaaataagtatggtaaagtattaatgctaaaatacaggtgaggaacatatgcgtgttcactgtaaatttcttccaacttcgctgcatgcttgaaattttttcagaagaaattgttgaaagcaatttttaaataaccctgcatttaccctagaataataggtaaggacaagggcaaattaatactatattttttaataaaaataggttataaaataccatgtataatgtaatcccaattttgtgcataaacagtaaataccaaaatactgctttctcttttggaaacaggattacgggtgatttatactttcttctctgtgcctttctacattttccaatttttcttcaatgagcatgtattgctttgcaatcaaaattttactttattacattaaagtttaaacaaaatctctgaagccaaatctcaattacttactattgagaattatatggactgaaataagttttacttttgtgggtttttttaatatagacatgcagctccctaagtaccagatctctgaacaaacaaactcagtagagggcaatcc

SEQ ID NO: 29779 - DNA, 1336 bp, Bovine  19866881477925
tcacattttacaaacagtcttatggaataatcagaatttatacatgtgaaaattggaaatatgaacagctaaaatgaccagaccataagtggtggacctggaataagaatccagatcctctgatatcttctgttgtgttcttcaaaaaatttgatgaccatgagccatcaagaaaagatcaagtacagtgtttcaggtgttcgttatcccaaaacacagtggcttagaacagcagcaagcagtcatttgctcatatgatactttgcaatctgggcatgaccctggagggggctcatctctgagccccgcaatgtccctggggaatatccatggtgaatatcccggaatatccacagaatgtcagctggctccactaaattgagactggagaatccattcataaggtgcttcactcttaggtgtgacaagtagattttggctgttgactggaaggtcatctaggcctgtcagtcagggacctcagacctccttgttggctccccatgagatgcaaggtgcctcatgggggttcctggcttcctatgcagcacaaaagcagaagctgctaggccttcttaagtgttaggcctagagctagcagaatatcacgtttgcggcattcttctggttaaagccgatcacagagctagtccagacttccagactcaagaggagaagactccacaagtgcacaaataaattgagggtggggggttgcagtctcttgaggaccactgatgtaactgactgttacatcacatacagtttagagtattcagattaagaaggacagatgtagtagaccgtttagaaaggtttctagagagtcaggtatttacaaaaataaactttagttaatggaaaatatttgttacttcctccaacgagccaggtaaaagaatccactgtaatttgaaaagggttctaaaataatctatcttaactattttttccttttagcagtttgttatctgatttcggatagagcttttcagtgaagatgtgatggattacccattgcttagtgttggatctttgtgagtgtccaatgttttctagcattcttactggacatagagtcctgagtacagcctctcattcacatttctatgtcaccctaaagaaatcacttatatttcataaacacgttttcgaagaagagccaagaagatacctcaaagatgagatgttggtttgtgtgttatgtatttaactctattcagcaagtggaacctgcagttctattaagaattgaaaaatcaactattgtcaccaactttgcagctgggaaagatagtggagttctttccagttaaatacataggctggccctgaa

SEQ ID NO: 29780 - DNA, 1804 bp, Bovine  19866881529206
atactggagtgggtaacctttcccttctccgaggatcttccaacccagggatcaaacccaggtctccctcatttcaggcagattctttagcagctgagccacagaggaagcccaagaatactagaatgcgtagcctatcccttctccaggggatcttcctaacccaggaatcgaaccagggtctcctgcaattccggcggattctttaccaactgagctgtcagagaagcccagtattctatgttgcttttattgaaaataagaaatctgttttgtgtaaaagagaaaaagaagtttactaattactcttctcagatgttaattgtattaccagtacttatttacttggaatctttgcataataatcacaagctttgatgtatgctacagtattgatgtactgtaatgtaaatataaattccatttgtattagagaattccctgcacagcttctctgaagttaatgaatttgtacaatacatcacagactgagtatttcttcctctttttgatgtgatgtgagtggattatattatataaacatttgaccctttttctcaaagaggctgagattattctaagagaaagacttgtgtcttttacttgtcattgatcacagtttacaattctccagatgtactgaataagtagagaatatcagatatttgaaaattttcatttaattagcttttaattaactttctatgtcctttaatgagaatcccagttctttgtaatcatacagagttcgtgactcctatgcttccttaatgccactgaaactgtaattttaaataataattggttacttaaaatatagtagcatggtagataagctataagtctatggctttgaattagcatgctctttgacaaagtttttatcccactgctttgggaaccagaaaatttaagaaagagttgtttaaaattgtataaaacccagaagtagaaaaaacgagttcttaaatcatgtgacacaaatattagtgaaccagataagtaaaaattgaactggcccaagaattacctctatccctcacctccatctctactccactcccaccacccccaagagagcccagcacaatgtggggaagaacatactcaatgagctagtgagtcaaaaaatttttttactaaaaaatctaaattttttaaaggtaaaaattctactcttgcctgaaatactgtagttttctataatattgttgaggtcttctataaaatgtcactgaactgatgtcgccattcaccattttgtgatgattgatctaagattgtgatgaatcttgcctttgaaccttatagtaaaaatagtttaaagggtaaacaaaaagaattataaggcagcgggtgacatgttttattacctgagaacaaaatatacttaagaaacctacttatgttaaaactgatgattattgatgtactctccttatttggtagtagtgttaactagaaaactaaacaacttgttcaaaattgcaaagcaagagttttgctttcatttagtaagtccagtaatatatatatatatatatatatatatatatatatatatatatatatataaaagtccattatgggttagctggaaatatgaagtatattccaaagcattaaaatttcatcttttaatattttatttgaaagtatttccattctaaatttattttcatacatttagtttagaattcatctcaattagccaaacttatactgagatttttccatcctcgtaaatctttttgctccaaagataaagcttaacagtattgtttattgtttcctgtaaactgca

SEQ ID NO: 29781 - DNA, 661 bp, Bovine  19866881807975
acacattcatcccaggttgggaaattccagtattaaactatagaaacttttcatcaaggagggaagttcacataaaatgtatccttaaaaaatctcagtgaagcagttctgctctaagtgggtcattgtttaatttttagatatttatatgttttgaagagcaagtaggctttctgttccaaaatagctcaattatgttttgattgcaacatctgattttttccagagatcttggatctcagatactgtaatcatttatacataagttgataattgctttacaaaaataaaaactgttgctgtggtggtggtatagtgtgggcatgtgtggtgtcttctctcatcctagagatttcacagtgtactgagctctgttgattggtaaaatacgctgtttgattctgcatgattgcagatatcttcagtttgccaggtaacaaacaagaggaaatgagctggagtctgtggacctggcagggccttgtctgggggtggggaatgaagtgagatctcgcagcagctcacccatctctttgaccttgagcagatgtcttttgctctgcatacttggcttcattggcttcctgagcaaagaccttggaaatgaaataacactcagtccatttatccaaaactcccccaagggatacacttttaaaaa

SEQ ID NO: 29782 - DNA, 698 bp, Bovine  19866881918518
tgtttgttagcctctgtcttctttggagaaatgtctgtttagttctttggcccaggatcctctatgacccacctcccagagtaatggaaataaaagcaaaaataaacaaatggtacctaattaaacttaaaaagcttttgcacaatgaaggaaactataagcaaggtgaaaagacagccttcagaatgggagaggataatggcaaatgaagcaactgacagaactaatctcaaaagcatacaagcaactcctgcagctcaattgcaaaaaaataagcatcccaatcaaaaaatgggccaaataattaattttatacttcttgaaaaaaacaaatacagaagataactgtgtgtaaaggtggtggggagttggagaagtaaaggtcatgaatattcactgtgtgtcttactggctaacaattagaagaggagttttacaggttgacaggactattttgtctagtatccaaaaaacctgcattgaaaccccttttcatttggttttcctggatattttctcttcctgtgtcacccacccccactcctccagagtatttcaagttggacctgcagggacccttttgaaggttaaatggagttcaagggcttccattcttagtttccctgctgagacaaaagatacactaattaatggcttttatgaagactgactttttacggaaataaaaccaaatattc

SEQ ID NO: 29783 - DNA, 1319 bp, Bovine  19866881929687
cttatttttataaacttgtaggtcaaataatttatacaaatagaaaatgaactctaacagagagttcagactacacacaggatgcacagaagcttcaattcttgatatgtaccttgtcagcttgtgtttaccttcaattttttttttcccctcactaatcaaccaatagtcatgctccacaaacttccaaattattggaatgggttatttttgaatcccattcccttatacgatgaacttcagaaactatacattaagtggaaaattaagtacaattgtctatttttaaacatgaagacaatgctaattacaattctccagataaacatacataattatagtaattacaattcaacaataactcactggtacttactattataaactcataaactattattcagtaccctataaaattcaaatttaattgaaagtgctagtttagcataattcccacaagccatcatctttaatattctggaatgaatgaggttttggttgagctattaattgatactgacaagcaataaccactggaatgaaactgcaattatgagtggcaattaatcacatttgctgtcatctctagtgtcaaacaaaattcaataatattctaaatagtttttaaaagtttatatcttttatgtttcaattcactaactggaaaccaaaagcagttttctgagataatcaaataacatccaaaatatgtcaaacatgtaaaatatgaacactgtatttcttacctctaaaagcttttctttttttccccccaaattattttcaggataaatctttgtctttgcagactagtaaaagcacctcatttcaccttccacttgccttaattcagtacatcattttgactcatagatcaccctcagacacagcaaaaattgcacatgcagaagaagttcctgagagcaggaacttcagtaagcatcgttaaggacttgagataatttgacagcgaatttttagaagcttcaattgatcaatgtctctttgaatcggggcaaggaggtagcaggatttaatttcttttcccctcattatttctaattaacaggacaaccagtgatgttctttgctgtaacctaaggcacgcataccccagcatccttcaccaattgaccaagtctgttcaaaagccgccggaagtttccttttgctaccaaggttatgacctcaagagtgaaacgaatgaatgtatttgctgtaaactgagctagggccatctaccagatgatcacacaaacggcagtgttaacaacacaagatctaatcccagacaaatgaaaacttgatgcaaggtggag

SEQ ID NO: 29784 - DNA, 1792 bp, Bovine  19866880624392
cctccaagcttcctctactcttggccccattcctgctatgctgagcttggaaaattcagaccgctttcctgggagcctccagcccccaccaaaaattattactccgccccaccatccaccatggcccctgatgttctatttcttgtatcagccaccatcatacccaaggatatgtttttctacagcttcctgaagccctggctgggtgagtaactgtgagtgaaggggatgatcttgggggcccaggaaaaggttcttttgcttactccccatggctgtctctgctaggggatgggctcctgctgagtgctggtgacaagtggagcagccaccgtcgcctgctgacacctgccttccacttcgagattttgaagccctatatgaagattttcaacaagagcgcagacatcatgcacgtgagtctcttgaacccagggtcccagctggagcattgggaaagggggaatgggcctcaacacatatggtctggaatcctgattcagctggatggctttgggggggtcactgattttcctctctaagcctcaatttcctcatctgtaaaactgggatgaaagtgaaagtcgctcagtcgtgtcctactctttgcgaccccatggactatacagtccatggaattctccaggacagaattctggagtgggtagcctttcccttctccacaggatcttcccaacccagggatcgaactcaggtctcccacattgaaggcagattctttgccagctgagccactagagaagcccaagaatactggagtgggtagcctatcctttctccaggggatcttcccaacccaggaatcaaaccagggtctcttgcattgcaggcagatttttaccatttgagctaccccttttaaaagattgtgatgctgggaaagattgaaggcaaaaggagatgaaggtggcagaggatgagatggttagatagcatcaccgagtcaatggacatgaatttgagcaaactccaggaggtagtgaaggacagggaatcctggtgtgctgcagtccatggggttgcaaagagtcagacatgacttagcaactgaacaacaacaacaaaagggtggtcaagatgacgtaatggaatcaggttcctggcacacattaggtactcagaaagttttagatgctagtctgcttcatggaagctctataaattcaggacacaaatgatgaacattgcatagtagttctttctgcaccaccttaaaactttctgcatacccccttaaaacccgtggacttgaaagaattagtgtttattattgttcatgagatgatacatcagttgagtcattctcatcctggttggaatcatgcatgcatttgtggtcatgggtgggttatgtagacagctcctgctgttctggatttagctttggcatgtactcagagcttggctagctgtcagctggtttaggatagccttggtgggacaatggactcctgtatttgtctctcatcttctggtagctctcatcacctgagcttgactgcatggtggaggctgggctccaagagaatgagcaaacatgcagtatctcttgaaacctagtttggaaactagcacaccacctcctgttaactgaagcaagtcccagctcagtccagattcaacaggtggagaaagaggttgctcttcctaatgaaggagctgtgaaatctcattgcaaagagtgaaggtgaagggaaggatgaagaaatggggacccatttgcagttgtctttcactatatagtgatgaagatgatgatgatagttaaaag

SEQ ID NO: 29785 - DNA, 1077 bp, Bovine  19866880792933
cgctctagaacccgtgagtgtggttggagtccggtgagtgtttcctgaggggcttccctggtggctcagccggtgaagaatctgcctgtgacacaggagatgcacattcgatccccgggtcgggaagagcccctggaggagggcatggcaacccactccagtactcttgcctggagaatcccatggacagaggggcctggtgggctggagtccgtagggtagcaaagaactggacacgactaaagcaacggagcacgcactgtttcctgggacaggactggggagggttatggggacggaaacaccaaggcccggagaggtgaagctgtttgccctgggtctctcagccagccagtggtgcactgagattgaatggggcgggggagtcgcacacgggccccggccgctccagcgagcctggcgctctggttcaccctgctctgagcatcttgcccaggggccacagggctgccgaagaacgtgaagcttcgcgcttcccccgggaacaactggcagcccagtcagggtttatatagcggctcccaaaatatcaggccgtggataggctgaggcggctgagggtgcggcaggccaatgccgtggcttcctgtcctgccaagatgtttcctgctgatagctgggcccagtggccttatctgtgaccctggggccaccaggaggacacccccccccccccaacaaggggacagactgttctaggtcccagggaaggggctgcagggacccaggagggggtcagggcgagcagccctctgagcgtggtgggtagttaggtccactctcaagttttgagatggagtggagcccgactgccccaagtgaaactgcagctctgcggctacagtgactgtgtgaccctcaggagctgagtcccactcagagtcaccctcatccatcaaatggggatagtggtggcttcattttcacttaacattccccaccctggccttcccagcctgggcatcaaggagcctccagtctgggggagatgcctcctgcacacacagccctacaggctcagagctcagctagaaggaggcggaagattccaggtgt

SEQ ID NO: 29786 - DNA, 797 bp, Bovine  19866880861761
agtgaactttttaagaagttcgaaacttttccaaaacatctttcctcccaactggatggtcccactcctaagtcttggctccaagctaagggccatttttaagcaggagtaattgtcctccagcgagatggcttgggatgagatcagagggagggttatgccggttacgtgtgtgaaagaggccaaaccagctactgttgggaggcttacaccaggtttctgagggctcttcacgccaaggcggcccttgcaggattaaaggctttgactccagccagcacggaaacaagtctttgggggagtgggggggcggttcttacccagatctgtccatccccacagcagtgccctctgcctgggcatcttttccacttctggggtccccaccctgagtctcaacactccagctttctgataccctgggcctccacactcttcccctaactttctttctgagtctttgcagtctcttgtcccagcaaactcttacttattctaagattgctcaccctccatagtgaagcctatcccactggctggttcttcctgtcatgctcccagttaacagaacacaaacccccgcggcccgccatggtaatcagccttatctgtctgactccccttgcccccactaggctgtaagcccctctacggggagaatgcggggagaaaagcgcaggaatagagcatctagtaggtgccaggcagagaggttttcctccacagtcccttccagcaatcctaccggggggagggcattattgtcacctcgacttcggagacacgctcctcctagg

SEQ ID NO: 29787 - DNA, 759 bp, Bovine  19866880974403
ccgtgcgggctggcgcccttccttaacttcacccaaagctggagtgtgcccccgctgcccggcagtgctggaggagagagtgccagccaacagtccgatcccctggcctcctctgggagttgctctgggcctgtacccttagttgaggtcccctcgtacctgaggcggtttttctaggcagtattaccttgcgttaagaacactttccccaaaatagatctcagaaagcatctgagaataaaaacaagactccaacttaattatttcacccctcccaccctaggattttttttaaaaaagccagctatgaaatacttgagtgccctttgtcagcccattttcagttgtttttcaagcatgcatttctatttagggcttttttttttaagttgagagtcatttgttttaagtcagttttttaaactgtaaaccttttagagctgcgtcttgtatagtagcttttttgtctgtgtgttttcctttttttttttttctgtttttggagcacacttcactatagcctagccagagagcccctaccggctttactgaaacccttctaaaaatagcaactttccctgaagctgcagcctgagtaggaaccagtcaggtcccagaggaggcttcttgggaaacttcaagtcatgaaagtcaggattcggaaatgacgcaggctttttggtgtcagaagtgataaaactccctgctgtgggcgaactctttctccttggagcgggtccaccagccacgcggtgggtt

SEQ ID NO: 29788 - DNA, 729 bp, Bovine  19866880974749
tgccctgaggagttctgatactggcggacatggagcctacatggggaggggctggtatggtgtttgagagggtgtgtgtgtatgcacactgtggggaacgggcaggggaccgactgccacaaaactaggcagttacaatgttaagggacctgggctgtgatgggggcagctcagggaggggtttagggaagcccagagaagatccccaactctgggggatctgagcagattcccagaggaaggcatgccacccactgatccattgcttcattcagccaaggtttcattgataacactggggtgatacagacatgagctctagaggaaagaagggtattaatcaaacacttgtccaaatgactgcaaatcgatcctggagaagtatttctgggggtgaggtccctgatgctttgagttgtgtgaagggagacaatagaaggccaggaagagaaagcttctttaagtgagcagatgcaggcaggagcgtgtacaacaaagggcagggaggcatccagggtgaggaccagcatggggtgtgtgatccactggggcagtggccctgggaactggagagcggaggatgtagagtaacacacacacacaccccgccccctactcaggcagtctatgtcctctctctctccacagtggctaactttgacccgggcaccttcagcctgatgcgctgtgacttctgcggggccggctttgacactcgggtcggcctgt

SEQ ID NO: 29789 - DNA, 1832 bp, Bovine  19866881027214
ggcagacttcagtattgctaggacagagggtggcaccccagccacctcagagagaggtcgtgtcggtgaaagcatgggccagctcctcgctggtagctttgtatgtgagtgtctgagtgtatagctcatctagagcgcagaggtccccaaggagagagttcagaagaggtacaggggctagaaggcgagggttggaatggagagccacacattgagaggaagaaaacaacagagaacaaagcgcgaactaggacaaggttgcgtctcgtgaaacaaacgagaaaacataagacctacggagtgatttctaagtggagtgaagctctgcaggggaccagccataatgaaactttagaaagagtggtgactagaaccggtgagagcttctccccaccaatctcccatcccaggttatttgactttgcagtgatgtcatccagtccaaaggtcatactttggaatgggggcattttgccttatatggaaacctcacttctcaaaccaaataccgggacacgtggtctgaagaaggagttctgtaccctttctgggtgggacaggcagtttgggagaactgaaattccaggattctggaatttccgggtgactccgcaaagagcacagggcagaattttttttaaagatgaaacacttcaagaaattctgggatacgtgggcaccagactcacagactggagtctttattcaggtctctacggtctctaaatttccattttctcatattgtgataagctttgcgctctctgggagagagtttccataaaacatgcaaggcatttaaaaaatgtgaggcgtctcagaaatgagcaaattgaaggaaactcgaaagagctaaaaaatcagccatatttggatctctgtacttacatatggagttaattacgcagaaatattttagttctggaaaaatggcaacactagtttgaatctgattttgcactgtcccgtcccagggctccagacttccagatgtgacatcactctgctcccctgacgtggatgaagcccaaaccagcctttccagatttcccctgactgtggatgtgtcgtgtaagggggaggcagagcaaacacaattagatggtgatttcataccttccaggtcatcaattgtcttttccagttttgcaactgttctctctgcaaattcggcacgggtctcagcctagggcagaagaaaggagtcaccaggactgcttcaagaccaaccccaggagaatcctgagccagctgggtgggaatcacactcacctctttcagtttgtcggacagaagtttaatttcttcttcatatttgtcctccttttcagaatactgcggtagagatcaaaacactactttttaaaacggagggagcaggaggaaagcacaagagaatgcacattccctgatgcttggagaaaagtgcatgcttgaagctatgaacctgcctaagaagcaaagtagagacaggcacctttccaggcagatgaaatgggaggggatccctctgggatgggactgatctcaggacctgagctgacaactcaagatacatgtgtgatgaagacagaggcagatgagtgaatggaaacatgcctctcaaggccctccacagcagctggcctagtctgggtttccaaccccacttcccaccagcttcccgccacttcctaaccctcttcggagtactctctggtctcccagcccttgcctatgtctgggcccccaggcatggaatgtcccattccttgctactgtctgtcagaaggtatgtttgcctttcaaggctcaacgcaggtgagtattagccaaccttcatcatctgccag

SEQ ID NO: 29790 - DNA, 888 bp, Bovine  19866881150201
agagggacctagcccccctccccccgctcccacttgcagcctcagggtccccgttctcacagtggggacagtggggcacccgacccaagcctgtgggtctcagggagactctattacagtgcccagctcatggtgggcaccagatgaggggtgatgctgggataaacagaggaggcggccctggctgagtctaggagaaggctcggcagggtgcgtgcagggtgagtgggtgttggaagaggccgagcatcgccaagggtggcaagagggggggcacagtgggcatcaggaccacggagcacagtctgtagagcaggggctgcaggaggcaaggttgggaggccagccactgggacctcgctggctgccaaggcatgcgagcttgtgtttttcctgcctgcagggctcctctgtaagcatgagggtcgtagtgtctgggcttctgaggaagggtcacattggtggccaaggaacaggactagagcctgcgccaccagggggaggctggtgcctgagcccagcagaaggaagggtccgggagggtgtcctgtcgggtccctgctgcccgcctcctgggtcctccctccgagagagcttacagcttgtccagagcctgtgtgtctgtctccccctgctcagggcatcatgctggtctacgacatcaccaacgagaagtcctttgataacatccggaactggattcggaacattgaagaggtaagtctccaggagcgccctggtttacccatgagatccctgagcacagaggcacctcgaagtaactcactaggaacaaagagggacgggaatccacacagtcgaccccagaaaccacccaagtgtggcttcgtcacagagcagccccgagagcccgttccgccagccggg

SEQ ID NO: 29791 - DNA, 1043 bp, Bovine  19866881184374
aaatgctaacctattcatctgcctattgtcctatccaccctaatcctcacccatttacccactcatgattcaagtgcccattcatttttttcaaccaccacacacagagcttaactttctacatatctacccactcctttcatctgtctcccagacccacgccctcactgaatcaaggagccaatgttggaattggagtgttatgaagatgctctcatccgagacctggaaattagtggagatgagatctgggctttactgagaatcaactgctacccctaacaatgaccgataccttttatcaaacattttaaactctaggtcttttactgtataaggaactttaaatcaattttacaaatgaggagatcaaggctctgagaaaagtgagggactaacgtcacagagctcatgagaatctccctgcatcgccccactcccctgagacctgcaatttaggggagagtttgagagagctggattgaggggatggagtttgctttctgattggcaaaattcaggggcaaaaaaaccatcgatttttactgaaatcaagattttactggggaacctaatagtgccagactgtttggtacctacagctccactccctactgtaggccacgggggtttgaggcagggggtggacaggccccttagacggctttctctctgctcccaaagcacatcgggccgagtgggcaactcaagtggtgtctccgttgatgcagggagctttgaggggcacgggctggctctgggactccgatgtcctgggaagaagctgcaggttctggatggtatccttcagctgggcctgagtactctctatctcagctagtcggcactcctggggaggcagcggcagtagactcagagccgggtgagggttgcatcccaacttcgcgtttcctcacccagcctaaatctgtcccagggctagggcatgggtctcaccagacttttcagcctgtggccctcattggttgaacgatcgcgccctggatccacttttcgcggtcctgtaggaattacgggtgaaa

SEQ ID NO: 29792 - DNA, 1110 bp, Bovine  19866881212802
aattccttaccgcctggattcctgggtgggctttggtgggggaagcgtgttagctggagaaaagggcactgtgtgagtggaaggctggctgacctttttccttcttaacctggttccacctctgacctccctaggccgaaggtgatgtggcagctctcaatcgacgcatccagctcgttgaggaggagttggacagggctcaggaacgactggccacagccctgcagaagctggaggaggcagaaaaggctgcagatgagagtgagaggtaaggacgctttgaacctggtggcatgagcgtttacttctgggaaattgaggtcctgccatactgccaacctcccggagctggggtgagagtcagtgagatcccaaggacacacgtgtgtacacatacatataaatgggcaacaataccttgtaaaccatcatgctgtgtgtggaggcatttgacgtggcagttatgaaggaaaactaccaccagacagaggagggcaaaaaactgggccgatataaggctgtagctgcgactgtcgtcagcagtctgtccgcagagcgctgtgtctcctgttgtctctgaaagtcactgtgcatgtggttgtcagcattctcaagacatcggtgtccagggtgatatgagaagacgggggatgaaaactggaaatgggctgtctgcatgaataactattagcagtgcttcaggccttgagtcactggacaactgtgtgtcagggacatgcacaaaaccactccaattaatgtatttgcaactgatagcacttcttacctccagggcatcctcctgctgcctccagcagggtgctgtgtcctctcaagcagcacgccttggagcagtctctggaggactatgggcagattgtgtaattcacagaagcggccgtctctgtgcgatggtcagtgggttccttgtgtggtggtggtgcgggctggaccggtggtcctcacgtatctgccacagcatcacaccagaaatctcactggactcatccaccatggttttcaagtttcccaggtggcgctagaacccccctcccagtgcaaccgatgcaaattcgatccctgggtcgggaagatcccctgaagagagca

SEQ ID NO: 29793 - DNA, 1070 bp, Bovine  19866881243468
aaacacaggttcttttttattcctgttttaaggtctatccgactatttctgtgcaaaaacagatttaaaatctcgatggctcagaagccgctggcagctgccaaggccgccctgttctctcaactcccctcaaggggaatctcaggtttgccttgtccatggagattttcctacctgcaggagctgtccctggttccccaaatttccacttcccccatcaccccaagcctggagagggtgggtctctgggattgatgggctgactggctaggatgagatgaacaattcctggaaggaggcctgggtgtttctaccagagaaagcaggatgcatgatgggaatgaaaacagtcatgtggtcaccgtggttgagccaagatttgaagttgggccctacctaggtgaacgtcccagggttagacagtgttgagccctggctggtgggagtgtaaaatggtcaagtcgctgaagtttggtgggtcctccaaaagttaaaggtagaattaccagctgagccacaagggaagcctaagaatactggagtgggtagcctatcccttctccaggggatcttcccgacccaggaatcgaaccagggtctcctgcattgcaggcagattctttaccaactgagctatcagggaagcctagaattacgcaatgatccattcattccagtcctaccacaaagaattgaaaacaggggttcaaatgaaaaagggcttcctaggtggcacagtggtagagagtccaatgcagaagacataagagatggggtttagtccctgggtcaggaagatcccctggagtaagaaatggcaaccgactccagtattcttgcctgaaaaattccatggacagaggagcctggtgagccacagttcacaaggttgcaaagagtcagacacgattgagcgactgagcatccatgcatgtgcttcctgtacccgttcaaataaaacttgtgcgtgcatgttcacagcagcgctagtcagagtctctgaaaggtggaaacaacccagatgtccaccagaggatgaatggataaacaaaatgcagtccatgcatgca

SEQ ID NO: 29794 - DNA, 572 bp, Bovine  19866881347736
gacttgggaggtgagagcggcggtggcagagcaggtgcacctggaggagggtcccctgggtggagcctggaggggcgccggggtccaggggagcccctccttctggcaggctgggcaggcgcttccaccaggagcccccatgctgggagcgtgggccacgacggcccttcactgggtccggagctggtaatctagaaagagggaggggggcgtccattgtctgctctgaccctagaggaggggccgccccacctgccctggccctggggttgctccctgagcaccaccctggggacagtggcacccccaccaggggccttttcagcatcccccacctgccccatgggcaagtcgcgtgtacctccattctgagtgatgtaacgaacccacggtaaggcctggtagccactcttctcgatgatcttcaggtagcgcacctgcggcacaggtatcagggccctaagcatgcacacgccacccccgctcctggctgcccactgagtcattcctcccggggctgggctgagaccgagagggccagggagagacgaagcaccttagtctgtatcaca

SEQ ID NO: 29795 - DNA, 1207 bp, Bovine  19866881364842
ggcagttggtgtttcccttcactacctcaagagatcaggctgcctgagactgaagccttttcctgggagaagctgaattatggagggggattctgaagcacaacactttctgcccctcttgaatgaggcttctgtccttgtgataaataatctctattctctgtcctttatcccacaagtcccctccagagtcacaaactagtgtcaaacatcctgctgagaagaatctgtctttaatggcttctactatgaaaaagaagaactaatgttcctgagtgggcttcccaggtggcactagcagtaaagaatctgcctgccaatgctggagacataagagatgcaggttcgatccctgggttgggaagatcccctggaggaggacacagcaacccacttctagtattcttgcctggaaaatccccatgtacagagcagcctggtgggcttacagtccatcgggttgcaaagagatggacatgcctgaagagacttagcacgtactcagtgcaatgttcctgagtacttaccatgtcacaggccctgtgctaagccctttacctgcattatctcatctcatctttcccacaacccagagtttgaattgtgtctctctcatgtcctagctgtgtgatcataaacaagtgtcttaacctctctgaaattcagtttcttcacctgtaaaatagaaataattgcaacagtcacctcatagaaatacagcaaggcacatcccttcttttttatcccatgcctgccccagggccccgggcataccttcagctcaggcatgctgccaatgagctcatagggcaccttcacgtcagggcagctggtatagtcgagagggacaagctgaggggccaggtcctggtagcgatagaagagcctggtatggggagggaaaaaatgagaaggtctgggtgatgagtgagggtgagcttgtctctactctctcactttcacagatgctcactatacactgaaggatgctgagccatcagccctgggcccaaccctcacacagagacatctttatctccctagggacaaggccaaggtaaagagaggaccccagggacttccctggaggtccagtgattaagaatccacctgccaatgcaggggccacaggtttggtcccggtctgggaagatcccacatgccatgaggcaactactagctcatacaccacaaccacgaagcccgc

SEQ ID NO: 29796 - DNA, 663 bp, Bovine  19866881366612
tctagcagcttccattcccttgccctgctatgggatgccctttaattccttacagagttgttttctaagggtaaggaatagaggtgagcttctctggtgagctgcctcccacaactgggagctgaagaggtgcttcatgaacaatgaagacatcgggaagcccagacaccattcttcaagtataacacagaaaaaaacaagagaaaaggactaaggagaccaaaatgctattgccgctgtttgaatgcacagatgaagttccatcccaagatagcttttttttagagataagcccgctggtttttgcatgttctgctgactctcttaagctgctcaagaggttggatgagtctccattcaaaacaatttctatgtagggaaaaacccgctagtggcatgcagatacagatagctactgcatttgagagctcaggccaagttggctcttgttttgatgttgtcagaaaagaatcatatgagcataattttcttttttgaaaccagctcttcacgtgaaccactcacttttggttgcaatccctcaggctatggctcaaaggcagcaagtgcagaaaatgaaaatgagagggcatgaaaatgaggacggtctgtatttcagtcacacagtcacagacgcagcagcagcaggcttgaaagatcaaa

SEQ ID NO: 29797 - DNA, 807 bp, Bovine  19866882052955
aatcaggtgaagaaaaccattctggagagagtgcatagtctgggcaaaagtttggaagtgagggtcagcatgtggggttatttggcatttgctgaaggatgaaagggagaggaatatggcagccagatggggctgggctttcagtgctagcctgagcttgaaatgttttacaagggcaatagggagccatgggaggtgtttgagcaggggaggctcatgttcagatcaggtgttataagaatctccctggggcaggtgtggaggattgcactggaggggtgaggtgggaggtgagagcccagagtggaggcccaaggaggtcataagcagaggtcaagtgtcagaaccttgttttgaggcatcgtcacctcttctctccccacagctgccgttgcccccaaggatgaccttttctatggcttcctgaaaccttggctgggtgagctcgggactgggtaggctggagctggggcttcagggaagagggggtggggcatgaggtttcctggaaaggtccttaacctcgatctcctgggtataggagatgggctgctgctcagcagaggtgacaagtggagccggcaccgccgcctgctgacgcctgccttccatttcgacatcctgaagccctacatgaagatcttcaaccagtgcgctgataccatgcatgtgagtcccaaggtttcttggggagaggatatctggaagtggggctggtccagactccagcttgtgggcaagtcatgcgacatcaggaagcctttgtcagaaagccttacttccttttttttttaaaaaaacaaacta

SEQ ID NO: 29798 - DNA, 2334 bp, Bovine  19866880352450
tccgtctagttaaggctatggtttttccagtggtcatgtatggatgtgagagttggactgtgaagaaagctgagctccaaagaattgatgcgttttaactgtggtgttggagaagactcttgagagtcccttggactgcaaagagatccgaacagtccattctgaaggagatcagtcctgggtgttctttggaaggaatgatgctaaagctgaaactccaatactttggccacctgatgcgaagagttgactcattgggaaagactctgatgctgggagggattgggggcaggatgagaaggggatgacagaggatgagatggctggatggcatcaccaactcgacggacatgagtttgagtgaactccgggagttggtgatggacagggaggcctggcgtgctgcaatttatggggtcacaaagagtcagacacgactgagtgagtgaaccgaactgaactgaactgaaggttaacatacaaagtagatatatgacagctagaatcacagaaactttcacttaaacactcttggtgcaggatattgtacaacttccacagtatggaagcccagcaaccacagccggcaagaactcaaaatgccaacagacaggtgattgtttctttatggagaaaagtccaatactcacccttccacctcttttgttcttggggttccaacctaacaccactgacactcagtttcttctcttctcttgacctgtacactgcctccttccccaggtattagagtttccatttctcttctggcttttcatctcatctgtgctatcttctggtattttttaaccctattgattttgacagtccttaggagatcagtcctgggtgttctttggaaggaatgatgctaaagctgaaactcgaatactttggccacctcatgcaaagagttgactcattagaaaagagtctgatgttgggagggattgggggcaggaggagaaggggacgacagaggatgaaatggctggatggtatcaccgactcaatggacgtgagtttgactgaactccgggagttggtgatggacagggaggcctggcgtgctgtgattcatggggtctcaaagagttggacatgactgagcaactgaactgaactgaactgaactagcatatagtagaattaatttttttatgctcatgaagtaataaatggatgaatgtatataataaacagaaatgcagattttgctatcaacagagaataccaatcaccatattgctagtggtaaaaaataaaaataaaaactgtaatttaattattctttcttggtttgctgcccccatttaactaattgctttgtataatttttctagttttgtctttgtttttgaaaaattgtcatagttttaatcaagttgaaattactggtgctcagcaaccaatcttataatcaaatatgagtcaccataatatgtccacacattggatacactgcatctttttaaagagtacttcttgggtttgatttttcctttgagattttgatttggctgtgacctccctgactcttttccaacttttttttacccccagaatgaaagagctgtcaagttatcatgccattagaagtgtcatgcaacctagccaaaatagtctcctgctgtcttggagtgtttactaatgattaatattcacttttctgttctcctgaggtcatttataatgctgtgtgtttgtggtctctctgcagggattcatttgacctgacacattacacatctgacacatccaaagcaggtacgctttattataaaaaacaaaaagcacgcttatgacattgtaggatagtatgtttactttcttaaatgatatttatacctaattaataatatcatatcaaaacgtaatatttttctaaaggtcagtattggcacttttccatgtgctgagcagagaaaactgtaaatcagtgcagcttattatttgctacctcacatctgtcatatggccttctcgccattgcctgttgcccttcccaggggaaaacctatatgtcatcctctgtcttaattcttggcgactatgttctctgttaatctgtcaccattggaaatggtttggattaacaaatgcccgaagttttattgatattgactcaaagcgtaatactctaggaatactgaaaatttactaaggggcttgaaaagacctagaagccatcaaggaagaccttaaggaatagatcttaaattgaagatggagatttgttctaggactagtctgggtctggctttccttcccagtgcccctcaaatcagacaggctaagcctccccagcctgccagcacggggaagagaatcaag

SEQ ID NO: 29799 - DNA, 1282 bp, Bovine  19866880466070
ttttttcttacctctaggaaatttgtttccaatgataattcacagaataaaaagtattccttcccaaagtattaagtggtaaaaatagccagtggtgtagaggattagctagatcctttgatgttttgacttccttgtgaggctatccacactagtacaactttaagtggcagcaagttttattttgtgttcctttcttattaccactaatggatactttggatgtttgacctgacttcaatacttacagagagctctgatagaaagcttattatatggtactactctcttggctttgatgttctgtaaaccatgtgtatgattgcttctaggggagaaattcaaactctctgtattttagacacaagtgaattctctttgagacttagacttgtgtccttaatcatgaaatacataagggatatataacaactaaagattatttctagatgctgaaaatggaggtgaactgatgtttatagcatatttagcagtacattctgagaattggtgctgttaggatatccttcaaagtgtgtcattgctctaccctaggatatttttccctttgtattttgagttactttcatttctcccatttcagtgggagagaaaaagtttcattggtaaataaaatggtgatgtcatccatttcagtatctgctatcctcagattatggtagaatttcattgggttactgaaagtataagtgaactctcttaaaaaggaatttaaaaaaacaaaatcatgtccttaataatgcatttattcggtagtttgaaatgaaaaatgctttttttatagatacaatgctgtgtgtggtagtgaggtttttatagtttataaaagttagcttcagtgatgtatagtgtatcaaaaagaaacttatgcaacacatttatcataagaaatagattttccttcctggggatgtgaagaagagaaataataatatgtgtacgtttctattggtaccaggacaactttaggcaaagagtgatttttctacaactctctctcacctagcatacatgttactactacccattcatacaagtagtggatgctgttaattgatcccagagctttttcatgctgagctcatatttgctttcagaatcctcaatatagtgatccaagctttatttagcagactattaaactgaatctcaatctctttttaaggtagataaattcatcagtaacaacatcacttagccattttaaaatatttctcaagttgtgggctatatctatttggaatgtctatggctaaaagta

SEQ ID NO: 29800 - DNA, 702 bp, Bovine  19866880501100
ctgcaaggagaaaagacacgttattttgaaggctcactctactttctatttaagcttttctaggtgcagattccgctcctctgacagcaccacagcactcattatgtactgcaagtcatcaagctgaggttaggagagacaaagcctgttccctgaagcaatttctttcagcagtgctgctggagcatagttcagaattatctttaatatgaatgagaagctagagccacttgaataggcagatggagttttgttttttccccctagaccaggaacttgtctgcttctttttcccaagtacattcatcatcttggttgctattttgtctaaccttgttctgccattctttccaattactcagtttagtttattcattccaggttagctaattggctttgcttagccctccttttcacacatttccatcccattccatgtgtaattcaagtcccattagctcccacttcatttaaaccaacatagggctcctgggagtagtagggctgctggaaacaggtgcaattggccagatggctgccttgccaagaaggaggagcagactgagacagctcccttgccaaattcagactgtgaggctgagacagctaaacgggttagcagaggggtaaacctggatttaattgttacagtccttctgctattggttcccccttagactcgaaatgcatattctctgcagg

SEQ ID NO: 29801 - DNA, 1243 bp, Bovine  19866880623903
aacaaaacagaaagaggccaactataggaaaactatacaactataaaaaaaagatgtatagaacagtcttatggactctgtgggagagggagagggtgggaagatttgggagaatggcattgaaacatgtaaaatatcatgtatgaaacgagatgccagtccaggttcaatgcacgatactggatgcttggggctagtgcactgggacaacccagagggatggtatggggagggaggagagaggagggttcaggatggggagcacaatgtatacctgtgatggattcattttgatatttggcaaaactaatacaattatataaagtttaaaaacaaaataaaatttaaaaaaataaaaaataaaataaaataaaataaaatacacgaaaaaaaaaaaagaaataaaaaaagaagttaggaggaaaaaacagggttttgagataggcagtaaggttgggggaaggtcaatcttgatggtggtggagtagaacacagagccaacaaaataaatgctcattatttcaaactttcaaagaaaaatttctttaacaaaacctttgatttgccaaagaaaaagagcctagctttactgaatgttcatttacaactttaatgtatcaaactttacagaaaattcaaaattgactcatatacctcattaccaaaaggcagtagtcctaattaaacatttgataaagaggacattttgataaaaatttctatcataaaaaaagtggtagtatcagttggaacagtacctttcaaagtcaattctgaaaaaagttcctgtgcacataactatggctaaatatttccattttgattgctgaggtcttttgaagtcctgatttataagcaatcagtgggaaaaattaagtttatatttagaaggcacaactgtcttaacagctggtcaccctgacacagcccatatggaatgtagtaatatgtgagttaacacattttgtccctcatcttgcttccaaagtagataatgcaaaaagatctgtgcaaatactttggggccagaaattcatttattagttaattactgaagttttaaaaaaatctcccaatttcatttctaaaaaactaactacattaagaattcacaattggtaggaaaatacgatgactgttttctagccctgcagataagcctgacttttagagacagatggtatatgacattcaccaccatctttttggttctggattataccctgactttagtactttatta

SEQ ID NO: 29802 - DNA, 1368 bp, Bovine  19866880625589
agtgggtctaacttcttttaacagcaattgccattatctttctgttaatctcatatccttttctccaggagagaggaaatcagcctttcaacagaatattttagaatttagttataaattcatctaactgcccaccattttagagtttagaagtgtgttttggtggagtttcaaaagaaacaaggatagctgatggtaagattggtaaagctctggacaagacagctataagtaatttttcaagaatgtcatctattatgaggataacataatagatgtcatgttattctccccaaagacaccaatttcacaccactggagagcatttttcacttcccttctgacatctccaggcactcagttgcaacacatagaaagcagtgctttgaaggataaaaaggcatattcagcccgcaattttggcttgctttccctattatttttcctcagaattatgtaatctttgggttgttccagaaaataattaaaatgatcatcatctgtataggatcctgtccaatatgcttaaagatttttaatcacacttcaggtcgtgtttgagttttgcatgcaacctccactgggctagaaaaatgtaagcactaagggatggcaatggtcttcttatctaacatcaggaaaaagaaaaattattttcttattttccccaaagggaaaattctttaagtaagctgattgaactagggaccatgggtattatgaggcacagtgtaaagtgtgtgtctgctataagcctatacctttttaataaaatattatttcagctgattgaactggggattattggttatatgaagggcacgataaaattgtgtgtctccattacaaacctaaatctttttttaatagagtgtttgggccattatattttcacatttgcttttgaataggtaatgactatcaatcatgctcttctatgataaacttgcattatgattcctaaaagcctttgcattaaaatgtgagaatgagtaggagtgatttgtacctttgactgctattgtcattagcattagatgattcctcctaatacttttcacttgagtggctattacaaaattataatttttcaaatggatatttaaaaatcacagaaaaaacaaatggggtgtacaaaggtggaaactactcatgcaggaagtgttgttctttcctgggaagctctataatttcctgggaaatgctgtcataaaacgtttcatatttttaggatgctttcactatgaaaaacctgctatatttcaatacttcctctctccttttatttcaaaaggaaaaatccaagcttcatgtgttttaaataaatgattgccttcacgctccccttcttctatattccatttgcca

SEQ ID NO: 29803 - DNA, 1339 bp, Bovine  19866880679402
acttgtcatgttaaggacactgcaaattcagcttgaatatactttgcttttcgcattaatagcatgtgaggacacttacacctctcatcatcacttcagcaccttgagaagaccaatgttcttattctcctctcaaaggaccactattacttcagcgcgtgacttctcaatcctttgtgatattaaccccttaaattaaactcacttggaattgaagactggctcaagagcacttgctttcctttagagttccacctggaaaattcagaagtattcaaaccctccactgttgattaaaatctgttctgatatcattgagagtcaagcattcatttactcagaatggcagggatttgataaaacatcacagataaaatgctaaatcacagcagagtttagcagtgctcctgctctaattttgagttctttagttaagtgaaactaagcattctcagattttacttcatgcccacatttcctcacctagagagaagtcttccgtccatgggattttccaggcaagagtactggagtggggtgccattgccttctgcagtaagtcctctacataggaacaagttctattccgagagcacatttgtaacaacaaagttagccgaggtacccaactaacacaatcggctacatagtactgtactgtaatagctttataatacttttcacacaaacagtgcattaaaaaaaaaacaaacacacaaaataaagaaaacatttttaatcttacagtaccttactttgaaaagtacagtagtaccagccatatcaccactgcttttaacgcctgcatctggacatcctgggcttgaaataaagatactgtactactgtgctctgtaaactacacaaaagcatggtcacttgtagaggatgcacacacctgacaatgtatgccagacgcatgaaccaacctacatgagtggacatgcgaacacaggttcagttcagttgctcggtcatgtctgactctttgcgaccccatgaactgcagcatgccagcttaacatcttctaaaggtctcaccttgaaggttggtatgtagggggcttactatatggcagagacacggtaaaaatccatgggcaagtttaaaagactttggtgatgctttctacactttttaaagtatatattcttaaattatttacatgtttttattttttacaaagaccaggaaccagaaccctttcattgcttgtttatagactattttctcccaatcactctaataaactgtctctacagattgttccacatctcatccaagttcttagagggcaattccaggaacgtgatcatctcagtgggaaaagccctgaga

SEQ ID NO: 29804 - DNA, 2097 bp, Bovine  19866880696882
taaaatctatcctggtgtttatcaattatagttggtgatttgtagtgaaatagaatcccccacctaacatatgtacacttgcattcctttgaggagtccttattgtgcttgttttcttacatattgtaataaagaagaaagatggggggcgggggtagagtataggtgtgtgtagataaggtgatataagcaattggatagactaggaaatactttccaaagcaaggaatggaaaatcatggtgattttataagtatgtaaacatatagaagtcaaatctcatacaaatattttaaagtgtactggattgttaatcacagtgtgccaataaaacatgacacaacagatgtgcttctggcagatgctaaaaaaaatctgttactttgtagaaccacatcctccatagttattggttaattatatccatgcctattgatggaaatcacagactccagcttccctagagcttcaattatggtaattagttgaatctatagacaagctgagttcactgcacgtgtgtgtaccctcaacacacacgggtatacacatatcattatataatttgaaagctttcctttatgtgttggattacaaatttatcaaatttgtagcaaattatgaaaatatacaattactttctcattagttaaaaaagtattttcttctgttatttgcctttctgtttctttatatccttctagtatacttataaaccttagagagaaggataagattcaggcatagaggtctgaaaaatattaccactcaggtttataaggattctaaacagattttacaataattctttgtacttttctatgtatagttttaaaatttgaaagaactcttgtcttatcttccttcttttttatttgatgtgccaatacaaatgtgtatatacttttttatatccttttatgccttcagttttgcatattgctttttttaggtgtgaagttaaaaaaatgatattttatagcataggcaaacaaaatatccttgatctggaattgaagttagttgagatgaaaatgactggacaagcatctgtatctaggaaatgtgcttgcagcttaaaatgttacataactgtttctggcatctgcatcataaatgatgtcagttaaaacagatttatggaaattctacttccctccacattcagctttatgtcattctatattcataacagacttgttagaaatggtctaaggccatatgagtaccaatcatggttaggatagcttaccaattcatttcattttcaattctaactttgactaaaacctagtttaaaactaggatgactgaagttatagagatatatatgcagatatttagagtatctgcaatagaagacatatttgacccctttaagaagcaggttttatattcgtcatgatgtttggtaccattcaattatgtcaagtctatgaatgacttcacagcctttatgtatatctatattatacatttagatacttatgaaaagtctggagaaaaagtaggttaaaaacattattccagtctattgataccctttgggctgcccccaagtcaaaatatgaataattgaatatattggttaattttttgctgaaaagtacttaaatactagagaatctcacagaacagacaaaattgaaaaatcgagaagatgatgtaatctcaatgacctagaataaatattataagcactgatgactatagtaaattatcctttagtctagcagaatacataatatcccatgtattttgtttcaagagacctcagcctccagaaaaacaaatcctaacctgctatcactttaaatgccagtatttagtttattgcttttaggtagggtcatgatatggcatgaactataatacatgaaacatatcaagttgaggagtataagctcagacccattctttcttatgcttatttgcagatcatccacactaacttctacttcaccccaactgcccagtgggaaccttttgtatgccataggattctaaagaattgcattagggcattgattccaaaagaccatgccattgtatcctgtgtatttgatggcaagagaaatgacccaaaccaagcctact

SEQ ID NO: 29805 - DNA, 1243 bp, Bovine  19866880744996
taagccttatctcaatacattcaataaagcttcccatataatcttttttaaatgtcagctattttaactttgcagctatgccaacataggattatctctttgataatttcaacaaataattttatatgaaaaatttattatgagaaaccatgacagtatgatatgatcactaatactttcatctggtttaaaagcttaacaacatctacttcaaaaaagaaaaactttcgtctttagcgctggactccttttgattaaacctaaagggtaacaagtacttttttatgaaacctttttttttttaagaactcttaaaaatgtagaccattctattacatgagagagagaaaagaaaaacatatctattcctgcattcctatttaacataaaatacaatgaaatttctgtgaactatgtggaaagctgtcatgacaatgactcaaatagaagcgaccagaagcaatcatagtagaacttcattgtgtatttttgttttttgttttttggctaggctcttcttgaaaagaaaaagcaacattggaagtttaaactatatttttatgtcctggggtaatgtgataaaagaacagtctcgtcatcaaataaacttggccatgaaaaacaatttaatttttaaatctattaatagattcatttttgttcttttctcagatcaccataaaaattataatgaagtagcaatctgaattatatcaattaagtcagcacttactgtttctactgaaaattcttaattatttttacttgctacattccctacaccactatttctattttttgtcacattcacatttcagagatagcttttacttttactcagtaggatagagtaacagaatactctattagaatacagtttaagtcttttctacaataatattttcttttttttttaattttattttatttttaaactttacataattgtattagaaagctgtggtacatatacacaatggagtattactcagccattaaaaagaatacatttgaatcagttctaatgaggtggatgaaactggagcctattatacagagtgaagtaagccagaaggaaaaacataaatacagtatactaacgcatatatatggaatttagaaagatggtaacaataacccagtgtacgagacagcaaaagagacactgatgtatagaacagtcttatggactctgtgggagagggagagggtgggaaagatttgggagaatgacattgataca

SEQ ID NO: 29806 - DNA, 992 bp, Bovine  19866880772906
attcattccaaaaatgttcatgcagaaggtatgtggagacagaccccaagacagtgagcatggaagctgtgagctcaatgaagagtttatattcaagaaaatagatgatggtttgtactaccaagaaaattttggtagtagcagtgaaaatggttaaggttgtctagattaaatcaaaatgtaaggaaataaaccaaggtaatgggacagattaactggatatggcacttcaaaacagaaataaatttaagatggtttctaggcttaagcaactgagtgactaatgaaaatattcatcaagattaagaatatttggcaggagttagggatgtgtgtaaagacatgagtttagtttgaccttttatgtttgaggtgctcaagggagatatttagattggatttggattagatttggaaattttatgttaaatatgatatttcaaaacgtgagacagaatgaaattacccaaggagggagtacagatagagaatcaaagagagctgaggcatcgtagcagagaagtacaagctagtaagggagacttggaagaagtagacagaaagataagagaaaaataagagaatgagatacaataaaggccaactgaaacaatctttttcagactcaatgtcacagagactgtgataagacaaaacattaagaactggccatatgatttatcaagttagagaacttggggaacaaaaacgctttatttcttattaatccattattctctctcttgatttagtcattattcagaaagaatcttcacaaaactcgtagtcttttttaaaaaagcttattgatgtatagctgacttataatattacatgttttaggtgtacagcatagtaatttactacttttaaaaactatactccatttatagttattataaactattggttatattgcctgtgctgtacaatatatccttatcgcttatttatttcatacataatagtttgtacctcttaatcccttgtcc

SEQ ID NO: 29807 - DNA, 1336 bp, Bovine  19866880864174
cttctatctctgcaaaattaagtatctggttattaatttgggggatatactttaggtgtgaagatcttataatcatggctttggagaaaagcattcaaatcagataggcttcaattaacaactgaagtcaaagagtctgaaccaatttgttgtcatcgcacatttattattttcattgacaattttcagtggagactgtgaactaacacatctgcaaagagaaaaacaaatcactttgcagaatggcttaccaggcaacaaaaggcaactgagtttgttgctcgctagaggtgtttgcttttattacttctgagagaaatatcatgcccaggacactgtcattgaactaaatcttaaattacatgtacagatgatttaagtccacaaattagccccaagacccagaatactcttatgaaaatctcacaattatttccatggcgtcaaaactgagcccaaaggacagtaataaccataatttatattttccaagttcttgcagctttccaaagcacttttatagacattgtctgacttgagcctcataataaatgaataaagtagaaattacaacctctagtacacaaataaggaaactgaggttaagagaggtgaaatgattttctcaagtaatctgaagctcattcaactgtggcatagttggcagagttccagtgccaagtacagtgccatccacactgtgggtgcctccaattttactgcaggctatgagtaagatttactgggctgagagttatgcagtatattcaaaatcatatgctcaagattttttagaacatgttacggactacaatcaaaatgcatgtttttggcatataatgaaaaccagagatttctaaattcctgtctgctgtgaaactgttttatcttttttgttttagagcttcctagcagtttgcaacatgttgaatagctaactccaaaccagtaatgaaagcaatttgtaaatgtaatctcgtatgataccacaaaaccaagtaacaagaaagaaaagactcctccttactgttagtaagtgtaacatgtcctgatatgtccagaattaacttatgagacatcagatactgagctcaaataactacaccgaaggcttaagcacatggcttaccttagcaacaagttcagattcttttggttaagacattgcacttgtatgtcagcatgtttgagatataacttagttcctcttgagcaaagggacttttataatatttgtagcagcatgtctcactgtgactttattttagctcttcagtgagtttcaaaaatatttgtatgattttaaatgaggggctctgatctgaagagtcataaa

SEQ ID NO: 29808 - DNA, 1428 bp, Bovine  19866880890984
aaaggcatttttaccactttgactttctataaattgactctatacaggtttcaactatacaatttaaggatgcttaattgttactcatattgtcattcagtagataaaattaccctttggaataggaagataagtaggaggatttgtgtattttttaggatgtttccaattacaaataagataataccaattagcaggggcttaaataatataaatatttaatcatttcacataaagaaagtttgtacatttctgggaccacatgagctaagagatcaaagtcactataatatgcattgatatattagtaattaggtagtaaaacatagtaacattatgtaccctctgatatgatacactgcaaagggctcatcatttctttgtttttctggccaaaaatgtacacacagagtgtgatctccacaatagccaaagagatcttttcaaatgtaattcagatcatgaactctcccactaagaactctttcaattcagtcagaggaaaagcccctaccacaatggcttttaatgtcatatgagatcagcttccttccacttctctcctctgctaacttctctcttcctgaggcactgtcagccaactgagttcctggttgttgctgaaacataccaactatgctcttctctcagggtttttgttttgctttcctccacctgcaactgtcttccatccgataccttcctgacatgttcctacacttccttcagtgcaaatgctagccctttcttgaccaccctaaataaagcaagataaaactccttcctcatcataccatcagcacgccttatttcactttttttcttttatttccaatagaacttactatttaggaatatatgtatttttctatacatatacttgtgtatacacatgtgtgcatatacacacatatgcccagtttctctcattagaatatgtcctccttaatgccatagattttgttcaacattatatcgctagtgcctggaagggtacctgtacataggaggtattccataagtgtttctttcacttttttttttcccccacactatgtggtatgaggaacttccccaaccagggactgaacccatgccccctgcattggaagcatgaagtctcaaccagtgggccaccagggaagtcctccataattgtttctggaaccaatgaatctatgaatatgaattgaatgtaaacctggacaaatgctttatacaggttatgttccccctgggatttgggaagatgtcttcatgtgaaggaagcagagagaatttgaacacatgatttcattgtccactgaagaagttccccagaaaaggtaaaggcactgcttaccaagtattttttcaacattcctctcccagagccaacctgagcagagacttccagccagaggcaagaagtaggcagccagagacaag

SEQ ID NO: 29809 - DNA, 1839 bp, Bovine  19866880945211
atataataaaggatacatgaatatattttggatcctattaatacccacaggagtttgcctgtggtaaaaaaggactgtaaaagaattttaatacaccaccccacagaactgtctgacaaagaaatggtaacttgttgaacataatataacctaatgagtctgttgcagaattagaaatacaacctaaaattcctgacaaaaataatcagttaccagcagtagctccccttcacctcatttcagttttatttcaaagaatgccttgcggccacaaaaacttaaattcagttcagttcagtcgctcagtcgtgtcggactctttgcgaccccatgaattgcagcacaccaggcctccctgtccgtcaccaactccaatcataaggtgataaaaatactgaaggcagttaaatttgtatttgtccattcttcaaggaactaagaaaagaaaatagaaattctgcacttatatcctttacttttctgaccatttactagtcattttaaataagagtttataatttggctttaaaacctgatgccaactctatgacgcaaatgtaaattttcctaaccctttgaacaaagaacaagcactttctctacctgttaacatttgttgcaataacttaaaattgttcttttgtataatatggcaaagtttattagattcaaaaccaatttattctagtctgcctaccatccccctttattttacatcagtctgcagaagaggaaggcgcacagaggactgtgcatgagactttcttaatgcatcgggcctggaaacagtccacatcatttccagtcacattcattgactagaactcaattagatgaccatatataactgaaaaacaaaggtggcaaaactagtgtggcagcacacacctgaggaagagaaagagctaggctctgcaggaggtagaatcatcacacatcttcaaagcctgaagaacccgcagtctcaggtggagagaatatatcagggattagagctggtttggaaactgaggcagtactaaatcagtgtatcagcccagaggggagggtcaacagaaggctaaaataaggaagaatggacagtggtttgcagtgagaagatccagagcacgggctcaggattcacctaataaaatgcttgcggtctgctaaagtatttcttatctggggctcaagtaaataatgcagggtcctgggaatagatgtttcaggagtctggaatggtcaccaaataaggcccatttgaatttggatgccttcttgccttgactggttttgtgggagagggtatgtgtgcagactgaagccatgaaattaaaagacgcttactccttggaaggaaagttatgaccacctagacagcatattaaaaagcagagacattactttatcaacaaaggtccatctagtcaaggctatggtctttccagtagtcatatatggatgtgagagttggactttagctgagcgccgaagaattgatgcttttgaactgtggtgttggagaagactgttgagagtcacttggactgcaaggagatccaaccagtccatcctaaaagaaatcagccctgaatattcattcaaaggactgatgctgaagctgaaactgcaatacttcggccacctgatgcaaagaactgaatctttggaaaagacaccagcatggaaaagaccctaatgctgggaaagactgaaggcaggaggagaaggggacgacagaggatgaggtggttggatggcatcaccgactcaatggacatgagtctgagtagactccaggtgtagatttgtctccttcaatggactaaaatctccacagaagtcaagagtgttata

SEQ ID NO: 29810 - DNA, 1317 bp, Bovine  19866880960206
caaaagtttagtttaaaatttagagtcataaatatcagcttttgacagaatatgtcgttttttacacggaagtgtatgttaacataatgggtgttctccttcctattacatgtatcaatatttaaatgaacggttctccagaggcttactaaaatggcatttcatgttactttaaactaggtatttatggtacaacaatgtaaagaataaaaggcatgaaacattggacaatttttatagaaaaggattctagtaatatggttgagtgcaatgcaccatcaacgcaggcttgtatccaccctcattcattcagctcacagcagaaaatgcatgtgcctaaatccaagagagtagataagtcggacttaaaaagtgtttctctctttggtataatactttttttttttacttctttttcaataattccttgcagctctagcttatacacaatgaattgtctgttcctttattgaagtattgaaggggaggggttggaaggaacacaactttttaaagccagtaccaaagaaaataactccttttgtgtaaggagggatcaatagtagtctctgtgttctttctatttcttgtttgtaatttctattgatgtgtacaaaacctagacatttggctttaagtgttgatttaaaacaattttaacagaaggaatagagagaaagagcaattttaaccatcgttgacctactttcaaaaattccattgtgttcttaattcacaaaccccaacaaaagaaaaaaaaatcttgaagtatgtctacatgccacaacactgcctaacttaagtttcaatatttttttctaggtcaatgaatgtaattatgaaagagggccaaccggaattactttaaaataagaaatttccaatcatgataattattatcctatgtcatctgtgcctttaattattaatgggaaataattatctcccattgagaaagtggctgactacaatggaaggaggagcatttcacttgcacgtcatagtccttttccattcttggtccctgattgcctttataccaaacaaagaatggaaatgcccaaatccattagaatgtccagtttcttcaggaataattaatttttatttttaaaagccattatattttagaaatttataagctgaatagaaatttataaattgaaattaaaaaaaaataaattgctacatctatatagtaaaggatttaattactgaaaaatcacattcagcaatgtctacctaggcttaacgtacttatgggttaaagttaaaatacataaataaataaatggtgaaagcagtctagatattttt

SEQ ID NO: 29811 - DNA, 2172 bp, Bovine  19866881105420
ttgttaatttttgccccaacaacaactaagatctaaaaatgactgggacaattagaagtagataataaaagaacttaagtctttaagtggagtccattgttttcatggtgcaaatttcctggctatataaaaaagaatgaaaatatgtaaaacaattacctaaaaagaaattttttcaagcattttactcattcatgtgagtaaataaacaaagtcaattaacaagcccagaaaaaagtattttttttttaacagttattattaatggagtttactctaaacccttgctgtcaccaatgaaaaacaccaaagtagaagcacagaaacctactgtgacaaactttaggacaaccaaccagtttgcaagacactggaggtacatatggatccaaaacattttgtgaatcatgaacctcaagataaacttgttaatgtctttttttttttttttttaaatctttgtgactgcaattttgcaacaccttctgtagagggagcaagaggcctttggtatttgagccattaagacaaacaattttttcatttttatttctccttactagtttgaatgaaaacaagtttaagactttttctccctgcccattaaaagaagacactctgaaaaacctaaaggttctcaaatttcaaccatatatcagagtctctaggaagttcagagatgaattttcaagtctatttttgcccgtctttgaagactttttcaatactgatttttgaattcttgtttgtttgagcgaccttgggattcaaaatgacagttcagggtgaaatcaaagcacagtgatgcagtgacaggagtccactgtcaccagccagagcacagctaataacctaagggttacacctaccacggtataacctagaaagatgtacatcccaaatgaaggccattgagtacacggactgcgaaatggtgatctgatgggaattagagcagggatttcaaacattaacttttcacaaattcttataaacatggatataaatttagctaacacaatggccagaaagggttctgttagcaaaagaaatgaaaaaagtccacatactttctatgtcctaacatactttcatgaacaatgaatttttttcccctaggaaattgaggcatatatcgtataaaataaaaagatttgttaaccaaatattcaaaactcattaatgtcaggaatgttctgcttgttccagcttaattctaaagatttaagagttttcaaagaagcagtgtactatcacataagaatgtacaatttttgaaatcaaatctggttgtttgattttctcttcaatgataaagaatttaatcaaagtagttcccccccaaccccctgcactgtttagctgcaaatcaatagatggagtatcctgaagaaaatgaaaagcaaagggcatctaatattttactgctaaaacctactgtggagtgaagtgtttcagacactcagttgggtctgactctttgtgaccccatggactgtagtccatggaattctctaggccagaatactggagtggatagcctttcccttctccaggggatcttcccaactcacggatcgaacccaggtctcccgcattgcgggcagattctttaccatctgagccccagggaagcccttgatatatgtggggacctgataaatatatacatcctatctcttaatttgcaaaaatttcctagaagttgtctacaacaacttatctttactttaagatgtgagactgttatcagatgggagagatggagttgaatgaatcctgagtgttgtacagagcatttcacagggaaggggcagtcacacactggggctctggtgccctgaagctttattactttacaagctactgttggtcacttagctgattcagagctgtctctaggtgtggaagtgtgtattgaccacttcagaaaatagaagaaccaggatcttttcatcttaagaggtagaaaccacttattccatttatttctaggtatcctctcttcctgcctctgcgtgaacaatgcagctgaataaatatcagagtggaaaattcagctctcagataattttccatcttgaggcaacccgactctgtgatatagggtcctctggggccctagactctcccagagtctcaatctcttccatgacttcaggacaaaagttt

SEQ ID NO: 29812 - DNA, 2887 bp, Bovine  19866881128609
ttctcacttttaaaaaaattgtcaatacgtaggaaggcactgatgggctttttatcaatttcttactatagactattttatagatcaagtatagatatatgtgtgtttctttatgaaatattgtaattattatactgtttaaaaaaacatgaagtttcaatggtggtagtttaagttttacaaatattacatataactatatataatatgtactatatattacaaagtttcattgaagtaaaaatataatgctcaaactttcagttaagcaggatggactgtccatatatatttacttcttttctttccaaaactagaaaataacagtaaagagattctaaaatgtaaattcaaaaagacagaaaggataaaacaaagcagattaagaatagccttttgcaatgtggaatgtatcaataccagtataaatgataatttgggatttagaaggcccaaatatgctgaaacctaatcaagcagtggggaaatccaagaaacaatctaattgtacatcagaattcgtaaaaggctgagaaatggcaatggcataaatatcagatgagggtaaaggcctgtgcaaagcaaatggaaacttgataaattttctgtttgagaaccatttggaagtccaaatcccacagtggaagactggaggcttattctctggtgacaataaaatggaaagttcttgattgcctcaggaagccaagtactatagtggaaagagtactattctcaaaacagaagtatatatgcaaattgaaactgaccagatatctttccccattcaatttccaggagactggcagccagatttagaactttaggcaaaactattctctaagtaatgaccagagctaaagaaaagatcctgctatttccaataaaagattataaccagatcactacagtaaggctaaattcaacaaacttatagcttctaaacaattttttgtaaccatttaatacattaataaacgttaaagaatcaatagactcttaattcaagcatgtaacgaatgatagactcaaaagacagaaatgtacaaacagcagaaaaagcattaaaagggaacattatggaagaaggggtaagttcaaatatataagtagaaaaagattcttctcatcatagaagaataaaaagagacactgtattcatgaaacaaatatagaaatatatatgtatataaatgtgttgagtatatatattcatatgcttcctgtttgtaccttacatatatttatatagcaatacactttatataataatttatatataatgtgtttgttcagagaataagaaaaccatttaaagattaaaaatataatagcagaaaaagaagaactcaatgcagcagttagaaaatcaaagaaatctcccagagagtacagcaaagcagcaaaaagatgagaattaaatgaaaaaaaattagaaattaatgatccagtccaaaaggaataacagctcaataatagaaattccatgaagaaagaacagaggaatcagaacttagggaatcattacataaacaatcaagaaaatttctctgaactaaaagacatgaattcaaagattgaaagtgtctatcaagtgcccgttgagtagatatactggatttattccacagcacatcagtgtggaaattcagactcacaatttaaatagaagattctaaatcttccagaaagatgaaaataggtcacaaacaagggattagaaaactggatggtttgggacttctcaagagcagtgctggaaactgaaagataatgaaaatataatttcagacctctgaagtaaaaggatattgattctgattttctatttatagacaaactagcaaatcaaagacaaagatagacattttcagatgttgtagagctccctaaaatgaagaagtaaccaaaaaaaagaaagggaatccagaaaatgggattttccttcctttaagaaagaggcaaagattatctccaggatgaagatgatgaaatataacaggaatgtagcaaatcattggtcagaaagagcaagaatagaacagcccagaagtttccaggaagattatctttaacaaaataaaaatgatagaatatctgatataactgggagagtttgggcatttttcagtgattagtacatataaagtaaagccaaaaaaataaaacaaaaagtcacttaaagaaataaaaaatagtcatggtttatacacagcttctctgtgactagttcttgtataaacataataatattccctgaaaaattttaatcaaaattatgcaataattttagtgggagaatagaggacatgggaagtatgtgtttttactgctagggcctagtgagttaaagaaagctcaatccttcttttccattgtaggaaaatcaataaatactacctgaaagggaaagatcaagaaataacagtattgttactttacttacacaagtggaggaacattatcaaaaataacagctagttagaaagcttaaacagttaagaaaaggttgcctgtgagaaaatggaaatggcaggaagtttggggtattgctatgttttttttttttttaattaagaattacagagttgtttgactcttaaatgtttgaaaaataactttgacaatcataaaaatcaaatgtaggaaaatgtttacactgaaatgtgttgatttttaacaattagaaacagagtcatcaacttatacagccaaggtaatcgattttttatagaaatctcatattgcagcttctcttaaaatatctattcacatgcaacttattgttgttgggccattgatttaaaaaatatagcttggtgctgttattactgtcattattattaagtcatagccattaaattcaggatggcatatgtccattcac

SEQ ID NO: 29813 - DNA, 1596 bp, Bovine  19866881180936
gtatatataatatatatccattatttatatatgtatattataaatatccatttatatatattataaatatccatatatataaatatatttatatatataatatacctatatatatatatttatggcttattcatgttgatgtatggcagaaaccaacacaatattgtaaagcaattatcttccaattaaaaataaattttttttaatgtgaatactcaaaaacaaaaagaaaaggaaaaaaaatccccaaattgtattatcctaaaagcagaatttttaaacaaaaaaaagatatgtttgttcttctggaatacagtttttaaaataactccattgctttagatatttctagcattaccataaacagacaaaaaatgacaaaaatcttatacattcattagaatgtttccaaatatcatatcaaaatttggcataccagaatatttagatcaaatctaattactggaaactattctaacatctgccgcttttttactttttaatagaatgtttacaaagtaaaagtgtattatgtagagaaagtcattatctaatgtatagggcctaattacctaaatcttgagtgtttccatttgtgctaatcaaaatgcataggaatataagttactgcaatcctcaaaaaattataaagaacttgcaacatgtatggatattaatactctttacagacctggaagaaaattatttttagcccaaaacaccttatcttccttcccagcagcattgagactctttttaaaactgaatacaaattactttcagcatttgttgtcattcagtcactcagtcatgtctgactctttgcaactccatggactgcagcctgccaagtttccctgtctttcaccatctcccagagcttgctcaaacccatgtccactgagttagcaatgccatccaaccatctcatcctcggttgtccccttctcctcgtgccttcagtctttcccaacataaggatcttttccaatgagttgactcttcgcatcaggtggccaaagtattggagcttcagcttccgtgttagtccttccaatgaatattcaggactaatttcctttatgattgactagttggatctccttgcagtccaagggactctcaagagtcttccccaacaccacagttcaaaagcatcaattctttggcactcagccttttttattgtccagctctcacattgacaggtggagtagggataattttagcattttgtaaaagaagaaaaagtaactggagtagtaaatgaagtacttgtggcatacccagataggaataggtctttattcagtgagaatgtggggctacttatctgctctctgaccatgggcttttaattcatttaattgtcatttgaattcacttggttcagatgtgtctttctaaaattgttttcacttgggattttaaaaataaagataccagaaagaaataattgagaatagttgaaatgatgctatgaaagaatggtataagatttgttaaagttgtaataaccaacaaactattcctaaaactctaaatgtctttttctagttggaaagtagtgaaatccttagattggtgtagctatgt

SEQ ID NO: 29814 - DNA, 786 bp, Bovine  19866881291078
ttttcagatgaaaataatgggtctataaatggaaaatggaatctattttaccataggtaatagctattatgactttccttcagcttctattgactgtgcagtcttatgctgacccacagtcagcataaaatggttaatcagcaaaactctgaggataacttgaactggcaattgccccaaactttagggtagttattataactcttccactgtctcaggcaaagataaaaggaagagagaaagtatgagggcagtgcattgagatacgaaagaaaaaatcctgggaaacctggcagtgatcttgggccactttgggaaatatattttggaggacaagcattttcatatttcagtgttacacaaatctccagagaagtagcaaattaggaaaggcagtaaattgagttttagcaagagagttgatgttaactctgaactcaaagtttgaattttgaacagttgcaaaaaacagcattgagaaaatatctctcacacattcatatttgttgttgttcaatcactaagtcatgtttgactctttgcaaccccatggactagaacacaccaggcttccctgtccttcactaactcccaaagtttgttcaaactcatgtccattaagttggtgatgacatacaactatcacatcctctgtctctcccttctcctcttgccctcaatctttctcagcatcagtgtcttttccaatgagtcgtatttcacatcaggttgccaaagtcctggagcttcaacttcagcttcagtccttccaataaatattcaagg

SEQ ID NO: 29815 - DNA, 1115 bp, Bovine  19866881331534
cttaattttataaattgatgttttggttaggtaagagccattctcatattttactttaaaaagcaattatgagaacaattttaaaatataaaaattttaatccaagcgtttaatatacttagaagggtcagtgtatttatgcagccatttctcaaatcattctaatgaaaagatgaacaaatttgtatgtgtgtacacacaacttttccaaatagtgtatatattatatgtatgtatctatatatgcatatatatgtgtatataatgtacatattgatattatatacatacatatatattgcatatatctatatataatagctatatgaatttgattttaaagacagtttccaagaggtatgtttccatggtattgccacctgcaatttgagcattttatttttatttatgttctctcaagccagtccaacagagaagtcatttggacaaattattttttatgtccttgagaataagtgttaccatactttattcatatatgtaaaagtccccaacaaccacagtgaaatttggttgattgtaagtaaaccacaagtttaacagtttgagtaggtcacctaagtttatctcataaaggagatgagaacaagggaaggaattgaaattagagggatgcacaaaggaaagaaaaataaaatgactgaaataagacatttttaaaatctgaaaaccagaatttcaaaatgatggggtgaaaggagtaaaaactgaattccttccccatactgccttccactgcaggccaagcatgcagcattcccacctgatttttatttctgcttctctaggattcattcctcaatcctttataaacatagagtttgccttctgttttcttcaaaatcagatagagtaaattctcaaaggaaaatgagcttgaatacaaagcctacaaaatagggtgtgatttgaagggataaatgagatttttaacctgaaaagaaacagaatgaaatattttcctggaaaaccttataattttcataagaattaagcaagattccccaaaataaagactttcaacaattcagaaaaaaaaattattaatcaaagagctgcaacaatacctgggattgcagctaggttcaggaatg

SEQ ID NO: 29816 - DNA, 1281 bp, Bovine  19866881401546
tcaaaaattttgggtaatggatttatacaaagtctttaaaataatatcctgaatatatttcagttaatggcattacatgatgactttaatatcagtatcctgaatatgttcaaagaaatagatataacctagagattctgaaaagaaatggcatttaagaaaatgtaaatctgggtactgaaagaaaaaaaaaaaaactaactgaaattaagaatgtgatggaaaggtttcacacgagattacaaacccctgaaggtattattaataaaacggaagataagtcagaacaatgtgtgaagaagtacagtagataaaaatgatggtaaaaggacaaaatatagagtagaaatctaccatatatgtgattggtgtcccagaaagagaagaaagaatgaaatagaagcaatctgtggaaagacatggctacaattttttaaataattagttttgaaaataataactcaagaatagcaatgaacctgaagcaggaaaaatacaaagaaaattgtacctaacatagcccagtaaaactttggataaggaaaaagggtaaagatcttgaaagcagacatagaaaataataacaaaaggagcagcaattagagaaaaataggcctccccatccctcagagagaatctgaaaagaggattgtgttagttatctatctgtgcataacaaattatctctacctaagttgattaaaacagtgaacacttattgttttatagattttgtgtagtaatcaggaagcagcaatgctgggtagttcaggctcaaggtctctcaagagactgcatccaagctgtccacttaggtgtgattatcttaagattcacatgggagagggtctttctgagctcacacaggtggctagaggctggcttcagattttccaggttttctcatatagttgcctgtttgcctcatttccttaatatacaggctgcctcatagcctgcctgagtgtcatcatggagctctttcctgggcagcctttctgtaggccagctggcttccctcagagagagaatgagagagagagcatgggcaaggaagtcaatgtctttttataacctaatgtccacagtgacatcccatcactgcctctgtgttttatttacaaaaataaagtcacctggtggctttgttctttcgtgtgtgtgtgcgtgtgtgtgtggtatgtgcacactcagtcatgtctgactggagggatcatagccctccaggctcctctgtacgtggaattttccagggaagaatcagttcagtcagttcagtca

SEQ ID NO: 29817 - DNA, 1579 bp, Bovine  19866881427344
ttgttctgacctgacacccatttactacttaataatctggttattaaaatcgtacctgttttagtctcctcagtgtttgggaaaagtataccaaaacataaaatcattcaaatcgctttagttgggaaattaatatctgaatgtgagacattaagataggccagcagatgaggcctgttccctcatttttgtttaaaaaagagactgttagtgatgtacaataacacgttggtgttctgttaagctgtgaacaatgggatattggagagaggatgaaaactttggggttgaaagtaaaggtctgacagagaaactgaatgagaacaaaagaaaataggatttaattgtctgagaacagatgggaatttaattctttgtagattggtgattatagttttaaagtcaaaatttgttttatggaaagcaaagaaatagtacatagtttgataatttttcagtttttctgtgaagaaagtgttgcagttcacatgaaaatgttttatttctgtccttgtttcttttaggtcagactgtgccaaaaccccaaacttcagttgaaaaatagcccaccatatatacttgatattttacctgatacatatcagcatttgagacttatattgagtaaatatgatgacaaccagaaacttgcccaactcagtgagaatgaatattttaaaatctacattgatagtctaatgaaaaagtcaaaaagggcaataaggctctttaaagaaggcaaggagaggatgtatgaagagcagtcgcaggacaggtaagaatatttcagattttatttttcttagtgttagtcgatgttgctttttgtttcatggtttggataaatgtcaccatgtgtgtgttttaagggaaatattgcatttgtgtatttgcttttcacattatttaaaccttgtagtttcacacaaagtttgcacaaaattacctgtgtcagtagctagttcatgagatggtgttcttatttttctgaataggcattatttttcagagaagttttagttggcagaaaagttgttcagaaagtagagttctgtttacctccatcctccaagtgccagtttcttcttaacagcttgccaagaatggtgcttttgttatactgatgaactgattactgatacagtattattaactaaagttcatagtgtctgttagggttcactccttgtgttgcatggctctatgaatttccacaaatgtataataaggtcatgtatccatctctctagtatcatggagaatagtttcactgctctaaaaatgccccgtgcctgacctgctcattgtttccttaccggcctgccttcaccacacctcttgaagccctagcagttgtcatctttttagtctattgttttgctttcttcagaatggcatatagttgaaatcatgtaatatgtaacatttttagactggcctcttttacttaacagtgtgtatttaaggttacccagtgtcttttcatagcttgatagttgatttctttttattactgaggatattccattatgtggatgtagtacaatttgtttaatccactcatctatgaaggagatct

SEQ ID NO: 29818 - DNA, 1090 bp, Bovine  19866881449748
ctcaataaccctaaagaattcacccctagttctggattgccccatcttgggacactctgtacttttcacacatgtaaatatcaacatcagactgataatctcatcaccacaccccagtgcacccccgacatctctaccctgggagaagaactaaattctcctgactggttaacacaatgccagaagtcagagagtgggttttattcctcctgctaacaggaaattcctcctatttccaaaatagaaaatagaaaacaaccacacacatcactggttcaacttaagtgtggctcacctatgcctaatttgagaaaggagcaaattatttctctgttcaataatctccttctatcaccattaacctttgagattcacaaatgaaaacaactcatctgctgtttggtcctatctccttaagaataagcaaaggggaaaaaagtaagacctgcgagctgagaaataaaatatcttctcttgggacttccctgtgagccagtggttcagaatccttctgcctatgcaggggacacgagttcggtccctggtctggttaagatcccacttgccctggagcagctaaacccgtgcaccacagctactgagcctgtgctccaggacttctgagccacaactactgaagcccacacaccctagagcccgtgctctacaacaagagaagcccaggcaccacaatgaagagtagcccctgctcgctgaaactagagaaaagcctgtgcagcactaaagacccagcatagccaaaaataaataaataaaatgatatttaaaaaattctgttacccttaaaagggtataaagagaatattatgacaactttgtgccaagggctttgacaagttagatgaaatgccaattccttgaaaaatacaacatatgagagctaacccaagatgcaacagaaaatatgaagagccctatctttattaaagaaattgaacttattattaaaatccttcccacaaagaaagctccaggaccagatggcttcactggtgaaatctacaaaagattaaaggaagaaataacataaaagctttcaaacttgagatatagttatatgtgctgagat

SEQ ID NO: 29819 - DNA, 1120 bp, Bovine  19866881608743
tctcttttaaaatgggcttttgtctgttggttcgtttggctcttcacttgggaacaactcctcaaccgcgttgtttgaagaactgtgtgctcgtgtgttcatgagtccgaacttgttggttttagccgggaaaatccaagtcctcagcctttgatgacaacagtcgtgccctttctgctcctgtagaataatctttaggtttatataacttggcgaaatcacacagtgaaagtgcagtttttgagtgaggctcccaaagtgttttctaggggcttcagttctggtcttttaaattggggttaagtcagggagagggggaaactgatgtgttctaacgtagatagaggaaatctaagtttttattactgttgttgtgagttatgtattaatcaagccttcactctttgccatgtgagaatgatgcgtctttaactcttagtgttccgaaaacagatctaaggtcattgctcctaaacctgtgtgttgtgtgtaaagattgtgagtgaaaaattcacacggtattgaaaagttgaatctgggaccctggattttgttctcagtgatggaggaggatgtaatgggtacaagttaacctgtttgctgttgcataaatattttcatgaccaactaactttttttttctttctttcaaagagctaagattccagatggcaaattctatgaatggcagaaaccctggtggtcgaggaggaaacccccgaaaaggacggattttgggtattattgatgctattcaagatgcagttggaccccctaagcaagccgcagcggatcgcaggacagtagagaaaacttggaaactcatggacaaagtggtaagttctgtctgactgtgtctgtacaacagcagggttgaccctggatgtggttttctccagttttgtttgtactgtcatttagtaataattattggtatggcaacagtattttgattcggattgactgtgtttcttatatctgctctgggtgttttgaaaagttgaattcagagccaagacttttttttttttcccccaccttctgtcctactcttcaaggttcaaagttcctctatatgactcagatatgcgaagcttttactgttggctgctctttgttg

SEQ ID NO: 29820 - DNA, 668 bp, Bovine  19866881631524
tgttatcacaatgaagtggcaacttttggcttttagactgtaccgaagatgcagcaactcataaaacaaacaaaccaacccaaaacacagtgctatttcagcatgacatcagaaactaataaaaacaaatgaaaaatcatgatgctgtaacatggagttcataaagcgatggagaattagccaatgcaatttttaaaagtataaaaaactgccctcatatacttacaggaagaacatttaaggcaaattaaaaattctcttccagggacatgaaccagctcagaatcagatgaagaaattaaaacatgagcacaaactacccaaggcctatgactcctcaaggacctcatgttaggagaccaagttgtcaagtcagggcacgtgtcagctcgcaaagaaatgtgctgcttccctccccgggtcaacacaaggactgtacaagtcttgacttagtttcctttggctctgctacacgtttggtcacatgctttcaaatcccaaagaggcactcattatcagatgcatctttttacatcacactgtgtgaaggtaaacgagtaacagaaatgtgcacaaacccgcaggcagtacacatttagaaaaccacctgtgggtcaagcatttaacacagacctgggttttgtctcaattctttactaaataataat

SEQ ID NO: 29821 - DNA, 723 bp, Bovine  19866881878485
ttcagatgactttaatttccctctgattcccaattgaaacatgatgttttgaggaagcagccaaataagacacatgttcttctgggtagctgaattagaaaatgatcttaagaatagactaagaatttggtaaaagaggaacaaaagtaggacatgtataatcctaagagatgagattctcattatcttgccttctcttggtctaatttttttcagtatctctttgacatgaacaatccttgtgaataattcatccatatcacctgaaattgtagtcaggtgtacacattcatttaatctgtatttgttctgtgagtatttcaagaataaagttaaaataagcagtgtaacattgtcaaagtttgattcttccaacatttaaatcattattgagcaccttgtttgtgctatggactgtcaaaaagacactgggaatatgacggtgtcttactagtctatttaagctgcttataacaaaaccctacagacttagtggcttataaacaacataaatttatttctcatagtcttgaaaactggaaactccaagattatgtggctggaggattcagtgtctggtgaagacccttttcaagttatagactgctgacttctctctgtgccttccctgtgaaagggtgagctagatctctggagcctttgtaaattgtcatttattaaattcatgaagactctaccctaatcacctctcaaaggctctag

SEQ ID NO: 29822 - DNA, 707 bp, Bovine  19866880397649
taaagcctcatcagaaagggcaggtctctgcctctgattgccccattcagtatctatcatggctttgggagttcctcttatagtctgacctcagggcctcttgatgagtttatcagataatacccagggagaaagataacatattataaaaaaagacagacaagcagaaatgtccactgctgagcctgatctaaccggctttcagcgactaggggtcatggagcagccacaccagcagccccaggttgtggctcctgggacagccacaaagtgctgtctgtctcccatggccctgcaccccggcacccacatcctaccttgttgatgaaggatgcaaagcggttattgaggcacttgatctgctccttctcgtccctcttcaccctctggacagtcggatcgacctccagctcgagtgggaccagcaggctctcattgatggttacaggggcgatacaggctgaagacccgcaagtggtgcctgctcgatacccaaagccaggcaggccacacctggaggccacccagggccgcccgaagcccacgttgcacaggctccgggagccgaggcagcccagggcacggaagctcccactgcccccagtccggcatggcccctggctcactgcatagtgagtgaccacccgggggaggacagctgagcaggagctgaagctctggccgccacatctgaagccctgctggaa

SEQ ID NO: 29823 - DNA, 1306 bp, Bovine  19866880598000
ttggggcccagtcaggaaaggagagggctgggtaaagggaggaaaagggtaggtgagaagtggggtctgggttgccctggctgaaggctctggcaccagcaggatcagggaagaacttgaagaatttggagggatggcactcacatgcggtgttggaagtagagcccaggtgcacacaaggggcttggaatagggaccagggtctggagttggcttttatgtgttttcattcagttcctcctaataacagtagcacctatgtgtgtccagcactaagtcctttgcatgcgaaatcattgtaaacctgctgattaccttatggttgttaattttagaaacatcaattacagatagtcattttcacagatgaggagcagagaagttatgtaactcacccaagtttacaagtgaaggagccaggatttgaacccaggcaacagagatctggcatccgtgctcttcaccactcttccccaagctggatcttcctattttgtgactagaatcccctcacagaagatttcctgagagtccccattgctcagatgagaaggctgggcctcctagagctagaagcatggacctcttgccttgtgggggcctgtgaggctttggggaccaagttggagcccaataaggagagaggggtgttctgctctgtcctcgtggtggctcccttttctctacctccagctgtccttttgtgtacatcaaggagctgaaagctgggttgaggtaccacctgtcactgcacccaggagtagggtataaggttgaggggctgtgtctccagggcctggagatgctccagacactgttgcagctcctggccacactccacgttcccaagtgctgttcgcttggggtgtgggccccaacctctgatgcccagctcagggggcaccttgggctggcctgtcccccgtcatggcctgggtcctgcctctgttcccatgtctgtttctggctgtactgtctccagggaatggccgtgccggctgatttctcctctctcacacaactccctctgtaggcctccaccatggacagaggccagccccagctcctccccggtgttggttccttctgccaggccccgaaggtcctagggatggtcaactgttgtctaaagtctgtcggtccacccagactggtaagtgccctgctgttgccctttgtatgcccctggggcctcctgagtaggtggttgggggccaaggtgggtgtgggagctgcttgaagcggatgtggtttgggggatggaggggggaagccctgcagaagtagcaggcggcgctgctaggca

SEQ ID NO: 29824 - DNA, 1587 bp, Bovine  19866880626148
cccaccctcccatcgctccaagcctagaaagggcacgttcatgagtttcccagtcccccttcgggggaggcagtggtgttcagactcctgtcctccagatgcctatgagaggcacacgaaacacagtggactcttaagggcatggactctaccacccacaagtgtgtgatcttggcaagtgactctgctcctctggactgcagtttcactatatgtaaatttggaatgaaagctgtacccatctcatagggtgtatgcaccacgaggattaagggagtcaaatatgtcaagtgctggagagccgtcacacaggagacactgtagaagcggtagctgttgttactgtcagcagagggaatgggagcttggtttgtcaataaacgagagactaacttcctgatgagctgttaaggagttgagggaggcatccttatctttgggttgacactaactcagagagaaaggtagaaaggggctttggggtcttggctacactgggaggaagagtgggccatcgcaccccatggggggacaggcagatttattagaccaggtggccccattcgcttctgtctctctattcaaggatcaccgggcttttcttgagaaactgagtttaggttgtcttcgagggaatgaaggaggattctgcttaagaggagccatttgtgtcactttacacaaatcctttactgtctgggtctcgttccctgccctccctggaggtctgataaagagagcgattctctggggcataggaagctggccctcgcaggtgagaacccagtggaggccttggcctgctcactcttgctcctccttccccaggatgctctgcgcaactctggtggcgacgggctggggcagatgtccctggagttctaccagaagaagaagtctcgctggccgttctccgacgagtgcatcccctgggaagtgtggacggtcaaggtgcatgtggtggccctggccacggagcaggagcggcagatctgccgggagaaggtgggggagaagctctgcgagaagatcatcaacatcgtggaggtgatgaaccggcacgagtacctgcccaagatgcccacgcagtcagaggtggacaacgtgtttgacacgggcttgcgggacgtgcagccctacctctataagatttccttccagatcaccgatgccctgggctcctccgtcaccaccaccatgcgcaggctcatcaaagacaccctggccctctaggtctctccagggccctcggtgctccttgatggcttacggaccttggcttctggggatcgtactgttaggcccctggggctctggaacccgctcccggtccttgatgagacttggaagggccgccctggcttcctcgtggtgtggttgccagtctctggtcatccttgtcacctttactgacggtcaagtctggcctgcactgtctctccatactcctggtttcggggcgggcggggttcccctttcctacactgtacagaggacccatcactaggatggtgaataaagctgagaatgtgagtttgggttgagctgtctctcccttgactggtgttacgccctgaaacattttag

SEQ ID NO: 29825 - DNA, 740 bp, Bovine  19866880662535
cacccagcgctgggacaaacacgcagcctgttcccaagtccacccccagccctccagcaccaagccctctcctcgcatcctttcatctcgtgccaagaacacgagtgcctgggcccccccttcccaccaggaccttgagtagggggaggccagacagaggaaaaccagaggctggccacagaaactccccctccagggtaaccccacagcctcaccctctgccccactgtcgcccctccctccatctctccaccaccccagggtcagcatgaaaggtcccaggtccctgttcctaggatggcagcccaccgggccaagcctgccctcttcctaaagagcagacttgttggaaggagagcccaagcgaagccaccacaaagcctgctggggtgagagaccagcctgccccacttctcataaaaagctacacccagggcagcccagtaccttgaagaagcctttgcagccctcacaggtgcggaccccataatgctggcaggaagcattgtccccacacacagcacagcggccctcgcttccacccggagccccactccgggccttggcagaggtcacaggcgcgtccagcctccctgagccatcaaggtggggagaagtgggcaccaggcctgggaacgctgtttgcatggaatagctctctccctcccccagctggtgggcggcctgcgaggggaacagcttcagggggcttgggggccaggctgggactggggcccggg

SEQ ID NO: 29826 - DNA, 1816 bp, Bovine  19866880719663
tctggccaactgtgatcgacccctaactgttgttgttcagtcctcagtcatgcctgactctttgcaacctgatggagtgcagcacaccaggcttccctgtccttcactaattcccagagtttgctcaaactcatgtccattgaatcagtgatgccatccaaccatctcatcctgtgtcatccccttctccacctgccttcagtctttcccagcatcagggtcttttcaaagagctggctcttcgcctcaggtggccaaaggactggagcttcagctttagcatcagtccttccaatgaatagtcaggtttgagttcctttagactctcaagagtctactccagcaccacagttcaaaagcattaatgctttggtgctcagccttctttctggtccaaatctcacatccatacatgactactggaaaaaccatagctttgactagacagacctttgttggcaaagtaatgtctctgttttttagtacactgtccagattggtcactgcttttctttcaaggagcaagcgacttttaatttcatggctgcagtcatcatccgcagtgattttggagcccaagaaaataatgtctgtaactgtttccattgtttccccatctattttccatgaagcgatgggaccaaaagccatgatcttagttttttgaaaggttgagttttaagcgagctttttcactctcctctttcaccttatcaagaggctctttagttcctcttcactttttgccgttagggttgctgatatttctcccggcaatcttgcccacactgaccacagggaggcagaagagtgtcggtgtgagagtcactgccctgcctcctacctaccaggagatgtggatctgggtgtggagagggaaaagctagctgagaagagaccaagggagaggggctgtgactggggttgctatttcaggatctgcctgccagaaacagtccaaactggagcagacccaacatgctgcgtgctaagtcgcttcagtcacgtccaacactttgcaactgtatggagtccaccagacttctctgtccatgggattctccaggcaagaacactggaatgggttgccatgtcctcctccaggggatctttccgacccagagatccaacctgcatctcttatatctcctgcactggcaggcaggttctttaccactggcccagggttaccactaattccaagagccaggagctggaaacactgactgtatatgccaactttacattaccagcatatttaataacaagccacaggaagtgatggggcagtgatgaggcattgctggggcacccaagaccttcacatttgggacactggcctaccgccctcagcaaggacaagtcactagcctgtcagaccacagccacccagcaccagagatgggaccaggcccagcaggcacgagtctgtcagcgtctgcagcactgagcatcctgagggtgtggccacttcagtgcccaggacgcaacacagttgccaggaggcccattctttcctggggggctgaccacccaggcccacatcatgagcacttcaggaggttggatggagcaggtcagaggaagcagctgtgtgcaggaatcccaggtttgaggtctcaccacagtccaggtttttcccaggctgtcatctgtactgtatgcggatcaaaggttccttgtgtggccggtaggactggaggaaagtgctctgggagacacaccatgccgaggttcgggaaatctgtaatagatagccgcccccgtccttgctggaaagggagccaaggaatgacagtcctttccacctcagggt

SEQ ID NO: 29827 - DNA, 2967 bp, Bovine  19866880806900
cttgcctggagaagtccatggacagaggagcctggtgggctacagtccatggagtcgaaaagagtcagacatgacagagcaaccaacagtttcactttggtatctcacatccatttctagggaaacattgtcaagatcagtgtgcttttcattgatttattcttccgtattttacaatgctttttgttacacgggggcaagctctaaccaaactaaatgaacagtgtgtaagcaagcagcagtgctaaaggagaaatggccagggtctggggtcttgtccatggtcctggagcagataggtgccaggatggccaggaagtgtttgcacatttctctcatttcaggccactttttggccatgtgttatttcatgaggagttttgtgatgtcatacccttggcctctggggccctggtgaattggagaactcaggaggttttcaggggtttggagatggggaaggcccattgtcagcaagtccttaatgagatgtgatcctacctggcttgctgcagtctgggtggcctttttctccttgctgctgctactgctgctaagtcgcttcagtcgtgtccaactctgtgcaaccccatagacggcagcccaccaggctcccccatcccttagaccagctcatttcctctgaggagttggctgattcagctgttcactaacagtgacttaattttaaacagagctcagggttgctacaggagttctcaggagacctgggcaggagggtctttcctccatcccagcttccccagacttcatgcttttctgcagccaggctctgctccagactttcaccctggcttggatgtggaacacccagttggcagcaggctccctttagtgggcagttcaatagcatctctatccactttggcactgtgacttcctaggggtaggggactggtttattcaaggtcaggacaggagccctggtgactcagatctttcctcttgatctgtaactctccttgacttcaggcctgagcagaggaatgggggcaggccttaaattcctcctcccctccatcacacctgggaccaggggggtgctggcccacttagccagacccaggaggctcccaaggggatgatgaaggctatgtatcactaaggttctagatactgcacatttgcctcctgtcccagtggcacctaggttgtttttagtagctaagttgtatctgactcttgtgaccccatggactgtagcccgccaggttcctctgtccatgggatttcccaggcaagaatattgcagtgggtagccagttccttttccgggggatcttctgacctagggatcaaacccacatctcctgcactggtagacaaattcttttccactgagccaccagggaagcccaagcagcatttaactttggcccagggacagaaagcctaggagcagggatggcccttgcttgtcctgtgtcttgctcagtgggggcagcaccgtggccagcacctggaatgtggtctagaatggtttaagggttctgagagggctatctcctgaccttttctaagggggagggtaagccctgaggacaggactcctggctttgtctggttgggtgcatgggccggttcacatgagtggctgtgtgggcctttgggttgagaagtacaccggcctccccgggattctgggcggtagctaccagccccttgtctagaaagaggctcctcgctcgccgcgaggggtgagggcgcacggcgcctgggatccgccccttgggcccctccccgacgcagccaccgcccacccgccggccttgggctcccgcacatctggcggttctcagcgcatctgggcagccggcgccgaagcatgaacagctcgcaggcgggcgccacagcccggggcgcctggcagagctcctgctgcaaccagtcgggggtgccgccggagccccccgaggggccgcgcgccgtgcaggcggcggtgctgggcgtgctgtcgctgctcgtgctctgcggggtcctcttcctgggcgccggcctcctgctccgcgcccagggtttaacagcgctgttggcccgagagctgcgctcgtcccgggagggcgagcccggtggcgccagcgtcgatgacgacgactcctaggcgcccggctgcgttcgggggtcgcgacctcccggcggtccgtggactccatgccagactttgagggagcggccccccagcacccgaagtctgcagtggggaaccctgccgcgatgctggtgcgctcgcacaggtgagagtgcgcacaggtgacagagacgcagccatcccaggcccctggcttcttctttctcccctcctctccttccggaagcctttcccccccgagaggcgattcgagtaagattcctcactgtggcctccctctcgaggcagggatgggggtgtgggttgagttttagggcagaaccaggggcctggatgaccctgggggatggagaggtgtgctgccccctccccctcaggttggggtgaatgcacgtggcccagagcaagcagctttggggtgtgcttgtgggggtaggtgtcaaggttcctaacagctgggaggcctcagaagcacgttgctccaggaggctggagctgagggttcccagctgcaggggctccatctggccctcctgcctctctctccccaaggacaggaaccatctggagggaagggcctgggtggcctaaagacaaggtaattctaggccaaggctgtctcaggccgagccacaggggccagtgagggaacccttttctgcccttctctatttagcatcgcacctaggggttcctgggaggtttttgtgggtgtgcctgttcactggaggtacctctgatctttcttgccccttccactgtagagccccgctcctgtctgccaaggcagaggcagggtcctggctggcccctgagaggggagggcttgggtgtgtgaggaggggccggtgggggtg

SEQ ID NO: 29828 - DNA, 1345 bp, Bovine  19866880868055
cccaccctacccaccccccgcactctccaccccacgtatacactttcatatccatgtagagacctatacgcactcagaccagccacaggcacacacacggcaacacccagagaccacaagcacagagaagcccaagcacacacgtgctccacagtcctcggtgctcacgtgcacgtgtctgtgacagcctcacagtacgcccacttgcatgtgtgtgtgtgttccttacatgctgtcatccctcagggggtgaatgtgcacacagtctccgctctgggtcccctcaccttccctcccctcttccaggctggttggcaggggccccctcacctcgtcatagaggcgcttcaggaaattagactcctccaccagggcctccacgttggcctccaggtctgactttcgcaggtaggcacagtccacatcctggtggtggggtagagaggagggggcgagcgtgtgggaggaggccccgggaaggtgctctgggtgggtgtggcgaccagtcccactggaggttgtgcacacagaggtgccgctccctccctcccggagcccatcccctttaccttctttagaaccacgaactcattctccgctgtggccctcaaagccacctcctcttcatacctgtgtgtgagagagtcagaggctggagctgaggagtcagggtttggcagccatcctgggcaagctcttctgggagtcaaatggggtgaactctgcaaacgtcatcccgttctctccccattctatttgtgcattgtttgtgggctagccctgtcccagcctggctcattccacctgagtcctgctgcctctgggatgagatcagagaatgcacattccatgcccaggtctacaatcatctttccatccatcctagatccaaagagagctggtgccacgggcagagtggatgtggagcctgggtcaggaaggggagcaggaggagcaagaaagccatggaaccccactgggcttccttactcctctgaaaccatctctaagacccatgggcctccaaggagttgaggtggagccaaagaatctgaagaaacctaggctcctactgcccatcctcttgggtagcaggcagcccctcttggcagacaggcaggaatcttaatgaagctgcttcaagagggttgtgggcagagccttcccccttaaccctgttaccacaggtggtgccacactcacttcttcttgtagccctccagcacctcctgcacgtggttgagctctgaggccagcctcccgccgtcggcctccacatgctcagcctcccgcctcagcgtctcgatgtagccatgaacaggggctccaggtgctctcgcagcag

SEQ ID NO: 29829 - DNA, 1241 bp, Bovine  19866880964921
aacgtccccagagcccacagctaggaagtgtccaagctggcatttaaaccaggccttccgatttggactcccttgcccaggttgctaaatacctgctgcttcaccacgggtgactatgatctgaagattacttggtgccagctgaggccacctgctcctcgcttccccaaggcctctgccctactcggaaggacaggtgtgggatgtggagatagaaaccagctagcctggtgctgggcaaagacctgcagtggctctggctgtgaagtcaagggcagaccccggagagaacgtggggcgtccagggaggatccaggaacagcagcacagggacagcattcggttctggcaggctccctggaggagttgccaccctcagaggaagttcctctgcccttcttcctgaagttcctaacctctcaggggcctggcgagcctccctgggggtatagacgacatccccaggtctgtactcaatgagcattaaagaatagccatcattatgttaataagtggccccaggacacataggaaagaggggactttggaaagaaccaagagttcagaacctgtgggagccagaaatcacagtgtcctcgaataagaaaagctgccttcctcccccgtctctgcgcagagcagtctctgaatgttcttccaggagtgacaattccagggctggcaaacagggtgagcccctcccctggctggtggtcttggaaggaactgggactcacaggacctgtttcttcttaaagagccaagagacagtgtccagagcaagtttgaagcatcaaggctttcccggaactgggttctcccatcctttcagtcaagtgggagaaagtatctaaagggagtctccccattatccacaagaggccattattgtggccactgagagttaagtggtttgtagttttgtgggtgagaaatgaaggccctggaacagaacctttcaagctggaatccagaaggttctaggagaccatgagctcaaccctctgccctgcaggaagcatgatcaaaacagcctctctggacctgaaccacctccaagacatgctgcttgaatgggtttgggctctcttgatctatctgcccctgaaacacaacgatatacctgagaatgtatcctgtatggagccccgaggacagaggtgatgatctctggtggtctcccccaacctggggccctagaacttcttcctggagatggtggccccagtccctaccccaca

SEQ ID NO: 29830 - DNA, 1231 bp, Bovine  19866880997622
aagaactggccccattgccctccagggttagaaggtcatggcatccaagccactgcctcccatgtagagcctcagggaatctgcctgcctttgaaagaagaaaatccatcaactttttctgttttgtcttgctttcctgggggaaccccaggctctaatttccttacctatataaagagagatgggatcatctaagtggtaaggatgctccctcaggggtgatgagtgtctatcacatgcccaaatgagagtgaagcttgcttgtttcctggagcatgtgctttgatgaccacgacttcctttgccaagcccttgtggtacccagttctccctactctcgaagtccccattctccctcagccctgcctacatctgccctcacagaggctggctcgtcttcctccagagcttcactcacatcaagattaacagaccaagaggtagcaaatctccatgtctattcagccctgggggtggcgtggaggggtgcaggtccagagaggggacggatgctgactatgcagtcgtcactgtgggtgggcgactcttggaacgagctgcttccaccaggaccacattcagtttgctagaaatagagacagagggcttcttgactttgcatacgatttgcataatgtcatagacacacagtctattttcaggcagctttcaggttaaagtgttgtcactgctgccctgcggggtgtcacgtctggatgagtctcttctctgttctttctcacccacccactcttactgacctagatccccaactgcaggagccagcggcagggtggggggcagactggggttgtccggggagacacgggggcagggcaaaaggcacactggcatttcctttgttaccaccaccacccaaagcaatgtggagctgttcaagggcagccgacaggcagaggcaaggaacgggaagcaaggtggctggctcatgctctgttctgcacaaactgctcccgcctcttctaccagaacagccagttcccataccctcgatttagtcttctgccagtttgaaggaagacatctaggtaaacctgttcctctcagccaccataaagcttggcttggcccagctatccctcttgggcatttattttcagcagtaaggtttgatcttagcctcctgtgaaatctgaccctctttctgtccctctcctgggaaccccatctgggagaccagtaaagctaggtctgatgatcagtgtttata

SEQ ID NO: 29831 - DNA, 1129 bp, Bovine  19866881092728
cagaagagaaagacagtccaagttcaacacgtgttcagatgccccactgaagcactttgaatcaaaagtcccctgtgggttggacctacagggtctatcctggactttcccatttggaaagtcaggaagagtcagctgaccacagttttcagcatgtgctaatacttgaagaactgctctaaacaaacctgtgacacttacagagccctgtccggtgtcaggcaccgctcaaagcagtggacagacaggctagtgtgggacacagagaaaatgctggcaacaggctcagatgcagaggcaaggacagaacctgagacggcaggttctcttcctggagaggggagcctgcttgaggtgtggaaagccctggcagggccagatggctgggaggggcaaggagaagggcacccctgtgggaattctgaatagaacctcaggtttccccagacctcacagtggagaggtgggaaggacacctgtaatcctgacctccaacttactgtggcctgagcaccggacagtcaaaccctccagcagacaggacaagaagagagggggttaaacacagcagaagagaccagagccaggtaccagggagagcttcctgctagacctgtctgaattccaaactggcaagcaactgaggggttccctgatccctgggcctttcaagaaggggagccacctaggggcttcagaagggtcttttctgcaccaaggcaggaggctgtgggcaggcctctcagggccgctcccgcacgggaggctcggaacgggagagcgcgattcagccactctcacaggtttggccttgtttttttcacacagcagaaactgcttcgtcagctcctctgtgcaatcactggtggaggagccctgccccaggcctctccctccccctctgccctctgtcctgatgcaggaacacagacctgcctgctcccagcacaggcttgggacccggccctcagcctgtcctctcccagctgggccatccaggtgcactgggcagccagcgcagaccccagagccccccgggcccaggcccagccaccaggagggggcagggagaacacacagcctgcccctggggaaacagtggggctggggagtcaggagtcccaggctg

SEQ ID NO: 29832 - DNA, 998 bp, Bovine  19866881115443
tttcattattcatggatcccgtatttgtgaatctgtccacttgctaaaatttatttgtaaccccaaaatcaatacactcagtgttcatggtcactcacaggtgagcacagaggggtgacaaatttgagtcaccccaacacacacgttcccacagaggttgagtaagaacgctctggcttgtttcagccctcatactgttaacacgcgttcttctcatggtatgttcagtgccaagctttctgtctttctgtggtttatgctggtggccccaagagcagtgtggagacgctgtctagtgtccccaggttcgagaagacagtgacacaccttagagaaaatccatacactgaacaagcttcattcaggcaggcattatagtgctgttggccctgagctcaactttaatgaatcaaccatatatattaaataatttgtctttaaacagaaacacaaacaacgtaaggtgatgtgctgaccagctgatgaaagcacagcaaccagcagcagcagcggtccaggatttgctaacccagtgttcaactgggcttcacagaacagttaccgaaaataaggccacctgactgcgttagccccattttacagatcgaacaatgacgtggacagggctgtgccgtggcagcccctggcgcactccggcacaccatcctgttttatttccttcacagcactcatgactgataaccgtgtttactcatttattttcagtctgagcctctgcaatcataagttccatgaggagttagggatttttgtccctcttgttccctgtggcctcctcgtgccaagaagcattccaggcacacacccaactaaatgaataaagaaacctcctatatgtaattgtgtaaatattagagtgattgatactttaaagggaaaggcagttactttcattatgttaaattcaaaatatttagcaagacaaatgaggcttcagactaaatgcagagagaaaaaagccaaaaagaacaccacag

SEQ ID NO: 29833 - DNA, 762 bp, Bovine  19866881213667
tgacctcgttgggccacctgccagttccaggagctggcgctgccccacttcgggaaagaggatgctggggacgtgcagcagttctacgacctgctctcgggttccctggaggtgattcgcaagtgggccgagaagatccccggctttgctgaactgtctcccggagaccaggacctgctgctggagtccgcctttctggagctctttatcctccgtctggcctaccggtgagcgtcccactgtgtgctcagccctcagctggcgccctgccctccagcccccctaacagctgtctgcaccccacctgccaggtctaaaccagccgaggggaagctcatcttctgctcaggcctggtgctgcaccgcctgcaatgtgcccgtggcttcggggactggatcgacagcatcttggccttctctcgctccctgcacagcttggtggtcgacatccctgccttcgcctgcctctccgcgcttgtcctcatcacaggtgggaggccggtccccagacccagggagatggggaaggcctgagggcctggctctggatgtaccagcatctggtgtttcctgggcctcctgcattgtggggtgagggtgacgaggtgcagagagggcaggtgtggctcagggcaatgcagttggtggttggcagggcccgggtttcaggcctagctgtggctgacggcaaaccctcagcccctgacgtagcccagactactcaagatcctaactgtgtaggtgtcatgtgtggcctaaagt

SEQ ID NO: 29834 - DNA, 2085 bp, Bovine  19866881237489
aaacgggatttgaataaggctggaatgcccagcccagtcctgcgtagctgctgcctcttttactccaccccaaagccttccctgccaggctgtcttagcgcagacagacggggccagccttatcgcttgcaggtacttttatgcctatggatgggcgccactggttggtggggccaaagtttctaggggctctgttgtctggattggttgtgggagtgtcaggacgggggtggagctgccctgtccagggcccaaggaggcaggagaaagcctattacgggagaactcccccaggctcttggccaggaggtaatgccagcttttgccccctcctgctgtcccccttggtcatggcacgccctgtttcagcttgctttcttccccagcctccctccctccctgactgatgaggctagggtcacggagacaaggcaaggaggtaggatgagaacctcctctctgtgttagcttttgacttgtctgtgaacttaaagatcccccctgaatgattctctctgctccttcagattcctccagatttgagggggtgtaagccccctttgtctgagctcctgggttcttcagggcacagaactgcttagtggagggacccagacttccatcacccccagcagacttctcctctgccctacacagccacctcaggtagtctgctggactctgagtgctctcgtaaaaataatagggggagatgctgcaggaaagcagagaagttccttttcaggactcgaagtccaggggctgctctccccgccacactccgccctccagcatatggccttttaaaggtctggatcccagttacctgatcccttggggtactggggaaggaggtcgggctcctttgctctttccttctgagagcatcccaggcaatgtagagtgggtgcccatccccagatggcaggaccggggtgcgcgtgggatctacagcctttgctcagtatgtagggtgagggtggggttggggatgggggtagggagaggctaattgctgtcttggctgctttcataggcaactgggccttcactctcagctcctcttccatttgcaggatgttgttcttcagctcaggcactgttgggggaggacaggagggggttttgcagaggctgagccatgcctgggaatattcccagaagtgccaggttggaggaacggcgtatctgctcccaggactgggctctggctttgcctggctgcctctcccacccacccttctcccagcccccacccgtgccttacccagttagggagaggcagggggctggacgaacacagctttcccctgttccagcagagaaatgctggctacatgccctccctagggttcccaggctgcccggggtgtggttggccttccgacttgagcccacccttgctgggaccttgcctaggggctttgtgacatggacattgaggtggtgctctgaccaggtaccaaggattcctgggttctgtggtgggccatggccttaacgcctcagtgtcccatgtctggctgggagtcctgcctcctggccgctcaaggacctatacttagaggtcaggcttcaggcctctcttactgacttccctctccccccactttggtctcttccctctccagagatgccctgtatccaagcccagtatgggacaccagcaccaagcccaggaccccgtgaccacctggcaggcgacctcctgacccctgagctcagcaagcccaccatggacctggccagccccgaggcagcccccgctgtccctaccgccttgcccagcttcagcaccttcatggacggctacacaggggagtttgacaccttcctctaccaactgtcaggcacagcccagccgtgctcctctgcctcctcctcggcctcctccacgtcctcatcgtcagccacctccccagcctctgcttccttcaagttcgaggacttccaggtgtacggctgctaccctggcacgctgagtggccctctggacgagaccctgtcctccagcggctctgactactatggcagtccctgctctgcaccgtcaccatccacgcccagcttccagcctcctcagct

SEQ ID NO: 29835 - DNA, 1469 bp, Bovine  19866881716950
cttgagtgggcaacgtgcagctaagcacctgtgaaggcgacgacgtgtgatccctctgcagaagagcccaggatttggtgttaatcccgggcagctgtgctgcactggacttgctgagctgtggacttctcacctcaggcacaccgcccccacccccttggagagacggctggccagggcagtgaggggtgtgtgtgactgctcctggcccaagggcagcggggctgggcgcagggacattccccactgccctttgctgtgtcctgggggaggggctggaactccttctctttacggtatccagtttacctgcccccttgctcacaacattctgcgtatttccgtcctgtctcccatctccagcctgtgcactttcctccttctccagctgggccagagtctccatgtctgctgtgaggccttcattttacaaatgggaaagctcagagggaagaaagtgacctgctcgagtgaatgccagagctcaaactggaccctggggctcctgattgattttgagctctggcggggagtggtatccctgagctttgggttgccccttttgctctgttctctcttgccctgatttctcaccactctttgagatgctgatgcaaaatatggcctctctccccaaaagaatgaaccttcacaccacacatatggcatatggtttctgggactggcaccccaactccgccccccgccttggtgtcctctctcccatccctgctcccccgcagccttgctggataccttcttggtgctgcgaatggccacccaggtgccacaacaactcccaggtagctgggctcagcttttctggcctgagcatgagggtgggatgagctcagagggtcagctggaatatacatctaaggaaatccaagtggacagggcagaggggccagaggtcaagatgatgacttggattggcctttgggttcaagtctgggtggtgttaggggtgtaggaagatttgatggcaggaaaggctgtgtcccccagcgtcgtggtatcagctcacacccaggcagggctggggacggtgcagtggggtgaagaagagggggtaggcaaagactttcttcatccaacttcctgtcttcgctgtcccttcagctcagtgcctgggaagctggcccatggtgtgtgctgtggaggacctcagtgttcctggaggaagagcctgagacgtttgctaagaaactctgaccctggtcaaggctgtcagactgaatggggagggaaagaattcagaaaattgggaaatgggtgttgttgtcacgccatctgtcaggctcggcttgggagtggcagggatgatgactgcaggttggtgtgccatggagtgaggccaggcatttggatcccaacaagctccattagcctgtgctgtccttgatgaaaggctgggtccacacatgcgggtggcttactcttcctctaaccccgagtctcaccctagg

SEQ ID NO: 29836 - DNA, 1573 bp, Bovine  19866881779483
catacgtctgtaacaggcaaggggaccctcagcccaggggtggagcaggatccaccccgtccctcagactgccttcccaacccttccctccctctgcacccagcttctctcccacctggatctcaaagccaaaggtctggttctcctccttctccaaagtcagcactttcctgcaggagacacaggggccatctcatcaagtctgtcaggattaaagaggagcctggcaggccaatagtgtggccctcccctgatgccagagtctgctctggaacatcaaggcagggcttactgtctccagtgacaagccacactcatccccagctgttggaatgtccttccccatactgaaatcagcttcatcgagccacacaaaatcaatcccctcgagtgggggacacactgcaatggctagcccccagagccagttgaactagttgagtttttcggccacactcccagcttcctagtgagccccagaatactactgactgactagctgaggcccccaattcggccccagcctggagcgctgtctgctccagagccttggggagagggctggccccacccccagaggccggtcacgaggctcagcccggaccccagctgcccctcccagctgcggtgagggccagcccaccagatgtgagggctggggggaggggagactcgaggccgccccttcccgcactgaaggcctgcccactggacacaatggtctggagctgctccagatcttcgtctgctgggggagcccagagtttcctctgcccactcccacccccttccttcccgccccgccagaagccgagctgaagcagcctccaaagtctccttcaaggctctcggcctcagcaaggccctggagacccaggcctctcagtgcccagcctgacccacatacccgccccccaaaagctgatcggcaactccctaccccagcgcgagctcctccctgcattgcaggcaggccttttcctctctgtgtgtatttgggccggggtgggggtgggggcagggtgactgtgtctactccagtgctccctggttttctaaaagggttggcaaagttttcctgcaaagggtcagacggtaaatatttcagcttttcttttcgagacctgaattatttgacagcctctgtcttatattgttctttgtctttatttttacaacccttgagaaatatcaaaacaactctcagctcaaggccaatctggccagcaggccacagtctgctgatccattttagaaaccaggctcacatcaggatgggacacaggcagagtagggctagtccttctgccctcaccccaggcccttccttagaggccaccaccgacgggactagcagagcactgaggttttgggtgcagggctagacagtcgagcagctggatgcagcttgccatggtgtgggccttcagggtttgttgggctgggaaggcccaggggagccccccaaactcctcctgcttccctcttcccagatccagatttctccagggaggggtgactggcagggactgggggggtttaaggagcacctgatactcaaaagtccctccct

SEQ ID NO: 29837 - DNA, 1167 bp, Bovine  19866881814139
tgaagacaggagagttatgacttcccaagaggtctttgatgcagacactgaagtcagactgccagtttttaaacctcaccatgctagtctcttaaaagacgggcttgttccttggaagaaaagctacgacaaacctagacagcatattaaaaagcagagacattactttgccatttgccaacaaaggtctgtctactcaaagctatggtctttctagtaatgtacgaatttgagagttggaccagaaaggaggctgagtaccaaagaactgatgcttttgaaatgtggtgttggagaagactcttgagagccccttggactgcaaggagatcaaaccagtcaatcctaaaggaaatcaaccctgaatattcattggaaggactgatgctgaagctgaagctccaatactttggccacctgatgtgaagaaccaactcattagaaaagaccctgatattgggaaagattgaaggcaggaggagaaggggacaacagaggatgagatggttggatagcatcaccaactcaatggacatgagtttgagcaagctctgggagataatggagggcagggaagcctggcgtgctgcagttcatgaggttgcaaagagtcagacacgactgagtgactgaacaacaacaatgctggtctcctcacctgtaaaacaggtaaaagaagggccctaccctgcaggtttgtcctgaggatcagacaggtcaatacatatacagcagcacatttaatggtgtccagccacgagaagtcctccatacatgtcagatattgttccatagattgcctagcactgagcctgtgctcacacctcaccacagagcccctgtcccagcttgccttgcctgtggcttctgatcagtttttcttacagtaaaatctggtttttcctcaaactggtccttcccaggcgtgccgttgtcatgggaacctacaggggccgcctgggtttgggggaggaaagggttgtggatgaaagccaaagaatcccaccgctgctgttgcagccactacagcagtaggctggccaccattctagccccccaaaaaagatcctgacagtgccagagggtaaggtttataggggcttacttccgccctgacttgccacaggtcacatgggtgaaatcccatgattcaacatgctccaccat

SEQ ID NO: 29838 - DNA, 1318 bp, Bovine  19866880626664
cccaagccctttcatgaatatacttaaaacttcccccccagtttgcagttctgggagacactgctttgtggaagattcccagtgttctccttacttgctgcaagtaataaatccttccttctctctctctgacttggttgggtcttgtggctcaacacccaccaagaggtgaactcagtatggaggctcctgctggctccctcactgggctttaatccagtcacactgttatgaaacaggggctctgaagaaattacttgggtcactaaggtcagagactcataaagttccagcatcctcaaggaatcctcactcccttgaccttaaggttaacagactaaagataaaggagtcctctgtgcttcccacctcaggggcaggaagaagagcagaaatgcttcaagaaggcttatgcagatatgtcttgaaacagacttggaaagatcaatgattcagaatgaggtaagcaaacttgttgaggcaagtcccattcaaatgttcaaggcagtaaagtggtctgaggtgtccacagaagtactaagaacaataattaaacagaatttcgcaatcttttccaaaccttttgctgccatgggacttttccttcaaacaagcttctgtcggagtccaaatacaaacccatgtgaaagcaggttgctctagtttcagaagggtcggggaggggttgggcacggttaaaaaaaaaaaaagtctattaataaaattagaaaattgtaaatcatcatgggagaaaacctttgaattcatatttatatcatagtctaaagaaacactgatcagaaagtgaagttccccaaaccgacacttcattagtttttaaagtgaagagcttttggattttaaggacatttttacttaaggctggagaaggaaatggcaacccactccagtactcttgcctggaaaatcccatggacggagcctggcgggctacagtctatggggtcgcaaagagtcggacacgactgagcgacttcacttacttaaaggcatgggaatagggaatatgatttttagtcacatggaaatgagccttcgatggaaattttcagatttaaggactgtgttctgcaggcccggggcaatgagtccccaggccccaccaggtggcgcgcatattcggcatttccagaacgtttagttctctaactctagggtcagacggcctgcctcgtgctttgtaggtttaggaaatccgattggatgtcacgctggagaaaataacacttctgttcttctgttggaaacttcttccctttcactttcgtcccaactagataaatccgcctaaccttgg

SEQ ID NO: 29839 - DNA, 1349 bp, Bovine  19866880783804
aaaagctatggttttttgagtaatcatgtatggatgtgagagaaagctgagagcttaagaattgatgcttttgaactgtggagttggagaagactcttgagaagactccttggactgcaaggagatccaaccagtccatcctaaaggaaatcggtcctgaatattcattggaaggactgatgctgaagctgaaactccaatactttggccccctgatgcaaagaactgactccttggaaaagaccctgatgctgggaaagattgaaggcaggcggagaaggggacaacagaagatgagatggttggatgtcatcaccgactcaatggagatgagcttgagtaaactccgggagttggtgatggacaggggggcctggcgtgctgcaatccatggggtcgaaaagagtcggacacaactgagcaactgaactgaactgaactgatcctaggtgggatgcccactgggaagtatgggagacattgtagttacagttcccctcttctcagaagacaggaaaattgcacttccctgccccatggaagcttggcatggccattggactattttgaccagtgaaatataagtgaaagaatcagatgtcttttcaggtggaagcatttaaagcacagggcacagttctccatgcctgctcctacctctcttctgtcgggatggcagcgttatgggatggaagtgtttcctccacctgggttcctgagtagccatgatgagcagatggccaagcgaatatgtatcagccatgtattataactgagaaataagttttgtcataacaagccactgagaaagactaaggtattgtctgctgctgcagcataatgtagcctcacctaatatagaaggaatgttagaggggagagggatttaaacacatttcaagtccctttctgcactcagaaaatgaatgtagattctgctataggcaaaactgctattctacatgctatttagacaactcattataagtcacagagagtctcaaaattcttctttgttggaaagtactgctttccccttgcacacaatatgaactatgcattcagcaggatgaggtcatgttacggcatgaggctgaccactttgggatccaggaattggcggcccagtcattcaggagtcacagaaggggccacacctctggaatggagcagggacggaagtctgagagcctgtctgggagagagagccctgtgccctgggcaggggtgatagagggactctgctattcaaaggtgccagtaaaaagctttgaacaagctaacagaaacacacaccacacatactcactacatagattttaaaactggcaaagaaaggcaggctaagg

SEQ ID NO: 29840 - DNA, 3586 bp, Bovine  19866880939078
ttatttttcatagctctggaggcttggagaccaccaaggtcaagatgctggcaaatatggtgcatgatgagggcctacttctggtttatagacagtctttttttcactttgtactcaaaaggcagaagatgtgagggaactttctggagcctcttataagagccttcatcccatatatgaaagcttcattctcctgagttaatcaccttacaaaggccccacctccaaataccaatttgaaaattaggttgcaacatataaattttgtgtgacacaaatattcagtctataccaacaaatgacatcaaatattttcttaaaaggggcatatttctaagatacttatatttaagatgttagtttggacaccttatccctcaaggtcttgttttcattgttcagttgctaagttgtgtccaactctttgtacccatgcactgtagcatgccaagctttcctgttctttactatctcctggagtttgctcaaactcatttcccttgagtctgtgatgtcatccaaccatctcatcctctattatttccttctcctcctgccctcaatctttccgagcatcaggggcttttctgatgagtcagctcttcgcatcaggtgtccaacgtactggagcttcagctttagcatccgtctttccaaagaatattcagggttgatttcctttaagattgactggtttgatctccttgttgtctgagggacactcaagagtcttctgcagcgccacagtttgaaagcataaattctttggtgttcagccttctctatggaacaactctcacatccatacatgactaatggaaaaaccaaagctttgactagatggacctttgttggcaaagtgatgtttctgctttttaatatgctgtctaggtttgtcatagctttccttccatggaacaagcatctttaaattcgtggcaatagccccagtccatggtgattttggagccccccaaaataaaatctgtcactttccaattttccccattcatttttcatgaagtgatgggataagatgccatgatcttagtttttagaatattgaattttattaaataatagtttaactccaactattgtagtaagtctacagctatcctaatattcattcaaactcttaaaagtggtatatggggggaggaagactgtctataatctcttggtcactctggctcctgcttccagctttaattgaagaaatatttggaaattgtttcctttttctgacatttttttattagcccatatatacatatacacacacaaacaaaaaaccctcaaaaatctcatatatatatatatatatatatatatgtatatgtgtgcatttatacacaaaaacactttcactgaagattcctttccatttcagggaagaaaaaataatgtgtatatataattttttcttaaacccgaagtgacctttttcaccaaagccaatattctatatacatcatttgtatattacatatataatttgcatgctatatatatataatcaatcaggactgtcagtttatagcatataatcaataactactttaaaatttattagaagtctaacaagttattaaatggattaataatttgactcttagttgatcagaagctagtgttagaatgattgcctctgaaggaaggtagacctggtgtgacatcttggctctgaccctatggctccatagtgattctggcccttcccagtttccagtgttcagtttcctgtttggaagcttgggtcctgctcagaatatatcatcaatgtgtagacattcttcaggctggcagggaggattggtggcacactgaggcctccatctctacagggtctgattgatgacagtaatctgaattttcctcatctgtaaagtgggacacttaatctgtattggtttcctgaggaatcagtgaagtgactcctggaaattgactagcaaatacgtaattcccactttaaagtctctcacttctttatcaaagcttatgtgtgctgaattttgttattgtttggaagtaaccccataacattgttattattgttacaaagcattggaatgtgaaccaaattttttccttcactcttaaaaaataaatctaggatttgtctaattatttaaatatgtctgtactataaagaaaattgttgtaaaaagtgtgaatcaagcataaattcatatgaattactggtgctggaaggcagggagacagttaattgggaacactattgttaatgcttccctgttagagacttctattgttagagacttcctggttgctcagacagtaaagcttctgcctacaatgtgggagacccgggttctatccctggatcgggagatttcctggagaaggaaatggcatcccactccagtattctcacctggaaaatcccatggaccatggacggaggagcctggtgggctatagtccacagggtcgcaaagagtcggacacgactgaagcaacttagcatgcacacgtgtgtgtgtgaatgtggaaaattaatgcctctaatctgtgaaactgaaaggtcccagatgtctccggggtgacttgatgaaatcacagctattccttcttgattcccagagcgtcttccagagacagcacccttctaaagcctgcatggatatcccctgggatacccattaaagcagatggatagtccatgtgccctcagagggccactaggatttctttgagtatgaatgtccatcccacccatctatgatatcatttctgaaaacacactcatcccaaccaaggccaaaattgcatatacctcttcgaagtgactcagaatctggctgtatttctcctttgcttcttccccacaagggcatgacatatgggcatgctgaaaagaataccaaagaatgatagatgttattaaagattgcaatcttctgccattgacatgaagtaggtaggagttctgttctttccacctgtagaaatcttttcatacttctttatttgggatcactaaagtgtacatcagctagaaaaggaagccagcgttttacgctcaaatatagagctcgttgcttctgttcagaaacaggcagcactgaaggagtttgtgagccctgtgtcccttctggcctgcacccctgttctaatctatttccctcccagggagcgtcatgggaagagcgaattgggttctgaggtcctatcttgaggttgagtctggtggtctgctgattagctgcctgggctcaggatgccctaaaacaccataggataactcacagaagaaccatgatttcattcacatatagtgatgattgttggtgacatcaaagagccagcactttatagttctttagacattttgcatagagcatgtatccaaaagtcaatataactgagttcttattacctagtcacatagctcaacacagattaatttagaactctcgaactcagtttttccatccattaaatgggtctaagatgagcctgattgctaagttatgtgctgaggtggatccttttacccaagacccatactcacacacagcttggaggtccttcttgatggtgagaagagagttggcaa

SEQ ID NO: 29841 - DNA, 1615 bp, Bovine  19866880985132
cccggccttcctccacaaacggataaacaccaaacccccttctgtggcccctaccactgccgaacccccgaaggactgaggcacactgctcccatcagagcaagcgaggccgggccaggccgctctgggccaccaaaggtgtctgaagggaccccccccaccctacggccagaaaaagcagatggtggttcctgccaccctcaagcttgtgcgtctgaagcccaggcagaagtctgcctacctagggcccctggctcatgaggttggctggatgaaccaggcagtaaaagccacccggaagaagagaagagagaaggccaggtaccattctcggagacgtagtagctaatgaggcgatggaagcaggccgaaaagaacacagaagaaaactgacaaactcacagacgtcctcaggacccatgggtttctagtctgagcccaataaaatggtttactcgtcatgcttggcctggcctggccttcctccatcaccacaccaggctgcggggggcccccaggggctgccatccaggtgccacaggcagcctggggcttagaagaccgggtacagcggaggggcctttgtcgtggctgtttaagaagggcctttttaaaagtgtagacagggctgtgttgtctacgtggtctaagggctgtgcaggcacaaacttgcctgagacctattccttcatgagagttttaggacataggcggttggaacaatcagtgctattgcaatcctggcaaaagtgagctggaagacttagttggaagggacaccacattgagtacaggagtctgcttaagcttcccacatggttggatatacacgcagctgctaggctgtgagacaatggctaggcagcacaaatctggggttctaaaaggtatttatggaagggaagtgcagccaaggggtcacaggcattccccctgtgtcttccctatattttgtgatccaaaattaatcaattaataaataaataaaaggaggcaataaaagggagaaagtgtataggaaatgcatggtatattcaaagtaaggcagtaggaataggttcaaatgaatcgataaatacaacaaatgtaaatggattaacacttcaaatgaatacaaaaattaccagatctttaaaaaagaaaatccaattataagatatttataaaggaatttgaaagacagtagatacgtgtataacagaatcactttgctgtacacgtgaaacatatgtgttaatcaactgtattccaatataaaattaaattaaaaaaataaaatttttaaaagggaaaaaaagtatttgtaaaacctatttctaaaacacagtgatgcaaaaaggttaagagaaaaaaatggagtaatatgtgaatgggtaaatactaaccaaaataaagttttatagctacactaatatcagataaaacagattttaaggcaaaaaataatgaggtaaagaccttattacataatgcctagcagtttcatcaagaagctgcaacaattctaaatgcataggcatctaataacataacctccaaaacagaaagcaaaaattggcaaagcatgaagaaaatgtcaaatccacattgtagcaagaaatttttatgtatttct

SEQ ID NO: 29842 - DNA, 2149 bp, Bovine  19866881089771
acagacatggaatccaccttcatggatttcatagctaggggcagaaatagacattacaaagttaacaacccaattttattataattgtgacgtcaactaaatgagaaataggagcttttaagagagcaactcaccttgactcaggttagagggaggcttccgtgggaaggtgacattcacctggacatggagaatgagtggcagctggccaacaaagagggaggcgctgagatcattagcagggagaaccatatattaaagaccccttgcagggtgggaggggaaaggaagcaggagggaggttcaggagggagggaacagatgtatgcctatggctgattcatgctgaggtttggcagaagccaacttaattttgtaaagtaattatccttcaattaaaaaccaaacaaatgtaaattttttttttttttaagtaaaggccctttagaactgagaataatgggaagcaggtgtctctgaagcaagggtgattttactgatagctggaccgggacctttcaggaccctctgccctctccataccttctcataacctgaggcttggaagtaggacagaacttaaactgtttaaggaaataaaaaatgaagcccgataagtgagggacgtcatgcttgagggagagagatttaagatgagcttgaagcaactggcaggggtaaaattttcagactttaacctaagagcacagggaagctattgaaggctattaggtagagagaaaaatacatatcttctgaacaagaccatgtaggggccatttgctagcaatccagacaagaggaaattgcagtctggactaaggtggtaagaaacaggaattgagagaagtgtgagtgatcagacatgcagcaactgcttagatgagggtggcgacagcaggtgatgaccaaaacaaacctcaggtttctgactccaacaaccgggtggggacgaagccggtttgcagaggagggtgatacacttgtcaacttcaaattggcacttgccaagggcgcttgccatccacccctccgaggattaaatcatgtgctgctgtaactgctgaacctcaatacagcggttgtgtgttgtgctgggaggtcagggcggaaattgggaatgaggcactctgtgctctggaaaaattggcagaacaggtcttcagatagttggatatttttaggagctgactttataagcccaatttttgcatctcatcaatctagaaaagcactaaattccttcatgatgacatctgctcctagtgactagcagaaaactttcggtaagataagtgcttgattgcatgaatgcccccttcaccaaaatgacacaagtactgaccttcccccctccaccccgccccacctctttggagctgtttctcagagctatctaaagtgctgtctcccagctatggttctgattttgccccaaataaaactcaacttgcaactctcatattgtgcttttttttttgagttgacactctctacattgaccctgttgagtcagagttgcctctgaggttttgagtgaatatgtccagagtggtcagctggacagagacatggagtctggagataaattgcagtaggctggctgtcactgctgtcgagacagaaagcgaaatgatggcctggagcgaatcaccgaggggaagagtgcagagtgacgagagagtccagaaccaaaccccagagaagccagacatttataattcagagcaggagaggctgaaaagcagcttgaaagagcgacctgagcagtaaaaagaaatacgagaagagtggcatccctgaggacaagggaaaaaccgcgccaaggggcaaggagtgctcagccaagtaaaatgctactgggaaatcaagtaagatcaaaacaagacagcctctactggatgcagcaagtggggccctggtgacttcatctctaagactgcagaggagtatcgagaggtcaaatagatggggttgtacgaattggggagtggaaagtgaggacaagtgtagacagctctgctgagacgctgggccaatcggggaggaaaagcagttgaagacagaggagtgagatgggagagcccctgaacacagagttttcagaaagcaggagcaggtgggatgaagggaaaagcaagaggggagg

SEQ ID NO: 29843 - DNA, 1223 bp, Bovine  19866882245808
agtggaagagatggtaagatacaaaagtatgtcctgtggagccagatggcatgggatcgagccctacctccatcactcagttgtggtataaacttagttaaatgacttaacctgttttgtgtcttggttttctaatttatcaaatatagacaatggcttgtagcattgttgtaaggaataagtgtgctgataatacctttagtgcacttaatacctggttcataggaagaacaatatgaatttcagccattgtgatattactctatggagcctctccacaaagaagagctctgaacagaccttgcagctccttgttattcaaagcattgacttaatctgggagtgtgggtgaaccacagaatctcagacctcattccaggtctaccagccagaatctgcatttcaacagaatctctaaatgatgcaggtaagatactgtgcttctaactccacctctacatgaggtgtgcatacaacatccgcacgtacataagaagcgctgttcatcaccacacaggacgctgaccacagttcctagacacagcgacacagaaacccgctaccaggtagcacgcttcatgcataacagcttacagttcactggggctctctgctccctctgcattgtgcgtgtgtgctaagtcactcagtcgtgtccaactctgtgtggccccatagactgcagcccgccaggctcctctgtccttgggatgctccaggcaagaatactggagtgggttgccacgctcgacccaaggatcgaacccgcgtctcttacatgatcgaacccgcgtctcttacatgtaagctgcattggcgggcaggttctttaccactaatgccacctgggaagcctccgtctgcctcagccctatcttaaacagtgtgtgctttccctcagatctgaacatagttctgatatgtggaaagaaaacagtggaggcataatggggagggagagcccaggaaattaacaaatgaggtaagaccaacacaccctgcagacacagaactgggcagaccggccatcaatactgttgagtaaacggatgaatttgagcagggaggaggctgtccattcaggccgctgcatcccatctctacctcccctgtcctctccccctcccttacctgatcatagttgtcatggatgattctggttgcattggttgcttcctgtctgcagtgacacagattctgctgcgataaaatggagatagcat

SEQ ID NO: 29844 - DNA, 3025 bp, Bovine  19866880182857
aaaaaaaagatagacacaaagaaatcttccatttatatacagttcaaaagcagtaaaaatgaaacgatattgtttaagggtgcatatcggagaaggcaatggcaccccactccaggactcttgcctggaaaatcccatggatggaggagcctggtaggctgcagtccatggggtcgctgaggttagggcacgactgagcgacttcactttcacttttcattttcctgcactggagaaggaaatggcaacccactccagtgttcttgtctggagaatcccagggacgggggagcctggtgggctgctgtctatggggtcgcacagagtcggacacgactgaagtgacttagcagtagcagtagcagcatagaggtggtgaaactataaggcaaattgaggaattgattattaaaaaatcaggatgtttattatctctggagagtgaggaggggtcggaattgggagcgaacacaggaagaacttctggggatgctggcaataagcatatttcttaacctgatggtggtttcataggtattcacttaatataatttgttccattgtatatttgtgttttatgtacaaagagtacattctatttcttatatatgatgaagaaaaatgaagattaagaatcatgcaccatgttcttatgctccattacctaattgaaatcccctttctttggttaacagatattaacctttgtttctacatcattttttattagtcaactcattggtattcagccctggctgtgtgtcagaatctccaggggagtgtgtcttcctcccaaacatagttgcttgagcccatcctcttaagattttgcttcaggagagccaggtgggagcctagctaggccttgctagtttgcagacactccccaagcaatagtgataggcagctggggtggagagcctctggtttcagctcctgctatctcattgcaatttctgcagagtattcccctcagtcacacacttcacccccaatattcatccaagctgacaagctgagcattttatttttaattgcattttccttgaagttagtttgccgttgagtaaaaaagactggtcctattcaaggtgttatcttatctggcatttattctagctttccattcaccccttcctaaactccagcacctcgacacttcctttttggtacattcacttccttattttaagcccagggcacattcttggttccttacagccaatcccatcactcttttctccccagtgctgtggcgggcttgccacccatcccagagtagataagtgcctgtttatccctcgcctttgtttctgggctttaagtcagtttcctatcacggggaaacattccttccatcctctgctgactcatctttatcagcatttactggagaaccttatcaatagccttttgaacagcaacgtaaattaaatttatccctcttatcctccttctttatttacccttccaaacatcactagcaactgcaaaatattccagattgacttcctcttggagaaagcactgcatttcttcccagtagatttaaaataaatgtttgatcatttgttcattggaaggtaatctccatttctgctcaagtcagggtacctgtaagtccctgtttgccttggacagttctgccttatccctggtaattgttaatggtgcccccttttacttgaaggaaaaaaaaaaagtcaggatgatgcattttatgatcactttattaaagtccattatcaagtatacttgaaagataactagaggaagaggaagagactggatcctcatgctaagaggcacacattaactgtgtaggtttgatcattataaaccctcactctcaaagtgtggtctctagactagcggcataagcatcacttgggagcctgtgaaaaatacagactctaaggctcagtccagacctactgaactagaactttcatgtgaataagactcccaggtgatttggatgcacattacagcttttgaagcgctgtcctgaacctcaccaggcttcagtttattagaaaaataaaaattgtccagcctccacacagcattaaaattatatcagtgtatacaacttgctctgttttaataacaaacccacaagaacaacagagaagtacattaaaaacatgtacttacatggtggatgacttgcttttctcttaaaaacaacagcaacaacaagatggcggaggatgaggtggatgtggagtacatctctctcttggatacttcaggaatacaccttcagacacagaagtgcatgcagaacactagctgagagtggacaggagtacctgaccagtggaaaagaatatatagaaccatgcaaaactcggtagggtgaaggaactaggaggaaaaacaggagtgttagtaggactggacctgccctcaggcagtgggggaactgaagcagtgggccaatccccatattggggcaattgtctgagtcagaggagaaacattcaaggctgagagcgaaacagctgatctgtggcagcccaaatggaatgagaatcagacagtccttgccacagccatacataccccagacagggatgcagattccctggaaggcacagcagctgggagttggagattagggagtgtggagcaatcccaaggtgagggctgctcttaactgtggagagacagatcaaggggacgtgagggaggagattgtggtgggaaatgcctgtggaggaaagccaggcagccacggaagcaaggcgatactgctgagtcacgcatagtggatggagccatcaccatatcctctctcttcccacactgccacatctgcagctaaacagtagagaggctggcccatcaaatgcctgatgtactgaactacagagtaggaccccacccagggtgcccctttaagtgcctgatgtgccaatctacagagtaggaccccaggcagggtgtcccctctatgtgcctgatgcacccaacagcagagaaggaccccaggcaaggaagccctctaaggacctgagtg

SEQ ID NO: 29845 - DNA, 1435 bp, Bovine  19866880342961
acagtctcctgtctttgtccgattctttcagctggctgcaaggagggaaaaaaaaagtcagtgaggttaccgtgatttctcaagcatatgaaatgtacaagaggcaaagcctgaaggtagcaatgtttaaagattacaagctgttccaagaaacaaattcagttttcatcccgggcaagctccctagggaggcagagcttttctgttttacagcctgtggttaaacaggaagaggacccaggcgagctctgaccaggcagttctaaccacttgcgctgccgtatgtccaggatccacgatgttcaggaaatcctactgacacagtcactctaagaactatgaatgccagtcctgtaattatgtgagtgtttgcacacatgcaggttgataatgaggttgaggaaatgtatgaaggaaagagccttgctggggccagtctggggaaaattgttctagggcatgtccttgatggaggctgagatgagcccccagttttgctctgagaggggaaggaggaaacagggcaccacaagaagtcatgcttttggtccatgatccctgaagttggagggcttccctggtggctcagacagtaaagaatctacctgcagtgcaggagactagggttctatccctgggtcaggaagatcctctggagaagggaatggctacccactccaatattcttacctcaggaagttccatggacagaggaacctggcaggatacaatccatggggtcacaaagagttggacacaactgagcaattaacacattcacttttccctggagttggactgtcactgaatcccatcctaccctgttcttgttgtgggatactggcctgttctttaacctcttaaagcccaattggtaaaatggggatgaaatgactagtgaagccagatcccttaatacagtgcttgttataaacagcacatgctcagtaactgtcggctgatgtatctcataattgttagctcagatgcatcaaaaagtgatgccatgttcttggagcactagccagggaagaccctgcatggcagctagcaaagagctcccagcaggtggctggcggctggcccagcatcagccacacacacagccctaagcaggtcatccccacaccctatgggttgcattctatgtttgctgagacccagagcaactcccacaatttggcttcacctagcaacacatcacagtattttccactcccccacatcagagacattctcaatactgtatatgaaaaaagctccaatttttacttggcttgcaatgcaaaactgcaggtggagaggaagggaagaaggaagaaaggaagagaggaagggagaaagggagggagagaaggagtcagggacagagggaaggaaagacaggcggtaaaggaccttcccaatctcaggggtccacaacccaaccttgcca

SEQ ID NO: 29846 - DNA, 1465 bp, Bovine  19866880581318
atactgtaattggccatagaagggatttatttaagtaggcatgttgaatacagtgggcatgtaatatgacagtgacatttttcattagttgtcattgagatgtagtgtctttttaatggaggtttcattgaataataatcctgttggatgtagagacagaaatattttcatgaactaacgtttcagcgcctaattcttttttctgagtattattaatttagatttaatttttagaagaaaggtatatgtatctaaggggaaggctgttgtggttcttttaaaacagtgtgttcatggcttggctttgcctttgttgattatggttggctttggacagcctaataaattttaagaagtgctgtccagcgtatacaagtaggatgcctacctatcattagtcttattaaattacattttccagaacagtgatgttgaaaggttgtacttatagtaaaagttttatacacatactgttacccagcttgatcacctgcttgactaggtttgactcagaatgacttggcttttctaggaattaaattcatcctcaaaggaggaagacttgccataattaagattattcagaagaatctgctgtgcacctcgagggcagttctgaaagaagaggtgaaaaaaaagtatagttagattataataatggaaaattatttgtcttctttacataaaacagaagccatcctttttgcccatcacagcatcattatttaatacacaaatgtgaaggtcttcttttgttccccaagtattccttattaccccttcaacctgctgatgacttcttttcccacactttctaaaggctggggtgagccctggggggagacttcaactccagccacaactgtggataatggtacttcagcctggggtaaacccgtagacagtgggcctagctggggcgaacccattgctgcggcatccagcacatccacgtggggctccagctctgttggtccacaaacattaaacaaatctggtaagttactgataattgctggtttccgttggatagcactggtgattcattgactataattaagtaattggataacgtttatgacgttgataatgtatccacatgttatcgtaattgtcaagcaactttcatgctatccagcacaagagactgagtataatagtcatggggacacatatccaagcggtctggctcaggtaccagacaggcccctaaatactatacagataatgagcagagttcaggaaggacccttaacattcagacagacattgttactattcttctagggattccaaagaccaagtatagagatgagatactttctgcttctgacctgcatgctgtacttttgggccattctccttaaaaatatgtattaagatgaatttttaaaagttccattcatccttgagttcctaagcaaatacgaacatgaatgccaccaatgtcccatgtttaggaatc

SEQ ID NO: 29847 - DNA, 1895 bp, Bovine  19866880585066
gaaaaagtgaagaaggactactccaaagacatcaagtcagagaaggtagctagtaaggaagaaaaggccaggaagcctaatgagaaaagtaaaccacttgatagcaagggagaaaaaaggaagagaaaaactgaagaaaaaagtgtagataaagattttgagtcatcttcaatgaaaatctctaaattagaagtaactgaaatagtgaaaccatcacccaagcgcaaaatggagcttgatattgaaaagatggataggacacctgaaaaagacaaaatttcatcatcagctgctccagccaaaaaaatcaagcttaacagagaaactggtaaaaaaattggaagtacagaaaatgtatctaacacaaaagaaccctctgaaaaattggaatcaacatctggcaaagtgaaacaagaaaaagtcaaaggaaaggtcaggcggaaagtgactggaactgaaggatccagctcaacacttgtggattataccaggtatctgataattggggaggggtggggtgggggaagggttgcattgtggattataccaggtagctgataatggcaggggtgaaaaaaggagaatatgtttcttaagaatgtattgatgttaggggttagctggttactcttgtctttgaggataacaattgttaaaagataacagatgttaagtagattttgggagtgagccacacttacttttatgtaatcatacacacatatcttagagcagagtaagtgggcttttgaaacttgaaagggcatttattatatttaagttaagtctttttatactcatcagtgtttaacagttacgagttcttcattgaatacaaaatattttaattctttttagtaccagttcaactggaggcagtcctgtgcggaaatctgaagaaaaaacagatacaaagcgaactgtcattaaaacaatggaagaatataataatgacaacacagctcctgctgaagatgttattattatgatccaggttccccaatccaaatgggataaagatgactttgaatctgaagaagaagatgttagatccacctcacagcctatatcaagtgtaggaaaacctgccagtgttataaaaaatgttagcactaaaccaccaaatgcaatcaagtatactgaaaaagaaagtgaatcatcagagaaaattcagaaactcgccaaggaagtgagccatgaaactgcacagcatgaggtcaaaagttcaaaaaactctgcatctagtgaaaaagggaaaaccaaagatcgagatcactcagtattggaaaaggaaaacccagaaaagagaaagaacaacagcactcagccagagaaagatagtaatctggaccgtctgaatgagcaaggaaattttaaaagtctgtctcagtcttccaaagagactagaacttctgggaaagaagataagcatgattccgttcgagggtcctcaaataaagacttcactcccaacagagacaaaaaaacagattatgacaacagagagtattcaagttccaaacgtagagatgaaaggaatgaattaacaagaagaaaagactctccttctcggagtaaagactctgcatctggacaaaaaactaagccaagggaggagagagatttgcctaaaaaaggaacaggagattccaaaaaaagtaattctagtcccacgagagacaaaaaacctcatgatcataaagccacttatgatactaaacgcttaagtgaagagacaaaatctgtagataaaaatccctgtaaagatcgtgagaaacatatgttagaggcaaagaacagtaaagagtcaagtggcaataaatcacttagtatacttaacccacctgacccacagattgagaaagagccagttactgggcaaattgataagaaca

SEQ ID NO: 29848 - DNA, 886 bp, Bovine  19866880627305
ctttttgattacaataaaagttttcagtaaacttttcaaatgttgaatgattgccttatttgaaggaaagtgtgtcatgacttcacttccttcttccatttccctatttaaagtatcctttgagtctttagtataaactgaactgtatgtataaaatcctgaagtaaacatggaagatatacttcatttgttggctgataaaaggtggccagaaacaaggaatcgtggttaatttgatttctggttgaataagtcttaaagttctagatcgcacttaccatacgtggcctatccaatctgtgtccagcagcgagtagtaataggtccagaagcagtaggtagagactacaatggatctccttaatggctctggttcaggaagtttattgtgggcaataaaaagctattgaaaagatgttgggagctagggtaagattggtactttagaaatacggctgtgtaaatagagattaagaagacagtggctaaaaggaaaagagactagttctagtgtgaggtaatgatcctgaaatactttggtccagggcactggactggtagtgagagaacaggtttacattagcagcaactcagttcatttccttgatattatttccaaagtgtaccatatttacagtcttgtatgctgctgttggtactcggttttaggtggtatacaaacatacgtgaggatgttttctaatgcagcatttaatacgtaaggaaaaacattaagtgattgaaagcatgtaagggtaataacgaaaatgctgttcacatcaggaaagccattcaggactgagttaagcttggggagatgttgcctttaagtgaaaccaactgacttttaaagagctcttttgctgtattcttaagtcactctttt

SEQ ID NO: 29849 - DNA, 1520 bp, Bovine  19866880651160
aatccacttaagcatcttccaatgcaggagacgcaggtttaatccctggtccgggaagatttcacatgccacagagcaatatgtaccatgcctaagtaccgcagctactgagcctgcgtgcagttactgaagcctgccttagagccggtgctctgaaacaaaagaggctactgcagtcagaagcctgtgcacagcaacaaatacccaatgcagccaaaataataaataaataaaagacttcgctgagtttccctgtctctgaaatgctgataaagtcgcatacaactcaaaaggatgtctgataattataggactgccatccatgccagtttaccaagaacaacctcagtctctatctgttgttcttttactctcaagagagtctagttcggacaataaattacatggttcctctaattacagaggataatggtgttgaagtatagtgaaaagcacatggcagagtctcaacaaatgttgatttcctgtctcctttgagagaatttagatcaaattacataactattaagatcaatttcaaggctaaaagagtatctctccaaagtgattttcatataaatgaacctggaggaggtagtcaaagaatgatgttctgatgccaactgtgataaatccctcccttcttcttacattatagcttcctctccattccagttcagccacctggagtctcacctggaatgaatggttcttcctctgaactccccaataaccttttatctttttaatcctctgctccctttataccattttttttttaaatacatatcaaaccctttgatccctgaactctttcctttcttctgggccatcagtgagctgctgtgatgttacttttcttcctaaccctgccaatatggaaagctcctccaagcacttctggccatgggctttaatattgtgtcttttgaacaacatcctgtctgcatacctctgactgtcagtgatacacggcttcgagagagcaccagagaaaagaataatacatggagagcttgatgcatgacacacccatgacctccaacaaccgcctggccctccacaccacctgtcaccctactgggcatgcctagccaacccttccctttcccgacagaaacaatctcaggagttcatcattttaaggctcctgtctgattcctgttccatctggttcgcacaatgatcttctgtattatgtctgtggcatggatttctagttctatcacgttttcatcagaagatgtaggctgagccatttctggggcattttgtgaagaggtctgctttgcaagttaacatatcatcaattttgtgcatactagggaaaaggcgagtctcttaaggaagagttcaggcttcaagagagaagtatttggcacgagctttaagaatattatttaagtaatctatactcatatttttttacctgttttatctgtcaaagacggacacaatatgttttaaaaccatccctcaatggcatttctataaattcctcatttcatttctagcagttt

SEQ ID NO: 29850 - DNA, 1714 bp, Bovine  19866880676055
tgcttgaagttggccctggctgctgacaccagtgccccaacagtgcaaccttcaaagctctctccccaaaagctgccggggtacttaactagcatgtgctttgagtttgggcaagagagagaaaaatgcagagctccacccccagactctagtgtcttctcctggatcccaagtaaagcattgagttaccccaggaagaaattgcctgaagagatgaaaaggcagtttagtttctaccggtaacaaaggccttttctgaagtctcggagctcccgttgtgggagtctatcctaattttaatctcattagtggtatggattcacacgcacacatatacatccatacattagaagtggttatataatcctacagacaaaagctcttccctttacttcaacctgctctgctatcttcctgcaccatatggtgagtctttttatcatatggttcacagagagctcaaagtctttgctacctgttcccttaatccttttccagagaaccttttgacatttgctgtctgatcttggattcctgccttctctttggttctatcccaattatggctccttcctcccagcccccagtctttcgtatgcaattcttattgctgagtatttttgccaactcatcttcccaagtcactttctgaattcgtccaggtctctcatcaatgaagtgacttgctgcttttccgtagccccgattttcaccccttgtgtgtggagctcagtcgctcagtcatgtccgactctgcgaccccatggactgtagcctgccaggctcctctttgaagggatttcccaggcaagaatattggagtgggttgccatttcctcctccagggaatcttcctgacccgggtattgaacccacatctcctgcatctcctgcattggcagacagattctttaccactgagccaccatgtaagccccagttcacccctcaggagatagtacattacagaacaagaaagtataagagtctattttcccaataaaatgaattatatcaaagaaagtgaaacatttggaatttcaagttttcttgtcaagccagagtgaggaaaggggggatttattgggcagacacagcctattttccccaacttccaaaggcaggaagtgcagctgggatgagaagcttccaggaatccagccattattgtcttcatcctggggaacccccgtctgtcaccccagcttcttgctgatgtctcttgttctgactgtgcctcagcaacacctccctcagccttccagcacttctccattctcaatcgaatccccaaatctagaacagcctagaatttaaagccctaggaaaaagactgatgggccaatatggctcagggatcatgagatccagttagctttggccgggaggacaggtcacttttccaaccatctgtcaggaaggacaacaggaatggactgtctgaaaagcagctgtggtctgggaagctcctcaaagagaaggaagaaaatgctgggctgcatggcacatgggcctgtgttcccttccgatctgtagattcttcaaaacattgcctggctctttggggaaaataataaaaagttaaatctagttctcttacgaagggtcagatagagcctattaacatgggatctctgtttcaggcgataattcatggcctctggtccaattaatgtgctggcatagttcaccctctgcgcatccatctcaaccg

SEQ ID NO: 29851 - DNA, 1199 bp, Bovine  19866880712698
ctgggcttgtttcctccacagacgaagtagcttgtgcagacccagaaatctgccggaaggtctgtagcaaccccgccggctgctctgacatcgcgtatcccaaacttgtgctggaactcctgcctacaggtaatgatccatcacccttcagctgagtccccccgagaaaggaggaccctggctgggctcccatccaaggtgggggacaagatgagagggcccccagctgaagttcaggccctggctacgcagggggctgtaccctacccacctctgggtccctcctctcagctcccagccctgagttctgccttgtcagcattgaacctctcaggactggttggccgcagacctgggcaatggggtcaacagtgaaggcagaaaaaagcccaaggcccatagagctcccttctgcccccagggctccgtgggctcatgatggctgtgatggtggcggcgctcacgtcttccctcacctccatctttaacagtgccagcaccatcttcaccatggacctctggaaccatctccggcctcgggcatctgagaaggagctcatgattgtgggcaggtatgattttactctggtggctcagtacggtaaagcgtctgcctgcaatgtgggagacctgggttcgattcctgggtcaggaagatcccctggagaaggcaatggcaacacactccagttactcttgcctagaagatcccatggatggaggagcctggtaggctacagtccatggggtcgcaaagagttggacacgactgagcaacttcactttctttcacttttcacagtcttattgggtggggccgggcaagagtctgaaaagtcaggataacccagggaggaaaaagctgagccattcaaagggaaagtccgaacagtgacttctcctggttggctcagccccactctgatggccaagctgaaggacaccaggaccctgtggatgagtaaggcattcattcattcaagagcacttcctatctgccaggtgctgggcacataacagtgaaaagaaaagactcattttgctttcttggagctagaataagaaaagcataagtaaacaggtggttttaaccgcattgagtattatgacagatgagccagaactagggcttcagaggaaagtctctaacttgggttgggatttgaggggtcaataggagatagccaggtaaaagcaag

SEQ ID NO: 29852 - DNA, 1930 bp, Bovine  19866880752448
ttcttgactcttggggttgtctgaggattaaatgagatccataaggggaagcatgtcacagggctgaaatgctcatgaactcccatttaggatttgtgtgagtattatttccaaggtctacaagtccttatccaaaattatgaaatccaaaaagctctgaaaaaaaaaaaaaaaaagaaagttccttgctgtgtatttggtaacaaaactgtgaggtcatgacatggactcagttgctgataaaacctgacctaacaatctaacttgagaaagtaactgtcatctttacagatttcacttgttggaactattttgaagttttgctacagagtaactaatgcatctgatggcagggtgctgctgctgctgctaagtcgcatcagtcgtgtccgactctgttcgaccccatagacagcaacccaccaggctcccccgtccctgggattctccaggcaagaacactggagtgggttgccatttccttctccaatgcataaaagtgaaaagtgaaagtgaagtcgctcagttgtgtccaacccttagcatggactgcagcctaccaggctcctccgtccatgggattttccaggcaagagtactggagtggggtgccattgccttctccgctacccagggtcataaagccatctatggtaaatgtaccctcgtctctctaaaattctaaacactctgatgcatgaaatgtactcgggttagcaaactacgtgttccccagcctttatggccgtctccatatatttacaccaccttttagtatttgtctgatacgtctctttaaatcaacttactttttttaaaacccaattttatttaaaaggaggctttataacctgactgtaaatggagaactagtattgctggccataaatagaaggccacctcgaaaataaacacaatgaaaacaaaatgatgttattaaattccagctagacactgtgaattgaaaagcaaatagctttctcgccatgtggtaagatgctatttaatgccatgtccagattccaggcatcagccatggtaggtaccctctgaggcatgggagcctctgtgggtgggctatcaggtaacccccaggtagaagggagggctaggtaacctcatttcatttaggctgggtggcactgattttcaatgcctcaaggaacagccttaataagcgcccttaatgtgatttgctgttgttgcttagttgctaagttgtgtccaactcttttgtgaccttatggactgtagcccgccaggttcctctgtccatggcatttcccaggctagaatactggagtgggttgctgtttccttctccaggggatcttcccagcccagggattgaacccatgtctcttgcttggcaggcagatgttttaccgtctgagccaaaattttccctaagccaccctaaccatcctgtaacaggccatttccgcctaatatacaaggcccctcgggcctgtgttgctgagacttcgtgttgaaagggctatcatataataaccagatggtagccagcctatgagctgatgccaggcaggaagctggtgtttgttcattcactcatccataaaaatgtctacggagggcctactgggtgctaagcataacacctggctccaggaaatgaacaaaatctctgcccttgtggatgtgggggagaaagagagagaaagaacaagcctttcttgttcaaacaacatagcatgagggggaccatgctatgaaggaaatcaacaaagtgtaacatagccagtcacagcgggaggagaaggaagcttctggaaggggcatctgagctgaggttggatgcagaacatgagccagccatgccaagagcaagaaggagagcatcctagctgggtgaccaacaagtgcaaaggcccagaggctggaacccttgagagcagcgcttcccaaa

SEQ ID NO: 29853 - DNA, 1714 bp, Bovine  19866880781293
aaacacctgggatttctatactgataaagcaggaggtgactggaagagatggacaagtggcatgctacttactcttctcatttattttttattcgacttcatttatcaaagtatacctgctcaagattttctgaaaatcaaatagggccaaaggggctgtcaggaaaagcagctcctggccccattcctgctcctctcccccaaagttaccatggttagctggtaacttttctgtcttgagcgaacaaatgaaaggcattcagtcatgtctgactctttgtgatcccacggacttagcccaccaggctcctctgtccatagaactctccaggcaagaacactggagtggattgccattcccttctccagggcattgtcctaacccagagattgaacctgagtctcttgcattgacaggcagattctttaccatctgcatcaccctagtttaacttgaaagtcgctcggtcatgtccgactctttttctagtccatagattctccagtgggtagccattctcttctccagcggatcttcccaacccagggatcgaacccaggtcccccacattgcaggtggattctttaccagctgagccacaaggaaagcccactccaaatacagttgttgaatttttatggttcctatattgattcccttataactttcaatggcatactccaacctctagagcttccatcagctatcgacagcataccttggctgttctctgtgtaatacctggatgttgcagccccaccattccttccctcctccaaccatccagctccaatcataggtgcagataggagggacctaattttcaagtatttgagtgcaaaagaataggggattttggttactgaaagaaggtcagtaaggctaaagtttaaataacatgaggatgtgttttataaccatatttcattttccacaccttgaatctagaagtgacaaacccataactgaactatgtgagaatataaaggggagttatgggatggcagatagggcgccctcagtccacatctgcttagttttcaccatttccttaactgacattcatgtgggtgactttaccacagacgagtttttctctttcagcttatgtttcttggaagaagggcatagacaaaggtgaagctggggggtacactcagcccagttgtacatctggcagaggctccaataccttcagagccttacaccctaacatgttgccttctcactcgtgatcatgttttactgctgaacccctgggcatcatcagagtggccccagaagagaatcaacatggatttttcacagcagtcttttgagaggtctcaaaagttcctcctactctgagaattgtcctctctccctcagctcacaggagctggtcccagtagctgtgtccataccaccaccaccccgtctcaatgaccacagcaggtcgggctggaaagtggcatgagacacaatcagtttatctcccctgaaagtttttaattgagactaaaactgcccttttgagtctgggtggatctcttggatagaggagacataaaacctcaaaatctagcttccatctggaggatcaacaaatagagatggcaaaataatctttttccaactaaaaatatggaaagaggcagagatgaaaaatagagtgactttcaagccttttgatggcttttattccctggttttatctccttgctgaggcctgat

SEQ ID NO: 29854 - DNA, 1534 bp, Bovine  19866880790793
acagtacttctggctaggtaggaaaattatgtgagatgattgacatttgcaaaatattaagcatgaggctaacatgcaataaatactcaacaaatgtcacacattatggattgcattatgtcccctcaaaacttctatgttgaagccataagcctgtgcctcaaaatgtgactgtatttggagaaagggtctctgatgaaagaccatgtgagtacacagagatgttagatgggcagtggtctacacgtcaaggagagaggcctcaggacaaaccaaacctgctgacaccttgatcttagaccatccacttccggaactgtgagaaataaagtttttattgtttacaccacccagcctgtggtattttgttatggcagcctgagcagactaacatatcccctattgttattattttgaaatcccgatgcaaagttgagaagcaaggtgcccttggttttcactactgataaaggctcccaggccaattatgcagaggaaggcagaatccacattccttccagccctgtcacgtgggctgactggctgcagagaccaccactgtatgactcaggccatctctggtttccttgcagggtgcagatctctagagaccagctgacaactgctatgagtcaggggactcaggggagtccctgagattccaagacatgctccattacccagcccccggttccttgacagatgctgagaatgtgtcacccccaaatagtgaggttctcccttggtttctcagtcatctcgattgccctcccatcaccttctagaaggtcagaaagtcagattccaccaaaggctgccacagatgtggttttaaaatagtcccttcagaagcccacaattaaagcctaattacacatctttgccaattagtgaaggagttgccgtatccgatgatagcagaatcccccaaaatccacaattgctcttgcctgctcccccaacaaaccactgtagcctttatttgtaatcctggaaaagtaaccaaacctctgatcttgatgaattatctacaacattgtgctaacaacacctctcgttagaagggtgctaagaagtcattaattttttaaaaagtcattaatgcaattgatattttctgactgacctactgtacattcattctttcattcagcaaatatttactgaatatctgccacatgtcaattgaataatatctagaaagttgcagtttaccttctcaaagagagatcaggaacaagtagacaaaatgacttcagacagtgatacactatacaggaaacaaatgcagtaatgagatggaaattaaacaagaggtaggttagagatgggatgacacagaaggcttctaagaggtctggttgataagttggccatgagagggcctagagaaagaatatgctcccagaacaatgcaaaggaaaccacaggtgaagcagctctgaaaagagagaagcattttatgaacagaaaaacagacagaagagcagtaggaggagggagagaatgtccaggagagagggacaggggccag

SEQ ID NO: 29855 - DNA, 1951 bp, Bovine  19866880861092
attgtaatctattttctaatctaattttttgtaatctaattttcacaaagattgaaaatgacttcaagagaccactgtacacccactagtatggctataattgaacagcagatagggaggcagagaagttggaattcttgtgaattgcaggtgttaatatataatggttcaactgttcaaaacagtttggcattttcttaaaaagttaaatataaacttaccatatgacctagcaactgcattcgtagaaataaaaccatacgtctgcacaaagacatgtatacaagtgttcatagcagcagtttttacaagagccagaaagtagaagcaatctaaatgtccacttataggtgaaggataaataatgttacacaatggcgtatccactcaacggaatgttttcaacaataaaaaggaatgaaatactgatacatgatatctgatgaacttcaaaacatgcgaaatgaaagaagccagctgcaaaagaccatgcattgtatatattgtgtgccatttatgtgacgtgtccagaaaagcaaacctatagacacagaagcccctagggggcttccctggtgactcgtggaaaagaatctgcctgcagtgcaggacacctgggtttgattcctgggtcaggaagatcccctgaaggagggcatggcaacccatttcagcattcttgcctgggaaatcccagggacagaggagcctggtgggtatagtccataggatcacagtcagacatgactgaggaactaacaattccattttctttcacagagatagaagtgcttctttaggttgaaacaagaatagactgtaaatgggcatgaggggatgtttttggagtgatgtatattcaaaaacttgatttgtgatgttggttacatgactataaatttaccaaaattacttgattacatactcataatgggtgaatcttatggtatataaattctacctccagaaagctaaaaagagaagtatccagggaggacaaaactaatgtggggggtgtgggtctctcatccaaccagggtgtttgtgttgcttctggtgttggtctccatcctctggatccctgtggtccaggccagccagggcggccagctcttcatctacatccagtccatcagctcctacctacagccacctgtggctgtggtcttcatcatgggatgtttctggaagcgggccaatgaaaaggtagctctggatcagcccttcagtccattggatgggagaggagggacttggagaggggacacgcggatgtcaggtgtcattgtgtgtgtgggaggggcgggtaatgagatctggggagaaagatccagggaggatgtgacctggctttttaaaaacaagcaatgaagcttctactttgattcattttgtctttcaaaagggaagctgaattaacagggaattacatgtagtggatcaattgtatgtaaaagataagtagataagtagctcccaccctttttgaatcaccgacccatgcagtgactgtcattataaagaccagctctggaaagggcttgctgagctttccggaggcacgtgtctaagatagctttgctttgctctgctttgcagggtgccttcttcggtctcgtcttaggcctcctcctaggcttggttaggctgatcctggacttcatttacgtgcagcctcgctgtgaccagctggatgagcgcccagccgtggtaaaggatgtccactacctctacttctctatgatcctgtcctcggtcaccctgatcactgtgtgtgccgtgagctggttcacagagccgccctccaaggaaatggtactttggggtttgacctatagcctatgacctatagccattgagacccttcactgctagcaacagaaaaccaggactgattttcaaaaagctgaaaagtccaggggttcggtctttggaggaacttgatttcaga

SEQ ID NO: 29856 - DNA, 1196 bp, Bovine  19866880868740
cctgatgcttaggcagcaggtttaggagatattttcgttccagaaattctccttgagaaatagtgagccaagtcctcagctttctccttgttgggtgtgaaaaccgggtgtttggatgtgggcaggaaggagtctcaggtaccccctgcctcttccaactggatggtgctggcgtggtacccactgtgggggtcatgatccaatgcctggggtctctgtgcttgtggctgaaggcatgggtgtgaaattctcccagccatgcagatgggtgccatgacaattttgtggtattgcatcacagacctggcctcatcactgctcagaaatcccattacacgcctattgccattgatttcaaaccccattactcacttggagccctctgtactctatcccatgcccaattctcccctcctctccagaaggatgaatttttaaaataacagctctattgagatataattcatatactataaaattcacccctttaaagtatacaattcaatgactttttaaaaatatttacttattttttatttgcctgcactggatcttagttgtagcatgtgggatctagttctctgaccagcggtccaaccctggccccctgcattgggagtgtgtagtctcagccattggaccatcagggaagttcccaatgatttttcatgtattcacaaagttgcataatcatcaccactatctaattttggaatgtttttataactccaaaaagaagtcccagggacttccctggtggtccagtggctaagacttcatgcttctaatgtaggagtcccaggttcgatccctggtcctggaattagatgtcacatgctacagttaaagatcccatgtgccacaactgagacccagcacagccaaataaagttcagtgcagttcagttcaatcactcagtcatgtacaactctttgcgaccccatggactgcagcaccccaggcttccctgtctatcaccaactcctagagattactcaaactcatgtccatcgagtcagtgatgccatccaaccatctcatcttctgtaattccccttttcctctcaacttcaatctttcccagcatcagggtcttttctagcgagtcagttcttcacatcaggtagccaaagtattggagtttcagcttcagcatcagtccttccaggaatattcaggaatatttcctttagga

SEQ ID NO: 29857 - DNA, 665 bp, Bovine  19866880871824
tgtgaaggcttgcaaaacactaacctggaaaatgagcgcctacgctccttttgaatctttttgtattccatcaattccttagcaaaatcatttgtaaactcatctagcttggactttttcttttccctagtaaaataaagttaaagagtgaaagttaacaaaaaccatttaagaaaactaacaagacaaatgtaattagattatgaatgaaatgaatgaaattgccattagttttccactttaaaactataaataactaggaatccctgaggaagttgcttgtatgacttggtttaagttttaggtgatttttcttacactaactggaaacactggaaaatgcttccaaagatacctgtttaatgttacatcagaaaatgaacgtgtagagtaatttcaaattagaacacttactcttcttttagtcgtcgttgctctctatagaattcttccctggacaaaggtggtgcttgtgttgttgggatggtattagaatgagcagtctgtactccagatgacacccaaggtgcagataaattggttggagctggaggaaaccctggagggggaacactatacccagcaggtggtggctggccaggaggaaactgaggagagaactgtggtggaggaacacctgggagaggaagtgtgtggggaggagg

SEQ ID NO: 29858 - DNA, 2126 bp, Bovine  19866880935231
tattgatcagtaaaatttatctgtagtctgctttttgtgtgctatctgtgtttagatatcaaagttgtgatagcttgataaaatgatttgctatgctctgaaatagattcaataacatggagattttcatgtaaaaccctctgggcctggggcctttttgaaagtagttctttgacaaaatctttcatgtgttacttgcttgtatcaggcctttttttggagtcatttctgtttcctagaaaatcattcacttcatagaaacatgcaaatgttttggtatagagttgaacactgtaattgcttaaagcttgtgtttttccaagtctatcttttctcctctctagtttatcattttgtctccaactgcgcgtacagttggttctgttttttccaacactgtgccattgagttgtctttcagccttcaatttttcagctttgaggtttcatctctttctgggtttttatgtattttttaagaagctgggaaaaactgtttgaaggcagctagccaaatgcattttgagcaacatgttttttctcttgggactttttaacccagatttaaagtttcatcttgttcaggttggcaggttttaatgggaagaagtccttttggggatcccaactcatccagcaaaggcactagagttcccagctaagtgtcatctgccaatgtgatttactagcttgccactctgattctcacagagtcattgataaaaccactgaaaagggaaagttcaagaatgtagctcagtggtaaagaattagttaagcataatcattatcagaagattcatctgaatataaactcacttcaagttcagtgagttcactgaaaagccagagcccctaacgctggctgagttaagtgttattcacttatattatacactcattgagtatttcctctgggtaagaaaggcaccttgctggtcttagacacacaaagctgaaaagatgcagcccctttcttcggacacttaggttgtgaagaaaatcctttcttaaattatgtgatcacacaagcttgcctcacaagcaagcttttcttatgtaggcaaacgttaagtttcttttttttcttatgtaggcaaacattaagtttccccttcaaaaactacagaagtatcatatttcctgtaatcagtgaaactatgaaaacatagaaaaggtagtaataatataccctgctcaattccaactctatttccacattaccctactccaaagcaatccatgttaacagctagatatgtttcctcaacatcttcttcaccctcaaaacacacacatacatgcacaagtggggtggggggggatttttttttatttttaaaattgaatgagatattagctgctacttgcttttctccttgaatacatcatgggtttctttccagggcaatagacacatatctaactcaatccttttaatagctatatcatattccatagaatggaatcacttcagtgtattcaaccatttccccatgggtgagcattcaccttgcttccagtttcgtcttgtttctagtcattcttacaaatatgtcactacatactcgtgcttttatttttataggctagattaccaaaagtgagattgccagatacaggcatgggtttatcatcctaaaaggtattgacagacttgaaaatcttgaaagattttagcaagtaggggatggttaccaggcaaatactataattattaaactaaaatgctgcctgcccacacaaattcaagacatttgtttgaaaggaagctttctagaatgggtctgttggatgcacaaaatccagggggcactgctctgagaacagtaattgtttgtttgttgttagtcactcagtcgtgtccagctctttgtggccccatggactgtagcctgccaggctcctctgtccatgggattctccaggcaagaatactggagtgagttgccaattccttctccaggggatcttcctgacccaggggtcgaaccatggtctcctgcattgcagacaggttctttaccatctgagccaccaggaaagtcattgagaacagtaaaaacaacagcaaagccatttactgagcccttcccatgtaatcagccagcacctttaagtgtgcat

SEQ ID NO: 29859 - DNA, 1007 bp, Bovine  19866880942313
aattacatagacagaagatcctggtgggctaaagtccatgaagtcacagagtcagccatgactgagtgactaacacacacacatacaaatctatcagtagaaagaatacaggatttgaagacagatctgggtttgaatcccagctcctgcatttactagctgtatgacagtgagtgtgtgattgtacttctcagcctccattgcctcatctgtaggattggaatggtgctacttacctcacatgtcagacacctccacatagttcccagcagataaaaggactcttttccttttctgtaacagttaagttcaaggcttccctggtggctcattggtgaagaacccacctgccaacgcagggttctgatgccacgtccggggacatcccacatgcctaggaccaaccaagcccatacaccacagctgttgagcctgtgttctctagagcccaggaactgcaactgctgagcccagggttcgtaactgctgaagtacatgcgccctagagtccatgctgtgcaacaggagaagccaccccagtgagaagcctgcacactgccacaaagaccagcccctgctccccacaagcagagaagagcccgagcagcaatccagcacagccaataaataaatacttaactttttttaagtacatgggatctttaaaaaaaaaaaaaacacacagttcaaagtaacgttataaaatgctaattaaaatgtactacatgaagtttatattgaggcttcattgtttataatgttaatcagaaaaaatattcaggtacatataatgcttgctcatatctctctatctggaacgagcaagaatcagggagtaaggaaaagtttctggaatagttaaaaaataggtgtcttaaagtctatgcaccaaaagatcatgtattatactcaagcctattttatctttccacacagttccaacaaacttggatacttggtttctccaccacagcaaattagaagaggagagagaagctgctacaggt

SEQ ID NO: 29860 - DNA, 1083 bp, Bovine  19866880955570
gcttatggttggagcataggtttgggagccccctgttcagggttaagatctgcttctgctacttactggctgtgtgacctggaccaagttacctaacccctctgggtctcagttttctcatttcttaaacaaaaggggacagatgataacagcttcaacctcatatgactgtgataggattaagcaatccgaaagatgccgttgaacaaggggcacagtagggtcaggctaagtgttagctgttcttatcacggagagtacagaaggtgagaacccgaagacgctatggtggtggcggaaagggttaaaggggttgtacttcgtcaagggaggcagactggaactccagggtgagccgtggggagggagacttgggtaaatgaggggtgctcactgatgaggtaaggacctgggggcgacagacgagcccggctcccgggcacaggtggagcggataatcggggcgcggaggtggaaagcattcaggctgagcaaggtggcagctaagtttagcgctggaagggagggatttgaatatgcgtgaactgccctcccgcggtgccaaacggctgaggttttcaatcgctcctcacagggagtcatgcatgaatggggaaacagagtcagcaggaatgcccgtctagggggctgtgtgcccatttctcccgggttcgggccactggcttcccaccccgcgtcggggaccagagagggggctccttgcttttgtccaatgaaactaggcgtttggggcagtggatctccagggagtggattcctttttgacatcaaggaggcctggtttggggtggtagcttgtacacaatcagaagtgggaaagggtcctggctcacttcctggtacactccctgaaactcacatccccgggtcctggcctgcctccccttccctccgctgcccaaccctccccagcctctctcctctccccttcctctctacccctcttcccctgttccctctatctctctcccacaaatctatattcagtttctgtcttccaaaaagaaaaactgagtaggaggacaaattgtttaaaagcaatgcatctattttaacaaaacg

SEQ ID NO: 29861 - DNA, 2786 bp, Bovine  19866880970500
ccctgactggctagaatctaaggttctctaacccctcagccctgggcttcccaccatttttagccacaatcccacatctttttttgtggttgcattgtctctgctaataaataatagccagcattattaaatgtttcccacgtacttggtactgctctaatgcactttcaagacataactcacttagtgttatgtcatgagatagatattgttcccattttacagatgaggaaaccaaggcacagaagaatcaagtaacttgaataaggtcccagaatttgtaggtcatggaatcagtactgcaaacccaagtggtctgacttcacaacccgaatccttagccagatgctgtgctcccagccactctgagggcagtgggacagccttggtgggctgagtggacagagccccagaagatgaggtctgcaggaagctggaagggaggcaaggaaagggcccccctgagagtgggtggccaccccattgtgttgatggctcaggcccacaggcttcatcaaatccctctgagatgcaaggctcccactcttgtcaaattgaacgggctttgcagatttcagtttcaatcctgccaacttgaaagttttagcatttcagctgtttcagaattataaaagcctacaaatgctaaggtgctttttttagagttttaaaaaaatgtgtcttttccccaccatcacataacaatctgaaggtttttttttttttttcagattcttgccaaatgtgtatttttaaagattgcatttggccaaagaccagaagtggagactctgggaggaacgttgaggaagttctaagacacgttcagaggggaagctctttccttgcagcataacccaaggtctgctggggtgatgctgtttatttcagctttctcactcccttgagtgacagagtgcatccctgggacactgacacttcagtgagttgggtgacccagaggacatttggatagcaaccatggccagggaagaccaccattgctgtgtgaaaagcttccggttctgcaactgtcaccaggagccagatggccctcagtggacagttaccacgcccactggaccaggtgccagctcagtcttcactaattaagtgtcgtgtgcatgtatgtgtgtgtgtgtgtttatgtgtcaaagactctcccccggtgtgaatcagctcaatcatcgttttgcagtgtttcagcttcagattgcaaacatctaccaacaaataggagccttgctttctaacgagctggagatgtgtggaaaatagaatcactcatggtagtagggagccacagatgttccagggaggcagcaggctgtgccaagcacagacggtacgtgtgcccacgagacaggatgcagaatcttgccatgcaagtgatgcccacacacctcaaaagatgaagggatgaagatgggtgggatgcaatctggttccttcttccaaaggcctggccttctaaacagctgcatgacatgacatttagatatggtccaagaagctgaatgtttaaatttgaataactgccaccaaggtcttcactaccaaaggaagggcaaggtaagcttctaaggaatctgaaagacctcagttcaaatcccagctcctacacttactgagtgctcttgaaaagtcatttaacctttcagggcctcagttttctcatctgtaaaaggggttaataatagggttcatgtgttgggtttttgttaggactgaatgagagtgcaaacaaagttcttgatgtagtactgactcatagccaatgcttgataaacagtagttatcacaaccatcactatcatttctacttctgcagttctaggaagatgatcttgactctgctgagtgtcatttttctcctctgtatgatggaaataatgatgcctaggtcacagagctgagtcaatgtttattaagttccaagacagtactcaatacataggctctcaaagctggattcatttcccttctcccctgactagccttgagtcttactaaaaaacatcatcaaatctaattgctgagaatcaatattggcccagcatgatgcaggttccctcaggacctgtaaactgggaggcatgggcattgactggtccccaaggagatgatgctctaataggtaagacaagacactgagtgggatggttatgctgccagggagaccaggaggcttggagagtctcatgaaacttgctcaaggatggatagcaggttggtttccaacccaggtcattccgactccagagtctatacttttgaccatgattgtgtgttggctatcacgagagaatggagacaggtaaaaagttcccagtttctcttagttgcttcagttctctgttttgagaaagaaaaagaaagagagtagggagaggaaaagaggagagagggaagaggaggagaaagctggctttggagttgtgtgcagggcaaacaaacatgtccacctagcatcctgggagctcacttctcactcagctccccttgaatgaggaagtcctacgtggaggtcaatcaagctcgaggctgtgttcctccttcccagcaggaggcacagcttagcctgttcaaagtgaacatcaaaggtcacatcattttggggctcaagtaaaacagtgtcagcaaaggcatccttggaagaaatcccatatggtggttgagagcacaggtcctggagccacacagaattggagccagatctcagctacaccacctactagatgggtgaccttgagtaagtgacttcaacttgctaggcctgtgtctgt

SEQ ID NO: 29862 - DNA, 3250 bp, Bovine  19866880972249
tggtcccgcgattaagactccacgctcccaatgcagggggcctggtggggaaactagataccacatgccataactcacacccagggcagccaaataaaaaataaaatcatggttggactgcatgtgcagagttcaccaggggggtcatggaaagggcagggcatttaaagagataatcactgttcctctaagtcagctgaaagtgggatgtgacatgaggcccatgtaactgccaggaggacacctgacacttttcataaggtaccccggacagagaaagtcagcaacatgagcaactctaagcatgtaccctctctaaggcgagttgcagtaagtgttaatctatttaatgatctggagtgattttccaaagctggtcagtgaatcaatcttgcctgtaaactgttctcttactgtagagatccatctgtttctctcaagaagctgtgcagttaagggctctagctgtggcatgagcttgttttgagtgcaagtcctagagatcctgcttactctgacatcttacattagttacttaaacttcctctgcctccttgaagggacaggaacagcttctcctccaaacagtttgcaaagatgtaacagatgatgcacatggagtccatgcaaactggtggagcctcattcatatgagggtgtgacaccttatttcctctgtattctgtagcctaagaatcactatcataatcatgcaatctgatgctcctctaactgtattttcagctttctaagctttgcccttccacatagaaagcaaagttctcaagttcagttcagtcgctcagttgtgtccgactctttgtgaccccatggactggggctagggccatctctcttcttccttggaattctatggacctttgattactgaatgaatacacaaaggtcaccatcaagagggtagagaagcaggctgtgtccattcctacccaccccagctctgtatgcctgggttgtattcctggatcctttcctgcactcaagattcttagatggctttagctgcctaaggcccagacacctatctctccggtttcctctctttggagacactgaacaccctatttgtactgttagcagcaggctatgtcctgctccaacccaattgatctccttggcctcaagatgctgtctcccacctgacaagagcaccaactattccttccctgtagatacaactccttcttaaagtttcctactgaactagtagtcaattactaggtgattggactaggaataaagcaactgacctatgctgaaccaatcagattctctttcctgagtttgaattggaatgtgggaatttggcggataggcaaacaggggctatggaagccatgttaccatgatcagggaaaaacaaagaaagcgcggagaaagaaacagatttagtctagaaagccttgaagttctagatcttcatgaggctcaggttctgcctttcggtcgtttctttccaatattttcttttttaacagctaatttgaaagaagggtattctatttcctgcaactcaaccatagagactactgccaagagcttcctacggcaacacccttacatttaaccatatccttggataccggtgccaacccaaacttgaccccaaattacaaggaccccttagacactctccgtgctcaatggacatgtcaccgggggccagctctacaagcggaatcattctcatccccttccctgtccctttttgcattctgggttgacgtccctcccagcatgccttgcaactgagttcttgctgggccacgacagcaaatttggggaggaagtaacttctgtccttcaatgactcatgaaatctaattctatttaaaaaaaaaaaaaagaagtgcatatgttcaattgaaaagaaaacatttaaaatagatgttttgctaaggagactcaactgcctgtgcccactggcagttgggaaattgcatgaatgtgccgggctgacaactgtccctgggaaacactgcaaaaaggctggaggaaacgcaatccttttgtgcctaggcagccaggtgcccctacagcacagctcaaaggggtagcctcatttattatttgttctgcactttgtatatcatctcttttaatcttcacttcttatgtcactttaaagatgatgaaaccaatattcagatctgttaagtgaattcctgggaggtcacacagccaggaatctcagacctagatttatttgactgagaagctcctacttatccctttgtacttctagaaaaattggcctaaaccccattctcctaagaccagttcctctaatgagcaattcactgaaaattcaacccccttctgatggcttttgcatccgtgtattaatgctgaagctgaagctccaacactgtggccacctgatccaaagagccaactcactggaaaagaccctggtactgggaaagactgaaggcaggaggagaaggggaagacagaggatgagatggtgggatggcatcgctaactcaatggacaagagtttgagcaagctccagaagatggtgaaggatagggaagcctggcacgctatagtccatgggattgcaaagattcggacatgacttagcgagtgaacaacaatttcagtattaacttttgccaccttgtggtacattcaacacttttaaggtattttatcacagactctcctgaaataatataaattcaaaatgaagacaattacccacaggcacctccctaaatcaaataaatgttttgatttgtctatatctctgattcttttccatgtgcaaatccaattttaacacatttagaacaatctcttaaatagaatttgatatcttacatcttctgttaaattgagccatgcatatttttcaaggatttaaaaaatccagttgtctaagaatacttctgatgtaactttgcttttctaaacaagttttttgaaattaaatttgcatcattttaaggatgacaaaaactgtttcatacattggtggggagtctttttcccttttatctattctgaccagcatcaagattctttttcttttattaagaagcttttatcttccaaattctaagtctgtagcaagaaaaacatatcaagtctgcagcatgctatactagatctgtcattttttttttaaggtagctgattcataaaggaattctgggtcccaagatacaaaatgacactccattcaggctacacggccggtcgctgctcctcaaacacgccaag

SEQ ID NO: 29863 - DNA, 2692 bp, Bovine  19866881000622
ctttgtttgacctagcttttattatagattcaggcctagctatatagttaaatgtttacttgtagaaaacttgggaagatgaacatttatctttttattcagtggaggtacaaatagtttctgttcattagaggagataactccaaatgttgtggacaatttgcccattccctaggacattagtcagttttatatataacttaacaatattatttcagtttttttcatctaaaaaagaaaacataacatctttctttgagccagctttgtcattctgctggttcccttcactgatgaattaaataaaatttgacataagctcactgtgtattttagtagaattatgtttttaacaattgaacattctaccctaacatgtgaaagtattcccaataaaaccaatgtttctgagattgaaaagaagcctacaaaaactccaagattgatttttttccccctcattctatgaccctgccgagagcccatttttcaatatagaagcaaatgggcctttaataatttatggaagatcccaaagaatattaaataatagcaggggctttggggtcaggtagacctggtttcttacctgaatcctgccattttctggctatacgacttcggagattgccaaccctctgagcatgagtttctttacctgtacaacaaggaaacaaaagtagcaagtactttcacctgtttctttcttagttcttaatttatgtcttatggttccttcatgcctctaaataatatgttgactagtagtccttgattcatgcgttttagacaagatgcattttctaagacaaatgattttgctttcttaaactactacccttccttcaatacttttagtttcccaataagttacctgtggcttccaagaagaatcattcataaagcctgagggcagctggcatctcattcctggactggatactagctgaggcagcacgactgctcatctgctcatgtgcacattttagcaaggaagtcagaagacaagagcagggctgagagagagaatggcagtggggcggcctgttcggaagggagaggtcttatgagttgagtggatctatggtggatacctgagagcttatgccattttgttcacatcccacccaggagaatagccagttaggcaagtagaccctagacagggctacatgatattcaggaagattgccctgcagtctgttgccctgcacagggctgcctggccaaggggtcaagcagagattaagagtcagtccatgcgccattccccaaaccacacctgttgatccagaactgagtctatccaaagggaggcagacctttaaaagcataagggttctgtatggggcaactgcaggtccagcagcatagggctatgcattgccagtgatgggagccacggtgggatggcaaagactgaccagactcaggtatctcacatcagggaaggaagttgcagtggaaggtccacagggcctccagtaactaatgcacatgcttctaatgggaagtcaatgtgttgactcctgcatgcagagaatctgaccatcagtgttagatgcaggaacagtagcaatgaacagtaatgctttgcaaatccacccgctaaataaagtgacattttggccttttttccttcctgttcttggccacagcatactgaatttactcccaaatgaaagagggaagagtaaggaaatagcttgcaaccaggtatgcagttgcaagttttaacaaccaacagtggctggaaagttatgaaatctgcccaaaatatcactaagaaaatgagggattggacataacacagttgaaagccaaaataaaacagttgcctcattatatgccacttagttgagacttatcaataaataggaaatatgtcatcacgctttgtctctaaaattctaaaagttgaaaattcagtgatgtactatgtaggtactatgatacataattatatttcaggagttggcaaattacagccaatgggtcggatttggcccatggtttatttttgtgtaatccaaaagctaagactattttgtacattttcaaatggcagaaaaaattaaacaatatccccaaatatttcacaatacataaaaatgataagaaattcaaatttcagcattatataactcttagtgttgtatatttttaaattatggaaatttgttttctttcctgttatgttaatacctatatagtatcctcaattttgctgcttggcctgcagagcctaaaatatttactgtctggccccttaagcaaaagtagtttgccaatccctgctacacctcactgcagagatatgtaggaatctacaataacaatttatttcgagaagtaccctttgtattcccaagagtgttgaatttctttcttttttcctggtactacgttgcctttatcatagactgttcatctgatcaggtattcaggtattctgtcctctcttctttcctgaagaactctcatttagttctttgcccaggcagtccttgtcctctttctgagccatgaaaagtttgaaagaaagtcaacgagatcttcccctctctaatggtatctaaggaagacagcccctgccaaggtatgtaaggaaaaacatctgttggagccggcaagagaagaaaactttggtaacctgtgttctggtggctatgaagaaattaaaaaaaaaaat

SEQ ID NO: 29864 - DNA, 2293 bp, Bovine  19866881064430
gagatccaaccagtccatcctaaaggaaatcaatcctgaatattcattggaaggactgatgctgaagctgaagctccaatactttggctacctgatgcgaagaactgactcactggaaaagactctgatgctggaagggattgagggcaggaggagaaggggacaacagaggatgagatggttggatggcatcaccaactcaaaggacatgagtttgagcaagctccggaagttggtaatggacagggaggcctgatgtgctgcagtccatggggttgcaaagagttgcacacgactgagtgactgaactgattgactgtcttgaaccattgaggggggaaaaaagaaatgctcaaactgtttaccctggcccactcactctatattattgagccccagtccaactcgctgacctccttggctaggattttccttcttgttcatgagattcctgccactctgtccacctcaacaagtcatgtttattctcctttcagagcttctgcacttgatgatccttcttctgggaacaatttccttggttcttcttcaggctgactccttctccacctttgatttttttcagctcaagccacctcctcggaatgccctccttgattgtgttccttaaagacttccttctgccactgcccctactgtgtatcctatcgagttacccaattttcttttcttttcttcacagtacttatcactacttgcttcacggtatttatcactaaatttttgtttgtttgcttatgtgttcattggctgtctccctcacctagaatgcaagttccttgggggcagggaatccgtgttgctcaccactgcatcctcagtgcctacagaagacctggtctttgtagatgtttgttggatgatctcgcatggcaaaatggccctgcgtggtctggcatctacctaactgtagtgcacagtgaacatctcatttttatctccctttttctagtaacaacaccctcaaattcctcatagaatcagccccttacccagtctcagttcacacaaattgatttggtcttcctccctgtgtgtccagaggcagaatgatagcacagacctgaaaatcagtgaatctcatttcctggatactacaattgattcaggtagatctgaagcaaatgggtcaatgagaaactacccccaagacatttgttctaactgttgattgagacatatcctatttcttctagggttgctcagctggtagaaggcaagccaggagttccttgtacgtgagaagagagccaggctgaggatggagccggtggagagggagacagggctgagatgaaaaagcagactggatgccatttgtgtgaagtctgggattcagttgctcacgagcttatctacttttgtgcttttaagtcacaggcactgattgattgctcttgctttttgtacaccctttcagttggatttctgtcaactctaatcagaagctttgtggggggtgggggaggacaagattgggagtttgggattagcagatgcaaactagtatatataggatagataaacagcaaggttctattggacctatatgcaataccccatgattaaaccataatggaaaataatatgaaaaataatacatatatgaaaaataatatatatatatataactgaatcacctcactgtacattggaaattaacacaacattgtaaatcaactatacttcaataaaacattttaaaatagaaatttcatgactaataggctacctctctaattctacttctcttcatctgtataaattaggaattaccactgatccttgaacaacaggatttgaatgctctgttctacttgtatactattttcaatagtaaatatatactatactatatacagtttatatatatggtactatataaaccacagttgggtgaatctgtggatgcagaggaactgcatccatgtgtagcgggcagactataggttttttgtggatgttcagctgaacagagtgctggcaccctctaacccctcgattgttccagaatcaactgtatgctcatctgctaaaattgaaaaggggtgaaataagaagtctgtttttgtcatgtaataataactttggagatgatcgaagccaccttagatgatggctccataatgctataacagacccaagcttctccaattttattttattttcagacatcttaaacatgtacttgtcaccttccagtaacaagtcatctggtcaacctctgaaactgagttccagttctatgcaggaagaaatataaggtaaggac

SEQ ID NO: 29865 - DNA, 2217 bp, Bovine  19866881131407
tcaatgtgcaaagaaatgtggtagatccattcaatggaagatgatctggctataaaaaggaacgaattactgataccaccccatgacatgaacaagtcttgaacacattaccataattgaaagatgtcatatgagaaagactccatattattaatatatgattccatttataggaaatgtccagaataggcaaatccatagagtcacaaagtagattagcagttgctaagggttgggatgcagaaagttggtgaactgggggatgatggatattggggtttcttcgtggggtagtgaaaatgttctaaaattgattatggtaatggttgactgaactgaactgaagggttgcataagtctgtgaatatactaaaaactattgtattgtatacattgaatgtatgaattgtagggtatgtgaattatatcacaagaaagctcttaccagaaacatgtcatttcatatggttcaacccaatattgtccaatgtcttttttacaaagtttctttaaaaaatatttatttattcatctgcatcgggtcttagatgtggcacgtgggaccttccttgctgtgtgcaggttctttagttgtggcataagaactcttagttgcggcatgtgggatctagtgccctgaccaggcatcgaacccaggtcccctgcagtgggagcacagagtcttagccaccagaccaccagggatgtcccccaatatcttaaatagcatcagcttatatggtatggcttgaagaactgaatataggaagagaagagggagtataagattacctgcatgagaaggtagaaaaggagacaaccagtgggagcagcaggcggctggtttgctttttggggagaggacttagacttcctgcataggaagaggagaaagaagcagcggagtggaagatgttgaagaagcaggaacaaggttgacggatgacctccagagtcatggcggaagcaatcacctgggaaggagtccagcctctctcccgtaagacaggaaggaagagggagaggatgaattcagatactaattagttgatggtgcagggaattttattttcttcttactggcctcaattttttctggaaagaaggcaaaatcgtttgtaaaaataaaagaagagagagcaaggtcgtgggtttgaagagagggaaatgtcagggcttggtaaggggaatgaatgaggaaacacgggggcttgggagggcttgagggcttgaagatccggctgccagcagaggaatggactctgaagtgatgctgagacatgacccctgcagatccctggagtctcgttcgtttgggagccatcacctcctgagtcattcctgcttcaggccagacaaccccaattctttcaatattactcatacattttggctttgagcctcttactctctggacagcctcctctgaactggctgcctttggcaacctttctcccagaacagaatgttctttgttggtgagcactgatccaagtccacctccctgattctgagccctatgctttcattaattcaacctaagatgaccagattccacttggcagcctcatggcattgggtcagtgccaaataaatacaaggagcagacagaaagctacctgataatatatcagcctcccgccttattaggcaggggagaaagtggcgcgggtggagaccagcagtttgtcaaagaagttagaaagatgtttaacaaggtgagtggtgaacgtctaaaggtgtaggatcagggatcagggtgaaaacacatatgtgggccattcccccagggtgtgtaaggccagccagactggcacgtcacccgtcaccttgaacctagttactgaacacagcccgtcaagcacattaccctggagatccacagcccattggggttcaggagtgtcacaagataaaggggaaggtgcaaaggaaccctaggaaatatctttccacctcagctgctgcagttacacaggtgttactgctggtctaagtctctaagtaccagaaggcatacagtccctgattctagaaggggtaggataaacatggtagaaggaacactgcctttggtgtcagataagaccctgatgctgggaaagattgaagcaggaggagagggggacgacagaggataagacagttggatgacatcaccgactcaacggacatgagtttgagcaaactctgggagacagtgaaggacagggaggc

SEQ ID NO: 29866 - DNA, 922 bp, Bovine  19866881160092
tggtgatctcccgtatctagacattacattacacatttgtcttttgaatgccaggatactgacaaaaagtgacaactttaatggccgacagtaaattaagagagttgacctcatgtgggcaaccaaacttatccactgtgccaattttatttaactggctctggctacctggcactctgtcttcagggtttgcagcttagcagaggaaaaggagaatggcaataagacttccgtccttcattcagagactggaggagtttcccaacagggggtctacacagtgggaatttggagtcccagggtattacaaaagatatttaatgcttacagatttaatgttaaaaatccaaatgtttggttatattcaggaaacatgaagatctagaacagtgggggtgatttcacccgaggggacctctggtggtatcttaaggagttttttgactgtcacacctgagtgagtatttctggccaaggctgctacacatcccgtagtacacagggcagacttcaaaacaaatgatctggtcaaaatgtcaacagtgggtctactggttaagagtccgagcttccagtgcagggggcataggtctgatccctggtcaggggactaggatcccacgtgcctcgtggcacagccaaaaaagaggtcaacagtgcccaggatgagaaactcttatctaggagtgctgcctgtatatgtgggttctgcctctccaaagagactttcacgttttttggaagtgaagaaccatgcctcttgcaaggcaacacaatatagcccaaagcgtaacatctcctgcagtttaccagtggtgtggcctcctggaagttacttaacctctttgtgcatcaaagtcttcacctgtaaaacagagaccgagatcctgaaagcacctacctcagagagttccaggatcag

SEQ ID NO: 29867 - DNA, 1623 bp, Bovine  19866881170244
taatataaaggaagtacatacatgtttcaaaaaattacaggtgcatgaatagctaatagctgggaaacttggtcaaggctatactcaaccctgttatacagtctgaatcttgagctatgggagatggcgtcagcaccctggagagtggtacacaaatactgagtctccgggggccactgggttaacccccaacagctgcctcagtgacattcagacacttagtatcatcagcctcttggtcattactcgaggaaagtcaaacactagaagaagctgaatggttttgtctctcacctcttggctttttatttttgatcatcttcgatgcatttaaagcaaaagacttgaatggagctttttgaagagataaaagtaatacctgcttttccaaagactttccacttttccttttaatttcataagctgctgacttcttcctacttgatttattcctggcttatgctatgcttcaggaaaagcaggactcacacctggcatgttccatgatttgaacacaaggaaatgtcatcaagagaggcttaatggtttttgtttgtggggcatgaaaaatgaggagttctaaaggttaaagtcagaaggtctttcttgtcatcgagaaaaattccaaccagagctgaaaagtagggattatggctgaagccactatcctcccaccaaaactgctctcccagcatcccttgctctgaggcacgtgactgaattctctgcaacagcgtgtaggcagaagtgatgggtaccacatccacatcagggcttttaaaaaagcagcttgtgcctcctctgtactctttccccctctgctctctgagtacagacaaaaacaaggctgtagggactgatggagccatgtaggatggaaggaacctgggtcacttaatcaccagatggagagcgtgggcaaggccagaaacacccgtcttggactttgcatgaatgaacactgaacttctattgtgtctgaatcagtacagatttagggggtctgtttgctatgacaactgaatctaccctacctagcttatgtgtttggctgccacacagattaaccaggctgggcttgctgtggggtcaggaagaagagacttttttttttttttttcatttttggccatgccacatatgagatcttagttccccaaccagggattgaaaccacgggaccctgcattggaagtatggagtcttaaccactcaaccaccaggagagtcccagaagagacattctgagattttccatttactccctcccctcttggccacagttaacttagctcatcctttaggtaaaactcaagagcctctttctccaagaagcctttcctgactgcagccagagccaagcccactccctcaggttctcccagcatacagcaaacatcacagttgtactttacatctgtttagtgtgaagttttttgattaatgtttatattcccattaggtttttaagcatgcatttttcaaaattcacagaatgacatgctacttcatgcattttgttgtgtgcaaattttaccttaaaatgatcaaaaacaaatattaaattctggtgaaatgaggtgcgtgcgaagaattcagggtcaagtgtactgatgtctgcat

SEQ ID NO: 29868 - DNA, 3905 bp, Bovine  19866881181370
atgttttttttcttgtgcttgggcttattgagtttctgggatctgtgggtttttatagcatttgccaagtttgggaattgttggattgctatttcttcaggattttttctgttttttcctctcccctccttcatggattccaattacatctactgatatattggccttttgaagtagtctcccatcttactgaggattacttattttttttactctttctcagtgcttcgtttcatatagtttctattactataactttagttcattactcttttcttccacaatatctaatctgctatccatcttatccagtgtatgttgcacctcagacatggtagctccatctctagaagtttgatttggttattttttttttttttatctttgggtctccatataattttttgaacatatggaatacagttctaataactgttttcatgtccttgtcttttcattctaacacctatgtcatttctgggtcggtttcaattgcttgatttttctcctcattattttccctttcctttgcatgccaggtactctttgatcgaatgacagacgttgtgaatttttactttgttgagtgtgggttatttttctattcctttaatattcttaagctttgttatgggacagttaagctgcttggaaacactttgatcctttctggtcttgcttttaagaattttttttactgagaccagaactatgtttagtctagtgctaattattccccacaactgagcaagacttttttgtgagtacattgcctaataaattatgagctttttctagtctggcaaaactatacactattcttggccctgttggagctctgagtactgttccctataattcagtggtcctttagaggagcagtttgccccagggagacatttggtaatgtctgaggactttttttattgtcatagctagggttgctactggtatttagtggacagaggctaggaatgctgctaaacaacctaggatagcccccaacaaaaaagaatttttccatctaaaatgtcagtaatgccaaggttgagcaactctgctacagcccttccaaatcattccttccctggcctccagtggtcccctcacatgcgtgtgctggtcagtactctgctgaattctcaagaaggaccctctacagactttttttcccatgcaactccttttcttcaatactttgtcctgcaaattcttaccatctgttctaccaaatttcagctctcgctttctctctcactctctttttggccacaccttgctgcatatgggatctcagtttcccacctgggaatggaactgggcccctgcactggaagcacagagtcttaactgctgcaccactacagaagtgcctcagcactgtctctgtagcttaggaagtcagctaagctcttcctgggcacctccttcctgtgctacagcctataaactcttttaaggcagtgagcaagggtaatcaagggctcacctatttgtctccctttctcaaaattcaccatccttcacttcttcaggtccgtattttgaaagctttgtttcatgtattttgtctactttattgttgttgctattttatgtttaggccatgctattttatgttgtggcatgtaggatcttagttctcccatcaggggatgaacctaggccccttgctttgggagcatggagtcttaaccactagactgcaagagtagcccctgttgctgttttagacaggagggtaaatctagttctagttactccatgttggctggaagcagaagttgacttcttatttattatcactatcaaatattctctttctctcctgtcttgtgtcaagaaagcgacttttcttgtttctaatcttgtcaaccactaattatgcactatatttatttctgtatcttctcagtaagcaccacttttgttactcacgatacactctccattccctatatttttcagtttggtttctgttttaatttctgtctcaaacatgagattcacttgtgttcttctatttgaaactgtaagctcacattttagttgtacttgaatctagcattattttaaaaatcaccataacatgattttatttttgtacttaattattccaattctttgatttataaatttgtctcaggaagcaaagtttcctctgaattgaacaatatccattgatttcatcttgtgttcagtaacagtaatctagttattcagtaaaggaaacattttgaagttcttgtggtgtgcaaagttgtatttactgttggattaagataactggtaataaatcataaatactagcttattaggggaaatatgagtcatgaataataaaaggcaaaatcttcttggtattgtgtacaaataatttaatttgtatcattaacttcaaatgtgctggagtaaatgagcatttctctaaaatccgctcatccctttggggagcttctccaaacctattattaagtgaggaggcagtctatgcagaagatattcagggaaatattcaggaatttgtaatccttacagataataaataacaatgggagcaagagtgagtttgaccaaaaggttgcttaatcctttgggtttggacatttgtttctatttcagttgctgtatcaacatataagcttacagaattttagatgcacagatgattttgtcagcagcctgagagattctaatcattggcagcaagggtttcaaaaatataggaagtccagttacaatcagattacttcctaaagatacaattttacaatatttctttggagttaggaacacataatgatacaatgtgataatgtcctgagttctgtggccaagtttcaaataatgttgaaataatgtatctaaaatggaagatttgatacctagagtccctaaatcaggactacctgcccattgaatgaatctttcaaatactttgcaagatactgaggaaaaacaaatagccaagtaatgatatttgcttaaggccagctgtgtttttcagagcagtgctatgcgtagtaactgagtggtttttcaaggcactcatgaaaattaaccagatcagtttgatattgtcatatacttgccagtatatagccagttcaaccaaaaaattttggtcccctttctctctaatagttttcctaccttttcaaagctcccacccactgatgaagcaaaggtcctgttcattaacctctttatgctgactatgcgcacagcgaccctcttccttgggtaggactgtgcaattgccatcaaagtgctttaacaatttagcgccacttaagcagcggcatttttttaaccttctcatcttcagctttgagtgctggagataatgcagaaaactgccttttgaagttatattgaactcactgacttccatcagaagcgtatcagtagttgcaaacgttacagtgtaaattaaatccttgaagagtctgagccatttgcaacactggaaagcgagatgctaaggattttttattgcttggaatccctaagctcaaaatgtctttgtctttggtgtgtatttgaatactctatcttgattttccatggcactctaaaattgcttcgcaaatagagaaaagtcagatatttaatgctagggatattctatagaactcaagaatacctaaaattatctagtactaatttattaatgtttaattagaattgatttataacacgggtagcatcgctacaaggatgcatctttgccactgttgataaatgttcaaattactactttgaagaacttaccaatttttgatttatctgatttgggagactgaaaaaaaaattgtatcatgaactatatagtaaagaaaatacttttacattcaaagatccaaagggacaaagaaaaagatagaaggaaacatgtaggtcta

SEQ ID NO: 29869 - DNA, 669 bp, Bovine  19866881184357
tgaaaaaatgttagttgctcagtctgtccgattctctgtaccccatggactgtgtagcccactaggttcctctgtccatggagttcttcaggcaagatactgatgtggatagccatttccgtctccaggagatcttcccgagtcagggatctaacccaggtctcctacattgcaggtagattctttatcgtttgagccaccagggaagcccctatcacacagtagtagttaagcaggggtaatgatttgatacctttacttaagagggagggagggagggagagaggagacggcaggagaggttatggggggatctgtaggcctcgaaacatccaccaggatgaacactcgtcctcaacaaacgcagcctccctttgcatagaatggctgaggagtgtcttcagagataacagcagtatcaccacagccccctgagcttctcttctgcagctcttatctcaaaagtaattgattaattttttgtgcacagctgggtgtctggtgaggaagcagtttaattttgttttctgcaagagaaactgtagttccggaagagctgcacgttcagaggacaaattcacagaaggagaccaagacgtgaagttgtggaaagctgtttagtgcaaactggcccagctgacatgcaggagggcaagcagactcctagat

SEQ ID NO: 29870 - DNA, 723 bp, Bovine  19866881185161
ctgagtcaaggcctgctgcacagcatcataattgctcttttctgctttttcactctgtgctgagtgatggcttagctctgagcagtggggaaatggcaggggttgggttctaagagataataaggtctgaaccaaggaaaattcattctgggccacccccaaagatgattttccagttggagtccctggggctgagcataggaaatggagagtcttagcccaagactgtggactttctccaatctctcttaaagcaggcagaagaatggggtgggggaggagtgtgaaattgtaaacagcatggtcaaggtcagcttccctgagaaggtgacatttagccccaaatttgaaagaggtaaggaaccaagtcaggtgggaagaacgttcctgccaggcagaaggaacagcaggtgcaaaggccctgagaggggagatgccttgggtgtttaaggagcaaggaagtcagtgtgactggacaggatgagtgaggaggaagagagaacaggtgagagagatggaggtcggaaggaagtagtaagaacttggactttgagtgaactggaagcctttggaagagtttttaattaatttacttctttggctgtgtggggtcttagttgtggcacacaggatcttcggttacagcacatggattctctggctgtggtgcttaggctcagtagttacagtaggcaggcttagttgcttcgagacatgtggaat

SEQ ID NO: 29871 - DNA, 1312 bp, Bovine  19866881214891
actttaaaagggtgaactttatgctatgtcaaagtgttagaaaaaaatttttttgagggagaaattgaagaagacattcagagaaggaggaactgaggacagagcaagaggtagaagggataaagctaaacagataagcttagcacagactatgagtttgggcttcaattccagagtcattacagaagcggtggaagtttctaagtgacaggctgagaattgcagcttgagcatgattaacttgcagcaatgtagagaaggcacattttacattcccttctagcttttcacagtgagattctcacttatgtgcctcacatcatctagggactcacaagtagaatattaagtgaaacatatttctctgacatccttgcacggtcaattaacagcaacaaacagagatttgctcagttgtgtctgactctttgtgaccccatagactgaggaccccaacaggctcctctgttcatgggattctccagccaagaatcctggagtgggttgccattctcttctccaggggatcttccccgacccatggatcaaacctgggtctcccgcactgcaggcatattctttactgtctgagccaccggggaagcccctgacacggtgaagtaatgcttaaaacacatttaaaatcagtgcatatttcacaccacacagcactatgttctactgttttatggggatactccaaaagagtaagagaaaagagagaccaaagtcaacaaagcacagatgtcaaaattgtaaaaaatattcagtatcactgcagcaagccgttcaatcaatgctggctgactcaaaattactagtaagaacagcaaaacaaatgacttggtttcatcgtgtttgtttttatacaaaatctaatcaattgatgtttgcagaaaatatcttgtaaggttcaaagtataaaattccttaaccaagtttcaatctgttttgaacattccatttgaaacgggaagtcagctgagtcatggtcacacaacacactaaaattcaaaatgccttttccctgttaaaagagtagaaacactaggatttctgcttcataaccatctcacacagagtatgcaattcaagaccaccttgataggacatttaaactatatagttgggctcccaaagcccaagttccaaattcagattcaattaaccaaggatcagaaaaaattccagaaagttctaaaaagcaaaacctgaatagctatacatgggcaaatgttcagatagcatttacactgtatttacaactatttacataatatttacattgaataaagtattataagtaatctaa

SEQ ID NO: 29872 - DNA, 713 bp, Bovine  19866881258879
agcctggtgagctcttcctgcgacgacgtgtcgccagcggcttggcatttcactccctggcacagcgaagtgtcaccgacgcatgtggctctctcaccactcactcctccggatcagtcaggcaaatgtcagcgaagacccagcccagcactgacaccctgctgttttcaattaattgattaactaactcatcacaacccaaccaagcctctggtggcaagcaaaagtggccagctgcggttaatgtaagcaacagagcgattttgtgtaaggcagaacttctcaaaggtggtgcaagcgacattggggtctggataactctgctctggggctgcgctgagtattgtaggatgtttagcggcagccctggcttccacccaccagatgccaggagcacaactgccctgccccacccccaacgttgtgacaaccaaaaatgtctccagacaatggcagaagtttttggtggggatgggggaattaaaagctgctcccaacagaaaggattaaggattaaacctaagaaaagacggcaatcttgaaacagagcaggaccctgtggggctcctgggcctggaagcatttctgtgtcccccattctttccttgtttatagggagtagactccagtctccatgatcttccttgagttccagagggcagattcaagttgttgctactcagggaatggaggggggctgcagagataaggaa

SEQ ID NO: 29873 - DNA, 1669 bp, Bovine  19866881469256
gggctccgtggtaaagaatttgccctcaagcaggagactcggtttcgattcctgggtcaggactatctcctggaaaaggaaacggcaacccactccagtattcttgcctgggaaaccccttggacagaggagcctggcaggctatagtccatggggtcgcaaaacagtcagacacaacttagcgactaaacaacaacatcaaaacaacaaggatctactgtacagcacagggaactatattcagcatcttgtattaataataacctctaatggaaaaagaatctaaaaaaggaatataggtaatataaactgaatcactctgctgtacacctgaaattaacacaaccttgtaaattaactatccttcaatttttcaaaagaaaaaatttaaaaatagaagacagtttcaagagtgatgagcatgtattaagatatccctctgggacacatatcaatgtccagtcaaacataaaccccatgagggcaagtatctttgcctgttttgtttgttggtgtacccccgcaagcctggaatagtgtgcctggcacacagcagatgttcaagaagtatttgttgaaggaaggaatgattgaattcctgataaaactgaattgggggcaatggttctcttgttctttcagttatttaatatttactaagagcctgctaagcatggagaaacaccattagatgagcaggcacgtttcctgatgctgcattccaggggaggaaggaggactttggacattaattacagggatgattaatgtaatattttaacatcccctcctgtgtcctggggcttccttctacacagccgtggtcacaatcagagcatgttaatcagcgtggctcgtgacacatcattattttcactggttgtgactgtgccagagggaagagtgacccgcaggtaccgttctcaagaagcctcttagaagcatggggcaggaccatgttgttcaagacctaacctggtctgggggcttctgagaaggcttcctggacgaagaggcaatcagatccaagtaagtacacactgcacacactgggtcagatattttgcaggcaataatatcaatcgtcacattattttgagtaccatgtgccagacaatgagtggttctcatttattatttctcattcactttgcctaagactctgggaagtcagtaccattaagaactgcatttcatagggaagaggcaacatagggctggccgattaagaggcacagactattaggtataaaataagctacaagggtatatgacacaacacaggaaatactgccaatattttatagtaaccataaatgaagtttaacctttaaaacttgagaatcactacaatgtatgcctgcaacttatacaatattgaatatcaactatgcttcaataataaacaaatataagttttaaattaatgaattgaaaagagctctatctcataggtggcccatggcaggtaagtgacctgtgacaccaaaaattcagttagggacagagccaggatttgaacccagtctatctgaactagaagaaatgggagtagccatcatggtcaacaaaagagtcctaaatgcagtacttagatgcaatctcaaaaatgacagaatgatctctgttcatttccaaggcaagccattcaatatcacagtatccaagt

SEQ ID NO: 29874 - DNA, 1024 bp, Bovine  19866881579842
taataaaaggttttcttactgtatttgacaaactacaagaaataaatgtgatggtatattttgctcacacttcccttccattttctcttttttaggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccaggtaaatgctggcatcttcttttgtgagagtttgtttccattaagatttcagtacctctggacatacaaatgatttggccccagttctatttgattggactgacttgcacagagggtgggggagagcacagaaatggcgaatgagaagttgagcgtcgggtttgggctgctgagtgacctggcctgttaccggtgcttgtatgctgtgaaggtggggttgattagtccgacacaaagcatgatagaaacctgtgttcattgttcttctccaaatgtctggggactgacatgacagcatttccatctattgaggaatcaccagaaatgcacttacagcctgctttgtccaatccaagttgctgtagctttgtgattgtaataaagcacttcaaaatacacttttaaaaatatataaacccagagaaattacttcaggcaaaaatttgcaagttactcattaataacagcttatattagttgtgatattaaatcaggctgttagggtgttggaaaataatttgagaatattgggaaatatttgagaattgcataaacttcaggaataaaactttgggatagttaatagtggatttttagatgattaagcctgaactaatttgaagtttttatttccagaatttcgccctggtgaaccatggaaaggttatccaaacattgaccctgaaactgacccttacgtcactcctggcagtgtcataaacaatctttcaattaatactgtgcgggaagtgaccacctcagggacaggaa

SEQ ID NO: 29875 - DNA, 1237 bp, Bovine  19866880555509
aataatggagtgggttgccatttccttctccagtgaaggaaagtgaaaagtgaaagtgaagtcgctcagtcatgtctgactcttagcgaccccatcgactgtagcctaccaggctcctccacccatgagattttccaggcaagagtactggagtgggttgccattgccttctctgatatacagtatgtataatggagtgtgaattcatttttattcactaaaatggtatcatgatgtgctaagtttcaattcctgtatctcataactacattataattcatatagtaatttaataaagtaatattgacaatgtaataattggtaaagcttataataataaaattataaaagaatgttaccaaacctgcctcatgcagaagagatcatgaacttgggaagcattaacatctaatgtacattagtcgaatgcttttatttttcaatctgttttctaatgtatccatagttctctattcagaaaggtgaattccattctatgcaatttcatatctctgtgtctttcatatttctaaatattgtaataaacacaatattttttatgattcagaaaataaagacattcaagtttttatttacatacactgggattagaacattaggcatttatttttaactctttaaaggttttgacattcatgttcaataggatggtaaaaaaagttttttaattttttgaaaaaacttcactgtctgattttctgtatttccagatgtgaacctggagccctacatgatgtatgagtataggatttctgcatggaatcgctatgggcgaggattcagcaaggcagttagagccagaacaaaagaagatgtgcctgaaggagtgagtccccccaggtggacaaaaatggatcatcttgatgatgtaatagtcttaagctggaagaaacctatacaatcaaatggtattaaactatttttaaaattaaaataacataatcccattaaatccataagggaactgaaattagtgagatgcatttaattggcacacatctaaccactaaaaagggaacttcagttttgtggggaaacagtggaaacagtgtcagactttatattttggggctccaaaatcacggtagatggtgattgcagccatgaaattaaaagatgcttactccttggaaggaaagttatgaccaacctagacagcatattaaaaagcagagatattactttcccaacaaaggtccatctagtcaaggctatg

SEQ ID NO: 29876 - DNA, 3267 bp, Bovine  19866880627615
tctacctagagaattcccagtgcattaattatagagtcaggacagtccactctgtcagtgagacgcatgaacctaaatatatatgaaatttgggtttaaaaactgtcatttttcacaatgcctcctaaagaatggaggtcttatcagtttagcctcttcacagcctagtcacagaattaaatgcttgtaagttttatttggtcatgaacaacatgcacactctttaaaggagaggatatgagccttgaatgaagaacataatgaagcttcccaccaaagtttctcattgatttgctagcttctaacatatgtgggcttcatcacttacctttgtagtacttaaataagtttctctgctacagagacaaggaaatccatagcataggattcaataacccatgagagatgaggtctaaagaattaaatgtggttttgctttttgtagctacagctccaatagatgaggggcagaagagtgagcagaaaccagaggtgttcaggactttatgtaggatagattaaaataaggagtctctgaaggaaatcttgatcagaatcggaaggattgatcaatcggttcctttgggaaggtgccaggtggtgctgaatttggcaagcgagactgagaatttcaagtttagagcatcccaattaaattgatgtttttgtccttatagcttaacgtctattattgtatgatcaattcctaaattcctatctctgactttatatttatcctgcattgtggatttgtattttgaacactctacttcacagagacctcaatctcaaggtctaaaaaagaattacactattttccactcccaaatgcgttcttcttcctggggttttctctcccccatttccctataccagaagccttagagtaagactcttaaaagtagaccctgcttcctccactctcaaattcaagtgagccactctattttatcttttatttcttccagaagttttggttttatatgcaatcagcaacacaagactctgcaggtgtcaccatgatctaacttacattggaggaagatagcactgctggcaagtcaatgatggatagaaaacacgtggaccaggaggaagagctatcaatttgaaagttatggcacagttgtagaaacaacacaaacaaaaacagcatctcactgcattcctgtcttatgtcaggcatcatatattatcttctttaatatcactggaatgtcaacttcatacaattggggactatgttctcctcttcaaggtagttccaatgcttagatttgagtacagatcggtagctcaaatgctgattgaatgaatgaatgaaaccagaagacaatattgtaagataaatattactaccatttttttaaaataagaaaactcgggctcataggagaaacttgttacagatatcacatagattaatagaggcagcaaaacttgaactcaggcccatttgagaccaaagcttctctctctatattcatgctgtctcttgataaaagacttgaataaggacaatcagaggaaaaagtgaaaggataattttgagagaacacgtagacaggcagaacaagtcttggagacagatgagatacaggggcaaacgtgaaggaggagtcagaactaccactgatggaacaaaattataggtgaagatgaaaagttctgaagagcagatttcccaaactgggatacatatatcctggacatttgtggacttttgtcaaagtatttttggagacaaggacaaacatgtccctctttccccaactagttttgacttgtagaatttgtgaaacacataactcccctctcccataacactagggaaaaccagcagaagcccactatttctgttcacaaacatgagtatggatatttctccctaaaatgcacaaaattagaaaattgtatgtgcaagtgagtgatgagaactttactaaattgttttgaatatatagtcacttcagagtgaactaattgtataccagcagaaaaagtttatgtgggcaaaaccagtgtgttgaacatgtataaatactatttgtggtgcaaacatcatttaatttttgtcacttactattgctttaaaatgattcatcatgtgtaatcttccccagacacgggatgaaaaacagactggaaccatgatgcctctgctcagtctcaagtaacacaaaattctacattattttttttttccagatatcacagcaaagattaatacctagaaaatttaagtaaattcattttctctttaatggaattgtgagtacatgtaatgagctcatttagaagatattcttcaaggcctcattcttaactgcaagacaaaattgggaatgcttttccttctcccagtaagactgctataattaaaacaaagttagagagttggatgaagtgagttgattacagggagcattggaggctctaagttcactaacagatgagaaaaacttaagaactatattagaggtaaaataaaagagcaatctaatcagggttttctttttctctactaaagacgatctttggggattactgctccaagtagtaaaagagattgacgagcgagtcagggaccgtctcagtttgcaatttgaccttcagcagaagagtatggttatggaaatatccctccagaaggtcttgggaggtcacagcatcctgcctcagatttggggatttctccctgttgttgccctaacgtagtttgtaaggcagtgggggaaaaggttgctgtttgtgcacacatatttatgacaaaatgaagagaggaagaactgcctggacattgagctgttattggggtcggctctcttcagattgacttaacatccagaaatataatagcatattatgatttagctaaagagattatcaatagaagaaaagggtagaaaatgtacccctgaatgataaattccacaatacattgttttttggatgtagacaaacacattggaattcaacatcaaatttgcatgaaattttaagataaaaagcaagaccttaaaataatttacaaggttatggtgactgcttcaggtttttttaaacctcctcagattacatgtttattctgtcttctcttatcctaggatggatcttgtggaaaagtctgacaaacacattttggaaaatatactataattcttgatgaactagataaactacaggatggagtcagatcaaatccctcttctactttgcttattccctggtaaattctccatcctctgcagataccagtctcttcat

SEQ ID NO: 29877 - DNA, 864 bp, Bovine  19866880629822
acaaaataagtgaggccaaaccagcttgtcaactactaggttgattgtaggaaaaataaagaaatttaaatctgtggccaaaagaaaaaaatttaaaagaaaacaaatcattttctaatgctatggaagtttaaagatgacaaacaggttaccttggtcagcatagaaagtgccagtaaaaaggactgagtacatcaagcgtccattagggtgaaaaggcggttcccacctcacgtgggcttttcgggatccttctgttttgacaaacacatttactgttccttcaggaggagcttccagagttcgattttccacctgtgagtataaaaagatttatttttgtttgcaaataaaataagtacatgcttcactttgagcatatttcttcaaagaatctcttttggctgtgaagtaaactattttgacagtcgcatcttgtatgaatacctcattttgtcagcaggatcaaagcatacctcatgttttcttcctcctgctgttaaagcttagaatttgaggtcctgaccaaggcagtttgtgatttccagaatatgtggatcagctcacactgtgatcatgcctatagctgtgcatatccacagactatttctagggtggcttaaaaacaatttttttgtgattgcaaaagggaagaaatgcataaggtctattttcataagctcctgactggagtaatagactgctgggcattgtcaaaggccacatcaagcatcttcacagacacacacacatactcacttctctgagctgtgttactaccaggtatgtgcaaatggcaccatgccagacatcaggagataaatgtacctgagtgaatctatccctaaagtataatcacaaaag

SEQ ID NO: 29878 - DNA, 2086 bp, Bovine  19866880629850
cgctacagtccatgaggtcacaaagccgtggacacaactgcgcaacgaaatattcatgcaccacatttcaagaaccctgtctcaatcagttaacaggaagttaaccaagaaagcattaaaactttaattccacaaaacaagactgaagttggaaaaattaataacagactagtacacttggaccacacaggaagacagatgttgaaacaaggaaggctttcagatgctatgcctctttgcagtgaaactacacaatccccaaacacctgggtaaatccttttgtgagatcccttaggattcaaagaggaatctggcttctctcagtcaagggcttacacttggaatgtagaccttctttcagccacaaaatgtgcaaaggcgttcttgataattttcagtcatgttgccagaccagaaaactcttctgggaaaaatgtattcccaggagcaaaataatcccttcattaggcagctgtgggaattcgctgcactttaggatctcatcaaggtggaaatttggaggagcaagcagagttttgtgaaaggagatgcttttcctgaaaaagggaaaggagagcatcggccaagcccatgttatatatcctgttcatttactttacctcgtaatctattatgtttttacattgctgaacagggctcacctgatgctccaggttccttcctggaaatttgtaccaagggtcttctattgtcatccttgtggctcccagcatgggtgcagtgtcactattaacaggcatttcattccattctaaagacttaccttaaatgttacttctggaatttgctgctgaattaacgtgtttcttcggtttagaaagcacaacctatttgaatacatacaattttggatctctaatttcaggtcctgaagacgattttactaagtcaagataataaatattttccaaaattttattttagcctcacacccatgacttgataactccttctcacttatagtcacgcaatattgtggttacatcttcaaaggaatcaggatagttctaaaaaggataataagctaatgcagcagtggagatattgaaggtctggtgtgcatgtgtgctcagtcattaattgtgtccaactctttttttatgactgcatagattgcagcccatcagggtcttctgtccatggaatttttcagccaagaatattggagtggattgccattttcttctccaggggatctttccgacccagggatcaaactcaggtcttccacattgcaggcagactctttacccactgagccagaagggaatcccagcatcagggtctttaccaatgattggttcttcatatcaggtggccaaagtattgtagcttcagcttcagcaccagtccttccaatgaatattcagggttaatttcctttaggattgactggtttgatctcctctcagtccaagggactcttcaaggattcttggaagactagcacatgtttatggacaaatatttctatgggttctgtcctgtaggccctaagaagtctgacagctttacttaattttgtctgatctacatctctttcagtttaaactgatagggtttctgctggagtggatgattaggcctatgattctcacccagactaatcactttatcgaatggttgcttgtacacacacttaaaattctcttcagaaaaatgctttctcagttttgcaatatggataggctgagaatttttcagatctttaagttaagctttactttggttaacaattttgtcttcaagtctttttttctctcttctgaagttttctataagcaatcaagggaaaacaagctacttattcaacatttttcttaaaagtctcctctgctgcttcttctgctgctaagtcacttcagtcgtgtctgactctgtgtgaccccatagatggcagcccaccaggctccccagtcacttggattctccaagcaagaacactggagtaggttgcaatttccttctccaatgcatgaaagtaaaaagtgaaagtggagtcgctcagtcgtgtcagactcttagcgactctgtggactgcagcctaccaggctcctctgtcca

SEQ ID NO: 29879 - DNA, 2475 bp, Bovine  19866880664030
acctgtaaaagagagtttaataaagctctactttagaattatgctatagatccaaaacttttaaataaaataaaatattagcacattgaacaaggatacttattcttagcccagtctcagcccgttatatcgatcttcataaaaactcttattcataaagttctttttttctttgtttttatttgaaggataattgcaatagtgttggtttctgccatagattgccatggatgagctgtaggtatacatgtgtttccttcctcttgagcttccctcccacctcccatcccagcccacctctctaggttgtcacagagccctgacttgagctccctgagacttatagcaaattcatataatagcatatatcgattttatatatgttagctttatgtagttttaaaatgtgattagatgaagttaaagaaattagaagtaaattacaatgtttgtgtgttacttttttcaagtctgaagccaatcaactaaaccaccttcataaatttttgtttatgaccaggatcatgcaggtgccttaattgtttagggccacacttcagagatctgagtgagtaggtgaaagtcaatagttctttaaacacctacccacctgtcctatcttattcaaatatatagtaaataaacagagaaatggaaatccaagcaattaagaaccacacaaacgaaagaaacttttgtggtcaacaaagcatctctgaaataaacattttattctaagccataaatgaaactttattttaaaaatttcagtgtaagtcttgttttagagaacatcttttgcttattaagtcaggaacatggtccttagtctgacttttttgggctgcaagaatattttataatccttcatatgagcaatagataaataaaaagccatgggaaattaaactgaaagttttaatctcacatatttggccatactgtaataaatgtagtcttaagcattggaaagaatagaatccaatatttcactaactggctccttaaaaagcttggtcacatttatttttagtaatagctccaggatgttttctagaggatgatcaaattagataccatttctgttagcctactcactataatgacaatggccttctccaccttgctctaaattccttctaaaaattttctgtgaaagtagactcatgtcttccaactcagtactgtcaaaaagatatatattcctaagcctttaactttttaagtgagaaaaatagcaaatttttggatgcaaacatttatagtagagaacacagactgtcttcagagtcattacatcacatctcttaatctctgcaggttgatatcttattcagatttttattttttgaatgttttcttagcctcaataaccaagttccaaatcaattcactctcagctcaactgcgaacacagactaatccgaagtttgaattctttcaaggactgccaagccttgacctgaactctcagaatattctagttccagaggcaagtggcattccacatgtgagtcaggtagaactgagctgtgataacccttccattttttatttgcaagtaccaggaagccctgtaagtttgaccttgactcacttctcaagcccacaaagaacactgtaccaccaaaataaatagaaccctatgtctgctttataaactttgcttaatttaggcctctttgatctcgcctccatccaggcaaattctctatgctcataaggaacacatctaacacttgtcttcaccagcacattttggaactcttttctcctagaagtttttaaaatcagcaatgacttcaagccatgtagtaaaatttcagtagatgtcaagtccttgttaattataaattaggactgtaatcatcaagcagctgcccaaatgacatgttgtttagtcactcagtcatgtccaactgttggtgacccgtggactgtagcccaccaggcttccctgtctttcagtacctcccagagcttactcaagactcaatcatgcccactgatatggtgattccatccaaccatctcattctctgttgcccccttcttctcctgctctcaatctattttgtctccaacaattagtaagagaaccctacgaaaatctcaggttagattgctcctggaggaaacttttttcctttaagacagaaaattttagttcatccttctctgttctaatttctctattctacacattttagactttgaatttgtatagaactataagtgcaggtatcaatatatcactttgtggaaaacttgtttaaattatcaaaatagctgtatgctaaggaaaatataatgccatcagccatgactggaattacttgttaaactccatctctgagtatttggcattaaataactgtacaatttaggctctgttctcatgacgcttacagcctatttgggagatgaaatatacactctaaaatttaaagaacactgcaaggcaagaaaaaaaga

SEQ ID NO: 29880 - DNA, 895 bp, Bovine  19866880722058
cagcattttgctttcttacaatgatttattcagtttctttatcttacttctaactcctttgtttagagtcagaagaaaaaaaagagacatatgttgtacacatgtgatgtatatcttataaatatttgtggtctctatagcactgaggatgagatggttagatagcatcactgactcaatggcttaaatttgagcaaactctgggagacagtggaggacagaggagcttgacatctatagtcaaagggttcgcagagagtctgacacaacttggcaactgaacaacctgaaatagcactgagcatttgacagcttctccagagttttatgtgcggttgggttgctttgggagatgaggctcatgaactgctgcagagccagattgaaacaaaccatcatggatgcaccattcatgtcaagccctactttttatggcctctaccattttacttctctcagtccctaccttgggtttgcaaggtaatcagattcattgtaataccagagataaaaggttgatgatacagactacacagtcaatgtcttctgttctcactgaaggaactgaagtaaacataatttccaacatcattaatgtcagtggccttactacatccctaaagtgtgtgatgtcctctgctaggaacattcatgatgggactccacttggaaaccccctagggatgtttagcacttcagagcatcttttgctctcctcttaatgaaagtctattgtcaactacttataatccaggaagataaaaatgtctaatccagttaaaaatgttacagacttattttaaaaacttagtgtattttctctcccagtgggccaagaattcagttttcatgtgagaaacatatcttcatcctcaaattcccaaaatacgtctat

SEQ ID NO: 29881 - DNA, 1376 bp, Bovine  19866880980892
attcagagagaaatgtccagagtttggtttgaacatgttaagtgttaggtacctatgagccatccaagtggaaatatcatgccgagtcctggatcccagtacatttagagaggatttcaggattagagataaaaaaggggagttaccagttcaggatgtatttaaagccacagtcccagatataagtagggataattagagtggtttgggctctggggaaaaaaaaatgccattctcacaaagaatgatggagttagttaggaatttctaacttttctaaatttctaacatttctctctgaatctgcttctccaactagcttgcccaccctagttatgccagttacattcttccagttgctcaagtcccatatcttgcagtcgtgctctacattagggcttagcaaaactcttctggaaagagccaggtagcatgtattttaaccggagatttgcatttgtatgcagcacacggagggacccaggccctttcagagttctcacagttctccctcttcatccttttagaggacttatggtgtttatgtgggtggtaaggagatcttggaacagaggaggtctgggttattctaacatcaagatgttgggatgataattaagaaccagtgaataaaagtagccaatagcagagaaccaagagggaagtgcatcccgaagcacaaggaagggtttaatcatttggtaaatttgtagaatagattgtcctgctgaagttctcatctgcttttccatccacaggctcttcagccaccacgaatggtggtactgttattggagagaacacaggagtgtttgtgggtgggctgccacagggttacaccattctcagaaaggattctggtgagtttggggaaagtatagaatttatatgttgtctccataattggggctcccctggtggctcagcggtaaagaatcctcctgcaatttaggagatgtgggttccatctgtgggtcaggaagatcctctagggaaggaaatggcaacctgttcagtagtcttgcctgagaaatcccatggacagaggagcctggcaggctacagtctatagggttgtaaaaagtcagacatgacttagtgaatgaacaccaccacaatttagtgtagaatcaaactatatcatgttaaagtatggataattatattattttctacctcatgctgtatttcctacatcactatgtcaaaaatttcctttagatctcttattttctagaggaaccatgtattacttatatttaaattcttagaaaccagttcttgatatatcaaagaaggtaattaaacttttgctgaaataaattatactaatttaagtcaaagttttataatttgggggtcaaaggtatgaaaaa

SEQ ID NO: 29882 - DNA, 659 bp, Bovine  19866881171178
taaatgagttggatagaaaatgaaaagtctataagaaaggttgcttagctataagaattacttaatgatgagatttgcagtacattagaacacatcacataatgttaagagctacctttttggaagtactgacagcttaaagtgataactcaatttgtctagtctctattggcccaagatgtttaagaaaatattttttaaactatatagtagtagaggaaaaaagagattcttattaatgatccttaattgctggtgatgttacttctctgttattacagctagagtcattttctcacccactgtatctgtcacatgatatcattagaaatgggatgttacatatgtcttagacacaggatctccttaggtttattaaattttgaggttaatgaatattttgacacttttacctatacatatcattagggcttattgtgatagggttaggatggcaatcataataaacatatatagtacaataaaaagcacttttaatctttggaagtgccttataaacaacagtgatccatgctatggatggattaacagcatcaaattgattgaattctatttcaagggcagtggtggtattaacattgacattcttgttccgaaggaatgcagcaggggcagggctagagtgcaggttctggagt

SEQ ID NO: 29883 - DNA, 1585 bp, Bovine  19866881327050
atcttccaaaataacttgtgtttatcacattgtttaatcttacttttattttctgtggtcaaattaagtttttttttttaaataagactaattttattaaacagcacaattaatgaaacaaggaagatctgataggactaacaagggctcgaagttagattctgctggacattttcccccagacctgttgaggtataatcggcagacataaaactgcacgttaatcatatttctcatcagacagaatagaaagatgtttcctaaccaatgcctaagagatgatgtaccagggtaaattctttatgctatggccccttacctctcccaaattcctatgtaaaccagtgtctgttactctctgtttacctaagtaaacaatagggaaggaaccagagtcatgagttagtacactttgagactatttcttacttctaatactcctgctctccttacagtttggatccccacctgcatctgcatggccacagcatctctgcactggacaagcatacccagaggaggtcaccttttccacagctggctacaataaaggattgtgcaggtagaagaggaggtctgagcgggcctgagcaatgataagcttacaacttaaaactggtaattaagctatcttgactaacttatttatttattcattcacccactgattattcattatgcacctaccatgtgtcaggtgtggtctaggcattaaagataaaaatgtgagtaagaaacagtccctgctgtgtaggctcttatcaccagcgattgtgacagatgagacaaacaatttcagcattatgcgattgaactcgaggatacagaagggccctatctcagccttgcttggtaaaagatgacttcttgatggactgacttccaggttgaaaccctaaaaatgagtaggactcagtcagatcaaggaggtaaaggaggttttctgagccacatttgataaagaaaaaaaaattagcatttctgctttgcccaaactttctcttcttgtttttcaactacactaggaagaaaacagctaaggatgctatggccacagatcttgcataattcagcattgaaagatagtagggattcaacatcaccataaaagacattaatgttaaaatcaagggaatggcaataatgaaaataatccaaatataatggaaaagtaaatagcatatagaatcttctctgcctataagttggttcgtttcgatatatcggttcatttattattcatttcggtatgaaacacagttcactggacaaaggcatggaagatttctttaataactctcagtactaatttaattctacttaaacacacatattctagtgaatgccacatgcttttcagcatgatttttatgtgtaaatcaggataatatgttttcagatcattaagtaaaaggaagcatgaactaaaacctatttaatcaatgaggtatcacctttaaactgccacaaggtcataaaaaagcataatttcaaagctataagtttcctaattgtaatcaacaacaatctaatgataaagagaagtatgtgctaatggctgtaataaacttgaggaaatcactgt

SEQ ID NO: 29884 - DNA, 1474 bp, Bovine  19866881329337
tttgcttttttgcatttcttttcatggggatggtcttgatccctgtctcctgtacaatgtcacgaacctcattccatagttcatcaggcactctatctatcagatctaggcccttaaatctatttctcacttccactctataatcataagtgatttgatttaggtcatacctgaatggtctagtggttttccctactttcttcagtttcagtctgaatttggcaataaggagttcatgatctgagccacagtcagctcctggtcttgtttttgctgactgtatagagcttctccatctttggctgcttaggaaatgctaataaagatgaaaaatctgctctcaactttttaacaactaaaaataattccataatacatatcttcctgagcttatgatggggttatgacttacaatactgaaaataccattaagtcaaacctgcatttagtactaaacatcacaacttaccctagcctagagtaaatgtgctcagaacacttacattagccttcaggtgggcaaagccatctaacacaaaacctattttatgatgaagtgttgaacacctcatgtaacttactgaatactgaaagtgagaaagagaatggctgtgtgcatacagactgattccaagcatatcacttgtttacccttgtggtcatggggctgactgggaacttaccaggcctgctgctgctgcccagcatcacggaggaatatggtaccacacatccctagcccgggaaaagatcaaacttcaaagtactggttctactgaatgactgtcacacttttgtaccatcataaagtcaaaaaatatcatctgtataattttttgactttagagaacttaatcagaaaaacacactaagcttctgttttaaataagtttaaaagtgaaaatgaagaatttatatttacaactctttttttaggttcctactaccaataatacacttcttcagcactgccttcatagtacttgagaatgaccacctatgtcgttcccagaggagtagcttccgtggctttctgtctcctccagagacaggatcttgaacgatgctaaaggagtggaacccggctgagtagagatcattcctctgaatcgtgttactgtccatgtccggacatgattattatctgcacaaactaggagagaaagagaacacacaagagtttttaaatacagattgtaagagcaccaccaacatcacttttataaattcattttaacttttttcactatgatctacaataagtagatcacagcacattttgagtgacaaaacaacttatcttaaaatcatacttaaatttgtacctagccaacaaaaatgagataacagaatatggtttaccttgctgcaaatataaggtatataagttaatctacggatccttataaaagtagcctatagggtatagatttagaaaaggttaaaaaaaaagtgtatgtaaaaaaaatgttga

SEQ ID NO: 29885 - DNA, 1785 bp, Bovine  19866881449440
cccctgtacccccagccaactgagaccagtacagggggccagggcagagagccagcctcgagggtctccagccctacaccacctacaagctgagggtggtggcccacaacgaggtgggcagcacagtcactgaatggatcagcttcgtcacccaaaaagaatgtgagtagaagtggctgccaccatgtgcccgagaggcggcagggcagccagaggggaggcttgtcctgaagggaggggaacagttcactaaagggattgagtgttcaattccagtgaacggtactgagacatccatgaagacaagtatcaggtgaaaatgcccattggattaaataacatggagatcaagagggaatttagggaggactttttagggaggaccaccatttaggtggtccaatggctaggactctgtgatcccaaagagggggcccaaatttgatccctgttcagggaactagatcccgcatgccataaccaaagatcctgagtgccacaactaagacccaatgcagccaaataattttaaaaaaagaatgaatttaggaagatttgtcatgtggcaatgggatgaaaaccaatttagagaaaattaatatatgggtaagatgaaaatagacagtgaagatgacttttttgtaattcttaaaacttttaatgaaccaatttggtaatttatttaattttgactgtaatgggcttcattgctgcgtgggcttttctctagtcgcagcgagcaggggtgctatgtggttgtggtgtgcaggctgctcactgcagtggtttctcccatttcagtgcacaggctctgggcatgcaggcatcagcagctgcagcatgagggctcagagcgcaggctcagtagctgtggtgcagggcttagttgctccacggcatgtgggatctccctggatcagaagtcaaacccgtgtctcctgccttggcaggtggattctttaccgcggagccacccgggaagccttatatatttactttgggataactttttggagaagtttgtcactcctctcccttacaaatgacgtaatcgctcacattgccagtaagcactgaaatctggcccttccaggaagaacacaagggctcctgagtgcagaaaagggcaattaactaattcattgtgtccttacatttctataaaataacaccttttctgagttgataaggtttatatgtctactttttaaaactggcaaatacaaaaagtatgaagaagtacttataatcagaaccagctatgtagtttgtggggtccactggaaaataaaaatacggggtcccttgttcagaaatcattaagaacttaaagacaatgacagcagagcatcagactaagtctataattctcctacatgagggaccctgggcagctacacaggttacacacccatgaagacagtcctgcttattatcccactccaccccgaggcaaccaccgttaatatgttggcataatttattcctttaatccctttttatgcagcttttattatgtggttgagatcatactctaatgaaaacttaatatctgatttttatacttgatattattttatttgcattttccatgacattaaaaactcttagccaccaaggttaatggctgtataatattccatcgtgtgaattagttgagccattccagttgtttctaatattttccttttataaatgtggtgagaaatgaacaaatctttgtgtgaatgtctgattatcttcttaaaggaatttatcttcagcaaatggaacttactacatcag

SEQ ID NO: 29886 - DNA, 736 bp, Bovine  19866881497747
aaactgatgctgtgagcagagtccctatggaataagaggaagggcctgtgtggtcacatcacattcgtgatggtacatggacatatcatagcatcacaaccatgccatgcttattggatgcttttatgccctggtcttccttaaacaatttttgaaacacattgaatacatggggagaaatgattttaaaaacattcaaagataccatccttactctcaaagggcttaccttctaagtgagaaggtaagatattcagatacaatggtgttacaagggtcaagaccccatttttcagtaatgggagtaaagaaggcaaccttgtcagactaaatcagtcaccgccatccctgaccttcattcttaaatgtttctcttgagctctatattttataatcttgagcattttcctataagcttttatcaaacccacaaggcttgaaaatggcctagatctttcatcatattcctcatctgtaaatcagataaatatcagaagtatgtaaatcctccatagcagccaagtagaagattataatcaaataagtatccacatcttatcattaaattgataaggaaacactaagtgttttgaagctgaatcccagagcagctcccgctacagaacattacggctttagcagagaagccagactactgctccaattctaagtgaactagttaattaattttttcccttcacttaacgagcacctacttcgtgcctgtcactattca

SEQ ID NO: 29887 - DNA, 1237 bp, Bovine  19866881675829
ccctcccttttggactcttccttcccttcggtcaccaaaaaaaacctacatttttgtaaaatctatttttagagtagtttaagattcacagcaaaattgagaagaaggtacagagatttctcatatactctctgtctccacaaaggcacagcctctctcgttatcaacatcccccaccacatactactgaacataacaaagaagaaacagactcacagatatagagaacagactagtgggttaccagtggggagggaagaggggggtgcaagattgggacaggagttaaaaggtacaaacgattatgtacaaaataaataagctacaaagctgtattgcacaatgcagggaatataggcagtatcttgtagtagctataggtggaatatagcatttaaaaattatgaatcactatgtcgtacacctgtaatttacataatattgtacatcaactgcacttcaattttaaaaaatgaaaaagacaatcccccatcagagtggtgcctttgttacagctgataaacctacacagacacatcattatttcccaaagtccacaggttacattggggttcactattggtggtttatatcctaagggttttgacagatggagaatgtcatatacccatcattatagtattttcactcctttaaaaatccaataggctctacttacttattcctccttccactcgagcccctggcaaccactgatctttttactgtctccatagttctgctgagtaaaagttttttaaaaaagactaacaaagagtatttttaaattcttgtttgattttcccttctgttaaaatcaaactgatcaaactcattcaccaattgcattttccactgacagcatttttccataaagttgtctccttatttatttttcagtgtcaaaaagcacttaaaatatcaatgaccctctccagaacaagttcatggatgaaagcccttgactggctactgatggatcaagtttatagtctacctcttaaaaaaaaaaaaaaattatctccaaatccaagaatttaaaaaagactactttttagagaatactttggaaagtctagagtgagagatgctattttggggagaggagtgggatgaggagaaaagaggtttaagataaactttcccattgatgggattagtctattatcttgaaattgaaacataagacaaattgccctcctttccacttctgctattaatgtcatcttttcaatga

SEQ ID NO: 29888 - DNA, 1343 bp, Bovine  19866881699193
ttccatgtctggttctaacttttccttcttgacctgcatacaggtttctcaggaggcaagtaaggtggtctgatattcccatctcttgaaaatttttccacagtttgctgtgatccaaacagtcaaaggctttagcgtagttaatgaagcggatgtttttctggaattttcttgctttttctatgatccaacagatgttggcaatttgatctctggttcctgtgccttttctaaatccaggttgtacatctggaagttcttggtcacatactgttgaagcaatataatttggtactttaagtgaaagtgtctatagtcagaagctggattaagaagtgactgaaatttgttggaaagatctatggaggaagttgaagcaatgagtttgaatgtggtcatttaagaatagacaaaggaacaaaaaccaaaaaccatagatgaccagccacgttgagggagctactaaatgaaaaaaggaaaaagcagtcaaacaatttgggagaaaaataaggaaagagccatttcactgatgccaaactagtcagaggaaacgcagttttcatatggtttacacttgagaagctcagcatctttgaacactgttgaaaaaccatccaaatacaacattcgttcagacccgtcagttgcacccgccatctagacagatggcagctgattggcccaataaaaaattatggtccaaagggtcctagaaccattctgaacatctccttcctaccagatgccaaaacaatccgtgaaaaagcgaaatcagacttaattctgtgaaaaaaacaaaggcagccattttttccacccaaatatattttgataatgttgagcaaatcactggttgatttatcctttttttcttctcacttggttctctttcagaacattggtgcagacactataaagtcatcctgggtatcatagaaggagtagcaaaaagactgcccatttacactgttcaaagtatattatatgcaagcaagttcagatgtgggttttgctccaaatttactggtgcttaaaatgtacaaaatcaggctgttaaaatgcaaagacaccgatgggccatatgttagagagttatcgagagttctctagtaagacagtctgccagccagattttacttgtttaaactgaggactgcactctgccatcaaaactgttgttgaaccgttgtgataaatggtagtcgaagacttacggaatacattcaaggtcagatttcattgtttgaataggatggtagagaaagaattttaaaaagagggactgcttctccaagcctagctaatgatatgccaagctaagacagcaacattttaaaacaaaa

SEQ ID NO: 29889 - DNA, 601 bp, Bovine  19866881745929
cctcttaaatgaaattttataaaaagaacatctcccctcctacttgaaaggctagctgtggagagtcgcctattcattgtcatctgacatttagtacatacccgggacgtaaattgccacactcaccagtgggcccagagcacaacctctggccgtgcaggcttggaccctgaaggaatgcaagctccaaggagcgaatccagaagcatgacaactgagttctgaggagttgtgaattaatataccatcgagatacagcccgtaacttgtgataacacctgggaaggcaataataattgtcttttactatgattgttagacaatagcaaaggtcttaaaagaagcatgtacttcttgatgcaatttctaattgcatggaatcacagtctctcccttagtctaaatcctatctctttccaaaggataaaacaggctttaaactcttgaatctcaaattgttaagctaattagtatagaggcacaaatagaaaccgagtcccagaataggaagctttctattgcatcatgttaactgctgtcatttggtgttccatatcagaaatgaataaccgtaagtacatttacaatgtgcatttgtttt

SEQ ID NO: 29890 - DNA, 951 bp, Bovine  19866880344452
ggaatatgtatttgccaaatggaagtagttgaaatcaggatggaaggaaaattttatttttatggtcctaagagggctttataaacaatgagggttttaattaaaacaaaaagccattcagtggacgtgtatggggacatgggctgcgggttagatacgggtttaactaggtttgttttggagtccttgacagaccctgattaacaagaaaggaaataccctgcctcgcccagcccctccttcttccccgtctccattgtcaccggaggggcacgtggcgggtggtggcagggggagcctgggttgaaacaggcaggttctggaaaattactatttttattgccaaggacgccgcatataaaaataggctaaccttctctgggagggcatggccctgaagcatttgccttctggtactctagaaatttctgtttcctacttctctggtatccttcagccactaaggtttgaggatttaggcttccagaaaactcttagccttctgaacagattaaaacctggtggtgtcatctgccattgtgtgttgaccctgatcctatttttattacagtactctctgaaaaactggggtaaagatactttggccaggcagaattactttattggcaattttatgcatatccaagtgaatatacccccatgtctccaggcccatgtaattacaagcttcgatgcacagtgttattgtgaggaccctaaagagtttaagcaaagtttgaacttgaaatcagaacagaaaggagctctagaggctcagcctctgccctttgttaaccctcgggacgctgggtcgggggaaacagggatgccaagaaggggagacgcgagacctccccagctggctgtgctgcagcttgtcctgggacggcggggagctcagccgtaggaaaccggctgatgatgagctctcacagcaagcaagcctcatgt

SEQ ID NO: 29891 - DNA, 1811 bp, Bovine  19866880406500
aactacttcagaacccagatgcataaaagtgcttccagtggagatgatttctaagaggcaggtgatggggtgggggtggggggtctgaagcccagcggtgtctcctttgggaacacaggatgggtgctgtggtccagaggagcacccagaggcagtgtgtgtgtggcaggaggctgccagggcatccctcccagggcttctcagccagatggcggttgctctccccacctctgagtgctcctggttggtggagggacagaggatcagagtactcctgacctgggggtgaagggggaaccagtggcaggtgctttgggcaaggtaggcctgacctccacttgcaggctgtcagaccttggccgagttgtggaaccctccatttgaatcttaggagaggaaggacatggatcctcgtatgtggctggggcaaggaaggcacacgtccagagtgaagccgctggagcgggtgtttccagcgcactcctcttcatcatcactgtctggggcaggggactaggcaactggcccggcacaagtgggcccttgataaatgcttgtggaacaaatgcgtatgtttccgctctgtctgcaggaaatgcagtggagtcctgacttctgggagcaagtgaagctgtttcaggggctggcccttcccagctgggctccggggacagacagctgaggctccagtgtagcgccaggccctggagagagtactgagccaggcggtcaggagctgggggtcaagggtagggttgctggttccagttgccatgtacggggctgtgtgacctagaggtttgtttctccttctccaggatttgctcatctccttttggcagagtggccagggtgaggtctttccaactgtaatttgcaactcatttggtacatttaacagagcaatttagtggttcacaatcagttttaaaaaccaaaatgaaacaaaacaaatagaacagaaaatatcagagtgcaatcacaggtcataagggtaagtattgttttgtgaaactattgttttgcttatatatggatgaaggtgccgacaggtctgaggtaaaattgatttgctattgtggggtcctggtgaaaagactggaaaatactgaactcagcagtcctggaggcgtcctcctctcccacattctaggggtctttgtgaaaaagccacaggtccaggggctcctcactctctccccctgggtcagcagctgtctcttggctcctcgtagttcatccctccggggtctttctctccaccttcaatcctcagccccctcctccctatcgcccagggataagcctcccccttcccaggaagtcagggtgggggtgtcggaagggagtaaacgtgatcgaatgggtggcactgggcactctatcccagaagctaagataaaaggactaggaagcaaacaccgcagcgcccggggacagaacagaaagctggcgagctggggacgggcgtttgaggggaggacttcatgaacaaaattttgctcagcggctacaccatagcgggtcactcccggggcgggggtggcgggggggctggccctggtctggtcctcgttggcgctcgggtgcgcaattaaccagcgaaggtagttttcactcctgccctcctccttccccccttaaaagaaaagaaagacagaagaagccaggagttttggagccaactcctggagagggagcggctgaactgattcggaagttggatctctttgtacacaggaatgcggcgagaaaaaaacaaaacccaccccattgcttcatttcccctccaagccctagcactttctttt

SEQ ID NO: 29892 - DNA, 655 bp, Bovine  19866880476618
gggtctttatctctcctttctctttgcccttcctccctctgagagggggctcaggttctggcctgagctagtgcacattattatgatgaccatcattattattgttgttgtgattaaatatttatctgcaaggggagaggagagaacaccagctcttcctcattctcattgctaatctgggctaatttccccagggcttccttcccagggcccagccttccctcagtgccagcaacttccctcccctcgacttgggaggccccagggagaaaggctgaaagaagagtcagggcggggttggggtggggggacgacttcaaggcccccttccctgtgcatctgtcaaatgaagaccaggagccgctcgcccgatctgtgcctcggtctccccagtcgtgtgaaagagcctgtgtttgggttgggaggcttcgctggagacctggtccctccatgaagaccaagtgggggtctcagagccaccatccccccaccagaggcttccagggctctggaaggggcagggaagcatggggacccgccccccaggatccagccttggctcctgggcttctccggtgagcgtcttttggacactcacctcatacctcgcccctcatccaaatgctgccccctccattagctcctcagaggccaa

SEQ ID NO: 29893 - DNA, 738 bp, Bovine  19866880568598
tggcagagggctgcggaaagcctgctcggcgctccgccccgacctcgtggagcagccgcgtcccaggtcggcccgaggggcagggcagagtgcccggcgggccggctggggccttggcttgagtcggcccaaggctggcggcaggttctgggggcggccacacggcaggacccagcagggacaccgcagggtcaccgcgtgactccccagagccttagtgcccatccatggaccgccacgaccccacctgagctttcctgtcaacaacagagctgagagcaggggctggcagggccgacagcaccccttgttgggaagtggaagtgggttgtcagcctcctctgtacctggactcctcactgtgttttgcataaaataaatacatagaataatggcagaaaccagttacactgcagtgcactctgtcccgcaagcgctgagacaggacggctctcagcatctcccaagagtgcacgctgaggccaggccagcaggcagggctcagacccctctgccagcagcgtgttcccaccagctccagcccccaaggagccagcatccttttctaatggactagatttatttaaggcaattaacatattagttctcgggccaaaggatttgtaaaacattacacctaaaggagaaaacaggcagtgaaaaccagcccctcctgacacgccccagcccagtcccttggggcgtgtgcccgtcccctccccccttgcggtctcctgt

SEQ ID NO: 29894 - DNA, 650 bp, Bovine  19866880589766
tatggtgagaggaagtagatgttggaccggagaaccaacagctgtgggaccagctcagggaggcccagcaacaggccttggacctggaggcagagtgcaggacactggagttgaccaggtacaggcccaggctgagcaggccaatgggagttggggaacctgagtgctcgggtcctggagctggaaaagtggataggcacgaaggaggacttagtgcaagggctccagaaagaacagctgagatgttcggaggagtggaggggactggctgcctggctggaagagcaggagaggagcctgcagacctcagaagcttctctgtcggacagccaagcagaggtggcttctctgtgccagaaggctgcagtctgggagggctcactggctgagtgggaagaacatctccatgggcttgagatggagtgccggcggttacataaccaactgcaggaactcaaaggcaacatctgtgtgttctgccaggtctgccccatccttccaggggagtccaacccatcccctggctttctccagtttccctctggcccctgtgggccctctgaccctccaacccacctcagcctctcctggtctgacgagcagtgtgggaccctgagtggggcgccagctgcccctacccaccatgactt

SEQ ID NO: 29895 - DNA, 2412 bp, Bovine  19866880619755
acatacaaaataaaggtgttgaaaaagtacctactggtgagaaagtaatttatagactgaagggtttccagaaaatcataacaaaaaaaaagtacataagatgacctttactcgtaaaatttcagcaatgatgagagaaaagtaaagcttagagcttagtctctggattactagaactctgaatcaaacacatctctagatggagaccagctcccttaacttctcatagagactgaattaaacatttatcataatttttcttgctctaactcctctctcatcaaataccttctaattggaaatttaatccagtttcctgtacgaaaacatctattacaggcaactgatcagtatatctacagcctgtaaaccagttcccgtaggacagttagcaaaaacttgcaaatatgtcaggttgaggcccacacccaagaagagatccgtaatatatctatccttgtggaataattaacaagatatgggacgttgctgctagtcctgtggttaggactctgcactgtccactgctggggtgcaggttcaatccctggtggcatgctacgaggtatagccaagaaaaacccacccaacaccaacatcaagatacaggatcagggtactgtggtagtgaggggtaataagtatccagcagcagcagtggctcccttgtcctgaaagttagcatatggcctcagcaatcacttgtaagtccaatgagcagtggcccagccctgacccttgcagaggtccctatggcgaaggaaacaagcatggactctgaaccggcgaccacagtgaggacaggcatgtagggctccagcatgcgtcttcatatgctctgtcagatggtgcttcagcttgaaacgcttgttgcagatgccacagccaaagggtcgaaggctgaaggtcagcatgatgtgtcggtcgcgctttggcttcactgcaaagcgcttcccacacaaacaaccaaagcgttttccatctgcagggggtgcgccacctagcttcacaggcccatgcacagcctgccctgctcctccaggtcccccaccccctgataggatttcattaccatgaagatccactggtttccaggatggaccacctcctccagatgttgtccctgctcctgagggcagtaggaaccctagttctccattctcttcagtgttccctgctggaaacactttggtctcctcctttgctcctacagactgacttccgcctcctgctatctcctccttggactcaaagggttcctgcttgatgtagaagactttggggggcaatgcagtatgaggagcgggaggctcaagtggggcactctcaccctctggaagcctgcaaggagtagtggatgtgggcagggggtgggatacaggagggcgaggaaaactccctgattctctctgaggctgaggagtctgagagggtgctgctgacccttggtcctcctcatcttcctcctcttcctcttcaacctgaagctgtaacacatctcccagttcactcccctcccctccaatcgggctctgggtagaaggagaagactgtgccggggtctggaaaggggaagagcggatgcaccagcctcctgtggtggaaagaagtgtgtggaaaggggtcgctcctcgggatgaaatcccaccaccggtgttttccagttctctaaggatctctgagcactgatctaccacttgccacatctgcaggccactggccacaagaaggtgcgcagggagagcatccaggggcagacggaggtgccccgaataaatgagctggagcagcccctcgaaggcatcggcttcgataacgttgggtagggtgagacgcggtgcatcccccagaagtagtttgtcgtggaagtaaggagaagcggcggccaacactgctttgtgggccctcagttcgcggccctgcaccaggagagagacgtcacagaactttccctccagcctgtggcggttcagggcctccagcagcaaagagctgtgctgagggaactcgatctggatcgtccgtggggctgggttgcaggctggggagggggctacgggaggcaaaggcgtcgaggtatccatggcctcctgaggaagaaaaagaccccagagggtcgggtacaagaggtgaggggagggggagagcccctgcgcgacgagggctgtggaggaaagagggggtcacagaagctctggataaggaaaatcgtatctccccaagcaacgtccgcctccgctgcaccccaacgtgtgggaacttttcggtcgccggtggttcgggcagaacagtcccacacactcccccgccgagaaaactaaaacaaaccacaacaaaacaccaaccggggcttgaacttgcagggcctgtggcgaggaggaggtccttcagccgtagccggatcccgccggc

SEQ ID NO: 29896 - DNA, 1864 bp, Bovine  19866880628650
tggaagtcctgcccactacaggctagctgtcacctcactggttgggacaacaaagatcaccccctcccatttctaaaacacaccgcccccaactcctactgggaactataatgtggtgaccaggggaccaggagccctgaaaactcccatttagcctggagaagcaggaggactcgtggaggggtaaccccccagcttcttgaaggttgggcagaaccctgtgaagacgtactctgggcaaagaactgagtgtttccgaagtgatgccctctcatgctggtggtaccagggtgggcgagctagggcagccctcggtggctccgtctgcttatgcagttgtcttttcccctgcgttcaaggaagttctgtgttctctcaactttgcctcacttggttccccttcctgatgaccaggggcctctgcctgctgtgggctaggcagaaaccccagttttgtttttagtttccaggggctgtaggactagctttgaccagagtggggacatggccttcccttagaggctagagggacgggcctgacggggggtgcatcccgtctctgtgatctgcctccccgagggccctgtctgggttcccagcacgaccgtcttcctcctgtattgctgccaaccagggaggcacagcactgcagcctgagaggggtcttagaggccatgagctcagtcctgtgctttcctgggattccctcctgtgacggagagctcactgcctcacagcacggcccgtggtattatcagacaggccctgtccccgtgccagcgtttcaccgcaccccaaatccttctgtctcttcccaccacactttagggttttccaactcatgcctgctttccataggtagaaaaatctgaacactctttctggagtttgggcttatggaaatcgttgacgttgtatctatttccaaaataaaaaccagctaataaagaacctatttctggaattttaattggctctgtcttaggtcgaatttgctagaatcagatcctaaaagggagaattatgaagaaggggtcccaggcggagtatcagggagtcttgctcctacagggcagggacgagccgagcaaggacgtggtttcaggggaagagaggcctcaggttgatcccatagggaccaacagacagtctcctcctcctgccgtgggatggaggccacctctctggggtggggggatgtattgataacttcctagggaactgtgggcaagatagtggtgggccagagagggctgctgctgtgaactgtcggctgccagagtacaaaacctggacccagaccgggcacaggaggggtcctaagggcttctgataaacttcccgcggggaagagggcacgcgtccacccccaggtgagggcctgttctcagacctgcttcccggcccctccatcctactcagcacgatccaggatgctttaagctctccgggggtcttccaacactgcctcttcaccccggtggggccaggggcagtgatggagggcagagcagaggcggggtttgcgggcagggctgtaggctggggtcttcccggaacctcgtgtgagccgatctccctccttctgctccctcaccccccagactgcctcttcaagggtgtgtcccatgaaccgctactcggcccagaagcagtactggaaggccaagcagaccaagcaggacaaggagaagatcgccgacgtagtgctgctgcagaagttacaggtctgggcatgtggggtgtccacttggcccgtgtgtctcatgaacccgggcacacgcccagggctgccgctcatcagagccgacagggccttagtggcccgagtccttgaggtttgacccgttcggccagggactgg

SEQ ID NO: 29897 - DNA, 1213 bp, Bovine  19866880641951
agaggagagagaatggggaatgggtttgggggaggagagaccagggcagggggagggccaaattaggtatgtgtttattggtggggaggggggcaatacaagtaaaactgagtgctggtagtaggggcagattaagacccggccccagactcaggccctcattaaggcccttgagcattgaaacgtaatccctgggggcttatccacttccttcacttcaccactttcaacccctcccccacctccagtccttatttccattccccctccctctggtgtccaccacctatatctttccccacatatggtgtccgttccttatatgagtcccccttctgtccttcccctgtatcagtccctgctctggtgccccttctctctctccctctcttccgcctggtagtcctttatatctctaccacctctccaccccctccttcttggccccctcgtcttaatgtccctattatgtccccctcacttcctttgggcccttctggtgtattcccttgtccctaaagatttaccatcatctctgactcttactcccttagatccattcctgttatttcttctccaccccatcccttcttccccaccccattccctatcttatcacaagtctgtgcctacttactttcccctaagaccccatctcttatcacccattcctcttctctcgtctcctctccttcctgggctgttggagatttggggagcaaagacaccagttttgacagttggaacaggacctacaagagatccccatctgagccccatggaagtgttcatcctagcaaaccttccccctttcttaactgcgtccttctgtctcttgcatctgcctcccagaatcatcctgcgtccaggcagcgtttgtgtatgtgtgtattccagagttgctcctaagtgaagttccccgtgtccttccccactcccaggaggagggtgtcccctgaagtctaactgtcctccctgtggctgctgtctgacccagtccctcctataatgatgatgtgaatcaacagatgtcccctctgggagtcctcggggtctgactgcagtgggcatgtttcctgcagtatctgcagtctcagagtctcagagttttggtgatctctttatctaaagggtatgtctctgaggtggcactgacagagtttcaagaggattggggtttttatatacctgtgttcagggagttcacctctgt

SEQ ID NO: 29898 - DNA, 1940 bp, Bovine  19866880656464
atgaggatcaaagaaagccaaaaaatgtggaaaccaaaccccaccccattattatgatacctgggaaagaaagctagaatcactggctatcagggaggaggtgtgctttcagaaatagaaacaaaacaccatttcaaggtaaagacaagtgatttttatagaaaaattatggaatttagaaagatggtaacgataaccctatatgcgagacagcaaaagagacacagatgtatagaacagtcttttggactctgtgggagagggagagggagagggtgggatgatttggaagaatggcattgaaacatgtataatatcatataagaaaggaatcgccagtccaggttcgatgctggatacaggatgctcggggctgatgcactgggatgacccagagggatggtacggggagggaggttggaggggggttcaggttggggaacacgtgtacacccatggtggattcatgttgatgtatggcaaaaccaatacaatattgtaaattaattagcctccaattgaaataaataaatttaaattaaaaaaaataaaaagtaaactatttaaataacttcaaagctaaatatagtgctacttcaattttaatcagtatcatagaaaacaaatttgaaaagaatgcttcagatacataacagttattatctctgagttccattatggatgattatttaatttattttttttgatacagttctctacttttaaatctgttttgcaataaacatatgttccctttatcttggaaaaggtatttaatcatctaaaaatatgaaatcatagagataaaactcctgagtgttcagatgagaaaactaacgctcaaagagttgagaccattgtcttacatcttcttaagccaggcctaaaatccaggcagcctgaatcaaagccattgctctctgttcccatccttgcaattattcatgagaatgcaaagaaaagttgactgagttcatttacttcatcttcagaatcatcccaccctgagattgggtcttgggtagttaagtgcttctgaaaattcttctcttccacagtttccagggctgataaaagaaagaactaatcatgagacaagtgatgaaccttatttttgagggaaaaattggagggaaaaaagctcagcatataagatagaggaagaatgctttagtggaaaagctctgacttgggaggtaaatgatccaatttttacagtcattattttaatgattgccactaattatctatatgactgtggacaactcccttaatctcttttcttaggttcttttttaaataaataacaaaaggaaaatctgtgccagatggtacccatgtttctttcaagtaataacacttggtttataaacacagacggggcaggcagctcaggagcacggagtgtgcgtacccttgtgtcgcgagcgcttgagcgaacgtgggtcccgggagccccggctctgtgtcctcctcattgcacttgcccagtgtgagtagcaccaagctggacatggagccacagcagaggtccccattggtggaagtgaaggggagcgtagagctgaagagacccctggccaaggccccttcccggctgtctctcttgggaggcaggctgaagaggaggcctgaccagatggaggaggccttgaagcctgagaagaaaataacaggaggcctgggcaccagagtggccacgacccaccccagagcagcagccctcacctccgtgccacagacacaaggccagactgcagtgcccaaagctcccaagaagccaggaccctgatgttccacagctgttgccacagcgctgaagactcagaagccaggtcctgctcttcttgcccagaagcctagaacaacagctgcccctcccatggtggaagggaagaaacccaaatgtccagtctgggacttaaggggcagttatgtga

SEQ ID NO: 29899 - DNA, 598 bp, Bovine  19866880667999
ggtgttagaaacggtttcctggtctttatctttctctgtcgacacctcaaattcctggcaactgacccagcaacttggcgggggcggaggggggggcgctttctgtgaccacctgttagttggccagggaagcgtcggcattggctgctacaggtgacattaaagttggaccaccttctgcctgccctagagtagtctggatgagccagaggaaagtaactcagattccacgcatgcacgagtgctggtcaagcccacttccagaaaagagaggctgtcctcctgggaccttttaactcacgtagctgtcaagcggtgaaaaactcttcagattcctctcaatgcagaagaaaagggtacaagacctctacatctcttttctagtgtcaccatcctgcatttctaccattgtcagatgctgggctggcagtggggtgaggtgggcgcggatcctgactttgcatttgactttgtggaactagccccagttctactctgggttagtggccctaggcaagtccctccctcttgctgggggccagttccctcatctgtaagtcaaggggacaaaacacaaactttcctagttctttccagt

SEQ ID NO: 29900 - DNA, 1509 bp, Bovine  19866880672261
cattttattagcacccggcaggggctccccgaagaaggcagctgtgtgaatttcgcaggaagaggggagggctgtgatgtcttttgtcttccagcaccttaaacatttcagtccttctggctgcaagatgatacaagctctttccaagctatttccctattatggcgcctgcaggaaaaagagatccgttgtgactgtggtgccgtgctgcaggggtgggaggggtaggggcctggtgaggggccctgacctggccagtggggtcctggtgacagtggagggacctacacatgctgacttgtctggggtctcagggagcggggagtcaggggccatgaacccactctttggtagccacgggtggggttggtgatcctaattaaaagcttggatccaaaaggcttgatgagggaatttctaattaaataaatttcatctcatctgggaaacagaggtttgcatatgataagcatgaaattaataattacgtttagaaattagctgttgcaccaagccaagccatttacacaaccctcaggggctggccccgaccccggcccgatcctttgtaatggagacggatggtctgccggtcaggagcagaggcagtggctgagcagaggggaagcggggctggccctccccctctgtggccgccggccgtgcgggagtccgcctggaggctgccagtgtctctgtcagatcctgtgtgtgagcacacgtgtgtgtaggctcgcttgtgaggcggggaggctgagctttcaccggagagtaaaatgggctctggaactcatccctctggctttaaatcacggctgtgtgtcctgggcaagctcctggacctttccgtacccaggtgtaggggaaacgagcacctccttcatacggttgtcgtaaggttaaaggtgttagtcctataagaccactgggcacagttcttggcacacagtaaacactcaatcaatgctcatcctcaggaagatgatgattacgtgtgtgcgtgtgtgtgtgtgaatttaattcagctcagcccaagccaacctgtgacgggtgtgagcctgacatatccaggcttttgaggtggagaaaaatagagctccccccttgctctcggggagctagagctcgcgcccccgtgtccatcggcatcaggaggaggcgctgcaagagcacacggctcccgcttctctgtggctgtaaacccgtaaactgaatgtacttgccgtgttgtgtgtccacatggcttggctgggtgctcatcccacctcctcagggaccaggctggcccggaaccagtcacggcagcagggtgatgagacgccctgaccctgagttgatgcacttcctgctcgcagctcaggggccagaacacgtcaggtggggcatgaggggcgcgtcgtcagatttgccagtatctgacggggaatgagggagggacgtgtctctaaggactggcacccacgttggccatgtgtgggctcactgagcattgtctctcccactggagtg

SEQ ID NO: 29901 - DNA, 731 bp, Bovine  19866880680918
tgtggaacccacaaaacagagctgaacagggcttttcaatggactgattgtatcttgcatcccctgaaagaatgagggcttctcagaagggatcgggtctttgtcctttcttctcataactacttggccccaggtgttgcccttggaagggactagaagcctgccctgtgggtaatgacagggctcagggtggggagggccccccgtaccctgtccagtcggctctcgtccatagacttggaatactccttgagtttgtactcttcccgctcgatgtgggcactctcaatgtcagccgacaggtgaggcatgttggagacccaggccaccgtccgctcggaggccggcatcgtggggttcagcgtggacggcgtctgggaatgctggggcaggggagagggaaggcggaaggaggtgggcgctttgaaaggcagggagcacggcccaaggaaatgggagtcccccgactgatcccctcatgaatgctgttctcatcacatctgccctgggagccccaagagggcagggaggcctgtctgttaactgacaagcacacagtgcccagaacatcacatggagcaaagcaggccctctgtgcactttgcttaatgaacgaaaggaggtgagaaaactgtgacttcagaccacagaatgttgtgctcccctcgacccatctcctcctcctcccctcccgctcactgccctgccagccctcccgcccgtcctacctg

SEQ ID NO: 29902 - DNA, 702 bp, Bovine  19866880742964
tcgccggaatgctggggagaagataagtaccgcctggtggctgtgccccacggcaacgacatcgcttccctcttcgagctggaccccaccacgctgcagaagaccgactccttcgtgccccggtgggtgggcactgtgggcctggggttggcgggggttgcctgggctagtatccggacccccagtaccccctgctcctctgtccttccttgcatgacccatccctctggagatccagatccgaggcagctgtagggagctcaccgccgctgaacttggcatgtgctgggccacgggccctgcaccctgggtgccgccttctctccagtgttctttacagccagttggcctggggctcaggacacattgggtgcgggggacggactccttaacctttaaggtcttccaacctggagattttaggatggaacatcaggaagcttcctgggtgtcaatcaggctttaacgttgacctcaggcagctgacttggtcacttggcccagacatcctcacctgtgtagtgggattatcgagttacccatcaaagggctgatgggaggattacccaatcccttatctgcatcttgaggccagatgtactttggaggttcagattgtttttcatttctgaaaggtagttgtgtttcaccatcaaagacatgactatttctgacgtgagacgcaggcatgttgacactgaa

SEQ ID NO: 29903 - DNA, 1241 bp, Bovine  19866880769892
ccatccctttggaccccccgtccccatctcctccctgctggaaagcaaaaatggcttagccgtgaactgggggggcagaggctgccccagcctggcctcgatctgggaagagcccgtgtccctgtgaaaggagaaagctcagagggcagatgagtggggcgctgcttctggggctcaaaggtacacagaatgtggagggcagagcaggtgggtagaggcagcagggagattacctgtgggtgctgctgctggcctggcagcccgggacggcagagagaaaaggacagaagaggaggttaggacagtcttggaatcacagcggagttggcggtggcctctgaggacacaggcagggtgttcagctctgagcactgattccatctcctgctcctgccgtcaccctcagcctcgaatctaccccgcgactgacttccttaatccgcatggtgacaacggctaacacctctaagtgtgcacgcaatcctaagcgtattccccctagtttacggaccaggagactgaaaactaggatgtgtcatgaagccggtaaatggcgaagctaggattcgcccaggctgctggtctcttgaggccagatctcagcatcaggaagtcattttcaggacccggtgggctgaagccaggtccagcaaccatttttgtgtgaaatgtggctcccaatcagaacaacagctgtgtcccagcagtgctggggagctctgggaacacccccactgcgagccccaccccacacacacagtcctgatctaccagctcatgttggtatcagggcttatgaaggctgtgcccttgtgtacaaagatgaggagtctgggcttagaaagagaaagacgggggcccaaagccatgcgtgagttaacagcagaggcagggacagaaaacatgtctcctgacaccagcagagaagctgtctcccgtttcacgggcagggcctggcgcggtggggacagcgccgtggaggggcggtggccggggctacctggacgcgatcttggtgaagtactcataggcgttgtctgctgttggctgcaggtgctgcagcatggcctggaactccgcatcgtagcgccggttgatgtcgtccccgatgacggcgagctggcggcccacctgccccatggtgctggaggagcgggaggcggccagtgagttggggcccgggctggcagcaaaccgctcctgcctgagatgcccggcctcgggcgcccctcctggaagtc

SEQ ID NO: 29904 - DNA, 1533 bp, Bovine  19866880772500
ccagccggtgggtcacagagcacagagctgggtcctgcttggatcgggctccaaagggaggtcagatcctcgagggagcctggagatgggccatccaggggtgtcagggggaggctggtaattggggctcaaaggggagggtcaccagcgctcggagttgggggcaatgaggaggtctctactcaccctgtcgcctttcacacccatgtcccctttgaagccgggaaagccatcctcgccctgagaaatatggggcgagaggacatcacggatgacggaaggaggggtagacagaggtgggcaggagaaggggcggagggtggtgagggcgagaggacaccacggatgatggaaggaggggtagacagaggtgggcgggagaaggggcggagggtggtgagggcgagaggacatcacggatgatggaaggaggggtagacagaggtgggcggcagaaggggtggagggtggtgagggcgagaggacatcacggatgatggaaggaggggtagacagaggtgggcaggagaaggggcggagggtggtgagggcagctggggctgagggccattgctcaccttttcacccttgtgacccttcagaccccgaattccatccacgccctggaattggaaggggagagacggagtggtcaggaggggtggcgaggctggcaggaccaagctccggggcccagctggccgccctgacctcagccttcctctcccagctggctggtctcttaccttgatgccccgaggtcctgggtaccccagaggaccctgaggtccagaaggaccctgcaagaggacagagagttgtcaataaagggtctcagggggtcactgaggacgcccaggggtgggagaaagggaagtgaccaattggagtccggagagggttgcagggggtggactgttggagccacgtgaagatacgaggagatcccaaggacttgggtgcccaggtctgggtggcgaccctgccaggggatgtgaggggccatggaagagcttacctggtttcctttggttccgggagggccttccttgcccgggtgaccctgggggtaggggaaggagagcgtgaccactggtccctgtcacttcctgcatccctctctacacttcttggacccaaatgcccccaggtcctaatgaagctgactgaccattggcggcatcaccagtgacttcccaggacaagggacactctgtaaggatactcactgaggtgcctgcaagtcactccctggggtggaaggtcaagggggatttgcatgacgaggtgggggcactcaccgggggtccatctgagccgggcatgccaggtagccctggtttccctcgaggaccctgcagggagatgaggacactcagtcacagccagacatttgggggctccctgcaacccgcctcagcacacccaccatcccccagatcccttagtcacttaccttctctccatgagggccaatggcaccctggggcccggggagaccctagacaccggagagagacattacaggggccc

SEQ ID NO: 29905 - DNA, 949 bp, Bovine  19866880845375
aagctcacatcctaataaactctccctaaaaaaaaatggacttatgagagcagcctgcaaagtcaatgccttgaattcttcatagagacaacagggctggtctgtagtgaaagaaacagggttgaagggctagggttcagcgggtggggggggtctccagccggcttcagaggcccgctgaccaccttcctgcgggaaagtggcctctgtgtcccaggaagccttccttaatgctgcgcgaccagggttcctgttgctggaaaacgtcgtgtcacagtacaagcatccctgcatcttagacctgaagatggggacccggcagcatggggacgatgcctcggaggagaagaaggcccgccacatgaggaagtgtgcgcagagcacctcggcccatctgggcatgcgcatctgtggcatgcaggtaggtgggggtggggcaaccgcagggactgggcatcccgggaggtccgctggaggcaagggtgtcccccaaccagacaccgttgccttcactttgtgggagcaacagaggcagtggccaagcacccctttccccaaggaaacacatatcctgatccaggacatgctgggtttttttttaagagcacctttcaggacagtggtgtcaaaatctcaccatttggggaggaatgtaaattggagtaaccacgatggaaaatggtacagaggttcctcaaaaactaaaaatagagctgccatatgatccagcaatcccactcctggggatgcacccagacaaaactgtaattcgaaaagatgtatgcatcgctgtgttcatagcagcactatttacaacagccagaatatgaaagccacctaaatgtccactgacagataaatggataaagaagatgtggaacatacatacaacgcaacactgctgctgctgctgctaagtcacttcagtcgtgtccgactctgtgcgacc

SEQ ID NO: 29906 - DNA, 685 bp, Bovine  19866880895304
tgaacgcagagagaagagctgcaggcgtaaagtctccgccaggaaagaagaggggagggcagagtccagggacttacaaaggtgcagactagccggtcgtgagagactgacagggcggatcgtttcactttacagctgggggaagctgaggcccgaggtcactgagacccaaagggctggggggggggggggtgttccggagaggcaacaagagttggaagcgagtccgggatgactcaccgtgaattttgaggtagcgctctggcgcgaggtccggtcgaagaggtgggctctccgcgccctggcgcagcagcagggcagcgggtttcttggccaacttgcccccgcccgcatcctccacgaaccagcactcaatcaccgcgggtctggccgagacagcggtcgccaagcctggggagaggcgcgcgggtgaaggcacggccccaacttcaggtgacccgacctcccccatccccggacgtggcggggctcacctcccaccgttccctgtgccaggagtcacgggggtcgctcacccaaagccacagcgaggagcagggacaggcgcttcatggcgttcggatttctcagctccgaagcagcctcttcctcctttcactttcactttcctccaaaggccagcaggtggggcggaggaaatcccctctcaggctaagggaaagtt

SEQ ID NO: 29907 - DNA, 1885 bp, Bovine  19866880896999
ctgggggtgaggagcaggcttcagttcattctcaggatttttgtgatattatcttcagccactctttccccagcacacagacacatacagactggccatccagagcccaggctgtgccaggctgagggcagtcaggccggtgagaagttaaggcccagcctcacacagtccctgctcccatggggtctcctggtaaagcagctgctggcaagtgagccacagcggggtatcgggagctaagggctgtggcggggccccaaagccagctgatctggctaaacgaggtccccatggctggggccttttcagaggggctggtccgtgggccgggcctagaagcctgggctggacgaagggcgaggctcccggctaccctaagtgggagccggctgtacagggtgctcagcagagggctttggggcaccatgccgaggtcccagcacacagacaccccttcttccttggccatcactccccagggcccctcaaaacctggcattctaggtcaccagcctgtgaccagtcagaaaccctgcagtgcagcggcctccctgcctttctttttcccaggctgcgtttatttatagtcccatcccagtaccttccagagctgtctgtctgatccttttagggatcaattgcaaacagaccttggtattgggcagctttttagtcatttaatgcaaattgctgcactgctttgcaggtcaggttttaatgatctggcctcggtccaagctaagtggcttttgatcttgctacacagtgaagatgccccacagcggtcagggccggcgggccgcacgctccccgtcagagctgatggcttgattcttgctgccgtgttcagtcggttgccaggtaaatttttttacctctttgtgtttgaatgtgtgttttttcccctcctaggtaattttgaatgtggaaatccagagaagctaaagagcaaatgcattcctgtcatggaagcccaggaatatatagcagtaagtaggctgccgtgtgcgtccattccctggaggtcctggtgttctgtattgatctttcaagccctgtgttttgttttgttttttttcccttgttttgtgtttgctttttggcttgtttgctttccctttaaaaaaaaaagttttttttttttttaacacagttgagtgctcggctccctgaagttaaggcagcagtggggtgactgggcccagggtgagctgagagccagggcccagcctgcaggcagctcgcccctgacccattgccccccagccagctgaccggaccactgccctgccccttcccagagcagtcctgtgacttgctcctcttctggctcattttccccttctcagcagcttatttaagatatttcacctgctatttcacttcccccttaggattaccatccaggttgctccgggtccttttgattttcgatgtggcctcaggtggacagaattacaggttttagagccagcagagagagacccaaggggtcacctcatccagttttcgtttcaccgatgaggcacctggggcccggagaggggagggtctttgcacaaggccacacggccggctctggccgcagggagggcccctgcccccacgtcgtcttccacgtccatccagatgagccgccagctctctggcctggcaatgcggcccttgaggaaactgcattcctccagctgccgcagacctgccccgttttcccacgtgcgcttccgcatcacctcctccagttacagcctcttctccgggatcatctgccccagatcgccattccaccagtttgctatgcgtttagtggagcggggcttgggggcacacggaggacaaagggggcttccacaacccagctgctctgcccagacggagcactaat

SEQ ID NO: 29908 - DNA, 2432 bp, Bovine  19866880919140
gtagaagccgccgtaagtacagagggctctggtggccttgcatctgctgtctttggatcaggcgggacaacaaaggctcagagaggctgaggtgtttgctcaagggcgcacagccagctagcgacagaactgtgatcccaacatttgacctcattcactgctctttccactggagccacagtttcccagaacactcccatccccctggatccctgggtccccctgcagcatcacaggtctggtgcccagagattgtcctgcccccttgttcctgcaggatggtagttggccctggtcactgctgtgctcgctggcttttaggggatggtcatgcccagagccacaaggtgaatttcctccttgagatttttgtccccatctaccatgaagccatctttggattctccaccctgcctgctccaacccacctcactcacccattttctcatctctaaaaccctcccttcagccccaaaccaactggctattccttctcctggagtgagctcccaggacaaagggcctactattctctaagcgtgaaagtgaaagtgttagtcatttagtcgtgtccgactgtgtgaccctctggactgtagcccaccaggctcctctgtccatgggattctccaggcaagaatactggagtgggttgccgtgccctcttccagggggtcttcccaacccagggattgaacccaggtctcctacattgcagatactttaccttctgagccacaggggaagtcccaaagccattctctaagcatgacccttccaaagagctgatgcttggaatatggctcccaagtgtggccaggctccctttgcccagagcctggagctcgtgggggctctcgcttactttccagaacttcgtgacacactcagtagggcatgccagcttctgtgttcctttgctcgcagcagttgtgtcttcagaggcatgtaacagaatgcactcattcaaagcaagaggcaaagaaacactcagccctgggcacacattgcaggttctctgattgaacctttgttcattgttctctgctgaacctgactgcctgtaccacgcggaggccctgggggctgagccacagggcagtgtgtctcccctttgtgtgcgcacaccagtcacctgtggggtttggttaaaactcagattctgggacttccctggtccagtggttaagatttcactttccaacgcagcagatgagggtgcagtccctgatcagggagctaaaatccttcatgcctcatggctaaaaaaaccaggacatgaaacaacagaacaattgtaacaaattcaataaagactttacaaatggtccacattaaaaaaaaaaattaaaagaaaaaaaacaaaaactcggattctgagtcagtaggcctggggtggccaaacatttacatttctaacccgctcctgggtgacgctgatgcggccggtcggggaccaccgtgagagcgaggcctcacagggctgggagtccgggctgcgggctctccgagctctgtcctgtgactctcggttgtcactgctggtctctgtatgacccttgggggttttgtattggagcaggatcccctgctggtcatctaggtctaaatcgtgcccgagagcttatttaaatgcagctgttggattcggtcgatcctggcagggccagctgagcagctggattttggccatctgactgagcaattcagacacgaggttccaggatgccagctcagggggcggtccagggcactgggcagcgtgtcctgaggccggctcccctgcgctgtcgttgacagatagagcggatgctctggccggggagtggccagcagctgccccgctccgtctgcagcctgccctgccagccgggcgagcggaagaagacggtgaagggcatgccctgctgctggcactgcgagccctgcacggggtaccagtaccaggtggacggctacacctgcaaggcctgcccctacgacatgcggcccacggagaaccgcacgggctgccggcccatccccatcatcaagctggagtggggctcgccctgggccgtgctgcccctcttcctggccgtggcgggcatcgccgccacgctgttcgtggtggtcaccttcgtgcgctacaacgacacgcccatcgtcaaggcctcgggccgcgagctgagctacgtgctgctggcgggcatcttcctgtgctacgccaccaccttcctcatgatcgccgagcccgacctgggcacctgctctctgcgccggatcttcctggggctcggcatgagcatcagctatgcggccctgctcaccaagaccaaccgcatctaccgcatcttcgagcagggcaagcggtcggtcagcgccccgcgcttcatcagccccgcctcgcagctggccatcaccttcagcctcatctccctgcagctgctggg

SEQ ID NO: 29909 - DNA, 1516 bp, Bovine  19866880932879
ccacctcggtgacagagaatctttaccagtggctccttcatggctgggctccataaagacacagtccctgtgcaccagagaagagcagaagttactaatagggtgctgaggcgattaaacctgcaaaagagggggattcggggccaagaggtaagaaaagaggggaacagaggggcaacctgaagggactcgttaagtacaaatatagacgaaaagctggggcattccctgatgatccagcgggtgggactcagctttcactgctgtgggccaaggttcaatccccggtcagggaaccaagatcatacaagccacatgacatggccaaaaagaaaagcaagacaggatggtgagggttaaagttctgccaggcaccaaccattactgtgtccgagatggatgacggcattgtaagggttctgagtcatgacgctggagccgtccagcccgagcattcagagctgccacgatctttcccactgacacgtccaggtaggtcagaaaccctgtctctgactgtgagagagagagggaaggagaccggattgccctctgtcctccccctactggggccccaggggagggacggtcttctcagggctgccatctggtccctgcactccagtcactcacagctgtggccaggaggaagtggaaaggcaggaactcaagtcgggtgacccggtcacagcggcggacgcaatggagctctatgccctggttgtcgtaaatgtgaagccagcggttctgggcaacagccagcagtgcctcagaatgcagaaacctgagaggggcggaggagcggagcaatgtgaaagggagtcaccagctgtcgactgatcagtgacgggctgtctcatccccaccggccgctgaccaaggccactgaccggatgtcccgcactgcctccatgacgttgatctcacacataagcttctttgttacccagtcgagggcagccacatgaccccggcgtcctccaaaagccaggtgtctgttgaaggtggaggacaggcagggtgtcagttcaaggcgtgtgtgtagggcaggcgcccggactcaacggtctgtcccacgccagctcctcctctccaggtgagaggagagatgttaccacacacgcttatcacacatgcaagcaaataacaagaccctccccacgtcaacaacccagatgtacactgctatggctgagatggactaggctaaagtcaatggaattcaaccttacctcccagttctagagtaatttagcctgtagggtccaaactgcctcaagttcaagtcaaaatgctggagaagggaatagtgaaaaaaagaaaaaagagagttggttcctttcaggaattttctagtccccactcccgtcttattctgcaccatcagtcgacccgctggcccctttgccattctcaggctcactttggctgcacttgcaatgtccacagcctccacgatgtcagcctggcgaatcttcgccgtgtcctccccatcctctccttccagaaaccgcaa

SEQ ID NO: 29910 - DNA, 939 bp, Bovine  19866880951571
caggcgggacaggggaatgggaagaatacagagaaggggaaggagccgcaggctggggccgggggtgggacagaatgcattattcgggtgtagacttgggttgtgagggaattgccgcgaggtcacccctaccctgctcccttacccttctgcagctgttgatatttctccacttctccctgcagcttcttctggattagctcagccatggcggggacgaaagcctgcgggtagcaggagaggggcgctgggtctcgctctggaaggtacccgggctcccctttctggcctgcggaggtgacagccctcttgagaggcagcccctcggggcacccactgcagtctctcctcgtccgggatatcgactcacccccggcctcagggagtggcagaaccccgaactcctcaaccgaaccgctccccgactcacgctctcacttcagtattgatgaacccggaagtaaatagagaatgctggggaaagacggcaccggaagctgtcatctgacgcacgccgggaaatgtagttctaacatggtcaatgtgtggtgttctgctaaaaagaccagacgcggaaggatttaaggcaagatggagaaaccgagatgggaaaagaaactgcacggttgcttgggtcttgacctcggagtgcccgtctttcatcacttgggcataagttgcctcactggggtccttggtcccgcccctcagtggggagcgcgccctcattaaagatggcgcctgggaggcttcgacctggaacggcgctgattggatgagtctcggaggacttccgggagttttccatccgactgtggaactgtggagaggagtttgcacgtggatcgtggttctagtgggctagatggagacagtccccgagccgggcagtaatgtcccacccaagaaggacagactgcagaccaagaagaaggtagg

SEQ ID NO: 29911 - DNA, 655 bp, Bovine  19866880994065
ctctgcacccccagccctggcacacgggcagctcccacaagtaccaagtttaacctgaaccacagggtctgcaaaccagagtgactcaagcctctaccacccccaacagtctgtcccagggaagagggaggcaggttggtgtgagttaagactccacccggaacccaagaagagaaacaggggagcctggcgggataagcactctgcctgtgcaggcctctcatccccacccccaacccaggagaggcgccgcagacctctggagtggttgccgggcagccggtccacctcaaggatgaagtcgtccttgaggaagaggaagccgacgatggagaagaggtagaccaggatgagggccagcagggcggtcagcaggatggagcggccgttgcgggtcacgctcttgatgacgttgaacagcgtctcttcgcggtagatgaggtcaaagagctgcgtggcagaaaagacatggctggacccacaggctgcctgcttcccactgggtcccacgtcccccccaaagaggtctgcgcttaggcgggtggaaccaggcccacgggcccattgtgggcgacatttccgaggaacccagagtcctaaagcccaagaaggaggggtcccggggaaagcatgagggcggaatagcaccaagtgt

SEQ ID NO: 29912 - DNA, 1131 bp, Bovine  19866881038118
tcactgatgcccctgacgcctccctcacctgctggtgagggccccgccgccaccccaaggtagggagccaatcatgttttgctcctgaattgtggcttgaggctggtggccccccgcatggggtgggcagatgatattaaccaaggacccccctgacccacccccgcctctcccaggcatgccactcatctactggttctcccgccgcatgactctctggggcagcatctccttcaacctggcagtctttatcaacatcatcattgccttcttctacccctacgtggagggcgcgtccacaggtgagggcacctcagggcaggcggagggccctgagccttccatgccccctcctctgatgtgagcagggccctggggccggccaggccccgaggggactgggtgcagcgtggggagcagtgccctctgggttatgcaccttatcaccggggcagacagggcctgtgccctttggagacagtgcatacacatgcataaggcagagaccagtttggtagcagcagctggaggtggtagcaacacctcctccagatgcaggggtgatggcagagccctgtagccaggtgaccaacttacagggaaggctcccgggaagggggagggcttcttggggtctgtggggtgggtgggtgtgagtgagccaccctgtctctgctcccgggcccccaggcgtgctgggctccccgctcatctcactgctcttctggatcctcatctgcttctccatcgcggccctgttcaccaagcgctacagcatccgccccctcatcgtggcgctcatcctgcgttccatctactacctgggcattgggcccacgctcaacatccttggtgccctcaacgtgagtgccaaaggaccccagcccccacccctcagggttcatcatgtagtcggacctgaagcgggcccgttgcctccgactggccactgctctccccatccctcggtctctgagccggaatcattacagacccgaggttgggaccactctgtcttctccatcctcctggacaactcagggcagcagacagttggagtcagccagccaggagccactttggggcaccggcttcagggctgccgggtacccggagttagttgtgcactgc

SEQ ID NO: 29913 - DNA, 1706 bp, Bovine  19866881258117
agctccctgtgctgtatagcaccttcccactagctatcttacacatgatagtgtatgtatgtcagtgagtcttgtccgaagctcaggtagacggggagaggtaggaaggagagcatttggctggaagaaggaaaatccaagtctgtggcggtgggaggcatagaaaaggcaccacagcagccatagtactggagggtagtgtcaacaccatcccaactctgcaacacaggaaccacaaaagctaggaagtctcactcctgcaggacaggcagcttcaccagacgaccccccagagatgaacggtaggacttgaggatagagtgtgtgagaaagatttgaacctgggcagcatgcacccctctgccatcacgtttgtctctgaaaagaatctctgcttactacttccttgctgtcacaacctccactgtactctctttccatttccctgattacaaccaattcacccctcaaactgctgggcaggagaatttttgtgttcctatctggttgattttgtatttgcttctacttgtttgcattttaaatattggctttaattgtatctatcattttgaccttcttgcaaaaactaattttgctttgtgttgtgtttatggttagatggcatcaccgtctcaatggacatgattttgggtaaactccgggagctgctgatggacaggggggcctggcgtgctgcagtccatgggcttgcaaagagttggacacgactgagagactgaactgaactgaactgtgtttatgaaaacaggcttgtttttgaaaagcaccacttgcatacattgtgtgcatttaagggaaaggtactgtgtttttaaaaaattctcttctttatttgatagacccaggtatcagtgctctcgcccaataaaacacccataccccccaccccatgtgtctcacacatacacacacacacacacacaatatctagatccatcttcatttcttgttgacctggacagtaccaataacacactggttcaccttggaggcaaagtgtagggagttgagggacttggagacattctcttctaggggagaaatgttcacaaacatgagtatcttagcactgccgcccagagagttctgccccaggtaagtgagcttgctgttacagtaaggcccatggggctccttgttgctcaaggccatggtgaccagccccagcgtggacaggctgctgttaatggcctgtgtttccacagaaggtgttcctgctccccagggccgagggatacgccagggtctagctgctcgctcccagccaagtccacaaggctgaggggggctacgcactgcaggcctcggccagcatgctccccagagatctgcagctggaacacactgtgactacatgacgagcgctcattctgggctctacgaatgacagcccagttctggtaggctagtctctttctcacaggagactggaacatagcgcatattggtgacattaagctcctcgttgcctgtccctgcctggcgaatcacacattcacctccctggcccttccgggtcccagtggccagtaggtctcagacagtcttgttgtagatctctaagtaacttgccacaaaactgtaggtccagccctggccacttagttcctgggccacaggaaagaggtgcccgcagggcccaagggatcagccccttcatctgggggtctcccctaggccca

SEQ ID NO: 29914 - DNA, 1416 bp, Bovine  19866881318994
accccaggtcccggaatgccgcatgccctagggcaactgagcccagggaccaccacttcggtgcctacacggtgcctacacactaccgtgccgcggagcctgtgctctgcaatgagcagccatgctcacaactaaagagaagccgagcgcagcgaggacacaaagaccaagacaaggtctgggcagctgagtggggacatcaatcgagtgtgaaaaatgaccaacagggcccggtgtgaaagcatattccctatcagagtttccagaaaaacgcaaagaaccacaagacggaagccgttaactgtataaactatttattaacacaaagcccacacattatttcttcttggacacacccacagtgcgaccacggcggcctgtggtcttggtgtgctggcctcggacacggagtctgcagggagaaaagacaaaggttactcaccatatcaagcaaatctgggaaaagacggggcatgagagtcccctgggagtctaaggacagacaaatgggcccccactcacccccagaagtggcgcagccccctgtgggcccgaatcttcttcaggcgctccaggtcttcacggagtttgttgtctagaccgttggccaggacctgcacagacgggggacagtgagggatggctgttctccgccctggtctcctaggtccagtcccaactggacagcctgcttttctttctgctctcccctctccacacacacctggctgtatttcccgtccttcacgtccttctgtctgtttaagaaccagtctgggatcttgtattggcgtggattctgcataatggtgatcacacgttccacctggcaggcaggacaagggtcaggtccagacagcccccatctccaggcaggcccaggcccagccccagccccgatccctgtcctcacctcatcctcggtgagctccccggccctcttggtgaggtcgatgtctgctttcctcaacaccacatgagcatatcttcgccccacaccctgaggagaggttttagagttgtgtgagtctgaccttttgggttgctcatgattcaaaaagcacacaaaagtagggtccaaaataacatactcttccagatacaaagcctaatcattaaagggaaaaaaaggttttgatatcccctgaaagctgtagcacccgagtggcaccttctgatttctacacagtggagacgaaattgatgcttctcagtcaatggagcaccagagcaacaagatcaaggttctctgaattaacggttgagttgaattaactgaattaactgaattaacatggtcagttgctcgtgatgtcaaagggccataggccatgatcctttgggcaggtcactaaatccctgtgatcaaaataaacactgagaccagtggcattcctgtcaccaccaacactggtg

SEQ ID NO: 29915 - DNA, 962 bp, Bovine  19866881321046
atcttccccggccacgcggtgggactccgtctggattcgggattcgttggaggccaggaactccaccgcccggtcccacactcgcttcatgcgcctcctgcagagagggggaggggaagctcatgaggccagagggcccatggctgccaagggaggtgggctgtggatgccctctgtaccaaagcagggagctcacccagaatttatctatctgcgggaagagtggtcaggtgctaacagggctcttgcagaggagagaaatttcgtgagcccagagaaaggcttcctcaacctcctctgctccaaaagctttcagttaaagggagctgaaaggagctgcagctccccgccccccaccccaggtgtccaagtgggaagactcttgctaggacttgatactgcagcaggcccgccgcccccctccagtgagggatgcattttaatgtctcgtgtgggccaattagacagtgaccactgggctgttgagtccagactccacagcacttcaggggatggggctgaactaagcctccagcgggggaggcctggacgctggagctgcctgtggaaacagagccactaggtcgggcagtctttgcagtgatcagagtccctgctctttggggtccccggggccctgcaccccctcagacagcctcctagtttctctttgctcctctagaccagacaggaagatcccagggcggtgggggagggctgctctgatgtctaccctttggtgagacccagcctcatgtctgactgcagaccactccccagcaccccaagcatgcaatgaatgttggggggtgtgtggagcagggggttcagcggggagcgcggatggagggaagctccggaggtggctcctgactcaggaggcagagtggggtctcggggctttcttcccggggaggtcaggtccaaaccccaggctgttcagcagtcctcacttggctggt

SEQ ID NO: 29916 - DNA, 718 bp, Bovine  19866881348693
tttatgttggtcacctgcctcattttagagaagatgagcttgaagcctggctttcccaaggtcatgcaacaaaagagtgacaggtctgggatcagaatccatgtccctgaagacccaggcccagtgcgccttctcctgccacttggttgagtcggaagaacaccagatttgcagttaggaacacttaggtttacatgtatgatgtgccatgtattgtgtgaacttggacaaactgttttaatgaactgcctcaaaatcaatatctttaaaaacgggggtcaagagctcacagggtggttataaatactggaatgaatgttaaagcacgcttggcatgttttttagtatgtagaaggccttctgtttaaatgttagttttctgctaatttctctgtccacctcttttacttcttggagtagtcatctgttctttcataactcctgtgtctagactgccacaaatatgccgtggtttcaagtgacttcccaaatttctataaatatcttctgagttaggccaggagaccccgatatggccctaaggacactttggaatctcctcacggctggctactgactctccatttttctctcctccttccccctcccccttagctgtacaggaggagcgtcagcgggggaaagacaaagacggggatggggaggggtgctgggggagcccccgaggagatgcctgtggacaggatcctggaggcag

SEQ ID NO: 29917 - DNA, 1446 bp, Bovine  19866881363019
ctatgagacacttggggatcttagcttgccagccagggatggaacctgcccccccctgcattggaaggcaaagtcttaaccactggaccagggaaccctctgggcctgcacttcctgccagacaattggcatggccccatccacatccttgaattccatagatttactactcctccctcctgggacctgagggttcttgagctagcagtgatctcaatagggggaaaacgaaaatggaaattaaggataggtggttataatctgacaattttaaggaaaaaaatgtaaatgcaattaaaaaaagaacgtgcataaatgtataatggaacggtgtacagcagaaaccaatgcaacattgtaaaacaaatgtacttcagtttgaaaaaatacaattttgaaaatgtgcatgcatatagtcgtcaccattactaagcacagactctgaaaagtaagttttatgaagcctatttaaaatgaaatcaaattgaggttcacagtaattaagccacttgccagggccaaaagatagcctgatggtatgtgttcagtcacttcagttgtgtccaactctttgcaaccctctggactgtaacctgccatgctcctctgttcatgggattctccaggcaggaatattggagtgggtaaccatgccctcctccagggaatcttcccaacccagggatcaaacctgtgtctcctgtgtttcctgccttgcaggcagattctttacccactgagccatcacaccagttgctaaatattgaaatgcttcttatctggttggtaagagctgccgccccaagctggccccccacctcatccccaccccgacagcttccccaggcctccccgacagcttccccaggcctccccgacagcttccccaggcctccccgacagcttctccaggcctccccgacatccatgctccttgttcacatcggtgctgtggttcacaagccaagctcctgaggctagcactgaccgtcaggcagctctgggtggcagagcttcaggtcctggcaggtgcgagcagggctgtcctgggtccccatgggccgcctcatttgctcgatctcctcccgcagggagtccagggagccaaagatctcctccaggcccccaggactacccggggcacccccagttggcacagcttcatcttcctgcatcaggcggcttccgtccactgagcgccgcgtcttcttgggcatctggatgggcaggggctggatcacctctcccgggggtccctgggtgagagatgaggtcaaggtgagggagacgcggagaaatacccagacagagaggggccaacagaaacgcgggccctgcctcgtgactcaccgggtgtcccggagggccctggacgcccttctctcccttaggtccggccgggccctgccaaaggaggcaatgaggtcaggaggggtcaagaggtca

SEQ ID NO: 29918 - DNA, 990 bp, Bovine  19866881449604
taaaataagatgctcattgtgatttttttaagttattacacatatcatgacattttgcccctaaattcttgagtatttatcttataaaaatagatatttcctacttaaccacaacttccttatcactaataaaataataattctttgcaccatctaatactaaatctatattcatatttctccaactgtctaaaaagatcagtaaggatttaggtaaacctgaacaggagtcgactgtatcctggggggtttgttcaagtcagctttattctcagatgatagttcacctgggtgtaatggtgtaagttgccggatattccctccaggacctaggaaggcagcagtgccctgtgttcttgtttctatagttgctgttgagaaatttgctatttgtcctggattcattgcttgtggaacacacgttttctttcttgtttcttttaaaatatccccccatccccccgtctttgagttctttagtttctttctgatgtatctgggtgaggatttagtgtatcttgagacttatttcctgagactgagagagaattcttgtgcaaaaccagttctggatgatgatcaatcatgatctgttctcatcatctcattatctgttttaagagcctaaaatagtgctggcacgtattaggtgcttataaatagttgttgaatgcatttgtaaataagtgagcatttttctccactccccctcattctctctattctctcctgctcaaaattttttcagatatttgttagaacatttcattctatctaccatgcctcttcctctcctttacacatttttcatctctttatctttcttgtctacattttagatacttttgtcagatttatcttctagtgcccaattctaacctcagctacttctaacctgtttaacccatccattgagtttatatttatatattgaattatattagttatttgtaatcattgatacctagttaatctttttataatattctg

SEQ ID NO: 29919 - DNA, 1157 bp, Bovine  19866881451711
aaaaatgaggttcagcacgatgatgatgacgatgaagaagaacaggaggtcgtagaccactcgggcgggaaagagagactcctgcaggagggaggcagggaagctgggcccagcagctcccagaagggcgtggaggccccgaagacagtggagaggacccgcctcactagagtcagaatcaccgccagagcacgtgcagggacggggactcagcggctgggaagaggccctcgaggaggagtctggcatggggggccaggcctcggctgtgcccacccctgaccgctggggaggggacgagtggctctgaactcctctgctgccctcaggacacgtgatctcactcattctaggggacccctggccaaggagcagcttcttacccttgtgccactggggacagactgatcccgggaacgcgtggctgcctgcacacgctgcgccaagccccgaggcctcttccccacccggccaccctggctgcaggccggggcccggggcccagggcccgcccgctgtctgactcacggctttcccagcctgagaaagctgggtgccaaggtcttccctcagagcacccaccacgagctagagggcacccactgtgagctagagggctcgtctgggctgacggggcccggaaggtagcacagctaccccgtaaccgcctgggatcagagggcacaccgcggggtggggacgtgaagtggggggactcgctcccctgaacatgggggagactgagctgccctgctggccgggacctgggggcggggccgaggcactcacgtctttggagggcttgcggaggatgtcccccacgccaccgccgttgcgcagcccgtggttcatgacggtgacgatgcacatgagcagggtgtcacaggcccgctccgtgctgtctggctcctcgtcctctacaagtggagcacgtgctcagacccggccaggagtctgctcccaccctcactgcagcccactcctgagacacactgccctcacctgccaggacctcaggcacagagactcctgagacacagtccacgttgtccccactgcacgtgttcacaaatgtggcagctccatgtggcatccccagggggttggctggaggggacagggtcaaggacaggaggtccaaggactggcttcatcat

SEQ ID NO: 29920 - DNA, 658 bp, Bovine  19866881624874
tggcctggtggtcggcaggggcccacgacgggccagggtacattcaccatctgtgtttacagatgaggcagagggagctggagcgacttgtctaaggtcacccaaccggatgacggatgacggtgctctagatcaggagccccacccccctacccctgcagctctggggcagctcaggcctggccctccctcgggatgtgccctcctcttttccagcaactcctcgaaggcaggagcctctgccctgcgtcccttgggtctggcacagggatgcctgtggcctttcttctaacagtggccctggggtttctggagggctggcggttctgagatgcagaccctgaggctggcaatgagcgccccgaggcccgggaccaggccaaagccgctgccgctggggagtagctcgcattgcgggctgggtctggatctcccctcctaggccttgcaggaggccccccactgtgggcgggtacaggcagaggcccccgggctccacagcgctcagtgagcccatggagccagcaggggaggccgcccacatcccaggaggctggcagcttgagaaatcaccctcaacaaccccaggaggccccttccctcacctccctggggagtaaggcatgcagctgggaggctgccagcaagggtggtctgg

SEQ ID NO: 29921 - DNA, 1169 bp, Bovine  19866881747940
aattctactttcctatattttacagtttttctctaagacttttattataagaaaaatatattttattttatcataaaactaaatgaggagttgggactgacttaggactgatttctcctctggactctcagggtcctacatcatgttctaagtgtaggtataggatttcaagtgggaccatatgctttttaaaaatttgattggtggatgtttaaaattttttttggggggggtcagaaaacgccaggtatttttacattttattagctacagtatagacgctagagctgcctcatttcttcccctcccccacccccaggacagtgccaggccttcccaggagccctgcctctgctgcctgggcagtctgaaactcctgttgcagctgagcaaaggtctccctctgttgttctgactgacgctctagatcccggagctgggattcatatcacttaatctcagctgtgatgtagtccagccttttacccactgtggcccgagattcccccagctcctgtttgaccagtatgggccccagaagtttaaacaccacattggacccatccagtagagccagttcctccttcatgatattattttctgttagttgtacctctagtttctgcctccctgacacggatttactcaagtccttctgcagctgttgatatttctccacttctccctgtagcttcttctggattagctcagccatggcggggatgaaagtgttctcccttcagtactggtaaaccctatttttttaattttaaggaaatatagatgatttacaatgtcttgttagttttagatatacatcaaagtaattcagttgtttacacatataagtacctattcttttttagattcttttcccttataggttattacaaaatattgaatttagttccctattcaagaccatatgcttttgatgaatattaatgattatttcaagtcagaagaaataccattagtcattatagtcaagctttatgaacagtaaaaaagctttttcagtttggtctcagaagttagttcattttatccttcttcctttcttttcctccctttcctcccacctttccagtctttgaggaatttaatgggtctagttctaggaggtagacttgatatttaaatagccgtcttactttaagccattaggt

SEQ ID NO: 29922 - DNA, 1252 bp, Bovine  19866881843230
ggcaggaccctggtcattagattttccatgacacgtccctgggaagtaatttggccatgggtgtggcagcaggcttcccccacatgactgcttttctagaggccttcctgggctgggcccgagcgcgttcaccccacgggggatgtttttcagaacaagaacctggactggttcccccggatgcgggccatgtccctggtgagcagcgagggggaaggggagcagaacgagatccgcatcctccaggacaagctcagcgccaccatgaagctggtgtcccacctcaccgcccagctcagcgagctcaaggagcaggtgcgccccccacgtcctggcccccgctggcagccccggctgtggctgaggttccagcctgcctgcctgggggcggggagggtggtggggcctttctgcttcctctgcccccttcctgctggtcctcctcttgggtctggggtggaagacgggtcccttggagagctggatggaggagagacgaggcggcccctacccccatgccccggaagggcagacgggcagggctgagtgcgacctcgtgcacgtgtggggcctccctcgcgcgccccctcacctccaccctgcagctgctagactctggcccaggcgctgacgggttagggtgatggggaagttagggcctccttccgcttctcaacacgcgctgttgcccagagtgtcctctgcgccatctggcagtgactaaatacggtcagcagcccctcttttaggtggggcgctctcccagctgcaacaaatcagtggtttgcgacacgctaattgaggaccagggtttggggctgacggccctgctgcaccctgggggtccttggccagctgccagggccgaacggcagtgggggcagcagggagggtgggctctgggcggcctgacccaaccgctggcatctgtttaaacccagatgacggagcagaggaaacgcaggcagcgcctgggctttgtggatgtgcagaactgcatgagccgctgagccgccgtggcaggcccactggccacagggacgctggagtgctgaggctggggagactggccaccccttcaggctgggcgcccgcccaaccgccagaacccactcggccagaccccccaggccaggctggaggagaagctacagagcggacagccctgcccagaccaagcccctagaagactcagacgcttgacgggactcgctcaccctagtgccttaaaggaagtccatcctctcacagg

SEQ ID NO: 29923 - DNA, 746 bp, Bovine  19866881899741
ggtgatgaaggagaagaaagagatgcgccgcctcccccccgacttccctcactgccactcacaggtggggctcttctctgcagaggaccagctcagatgccccaaggctggacccgaatggggtgccacggggtgcctgggtgatgtgggctgtgcccaaaggagcaggaatgtgaggatgaaataaatgcacgcagctgccctgtttcaagcgtgaaggggcagggagaggccacgaagcaggggctgtgcaagcgtcagcccacggccatttctggcaggctccatgggctctggctcgttccagagtaggatctgtgtcaggccagtccccagagcgctttctagagagaggagctggggaagggggcaggttgaccactgccattaaactgtggttcgaaaggacatcgcaccatgtccacccctccccctctgcaggcaccatcaccgtgcacctccagaaggacagctgcggccgtctcagcctggttgccaaccccctgactgagaaccgggggcccttcacggtctccacggagtcggcagcggtggccatatggcagaccctccagcagaccactggcggtagcgccctccccctcgcccagtggcagcacccccagcgggcacactcgctcaaggagaggtgagaccacgtggcaggatgccggaagccaggctgcgcgtccctagcggggaccagcaccgttcacgcccgtgccaaggccaacggctcccctttg

SEQ ID NO: 29924 - DNA, 754 bp, Bovine  19866881959457
tacacgctgcagaggagagcctccccctccggtcctgtctttccagcaatcggcaaaaccaagggggagatccacaacgatcagctgactgggtcaaatgcctgcccctggctgccagtttaatgaaccacctttctttctcaaggtctttataaatgattcgggggtgtcagtgggagtgactcaatgctgttctcaattccagcaagggactgctccttctaaaaattaccgcaaagatttattaagcctgggagcattctcaggcgacagaaggatgagggaccacgacagtggtcctgagtaatgtgcctgctgccaccatgatgcaccggttcactctaccagggacgcattcatcagcagctcgggaaccatcaactgagccatgagtccatctgcagccatgactccaactctgtgtgggccttctactcttcagaaccgtctccctaagtgatgacaagggatgacaactccaaaagagaaagctcaatcctccttttctggctcttcttaaacagtcaagtaggtgaatctcaccttcccagggtccaacctctggcagcttctctgctggctggtttcaccactcgaatttcatcagagttaattcaggtgcctgcccaactgtaacctccctggtggtaaggaccaggttctgtccctcttctgccattcctgcagttccccacagagtgagctctcaaattaattctcacctctcaggacacagaaatactcccatctcact

SEQ ID NO: 29925 - DNA, 729 bp, Bovine  19866882062387
gagagcccctccttgtgacccgtgactcatcccacatttccggcgcacccataggtggggaacatgggacagacaaactatgcagcatccaaggctggagtgattgggctgacccagtctgcagcccgggaacttggacggttggtcagacgcctgggggcatgtgaaaagtcagaggaaggggtcagtgttcagtcctttctggagtcagcagacactctcctttccacagacacgggatccgctgtaacagtgtcctcccaggattcattagaacacccatgacccagaaagtgccacagaaagtgctggacaaggtaggagactgtgggtggagggcagaaccattcggagaccagcctctctgggcttcagagagaggatgctgggcccagtgcaaggcaaacagcagatagtcaacaactgcacagggaatgaagaccgccccccgcccccccccaaaatcacaccttttcctacagaaaacccacaaaagaaactttcactcacacatgagtgtttccttacaggttactggaatgatcccaatggcacatatggggaaccctgagggtgagcactgaatgaagataccaaagtctgtggtatctgagggggggggtctcaccaagattggtagtggggggttagggaggattctggtgggaggtgacagctactttgggtctggagtgaggattctgcccactcccctccactcccatagat

SEQ ID NO: 29926 - DNA, 2015 bp, Bovine  19866880391949
agctcacatgagcatgtgtgtgatttgtcttgcttgtaggaaaccatagttatctgtgctctccaaataacgctggacctttagattcctcacatgggaaataaatctgtggttggcccaaaagggaatgcaaaaagctgaaacagaaatgaaagagtatgtatttttggctgggcaagaaattagaccccgtgctgaaagtttcaagtagcttctgccaacagggtactagtggaagtaaaactagcatttggtagtagcagatgggttacatctcacgtgccaattattcttcatggctgcctggtacactgtataagatagcttgtgagaacttctggggaaagaataactgcagtggcatgggagatatgagtgatggcacaagtgctgtgcatttacctctctgatctaggtctgaaagacaaacagagtgagtttcaggaatgggaagtgaagttgacaactggatagtaaatacatttaaggctgagagagaaatattactagatttaagtgaaatattccatcaagcctgttagcaaaccagtattatgtgcatatgtctatcttagcattaccgcattatagcaactcctttatttatgagtttgtctctctaactggaatagaagtttccagaaggaagacccactattaccctttgtgcattataaagtgttatgtatgttcagttcagttcagttcagtcgctcagtcgtgtccgactctttgtgaccccatgacttgcagcatgccaggcctccctgtccatcaccgtctcccggagttcactcaaactcatgtccatcgagtcggtgatgccatccagccatctcatcctctgtcatccccttttcctcttgcccccaatccctcccagcatcagagtcttttctaatgagtcaactcttcgcatgaggcggccaaagtactggactttcagctttggcatcagtcattccaaagaaaacccagggttgatctcctttagaatggactggttggatctccttgtggtccaagggactctcaagagtcttctccaacaccacagttcaaaagcatcaattcttcggcgctcagctttcttcacagttcaactctcacatccaaacatgaccactggaaaaaccatagccttgactagatgggccttttttggcaaagtaatgtctctgcttttcaatatgctatctagattagtcataacttttcttccaaggagtaagcatcttttaatctcatggctgaagtcaccatctgcagtgattttggagcccccaaaaataaatattttggaaagttatatatttattttaagtttagattatgattatatttaaataaagcattttgactatttttctgatattatcataaggcagaatgactgcaacaacatcttttgattccatctatttacaatgaagactttagcactcatttctttaacctcttatcttgactccaattatttgttaagaggagaatttagtattagatctgtgtttttaaatgactagtttttatattatataaattttcttttgtgcatattgtttcttcacatttgcattcattttttggaaacaatacttccatatttggcttcttaacacaacatcagccagaagaattctagtgtggtgatgggctgggtgcaccaggagagccagttagtacccccttgggatattttaagagaaaagcctgtaacaaggtactggaagacatatctctgtaggcagtctcctagatttccccctaataatgtgtgtgcctaactgaagagaagttactataacagatccttttatttcagtatttcagcatccctaattgtggtgtcagaaagaatcttagaagcacagagataaatgggagactaatgtgaagggaagctgattaaaaacattcagtgaattgagtttggaacgttttttatttgctacaaaagcacaaagtggcagactgacttccaggagcaaatccttgctcaaatataaactcaa

SEQ ID NO: 29927 - DNA, 1445 bp, Bovine  19866880478084
ttgatgaactccttttcctatttggaaccggtctgttgttccatgtccagttctaactgttgcttcctgacctgcatacaaatttctcaagaggcagatcaagtggtctggtattcccatctctttcagaattttccacaatttattgtgatccacacagtagatattaatgaatttaatgtcagaaaaatcttaaaactataagattcaaagaaagcaataattatacatcacagtgtatgtagaaaagacacctgaaaatattcaaaattcattctttaaggaaatattcagcaaagtaattttagaagggaacatcgttagcttctttaatttcttttttttttttttttttttacaggttttccatgacctaaagagaatattcaagtcaaaagagagaaatttaataaagaagtaacagaaaatccaaaaacccagttaggtgaaagtgttcaattttactaattgtttaagaacaataaattatttttataatggacatcactttacatgctgattcaataattggcaaatgtcgaaaagtctgacaatataattttggaaactatgtcatgagcaaggagcactcatgattttttgagagatatttaacaaaatataatacaatctaagatgatcaaactctgtaattcaggaattccctttattacttcttagaaaattacacttatgtgcacagagaaagttgcaatttgcagaattatgcctgtagacatgaaattagattccagatatataaataatagcttatctgcaaaacgataatacaccatttatgattaactatttagcaaaatacacaccaaaatcataaactttgaatttatggtagaagttaactttcagataagaaagaaggaaatgagattaggcagaaaattatggggacctcaattatctctgccacattttaattcttagaagacctgcaataaatatcacataacaacaagtgttggtagagccaagaatgtaaaggagtagttgttatgttattcattaatctttactacatcatttgaaatatttcacaataaagaatttttattttaataaaaatgtttatttgtatgaatgttatatatactcagggggtggagtaaggtatcttccagaaaatggtgcttgtaaacatttgcactgacagattgctattttggagaaatcctagtggatagctacttcaatgccaaaaatagcactagcagatgtatctacagctggaccaaaaaagctacacatgtggtacagtcacatttggcaatgagaaagaacttttggagtctgcattggctccctttttctgtttgtttattttaattcttttttttttttttctggttgggtaacaaggcagagaaaccctagagtcctctcccaatatggagcatgtacagagaagacagcaatgagagtgagga

SEQ ID NO: 29928 - DNA, 3189 bp, Bovine  19866880552479
cagagacatactttgctgacaaggtccatatagtaaaagctacggtttttccagtagtcatgtatggatgtgagaggtggaccatgaagaaggctgagtgttcaattgatgcttttgaactgtggtgttggagaagactcttgagagtcccttgaactgcaaggagatccaaccagtcaatcctaaaggaaatcaaccctgaatattcattggaaggactgacacagaagctgaagctccaatactttggccacctgatatgaagagccaactcattggaaataagaccctgattctgggaaagactgaaggtaaaaggagaatggggtgacagaggatgagatggttagatagcatcactgactcaatggacatgagtttgtacaaacttcaggagatggtgaaggacagggaagtctgtcgtgctgcagcctaatggggttgtaaagaatcagacatgattgagcgactgaacaacaacaacaaattagaatgaagaaaaaacccgttgttaaattcaaatggcaaaaatcattctttgaaagagaagatagtataaacattcgtaacttggatcccaaacctaaagttatattcaccaagactgaaagcatgtgggagacattgttgaaggaatagtaaaggtatgttaaatttgataattgattattcacttcactttgataattagaaaatgtaaatctgaagaaaaatttagtaactagataattactagtgaaactaaaaacagggtagacaccttctgaatctgggagaatttaaattttatgaaccctatcagtgtagcacaaaaaggagaaaaacaaggaaacgttttaaatgctttgattaagataaaagaagttaggactaaatatatcagtaacgacaaaataccataaatgtgctcatgttccctattaaaaaaacaaaactcccacattgggttaaaatgcatcaatacacttcttgtaaagagatacatctaaagcaaaaaaacataaaattttatcttatcctttatcaagcatagagaaattaaaagtaagatatgataacttggggcaaactaaccttccaacatgccaaaagcataaagtggaataaagaaggtcattttttatttagtaaaaagtacactcaattttgaaatctaatggtcataaaaatttatttgtctgataatagaatcaaaatttatactgtgaaaaacggtatagtgttagtagtagtagcagtgttagtcactcagtcatgcccgactctttgcgaccccatggactacagcccaccagacccctctgtccatgggattctccaggcaaggatacaggagtgggtttccatttccttctccaggaaatctatccaacacaggaatcaaacctgggtctccctgcactgcaggcagattctttaccaactgagccatcagtgaacagccggtgaaaaactgtatagatgtagtatattctgagaataaatatatataagaaacttacagaaagacagttattgagaggctttaaaatatttggagcttccctggtggctcagagggtaaagcatctgcctgcaatgcaggagacccgggtttgatccctgggttgggaagatcccctggagaaggaaatggcagcccactccagtattcttgcctggagaatcgcatggatggaggagcctggtgggctacagtccatggggtcgagaagagtctaacatgactgagcaacttcgctttcacttttcactttcatgcattggagaaggaaatggcaacccactccagtgttcttgcctgaagaatcccagggacgggggagcctggtgggctgccatctatggggtcgcacagagtcggacatgactgaagcgacttagcaacagcagcagcagcagggggaataaagtcagagaccttctattctgccatcttgctgacatcaccctaattgcagttttcaacttttaatagtgttttcttccaccagtgtaattgcttgatgctggtttgtgtgatgtttgaatatataattttaccataagtttgaatatatttcctcaacaatttaacattttaatcactgacatgagttataaatgtatagtacaataaaatagaataagatgaatcttgacaactaaaaaaattatcactgtaacattataatcaaagagaccataaagtttcttagagaaatggtatactcattaaaagctcttaattaactagcttccttcaggtgacattcttgcacactaatttagaacagtatacaaatgacaaagatgccactggaacactgggaaggttatctgatgaatgcccaaccaaataaagtactgtatgaatcatttaattggatatgttgcacaaacaactaagttttttgtttttttttccccactttttgttgtcaggtacagaggtgacttttcttgctgttctgttattattttaatagtgtatggaaggatcgatttaaaattgaacagtcacctctaaaatgctaattccccttagtcctcaaagcaattttgaatgtgagaaattacattatttttctctgtttgtcatttattttattcattgcttttcacctcatttttaaaaataatgtatctagtcattacatcttgcttctgaaatataattgtttacaaatctgattaatttcaaaaatattattaaaaaagaggatgaaaaaatatggtgataattggcagaaatttctttttaagtggcaatagctgatttgaaatgatagtacagtgtgcagagacaagatttatttgttctgaatatgatttccatcaagttaatatataactaagtaagtaacatctacttcatcagtcccagcaaggataaaagttgtgtctaagaggtttttttttcctacagaaaaatcttattttctatcaaattacattaaaaatcagtcctttcactccaagtaactgtctctgatagactgaattaaatattatgatattaaaaatcagtatcatattatattagatttggaaatgttaaataaaatacatagtttccctttatttaaaagataaacatgctatagtaagtatccctgatgattttgagacaggagatagagggaccccaggttaagcagctggagttcattcccaagaacagaaacttcaaaatatcaatatcaggat

SEQ ID NO: 29929 - DNA, 2659 bp, Bovine  19866880628714
cctttgactgtgtagatcacaacaaactgtgaaaagttcttaaagagacgggaataccagaccacctgacctgcctcctgagaaatctgtatgcaggtcaagaagcaacagttagaagaggagatggaacatccgactggttccaaattgggaaaggagtatgtcaaggctgtatattgtcactctgcttatttaacttatatgcagagtacatcattcaaaatgctgggctgggtgaagcacaagttggaatcaagattgcggggatggacaaggagacaacccggggcctcaggctgctgagcagggtacagacacagctgtgccttcggattcaggcaagaagcttcctgaagtggacattgattgattccaacaattgtttatattaaaacagactattataaagctaaaaaaaaaaagattgcagggagaaatatcaacaacctcagatacacaggtgacaccacccttatggcagaaagtgaagaagaactaaagagcctcttgacgaaagtgaaagaggagactgaaaaagttggcttagagctcaacattcagaaaactaagatcatggcatctgatcccatcacttcatggcaagtagatggagaaacagtggaaacagtgaatgactttatttttttggactccaaaatcactgcagatggtgattgcagccatgaaattagaagacacttactccttggaaggaaagtcatgactagcctagacagcatgttgaaaagcagagacgaacaaaggtctgtctagtcagggctatggtttttccagtggtcatcatggatgtgagagttggactataaagaaagctgaacgccgaagaattgatgcttttgaactctggtgttgggagaagactcttggagagtcccttggcctgcaaggagatcctacccagtccttgctaaaggagatcagtcctgaatattcatgggaaggactggtgctgaagctaaaactccaaatattttggccacctgatgggaagaactgacttcattggaaaggaccctgatgctgggaaagactgaaggcaggaggagaagtggacgacagttgatgagatgattggatggcatcaccaatttggacatgagtttgagcaagttttgggagctcatgatggacagagaagcctgatgggctacagttcatggggccataaagagttagacatgattgagagactgaactgaactgacaacaattcttctcaacgttgcctggatttcctacatcagggaaagacattcctctcgatctttctggttatataaaaaatctgcttttcgtccttccttctttccatccttccctctcccttaagcacaacaaaaccttcatctagtcaaacaccatatcctgttggttctctcttcttaacatctgctaaggctcttgcaaattgggctgctctcatttcttatttgtattatttttgtagtataattattaatatcatgtctttccaacccaagcttccacattacaatctccacaatccagccaaactgagatttatgaaacaaaaatctaactgcttcatattcatgtcaccatagcttatgaacaaatcccaatgtgctttttgacataccacattaaacaagtcatgatgaatacactttatcaccctagcttcatctctcagcctcttccccttcagttctgctgaactttctggaatccttcagatgcatattctgcatctttgcaaataatttttctttttgaataaatccatcataattccttcttcatcagaataatccaattcattcttatgatctcagtagatgtcatttcctcctagaagagtttttgaaacttttcaaactagtttaagtgcccattctgtgcaagttattgtttattctttcatcttctcttcaagaccacactttccttgtggggtgggactgtgtcttcagaactatgtgtgtatccttatttctctaggaagagtgcgatttaaaaaaaaaaagctgttgagtgaatgaaaaatgattacattaattaattcttgctggatagtgagtaagcaataaaccaatccaaatatgggggagaaaacattttaaagtaatatttggcataaggggagtgcgaaatgaaaacaaggatgtgatcataaatcttatactaactgaatcaaaccattagcgttctcacttgccaccagccaaaatacacagcaacagccacagctgccttttctttgaaatacaaaaataagaacagttttcactgcactggtttactgtactaacaattatcaataattgggaatatcaggttataaacaagcaagctaggtgattatattaaaacacataaacaaatcttaaagcaagataacagttgaattaaaaacattccttagtatagtgagtctggacagccaggaactgagtagggtccttggctaaggtgtttagatctgagtagtttatgcctaaaaggatactgtataaggaaacactataagacctaagttcctttcaggataatagggatcttatcagggctctgaaactctctgctcacatgatgttaactaagtcattctcattttttaggttagtaataacatcccttcttccaattacctaaggatgttgggaagtttcaagtg

SEQ ID NO: 29930 - DNA, 1380 bp, Bovine  19866880858250
ttgagaaattaaggggaaaactaccatatgatgatctctatcgatacagaaaatatttttgatgtttaaatacctgttcactgtaataatgattaactcttagcaaactagaaatagaaaaattttagcctgataggaattatctattaaagaccttcaataaacataaaagtttgataaaattatagacatgtttttttttaattgaaacaagacaaagatacctgctattaccacttcttcccagcattgtactggagatcctttctatgcagttaaaaaaaacaaaaacaaaaaacggtatggattagggactaatatagtggtccagtggctaaaacttagagcttccaatgcagggggcctgggttcaatacctggtcaggggactagatcacacatgctgaaacttagagtttggaaactgcaactaagagttcacatgctgcaacatgtgtgccacaattcagacccagtatagccaaattttaaaatatatatatatatttttttaaacacgataaaaaaatatggattagaaagaagtaaataaagctcattctttttaagtgatgttattgtaaatacatggataaggcaatgacaccccactccagtacttttgcctgggaaatcccatggaccgaggagcctggtgggctgcagtctatggggtcacgaagagtcagacacaagggagcgacttcactttcacttttcactttcatgcattggaaaaagaaatggcaattcactccagtgttcttgcctggagaatcccagggacagcgaaagcctggtgggctgccgtctatggggtagcacagagttggacacgactgaagcgacttagcaacagcagaagcagcagcagggaaattgctccatcaattacacattctttttacagacttttcaatcatttgcctctcacttgacttcttcctttttgctttcaaaatgtgttttttctaaagttgaaaacaattcaaaccagtcaactaaacaagcaataaacaagcaacaagaagaagtaactctttatttcatcctgtgattctctttattttctttcatggccaaattgtagaatgtgttgaattttgagctttgtcgtctgtataattttgttcatggctaatttaatagtcagcatccagaatccgcctgcagtgcaggagaccccagttctattcctaggccggtaagatcccctggagaagggataggctacccattccaatattcttggacttccctggtggttcagctggtaaagaatctgcctacagtgcaggagatctaggtttgatccctggattgggaagataccctggagaagggaacagctactcactgagcaactttcactttctagaa

SEQ ID NO: 29931 - DNA, 1306 bp, Bovine  19866880885133
caatgtaaaggtagtattagatacatttaataagtttagtaataaaaatacagaacttaagaatcaaaagtctctgattaaaattggtcctcagttcttcctgaataaacgtaaacatctagaagagcttttagataattgtaagacttggccattggcctcccttctctcctccagaaattgggatttaaatagttgagcctttttcagtgttctccacaggcctttatactatgcacccaagtttgagaacaactgccttcagacattgctccacaactctgaattgtgttatttctcctcaatattttaacctctgtcaaattcgatctgagcatctatgccaggttggagataattttcatagaatttttcacactttgctatagcactatgcttcttatatgaatctgtctctaggattcttgtaagcatatggtacataagacagatgaacagaaatactccttgatttctatggaaatttagagattctgaaaatatatcatttatgacatataatatattaagaattccctcaacttataaatactagtgatttgtgatcctgttggacttcatttattttgcaaatgtttagctattcctttccatgattcagatgtgacttcaaactctgcttgaagggaagaaaatgcatagctgcagtgttttattgcagtaacaaagccattcaacagagtgattgcctttctgtattacttattattatatactactatatatacatatatatatatgaattttctgctattgaataagaaaacatctttcttttgttgtgtgttcccacatatcatgtatcctgataataataaatctgtttctctcaatattcttctgtgaattgatttagttttatgtagcaggacatttaaacagcctttttaattcagatagcatgtatcattaaaattgtaattgaaataacaagtccgtgagaccccttaagatttcaacaccatgtttacagggtacagagctatcaaattaagactgaaaatttttctttttccttggggatgctgtttgcaaatgtaaattttcatgtcagtatttaaacatattggtgttaataaaaatgaaaaagctgattttttctattaactattatgcctattcataaagctgtaaacaattatttatgtgacacacccatgtgaattgtcaagtgcaataacccttccaaaactggggtttgaaactgccaggagttccttgaaatggcaaagtgtttttaagcaaacagagccactaaaagagaagacatattttaataaactat

SEQ ID NO: 29932 - DNA, 1546 bp, Bovine  19866880902765
attccaactgtaggtcatcatactatattcttggacatgctcattttaagtagtaggcagataacgactttccaacataaccaaatacacaagactgcagaaaatgcaagagtcccatgtgcccatatcagtcatgaacaatcatggagtaaggaagaaaatacagtaaaattaatcttgcttagatttccataatttcccttaaaaagacaagcagattatgcagtattttatagtagttttaaattttgacaatgcattctcatttcctcaaaatgtgctgagcaggattattccttttaatagttaataaagaatgagacccttaaatttgtgaacttccttcatagaaaacattcattatagtgagaatgaaactgctttttgttctgcttcacacctccctaattatggaataaaactctgaaatagtctggacccctgtggtaaataacaaagttttagaagtgaagtgaaaacgatgaaaacatttcactccccaaattctgtcagggaacactgggaggatattcacaactaacaaaatgtgtgcatgtttgccaaggttgacattattctgctggtgttttcatagactcataaaatcacatttttaacttgttgacactgattgtccggtctcctacagacatttaataaaaacaaaacatttaaaagcatcggtgtgttcaggtaattctatacattacattcatctttgttaagggtttttcatagagcaatttcaaacttaaggttcatcaaaccaaccatgtgtattttaaatattttacaggtagatggcctcctgtatttataatagttgttggcagacttgcagttcacaacagatgtgggtgataagtgttatgctgacacatgcaatcaatctgcgaaacagtggtgcaaggacaaagggacatgcagtaagtacttggcaatcatggaaaaactattttatcttttagattttgtcacttccttctgctgggaggtaaattggagaataatgatgtgtatggaatggccactaaccttcactgaaatccagttaccaagaattaggataggagtccaggaagttatgctaaggtgtgcaattacatgtgcatatattattatgctcattaatattgactcctcccttttctctgccttattgccaagcctctccacattcttctcctctgtgctaatattttcttttttagtatgcttggcatcctttctggtttgggacatcacagttgcatttagatttccaactacctctcataaaaatgcaaactatcttcttaagaaagtccttaatataatgtacatgtatatacacattcatgtgtgatacaatgtgaataacacttaaagatttgcattcatattttggttgtttaaaatatatatctacagattctttgatgctctcctttttaagcactcttcataattcccctccccttaaatgtagactatgtttaatgattctctcttaacaagtagaatgcagaagaagagagaatgtgtgatgttcaagtttaagacacaa

SEQ ID NO: 29933 - DNA, 1608 bp, Bovine  19866880945674
tttcttatctattcatctgctgatggacatcccagggtgcttcccatgtcctggctattataaacagtgctgcgatgaacattgggggtacatgtgtctctttcaattctggtttccttggtgtgtatgcccagcagtgggattgctgggtcgtatggcagttctatttccagttttttaaggaatctccacactgttctctagaggatacttgtaagagtggcaagtgggcatgcaaaggagctgtgccccaaggatttagtgggttacaattttatagtaaaaggaaagttcaggagaggaaaagttacccttctttgagtagatgtcaggcttacatcacttttctttcacctatatctagtgcttttattcatggctttatagttaagcatgtttactttgttccatgatattctgatagctttcttgagtgatcattaacttatacagtggcctcccaattttcttaggtttctctatctacggtcttctacttcccagggaattcagtggtaaagaatccaccagctaagcaggagacacaggtttgatcccctgggttgagaagatcccctggagaaggaaatagcaacccactccagtattcttgccaggaaaatcccatggccagagaagcctggtgggctacaatgcatggggttgcaaagaattggacatgacttagcgactaaaacaacagcaactgtgacttctacagttacccgtttgactatcctgtgtgctagtgtgctaagtcgcttcagtctcttatgtctcctgaactggcaggctggtactttaccactatcacaacttttctatccctttcacaagggagcccaaaatcaaatagcaaacaaacaaaaacaccaaaaaacacactgtgacagggcaagagagagactgttgcccttgaacaaagaactctgcattcccctttgcactgggatctcactgctaaagtcaattcagtcgtgtccgattctttgcaaccttatgaaccatagtccaccaggcttctctgtccatgggattctctaggctagaatactggagtgggttgccatgctctcctccaagggatcttcccaacccaggaattgaacctgagtctcctgcaatagtaggtgggttctttaccactaatgccacctgggaagccctcatattgtgtagccaggacaattatatttatagagattatgtgaaaatgaaaagagttaataaaaataaagtactgagaatagtgtttggcatttaaccttcaataaatattaattattgctattgatattgtcatcattaaagcaaaagtttgattggaattttcacagaccccacttgttggcattatataggctgcctttttccccttgggttgctttaaataaaggaactcattataaatctgagagaagggatttagattgcaaaaggaattttactttttcttcaatatccaactgtcaggccagctgttttagttgaggctaccaatgggaagctacttaatgaggttgcttatggtttaatgatttgtgtggcataaattatttgtcttaatgttattcctggggcagtttccaatgtttcagaggatacacg

SEQ ID NO: 29934 - DNA, 1279 bp, Bovine  19866881119834
cataaatgaataaacatggtatgttctgataaacccatccacaaaaaaccaaagtggtagagatacttggctggaagctgtagtttgctggcccctggtctagagcatacctatctaggttatctggctctcattctatgggagctattttacaactctttaaattgtagataacttgtagcaatgaaaaataattcttatatgtatatctgaaaaaaatcctgtccagtaaagagatgaataacatttctccaccctcaacagctctaccaccctcctccaaaggaataaaaaaagtttttcctctatttgaatattaatttccataattttgatcaatgaatgtgtctgtttttggattttccttcgaactggttctaataccttacagatttcttcaccgatgagataaaatctgtatacctgttcatttttatatctacacaaaagtcatgattttatttttaaaatcaacacacctgcaatgtgctgttgtattgtaactaagatctatctaaactactcatcccactgttcttgatatgtagcctattgctgctgctactgctaagtcgcttcagtcgtgtccaactctgtgcgaccccatagacagcagcccaccaggctcccccgtccctgggattctccaggcaagaacactggagtgggttgccatttcctgctccaatgcatgaaagtgaaaagtgaaagtgaagtcactcagtcatgtccgactctcagtgaccccatggactgcagcccaccaggctcctccgtccatgggattttccaggcaagagtactggagtggggtgccattgccttctccagatatgtagcctagagtaatataatttcaaatagtttccttgttgccattttataaattctcttgtaaatcgtaaactcacagcttaacttttctaagaaacacctgtatttttttaatcgtgccatgtgtccaatcccaaacccttaatctttgtttaggtattcaagcatcatccttttagttaaaacatcttacaccttttccctaaacattccattcaagccaagctaaaatgctactattctgagaaaacacactctcttcttttttcattccaaatacatttgttcaaaaggtattcactgatagcttcttgtctatcaggcacagagggaggacctggaagtaataaacaagaagccactgactgccttcacaaagtggatagtttttccgggagaaaatcaaggaaaacaatacaatgtgtagaatactactggctctatt

SEQ ID NO: 29935 - DNA, 1207 bp, Bovine  19866881289608
gacacttcccaaggcatctgtctcaacccctcaaagaattggaaagtgacgggcctttgtctccagagcagttcaaggccacaggggaccagatcaaatcaacctcatttttgagaccatttcaggcgctttagaagtgctttggacttcttctcttgtctcctctaacgttgcttttgaatattccagctcttaaaaaaaaaaataaagaagagcaattaaatgtttgggaagtctctggagatccagtggttaggactcagggctctcactgctaggacccgtttcttccctttcagggaactaagatcccacaagctgctcggtggggccaaaaaaataaaaagcaatggaatgttccagcgcctcataaatatctgttttgcctttatttccatccccttataaactaaccttcaccctgtctttagaatttctcccaaatttcttgcaggttctaacagctacataaaggcttgggtgtcagcagacagtgaaaggcaaagaaagggctgctcaagggctgaggctggtacggggagggggtctctactggacgcacctgtaaaattgtacatcgttgacgctttcacctctgggactaaccagtgaccaggatcgccttgcttcccttggtggctcagtgcataaagaatccgcctgccaaccaggagacatagatttgatccctgggttgggaagatcccctggaagaggaaatggcaacccactgcagtattctttcctgggaaatcccatgaacagaggagccttgtgagctacagtccatgtggtcgcaaagagtcagacacgactgagtaactaaaccaccaccaccaagaagattgccttaacattctccttagcttacttcttgctgacttcaggctcctgacctcctttttctcatagcatttcctggagaacattgcagttgttcattctgtcttgcccctttgggatgtaaatcttctacaacccagcaatgtctttcacaaggacctgggagccatcccttggaatacaattattaagaaagctagtgccccatctactggtctctgtgggcgggtatgagcctaagtgccatcagcaacaatcggccagcacagatgcttcatcacatgagccaaactccttaataatgtccttcagtatttttccaccagcttactcctgtgcttaaaacatcccttgtgtttcagtg

SEQ ID NO: 29936 - DNA, 989 bp, Bovine  19866881499802
aactggaggaacacagcccagctacaaaattgccacttactaaactcctccatcaattcacttctgtgtctttgaaaagagtaatttcatagcctttttctctacagctttaatgccctttgtaagataaataccctcctaaatggtcacatctgctttcttttggcccacaaaatgcttagtcaaagaaataagccaccatagctactttcctcactgacattaaatcaaattttgtggcaaaggaacattgaagatcaaactgtgtgtgctattcatacaacttgcattacttcaaaactcattttatttccccaaggtccttaagagcagttactttctcatatatttatttattcattcatttatttttaattcattcaacaaatatatattagatgcttactatatgccagggatcatgttaaatgttgtagatacaaagattaataagtcacaatagatgctcttaaagagtttgcagtatattatgatggcaaatataaagaatgacgaacacattgcaattacagggatgagggtagaaggtggtagcaggaaggaaaaaaaagtgtaattaatgctagtaggatgtgaggatacaagacatgatttatagatatcctctcaagtatggtttgaatgatgaatttttaaggcagactaggatgggaggaaatgttactattaacagatgaatattacacatagggaaagaactagaagaagacatatcacttacaagtgttgataaataaggttggagagatgaaccggtgaaaaacttcataataagtaaatttaaggaatttggacattgtcttagaggacatggaaaactattagggaggttttattaactgtggaaagggagatgaataaaataatctaatttgcatttttaaaagattgttctcattgcaatatgaacattgtgaccaattctagatttagcaagaacacagaccaacgtcttacatacagtggga

SEQ ID NO: 29937 - DNA, 1142 bp, Bovine  19866881535174
gtagacacagaccaatttgcaaatcttatttaggtcattaacatgcaccagtgagagaaaacaaacatcagccttcccctggacatctctttttttgtttgcccatgctaatttgcataaatacataaaaatcccatgtgttcctcagtgtattcagtactcaattctcattaacttcagtaaatattcccacactgtggacagattgactccccacctttgaccaggactaacccaggggcacatcatcccttagacatctatttctggatacattaaattagagaatacatcagacacatgaaggactttatgaaccttcatttacagattgggaaattgggacagatgagttaagtaaattgccccaagtcacagtcctagaatctgcgcatccagaataaccaagtaagaatgtgctcctatgacaatggcactaaggacaagcattataatacatattgtcttagagctgacatgctccacctgcctccatttttctttgctgcactgtggctagacctgcagtcaactcaaggcctaagtgggagggtatctacttccaagctgactcttgtggctgtgggcaggactgttgcagacctaagatttttgtcagatctttgcctgtgggcttcaacatgtggttgatctcaatatgtcagctggtttcccccagaacaaaggatttaagagagagcaagggagggcctaaacttggtcactgaagtgccattctatcacctctactgtatactagtatgctattgaatccagcttgttcttaaagggatggggatcatacttgggtgttaacaccaggagctaggcatctgagggggcatcttggagacaatctaccataatggcccttgccctctgagcagccccctcatcccatcatgctctccctgacccatgctgtatccacttgctttcaggcaaatagtggcacagtatttgacacagtagacacagcagggtctttgaatcatagatccataactgagcatgaataagaactagctgcagcctgcctcagagctgcaggtattatccaatgcaattatgtaaatctcagcacttttcatactgaccacatcccagaaattgccatctggggctgggtgactttgcacaga

SEQ ID NO: 29938 - DNA, 1153 bp, Bovine  19866880395269
tgttgtcatcttaaaccacctaaactttagcagtgcaggcagaattccttttcttcaggacttattctggatctgccttgcaaatagtttcatggggagaagtcattgatgctaagatggtaaaaggtgccagcaagtctaattgtgatagatgaagcatggtttcaggtaaagatttatcctcatttcagaacttcatattctagctgacattattccttgagcatacaaacctgggtcacaggtctcctaaactatctctaaaacattattgtcataagaaaaatgtacccaccaaggtgttgtcagttaagggacagcttgagtggaggtgtctgtcaaaggaaatatgaggcacaaagaaagaatgagtcatcattttgtgcccacttgaaatgcctttcttgatagttaaagtccatgtaggaggtagtccttgaaaggaatcacactgaaacagaagtcctcttatagcctaattcttgcctggggagatgcaaggaggaaaccattcatcagtattaactgtttctaacaccagagctggcacgaaagtaagcacaggaggagaaaaatcatcctgaattacggatattatgtgctagtttcatggcaccaggtgggaacgttaacacttaatcagtctctctggcattatttcccatccgtactgccaactttatcaccatgaaagatgctttgatcctcgtccgtggtgtcaagaacaacaggccacagcatcagtgacattccaatcagtggggtatcatttcacattagttgttatcagatatgatatttcactaatgcattttgacaacatgtggcacaataccaggtgcctctctagtagatatagagagagagacgtagtcctagatacaaatctcctaacatggagattaaccacaaagcacttttttctcactgttctagactttggaaacagaagacagtattctcttaaaatgtggggaagctctttcctcgatagggcttaatgctcttttacggaaaatgaaattcctcagttttgcacacaatagttacctcatgttaaaacaatactaacaatgaaatcctaagaattagaaaatgttaatatttcacacaagtactggtgtgaacaacaccttatataataataaaagct

SEQ ID NO: 29939 - DNA, 1407 bp, Bovine  19866880625920
tatactgataccaaatagccaaagaaatttatttattttgaccaaaaattattaatgtcttcttgaactgtaaatgttcaaggctttcccactgtgctggttatttctcgtgggcaagccctgacaactaaagagccatttgctcattgtggagacaaagtgctgaatctgaagtgctgactcagctgggcaggaggtggtaagattaatggacaccaacctagagggaaaagcggtctgtgagtgtaaagggccttggtgggagaaacatttccccagtgaaagagagaacacacacttcgtccttccattcactccatggccagacatcctgtggaacatgtctgagtcccatgcagtggtcctattgcaaatttatatctctattcagtagtgattgaatcaaggccaactcatcacacattctatcgtaaactttaactgctgtgatacatccttttcaaagagggtcaattgtattttcatcaataacacatgcattctacttgaaataacaagcataattgtaacagcatctatcaagctacataagaaaacaagatatgcccaaggctatttttaaagcacaacttatatactaaaggagatagtaaaatagtgaatagctatgcaatagaatgatataacaacagattaaaaggaataaatggcgtatcacctagttacttttggctctttaacatttagttaacttttgtttagtgtgagagaatgggcaggcaagtgtcttcctatgtcagacaaaatatgctccatgtttaacacaagtatttaattgtactgcagccagaagaaatctgacatttttcactttcgtatttactgttagtccaggatgtttgacactctaatgtatcccatgaatagatttccatagagtgacagttataaaacaacagtaaattgattcaaaccatgtttagctaacagacaatttgtcaatatgggtggttcagtttcaaggcttgacttaattcgtttggtaggttaaaaacattagttttggagaaacaaaatatgatttatttattttgtaaatatttactggtatctgctctgcatcaggtgctctttccagctactggggatctagtatcaatgactaatcaagtgtagaacagtggtaatgccgagagggggaaaatggagggttggacaattcaaggtgaagttagatgtaatagaaagttaccattctctattcttccagaaaacaaacaagtcacgattacaatttttgtttcttctacctgactgcacttttgtgttttgcccttttcctttgtaaattcagtgttccacggataatgtaatggagaccaaagaggaatgaaccggaagagctagaaatttggtttcatctctcatactaattaaccttgtgac

SEQ ID NO: 29940 - DNA, 1069 bp, Bovine  19866880629608
tataatacattgatatttctactacattttatttattatcttgatcagttctacaaaatgaacaatacatttggttcttgctctcatgggtacacatgtgttttacaaggacactggtgatatattttgctatacaaatcacaagaagtagtttacacacagagctcatgtttttatacatttctccccaaagggtattcatatttgataaatcactgattgaaatctgaggcaattaagttgtgatgaccttggcatactagtgaatgtaatttccattaagacagtgtcagtcctttattatggtctgcctgagtttaaaaaaaaaagccaagttcggttcacggcacatttaatttcttatccttcaaatacacacagtattttaattcacactgatcaaaatctacctggcagccccttattaggccaagttgaatgccttgcttagaatttccattttttaattgatataaaagctgttaatctcccaaaagggaaaacaagtatctaacattgcattgatatttatttcttttagtctcatgttagaatcatgaatagaaatttctgctatattctacattgctgtaatacaatattttaaaatattttggttataaaacactttaacaatatccaagtttatggccattcacttccatgttttattcctactctcttttctcctcagaggtagcatttttcattagctcttatgtttttatacaaccctttccactcatttctatacacaacttacagaatattgaatggaactttttctgttatcttttatctagggtaatcttagacacagaacatagtatttactcttgataatctgggcttcctggaaatcctgtgacccatctaatgacccttattaaattattttcctgcttataaattcagaatatattctgttattggtaagaacccagaatggcataggattttcttgactcttcctctgaagatgatctggatactaagtccctgaatttctgattattattaaattagcccaatgctaactgagcatacgcttttatgttgctgttctttc

SEQ ID NO: 29941 - DNA, 1921 bp, Bovine  19866880654401
attgacttccttaactccttaatagttctgttacttttttactttatactcactagtgagttgcaggagattgtctaggtacacaaaggagatgaatatcagtagcagtatcagtttaaaagggcacatcacgtttttactctgtggtttagcaacttctgatccagttcatctatctcttccttctttcttcctcatgctaagagaaacagattttcctatttcttttcatgactaatatctctcactgattacattccttcttaccattactagaatcctcaaaaccctgctgaccttgccattacgttgctaatccatattcttctgaccttcaatggcaagctttcgcaaaggggaaagtcatgattaagaaggtaggcacggctggggccttcctggcggctcagtggtaaagaatccacctgccaatgcaggttacacaggtttgatccctggtgctggaagatcccacacaccatggagcaactaaatctgtgcaccacagctaatgagcctgtgttgtaaaggagccacagctcctgaagcttgtgtgcccaagagcctgtgctctgcaacaagagaaaccaccagtactaagaaaccttcatactacaactacagagtagcccctgcttgctgcaactagagaaaagcccgcacagcagcaaagacccagcatagccaaaaattaataaataattaatcaagttaaaagaggaatgtaggcactgctgtcagattactcaagttcaaattgtgattttgcaacatctgcgtggacttatgttacttaacatgcttttctcagtctctcactgaaaaactaggaaaataagagtttctactttataggattttttcttaatgaagattgaattaaataatgtacagaagacaattagcacagtgcctgccatctgccatagtgtgcactttaacatttgcaatccaatctctgtccccaaatttcactctaagctgtctcaagtagtagcttacctttccaactactaaaactagtagcttctatattgtgatcgacatctgtgaaacctctagtagtttaatcctctgctcatcccttgctttttcttatatctttttacacttaaaaagtatctaaaagtaccaatttggataatgaccaatctagctgttatgaaggagaaaaatgtgggccatgcctggatcacaccctcaaggaacttagagtatagtagggaagattaaatgcatataaaatatcattctaatgtaaattagaatagagaggcaccagaagagatgccaataactgataatgtagtgctatgggagttcagatgaaagcacaattactgctagctgggaagaattaaagaaaattaatggaggtgctggcatttaatctggaccttgcaggatggaagacatttagatatataaatattgaataagcatattttaggtgaaggtcaccaaatttgcaaaacttcctggagaaaggaaaccatggaatttatttttgattatgattagaaatttgtataaaggctacaggtgtttaaggtcttaatttccaggctaaaagtctgatttttcctgtattatggggagccattaaagcttttagaacaagtaagcaacatgatcaaaactgtatttaataggattaattccactatgatttcattacagttcagcagacatggataagaccaagtacctgcttttgacgagttacagcatggggtaagagcagtgacagagctataaacagatcccttgggggtccaagggggctggcttactccacttgaaaaataaaaaagttgctgcaaaaggtgacacatgaactaatttttgatagataagaaatgaataggcgaagaaggaacacataatttcccataagtgaaaataactaacatgtttgaaa

SEQ ID NO: 29942 - DNA, 727 bp, Bovine  19866880728974
cttaaagaaacccataaagtcaggaaggtccagggatctctggggagacccagggactcttggaggcaaagtcaaaatctattccttacaatgagaactgagcaagatgtgttcttttaaattatcttttattgatattattaaaagggtacattatcaggtgtgaaaaaggaaaataagacaaaaagaaacaccacatcttgaacaaattctttctttattgtcatgttaagagctgagagaagttattccaagtaactgttgaccagcaaatcaaaaggatattctttcaagttactttgagagtatttgttttataataatataagatgttaaaatgatataatttcaactggtggaatcaaggtttagcaatccagaaacaaaatattcaaaggcaagatgttggaagcaaggagagtgtggattgtgttcccatgtggtttcatttgacaggtacgatgtgttctccttgctcaacattgatttcccaattgacatgtctttcagttgaggaaaaaagtgttctaggtatgaaaagtggagttgtgggaggcataaaaatgtagagacaaatggtgtgaatggctaagagttcagggttgaaacaggtgttgaatccattctttagattattacacatatatttcttttaccttttgcttaagatcagccatgcaaagaagaaaatcagaattaaatttccaaaaagaaaacagatacacaa

SEQ ID NO: 29943 - DNA, 2139 bp, Bovine  19866880760426
actctcctctttactttataaaaggctctttagttcttctttgctttctgccataagtgtcgtgtcatctgcatatctgaggttgctctgtcaggtccaactctttgccatgccagggcctgtagcttgtcagactcctttgtccatgaggattttccagacaagaatattagagtggaattccatttccttctccaggggatcttgccaaactagggatcaaacctaggtctcctgcattgcaggcggattctttactatctaagccaccagggaagcccacttaatgatcaaaggcaaatgtcttttttttttttttccagttaaaaattactatccatcatataaagggattgaactggaaatccactcataaattttctgttttatttactttttgtgattctaggactatagtttagaactttgttactggtacaatttaaatcagccaatacatttcttaacctttaagtacacatatcagcttacttcctctaaaggtctttaaagcttactagcttatatgtttgttacctgctatttcacagaacaaggtaacagcatctatgaataggagaaagagtttaatatatcttgaataaataatgcacatttcaaaaataagcactttggctacatttagaagctagtcaaatttttatttgttgataaagcagatattttaaaatcttctttattctggagtttatttcctctgtccacgttgttgttcctttgggatttagaagaagcatttatagatatgacagaggaatatctcgtgtcaaagacagtcaagcaggctttagaaatgctgaagaagcaaacatttcaaaataaaagtggaaaaagtttacagcttggatctgctattaaagtatggacacatattgatatagcctctatagaaatgtatgtggccatgtagttatgtatcctggaagtagacatcagatcatctacatgtcttctgtctgagcgtgaagaaaggtgttttatagcatcagtatagtaaattagaaagtcaaaatataccgaaaatcagctacaaaatagagaaaataagattccagtaatgaactctgatgaatcctcctcttgttatttcacgtgtgtgattaataaaccctaagaattgcagccttaccttttatttctcacaacaaacaagtgaggtctgaatcgagctcagagataacaagtgaatatatacattgtaatttccattgtgcgttttgcttgtgtggtaacttagcttctctttctgatttgaaatcaaggcagagacctgtgcatctgggaatatcattctgccgtgatgtgtcctagtgtgcctgaagccttccacatcatttaacacattaatgatgcctttcagccatcacaccctggtacggaggcatattacgtatctgcagcgtgaacaaaagcacagccatatattgtcctgacagttattcagaacctttttgtgagcttaaagtcacaactgtatgtaaaacgagcaaatggagacagtttgggggcttccagatctatgttgaaatctcattccattttcatttctgattacagtgaatgaagtacacttgtgtttagagaattatggttactcttttcctgctgacttctaaaaggtgctcataagaacagaaataacaacaaccggctagagaaaacatggtattatctaaagcacttagcgttaacaaagtatgatacgagaactatacacaatatcttgaaataacttataatagaaaaagaatgtgaaaagaatgcatatacacacagacagatatatatatatactccctgtccgtcaccaactcacagagtttgctcaaattcacgtcctttgactcggtgatgccatccaaccatctcatcctctatcatccccttctcctcctgccttcagtctttcccagaatttgggtattttccaatgagtcagttcttcacatcaggtggccaaagttttagagtttcagcttcagcatcagtccttccaatgaatattcaggactgatttcctttaggatggactggttggatttccttgcagtccaagggactcaggagtcttctccaacaccacagttcaaaagcatcagttcgtcggctctcagcttt

SEQ ID NO: 29944 - DNA, 1583 bp, Bovine  19866880763432
ttgcacagagtcggacacgactgaagtacttagcagcagcagcaggggcctcattggctgacctgcctaacattcttgttccctcagcctaagaaaggtattagccgtcaaggttctagagtcttctaacatggcagatagtggagatctccaaccttcaggcttgtcccggcatcgaacatacttccactgcctggtgacagttgactagagggagaatgaccttacagagatcaagtcttgaatgtcaccaacttggtagtctgatcaagaacacaggataacggatagagaaaatagtatggcttaagaatggacttgaccatttgctcaaatgctggttctgccagtgtctgtatcactttgcataaattatttacattatgcattatttttgttattaaatatataatagtgcatattccacatgatttattgtaaggattaagtgagttcccatatataaatcactcaggacatttgccggcatgttttaagccctatggaagtgttttctagtgttacttaatacatgtccaacgtatctttttcacttcttcctcttttctgttgcaggacacatctttcaaacttactgtttcacagtaattaaagctatccatgtatagatttataacagattttttaaaagttaaggaatgattttctttacctctcaaagtattctttcattaaggaatcatagtctgctgtgaagtatgttaaccaagatggcacttcctattaggcacaaataactttttcaggtgatagtgaagctgagagaaaaggatatgcagattgtctcaatattgtacattttaaatttagtcagttaccaaatgtcgctttcctctcttttccctagaccctggaatctgtactgactgagcccatctgggaaagtacaccagccagatggccattgtgaattgctagggaggccctgcggcagtgagagtggatttcagaaaagaacgctctttgggacacaatgaatacagccctaatttatattttagggtttttgaaggagattaaggccaacagtggcatgattttaaactgcagttgggaaggttttttgtctgtatgccagcaaagctgaattataagtttggggagctttgggagtgcgaaaagatgccataaaaagaaagggaggctcaataattgtatagctgtgcagatacaaacagtatgtaaaagaattgaggttaaagagcctcatcaaagccaagccctcttcagtcggttattgttacagggattatgacttcaggagagctataaccagcaggggataaaggaatgacattctccatcctttttatgccaaagcacttaaacaattgataacaagggattagaaaaacaaaaatatattgtggttttgttatgttcagactagtgtcaaggttgaagagacatggttcatgaactttagaagcattagtgcacttgttatgtggcatacgcagaccttgtgtgtctagattcctagcaaataccgtgatgacaaaaattagttctggtctaagttaatcagtaaatcagatacagatactaatctggcatttcag

SEQ ID NO: 29945 - DNA, 1400 bp, Bovine  19866880773646
tttctgtagagaataaatccaataattactgtcatacacttaggaggtagttgattgccaataacataggtataaagtagataaaggatgtcattagacagaacacttaacttggttaataaggagtcagccttcctctaaaattatttggcaaacctaatattttaaagtgataatgagaaaaactagatattatatcatatgataataatactcattaatagtattcaatgcttataatattctggaggttttgatatgatatatcatttaatgctatatataaggttaggcagcaggtttatgacaggcctaaaatgaagaaaatgaaatagaaaaagattaatcatcttgttcaaggttgcatggttaagtggtagagtacatgcatgccattttggtgagtaaaagaaatattttgtataattgatttttaaaaacttacatactacataaaagcatacatcaggcagttagaagctttttgaggaatttagaattttattttacatctaggaagtcctaactccaaaaacaatattgtagagattagttccctacacttacatttttaagagatcttttattattttaaataaagaattatttgagtctcttcaataacacgtaggagaaggcaatggcaacccactccggtactctcgcctggaaaatcccatggatggaggagcctggtaggctgcagtccatggggtcgctaagagtcggacacggctgagctttcactttcactttttgactttcacttttcctttcatgcattggagaaggaaatggcaacccactcaagtgttcttgcctggagaattccagggacgagggagcatggtgggctgccatctatggggtcgcacagactcagacacgactgaagcgacttagcagcagcagcagcaataacacatacttctgcagatactgtaagaattctgtaggaatttaggaagaggaacaaaaagagaaggaaggaaagaaaagggttaaggagacctagtaaaaaaataattcaagttgtttcataacagacatgttttcttcaatgtcatacctatttaagaaattaaaccaacacaaacgtctgtaatacagtataaaatacaacaattgggacaagaagagtctaaataaagtgaaaagccaaaggcaataaaagtgcatgtagatatcagtccagaaagaaaggccttacatgtagctagttgagacacggacatgataaagtacgtactccatttacttcattgaacattctttagatcatctgacataaacattaaaacagagagaggaagtaaaatgtaagattttcaaagaggtgtttggggtctctgtgtgcatgtatactaagtcacttcagttgtgtccagccctttgtaacc

SEQ ID NO: 29946 - DNA, 1983 bp, Bovine  19866880820355
ttggaaatgcaaggaggcctatatatttcccatttcttgactgttctggcaattttccccaaaagggaggaaaaaccctataaaatttcttttggccccccaaagcagaaacatctgctggagtcatgagtagcttgttggcgcggcttcgaagtcccagcctggagttgattatctccccgcttcaccagtgtccgtgcactcagcaaggagcgcactgaaaggtttctgggaagactcattataaataatgagaacatggaagagaagaaagagggaaacggttcaagctactttggcccatgcattttacgagtttcacaaactaaaatcattagaccaccaaactgctcaattagaaatcaagattttaaaaattaggccattgctttctgtaaatacagctgcttggcaaatgcaaatgaaaaacgtgacagattgctggttgattttttttcctatcaggaaaaaaataagtcagttattttaagtgacactctggggaaaggattggttgctgatctgtctttaagttgccaattgcatcttacctcacactgaagctggcagtaagtagaattttctggcttgagtgcataggcattttttattctttgaaacagtttaacaggtgcaagtgaagtcttgctaggaatgcttatgtatgacaatatactctttcctaaattaattcactccactcagtgtacaatataacttgttgcaaaacttttggtgtgctgtcaattcaatcagttacttaacagatgaaaataaccctagttctttgcatccttcaacaactctgacaattttattatttttctaccatcagtttttctaatgttaacaactgacagggtcaaaatgttctttgtcattctgataggatttgcagggaaaaaatatgaacagaatggattttaaaaggcttgatgaaagtattcagattaaaatttcagtgtatacctaacaggtatataaggaaaggttaaaaactagtgagctatgagtgtctacagaatgaagttcatttgtgtaaatggaagtgacatattccaagacagaattctcaaacttgatggcatcatagacacttagagagcttgttaaacacatactgctgagccacagcacaaactttctgctacagtaagtctggggtggtacatttaagttcccaggtacaggttatggagctggccaggtgaccacacttttccaatcactactctaagagatagagagaggaaccaagtcaaaatcccagagtgtctatctctagaggctcctcagatttcaaggctaatggaatactaaccagttttcagtgagctcacaagttcattttcttttaactctgggtaccaagcgcatcttcacctatagtccaccaaccaaacgccatactttcatgctcgggtagtctaaggtgactatttgacctagatgttctccttttcacatccatatgtctatattgccattttattcaaatgtcaatttcttttgaccattgattgctctgatgacttacttttaattcttttcatattaaagttaaatctgccccagtacctcccccaacccacactcagagacataaacaccacaagcaggacttccctggtggtacagtggataggaatctgtctgccaatgcaggggacacaggtttgatccctgatctgggaagatttcacatgccatgggcaactaaagcccacaggccacagtgactgagcctgtactctaaaacccgtgagcagcagcactgaggctgtgtgctgcacctaccaaagcccacatgcctgcagcctgtgctccacagcaagaggagccaccacaatgagaagcccgtacactgcactgaagagcagcccctgctctctgcaactagagaaagcccgcacacagcaaccaagacccagcacaaccaaaaaataaacaagtaaataagttattaaaaaaaaaaaacccaca

SEQ ID NO: 29947 - DNA, 783 bp, Bovine  19866880868919
actgagattgaaaccaagagtgcattgatggatagtatgcatttttctttttaatggaaggatttgaagtctgatatcacttaaaacatgtttaatcttccattagaaaatatggtgaccctgtgatatctgatccagacagatgttttttattcatatttatatttttgataatgcgtaggaaaaacataacaaagagtcaccacccaataagagcctcaaaatatatctagagaattgtgacacgaagagcacccgcttcctcagtacttcttattaaatatacttttttaagaaatggaaatgtaaaagtagagattcttgtttcctggtatatatatttttattcatgagagcttttttgtcagaagtcaagatctattttactatgtcctaaatcctatctattttacaatacactaaatattattattacctatggataccatgggaccccttgtgcataatggattccagtcctcttacagagttgcatatgaaaatgttatcaatgagctgaagactctggcattcataactttgcaacattataacaaataggtagtcctaatattttttttcttttttaatatatcaaatatatttcattgcttacattatagtagcagattgaaaacatctgctcacttgccactagtccaccagcagctgaaaatctcagctcatttccacaggcctctatgtaccagggctataatccagctgctgaggcttgatatggggccagattaatcctcaagagcctttgaaatggaaatagtg

SEQ ID NO: 29948 - DNA, 2225 bp, Bovine  19866880893608
gtatagtgaggtattgttcacataagagttttgtaatttgtttcagagaagaaggatgagagggtgaggagtcagagtgaccttcctgcttctgccaccttttaagaattccttcagtttatggtatttcatatgccaagatgccacacttgggggtagcatgttctgaatcccactgttacgctcaggaatccattactgattaatttgtccattctccccagcagggatggcagtatgacacccagagaatcctagcagtctcaccctattagctcatctctctcctcaggtcccacattctcccttcagaagccagctaggcttcctgaaccacaaactcgaccataaagttcttcatgcctttctatgccaactccttggcaagcatagcatcttcagctctttactgctttttatctcatacttgactctactgtggacattttcaaatctcttctatattcagtaggaaaatttaaatagtgagggggacttatctctggactttttctatttacccatacactgctaacatttcttttctccactgcaatgattccatgctagaacattccacaatgatgaattttcctgaggtcccagacagggtctagggtaaatatcacatctgtccacagattctcacatctagtagtttccatccttcctattgggtaactgctgggtggtggtgggcaaggctgataggaacagagttccacgctggtggttaaattctatttcctccctcactcatccctaatacaccattagctcagaaatagttatccctttttatgtagaaataaaattaactttctgtgtatgatgtgtacatctttttcattcatttttcttcattcttttgtttatgatataaatatttgctctgagtttgtcaaatgttgctgtctgtactcaaaaccaaattgagggaattttaaaaataaaaaaagtcaatatggatactttcttctcatcagtttcaggctattgaaatcaaaaaccatacacaagttcaaataactacctttttagaaacaaatcacctttcattgtaatggagactactgatttagataatagtggtaaagaattattactaataaaatattaattatcttcatatactcttcttgcatgcatgctatgtccttttactcatgtctgactcttggtgaccctactgactggaacccgccaggcttctttgtccagggaattctccaggcaagaatactagagtgaattgccaggcccttgtccaggggatcctcccgaccagggatcgaacatgcatctcttatgtctcctgcagcggcaggcaggctctttaccaggttctagcatcacctgggaagcccagtttcctcctatgttcttacaataaccctctaagttatgtcaagagtagaactgacatgttgaaaactaataaaccctgtgatttattatttatctcattgattctcaccgcaacactatgcatacagagaactgtcccattttccacataagaagcctgaggttccacaatgacttaagtgattatttaagtttacctgaccttaaatgctagagctaaaatctaatctagagcttcctagtcttttctactaccatcataacttttacatgtaatatccgaaatatatattatatatatacatgtataatcatttgaataacttttaaaactattggtaaaagaaaaaataatactatggaatgatacaactatatacgtttctaattttaaaccactagacgaacacagagtgtatactgaaatgaaatactgatatttcttctaatactgtatcatcacaggacacaatttatggctttctgccatttgataatgaaagttaaattttctgtgctgttactggaatagggtataataattcattctccaaaactaatttatatacaaaacatattctatacaaagatgtttgagttcctgtatttctcttcttgtcacttggcggcaatttgtgtgtgactcaagaaagacagagtaagaaccaatggtaatttcttcaagacacagaaaagaccaagggtactgaaagtgtgtttcagttaaactcattcatttgaaattaaactcatgttctacagtgacagaaatcccaaataaggtatttatatttaaggattaacagtgtcttattgaaagattcttctcggtcaaaaaaataaagttcatttttttt

SEQ ID NO: 29949 - DNA, 851 bp, Bovine  19866880918067
cacctgctccccttccccgtctgcttgtgcaaatcgaccttgtgctaattcctcagcagaatgtgctgcttgtccttcagacagacagctccttgttgtctgctccttaatttgtgatcatacttccttgttactttctccttcttcccagatcccatcttagttcctgtcttatgtaaactccatgggtaagcgttggtgagttgttaatttgggaaacaaggcctgcaatctgtggagcaacaagaacagctggtgctgctgctgttcagtttttcttggcagatggatgtagagggaattacgaatggggaaatttgcctcagccttggctgctatttcgtacagcaatataacattgccagctctctctctctcctatgccaccactcctgcaccacagcctgatactttaatgtgttcccctaacttcatgatccaggtcttcctgggtagcctttgttatatgcttcatgcccaatatacctttttgaccacaacaagaggcattttcagttttacttaagcagttttaagtgtacattaaggaaatgttattccacatccccagtaatttgaggtcaagacctaacttgtttgtccacttatttattaattttaaagtaaacttcaatgaatgtcttagttttctaggactgctataacagaatatcatagactgagtggcttaagcaacatttatttcttacagttttagagactgagaagtctacaatcaaggtgctagccttttcagttcctggtgaacgagtcttctttctggcttgcatatggccacatccttggtttatcctcacctggcaaagatagagcaagccccagtgtctgtt

SEQ ID NO: 29950 - DNA, 1709 bp, Bovine  19866880920588
gttctttctgtatgtgtttgagtgatggattcacggatataatctttatgtagagaccacgctttttatctcactgacatactttgtgaaagtattaagagctgggaactaacatctgaatttacaacataatcctctacaatttagaaggtgccttatcgtgtggtcatcacgtggcatttacaatgtaatcaagagaaaaatcaacaaattcaatctcacaaactaaattaaaagggacacattcatgtttcccctttatagccatgtcagagatagagaggataggaggaatttaaacaccagacatcatagctgtcatagccatatctttctagagttagggagctcatttctcaaggctacaagtccattaaccttcacaagagcaaaaataaagcaaaacaatgaaacactctggagaactggcattgcttctaatcttgcttatatatctcactgtagggatttaaagatggaacaaagacttcttcttccccaggcacaaaaatgacacagactccctgaaataaatatacaaaatgcctcatggtacatattgtagacatatttgtgatttttctgaaaaatgagagtggggttaggaaaagtaactgatatcattcctgttgaatctttgtcttacccagtgatttgtaactgggagggccaaagtatcaaccccatttattttttaaagtcttggtcttcccttggttgccactttacctagattcattcactgtatatatctggaactattcgtttcctgataaacgcattgtcaggaagccagaggtcaatgataagataggaagcaaggagagcttgcttgtttttatacatttctgtttgacttgggagataattataacgcagattgatgctcctattttaaacaaggtagtaaatcagagtaaaatatgggattcaggaaagccatttgccacataattataatttcttaaaattcctgcattcattgaatatgagaagctgtaatcatgtgatacatagcaacaacattactcatcttttttttttctctcatagaagacagttaaataaacttaagttacagtctttaaatattattagttacaaagtttaaatatcattaactgaagcaaaacaagagcataagttgcttgatctgagatctatgttctagtgggagagattacagattcagtaaggaagattaaaataatgattaagtgtacttcactaaaaagtcatatcttttccacaaataaactttatttatcaccacgagacaaatagtattataagaattccatcaatataggagaacagaaaaaatgtaggaacaaaagaggggtttagaatcagaaagagacacatttaagcatggactctgccaagggttatattcagaacacctataaactggcatggcagggacatggagccttcaagttggaagaattccagcacggggatctaaagacccctgtgatgcaaggatttatcattttggttgctgcattaagggagagaaagaagggggcctgaggtactgatttagaagtgcctctaatgccaagatttatcccttcattgctagattatgggggaagaaaagggggaccttatatattgggtttaggggccttctcagggtacttgaggaattaacaaggtacagtacatttctatgctcacctaccagaagtaacctggacttg

SEQ ID NO: 29951 - DNA, 1215 bp, Bovine  19866880970503
tttcctctagattgtccaagaaagaaagaagttaccatctactgccctaaaaagtcctgactaaaatctttggggaaagggtatgaataaatggttaatcatggctaaccaggtccataagaactcatgacttcatgttgttcatatgctaaagttgtaccacatatgttattataaggcatcttgtggccggtatacaggattgcaattcatactaacagatgtttgggaaggaaattatttgtttaatttgtttatgagtcagaggatttttgtctgaatgtaattataggaggagaccacaatttatgaatggattgtattccaaaagtgcatttgtgagtcgcttgtttgggactaagaacatacttttatgtataaactaggttaaatgttagtgtttcccaagcaagcccacaaatagctgctttaacccattatttggctgatagtatctgcctattatttctatggccctggagaaaggatgtgaggaaaaaacctcttcccttttctggcatttgtttggatcccacagcctttccctctttccagcctgcttttccagtgctttctccagagacctcataagcccaaaccaccctgaagggctgtgactctggtctgacccatccttggcaaaattcatgctattccagagttatctgcctcttcttccccaccatcagtgtgttcgaccttttgatgttgctgctctcaagttataataagaaagcaatgtaattttctcattctttttatacaaatgggattaatgattatcttaggaatatttataatttaaaaatagatgtgtattcatacaaattcgtgtattcagtggaatttctgactaaaaaaggggaaaaagtccagacatattagagtgttgttgaatccaagttcatgtagccatcacacagtgaggccaaacagactgaaaagttggagtttggagcagagaaaggtttatcgccaggtcaagcgaggagaacagagcagttcatgctcaaaaggcccaaactccctgatgattttagggaagagtttctataggcagaatttggtgggggaggtctgctgttgtgtgaccttcctctgattggttggtggtgagttaacaggatggtggtccaggaatctcaatcatcagtcccctggctccaaccaatctggggtccacatgcttgtgctcagcctcccctggggtggaga

SEQ ID NO: 29952 - DNA, 1420 bp, Bovine  19866881038989
taatggagccaaagtgatttctttttagccacataggatctcagtaaataatctgtaagcccctccagaataccagaaaccatatttaaaaattgtatgggtaaagactaaagaaaatgagtctatcatgtaaattcaaggactcaccagagtattacaattgggaaaagttaggtttactattattagttaatacagtctataaattggtaaagatttctatatcatattacttacatattttaaaccagtgaagacatttagagcttgcttagattacattgctgtctagcaatggtttgattgtatagaatgaactattaggcttactcagattgaagatttaagtcctaaataaaccttcaagatatattttgtttggtagttcagtattgctgtagttgctttaaagaagtataacttgattaagctagcattgattttccagtttatggacggccctgtcgttacttattctcgtactcatagcttcttcacacgtttaaattagttgcctaacccttgagggcatttgagtttgcaatatggctttattgtcagacttcaaatgttataatccttcccttaatgttgcacactctttgaaagcagtacagtatttccttgatttcctaacagtaattagcacagtgtcttaagtaaatgcgtatttctttcatatattcatctaactcacaagtctttactatgtacctattttgttttagctaacacactagtcaataaggataaggatgtgagagacagttccagaactcactcttaaaagtcttaatagttaagtgaggtaggatttgcttatttattgataaaatgtcttatcttaaattctcttctatcataacttaagaaaatgaaaggattaccattctcttcccagaagaaaatatattaaaataagtaaatgttatagactgaattgtatcttctcacaattcatatctaattcacaattaaagttctagctcttagtacatcaaaatgtcactgtatccaatatggctgatgactttgccatacaaattttcctcatgtctttgtatggcaaataaagagaatcccagaagaaaccagccctgctgacactttcatcttggacttctagcctccagaaatgcaaggaaataagttttgttgtttagccacctagtctatgttactagcaagttaatacagggtggtattttgttgttattttggtttgtttttgtatatctaatttgatttaaattcatgtataaaaattcaaaacaacaaaacaaaaatgaaataaaataaaacacctagaagaaaacgaagaacatttagatgacgttggatatgacaatgactttttatcacaatattctttagataccataatctagagagaaagaatttaaaaatttttaaatttcaa

SEQ ID NO: 29953 - DNA, 1735 bp, Bovine  19866881058730
ttcctagaacatgttgcaagttcaacaaatagttgttgaatgagtgacaaaagtgtactgaaaaattgagattttttttttcctttttctcatgtaaaccttctaaagtggtgtcagatatctccattttgaagattaaggatacaaaggtttaaagagattaaatagtttgacccaggccacaggggtggtaagtggtggagcagggttcaaatctttgtctaactgcagtttatgttccttcttctaagtgaagccacttatcacatggagaacaataggaaagaaagacccctgactgtacaaaattatcctttataacttccctgttcctcaaatttgggttgatgggcctgccactaaaccatagaagcttgcagtgaaaaagttctctgctattttctgaaaagtaagcaaacaaactgaagcccagaaatattgagaagcaaaataataactatagcatgaacagtgtgatggctccaaaaagaaaacaaaagaaatcaagaatggtagcataatgaatgaatgatttactatctgtatcaaaaagtaaccatgagagcccataagcctcagcaaataaacattgttttacatataatttcctgggatttggggtgtaattctactgaacagcaaccacttagtcactttttaattaccctagcagaatttttccaaggtttaacttccttttacttgcatttaagtttttcatcctttgttttctgttttatgactactaaaacacaaacccagttaaatgtcactagtatcctgtttcatgaatgtgtgcatgatgatggggagaagggagttagagctccataaagtttatctaggtaatctgtcatttcccaagtcccaaacctcacccatattttccagcagtccatgtgacagctgtatctaaatccagattcaatcagtgcttcatgtcaactaacacaatcccttaagcacagcttatgtgagtttatattattccactagcaacagacaaaagcatactttctgccaacagtgaaacactttgagacaaagataaaagatgagccacagataaaagatgctttcctgttcaatggctatgttttcatgatagcatttatctcacaaacaaaattacagattggattaatcacttattctggaaaaggcagtaaaatttagggcatcctagtaaaacagggtatctacaagatgaatgttttgcaatatgtgcttttaaaagttgtcttgaataatttatttgcattccggtgcttatgaatcacaccaggggcaaattgttttctgtgtggtttaaaaatcattggtatgcaaataggctatgagctgaatttagccaagcaaaatgaggctatgcttgttaatcaaagtagattgtgaaaatttggcaaagagcttgaagctggagttattcttggtactgtaaggactttcagtgccatactttgtttttatcctttcccttaattacagggaaggcaaacaattatacctttatatccttttggcccatttatactcaaagacccaatttcctactactctcaccctccttttttcccctgctttagttgtcttgtcccttattttttgcaaaggactgtgcacacgctcaccccagagcctttgcactgctgttctctgacagtgtttcttcccaaacactcacaaagtcagctctctttcagtctctgcccaaatgtccacatgtcagccaaga

SEQ ID NO: 29954 - DNA, 1371 bp, Bovine  19866881144983
gacagaattgaagttgcattttgttcacagtctgcaggtgagcatgctgggactacaagaatcatcacacagtcttcactgcgctcagctttctccaaatgaaagatgtgagaactgaaagaagaacaaatttgtttggcttttatgactacttgtcacagaaaatattcttaccttagttttttttttttttaaatttcactgcagagcagattttcaggtatgtttggtgaagaatgaatggatgacataaagtggtgctatcaccgagaggcctgagatggggagacgagcagaaacagctgcagacgctaatgccaatcagaaatgaagctaacgtctggggcacccagggaagaaagacacaaacatcgtgctgtgtgccaagaccagccaccgggcccatcctcgttgtgtttaggacaccagcagtgaaatgtaaatatgggtcagccgagttattttacttaggccaagttgtatacacagtgtgtatccaggctttcagtcagaaaaagaacacatggagcttgctggcctgttttgaaggctgtggaacctgccataaatcttgttctttccatctcagaaggatcaacaggggcagcagaagccctgcctttttcccaccactactggctctagcatatgctcaaaatcatcacccctgccttgcactctcagaactggactgcagccaccagcggggcttctttcggacttcgtgtccagttacagcacttctgtcagcctaaagggctggaggcttgcaatgagtgactcttagcgaaggtccaagtgtctctagactgatccatctcacagactggctgaagaacttggttttggatgcaggcttttattcttaggcaaaacacagtatccttatgacacagtcagtgttaatgccacatcccctgtgctacatcatggtgtctctcagtaataaaactggagagaaacatagaaaagatatggcaagaaatcataaagcaaccaaccggacttcttggtggtccagtggttcagaacctgctaatgcaaggggacgtgcgttcgatccctggtctgggaagatctgacatgccacagagaaactaagcccgttcaccacaactgctgaagattgcaccccacaacacgagagtagccgccactaactgcacaaggcaaggaagacccaacccagccacaaataataaataaataaataaaattattaaaaaaaaaaagcaaccaaccatgttttggaattggattgaaggatattagaaagagaaactattctttatacatttataaatcagccatcagatcagatcagatcagttgctcagtcgtgtccgactctgcgaccccatgaacacagca

SEQ ID NO: 29955 - DNA, 1409 bp, Bovine  19866881147568
acagaagttagcttcttctattgggtcttgtggagtttccctcctgggctcctgagtcccaaacagcccaaatccctggggaaatgaacctctatgctggctggcagtgggacattccacaacgcatcttctttcttctgctgcagaggtcttcctgccactgtgggacaggagccaaaagtatcatgttggctcttttgttttaaatgacccatatctgattcacaagaagtggtggtatattctatgagaactctgaaagtttaagcaaagccaaggcagtgttcttccgactcttctcaccaaatctagtggtatcacatcaagtggttctctcaaagatcaccaaaggcttgggctcagaaattagcatgctccaaaatttaattttgagtgctcaaagcaaagcacaaactttctccaacaagatctccttaccagtctctttccaaggtctctgatatcttttttatgtccttgatttggcagaggggagcaagagtcatgtttttttgggttctgtttcctttaaaaaatcaggatataaggacagggacataagctgtccacactatctgttatccgatacttttccttatggtacctcagtggaaacctgaagcaggcacggtcccatactaacttattacactcactagataacttttgcagtaacaatttaatcttctggatctgtattttctccttcataaaatgagaaaggtgaagttcaatctctagagtcttttccagctctcaagacttggggtttttgaagttaaggttcgatagacagtgtaacatgatggaaaagacattgagatggctatcaagaaatataatccctgctgtaatccaagcaactatttgaatgacattttaaaagtcttctaatttttctgggacttagttttctaacatacaatgggggagtgggtactggatgacttgtaagaatctcactcagggattatttactgtttctgaagagtccctctattataagtccttactttgtcactaacaaaataagattttaaaacaagaaaaatatcacaactaaccacaaaatttatctgagaaacttcctggccagaaaaatcttaacaaaggatgaagtatttaagatcattaatattttggaaggctacacagtgggcatctttggaatctgaaaacttggtttctggttctacttttgcctcttccgcaggtgcataagcaaagatgtatcaccaaatctctttaaatttcattactattattagtagtagttcagttgtcagtcatgtccaactcttttcgaccccatggactgcagcatgccaggcatctttttccatcaccaactcccagagtttactcaaactcatgtccatccagtcagtgatgccatccaaccatctcat

SEQ ID NO: 29956 - DNA, 1794 bp, Bovine  19866881269101
atttgaaaagagtttttacttaattactgctcagatagtgtgttgacatgcttggattgaaagtttctagtaatatcacatgataattcatgtaagcatatttggcatttacttcataaaatttatgctgtttcctctactgctttcttttctctttgtgtgattctcaagtgaacataaatatctaaaataaatcaaatagatatagttattttctatataaagtaaattggtttgacaaatattttgactcacttgattacttatttttgactcagataatttcttcaaggcaagaacattatttattattatatcttcaccaactatctaagatagtcttgtatacaataaatattagggtataaaacagtttgcaaaaattttaggtttaatgtttttgaaatttagcaatttcattttactattgtaattgcttgtttcctaaactgtattttcttaaatcagtcaaaatctataagtccctctggttatacaatataaaaatgtccacatgtaaattcaaagacacttttgaaaaatcagtggaaaaaacctgtgctaaagaaaattggagactgagtcaaatactggatgggaaaaattaaaggtcatgagtgtttagaagaagaaaaatgaaagctaatgatattataaaagaataagggaatatcacctatgactgaacagactagaggtttaatggaactaaaaatgaagtcacctcagaaaacttctaattaaaagaaggtaggcagccaattagagaatgatgagtactaagcactgaagaattgatgcttttgacctgtgatgttgtagaagactcttgagagtcccttggactgcaaggagatcaagccagtcaatcctaaaggaaatcaatcctgaatattcattggaaggactgatgctaaagctgaagctccaatactctgggcacctgatgcaaagagccaactcattggaaaagaccctgatgctgggaaagatagaaggcaagaagagaaggggacgacagaggatgaggtggttggatggcatcatctattcagtggacatgattttgagcaagctctgggagatggtgaaggacagggaaccctgacattatgcagtccatggggtcgcaaagagttggacatgactgagtgactgaacaacaaatataaattcatcggacagtttctctccctcaaggtatctctaagttctaatgtttaaggttagatagagactattgaatgggtgagtctgtcatttctaagtgaaatgaataattattcatctagttcctatctaattgaaaacatcttcaattataatctgctaggttgaaggcacaatgtcctttaaatagatatgatatagtgcctcccctcaagacacttccagtctgaaaacaactgtaaagaaatacttctgaattccttaaaacgtatgaacatctcgtacttctggaagatgcacacagactaaggaggtgctgggaaacctctgaggttttcgattttctctagcacctctgtcaaagcgagcattctgttactgaaagcgtgactgtttctttaagagactttttgaacagacagagaaatgagtaaagagtaagagctggtaggttaaataaacaaaattatggaaaatcattgagaattcaaatcttcaaacttcatatcaaacacacttttctacccagctgctaatgtacaagaacaaggaatgaagttagcattccacaatgaacctacacagataaaacacagagcaacagattcttcagtgacattaata

SEQ ID NO: 29957 - DNA, 1122 bp, Bovine  19866881410421
cttttagatttgaactacggggaattcaaacagatgcttcccctgagagtcttcttggattgcccttcaccttgttgtctgctgttgtctgcagtgaatgaagtttacttcctgataatagatagatcctaaattcttcagtcaaatgatttatctctgtagttccaattctaacctgagaagccagtatttgcctccaggttaaacactcaattactccgagtttactaagataaactctgcgaagtcctttgtcactctaggtatgacctgatagagctcataggcaagcatatgaaatatggatcagccaagcatttcctaaaccagtaaggagagatttgtgtgtgtaattagagaaaaattggggctgacataagattctaggcttccgtgtccaaagatttcagcaattacattccttttctttagaaataaagacttgaagccccctagcccacagtgaatgagctaacttcagttaagcatctgaaaaattcagggcttttagccaaatgtctcatttaaactgtctaaattcattaaacttagagaaccaaattgcagatcttcaaagaacaggtttactgcacgaatcctattctaactgctgtttctggacaaaatgaacaaggttttggactactttaattctatattagagttcagcaattatataatgcctctccccagatcatccttcgtatctttacctgtatcattttattcttcttttacttttctgtaaacactcaatgaaagcaaatccagatattacagccaataggtatgaaatttagtccaaaattaagatcatctttaagagtccaaattaattaattttaaaaatgtcaccatccttagatggaaatttgaaagttgaaaagcaagagtctataagttagcatagctcctagagatagaactttaaatatagaggcaagtttcatgttttccatgaacctttgtttaggaataatgagatatctgcaaggagaggctaagacacttggcaaaaattagataatatggttaaagctaagcctagaaatgacaactcctaattcctacctaaacttaagaatccaaatggaacaagtgaccgtaagcccccctgcaggc

SEQ ID NO: 29958 - DNA, 1605 bp, Bovine  19866881450323
acatgagacctagacttgagatgaataggttttcttaggtttcacttttattcctctcttcttgttcatctctttgcatttgtgaaactgattcttatttaaaaatccttgagtacacaagagaagctgctcagtaaatctgcatgccttttcagtggaaatggcaagattttcgctggcagcactagtttcagtggagcttgtcttaaaaatatagattatgacagaatctaagaaaaaagcagaaccttcagtttttacacaggcactgtcaccatgggtgatttcatatttcacgtatcaggccaaatgtctaaaagaacacataaaactgaaaatcggaaataaaaatcttttatttttgccaattagtgtaacaaatcctgcatttagacagtcatccaaatttgttctgtaggacccttgaaagacagaagaatctacattgttttttcttattttggggtgaaaactcatgtttagttaccattatggtttcctcctctgcctaggtagaccaaacatcttcacatctgggctatttaagagcctatcagaacataagaacaagaattaataactcagaatagagtttggcttatcatgaaataatactgttttcaataaatatctgttaagttgaaattgttttgtgaggcactgatgagaaatcatcagatactgatgctgtctgctgaccttttatcagggtcactttcaagtcagacatcaagcctgctttccattctcagtctggagaacctattatgcttaaaggctttgtttgcaaaatacattatcaggaaaaggaaactatgccactagaaaagccctgtgtttacacagagctcagtaaactagtttacacagcagtaaaaaataaaaccagtcatgtctcttcttcccctataatgttagatactgaaaatttctaggtgtcaaaaaccatagtaagtgtgccccagggaaaccatagttatctctaaaaattcacatatgtactctcaccagaaaaatttgcctttgcttcattgttttggaacaatcgtccaaattttcttgcaaaataaactttacatgtacctagaaggctcaattactgaatgtaattttaagttcaataacaaaccgcaaggggaaacactcacagctggaattagaaattctattttacttttagtttgtaatacaagttgaactgaagacataaattatggtatgctgctgctgctgccaagtcgcttcagtcgtgtccaactctgtgcgaccccatagacggcagcccaccaggctccgccatccctgggattctccaggcaagaacactggagtgggttgccatttccttcaccaatgtatggaatgaaaagtggaaagtgaagtcactcagtcgtgtccgactcgtagcgaccccatggactgcagcctaccaggctcctccatccatgggattttccaggcaggagtactggagtgggttgccattgccttctccgaaattatggtataagtcttactaaaattgggttcagtcataatgtcacaaaaaattattgtgctaaagtcttccgacaatccaataaagaaatgactgtaaaagagagg

SEQ ID NO: 29959 - DNA, 1170 bp, Bovine  19866881459023
atcttacctaaatctgatgtttctgtgatttacccaatgatcataattaatactgaattctgacctccctccaccaacatacctcccctgctcctctgcactcccattctggactttctgtcttcctttatcatgcttgattattttaattttttccatagaattactcgctttttgtatctttccacaaataaaatataagccttaggaatttttgatgttgatcatcaatgtttccaaaacacctagaacagtgtttgatatttagtagacatttgaagcacttttaaatgaatgaataaattaattaatatgagaaaaatgatacattctggctaaaatctaatctgcgggcaagaaaaaccaagtagacacagtgagtttaaagggtacagtggtttgaaaggaaaaagtttctcttttcaatctactaagtccagtttatgtcattatcttacacaaatgtaacctattatgcaaaaaggtttcacattttcagattacatattatagaggaaaaaatatatgcttctgtattaaagagaagaagaaacaatgactgatggtagggaaacaataggacaacatagaactgttgcgtgcaacacttgatctgaggagtgaccaagagtccaaagctgagcggacttcaaagaggacttgtagattcaaagcacctgaattttaaaactgggtgtaatgtctggcgtgatctggcatgttttgaaaggataacgttctgagttatgataaaacttcataaagatttatatgtttcttgaagcttatgatttgtgtatttccttcatctttccctttgttattataaatcccagctgttattatatgcatttataaaggattggtgtgccatatattttcctgttagagactgtttggatgccttcaatccatgaaatgtgttcagattttgaaaacttcacaacagaaagggattttttagaaaatagaaatcattaggttatagcatgtattggtagtatcattaaacattagaaaagcatagtttaatgttaaaaatagctgagttttatccttcatacagtatgtttatctgagtgaagtggaactgggaattaaaaagagatgaggcagttgaatggacaatggcagaaacctcttgggaccagaggggtaaaagccaagcaa

SEQ ID NO: 29960 - DNA, 922 bp, Bovine  19866881597303
ccagaatctcagattaaatcatgttaaagaatttttgcaaatatgagaatacatcctcacctttaaagaatgtttccaacattcattctgataaagatacacctacttcagttgttgtttctgtcagtcatcaagtgatttcccattaggtgatttacactcagggatttgcatggtagaatctgcagggccaggattcttaaatcattagatcatatttgtaatatctttagggatttaaatgattcaaagtttttgtgtgtatgtaataattgaatatatactaaatgatgaatatatgtcactccacatgctaagatgaatggatgatttaatttcaatattaataaccagaggaaaaaagtgtttggggcaaggaaaatgagatttagtaaatttagtaaactactcattggaaggtaggttatttactaaagaactatatccttacgttttctctgatgttaatgatgaggggggaaagactagattaatcatattagcatttggtttctactcaaaggagaaaagctaagccaaaaagaattgtattgcattgtcaattaaaattaaatgtgagagattaattaaatctattgcattcactcagaaattgaatttttagtgcactctatttaacttgaatgagggaacacaaaattagcagcattactcatgattctgatcctctgatctattaaacataataatgtctgcactggttatctcacaatattgctatgatgatcaaataatataaatttatttaaagccacctgagatcttaacatactatatagattcaatgttcttgtaaacttagaatattaactaacaacagttccattttgtcttctgaattgtattgaaaatcaaccgtcaatatatatagcctaatagagaagaaaacaggcatcagaat

SEQ ID NO: 29961 - DNA, 1500 bp, Bovine  19866881632741
tgtatgcacaggagacaatgaataaatgtttggctttagcaaaaatgttaatataagggaagaatggcagacaacccttggaaagtaggcttaggaaaactttgggaggtctatgagtgacaagtgaaattaaattaaaaggaggcattggatatttaatttttttataaattctacttctttcacaaattatcagataatggctataaaatcatatttatcaattgatgctgcttctcttgaggtattgaaatattgagggaatatttttacttttaatatcttttactaaaaatctaattgtaaaaatgtaaacaaaatccaaggatggatttgtttggaatgtatatatgtacacagcttcagcctgtatacatttttgacagttgaaaaaagtacttggtccctgagacctaaataattagagaattgtgtgtatactcgagctattccttttaaatgtaccaccaggtcttctataataacatggatctctttaataaacttacagataatggagaaaaaaatgttcaagcagagatctgatgcagtatgtgttttccattaattgatcagtttgtgtaattctgtaattctgttataccttgctgggaatctcaaagaaatcaataccgaccaagatgagatagtttctctgccaacctgacctgtgtttaatcacaattcgttagcaatatattgcaacttataaaatccctattctcttctgagcccaccctgctttgataattggaggctcatatacctcataattgtatgtcattcaagtgtcataatcagagtagtctctgagttctatgaaagatgttaagtttcaagatgtggtgtatgatttatgatgattgttttcttctcagtttaactagattctctagagaactgaaaaggaattttcatcaaatcaccctcaggcctctgaaacaccagcaggagaattgtgagtcccctataaccggcaaggccacttcctctcaagtgaagacattttaaaactggtcctggcaaagtaaatatttctaaatgtccttgaatgttgtcatgtcaacttcagtcatgcatctaaaaaataaattcatgacacagagggcttaggtaagtggatcacaataaaatgatcactatcatggtttttaacatgattattatctctaaccatgatactgatcatttgaaaacctattcaaacccacaaagattcttctttaatactttttgtgtttgttagctctcaaaagcctctcctttgtcttagaaataccttgagctcaatcaagtgcaaatcaagctgctaataatgaatttagtcacaatttattgagagttcactgaaggtgcaataatactaggtgctgcagcaagaaattttaaaagaagtcacactgtcctgatattttggaattaatagttttcaaaaggagatggtgtaggacagggaagcctggggtgctgcagtccatggggttcaaagagtggacacaa

SEQ ID NO: 29962 - DNA, 1821 bp, Bovine  19866880107772
tgtttcttgacttcctacttttgcgttccagtcccctataatgaaaaggacatcttttttgggtgttagttctaaaaggtcttgtaggtcttcatagaaccgttcagcttcagcttcttcagcgttactggttggcgcatagacttggattactgtgatactgaatggtttgccttggaaacgaacagagatcattctgtcgttcttgagattgcatccaagtactgcatttcggactctttttttgaccatgatggccactccatttcttctgagggattcctgcccgcagtagtagatataatggtcatctgagttaaattcacccattccagtccatttcagttcgctgattcctagaatatcaacattcactcttgccatctcttgtttgaccacttccaatttgccttgattcatggacctgacattccaggttcctatgcaatattgctctttacagcatcagaccttgcttctatcaccagtcacatccacagctgggtattgtttttgctttggctccatcccttcattctttctggagttatttctccactgatctccagtagcatattgggcacctactgacctggggagtttctctttcagtatcctatcattttgccttttcatactgtgctgcaagtaagctataaacaggcgttatttttctatatccttttcaccctgtagcacagttctgcaaagaaagagagggaccatctaatattacagcagagaaccccaaggcctggggaggccagaaagtgcggtgacgagcttgggtttctgtagccaggctacttaggctggatctcagctctccggtttatgaggggtgaggcaaccagggatgctctgtggcctctctgagctcagctgcctcgactgtgaaataaatggcgatcacaacagcacccacttacctagaagactggggcttccctggtggctcagtgggtaaagaacccgcctgccaatgcaggagatataggttcaatccctgggttgggaagatcccctggagaaggaaatggcaacccactccagtattcttgcctggagaatcccatggacagaggagcctggtgggctacagtcctgagagttggatgagctggacatgatttgttgactaaacaatgacacaatctaaaagatttgctgtgaggatgaaacaaagcaaccgatggtatgtaagtcaaatgcttaggatggagccgggcacatggtaaggtgtctgataatgtcgaattgaatgattggggttacccagccggtgcatggctgctgaggacgtgaacttggagtctctggccccagagccaacgcttgccttgcacctggggcggccttgggctccaggccccctacccccagccccagccccgccccagtcggtgctttctcccgcagatcggcgctgctcggcaaggtgctgcgcatcgacgtggaccgcaacgagcgcggcccgctctaccgcatcccgccagacaacccattcgtgggcgaccccgccgcgcggccggaggtctacgccttcggggtgcgcaacatgtggcgctgctccttcgaccgcggcgacccggcgacgggcgcgggccgcgggcgcctcttctgcggcgacgtgggccagaacaagttcgaggaagtggatctggtagagcgcggccgcaactatggctggcgcgcccgcgagggctaccagtgctatgaccgcaagctgtgcgccaacgcctccctcggtgaccgcccccgccaccccgctctgagcccccggggacccctctccccagatctgccacccctcactccacg

SEQ ID NO: 29963 - DNA, 2043 bp, Bovine  19866880369329
ccaatctcatctcctgacaatgctttccttggctgaacctagctgcaggccagtcagctgaggagcatgggaaatgtagtttgtaggagctggtaaagtatctgcctgcaattcaggagaccagggttcccatccctgggttgggaagatctgctggagaagggaatggcaccccactccactattcttgcctggagaattccatgaacaggaacctggccagctacagtccgtggagtctcaaagagtcagacatgactgagcgactaacactttcactttctcccccacaactccagagtcctgccaatgctttccttggccgaacctagctggaggccagttagcggaggagcatgggaaatgtagtttgcaggagctggccttctgaagtagagagcgggtaagaggaggaccagggctgatctgaggacaaataagcaaataacaggacatcatgcattcgataaaattataaactcttgacattgaaagtacaaaaagaaggaatcaaactgactaatgtgagaatctaatgtattaatagattttgcctgtgagcttcctggcaaccagggcaaaaagagaaagcataattctcgttatcttatatgaggccacacaactgattctccaagagaggccatgtttgtcatgtgactctcacagaggggagacagagagacaggatgaatgtgtcttcagtgatgactttaaaaaatggattcctgatgaagactgaaggtggaacacaagatatacagatgaacatacttcagaattggggttcagcaagggtccctctggggacctcaccagtaccagcctagaacctgactcttacaggggaagaagtaggcatggctggctcagggcagatccaggaatgaatgggcatccttgcctgagtcagctgtcagtctcttttctcagggctggatgtccaacagcctgagctgtcctttgcggggggtacctggtttggggattgtgtgtggctccccatgtcatgtatgttgatctcacaatagaaaggcttctggtcttggttctgaaggttgaaagtcctgggttcaaggtacctgacatttctgtacctcgggtttcttatctgcattaataaaggattggccagtcagtcgccaatcctggaaaacctaaactagcctaagcattttggtcaaagggaatttaatacagggagttggctacaaaggtattgggagggctggagaaggaaaaggagagggtcaagctccctagagatgagttcttgtgagaagcgaggggaacaaaaggcacaaaggtcttggtgctgctggggtttgccgctcctggtacccagatgtctgggcagaaagccaggagtccacactgaccagccgctgtcgcccttcctgcaaccattgcttccggaggcagtgccagagaccagggacatgtggctcctcccttccccttgcctgccaccctctcctggcacgccctaactgggagctagctgactggcagtgtggtggaaggttcccaccctggcagtaaaggaggtcactgaggagtgagtgtggagctgagcacagtccacaccctccagcccgcctccctagaagttacagccataacaaatgagaggctgtcacaagtgctcagcttaagtggctggtgcgcgggtagctatgatgatgaagaaaccagtcgtgctagtgattgggtcaacggtttcacttgatcataacaggcaggggctagttgtgggggagtagttgaaaaagcactagaccagaaccagaagtcctgagttcctgtcccagctctgccgtctatgggctgtgtgatcttgggcaagttgctcaacctctctgagcctcttggatctcattggcacactgatgtgaatgatcccttcctagcctgccagatccttataaaaaccacctcctataaaggatatggaaagtctttccaactacgaaatggcatgtaagagagaggaggctttattgctgtggttttgttttgtgtttatggctgacatttttgttt

SEQ ID NO: 29964 - DNA, 1496 bp, Bovine  19866880380767
attggcaagtgggttctttaccactagcaccacatggggagccctggggaagttcagttaaactcgattccgcaggacacagggagcccagtaccaggcctggccctcccaacatgtgtgcatttccctccttcctctccccttctcctgggtcgctcatgtgaggacctcgaaggcagaactgcccaccaggccccttgcttccttcactgggccattctccacccagaaatgcctggcaggcagctcgcccaggggcaacaccacggaggtgccaccgtgtgatacccacatcttttggggaaggcgattcccccacaaaacaaaagcacagtctagggcagaagacaatggcctccccctgcaggctggcccgagcccctccgggcatgtacagcccccagcaggtggcaggtgtctggacggacagatgctccagccgagggcgaggtccctcccaggactgagtcctgctccctacggtgtttctgctgcccgtgaccttgtgcccacctccccagctcactcgagcctcaaggacagcggcgggccccagccagtgcccacgcagagctggcgctcaccgcctccccatcagtgaaggagggctggcatgtccctgggtgccctacatgcccaccacgggaggcaggggctatcacctcacagtacaagcctccccgggggcagcgtggccacagccacaggccacagagctggccgagtcaggggtgccccccagtggggggaggtgacgcccggcatccgcccaggctcagcctggccttgaaaggggaaagggaggtgtttccgagtgacacacgctccctgagggctgtcctggaaaccagagatcctgaaggcaccacccacctcctcctcctctgcacacttcacactcacacacggagctcacactcatgcacatacgcacacgcgcacacacacgcacacgtgtgccccatccctctcctgggtctcgacactgagaaaacagtatcgagtcgggaagcagtcaaggggtcatttattttaattattaaaacagcagccacttactctcaagccgtccgtaatgccacttaattacctactacataaaactgcctttgcatcttagcagagcaataaatcagctcggaaccagagttgtttaaagcattctagccgaagattcagaggggtgggggggtgaggagttgccccctcggcgccccgggaagtgataaaccaggtctctgctctgaagccgcggccacagaagggagaaacgggccagctcccgccagctgggtgcgggccggcaggccagggtcctctcccggtccctccgtccactgcgcagccggcccctgccctgccgcgctccatcctttgtgtggcccacaatagccccgccagatggcatggcgcggccagcagccccttcaagccaatcgctcatcctgtcgagacccagcaggggctatgggcaggacacctggaacggcgcaagg

SEQ ID NO: 29965 - DNA, 1902 bp, Bovine  19866880400052
cttctcctgatttttaacttggttatgtcttttggctcacacccaccaagagaaacccaatttttcaggtaacacaactacaggaaaaaacagttcttcccagaaacttttcccctgtgaacaaaattcttaagcttctagggtaagggcagtaaatcatgttgcccccaaggcacaaagatggggagaacagtaagaaaaaaaaaaatcctttaatcctggaggcaaagaaggaccagaaaagcatgatgagtcctgactcagaggtggtctattgctgggggaagaaaaagaaactcacttgctaaagagtttgtctcccacaaaaaaaaaaaaaaaaaaaaggagcacgagacaggagggaaaagggcaggacacacatgctagataaataaagggctgcaacccttaggatacagactggctggaaccagttaaaactaaggtggctctgagaacagtccaatcattgacctgtagttcattataccttcattgtaataggtggtacagttggtaatgaacctgcctgtcaattcaggagacataagagacatgagtttgttcaatccctgggtcaggaagatcccctggagaaaggaatggcaacccactccaatattcttgcctggagacttccatgacagaggtgcagtctgtggggtcgcaaagggtcaaaacacaactgagcgactactgctttcacttcgacgagatggaagttccttgggcagatcaccatagtaatatagacaaagcccatctcttccctttccaaatgcttaggtttgaaaagcaagaccgtatctacatcctctccgtaccaccaataattcgtatctttttaatcccagtctctgcagcaggacagttctgaatacccactatgtaccaagaattacgctgggcactggtggttataaaggatgaataaaacatggtagctcctacctaaaggaaatcatctatgacaactaaactgataatgttgttaagtgctgaagaaacacagcagcaggaatggctttctctgggggcgtggggggcactgagtgcctccttgaagaggcagtatgtaaattgggtcttagaggacagaagtctggctgcagttggtcatgaaccttgctaattgctctcgacacttgaacagtaattcagtgagacagttataaaattctgtttaaggaagcaccctataatgtattactgcgaaattgagttcagcatctagtaacgctgttcggggtatagtcggtgcagggtaggtgttgagttcatgaataaatatatgaataaagaaatgaaggagaagggcaccagtgatggtcactaattctgtgtagtcatttctctgtcctctttttctctactcctaggacacaaggaccttctactcagaacactctgccttctttttaacacaaattctcatgaaaagccagtattatataagcataattttttttcctgtatttcttaaacaaagacacttttaggctcaaatatcccaccaagactaagtagaagagagattagtctgtttagagaaaaggaaacttaaaatcaacagatgacttaagccacacagcgactagatcttaactacatttcataagtaagctgctgctgctgctgctgctaagtcacatcagtcgtgtccgactctgtgtgatcccatagatggcagcccaccaggcttccctgtccctgggattctccaggcaagaacactggagtgggttgccatttccttctccaatgcatgaaagtgaaaagtgaaagtgaagtcgctcagtcgtgtccgactcttctcgaccccatggactgtagcctaccaggctcctccatccatgggattctccaggcaaaagcactggagttgggtgccattgccttctc

SEQ ID NO: 29966 - DNA, 2221 bp, Bovine  19866880473141
tgcctgactggagaacaaggaggtgaattcagggtgggcaggggctcgaggggcatgttacagttcaggcttcttggtttaatgagagcctgtttgagcacagcggtaacggtcacgggcggggctgtgtgtcttgggcccacccgctggccctctctgtgcctcagagggtgcgggcagtagcactggtgtgggtgaagcaaccgccttcttgaccctgtccctccttgttcttgtccctgccctgtgaccctccagggccccctcatggcacagaggacagagagccttgccctttgtgacccaaggggtctggcctgagctgtctcagagtgaagcctccagcctgggctggtgcctgcgtcctgggagacctggggttggagaatgtctaaaggagcaagagggggcaggcgggggggccttccgctctgctgctggctggttagagcagaggtgcggtgcccagggaggctggaggttgctgtgttgggaatagtgagtgtgcggagtctgtgtgtgtgtgtgtccctgtgtgttcacgtggttaggtgtgcctgtatgtacatgcatgtctgggtgtgcctgttcacccacccacgtgtgtctgagtgtgtgtgagcactggtctgggtgtgcaggtgtccgtaccgtgcccacccagtgacttctgcacagcaccgaggtcctgctctgctgagcactgtctcatgggtgcctcaccacaagcccatgtgacatttcaaggtcatcatgcccatttcatagatgagaaggcagaggctcaggttgaggggtggttccctgctcccaggaagcagcagagccagacccttgacccaagatgctaacaggagcatctggtgtcagctgtgaccctttactcctcccaagcaaagtcaaaggctcccagctcccacctttcgggtcccctcatccccctcatcccccctcccgccccatctttggctctaaagcaggtcctgcgcacctggcgagtcctcggccgcctcgggggcgggggcgggggcggggaaggggaggcctttcccgaggtcggcgagcaggggacgtgctggtgtggatgtagctgctgaggctggagcacttcctggaggaggcgggctgagggtgtcaggtgcagaggggggcagggagctggagtgggaaacaacaggtactgaggccagagcggaaggtgatggggtgagggcgtggtgggagccgaggtcagaggagagtctgcaggttcacgagggcatcttgtgccggcacggaggcgcggggacagaccgtggttcagcaggactcagaactccgggcccaccccagggctcctggatcggagacttggggtgtgggcccccgggaaggaggggagtgtgcattttaattcctcaccctacttggggccgggggggaggggcaggggggtgggagtgtgagagctcagcgcctcctggtgccaatggcccctccgccttcgggcagcgcctgcggcctcctgcttggctcagctggaggacacgggaagcctcatcgggcggacagggcgtgcgcgtgcttatgtagtctgcgtgctcgcacgtttctgcgtgcgtgcgcgcgcggcctctgacccgctcgtccctcccctgcaggtacggaagatcgcgcccgagtactacgaccacctgccccagcatcactcgtgggtgaaggtgctctgggattttgtgttcgacgactccctggggccctttgcgcgggtgaagcgggtgtgcaagctggcggagaaccgcctgtgagccccacagccggccggtgccctggggcccgtgtgccccgctggatgcagggctggctgtcaccgtcccacggcctagtgtccagaactggttcggctgtatttggttcccgcgccctgagccactgctcactggtggcagcgggcacggatggcggctccggttgtacatggaccggtgacctcaggccggccctccctttcagggctgggcctgaccctgccctgggcactctacgcttaaggagcagtcctccggcgtccccatggcctaaattaaatccagcattggttttcaagtccccagagcctgcttcccctgattgggcctggctccctgcaagcagggcctgccctgtgccccctcgtggggaccacactgaggcagcattcggctggccccaggcatgggcagaggtccatgcggccctcggc

SEQ ID NO: 29967 - DNA, 3661 bp, Bovine  19866880504081
gcctagaactttcacaacagtgcaagaacttctttggtataattgttttccagtttgtgggtcatctgctcagcagctctgcggtggggctaatggcaacttcctccaagaggtcttaggccacacgctgctcctcccggctctgctgcagccagagcccctgtccgcacggcggccgctcctaatccacaccttgcaggagacactcacacactcaaaggcaggtctggctcagtctcttgtgcggccccgggtcccggtgcacacaagggttttgtttgtgccctctcagtgtctctggcgagtatgaggtttgattccaaacatgattttgcccctcctaccatcttgttggggcttctcctttgcccttgatgtggagtatctttttttggtgtgatccaacattctcttgtcaatggttgttcagcagctagttgcaaatttgggtgttcttgcaggagaagctgagcacaggtccttcagtccaccatcgaagtcatactccagagcttattattaatctatattaggatcttgaggatgagcaaaaagagtttctgagtatttgggaaagtaggctcatagccccaaactgggggagcttccattaaaagaaagctagtgacacaaatcatatctccttttgttacaagtttactagactgatgggggataatttcctaagaacactgaacataatcccacttcatgtaatagataccagaggtaaatgtacactgaataaggtctggttagatggatttatagccattcaaattaccaaatcacaaatgttgatcaacaggttgatgtcaacttgaaaagagttctttggagataaagctgcagggctctctggtcttgctttcactctggttagcactttttttttgttaccaacttttaaatatatgaggcatgctttctcagattaataaatgtattcaaaatctgtagtagaagtttgttagatgacactttagattcaactcattcttaaaggcgtgaacttataaaccaaaattaacaagatgcagatttgtcaagaattacttgaattcacaaaaatttagttgtgtgtgtgtttgagatgaagacctgacttgggaggaaaaaaaaaggttgtatgatgtaatgttccatttacagaagtgaactataaagttttccccagataggggaaaggtggtgtttcgctctaatgataaattgcgtttctcccatttactcactgtggaattaggcaagttgcttcatgtctctttggctccattttctcagggataaattgtgaggataagaaagcatagcttgcgggcgtgctgcaactcggcagacacacagtgggcatgttggtgaatattagtatattcactcatagtatgcagatcatatggggaatgttgttttccacattgattgctaatgtttagggaggctcttgaaatactaaaagccacattgagaaaacagagctgtttctttacccaaaagagaaaggaaaagaaaaattgtcttcacatatttcaaagtcaatcagtagataagggaaaggtattttcaaggcctaggcggctaggtgggagccacaaagttgttgaaaggtagatttcattcattcattattctgcgccatttatgtaccagatcccggggatgaatagaacagataaaaatcaatataaggttaatgcaaaagtaatgtaaaaaccagttattgatacctagcaataccgtaggctgctttgtcaactattaaggtcccagtggaaatggcgaattgaaggtgaatgaccaaacgttactgtttagaggcagtctgtgtaccagaagagaaaattgagtagtgacctttatagttgattccagtttgtaagtatccataattctaaatgttgaaaatgcatttaatcttttctcagttaaagtgatacatttaaagcacattcctgaaagatgttgttaaaatgccttaacatgccgcttgtttacagagagaattttactttgtggagctcataaatctctccatcattttcacagtagtcatgaactgctaatgagaaaatttagaactctagagtcttgtgaaaaaaaaaaattgaagagtaatagggaacaggcttctagaacccgaggttggaactgtttcgggagtgactgatttagaggactgtctctattctggtttatgtgacttattttctctgtgttacgcctgttcatcctgtcctggagtctaacagcacatagggtagattattagcatgggttttggcgatgacagcagggtaaaatgggtttgaattcttttccatccctatttaatccctagtggactgttcctgatcctttttttccactctgtccctctcttctcagcagaagtcttggcacttcccaaagagaatggagatgctgtcttatgatttattttctcccccttaaatgattttttaaaatatctttctcacactcttccttccctctgtctcagagaaaaagcaagctcttttaattatccctaggctttttattatctcttggccccttaaccacgaagtggcttgctcagcctcttctagtgactccttctggctaccgacattgttcattctcctctatgctgaagaaacaataacctgttttttagcctgttcattttttatcacccatacagttttccttctgccctactgcacctccagaaagtttcttctatttacacatgtgtatatgtctgctttattgagataacaattcacgtatcatacaaatcacccatttaaaaaggtacaagtcagtgagttgtgcacccaccactacactgaacttttaatgtttcataactaaccaccagtcctagtaaccttttcttttttcctgtcctttgatttttctttagcatttgttgctgttggctagtgcctcttggagaaggcagtggcacccactccagtgctcctgcctggagaatcccatggacggaggagcctggtgggctgcagtccatggggtcgctaagagtcggacacgactgagcgacttcactttccctttcactttcatgcattggagaaggaaatggcaacccactccagtgtccttgcctggagaatcccagggacaggggagcctggtgggctgccatgtatggggtcgcacagagttggacacgactgaagcaacttagcagcagcagcagcagtgcctcttacttaaagctggtgttcccttgatttcttatgtaattaagggtggaaatttccctaccttttgaccattccttccctttctgtccttcctgcttcttaaagttcttcagagttgtgtccctgtcttcacgctccatccttctgtctatgaacatgatgttacctgtcacgtctatgtaggtgaatcccaagtagatgaatcctttctagagttcagtagccctgtttatgggtctggtggttatttctgcacaagtatctagtaattatagaaccacattctttccctcctctatcgaaaccaactttttttttcacacttaaaacatagtaaattaactgaaagtcaaagtcgctcagtcgtgtctgactctttgcgaccccatggactatacagtccatggaattctccaagccaaaatactggagtggatagcctttcc

SEQ ID NO: 29968 - DNA, 1132 bp, Bovine  19866880549819
ctcccgtgggaaatggacaaggcggccccgcagcaggcgtgctcacagtaccttgacgtccgccagcctctcttccttctgccagtcccacacggacagcacgtggtcgttggagtcgtccaccgcacagaggttgctgcctccattctaggaaaaaaggaggtattcacaggaagactacactcgagaataaagcagactgagcgtgattaaaaaggaacataattttaattttttaatcacgagtctgctacatctttattaaagtgtatttacccatcactgttgagatctgcttaggacttgggcagacagatggtggggacaggggaatgtgggggttaccaggcacaggagcaggagggagagctctggggcggacttcagtaccgcttccgttagacctagcctcccaggggctgcagagctctcgcactggaggagacaagtgtctgcagctccggggcacagggcacagggcgtggggctggttatcgtaaggttgtatgaggggacaggtgctgggggtgaggcgcaaggcatactgatgtgaacacgtatgtgtttctaactggctgaactagtgcttcaaagggcggttcatcctgaggaagcctggggaccacgaggcccctccagcccctgcttatggccaggcagtgggtggggatggcacagacaggcaggggaaattcaaggccaggggaggcaagactgctctgtgagcctgagacagtgtggccgaagggcctcttctcatcaccatggaaatgtctgactgggagcgtgcgggactaggcatgtgctccctctgactgagggggcctggcaagcgggaggtttcagagttcagatctgggcacacatctgggcaggttcgggcgtgttaacctctccctcttcaaccttgagctgagtctcacctccctgtgtggacaaagctgcaagacccacagggttcacacttacagattttgagaatgcgatacaggtgacggctcggtcgaaaaacccgattccgacgacatgcagcgtattcagcgtcacggaatcccagatgcgcacgtgtgggggtaactgctgcttcggaagaaaatgctgggtcactcatcatgccgggtctgcaaattta

SEQ ID NO: 29969 - DNA, 1642 bp, Bovine  19866880550351
tgccttttttggccctgcaccctctgacctcaatgggctgggtgttcctggtccccaggcccctggaggaccaaagtgcccactgcaccacgcccctgttcaccctggactttgcctggaggggtcaaggcccgtcccgacggttatctgcctgaatgtgtccagagatagctccggaggggcgagggtcagggggcaagcgtagaggtcccctggggcctccggcccacccccttgcttcccgcagaggggtcgctccctcctctagcaccctgctgtccttgccaggagccccactgggaaggagcccagcccccactgcttcagttgtccttccaaagtgaggctctggcgaggagcagacccacgaccccagggcgtcctcagggtcctcgggagagaggccagagccctcacctgcttcccagcctccaccgccgccactgccgccattgacggggcccctcccatcacgcatgaacgcccgacgccccacgcaccgctaggtccgcctctccccgcgctgcctttgcgcctgcagtttcttctgcccagaagccctccctgccctcctgcacctgtgcttccctcattcactcagcaacccccgacctctggcggctgggcaggttgccccagaaccccaggggtctcccgcctccccacccgctctacgctgcaccccacggaggtccctaaaatgtgccaaagagcaagtgcctctcctgctcagaaaccatccatggctcccactgccttccctgagtctgacccccactgtccactcctctcaagcaggccctgagtttgtcctgtgcccttctgggggctggatgcacctgggtttcactttctgctcccatgtgaccttggaggtgatacctgctcactaaacagcaccccccccccccaccaagctatcaacgggaagcttgaaccacaggtgtctctgagctcccttagggctcccaggtctcgatgctggaggaaaagcacattgagaacgtcccaccacgccctcagggaagggtctggctcctcctgcctgcagcctccgagcactggtgccctgaccctgccgtgtgatctgcagaaaccgctaacctttggagtctccgagaggattaaaataggaaactctctccgcctcccacatggggtagacggttttcacagttcacacagcactttggctcagcgagccacggctgccattccagcattttcagacgtgacgatcaatacttaaaaatggataaaaaagaaaagagagagaaaaggtgagtggtggtggcgacaggaggtctgctccccggggcctccacgtgccaccagaatgcatcctcttgcttctgaacaggtctgaggtgggacgtgacacacacacgagtgaacgtgcatgcagacatcccaagtaatgcctgtaaacacacaaatgcaccaacatccacaaacccgcacacagccaaacactcgccaccctctgccacccacaggcgcgtcgaccggccacacacacgcgcgtaccctgagtgcctgcacccgtgtgcttctgcgcacacctccccctcctcggcgagctgggcatccccttgtctgacttgcctctgagcgaatccacggggtacacgcaaagacacag

SEQ ID NO: 29970 - DNA, 1762 bp, Bovine  19866880611081
atgggagaaccagggctgcatcccaccttctgctcaggcttctgtgccatcttcaatgatctgcttcaccttgcacgcttgtctcctcatcaccagagtcctacttgtcaatctaatgtttgttcttctgcccaaaatcctgtgacctttacgggtaaaacagataagctggctggtgtcaaggtaggcagggtagagaggctcatccagccttcaatctgcccccagaataagcactcatccgtttgttcagcaaacagagaaggtttgctcgttaatggcacttggaaagcgtcccccgctgacttccaggggtgcgaacttaacggtgaaaatactggaaagagtggtttggtcttccaagatcagatgttggccaaagccgtctggttaacaccaaaaggagctggttgaccgtgacattggcaggagcccacattttgccattttatgtgcattgtgcttagcgggaaagacagaagaaagagggatggacacagagatacagaggctgagagatggctggtgatagagaacctctggccctcacctgtccctgcctggaccacacggacacccggtgaatcctcgctggacgggcatctactgggtcagccaccaactccctccacaagttaagttcgacatcattttgctgctgccaaatctttcccccaaatgacagattattatcaggttctccattagaatagcttagaaggtcttcagaccctccaccatagtagtaaaagtcattcaagctgtaaagaaccattaaacttcaaactgggatatttctaataaatcacctatgcccagtatcttagtccatgttgaacagatggggaaactgaggctcagagagggaatgtgatttgtcaggattgcacagacagccagggtggctgtcagaggacaactgtggtccctgaaccagatgaaaagactgtaaaagcactctggggcctcgtcaccggatgcctgccccctagacaccagactcaaccagccagttcagaaagcttctctgaagtcagcaaagccctgtccatctgcccctgctttgggctatgtgggggcttctaccttcgcaggacagtggatgtccccgtgccagtaattatcaaccctgtggctccagaaaccaacatcaattacaaacagaccttgcctccagttttcagacaactggatgctggagagagtctgtgctgagaccacacgtacatcctgagggctctgctggcctctgaaatccaggctgcacgtggagcccagctaacccctccatcaagccctaacatgctgccagcacctccctgactccgtggctcttgtgcttgataaagggatggcccaggagacagaggagatgaattccaggaatgtgatctttcaacacccaaggagctggagcctggggtgagaaattccttcctgcctcttcaagtggcttccgtgctcctaggacctgacagggccggaccttcttctaatccgttctcattcacccatccaaccgctaagaggcagagagcacccacactgtgccaggccaggggccgtgggggctccagcactgtgtcgccctgcttccccaccacaccccgtgctcaggaccctgtgtccaccctgtcaggacacacatctcctaatcatgtgtcagatgatccccacccccttgcacctgcctttgacctgtctgaactcctccccagaccatgacacccatgggagacacacagaataaggtctttgctgt

SEQ ID NO: 29971 - DNA, 1367 bp, Bovine  19866880636773
ctgtgttcctgctaagattttatttttgcctgtaggacattttattgcaccaaattagagaagcagtaaaacattcttaaaagatagccatcgtttggaaaaaccatctgttttagttggaagagtatacacagaaaccataccatgaaaatttgctgctgaaaatgctttttctcccaaatgttacttttgtgctatgactatttataatgtcctggatgaatctccaaaatgttttattcaaagtccctgttgctctcccaagactgccattatgtgggaaagagaagagggttaatgagttccactcgagtgttaggcatgcctttcaaattggaacaaaaatcatcccagagtaatgaagacatcttttccacctggtggtcagactgcccgctgaagtgcagttctgatcctgttactgctcagctcagaggtcccctgtgaccccccactgcctgctgagtgaagagccaggggccaggccagccttccccgtgcgggatctcgcacacgtgtccaggcctcacatcactagcctgtgaaatggacctattctctagataccaagccgctcagtcccatcccagcctctgtgctgtcccttctctttgttccctgctagggactggactgtgtcttccggcatttccaggtcatagctctaatcccccctggtgacttatttggggacagagcctgagaagaggtaatgaaagttcaacggggtcatcaggccctcctctgatagggtctgtgtccttctagaaagagaagccttcgtgggacttgcctggtgtccctggtggttggggcttcacctcccaatgtgggggaggcgggtttgatgcctggtcagggacccaggagcccacatggcttgcggctgaaaaacataaaacagaaacagtcccctcggcacctagtactgtccgggggaccctagcccctccagaccttgcctcctcttcccagggggctgtgcactcccggaggacagactcactccctctgaaatctctggatttagaaaataggtttaacatgaaaacacaggttcctgtaacttttcaagaaggctctggtgctctgcctccgtgtctcaggccatgtgccagcaaactgcgttcctaattatccaacagtattaaatgcaaagtgtgtgtcagtatgaagaggagaaccacctcttttttggtatcttgtaaccagaaaacctctttaggatcactggactagtttccattttaagctaattagtaaattgcatttttggctctttggctaggttaaatttagctcatcttttcccttcaagtcaagctgtcagtgggatctttgcaattaaaattttcactctcaacttt

SEQ ID NO: 29972 - DNA, 1004 bp, Bovine  19866880760033
ccaccccatcagccctagaaccccacagagggctcttccacagctgcccccctacccaggtgcatttcagaagccccgtgccccagcctctcagcagaatggcctgagagtcggagtgcggggagctctcacccagcctccgttgggcagaagatagacaccaggccagttcctcccagggcgagcagctgccgcccctcctccagtggagacagggcgtcacggcccagccttatgagcgcagggctcgcatctgactcctctcgtggtcattaaggaagatgggctggcgatttccaagaagagaggaggagggctccattatgcgggcactaatgcctctcgggtctcctgcgctgctccggggagcgggtggggtatgtgcaggggcccggctggttcctcttcccatccaccctctgttctctgcgcatctgggtgatggcaagtagggcggaggaagcccccccaggggaccggctacggtgagtgaaatgagctctgtggcctggggagtctatggagcagagaaggaatcggggaacaagcgcctgcatctttgcagtcagagccacttggaattagcggagaagtacctatgccaaactgcaaagcgtttgttccctcccaggtgtgggaccctgggtgaatgcccaaccctgtctggccgacacaggagggaggtgggttccagaacgggcctcccgtggtcccggctagatctagagctctcaagcacctatccttggaatgatgtggaaggtatggagtgaggtttccacagcaggaagggaatttaatttcaagactttgccttattctgtgattgtccagctgacatttttctaacctttagtttatgatggccagagtagatgtcactatttttaaatttccttattcagcaagatggccagagatgtatgaagtctgtgagtcacgtttagcaggagttctgggtcctaaaggactcacactgcaggctttggtcacaatagccctgg

SEQ ID NO: 29973 - DNA, 948 bp, Bovine  19866880839401
ctcccggtgttctcgcccgtgactcccaggccagatgaacggctgtttgatttagagaaacccacaccctttgtgttcaagttactctgaaggggttgccttgcttggatggctctcttctttttcctccagggagaaagggagagatgttcttggaagtaatgtatgtttacatcaatttgcaaattcctatacatagagatatattttttaagtgtgaatgtaacaacatactgtgaattccatcttggttacaaatgagactccttcagtcagttacccaataaaatcagttctgaaatggcccctttggtttgttacgggcagaagagggggcgctcctggggtttgcagcccaaaagcaggtggtcttcctggggcacaggagcagggcatggaggaagggcccccaggagatggcccaggggggccttcaggggcccgccccccacatcaggcaccggccgggctttctccggaggaagtagttgaatgtggtgctggtttgggattgtccatctccctccataggcaggtccctgggtcagacctgggtttaaattggaaaccctttcccctgctggtctgactggaggccctggagcagcaggcgtcagccccactatccgcgccaaggggccccatcaccagagacaaatgagcactgcgcacggaggcttgcaaggagcctttatttatctagcacaaagtatacactatcacaatcttctctgttaactccttttactaaaatagttcaaatcaatgtttttaccacactatcaaaaagttctatttctttttctctccccaaatcaaagtggttcaatagaaggtagaaacgggcacaggagtccagggctaccggcgctgcccggagctggggttgggtcggcccgtgctccagccatcacgtcccacggaagacagtgtggctgccggcccggg

SEQ ID NO: 29974 - DNA, 550 bp, Bovine  19866880853204
ggctgacagcacccagacggcaggagagccgacccatttcagaaatagcccatgcactgtcagggaagcatctctttgtcttccctgatctgtctttctgtcggctctgggctgtaaggcaagaagcaggcgcgctcttgtcttggaatcagaggctccggggagccgcccccacccccccaccgccccccacaagggcccgattgtgcggcgcccctgaatgggcccgccccgccccaagcgcaccggctcctgtcctaatgagcccgctctgggagtggccctttgtggcgggttccggccacgctccctgtgccaggggctcccagaaggcttgattcacatctcctggagctccgggggtggacaatgggagctcccgccctgccctttcgccttttcctctgtgttttctgtattttgggggaatgcacgcacacaccccacttctatacgggacagaaaatcaaaccacaggtttctcgccctctctgcagcttctagccttggtgggaggagggccgggttcccagcccctcctgtgggacct

SEQ ID NO: 29975 - DNA, 838 bp, Bovine  19866880870359
cagcaggagagaaaaagaggccacagtcagcccaaagccctccccagcctccccgcctcacccccccccgcctcaccccccaacacatcccggcagcggcctgaccccgcctaccaggggcaggttgcagctggggatgctggggaagtcatgatgttccatgtggtagcccacattgaaggtgatccagttgaggggcccgtagtaggagtaggtctcgtggcccttgaggaacatgtagtgctcagccacaaagtggcccgagatggggtgcaggcccagacccagcagggagctggccagcaggtagaccatgggcttgagcccccagagggcatagatggtagcgtcggccgccagctgcaccagggtgttgcacagctccatgcgggtcatggccttggggtgcacgcagagcggccgcagagtgtagaagaatggctgcagggccagccagagcagcttgcgggccggcgtgcagaagagccggccctcgaagtacgtgggcacgtccacgtccagcccgtcgccacccaggtagcggtggtggtccacgtggtacttcttgaagctggcggcgtagggcaagcccacgggcaggttggcgaagatggcaaaccagcggttgcgggaagggcggcccgtgccgaaggcggtgttgtgcgagatgtcgtggatggccagcgtcagggagtggttcacgcagcccccgaaggcgtaggcccagaagaagagccagcgccacgccagcccctgcgccagccagcaggccagcagctgcgccagcaccattgccgttaccgtccacttgaggtaggggtccggccgcatcagggcc

SEQ ID NO: 29976 - DNA, 3082 bp, Bovine  19866880977553
gaaaagtagctgagagctttctttttgattaagcaaattattttatattccgcttcagttgattaaaaaaaaaaaaaaattcactctcgtttcaagagtccataactctttcgagcactgttctatcaaaaaataaaaattaagaaagtggcactaagatgttattggtatttattagctatttctctactggcattaaaatttctaatggaaaaaagtcataaagaaaaattcttctgtagaattacagtctaccttgaaacaaaaccgggtatgacactgagaaggtttaagggctgatcaagttgtgcagggttgtctgcaccagattctgcttggctcccacctctgagaaccagccaactgagagcccagcaggaaaagcaagaaaatgcaaatctacttctttttccaccaaaaaaaaaaaattatttgccttatatttccgtaattaaatgctttactgatcaatagttatgagatggatttcattcttgtttttatcagagaaaatgctgtctcactttctgagaataacaccattaaacatcattttgttgggagcagtcaatatctgaaaacggatttccagtgagagagcagtttaaccagtgcacagcttttaatccctacctataatataggcaattatcaaattgttcacttggaaccaaaagcaaagaatcgactatattagcttaagtcaccttttgacgtaagatgacttctgattatagtcagagatgagagaatattttagaactgggttttgaaaaccaggtctaagtcctaacccagagtcccgaaagctggggagcacccctgttcaggggcagggacggcagtgagagaagtgcggggaagagagcctgatgggtccgcaggagctcggggaggccaaggaggcaaggcggcaggaggccctgggcaggaggacgggcggatgggacccatcagggtgcgttgccggcggtgggagcgcccagacccaggggcctgaagatctctcaagtgtggaacatccttggtagacgccataagtgaagacagaggggaccaggacgttatctcagaggcatagggacattgtgtaaacccaggggctacacccgggaaggaaggaaagatggggatggagagacggcaccccgagcgatgtcacaagccccgggcacaggccatcaggctcgacttaactgctggccaggacctcagagagaccaagggaggcaaagacacaaagaaactgagaacgagacagcaaggaacaggagaaatgcctgtcaccaggtctgagctctctcgtagtaaagcagcaacggggaagcctgggggcagctcagggctgcggagactcggaaccaccacctgggagatgagatggtcagcaaggtgtgacgaggcatctctctggccaggcgggggttggcctgtctcggaactgacagtcaccgggacactcctgatgatgctcttgggcctgggagcagaggctgagagaggctgacatggaggcccgggatccgctataaagggtagtgcatacgcctccttcctaacagacgcgagacaacaagggttcaggtttagtctcaagctactcagggctggggaaggcggtgcagagagaacctctttctaaacacttaatgaatctgctgcagaaagaaaaaaatctgttttcccatctgcacttgcagacacctataataaagtgacattttccaacataggtttttctagatcattagctttgtcaattaagactccatgctcagcaaaatgaccattgtttttttcagccatcttctaatttctaaaaaaaaaaaaaaaaaaagctgcaaaacttgcaagtaatcttatatattcctgaaaaaaaaatgtgatgtagaaaagagtttccccaattttcacaactagtgtttggtactactttccagagtagaatgatttgcctcccgtccagtgattcactttgcccaccctaagacagtttaagattcctcttatttcaaatcgttagatgaccttcagtgacctgtgcttttctaacacagaagtctgcaaaataccacctagcatttggcttcacaccatattaaactgttcttgagttgctccattcattgattcattcagtcactcccttgttcaacaaatactaccgagtgcctgctcgggagtgaagtgctgtaccagatggggaacaagtgaacaggatgtcctggccttctaccctcctggagcttcctgtctgctgggtaagacaaggtcacagacaggctgagaggaggaaggcagagcagaggggtggtccagccaggcaggtggcagggggtgcggggagggaggaggggcaggcagaggcagccctgggctcctctgctgaacccgtcacatacgaggagctgaccaacacagactgaccccggttcactgttcccacttcctgttcccactaggggtcaagccccaagggggacaatcagtaaaactggttccccacactcagggcaatgacatcatcgcaggtagcctgtccggatgggcaaaacatgatgtgtcacagcagaccacatgccgtgtgctggaatcacacagaaggggctgcagacactgttgggaacaagatcaggcagtgactcggagaggagggggcacatgaatccggtctctgagcaggaaggtaggaagcgtcctgggcagatagcaccggcaggtcggttcacaaggaggggccgaggcgtgctgggtggaaacgcacgtgcggagcagcagcaggcggaaggcaggtggggggcgagggccctgcaggggagggtcagggcccagggcactggctctgcagcggcctccaccatcgctcagcagcctcacccacgacaggaagacagtgcccggtcccctaggtttgctggtacttgaggaggcatcagcaagttagtattcttccggggcgggggggagacttcattttagtagacgttggtaagttaacagaaatgatgaaggtcttcttggagctgcttttttatatttaatattttggcaacaccacacagttccccaaccagggactgaa

SEQ ID NO: 29977 - DNA, 1305 bp, Bovine  19866880982149
gaggttccacctccagtagtttccggtccaggacagctgatctgatgagtacgaagcacacgtagagagcaaggccgttggagaggcaccagaggctagcgctccggggggggggttcactgcatcctggggaaatcgggggagatgccagggaggaggggccagcccggagtcaagccttggcagtaagtgggaccttgctgtgctgagatagatagagcagtcgtccaccagaaaccagcctgatccaagctctgggggaggcgtgcagccagccaggaggcccgtgggcaggaagggcatggtgggactctgggtgggaaagtagtccgagctagactactgtgggccttgaattccagactggggaactgtgactttagtaggtcagctgacacgatgggagagtcttatgaagaagactgaattagacataacaggaagttagtctgctggggcttcttccttttgctgagatttactcagttctgcacacatctcttcctcactagtttgtgatactctcagaggagagaccatgtcaggatccactttgtactctggcatggcacctgactgctgtgttacgtgtggtcaggattctgttaatggaggggcacgtagaagagcaagcaggcaaaggaaagctggagacagagcagtgagaaggtcgctgtgatggaggagctgggcctggagtcaggcagcaggaggaaggaaggagaactcgggccgtggtacggggtgaacgctctctagcaaggctactgggcagggaggcagtgtctctaagagcacagcatgaaaagaaagtttgtttctatgacttcttccttctacatgatttacatggcatattattcagaaaactgtatttaagataatttgtgaagccaaattggaggtcgcagggtggaatgtttgtatgtggactttgcttcaagcttttagagtgccctagtgtttgtgaatgagaagagcaaggcaggaagggaggcgcccccggttgttgagaaggccccaaatctttctgtttctgggtgagccttgatagtgagatcaagagcttttgtcttccttttaggtaacaggagccttgttgtctctttctggctgggaaagtagaagaaacaccaaaaaaatgtaaagatatcatcaaaacagcacggagtctattaaatgatgtacaatttggccagtttggagatgacccaaaggtaagaatcataacttcctgtgctcaggtcttgattcctcagggcagcattaaggcagagttcctttgtgttgacaatggctgtggcc

SEQ ID NO: 29978 - DNA, 924 bp, Bovine  19866881041550
aaatgtatatgaacaggacccaaataagtcttaagtaagcaggtactattatcattttgcaaatgaggaaattaaagctcagagaggtgaagcagctggctcaaggtcacacagctaataagcataccaggctttggacacgggtcatctcagctatattttaaaacatcatgccaggtgtgtggcttccctgggtctctctgggcctcagtttccccctctgtacaatgggagaaacaggtggtcatgaggctctgtaagctccccaggggaaagagtctgacccacgtcagacttgggaagtatggtcttgaaccctctctgaaacctgtttgggatgtggatttatcccacccccctttctccccaacacacccacccctctctgggggctcagtgggtggaggcagcaaggcttcatggggcccagtgggctgacctcagctggatccccaggtcccctctctccagcaaggtgacctctctggccaggtggcacaatgacatgtcctggcttctaggagacagagcggtcaaaggtgctgttcgggttccccgacctttcacctctgcggtccctgaccctcagaactgctgtcgggtcacttacccgctcatgagtctccaaaaacgtagaggccgttcaggttggggtactcgcagccccggtacacgtagcccccagtcaccgacttgcccagtttgtgcgggtaggcgaaaatcggcagcacgtcatctgcagagtggggagacgctgggtgagcctgcgggggtccccggaggctccgcgggtggtcctgagtcctgcggggccaaggggtgggaggtccctaggagggcccgagagggggccccagagagtcaacgagaaagggtaatgcttaaagtttataaggtacggagagggcaaggatttgccaggca

SEQ ID NO: 29979 - DNA, 1356 bp, Bovine  19866881079336
ctgctggccttgtcgtgtctgtccgctccacacgagctggcgctcgaacccgcgccgtctggctctgggacctgtgcctttactgtcttagtcataggaggggctttgtggctgaagagagttctgtggtcagttggtcagaaaaattgcacaaccccaccccccacccccaacccgcagagtagcatgaagctctggtaagtcctgcaggggcagctattacatgtgtgaattttgcccctgagtttcccatgtatgtttgatgaagggatttttgctgcctaacatttgcatgcatgctaagtcgcttctgtcatgtctgactctttgcgaccccacggactgtagcccaccaggctcctccgttcatagcattctccaggcaggagtactggagtgggttgccatttcctcctccaagggaatcttcccccgccccagggattgaacccgagtatttctgcatctcccgcactgtcaggcaggttccccaccagtagcgcctaacacttaatttttagtttaaactctggaaaaatactgctgtatgggaaggagaatctgagcctcggaattagaagagggaggaaagagagttgttgttcagtcactaagtcatgtcctactctttgcaaacccatggactgcagaatgccaggagaagagaatattcagggggaaaatacataaatggaagaagataataaggcctgagatttgaagtctcatttaggtatgagttcaggcttctgctcttaccggctatgtattgtaatttggggcaaatcattttttattctttttgggtctcacttgccttatctgtaaaatattattgtgaggaaaagtgtgattgtatatgcagaaatgctttgttaacagtaaaattcatacttttttcaattggtgtttaccaagttcatttccactctagtacccaacatggcatctaccagctatttgaagaacagttaacagttgttggatgaatgagtggattttgtctttaggtctcagggttctgtagctggtatgttacaactgagaaatgttttacaatgagactttgtttcttgaattttctttctcaattgtgttttgtgtgttttaaaaatatttatttatctggctgcattgggtatcgaagcacataggatctttagttgtggctcatggactctagttgtggcgtgtgggctcagtcattgtggcgtgtcggcttgattgatgccacatgtgggatctgagttgccagaccaggggtcaaacccatgtcccctgcattacaaggcagattcctaaccactggaccaacagggacgtccccgtaaattgtatttttcctaggttttctgt

SEQ ID NO: 29980 - DNA, 1940 bp, Bovine  19866881123301
tgcattccacagtttaagtgaacttaaaatattttaaaataacaaaagcagcaacgctttcccacctcctagagtttgaggagagatgggctgtgccacatttctagtatgtcagacggtgagaaacttcatttcattataagtgaaaggaaattctagcaatagaattctctaagtttggaagcttttctgtggtacttatcacagtttggggtgtagggaagttcctgtctgctgaatttgtacttttatgagaaaaaaacgtgagcaccgttgtggtcaagttccataattaaatggaaagcatctttaggcgtcttggagcacagccttaacatttcatctattcaaagaagaggtaatgagaagcttctcccatctttgctgtgcttgaccatggtatagggttttgttgttgttgtttttaaccagaaacaggattgcctaatcttcctagttagaaaatgcagcaagagaatgcccccgggcaataggttatttttatattaaattgcatcttctttaatttcattttgattattatcacatttttattatcacaacatcacaatattgtgtgactgtatttccttatgttgacttttcttccaaagggttaaaactgggttgagggttagaggggagaagcaggcacctgggagctagcgcccaattggcagcctcgtgtaatatataatttgcctaaaatcgcgcgcagagcaccagcttttgttttctaattgatttacggtttgagccacttttacctcgtcccccactgtcctgcgtaccggtgccagcgagtacattaccgtgagcgatgataaattgccgtgcacttgtgatgctaatgcgtcaagagtaaaaactgcatactacatggggcttcgtgcattaaccgtggtgcagagacagtgcagccgattgcatgggtgtctcggaaatcaccgtttgttcatttgatcacttactgcaatctgtccatcagcctgtaatggaaaccgaagattaaaattataccgttatagcttttaatttcttaattgagacaaagttttttaagtgctcaaaaggtctaaggtgtgtgtggggagagtgttatggatcgagaacctgagatgcttaaaattttctccagtgtgtgaaatttgggatatttttatcaaatgatcttttgtctagagaaaaaaaaaagtagtgaagtttaaatgtgccgatctcaattttatcttcattatatttatttgtaaaatttaattcataatttacagaactgtattttttcttgattttctgtatttgagctgcatctggcatgtgtgtgattcatttgcacataacaaattgatttctttctaaatgattttaagtcagaggttaatgagagaagtttcagtttattctagtacctttaattgctccttttactgaggtaagaagagctttggactctttgtaagggctgtcccacacagtatgagacaggatgtggaggcaggtgggacctgacttgggctctgggtttctgtgttgatcagatactcatcgtgcgggtgtgcctaccttttgtaaactcagtccaccttaaattttatttgtgtgccttgtctgtgggccctggtatcagaatacaagcagcagatttatggcggctgctgggcaccacaaattaagttgacagtgatgtatgagcacataatagcacgatgagccctcggtagcgcggctggacgcctcctgcttcatttggctcttgttaggatccgttaggcagctaaataatgaaattctgctgactgatttctgttttccctttttctcttttcacctctgctttctaaaacttcctcattcccagacccatcctcatgcccacaaactgcccttgaaggactccttcacttacgaggactacaggttggtgtgtgggagggtgatgg

SEQ ID NO: 29981 - DNA, 3824 bp, Bovine  19866881162354
tggtgggggaataggtagaataagtgaggaggacacagaagtccaggaaatattctacttatcagattgggggcaaattctggttattcagcttattaaatttttcaataaataaactttaaaagtgcatgtcttgaactgataaattatcataaatcaagaattatagctaattaaattctatgaacataatgtctattaaaaaaacagttaaataggttcaaagactttaattactgtaacaatacttctagcaaataagctgtaaataccctcccctaaacattctccttaaaacacataagggaaagtatatcaaaagtttgggctgtggcaactcagagataaaacaatacatacttaatctgattcaaaactaaggaattctgttcactgattaggaatggacattcataatgaccaggcagtaagcttccttttccattcatgaaagcccaatctaagcaaaaaccctatgataacaaataaggcccaaaatagtaatttccagtaagttttagacttgtgtaaacacaagtccagaaaattcctatgcccacactcaagggaaatataaatctcccttcatgaagagaaatacaggcataaatacaattcaagaccttaagaaacaattttgcatcacagaagtagtaaagttgcctccttcaaaataaacttatatcacagtctaaaagaatctcagaaaatatctcactcttattctttttttttttttaaatcacgttttccttttaataaggctttttactcaaaagtgtagctttgaaaatctctagcttgttgcgacaaccagagaagccggagcggcctcgcctgaacacagccggtgccctcacgggtgctccgagccggggtggagggcgaacgcaccgcttcacaatcagagccaacgcggaaattcaggggcaggatacacatgtcctactttgattccaggagggaggacaagttcttagcacagtaaaacaaaacacaaagtaaacaaatctttagatttcactagatatgtgtgtgtgtgtgtgtgtgtgtgactcttattcttgattcaatgtaagaggacacattatctttgtgaaacagaagttatttgttagaaaagagaagcaaaatctttatgaaaccacatcataaaaattgtagaaagaaagaaaaaggaatagaagagatcaaattagtaaaaagaaacaaaacaatccaagtgattggcaggaaatatggtaaagtgactatatgtatgtacatttatatctatctcaaatctaccagaaggaaaaaaaaaaaaaatcagattcaatgaagacatattcatcttcaacaaaagtgacaaatggccacatatccctgagcctgtgagacacaatggaaataaccaaatcaaagtagggtggctacatattacattctcagtctctaaattcaagtaaatacaaatatctacttgaaagatcatcttcattgcagaaaaatactgaagacaaaggagctttttctttaggaaaaatcagggaaaatcctgtcagaagtccatttctacaacctaataatggcatgggaagtgagccacgtggcatgctattttttcccaaaaatggctgactgagttgagagagtttcaattactgagcaagttgatggtgcagaaagtagcactgatccaacacatacctgaattatggccacccagtgacctaactaatgtcacctttctctcttccacaaaatagattaaatgaaaaaacaataatacaacaatgtccttaggtatctaacttaacttataaggaaggcaatgactgtaacagtgcctcattcatgagcaaatttcctatatccaggtactgttctatatcttaggggtttggattacacaagtgtactacacactcatcaaaacccagttaactgaatgatcacttccagaatggcacattaagaacctatgaaaatccactttgttaaaagcaaaaacaatacctgaaaaaattgtcaaaatcaactttttcaaaactccaaatatttacgtcttaccaataatccaaggagtggttatttaagacacatcgatgagtcttttggtgaaaactgctagctctggtacgtgttcacatacccctatcccattcccctctcaccagctctagagaagccttgaaaaccaacagccctgcagtcatggtgaaaactgacagcctaggagttgctggaataagtttggagtttcccagaagttccttccccatagaactgccattactggatctgacagttccctagaaacctccacttgcagggtctgtctttatttgacctaactcagaatttgctcagtgtgaaatgcattttccctgggtcatttgtcagaaacaatcagtggcagatgtttatcatcatagctgactgaggcaatgaaaacagttggaaaaaaacacagatctgtcccaaaacttagaaggaaaagctggagaatgggaggtcaatagtggttttgaaaagctccaacacattcacgagaatcaagaagatcacactcctgttcaggactgtattcatactcaagaaagtactgaaaaggccctaatctctcatttctggctgactttgatattcagtgcaagcaagagttacaagctaaggcagagcagtcaacttcctgtaggaacattaaaaacatagcccatgtgcacacagaaccccttggcaagagctggaagactcagtggttccagacacttaagaaaaatgtctgatcatcaactgaccattagattaactgagcacagacttcagaggcaacacaatataaagaatacaggttttaccgaattagtctagggaagtcactacataaacaacaaaaaggcaaaaggaacaataagttgtgggtatgcgtgcgagttagtcgctcagtcctgtctgactttttgcaaccccacagactgtagcctgccaggcttctctgtccatgagattctccaggcaagaatactggagaagattgccattcccttctccaggggatcttcctgatccaggaattgaacccaagtctcccgcattgcacgcagattctttattgtttgagctacagagaagttctaataaaccctgggaagggagattaatttgatttccagatctgccacactacattatttaaaatgtcctgttctaaacagaaagctatgtgccacaccaagaaatattaaaatcggacctaaacacaggaaaaacagctctcagtagaaactgtcccagagaaagcccaagtcttaattagacttaccagactaagatttaagtcagctattttataacaaatgctggagaggatgtagagaaaaggcaacccttctacactggtggtgggaatgtcacttagtgcagtcactatggaaaacatgatggcacttcctcaaaaaactaaaaacagagctgacatatgatctggcaatcctactcctgagcatatatctggacaaaaatacacatgcacccctatgttcacagcagcactactcagaatagtcaagacatagaaacaacctaaatacccactgacaaaggaatggatgacaaaggtatggtacgtatatgcaacggaatactactcagacataaaaagaatgaaacaatgccatttgcaacaagatgaatgaaacctagagattaccacactaattgaagtcagaaaagagaaagacaaatactatatgatatcaccgatatgcggaatctaaaatatgacacaaatgaacatttatgaaacagaacaggctcaaagacatagagcaccgacttgt

SEQ ID NO: 29982 - DNA, 1775 bp, Bovine  19866881197010
accttggctgcctgcagagcagggcagaacagaggagccggctttcggggtggtgtctcagttgtggcacgtccttgcggtggggtccagcactggctgtatccttcattctgtgccctctggaggggaaggcatcattgttatggactgcaaattattcccacaaagaacctttcgcggacaatgggcagctcacagttaaggataatgaggatagagacgatcagacgagtattcatggagagagaggcctttaagttcacttggcagatggaggcagtttcgagtgcgtccctacaatgtgccgaggacaatgaaaaatgttgaaaacatgtcctccctagaagcatcagttttccctcggcagtgtcctgcgtgcgtctttcccccggcctcccatctccacgggagagttctcctctcccacggatctcatcgttcctgcccccactttactcagaccccggtcagtgctcatctggggtgtgttgtaagggcagcggccccaaactagcctttccgcctccggtctcagctcctttttcttactcaacacgtgcttgagtacccaccgagctcctcactacgcaggtctaagggttccagccacacgaggggtccacgtggccctggcttttaaaaggaagcgcacgttgcccttcaggagctggacgctcagcatcgtgttctcggtcagttgtttaacgaccctggacatagatggtgctgagaagcaggctcaggagaggggccgggcatgggacccagaaaggcctgcgtgagcttttccctggggagtggaagccattcacccacaggggcggggagagggcaggaaagaacattctagactgggtgtgaagccctgggcgggaaaggacctttttggaaactgaaagtcttcccctgagagaaagagaaatgggacagagttgaagtgaggcggggagtgtcctgtggggcctttgggccacattaggagtttggtcttatttctggggagcagagagaatgtggtggagaattttgaggcgatagagtgacatggtcagattttcagggagttttggagactgcctctccccgcagtgcagaggaggggctgggggtgctgctgagggcgagaggggggctccccatgaacccggggagaatggtggcaattcccaccagagggctgcttgggggctggccgcacctgggctttggcctttacaggcaggaggaggaggaactgaggatgcctcccgggcccctgacatgtccgcccaagtgagtaccacaggccaagctagaaggagctggaagggcggacaggcagacaacggttcagctggggcttgtgggacctaaagccgaggggctgactggctcgtgggaggcagaaaccggagccagaagatgtctgtcctggagaggagatgtttgagagccatcagtatgtagattggggcttccctggtggctcaggtagtacagaacctttgtgatgcaggagacgtgggtttgatccctgggtcgggaagatcccttggagaaggaaatggcaacccactccagtattcttgcctggagaatcccatggatggaggagcctggcgggctacccgtccatggggttgcacagagttggacatgactgagcgggtaacactttgacacttcacacttgcagtgtatagatggcaccagaatgcatggcgaaggtgagctcacttaaggtggagttagaatactccttctgaaagatcgatctgagccaggaaactccctcc

SEQ ID NO: 29983 - DNA, 1469 bp, Bovine  19866881241144
tgcatcaaaacttacctcctcccttctcagggatcttacacaatcaactaattggcgcctccctgcatctggttccttcctagtaatacttaaataagctcaaaatctttaaaaaaaaaacaaaaaacaaaaaaacctcccttgactccacatggccctccaatgaagacctcccacaagaatttctctgttcgctctgttttctcatcctccaccctcagccccctccaggttggcttctgctcttttcagtctccccaggtgaccagcacgcgtgaaatgatgcttagagggtgaaatgtcatccttcgaggatgaaccgcaaaggagcatgtgtgagtcagggtgagggttaagctctgttaaccaaggtgccctcagtggcttcatgaagatgggaggggtcccacttccatcgggcctgggcgagcaggctcctttggtgggcggctctgttcctggggatggctcagggattcgggtctacccttccatcctattttttaaaacgtatttatttgtttcagttggaggataattacgatattgtgatttgccatacatcaacacgaattggccataggtatacatgtccccctatcatcctgaacccgcctccccatcctatttgtcactgaggaaagtcatcatccttcctgcacagatgtttttccactttaaaagcatgggctttttacagaggacaggacccccgtgagctatttattattatcccagttttggagatgacgagactgaagctcggaggccctcgtcaagcagacaagcatcccacagtcagaaaggcatgggaccaggaccaaacgcaggtcccgcctgccggcccctgagtccattgcttctgacgggcggtcacctttcacagatgtacagccctgcctgccttgaccccgtggccaggggaagcctgccagcaggtgctgtctttagaccagaggctcagaaagtccccagggtttctggaactctcttctctcctgctctggagttcttccagcgggcccgccagccccctcccacatgcgttcagggttctgccaagagcctttcaaatgttccccaagaaaaggccagacccgctccttgagctccgcggctggccagacaccaccctcttcggtgctgcatggaaataaaacacggaggtgacaagccgcttggaggagtggaaatgtcagcgcgacaccctgagatctcctccgagcacgtaactcggagatggtaaaggttgcccagaatgcaaactgttagctaggaaccgagggaagttcctcctctgggttctcggagccaggagctccagaagaaacgctgtgcttgccaggagcccaccccgcgctcaggcaagctggcgacaagtgccagcacccctgcgcccgctcagggctcctgccctgcaccacttgtagctcctgtgcgctctgctgtcttgaaccctctggagtccc

SEQ ID NO: 29984 - DNA, 1076 bp, Bovine  19866881325274
aaaccctctgaaaccactcaggccgagtgttacacggtgcccacaggacacagatgtgggcacctaacctgcctctacctcattcttgctcctctgatcacacttcctcagaaaacgctcataaacaggaaaatgttaaaagctaagctcaaatgcaaaacattttcctgaaaactcttgtggatggtaagaaggaggtacattaaaagtcaacatttatttcgagttaaaccccataacaatgactcctgagggaaccagataaattggacataaggacaattagtcaacaaacgtttcgcatccatgtgtaaggctctataataagcgctctgggggagttacaaaaagagacggcaccgttgctgctaaaacagcagcgaggattctaccgctgggccagaacaggcactgtggagggccacaggccccctgcctgccagggcccttccctctttaaacagctgcctgtttcccgccccacgttcctgctagacctccaggccccctctgttccctaaggagaagactagatgtggtaaacaacgaagagtaaccagttacgtgctggtgtgtaactgtcaggttagccagtcttacccactcttccatcagcaccaactgtggccctggaacacgggagtctgtccttaggccatctacagtctatctgaggagacgtgggaaggagcaggtgggggaatgtgtctatgggggcccacgctgaattgcgggggggaagccacaagagaggacgggagcactaggggagggacagttacagccagtaccgtacctgttaggtaacagttacctgttggtaccgtttctccgtttttataggtggggagactgcgggctggggaagataggtaatgtgccaggttccatggctaaccagctgggatctgaaaacagtctgttttgcctcctgctccccagaccagggacccctccccatgaagacagatgcacacgcccccaaaagctgggcagccgagtcaggacttactctgcaaaagctcactggtcaggttcaaggtttcttcggggacacgcttgctgcagcaccagtg

SEQ ID NO: 29985 - DNA, 1398 bp, Bovine  19866881374037
cttaccaaagcaaagaaggagcctgttcacaaaacaccatgagggcgcttgccagaaaactgcccagctgcaacgagaccaccgtccacaatgagcaaaatcagagccgagaccaaatcatgagccagcagacacacttccagggtttccaccttcaccgctgcaatcagtgcttttttaaagagcagtaaggctccaggagtttgacaaaggaagaaaaacaaaaggcagcaagaggctccatctggataagcagttcctagtcagtattcagaactccacaccagcaccagcacagctcagatgaggcgcaaggtggggtcctcgccaccttcacacaccatcaaaccgattaccacgctgcctgggtgcctgcagtcgacaccccagaccggcaccacctcggcgcgcccacccccacgaccgggagaaaccctgccgtggaaaagaacccttcttttatgaggaccagccggagcctgagctgtcattacacagcaaaaacctagagaggacaaaaacccagcggcaggctgatggaggaaacccaggacatacctgaattcttcaagtgcaaacatgacctagtcggagacaatttcctcagactgtctgggggcctttctggtttggaggaccaccatttagtcagtcagatggtgcaaaggtgcaggaaaaagaggcggggtctgcacaccccccagtattctgaagtgaaaggctttctgcagacaggggcctgcagcctccagctccgccagctgctgacgagcggcagctaacaggggaggcagctaaggaccatgtgatcattccagcaaggctgattaatgcagtgagcgcggaggctccaggctgggagctggattagccgtgagaaacaagtggaaccccgggcaggcctgggatcctgcgggaatcacagaacacgcacgcccccaccaaaccgtatgggggccggggcgggggccagggagcaagagctgcaagggaatgagagtgtgccctgctcccctgagctcagcccgctcacctcgcccgcccgtggccactgctgtgctcgggttcagatgtgaggaccaccgtgggaagcgcacgtagtggagatggatcctgggctacattttactgaaaactcttcaggactctgtattccacccttccactatgaaatgttcttttagcacaaacacagaggccgctctggaatcccaggagtcatggtttccggccagagctctgccacgagcatcacctgtagggcagccgcaaagcgtgacctcatttatctcagtctttgtttgctgagtatttatttcagtatttgtttccacacataatatggaccaggcttcaattccttgaagtacaaaagctgctgtaacagtttcagaacag

SEQ ID NO: 29986 - DNA, 592 bp, Bovine  19866881778247
ttccctacaagctctgagacgagggcgagcctgtctgcctcttgggccttgatgcacccagcagaggggcagagcagcccacttgttcagcaagtgtgggttccacagcatctccgggcccccgaggagctcgcaggacaccgaggggacagacagcggatggccgagatggagggacgcctggaggctgtgggtccctgagcagatgtccctggaggtgactctgggtgggagtggggggcaggtgggatgttgggggcacaaagtgggaagggacccggaggccacctggggctggtggcggggggtgggccctggagcggtgggcggtggcagggcccaccgcgggcctcagggtgcagccagcctacctgcgccaggagcttgtcaccctccagcagcttcaccttggtctccagctgccgcatgtaggtggacgagggatctgaaagacacaggagtcacgtcacctgttggcagactgtctccagcaggagggccctcccctgcgtgccccccgggtgggccttggggcctggtttcccctgtccacctgcagaaccgaggtgaggggtgctctcaccagcttgtt

SEQ ID NO: 29987 - DNA, 641 bp, Bovine  19866881790103
ctgacttatgtgaaatttaatttaatttatttttataccagcagctgtcagttcaaagaacaacaacaaagtagccatctgtgcttaatttcatcaatccgctgccgatggtcacgtgagcgtggcttttggactgaggcagcgcacgtggccagatcccagcgcccccaggcccctgccccccacccctgagccgtcggtcccgggcaggagtctggtggcgtgtgcggggagccaaggggcacggcgcctgggcgctcaggccaaacttgtcactagtggggcaaagccagcagtctctttccgagacacagaagccccctgacttttcatgttatctctgctagtgctgagtaggcttctcagccctgccgagcagatggggaaactgagtctcagaggggtctctggcccggggtcacatagctgataaacagatccaaacggtggcttgtcacactccagaacccatgtcctcatgagccaagtggcttcctgcaaagctactgaagctcccgaggacttaggggatcaaagacagcagggtcctaggtggggagccgccctcccgtctcagacccgagccccccgcaagccaggaggcacgtgatggtagtggacgggatctctctgtgtggctc

SEQ ID NO: 29988 - DNA, 1455 bp, Bovine  19866881970843
attttatataatatgttaccccatttagtaaaattttctcagtacggttttcaaacggtaagcaaaagatttcaaactcataaggaaactggttgacataatagtttaaggtttaaaaagagtgtcagcagtgtgacatgctgtctcacctcggttttatgaagcttctggtaatttccatcccaagaaatgagcttgcggtccttccctcctcccgacacaagcgtgccatcccttaacatacaaagtgcgaaaataccgccctcgtgggccccttgaaccgcgtagcttattcgattcgtacctaaatacaatgagaaaaccatgcttaggacattgtccaaggcctcacctctgcccatctcattttttgttttaaaacgagattatcagaacatcaatgcagtgtgaatctataaaggattcaatttctacatgttctcagagcactagataaacaagacaaacgcagagaagggaatggctacccgctccagcgttcctgccggagaacccacggacagaggaccccggcgggctgcagtccatggggtcgcaaagagccggacacgactgagcggctaacacagacaaacacgaactgggttactttctaatcaaagaacacagggcaagggggagggggatgaacagggagcctggagtcagcagatgtaaacgatcacgtgtaggatggatacacgacaaggtcctatgtagaggggctgggagctgcattcaatatcctctgacaaaccacactggaaaagaatatgaaaaagaatacacagggcttccctggtggctcagtgctgaagaactctataaagaattcgcctgtcaatgcaggggacgtgggcttgatccctggtccaggaagatcccacaagcctcagagcaactaagcccatgcaccacaacctctgaagcccgggtgcctagagcctgtgctctgcaacaagagcagccactgcaacgagaagcccacgcaccccagcgaacagtagctcccgtttgccccaactagagaataaagacccagcacagtcaaaaaaataataaaaaagaggacatacatacatatatgtacaactgaatctccttgctatatagcagaaattaacacagcattgtaaatcaaccatacttcattaaaataaattaaaaaacaataaaggaaaacatgccaagatgaagcatatagtgtgctaggagggctgagagatgagctgggggtccctggacaagtggcctgattgctctgcctcagtttcctcctgggggtcatggggctgctgcttttccacggcaccgctttcagggtgcagtgaacccgtgtgtgtacagagcccgtggcactcagagtggcagcggtactaccaaggtcaccgagttagcccgacattaccccggggctccgcttctgccctcaccccacagcccaaacactgagac

SEQ ID NO: 29989 - DNA, 2495 bp, Bovine  19866880347890
ttgcaacccccatgaactgtagcccgccaggctcctctgtccatggaattctccaggcaagactactggagtggggtgccattcccttctccaggggatcatcccgacccagggatcaaactcatgtctcttgcattggcaggcggattctttaccacctgagtcaccagaaaagcccccagctctttcatgccaggttacaaatttcaaacaatatccagcaaaactcttccttactatttggtcccctaattgcatctcactcagactcagcaaaggatttggtcccaccaggaaagattgacacagtgaccacagcccatgtgtacccgtgtggccgccaggtcctgctggatctgcatcttctccaaccggggtagggctgggccaggctgggtccccagaatggcctgcaccatggcttctgcatggggcacggtagatatgggcacccaggtggagccaggctcggagggaatcttcaccagagcacggcgttcctggagacgctgaacatagccctggagctgggaagctacctcctgtgaggtgggcttatccacactgctgccttcgggactacggaagacagaagaggcctgtgtgaactctgctcagcatggctacgctaacttcatggcaatcctggtgggctttgtcatcttccatcttactgaccattgacggttccttccaaggccatcttgtggtaggcatggtcaaactaacatggtgggcaccataatgtaaacccaaacaggcaacatcagcccactgatgatcattcatcagtgatgaatgatgaatgaaagccaccatgccaatgggcacagtcactcacaccatcacagggaagccatcacaccaactcaatgagcaacactgctcaacctgccaaccctgttatgcagcattatgacaaccccctatgggtaccatcatcatgccaaccccattaagtaccatcataccacctaatcagtgggcaccactatccatattcatgccaccctggttgggtcctataccaaccccaatggctgtcaccaccatgtcaactttgttgagtagaaaacagccaaactccagcaggcctaatgccaacccccaaatagggccagttctgggagccccattctgcaaccagagccccactcactggcccacccagtccccagggttcccaagggcaccttggatatggatcctgcagtgtcactccatccatggcagccttctcttggactaggagcctctgagcttccttctcagctgcctccaagtcatccacgaaggcttcttttccagctcctgagtctgcctcccggagagtgagtaaggcgctatatgcctcctcacagtgttcactgtgggacagcagttctgagcactccagcatacccgtcctgctacgtaggtgatatccccacttggaactgtcactcctcctcctaaccccaaccctgggagtttgtaaattccttcagcactctgggacggaaattggcttaagttaatttccacggcaagggcaaatacttttcagagagggctctgtttctctctgggaagtaggactgtcctttgaggatatccatttccttcccaggcagtgagtcgtgggtggggtgcactgacctatactgcaaggctagaccaagcgcggtggcctcagcctcctgctggcccagctgcatgctgaggccctcacaccggcccttgtactcctggagcacagctgacagcagacggttgaagcatttgagcttctcaatgttcctgcctccggaggtgggggaaaagggaaaagtgagtgactttgaagggcagttaggacaccatggatttccacccttccccaccccacccccactccagctccagactcttggctttatatcccagctgggcggcaccagtgcccttatgagctcagcatttgtgactcttaccctcggagtttctccatctgggcttccatgatgtgcatctcaggcgcaaggggctgggttgggagggacccaagcatctgggtgctggaatcactctgcaggcgccggagcagggggtgagcccgggagaagggatcctgtcaaaaaggggtgacttgattcacccagaattttcattgagagcccagcatcatgggtttaggccttttgcaatccccgaggctattggatcacatgaccaggatttgagtctcatggccccaaatcctaaggatctgaaacagaccatggtttttagcttcacacactcacctgtgagccccaggtctctccatcagccccagagctgctggaaccactacctgagccacctgcttggtcacaggaaggaggtgaaaagggctccagcctcagcagggaatcctgcagctcctggacctgtggggaaatggggagtgtaagactggggtggctccaaccacctgctattcttccctaagacctgttcttggagcagtggcaagagcactagctggaaggtag

SEQ ID NO: 29990 - DNA, 1765 bp, Bovine  19866880417850
attccaccatcagcgctttatttcgccggccggagctgtcccgggttaacctgaaaataatctcccctttctggctttcggggagccagagacagacgggacacacaactccgcacgaggagaccggggccagagtagcccagagaggagagaggactgtgctggggatcctagggaggcttcctagcggaggggaccttggagctaggcactgaggctctttgtcaagggaagggtgtctgaggcagaaggacggcgggagggacagctggggaggggcgagaaactgtagacttctgagaaaaggagaagtcttcccagaaatttggaatagatttccccagggccagggcgtaggttccccggaactcatccctccaggccaccgagatgctcttgaaaatgaaaggcactcagtcgtgtccgactctttgcgaccccatgaactgcagcccaccaggctcctctgtccttgggattctccaggcaagaatactagagtggatggccacttccttctccatgggatcttcccgacccagggatcgaacatgggtctcctgcatttcaggtagattctttactgtctgagctatcagggaagcccccgagatgctcttgcttcgactcaaaccctcgccttcctataatttccattgccctgtgccactcctcatttccggtgtctaggaacctggtccctctaggatcctaaaaattctgtctaatgttgctggaggaacaccatttcactgcaccgcagcgtgcgagccctcggcttctttccctgtcattagccagtagaagcgaagatcttcagtggatgggcggtacgttttctacggggcccaatgataatcgagaattgttgagcactttaccagtcacgccgcggagtgggcggaacctcctgcgaggacttgcagacccccgcggcagggtgggcaggcggggagctgattgtgaatccatgtggcgggggctgtggaccctggtatcccgggctgcacgtgggcctcacaggtggggtgatctgggcaagggctgtgacagcgtagggtgttgctcgggccccaaaccctctccctgggatctgggggctcggttccctgcggcaggaccacctttcgcttccgtccaagccccaccccctgccgcagagcccaccacaatccagtcttcttctggcctcagaacttccgatcagtccatcccctagccacaaaacttccacttgggggatcacgcgaccatcgagccatctatccacctgccactctggcgtcagagcttctcagatgcactgactctcctcctctccagtcccagactgtgcacgcgccagggcagtggttaccgggcccccggttccggagccactatcttcgctctgagctctggccaaggccgctgcggcatcgcggtgatccgaaccagcggccctgccagcggccacgccctccagagcctcacggcgccgcgggacttacccctggcccgcaaagcctgcctgcgcctgctcagcgacccccgttctggggagcctttggaccgcgcgctggtgctttggtttccaggtacgggactttcagatccggaacctcaagtagctcctgtgaccgagcttcctccttccaggcggtcgcccaggctgtatcctgctgacacccatctcttcaacatactaggtccccaaagttttaccggtgaggattgcgcggagttccacgtgcatggagggccagccgtggtgagtggtgtcctg

SEQ ID NO: 29991 - DNA, 1684 bp, Bovine  19866880461737
ccgggtcctctagccctggtgagccgatcccaggggcaggtgaaatgacagagagaaacagagacatagaggaagagacagagagggggagagagacacagagataagagaaagtccaaaggggaaaggcccaaagagatggggagacaggaaggggaaaatggagaaagatacagagagccagagagatggagacagacaggacacagagacaaaaaaagacatggggagagacacaaaggcagaagagacagagaaatggagagagacacaagagacagtcaccgaaaggaagacagaagataaagataaggagacaggctggtcacagaggtgggagttatccagggaggcccccaggggtgcagccctgatccccagtacctggagggacccagaaggagcggggagaagggagaacagaagccgcctctgcccacctcactcctccctctcacccacccaccctcttcagcccacccaaccacagatggggaaactgaggccggtgtgcaggccagcctcatcctcctgggccagcgctgtgcccacttgcccacgcgggacctgtatcaccaggttaaaaatggaaatgggtctggcttttttttttttttttttccctttgagaaaatcctaggcccaaataaggcgagggctgcagggaggccggtgagctggccaagtcctcctgagcaagcaagcaagtggcggctggcccaggcggcctgcatttgggcctcctccaagactcaccccgcagcagggcggcgcaccccgggagcctataagggcctctccgccgccctggctgctcacttgacgccacagccgccgcagccccctctgcgcccactgccccccaccacccagccatggaggccatcaagaagaagatgcagatgctgaagctggacaaggagaacgccatcgaccgggccgagcaggcggagtcggataagaaagctgccgaggagaagtgcaagcaggtgatgtagctccgctgggccgcgccaggctgtccagcaccctctctgagctggtgaagttctggggcggagggtgggaatctcaggaaaccttaggacttgggagatgggggctgagacaaggggtgatgctctggctgagagagagtaaggggactattgtcttccctggaggggtccctgggctgggagagagggggccgactggacccactaccagcaaggccagtggaagcaaagtgagtgagagagagagagtgggaaagtgcgtaagaaagggaggggcatttgtgtgggctgcttgtgtgtgtgtgtgcaaagacgagagtctgaggaggtgtgttgaggtgaggggctcaccatgcggggtgtgttagaaggggtggtttagggctgctgtgtctatgtagaaggtatttgtgtgtgtctgagcatctgtgtgtctacgtgtgttgtgtgtgttctggctctgtggagacctgaaggtgactgagaatatgtgtgccgaggaaggcctgagtgtgtagctgttgacagtgggtgtgaaaaagtatggatgtgtttgtgagtctgagtgtgtgttgatggtggtattgccctgggttttaggggaagagactagctgtgtgttcttgtacacatgttgacctgatattgaaattgtgtgtgtcagggtgagtgtgtgtgtgttgagg

SEQ ID NO: 29992 - DNA, 963 bp, Bovine  19866880482290
caagagagaaaaagaaaaacactgccccgtatttagagtggcccctgacccactcggtctccccaaggcctagccctggggctataggtcccacccgcaaaagcacatttagtttatacagattctccctttcagctgctcaatgctagatttctcatttgacggctctgaggagttcgatattaacgcttttgaagacatcattgctttctatgaaagcaagaagtaagtagaagcaagggccttggaacccgagaccagggaggcacgccctgagaagccatcatcccaaggcgctcagcaagcacagtgttcagagccagaagagaggggatcagcaagccaggggcgctctcgccagatttggcctgatcggggggtgtgggctgaagccaggggcttcatcgtcatcgtagggagcgggcgctgcactggccgctcagggtgcagaggtgacatgcagcccctctgttgtctttgcttggtgcctccctggagggtgaaggagcagaggtgagtgcggccatccggccctgggcatggtgcatggcacacaggcaaggggctgccgatcggggtcttcccaggtcaactgctcagagcttaaacatgtattcaagtaactgcaatgaagaagtgttattttaatctttttatttacttaactgtaccagttcttagttgaaacatgtgggatctagttccttgaccagggatcaaatctggaccccttgcattgggagcatggagtcttagtccctgaaccaccaaggaagtcccttggaataaggaaatttttttaaaaagagagacagactcccagatcatcctgcagtcatcgctccctcatttctagacattctgccctagacatttgtgtcaagacattgttcgcgaatgtcccattttcagagcattcgattttttgtccctaaggcattgtcattctcacacctaaaacgt

SEQ ID NO: 29993 - DNA, 1110 bp, Bovine  19866880536835
caggactacccaggagatgttcgtgcagtttggctatgtcgtgcttttctcgtctgccttccccctggctgccctctgtgccctcatcaacaaccttcatcgagatccgcagtgacgccctcaagctgtgcacggggctgcagcggccctttgggcagcgggtggaaagcattggccagtggcaggtggggaagggccaagggctctgagccaggatgcccagaggtggagcgggtgctgggggggctggccagaccccacctgagccccttgtcccccctacccccgcagaaggtgatggaggtcatgggtgtcctggcaatcgtggtcaattgctatctaattggccagtgtgggcagctgcagcgcctcttcccttggctcagtcccgaggcagccatcgtgtccgtggtggtgctcgaggtgggaccggtggccgggtgggggacccaggcggtggttggggggtgtccccgtgcctgcagcctcctcctctgtcgcctcagcacttcgctctgctcctcaagtacctcatccatgtggccatccccgacatcccgggctgggtggccgaggagatggccaagctggagtaccagcgccgggaggccttcaaggtacgtgggccagggcccggcatgctttacatctctgctccgaggggcttctccccgcgtcgcctctacgcgtcacctggctgggcagtcacatccttaggagggtagatgtgcagttagtgtttgttgcttagtcgtatccgattcttggtgaccccatggactgtagcccaccaggctcctctgtccatgagattctccaggcaagaatactggagtgggttgccatgccctcctccaggggatcttcccgacccagggatcaaacccaggtctcctacattgcaggcggattcttcaccatctgagtcaccagggaagcctagggtaataattagcatttcaaaaggacctggtcccttctggggtcctggtggcatcccgcaccaggccagcacttaggaactgtcatctgccagcgtgccgggcattgttctgtgtggggtcagggacacagccgatgctttctagaagcccagcctgtgccacgttc

SEQ ID NO: 29994 - DNA, 1437 bp, Bovine  19866880587105
cctgcccccccggggcctcccgagtgatgccaggttgggcttccacacaactgtcagcccacatccggtgtgtagggcagaagtggccagcccaggtcccttatttttatagattctagcagtagggtgaggtgcatttacgacaacagtgtttaccttaagaatgaaatagtatttacgacatttaggttgcttgtttacgacactcagagctatcacccttttgtccctgtgcttaccttgggtccaaggttgttaatctgcagctggctttaccacagtcatgaatcattcttgttcttcagggaaacggcattagcgtgtaacacttggttctttttctgcttgatgacagagcggttgtcgaaaagtacctgcttgaaaagtctcgcctggtctctcaggagaaggatgagaggtagggggggtatttccttgatgatcccggatgtctgccttcttccctatgaaggagaaaagcagatgtcctgaggcggggagtatctacaggaggccctgatggatctcctatgagcatgagctttgccactttctcctgcttatttttgtgcctccctggggcttctccctggagtgggtgcttgggtgtctgctgaaatgtggtcagattagcatcatctctggtccaccaatgagtgagaggtgcccaccctctgaggaatctattcactggagaagctcgtggtttgatttttggagtttgtttttttttttttaaaaaaagatcataagaatcgacttattgtctccaatttgtacataatcgaggtgctttttcctccctggcctggtctccaaagcaatattagtagtggtttgacgagtagctatcgctcggcctccaaaaacaacttttttctcctaattttgacctacaggaactaccacgtgttttattatttgttacttggcgtcagcgaggaagagcgtcgggaatttcagctcaagcagcctgaagattatttctacctcaaccaggtaaatagcctcaagccccaaccacaaacgcggcctctgttccccacgggctgtttacgctctgccagggggtcagaggccgtccgccttggccctctccagcccccaaaccagctccaaggaggcccagagcggggcggcataaaggagcccattcattccctgcctccccagccctgccccatcgcttccagccaaaatcatcctcacacaccaccctccccagcccagaagtacccagagcactgccgactttgtttttcagcataacttgaagatcgaagatggagaggacctgaagcatgacttcgaaagactcaagcaggccatggagatggtgggctttccttcctgccaccaagaagcagtaagtgggtgggcccagccaggcacctccccctaactgaagttaccggtcactcagagacctgacctacc

SEQ ID NO: 29995 - DNA, 1138 bp, Bovine  19866880636830
agttcagccaatcagagtcagccctgggacctttgcctggactatggggataggggaatttccttatggcagcaattaaagaattgccagcctggtgtgctgcagtccctggggtcgaaaatagtcggacatgacttagcaactgaacaccaaccaaaaaaaggagagcggctcagagttggtgggggatttcttggcactttgtggactgtttttaggctttctccagctctgcactcttgcttttgaacatgccacactgtattatgtctggcatattaaagcgaggccaaggactttttttgctctaaacgtttttaaaaggtctttataattattattttggttctggttagcaatgaatgaatgactggctggacatgcttgggaattcttgctgagtgaggtcacctaacctcaaaaagaatataaatgggagctgaacaaattcttaatttaatgcttaatgaggctgacatagtttttgtgccctttgtgagtttttgtgtattttaggacaagaatattttattctccaagtctctaacagttttgtcagcccctgaaaaggcttgaggtcataggtactatgttgaaagtgcttacagataaagacttctttctcagggcacagtgggtgaagaggtgaagtgagaagcatttttttttttttctgacctcatttgagtgcctagatccagccacacctgaagccactaacccctgaccttttcagatagataagtcactccatccactctctttttttaaaaaaccccacatccagagtattttattaagtcaaacaacaagagtgatccagagttagttatcctgtgtgtacaaattcccacaataaaccctaggctcatatttcataaattatcttttaaacatatcttccaaacttctatttctctattgtggtactaaggaaaaaaacagtaacagcaaatcccttgttattcagtaagctgatttttttttcctccagtaaaacaggtaatctatagggctactagagatctatggatgatttaacagagtctccagaatcagcgacatatttttcaagattggaacaaaacataagatgtcaacagtctcttcaaagaaatgtgatgatctgatttcttta

SEQ ID NO: 29996 - DNA, 2460 bp, Bovine  19866880669413
tgttggaatataagggtctatctttttgttgttgttttagggatttaggttctgttagttggaatctgaagagggtgtatgtgaagctgaagctggagaacaggttgagaacattcctaggccacagatgattaaaaagttctttcacaaatatggtttatctaattgagctttgtgcctctgatgaaatgagagaggagagaatattgtatttatttcaaagctcaggaagctgcagctgagagtaattcttgctttctgactgttgtttagtattccattgtaggtgtcagcaaactttttctataaagagccagacagtaaatgctttaggctttgtaggccatctggtctctgttgtatctactcagcactgccattatagctcagaagcagccagagacaaatataagggagcgtggctgtgctccagtaaaactttatttataaaaacaggtggtgggctggatttggcccttggcccatattttgctgacttctgttcacttttgtttgttagttttaatccttttttcctgttggtttagaagttagacattctgatattacatttttctggttacttgtccaattcgaccatgcatatttaaagactaaaattaataatttaactcctactcccacatcactccctgacacacaaacataaggaattgggttactttaattccatttttgttcccaacttatatgcgtttttgccaggtattccatttctcatgttcttttttttttttttaattaaaaaaaaatcacaacttacagtactattttatacagatatttgtttagatctgtcacgttcctatatctttgctcaatattctgatttctccgctctttcctttttctctaaaagttttattgtgatataatttacataccatacaatttacccacttaaagtattcaatttaatggtctttaatatgttcacagatgtgtaagcagtatcatagtcagttttagaattctgtaccctttagccaatatcttatctcctcaccccactaagcaactactgatctacttttaagaaagccttcctcagtgatcaatgcaaagacatagaggaaaacaatagaatgggaaagactagagatctcttcaagaaaattagagataccaagggaacatttcatgcaaagatgggctcaataaaggacagaaatggtagggacctaatagaagcagaagatattaaaaagagatggcaagaatacacagaagaactgtacaaaaaagatcttcacgaccaagataatcatgatggtgtgatcactcacctagagccagacatcctggaatgtgaagtcaagtgggccttaggaagcttcactacaaacaaagctagtagaggtgatggaattccagttgagctatttcaaatcctaaatgatgatgctgcactcaatatgtcagcaaatttggaaaactcaacagtggccacaggactggaaaaggtcagttttcattccaatcccaaagaaaggcaatgccaaagaatgttcaaactactgcacaattgcactcatctcacacactagtaaagtaatgctcaaaattctccaagccaggcttcaacagtatgtgaactgtgaacttccaggtgtttaagctgaatttagaaaaggcagaggaaccagagatcaaattgccaacatctgctgcatcatcaaaaaagcaggagaatttcaggaaaacatcaacgtctgctttattcactatgccaaagcctctgactgtgtggatcacaacaaactgtggaaaattctgaaagacatgggaataccagaccacctgacttacctcctgagaaatctgtatgcaggtcaaggagcatcagttagtactggacatggaacaacagactggttccaaattgggaaaggagtacatcaaggctgtgtattgtcaccctgcttatttaaattatatgcagagtacatcaagagaaatgccaggctggatgaaacacaagctggatcaagattgccaggagaaaaatcaataacctcagatatgcggatgataccacccttatggcagaaaggaaggagaactaaagagcctcttgatgaaagtgaaagagcagagtggaaaaggtggcttcaaactcaacattcagaaaaccaagatcataacatctggtcccatcacttcatggcaaagagatggggaaacaatggaaacagtgacagactttattttggggagtcccaaatcactgcagaaggtgacttcagccatgaaattaaaagacacttgctccttggaagaaaagctatgaccaacctagacagcatattcaaaagcagagacattactttgccaacaaaggtccatctagtccaagctatagtttttccagtagtcatgtttggatgtgcgagttggattataaagaaagctgagtgcagaagaattgatgcttttgaa

SEQ ID NO: 29997 - DNA, 1578 bp, Bovine  19866880684515
cccaacatgaccaccctggctgacaggccttgtctccctggatgcccaggaggtgacaaagcccgtcccaccctcttggagttggcttgcagctaacgacacccaatgtggggatatgacaggagggtcccatcgcctcttggtgagataagctctgcgatacgactgccactcctgggttccccgggatctggctgagcccccttcctgccctcccccacctcaggtttctcctgggagttccctgctgtacaccacttgtgcagagaccacatcacaggcctgcttctagaaaacccaaacaaagacccctctgtgtcatttcaacaggagatagtttttcagaagggaaaggggagagggaaggaaagagaaggaattagagaagctcgagaaggtaaaagcccccgccccaacccactttctagaatcaagacgcgagtcagctgctcgcgaggcggtgctgggtggtgctgtgtgtgtttacctttggaatgatctgcttttgtttgatacctttacttttcctgtcaaaatattaaaaatggttttgtgaacagaaggaacacagtgtctggctctgggttagttcagcaagccacgccttgcgggttagatggagcgagaacagagagagcgacagagtccggaggcacaagtgcaacgaggccaccgcctcgccagggactgtgcatacctgcctcgccgggccagcggctgcctccgcggtggcaggggcccctgggtgtcggggggagctggtggatctcacagaatgacggtgagaggtcccaaaggggcttcgagggaccccatgcagctctgagcctaccaggtgtcccagctctatttgctagacgttgggaaccatcaaagcggtctgaagacccttctggagcccctgccctggtggccgggtcaggggcctgtctctcgaagaactgagacagggcctgtgtgtatgggtgccttatggacgtgaactggcagaaggctaaaaaatgaaagctgatcttttcggccgagggagggggggaagcccacacatccttagacactttatggaatcttgcagacaagcaaagatttttttaaaaattgcagcctgggcagttgctaagacccgctgaggaaatggctccctgcggatctgccagaggcttggctccgaggctctttgtgttgtttcacgtttgtccccgtgggtggaacgaggcatcataaaaatgactttgcaaacaggcatcactgcaggcacaagctttgttctcgggggcctgagccctgagcagctggtgcccactggttgaggcggctgcctgctgggtaggagggtatgaaaactgtcacccctgctttgcagacagagggtgaatgctcacagcactcaggtcaaacagtgattggggggggtccaaatctcatctgtgtggcttccggccctttctaccacatcacacccacaaagcagggtcatgggatgcgcagaggtcctcaggattgcacaccctgactctgaggcttctttataagctcatagtgacaaaggccggggcgggaggaagcaagccttgctcg

SEQ ID NO: 29998 - DNA, 904 bp, Bovine  19866880709393
cttcttgacccagggatccaacctgggtctcctgcattgcagacagattctttaccgtggtagcaaccagaggagtctggtgggctacagtctttgggattgcaaagagttggacagaactgagtgactaaccaccttacagcacagagagtttatgggctcttcgtaactggaaaagtcctctggcatcagtggtccagcctcccagctccacttgtggatgtacctgtgtctccccaaagctctgggggactagcagttccagaatctctgggaaagttccgggatcccctctgattggcccaggttgggtcatgtgctcaatcctgaaccaatccctgtgaccagagggaaggtctatgctgattggcccattttgggtcatgtgctcaactcagacccaatccctgtgaccaagtggaccatgctgattggcccattttaggccatatgctcaaccctaaacaaatcgctatgactaagaggaaatcttgtgtagatttgcatagagcttcaggagagatgagcagtgccccactaggagctgggcagttggctcctccaagaaagcagagaatggacactggaaggcaaaaccagtagattccggctagtcctggaggccaaagagcccagacaagtgtcagacaacaaatgagtcatttgggtagaagagagaagttgatgggagactagttagatgcattggagtaaggtccactggggacctcagactcctctctctccacccttctccttggtcctctcccatggagttttctctttgctgccttttcacagtttaccttgggcaagggctggggtgaagtgaataaagtatgcaggctggccaacctccccctgaatagctcggctttgtccatctcctctggtcttcagtagt

SEQ ID NO: 29999 - DNA, 1228 bp, Bovine  19866881012250
acccagcaatcatggaaacacttcctagcacaatttagacgcagccaaagcaacactctggaggaaaattcataaccttcaaaaggtttaaatgcttgagttaaaattaaaaagggcttaaaattaattactttggtgtctaactccaaaagatagagtcagaggggaaagggaaggagagaggaagtaaaggaaggaggaaatggtgggagggagaaagggcagtagagagaattttctaagcagtctcggaatgagaggatcaaactccagctacccaccctgccccagttcttctgttcccaggcagacctactcccccacaacaccttctctcttcacccccaaaccctcaacctcaagcacgtgggtgggggcgagaactggggggagaagagtcaaagtgcctagtgctcccacctgctgggccagtagggattctggccccctggggacattggacaatgtctgaagacagtttgggttgtcacacccagaagaaggggggtgttattggcatctggtggctggagatcaaggatgctgctcaggactctatggtacacaggatggccccaccacagaaaatgacccagcctcaaatgtcaacgtgagtttagacaaccctgctcaaggtaatggcaattacctggggggctgtctggaggacacggctgccatcaggctccctgtgtggggctggaaggcggggacagcctcatcagtgtacaagccgccgtcctgccggtggtttaggctcaccaggtccgtcatcaccaccaggcctgtttcctaggcaacagacaacgcccagacccacagtggggaagtggatatgtggctccagaagccactggcccaacaccactgttgcatagccctggggaagtcagtcctctctctaggcttggcgacacagaccaagagggacataagaccaagtgaccatccagggcacaacagagttggggtcagaatgcttgtgggctaggctcaaaacggaaatcaaatcctcatctcttaggattccgtttatatgaactgtctaaaaccatgggcagatcagtggttaccaagggctgggggagggtggatagggtgtgaccgctgatggggacgggatctccttttggggtgatgaaactgttctggagctagacagaggtgctggcgtgcacaacaccgtgaatgtactaaatgccgcaggattcttcactttaaaatgggt

SEQ ID NO: 30000 - DNA, 977 bp, Bovine  19866881022988
agcatcatccgcctccagagcctctgtcgggggcacctgcagcgcaagaggtgagcagaatgggaccaagcacccccccacccaaccccccagaacattccacccactcaacactcaagtgctacctgagatatcacctggccggtagagctgtcaggatgtccctgtctggatgcagggaggctgaggaggggctggcaggcgtctagccggtctgggcacactgggccctagagagacactccagggctggtaggtggcacctatggcaaccccaggtcaccattggtagcactcagtctctgccagagggacccccccacccgcctactgcacctgcccacccccagccactgagcagaacacctggactcagagggttcaggccaccgggaccaaccctcaggggggcccccttgtccccactcacagggagtccaccaggccagggaccccagaggaattcagggagttctgaacagatccctcctgcaacaaacctcataaaggtccccctgaccctgatggctcagatggtaaagaattcgcctgcaatgcaggagacccaggttcaatccctgggtcaggaagataccctggagaaagaaatgactacccactccagtattcttgcctggagaatcccatggacagaggagcctggcgggctacagtccatggggtacagttcaatagagtcggacccaactgagcaaccagcacttttcacttttttcactggaagaaagtgtcagtagacagtacaccacctcggtctcgctcactaccaagtgggctgagcagacctgagtacaagggtgctgtaggcctcgccgacgcttcctgtgcccgcccccaggtcttccattaggcagcagtgcccatgacaacatgaggctattccctgtctcccccctttcctggctgaggatgggtccacctttccagaagcatctctaggggccagggtcacaccc

SEQ ID NO: 30001 - DNA, 2304 bp, Bovine  19866881081503
ttggctatccatgatagtcctcttctttcaaaccctttctgccccaatcccaaatccttgggaaggattgagccttcccaatcccctagcctcctctgcagtggttcctgggtacctgaaccctccagcttcttcctgcctgagtcacacatttaacaggagtgtgataaccccacgagagtcctagttttcaaactccacatcatggcatggacagatcaggttccccctgcggtatgctggaggcacacgaaggcatttccaagatgtggttgaatgagggaggtggaatattggcccctgggcatccctcagccatccctctccgggaacctggagcctcctgtgtgcatgcctccggagaacttggcctggagtgggtctgtaagcagtctctaaaccccaaaccacaaaggcaattgtaaattccagtgcagaaaggcacaataaaggccttaaaagcaagtgtctgtgcctttttgtaattggataatgcgtccttcctggagaagggaatggcaacccactccagtattcctgcctggagaatcccatggacagaggagcctggccgggtacagtccatggggttgcaaagagtcagacacgactgcgtgactaacacacacgatgcatccttattctgaagacaaggtatttttcttaatcatatgcatgtggttaaacttttttcaaagagtatgaaagggtgtatcctttcatatatacaaagggtgtattcctttttcaaagagtatgaaagggtgtatcctcctttcccttctaagaggcaaaaacggttactaattccttaactctccttctagaaattttctgtgtaaatttgttgttcagtcactaagtcgtgtctgactctctgcaaccccacggactgcagcacaccaggctgccctgtcctccactgtctcctggagtttgctcgagttcatgtccactgagtcagtgatgctgtctaaccatcttatcctctgttgccctcttctccttttgtcttcagtctttcctaacatcagggtcttttccaatgtgtatgcttctgctactgctaagtcgcttcagtcgtgtccgactctgtgcgacgccatagacggcagcccaccaggctcccccatccctgggattctccaggcaagagtactggagtgggttgccatttccttctccaatgtgtatacataggacttaaaaaataaacacacacaatgggagaatagtcctgttctctaccttcttttttaagtcaacaataaaccttagagaccattccgtatcagtacatgcgtgcttacctcaccgcttttcactgacgtgtaacgttctcttgtgtgaatgtactaccgtttggtaaaccgagtgccccgctgttgaaggttctggctgttagttaattcccacagtgctgcagttaaccacactgtctttgcacatgtgtctgtggttaatttcagtgttcacccatcagagaggcaactgcaagttgaaagggatatgagcatttttaatcttgagaagatttgccaaatgtcaagtagggcttggtaatattattttcttaaagaataggacagtccctgaggactgtgggctctgaggcttctgaggataaaccaagaaatgaaagcgtgtgaaaaagaatacatacacacgcacgcacacgcacacacacatataattgaatcacttggtgtacatcagaatgtaaatgtacacagcactgtaaatcaattatcctgtaataaaaagaactaaaacaaggaaagcacagaggaagtggggggaagagttccatgtagtgatgcagaaaaacatggcaaacccagggagggaaattaacaaaggagaggacttggggtggtccctgtggcccttcttaccttctgagctcaggctgtgaggcaccactctccttttaacaagtctctgccaagccttcgatgcctcacttttctagctgtaatcaagtagaatgttgattaaaattgtgccaggtgaaagaattaacacgtcaagtccttgtaaagtagaatgctaacctttccaggtaagagaattaaataaaccatgcagcatattaacatgttgggtaagagaatgaacatattatagccgaatcaagtagaatgttaacttaccaagtaacagaattaaagttatggaactttaatcttttctttttaaaaaaattttcgtagagcagagaagaggaaaaggaccttcttccctgaaacatgggtttggcactgtctcaacatcaggtacagtaagatttctttccttcgctgc

SEQ ID NO: 30002 - DNA, 897 bp, Bovine  19866881117243
tgactgagggactgagccactgaccccgctccaggccaactggatatagaaaggtttagttctgccgaccggctcgggttccaatcctagctatatctagattcctgggactggggtttcagaccagcacaagccaatatggtggttgatgattgagtttctagggtatcggtcacctctgtaggacattctgcaaagcaactggcttggtctcctctgagactctttcatgggggctgggggagaaccataatttgaatccagggcaggctgcttttaatttcagctgccccaggcccttcccttaggcaggctggaaaggcatagggattaattttcaaaaggcatgaattttccagaattcgtatgctgcccaacctctgctgggcccagtacacaggggtacacagtagttactcagtaaatgtgagtggttgggactttgaggatggttcttctgcgaggcccagggttgagaaagagttaagaaagggttaagaaagagttcgaagggggtagcaagaggagaagggaggacctggctggtacctcctccgagaggccaactttagcttcctaattacaggtgacacgaatgtccctctctcaaaatagagctgctggacactgactggggggtggttgttgagtgggtacttagggggagggttagcacagggcctccccagcggggctcaggggtctggggtagcctctaccagcaaatagcagaggacagtggagccttctttttatttttttaaagttcatttatgtcgtattttttttcaactggactataattgccttacaacgttgttagtttctggtgtacaacgaagtgaatgagctgtgttagtggaaccttctgggcagaaggtagacacaagggggaat

SEQ ID NO: 30003 - DNA, 757 bp, Bovine  19866881202839
gaggatgcctatttccctgtgaagtcccgtgtccctgcaatttcaccttgtactacgaggtggctgcgaggggcaacatcgtgctctcaggccagcagcctgcccacgtcacccagcagagaagcaagcgggcagccctggagaaacccattcgcttaatgcacctttctgagacaggtgagctcatccacaggctggaggttcctgttcttccttctgaaccgttgagactgggatgggcatcccagcaaggcttggtaagcagagtgcatcccggaggggagcctgcttcagggtgaagggcacatatgccaggcaagactggactaggaccaggagggtgggcagtgaccagctgctggagccagctcctcttgaggctgccgtagcctgggcccctgagcaggtctgcactatgccatgctgccttctgccaacccccttctgcttttgcccagactgattccccatcaaggagtccttctccctgctttccttgatgccacatgctccccacaagacccattttctcccctgggtcttcccatccctctcttcttcacagcctctctgcccagagcaggatccccaaactaaggaccgtggacacttgcagggtattctttgtggtggggggccgtgctgtgcatgctagggtgctgagcaacatccctggtctccacccgttagataccagtggcaatccacctacacgcaggatgacaacctaaaatgtctcctgatattgccagtgttt

SEQ ID NO: 30004 - DNA, 2920 bp, Bovine  19866881272233
ccccaagaaaacctcaatttgcagcaaagcctaaactctttttctgttgagtttatattttctaggattaatttagaatataaaatatttaaataaaatttctaagactgtgggctaaagaaccccacaaaaaacatggcaaagcagaaagggccactgagggggagggcggtcagtcccccccacttcctgcagtccagagacaccactgagtcagccctcagggtatccaagggactattcccaggaaaacaagtaagttcctttatggaacaaatgttgattggagagttactatgctggtgactggtctgtgaccacagacccagggacccagtccagtcccacggggactcccatcaaagaccttggagacagttgatttcctggaagtccatggacctcagtgccaggctggaaagtcgcctgttgtatatcaaattttaaagatggaatatcctcattttgggaaagtctgaaatagggggacaaaagaacttttgttgaccaccaatgggaaaagtttcaataaatattgtgtatgaattccatatgactgtgccaggtatcacacttcgtgggaatgatgcaggagtttgtctcccttgaaggggacttcgtaggtgactcagcggtaaagaatccgcctgccagtgcaggaaacgcaggatcgattcctatgtcgggaagatcccctggaggagggaatgacaacctgctccagtattcttgcctgggaactcccatggacagaggagccaggcaggctacagtccacggggttgcaaagaatcggacatgactgagcgactaagcacgtccttgcaaggattccccagggtggcaaccttgagtctgggcacaaagcaaagaacttgactcttttgttctcatcagaaaaaaagaaagataaacaaggagctatttttcagttggatgtgctaatctgtgagcctcttaattttttttataatcctcgattggtattagtgcgtggactgaactctgcctttcatatcgtagcttaagtcagctgctgatcattcactacatcataatagcatagctcagttcctaacttaaatctacactgctttgattaagacacaaatctctaagagaaaaatctcttttttcctgtgaaaccataaaggatctgtttcataatattgagattaatttgctgttataaaaatttcatcagttaaaaaaaaaagtaagcgctgggacttctctggtggtccagtgattaagaatccgccttacaatgcaggggacggggattcagcctctggtgggggaactaagatcccacatgtccacatgctgcaagtaaaccccacatgacacagcaaagatcctgcatgcctaaactaagacctgatgcagtcaaataaataagtagtaagtgctgtgaaaatcggagggaaaaagagcttggccactgtaagtgagttgaagtatgtcccccggccaaaaattatatcctagtcctaattcttgccctggaacccgtgaacatgatcttcttcggaaacagggtttttggtgtcaggtgtcacctggatgctttgctgtcaaaggagatgcagagacattgctcagggccgtggagggtgggacgtggaaaagcataataggaaacagctcacaaacaaagatcaggatgtaccccaaatcatgtttcccctgtgtgacttccctctgatccaatcactggcagttaaaaaagacagcacataaataaccctgatgctggaaaagattgagggcagaaggacaagagggcgacagaggatgagatggtcggatggcatcactgactcaatggacatgagtttgagcaagctctgggagatagtgaaggacagggaaaccaggtgtgctacagttcatggggtcgaaaagagatacgacttagcgattgaacaacaacaaattcgaaggtcatcatgtaatttgacaagtcattttgcataaaatgtcttcagaattcttgaagacatgtcctgctctgcttcggaattacagaatcattgcaaattgctttggctcagtcactgctgggccccaccttgcacctccacagatctgcgcccccaccctgttcgtccctgatgccaaatctgtgcacattgatccccacggcctcgtgttcccgtgcctctcaaggcagctctgggaggcagatgcagaggcggccgtgtgactgcacaaatggctggcgcgtggccaagtcagctctggacccgaaggccagaagcttctagcttttcgggggcaaatgtggcgctgacaggaaaatgtttgtttggtttgtaagttgagctggcccactgtggaagggatgataaagatggaagcccgtgtggtcatggtgtggtcaaggctctgaacgtggctttgatgggcaacgccacaggcgtgatcctaagggggctcagcagagagttgacggacgtgacctgcgaccctttccctttctgaaatcatcagacatctgctgagtgagctgtttgggaactggtcccaggccaatgtcacggagggagcagagtgtggggtggggtggtgggtgggggggcaagataatctccagggcccttttcatcaggaacacacatgagtcatttttaatcaatcaaaaagaggaaacgagaccaaatgcagttaatgaaggctcgagtaccacgctgtgaagaaacttccaggagttggacaggcaacagtgaaaccttggagacagcttaaagggccatcaggagggagagtggttaagtaattaaggtcccctctgcacaatgcaatatcagcaagttgataaaaaaagagcaaaggaaagctatgtatgctgacatggaaagatacatgacatagggttcagtgcaagaaaaacctgcgagatagtctgtatttgttt

SEQ ID NO: 30005 - DNA, 1198 bp, Bovine  19866881329671
gtggcgctgctgcgcctcagctggagcgagctcttcgtgctgaacgcggcgcaggcagcgctgcccctgcacacggcgccgctgctggccgccgccggcctgcatgccgcgcccatggccgccgagcgtgccgtggccttcatggaccaggtgcgcgccttccaggaacaggtggacaaactgggccgtttgcaggttgactccgcggagtatggctgcctcaaggccatcgcgctcttcacacctggtgagacaccctggaattggggggctctggcctggggaggggctgggtggcggaggggagagacctagctcctgaccttgacccccttagtcctccacttccggatctacagctagccagacttgcgtccctgcatgcgcctttagcgctgttgggggacagtggaggaagcgatgcaggcggtctgacaccgtctgtgatggccccactccctgatcccaggccttcataagaactttgatcccccacggctccatgtcttaaggccccacagcctccccccttgattctcaggctccctgagacccccccccttcaccccctcatcaaggtgttcatcgtgctcagtgggcactgacgtgctcagtgggcactgacggcagaatgacaggtggggggccgcgggaggggaggtctgcccacttggctctgtccgtcacttactgatttccgttctccctgaactctgtgaccctcatctgccaaatcaggatgctcctcttgttactgaccacttaatggaggactgccttccacttacgaaaggcaggggttctctgacacctggttctggggtctcctgggcccttcgctccctgattcctaggaccctagaccactgacccagggctcccaacctgcccccccacccccggaaggccttcaggggccacccacagcagagctggatcgggtagggtgtgtggcttgaagcccctcccacctaggggcggaggcatcttagttccttcctagtcttcagtaaccgccaaagccctgcttcattgtggtgggagtggtggcatagcagactctgcactttgcaaggaggtcccactaggtgtctcctggaactaaggatgcggagccagacccaggctactctgggaggggcttttatccaataataggctttgcccctcttacttacccaggacattttctctgccc

SEQ ID NO: 30006 - DNA, 1422 bp, Bovine  19866881354087
ttagcatccacatcaagcctttcctgtgacctgccttaaccctcatgctaaccccagtgtcactcccaatccttaatccagcaacctctgatccttcaactcaactcaaatccatcccgaccctgaccccaacactgaatcagtccctaattctaaccctaagccaattttgaggcccaccgccttcctaaactccccaatctttatctctttcttaatatcatttccaatccaaactgcaccacagtcctaatgccaataaaatcctgtgtcaatacatgatcataatcctaaagccattctagactcatgggcacccatgtttgatcccagcctcaagtctaaatccaccctcaatgtctcaactcatcccagtcccaaaggaatcacagttttagattcacccctcactcaaccctggacctgatggacaccctacctccgactccaatcttaacccatcccctttctcagtgctgatacactttctaagctctgcctcaatcctaacatcagtgaaactcaagcgagtcctaacaaactcaatctacactgggaagccaacctctaaaagaagttaaaaaagaagccaagttcaaacccaagttcaacatcaccatcaacttggcctccagacccatccctccaatgcaaccagaatctagggccccctacccaccttcgccttgatacaggtgtccagggctgagttgctgactgccaactgcaacttgaggtgctcagtctcacgcttcttctcttccagctccttgaccagcctgtcccgttccttctgcagtgccaccttctcctccagggccagctgggtctggcgggcacattctgcttggagcttgacagcctgggcctgcgcctccttctccaccttctccttggcctcctgactggcgcgtaggctctgctcgacctccagtttctggcgctggagtttctcgttctcgagggtcacgctgtcgatgccagcccgcaaactccgggccagctcttccaccttggaggtcatgatggagggcaggctgtcgcaggctctctggatggaaggcagttccgagccgaggggatggtacaagttgaagctcagggtactgagggtgcgcgggatgatggagtccctccagaggtttcgcagatccgtctcaaacttgttcctgtccagggggatgcagaaggcctgcaccttccgcagccggtcctcagccagctgccgttcctgctgctgctggtctcgggttttgccgcactcggccagctgttcctcatgccactcgcttgcccaccgttagaccgtccttgtctttggtacataccaacttctcctttgccagctccacctccagtgtctggctttctgggtcagcgtgagggccaaagctaggagaaggaccagaagacccaggaagg

SEQ ID NO: 30007 - DNA, 993 bp, Bovine  19866881446632
cctggcaacccctaatctgctttgtcttatttttagaattttttgggggtcacatcacacagcatgttgaatcttagctcccgaaccaggattgaacctgcatcccttgcattggaaatgcagagtcttaaccactggagcaccagggaagcccccgctttccgtttttattgatttacctgttctggacgtttcatataaactggatcatacactacagggcctttcgtgcctggcttcttccactcagagttaacagtttcaaggctcaccacgcaagtgtgtatcggagctgaataagattctgctacgtgaaaggcccacgttttattcattcatcatctgctcatggacacagggcttgccctttggcaattctgactagaactgtgccgctatgaatgtacacgcactaggatttgttagcacgtgttttcagttcttttgggttcatacctaggagaggaactgctgggtcatccggtaactctacatgattgacttgctggggtgctgtgagacatcacagagttactgaccagtcccttgaacaccctgtgctatggtgcgatggttcctagcctacaaatgagacactgatgcctgagccccacaccttaggcctgtccctctgccttccaggaagaaataacgagctgctcccaaagaaatgtacttcctcagcagagcccttattttccagggagtggcgtgggctgtgcgaggaccccgtgtggagtggaaggtatgggtacaaggggtcctctgagggctgcgattgctgaccttggtcttgccgatctggtagctcctcttgtctatgtccatcttctccagcagggcagagatgacctccctgcagggctgggcattcttcgggagaagcacctggaactgctctgtgaaatcctgggtgattttgggtaagaaaggagaatctacgtgagggtttctgccaccagaaagaacagggctctagccactccccggtca

SEQ ID NO: 30008 - DNA, 1075 bp, Bovine  19866880200963
aagactcttgagagtccccttggactgcaaggagatcccaaccagtcccattctgaaggagatcagccctgggatttctttggaaggaatgatgctaaagctgaaactccagtactttggccacctcatggaaagagttgactcattggaaaagactctgatgctgggagggattgggggcaggaggagaaggggatgacagaggatgagatggctggatggcatcactgactcgatgaacgtgagtctcagtgaactccgggagttggtgatggacagggaggcctggcgtgctgtgattcatggggtcgcaaagagtcggacacgactgagcgactgatctgatctgatctgatctgaaaccatggaaagttcccatcagtgctcctgacttcaccggcctccctaaggcacactttctggtgctcattcaaacacctggtacttgacttgtcagattaggatgattgatctggagacatatgaagtttcatcaagtttgacttttgtcagaggagaaaggaggaataagaggtggatgatgacgaaagaatagagagtgggcttagtaatagttgttgggcatcagggctggggtggtcagaactgtgattggaacattttacccactgagaaatttatggtagaaataatttcccacaggctactaggataattatttttgttgtaataatgacaacgataacaataataatagctcttttttgaagttttatgatgcacttgatttttttgatgtatgctctctaatctagcacctctctgaagaaaggtttattagccccactttctggacaaggaaactctggctcagagagattaggtaacttgccataagtcacaggaaaggtacacggagtacctgtctcacttcaagtcagggcgagctgcttacgttttggtgacctcaaactgcagagatttgctctctccctctccacctcccagcagtttgtaaccttggacattaaatctgcattaatcagggaagaatgacttgcgttttgcagaccaaggtggccctgatctgctgagtatcgcttcacgtgaacag

SEQ ID NO: 30009 - DNA, 1609 bp, Bovine  19866880349882
atttgcactaaaaaccctagggctcatatgtttaaagcgatcctagtagcatatagaggtggaactgcatttgaccatgaagcaaactgtgtaaaactgatttggggatagaaaagaggatttcatctctgttcagcaagtctttaaacttacttccagttaaagggaaaaatgtgaagaaaagaggttaatgtcaagatatctggaattgtaacaaaattatgctacagcttcccagcattgtctgtttcttagtcgctaagccctggaaaatcccatggatggaggagccctatcaggctgcagtctatgaggtcgctaagagtcagacaggactgagcgacttcactttgacttttcactttcatgcattggagaaggaaatggcaacccactccagtgttcttgcctgaagaatcccagggactggggagcctggtcagctgctgtctatggggtcgcacagagtcggacacaactgaagtgacttagcagcagtagcagcagcagcaagtcctgttcaactctctgtgaccctatgaactgaagcattccaggcttccctgtccttcactatctgccagagtttgctcaaacccatgtccattgagtcagtgatgccatccaaccatctcattctctgttgtccccttcccctcctgccctcaatctttcccagcatcaggatcttttccaatgagttgtctcttcccatcaagtggccaaagtattggagcttcattatcatgcattccaatgaatatttagggttgatttcatttaggattgactagtttgatctcctcactgtccaagggactcttaagggtcttctccagtaccacagttcagtacactgggaaagaatctggataaaaacttaactagtttttgagagagttccttgttaactgctccattttggagggggacaaaaatattttctaaggaatttatgaaattagcagtcttaatttggaggtacagattcttaattctcgtttttacttgtaccaatacagaatatgagtttaagagccacatttactcattaatacagcaatgacttttttatttaactacagatcgaagcacatttataagcccacagcaaaaggagtcctcccaaatagagaaatcacaaagcagaaggctgacaggctcggctccagtgttctgtgcaggaagccttcctggagtagtgaatatttttacaaaccaaagagatgatgaagaaaagttccctgctaataatgcaaaagaaataatagaatttaaaaaatatctctttatgtaaatcctaatgaataaaggataaaagtgaaaattgcccagtcgtgtccaactcttcacaaccccatggattctccaggccagaatactggagtggatagcctttcctttctccagcggatcttcccaacccagggatcaaaaccaggtctcccacattgcaggcagatactttaccagctgagccacaaaggaagcccaagaatactgggagtggggtagcctatcccttctccagcagatcttcccaacccaggaatcaaaccggggtatcctgcattgcaggcggattctttaccaactgagctatcaggga

SEQ ID NO: 30010 - DNA, 1330 bp, Bovine  19866880350011
atgttgcacaagatgagcactgacactgaaagttttcccacattcatcacatttataagatttttccttagggtagacttcctgttgtataacaagacctccatttgggtcaaaactttccttggtttcattgtatgaataagtcttctctctggtgtggattctctggtgctgaataagacctgagcttctactaaaggcttttccacattcctcacatttatggggtttgtcccctgtgtgaattctctgatgacgagtaaggttgcaaagttgactgaagcttttcccacactctttgcactgataaggtctttcacctgtatggatcctctgatgttcaataaggaatgagctccgactgaagctttttccacattcaatacaaagaaaaggtttctcaccagtgtggattttttggtgttgtataagatatgtacttaatctaaaggccttcccacattcaccacatttatggggtctttccccagtgtgaattctctgatgttcaacaagtaacgaatttctactaaagcttttcttacatttggtacagtgatagggtttctcaccagtgtgtgttctctgatgttcaatcaggtgtgacttccaactgaaagctttcccacagtcactacatttatggggtttctcacctgtgtgaatcctctgatgtttaacaaggcttcttcgctggctgaagctctgtttacagtgattacactgatagggtctctctccagtgtggattctctgatgtctaataagggttgagctcacactaaaggtttttccgcaataattacactcatagggcctttccccggtgtgaattctctgatgttcaataacaaatgaactgcgactaaaacttttcccacattcattacattggaaaggtttctctccagtatggaccctttgatgttgaatgaaatgagccttgcggacaaaaccctttccacattcttcacatttatgacatttctcttctgaatttggtctcttacggataatgttagtgtttcctctgaacattctttgttcctgggtcaaagattcccttggtatttcccataagaagattcctctttgtttatctaacctaccaacaagttcaaaggtttctctatgcatgggatcctggtcaatttcacttttgattcttgtaactattataccctgtggttccatttcttcctcaatttcctcaatttcttgtttcacagttggctcctcatccttatctctgtttaaaacatctggaataaatggaaaacagcaatgtcagcctagttcttggccagcaaggagaaactgtcataaaaat

SEQ ID NO: 30011 - DNA, 3629 bp, Bovine  19866880469153
cagtccatcttaagtgagatcagtcctttgttcattggaagaactgatgttgaagctgaaactccaatactttggccacttgatgcgaagagctgactcatttgaaaagaccctgatgctgggaaagattgagggcaagaggagaaggggacgacagaggatgagatggttggatggcatcaccaacttttggacatgggtttggatgcactctgggagttggtgatggatagggaggtctggtgtgctgcggttcatggggtcacatggagtcggacatgactgagtgactgaactgaactgaactgaactaaacttatttagttcatttactgttggtctttcatcttttatcattgagttgaaagttgttttctttctttctactttaaccatattctcttaaaggtccaaagtttcaaacaaaaggcccgatgtaaacaataccatgtgtggttgtgtaactcttactgtgaggacacaatgcctttaaaatatcaagtgaggaaaatcatctgtcttgacccgcccaacggctaattccatgtctctgggaagtggcttgtgatggtaaagagctgtaggtattggagtcgtttcaacctgggtttgaattctgactctgccatttagtgacacagctcaacatctcatggaagtagacttgctcaactcatcctgcgtggcagggtctacagataggtcttaaaatattctttaggagaaaataagattgagacttattgcaaaagcttatgaaagtgaaaataacctttattataaaataaaaaaactaaaaactgaatcctagaagtgtgatggcaaaatgacattttaaaaggaggactcttacatatgatgagaagcttgagagacttcaaagacagaagggttgagtgcagtttatgttcacgacgtgtatcactggggcccctcaaatgtcatttacagaggaggtgcctgagaaggtaaaggccagatgctcactgcttcttgaagagtctagagttgctttgtgggattttacgagtttttttggtttgttttttcattttattgacatatcattgtggtattaatttctgctgtacagcagaatgattcagttatacacatatatacttcttttcatattcttttccattatggtttatcacaggatattgaatataattctctgtgctatacaataggtccttgtggtttatctggagaaggcaatggcaccccactccagtcctcttgcctggaaaatcccatgggcggaggagcctggtaggctgcagtccatggggtcgggaagagtcgaacatgactgagcgacttcgctttcccttttcactttcacgcactggagaaggccattctatatagaatagtttgcatttgctaaccccaaactcccagcctgttcctctcccacgccttggcagtcacaaatctttctctatgtctgtgagtctgtttctgtttcatagacaagttcatttgtggcatagtttagatctcacacataagtgatagcatatggttcttatctttctctttctgacttctttcgctcagtgtaataatttctaggtctatctatgttgctgcaagtggcattatttcattgttatttttacggctgagtaatattcctttgtgtatgtacacaacatcctcttcatccattcatctctcagtggatatttagattgtctccatgtctttggctgttgtaaatagggctgccatgagcatagaggtgcaggtatcttttcagattatagttttgtctggatatatgccatatgatcacaaagagttggacacaactgagtgactgaacaagaacaaatgcccagaagtgggattattggatcatattggagtgagtatgtgttaacttgatgctgtaactttgagcccctggtcagcaatataggagcagctgtcattagggcaagtccctttggaaccatttgtataacaaaactcatctccaaagtgtaactagagccaacaccccctgagtgctcactgggtaccaccactctaagccccttatatggactatctactcagtcatcacaaaaatgatgtgaagatgctcttactaccagccctgttttatcatgaaagtgaccaacccacagtcctccaactaaaaggtggagtcaggatctgaagccagccagacactcccaagcctgtgctctcaactctcaataataacaaggtcgtcaagacatactaaaataataccaaatccagcacattttaaacatatgtatcttaaggctttcctggtggctcagacagtaaagaatctgtctgcaatgcaggagacccaagttcgattcctgggtcaggaagaattcccctggagaaggtaatggcaactcactccagcattcttgctggaaaaatcccatgggcagaggagcctggttggctacagttcatggggtcacaaagagttggacacgactgagcaactaacacacatacactttaaaaatatatccaatccctcccccaacactttccaataagaaatgaaaatgtcaggtcaatgctactttattttttacataattgaatattctagtgaatagagagagcaagagaatcgtctttaaatagtattcacagaaagaaatttgacgtttgttcaaaacaattgctcgattgcctgatccagactccttttgccattgaattctaaaaagaaaaaggaaaaatgtacaggtcagatggaatcattatcggaatggagatgaagcagagggtcatgttattacacaacatatttaaaaatgcctcacttgacatggcataaaggcccataatcaggactcatgagatatgctattgttgtaactgatcaggccattaggtctgcgtgagggggatggcctcagggaccagctccctctgtacagctggggtagtgtgctccccagcatctggacagagctctcagacactctggcctgccagagcctcagccactgctggctggtccaggttgtgctccagctgggaggctggggcgcccctgaaggacagcagcctcatgttcctggaaccacatcattgtaagagacagagaaggtccagagttgccttcattcagactccccccaacaccatcacaggccagaagccgagaaatcccccgagatttcacctcggggtctctgagcataactgaatggagggaatagtctggcctggctatagtcagaaatgctgccgctgtagaaaactcctccccaccgagcatcccagataggtggatttgcctcatcacaagggcccagtgagaagtcacaaaagcttctgcctcctcacagtggctgctggagacagcgcacctgcaaagactgccttatttgggacaatgccaggctgcagtggggtctctgtgatgctgagagcatgaaagggagggagcagaggtccttaggggttccacatggtcctcactttttgaaactatcacccctctggctgcctgtcactcccccatgtctgacataaaacatttatttggagaagagttgcagagaggctgaccttggacaatcctaccaggtgtcaaagtcaaggtttcttccattcctggcggaaaacaaaca

SEQ ID NO: 30012 - DNA, 870 bp, Bovine  19866880470557
cacaaatgaggctaatttaatggctccaacaagcagtaccctaatggggaagccagcggctgcaggtgtgagcacagacaggcccgactcaggtctcctttgtgctgcactgctctgctaatcggatctaacgaaggagctggaggtattctccttctgttttctaatgatgttaatgtcttcatgaggttaatgaaactgctaacacaggccaattatgaatggctttatgtataataaaaaaccatctattctgagttttttgcaaacaagaaggacaatgattgctgtggtggttttgcctattattgagtatatcaacagggctttttttccttcttttttcctttaaggaccaggctcaaagaccactaaacttatgtgattcagagatgcctagattgctaggtggacctagctggggactgcttaaggctacagccctcatttagtcctatcctttatggtctctactgccccctgctgactgggagaggcaggagctgctctccagcacccccttgggaaatggaaagcaccagaagacaaaatatgaacagctattatttactgtcacttactatatgccttctaatttaatactcacaacattcccgtggggtagctcctgcccttttacagatgaagaaacctaggctcgagtaataaaccaagttccccaaggacacaaggcttgtgagtggcagatccaggacaaggtataaatctgtcaggactcacagctgctgttacactcccaccagagacatggtagagtgaaaagtacatgtattttaaaacaagataaatttggatcttggttttccttccccaatttaagagccatttaagataaaccttaaacaagtt

SEQ ID NO: 30013 - DNA, 967 bp, Bovine  19866880610852
atgaaattaggttgcaagctactggaaacacaacacatgttaatttcttagacacaagtggaaaaaaatcagttatggaaacaagtctgaatatcagggatctgatgaaatctcacccaatggtttctttacaatgtttctagctccccacaccccaaagagtctatctaagaaaagaacagactttaaaacagaaccagctctccatccagatcaccaaatgaaatacctcccaagctgagtgcagagaagcgcatcttattaaacagttttagcagtggtaggttatgaaggagacagctgcaaccagaaaatgaaataaaatgttctacaaaccttcagttcgtgtcaggttttactttgtgctcttgctttcaaaggatttgatacatttcattacctttgattctatagacatgccattagcatcaggatcctcaacattggttgctcgttggattaacctggcaaaattaaaaaacccaggatgcttaggctacgctccagccaagtttgagaaccactaagctagatttcaactttgagggtatttataaatgaaggctattcataatgtgaagcaagctacattgtaaaatgattccaaacaacatatggagtttaataaagcaatcactgtgacgttcgtgcttggaacattcctcatcaaatggtacaggtttggtgacacaggactgcatcttcctctcacatccaagcacaccacatagttttgcaggaagaaatattcacataattatgcttattggcttctgattttcagaattaacctataaaagcattaaagacaaccatagttacaagagagaatttaattataactttggacaatgtaatagtaatgattttggtggaaaaaaaaaagtaaagtaatgttttaactgagagaagctgagaaattgaagggggagaagacgtgcaggaaagcaaagaaaacagtaattta

SEQ ID NO: 30014 - DNA, 1248 bp, Bovine  19866880620550
ctgtgcgctgcaactagagagcctgtgtgaagcagctactgagactgcacgctctggagctcatactctgcaatgagagaagccatgtgcgacaagcagagaaagtccatgcagcacaacaaagagcccgggcacagcaacaaagactcggtgcagtcaaaacatttttttaaaaagaaaacatattagaaaaaaaagaatcaaggaaagtgtagaggactttaagagtctagaagagtctaaggagacatgacaagcaaatgcaaagtgcaattctggctcagaaaacagacattaagtaaaaactgaagaagtctaaatcatatacggactttagtggctaataatgtaccaccaagatcaagccagtcaatcctaagggaaatcaaccctgaatattcattggaaggactgatgttgaagctgaagttccaatactttggccacctgatacaaagagctaactcactagaaaagacccagatgctgggaaagattgaaggcaggaagagaaggagacaacagaggacgagatggttggatggcatcactgactcaatggacatgagtttgagcaaactccaggagagagtgaaggagagggaagcctaatgtgctgcagtcaatggggtcacaaagagttggacacaactgagcaacaacaatgtatcaccaccgagtcatcaactgtgacaaatatacccgaagtaatgttaacaataggggaaactggatgtgaggtatacaggaactctctgtactattcgtacaacttttctgtgaatataaagctctgctttaaataaaatgtttactttttaaaagtcaataaacccttgctcaaacttatacttggaatgatataatttttccaactataagttctcatagtaaaaggattacattacattgataaatgtgcattttggagcttggcacaatatagcagtttatatgttttctaatccaaattatcccccttctaaaacatcccactgagtacgttcagggagatggttataaacgcaggattctagaactcatggtaattcctcccagtggaattccggccagaataaagaatatttgactcactgcttaggggtaaaaaaaagcttttaatgaaaacagaaaatgtgttatgtaggatatgaaggctgggaatccaagaccaattattgtgagaaaagctcttttccacaaatgtgctgaagcaacattcaggatcagcgcagcctaattctaatg

SEQ ID NO: 30015 - DNA, 1010 bp, Bovine  19866880637668
cccccagggagcccctgtgccctggagtcaaaattcagaggcctccaagctacttgtgtcataacctaccacatgtctttatcttctctcagatgatcccgcagtgctctgaagtacacaggtcacattaataccactccccccaaagccagcagaatctttgcctgtgacagaatgcagtactaaccactgttcacagtgttagcaagcacagttgtgtgaacgtactcagtcacacagttatggccgactctttgcaacaccatgggctgtagcctgccagactcctctatctgtggaattttcccagcaagaatactggagtgggttgccatgcccttctccagggcatcttccccacccagggatcgaactcatgtctatgcattggcagtcatattctttaccactgagctacctgggaagccccacacagttgatgagcacagcttaaagcaattgtcaggacatagcaaaggtacataagattgggttttataattctaaaaataataattctacacctgatggaaatgtaagtcgtcataaaactaatccctgtatttctaggaagtactgctcattcttcacatctaaggctcttgagttcaaacccagattaacagtcactgcacaaactgtctgtaaaaatcagtgttcacgctgagaacagaacgcatgattagatcagtgaggccgtgatccagaagacagctgatgtgctatttttaaaacttctcactggtgtaaatcagctatcctccaatcaaattgaaaaaccagaaacttctcactgttaaaaataatccacattttgcagatattccttagaaggattatctcagtagctgaaaaatggacaatcctggcatggtcataagtcttctcattcatttgatgtggaaataagatactctggccagcaggaaaaccacactgtcaacagctaaaaatacgttgctgattttatactatacatcctcaggttggaccaaacatatgtcccacat

SEQ ID NO: 30016 - DNA, 1030 bp, Bovine  19866880686111
atttttttaaaacttgctactgttttatagctttgtataaaatgctaatgccatgacatttatagaactattaaatcattttaatgaaagagtaaccgttataccactaattcatttgagtgcatttcccttgcagaatcgtttagtagttgattgtaaaaggatgggacttttttttttttttttttagctccatgattttgttctaccatggaaccaaatcccattattttgatgtgctttataacccaagtgtaatggagccaaatccattgacaaaatttgttgtccgaaatctgagcttgtttgcttcctggcccccacttaatttgatctagtgtctgcacaagccaagtctgcttttcttgagaagtagggctttctgtttccctcttatgtgggtaaatatatagtcatgtattttcagctactgaaaaacgagcttcattgccttaacactgaatcaaagaaaatatttgggctttaaaaaatatcttgtgatcacatcaggagacagcttggattgattctggatctgggcccacatttccttgttagtggccatcccactcagcttatgttgtcataccggagtctctgtggaaggaagtggctggaaattcccagacacgaagcactgtgagtggcagaattagacctccaatctccaatagatcactcttgtctgaacctgcagctttcatctaaagtgaaaatgatgcttattttttcctctctgtctttttaaagccctcatttatagataattattatttcttggacagaaattatctttcaggaacattgcctggcatccttaaatgcatgagagacacagagaattgacttcaccatcaatatatttttcaccccttaggaacatgaatattcttgtgaaatgttggagcctgcatttactttgcttaccttgaccgtacatttgtatttacttttcatagttctgagtttcttcagaaataattaatctcattatcattctactacgagttaaagggttttgctgctaaaa

SEQ ID NO: 30017 - DNA, 1772 bp, Bovine  19866880729829
agctcctggggctgtttctttaaacaggtggttcctttaaacctgatggtgccacgcagatacacctgggccatggaacgtgggcgagccttgggaattagaggctcggcctgaacgcctctcctcactgctctgaaccaaaattgctgcttgagttgttttcctgcactgagaaggttttaatgtgataaacttctctccttaaaagaagaattagtggcagattcaagagatctggtaatcacatttacatatacacacacaattatccaagaataagtttacaaaggacttttaatacatattgttttaaaaataccattaaggccaagttaaatcatgtatttatccttagttggccttatgccagaatgagatggagaatagggaccattacacatatatatttactcttgaaattatttctgatatttgtataaatattcattggcacaacagatttgtgatgtgtgaactgtttaactacattttgcaaatgaataaactgaggatcacagaagtttaataaacctatccacagcttcaaatataaatagtaagtggctgagctcacatttatagttaggatgtgtaaagcaaaacccacacactttcaagtacctctccatgcctttcagtttatcaattcccactctgcctcaattcacatttttctgtattatcctgttctccatttggcatatgatggatcacacttacacatatgatgctaattcagcttagcacaaatgatggagaattaaatggataggtgcccagaagtgattttgtattatttatatattcaagcatagtctgctctctgttaattgctttattcttaataattggttaggaatcagcaaaaattaaatcaagctgagaaaggtctcaatgaatgtgtgccagtcttattttaaaaaggttcttaacaatacataataagtagtagctaccattaatgaccctggtagctcagacagtacagaatctgcctgcaatgctggagacctgggttcaatccctgggtcagaaacatcccctggagaagggcatggcaacccactccaagattcttgcctggagaatcccattgacagaggaacctggagggctataatctatggggtcgcaaagagtcggacacgactgaataacttcaccctttcacgttcaccatttatgaggtgtcaggcctttaatctaacttaatttttataatgttcctctgaggttggtatattattagttctattttctagaagaggaagcagctgagctctaagaacactgagaagcttgcccagagttatacggctgtaagaagcacagttttgatcatacaagctctgtctgatctaaataccctgatctgcttcacgtcttcttgcatgctggtctcaaagaggaagcttcctgccataaaaacacagaggcagtgagatacttaagggaaaatgacacatgtagaatactttcagtaatttcagtattttttttttagcttcctgaggcataactgacaataagccaggcacatctagaatgtaaatttgatgacttttgacatatgtgcatgtctactaagccaacaccaaaatctagataatgaatatatcatcacccccaaaagtttcctcattgcctttataatctccctgccctgttttctcattcccaggcactcataatatgctgttgctgctaagttgcttcagttgtgtctgactctgtgcgaccccatagatggcaggccaccaggctcccccatc

SEQ ID NO: 30018 - DNA, 1853 bp, Bovine  19866880815973
gactgggggaaagtaacagtggtggtcactgctgaccagagtaactttcctatcagataagtactggttgctcagcagttctgaaattcttcagcccattctttccaattcactttgcctctacagcatcctaactgcacaaacactcttcttcagacaagaaaatggaaaactattttaaaaaatcacatttcaatttcaattttactctctagttcaaggtagtggtattctaaaccctagaatttggattgctttaaatttattcatctgagatatatgaacatacacaggtactccagtcttcctaaaatgcacagagttcacagagtcggaagcgacttagcagcagcagcagcagcatcaagcatgataatgatacagaaaaaattcaccatgagaaaatgaaagatgatccctgactcttccatccccacatctgctgcacccaatggctcttgacctgggcttcattctggtgctctgagtttataccctcagattctgacctttttgaaaacccaccacatgtctttcacaagctgacctgtaatactctgaatataccaaatatcattggattgtacactttaaacaggtgaattgtatggcatgtgaattctctttcaatcaagtcgttacattaataaagggaccataaaagaattgaaagcacaatcttagatatgtgcacacccattttaatagcagcattattcaaaatagccaaaaggtgaaagcagctcaagtgtccagagaccaatgaatagaagagcaaaatgcgatatctatacttatctgtgtctatatctataatctgtatctataagtgtgttatatgatatgtatacatacactgggatattatgcagcctttaaaaattaaaaaaacaatatttttggctgtgttgagtcttcgttactgtgcgtgggctttttctaattgcagagagcaggggctactctctcattgcagtttttgggcttctctttgcagtggcttcttttgtcacagatcacagactctagagcatcaggtcttcagtagtcatggtgcgtgggctcagtagttttggagcatggagttagttgccttgtggtatgtggaatcttactggagcagggattgaacctatatcctctgcattggcagacagactctcaaccactgaaccaccagggaagtcctatacagcctttaaaaagaaggaaaatctgacatgtgctacaacatggatgaaacttgagggtattatactaagtgaataaaccagtcacaaaaacacaaaactaaatcattccacttgtataagatacctagagtaaattcagagccagggggtagaaagatagtttccaggggctgtagcgggagaagtggaaaatggttgtctaatagatacaaagtattagttttgtaagatgagaagagttctatagattggatacacagcagtgtgaacatatggaacactaatgagcactactgaacacttaaaaatggttaagatgctatattttatattatgtgtgttttaccacactttttaaaaaggggagatggggctgtggttcatgcgtaccgtttaaggggagctgcagcctggttgcctgtgaaattccagtaaacaatgatagaagaactttcagaatctaatatagttttagaagaaagtaatggtcatgttctaccccttaatggtttcaaagttctcagagataggaattataagacagttactctagacttttctgacattgataggaaaggattcatatatttattaattcatttattcacaaacattgagtgtgtgcctactgtgttttaggcttggtgccgattgctggga

SEQ ID NO: 30019 - DNA, 1671 bp, Bovine  19866880830095
cttccataattattacttctaggttgcaactgacagaagaaaagcacactctcatagcattatttccacataccgttgaagagacacccccaagtttaattgtttccaccgtggtccctgaatcttcaacagctgtcttcttctctggaggcacagatgtgccaggctctccagctgctcttttacttccaattcctgacatcgtggcacaagaagatagctgttttcctggagacaaaaaaaatcttaggtaagataggcaaggagagcaactagagtccatctatgatgtaaaaactagcaacttttcctgtcaatcctttaacccgggtccattaattccacacttagcaacatgatcctcaagttcctcttggaaagagaaaagtaaattgtgaagtaagaggcgcagctgaatttacagaactacaaagttctaaatagaatgctactaaaatacaagataatgggcaaaagatgaagagacttagaaaattttcaggcatctcatttcctgaaatgccaacagctgaaaatatagtttgatttagaaacatagaaaatcaattaattctttagtgttgggagaatcagagagctggaagagacctgggagatgtctacttaattattaatactgaacaagccatatatcatctctgagcctcaatttcctaaagcagaaataacaacagtatatgcttcctatgctcctcataaggaatgaataagtacagaaagactttagcataaggccgtacacgaagcatgcactcagaaatgctaactttcctttttatatttgcagtttccttatttctaaacgctctccccaccaatttgtgtcaccctagagaagctagatctgggtgtgaatcccagtactaattcttagagagccttggaaaggaattcttgatatgcacaatgcaagtgaccacatactctctctgctctactcgcctcccagggtttcggagctcaaaagaagcggaatagatgctaaagcactttgctactgaaggtatcagccctgccatcaccgagacgacacacaactctgcttccaactgaagctccagaagggtattggtggcagcgaccagagtgggtcctcgcctggagagaaaggaggaggacaatagcctcaatccgactccagaggagccaaggacccagccttcggagaggccaattacaggcccgggagagggaggccttggagcggaagagggtggggattcccgttgcccgctgagtcccgtcccgcccttggccgagatctgacctgagttcttccaacttgcgccgcccgggagtggaactcggggcagttattcaccaaggtccgagtagccctcccacctctcacccctaacccacaagtgaagacccagcgaagcttccgggaggcggatccaaggggaggaagaagggaaagaaaagaggaagtcgcttcaatctggcagcgtgaaggacaagactcaaccgggcggaagtgacgcgaatcgagggcgccccgcttccggaagtaagctctgtctagcagctcttgggcgcccggcggccgctaaatcgaggcctcgctgacgtcagaggaaacgtcccagattttttcccgtttgttaaccattgctactgcgcgacttgtttgtttttttttttttttta

SEQ ID NO: 30020 - DNA, 1022 bp, Bovine  19866880861611
cctcccgctgccgaggccctcccgcgtgtgcagggggctgccaggagctgcccacctgcgtaaacgggccctgggcggccggcaggatgtggggcggctcacgacacatcaaaccagaacacgagacagcggagcatgcttgccacctgctaggcctctcggagtttttcaggaaaggacatgggcccagagcagccatagttcccgggcaggaagcctgcggtagctcccctccaggccttgggtgggagagggcggaggaccccctgccccagtggatggtgaccccaccttgggagctgtctggctttagaggtctgaacacatgtgcactaagaacttaaatggctttccccggctctcttccaaaagtgatagttgctcagttgagtctgactctttgtgaccccacggactgtagcccaccaggctcctctatccatgggattttccaggcaagaatactggagtgggttgccatttccttctccaggggatcttcctgacctagggattgaacccgggtctcccacattgtaggcagatctgtatcgtctgagccaccagggaatccagctttctctcatgaccatgtattaaaaagaagtgcaggaacaggagaagcacattgattctgcttccacgggcaaactcacagcatggatgacacacaattagctgtgggcatcctcccttcctcctccctgtcctgggccacattcatcaccgtctaggtttgtgtcacttgtgccagctggcacccttgccgtctgcgctgccttctccagccccagctagggaggcctggagggtggccataatgttggtgtcacatgagcagatggtgaggctgtgccggacccaaatgctggtggcagggttgatgataccagtgtgaaaagagcaattaaggctgtggggagataaggtgtcaggagctcccatcccagggattctcctcagctctcgcttcctgagaatgacaacccgatatatgaggatgcattaggtcctgatcattc

SEQ ID NO: 30021 - DNA, 2073 bp, Bovine  19866880891355
ccacattaagattgttttttaatcgaaatctcacatctacagagcttccctggtggctcagacggtaaagaatctgacccaagttcaacccctgggtcacgaagatcctctggagaagggattggctacccactgcagtattcttgcctggagaattccatggacagaggagcctggcaggctacagtccatggggtcgcaaagagtcagacatggctaagtgactaacactttcacactcattacatctaccatagacagagaagcttgattgtttcttgagttttcttccattttgttttgagccactttgctttcttcaaaatgtctgattattctccacacaggtgctctgggtagagttcagtattccattaatactgaacaattcacatacaaatgggtagtttaaccttagatatttccccaaggcctggagaggctgacacaaatataaacagaattggaagagctggtaaaatatttagctgaaactttaaagaaatttttctctctctggggcttcctggtgatggttgtaatgcagctgaactactttagctctgtatgttttatcctccctcctggatgcaggctttctgatatccctggatgtttgaattagacagcacatggacacaaagggcggactacgctagtctatccagttgcatcaatagcttcttagatcccttttctgattctattattctgtgactgcctaatagctcatccttttgttgttgttgttagaatctcacatatacagataaaaaagaacatactattttgaaagaattaagataagaattaaaggaaaacatttaatgtttaaaaggaagacaatatgaagtgggacacaagtgtctatttttaatggatctaacctaagagaattttgttttaataaggatgacttattacaccaatacttaccagggatctgctctgtataccaagcactatatttgcttcctgatgataatgatgatgagaataatagcagctaacgttataaccaacttagatagcatattcaaaagcagagacattactttgccaacaaatgtccgtctagtcaaggctatggtttttccagtggtcatgtatggatgtgagagttgggctgtgacgaaagctgagcgccgaagaattgatgcttttgaactgtggtgctggagaagactcttgagagtcccttggagctgcaaggagatccaaccagtccattctgaaggagatcagccctgggtgttctttggaaggaatgatgctgaagctgaaactccagtactttgtctacctcatgcgaagagttaactcattggaaaagaccctgatgctgggagggattaggggcaggaggaaaaggggacgacagaggatgagatggctggatggcatcaccgtctcgatggacgtgagtttgagtgaactctgggagatggtgatggacagggaggcctggcatgctgtaattcatggggttgcagagtcagacacgactgagcgactgaactgaactgaactgagtgtatgtttcatttctgctactgtatactttagctctgattgattcttttttgcattctctagttagagttttcacttgaagttcttactgtgtccttccactctcaagttcagagagcatctttatcaccattactgtgaattctttatcagatagattattatctttgtatcattaaagtgtgtccgtgaagtttgtcttgttctttcacttggaacatatttcttcagctcctcattttgcttggctctctgtgtttgtttctgtgtattaggcaaaactgctacctctcttgttctttatggaatatggtgtaagtgatgatccttcttatccagccctgactagctcttggttgtctctagtatttttgttgttgtctatactgcctgatttatttttgatatgctcctgttgttgagggtatgccaaggtccatcagtgttccaaggggaggaatctcatttagcacctagattcaggctgaatcttgttttgcaaggagccttgtcattctgtagcaagcccaaggaggtgta

SEQ ID NO: 30022 - DNA, 1370 bp, Bovine  19866880907494
gcagatgctttaccctctgagccccaggggaagcccttaagaactcagcacaaagtaccctatggcagaaaggcatcaaacaacctaagtagtaagattacatatgtcaaagaaacaatcaaggtactgatttcacttggaaatattaatacatttcacagaatttgtcatcccttacaatgcatgcttgaatgaccaatctaaagagaaatatttcatacaacccgggcttgttctttagtgacaagggtaggtacatagacccccagactggctggacaagattaattggctattttgcatcttgtgtttgaaaagtgtcagaactatctgtcttttcattcagttctgtccaaatagattaatttccatggacgacaaacaaattaaacagttaaattttgtgtatgtcattagcttgacaagttagccatttgggtttgcactcgagctggtgactctgccagtcagacaaatgtttgcaggccgcagacactggctacccagaaataaccctccttcggcccaggacagttactgaataagaatgatggaacagagcaagctgaatagaagtaggtgataagaaaccttgaggacattcctgagctgacaaatactggcttgttcatggtgtgaggttctagctgggctgtctggtgagctaatgagtagtaagcatctactttccatgtgccaggcaccttaaaaacactatgtaatctgcaaaaccacctagtgaagtcggtattactagtattattattattactaccctgtaacaaatgagaaaactgcaactgggagatgactagtaaggtattacagctattttgtcagacccgcaaacccatgcttcttccaaaacaccatgccgccatcctttagggctagaaaaaaagcacaccaaagttcagctccaaagtgtttgccttaggacgtgcaaaaatgagtttgaacaatcgtgtcctcaatttttcaggtcaaataacacgtagtttcagggaaaatgagtctttaaaatacttctttttttttttttttttggctaagcattcttttgtctattatcaatggaaaattgattcctaagttatctaaattccatctagcatatacagaattaatatttatctccagaaaaatctgaatattttcaagaaaaagttgaaggatttaatataaaataatgaggatactttgggaagattgttgaacacatcagatttcatagaaggaaatactagagaaacagtgtgaaaaatacaacagcttgaactgactccattttgattgggggggatttaataaaatttcctttatcaaatttcttaaaaaaattttaccctccattcttcaaatctcattcc

SEQ ID NO: 30023 - DNA, 1665 bp, Bovine  19866880936445
gacatgagtttgagtatactctgggagttggtgatggacacaaagagtcggacacgactgagtgactgaactgaactgatactgctaactattagtactctaggggtaactctaggttaactatcaatactctagggctatgtacctggctctgttttgaatactttacaaatactagcccatttaatcctcacaataaccgcatcaggtgattatctgttacaagatcccatcttacaaacagggaaactgaggcatggagaggctaagctacttacccatggtcacagtcatgtaaccagtaagtgacttagcctagttctagactggagtctgtgtgactgtgctcagaacctcttaccctatatgaagacagatacctaccttgagaaagctaaagagaggaaaatatcaaagtaccaaatgaatcatttgaggcacaattttattattgttatttcacataaagtgaaagttgctcagttgtgtccgactctgtgacaccatggactatacagtccatggaattctccaggccacaatactggagtgggtagcctttcccttcttcaggggatcttcccaacccagggattgaacccaggtctcccacattgcaggcagattctttaccagctgagccatgagggaagcccaagaatactggagtgggtttgtcttaaataaagtactgcatatgcatagcacatttttcttttttaagagaaaattttctaccttcccaggcttaattctcatttatctccttgaaaagacttccttttccccacctcctgatacagccatcatccagaatacattgttgtttatgagataatttttcaatgaatgaatcaatcaaccaattagtcaacaagtgacttaatcgccatagagttaatttggcctggaattgaacagagcttggtgtgaattattattctaacaatctaagatgttctcagagcattagcacagagcttcctttgatagctcagctggtaaagcggaggactgtagtactttcagagcattagcacaagttttgtagactagtgcagtgaatctctagtatgaataaaatggagaaatcatactgggaaaaataaaagagctagtcttaatgatgtgccagtgaggtaccggatacaagactgtttgcatcatttaacactctatttaatttctcacaaaaacccatatagtagatgagaaaatggaggatcaagaaataaagtaatttattcaaagttataccagctattaagaataagcagaaaactggaaatgtgacccaaatctttctaactctaaagctcttttcactaccatccaaaatttcagttaagtaaaggagcaaagggacttccccagtgtctcagacagtaaagaatgtgcccacaatgcaggagaccagggttcgatccctgggtgaggaagatcccctggagaaaggaatggcaacccattccagtattcttgcctgaagaatcccatagacaaagaagcctggcgggctgcacagtccataatgttacaaagagtcggacacgactggagtgacttagcatacatgcaaaggagcaaacagtggagttggcgagggaaggggaagagagaaagaagtaagaataagatgagacttagccaagacagcagctttat

SEQ ID NO: 30024 - DNA, 1931 bp, Bovine  19866881040477
caatggatttgctcaacagatgattgttaggaagtgaatgagggagtttatgaggaagcacagagagatgaaatagcaggcccaaactggatgtttctctttgtttagccaaaccaaaggggacaactataaaggaagatgacagtggccagagagctctatcattgtaaatgtgaacagtaccaaattacaatttacgactaattagaatttgcatgagtctttcacaaaaccactccaaaggattcattagaaattttctttctttttttttttctgactgtggcaaaatgacttaatggaattacctttacaaatgtattaatttattctaccctgaggatattatattcactgatttggcaaaactaatctggcctaataacagacacacatttactgagactaagcaaattttccagtagagagatactcagccatttggaacaaatgaaagttgaggtataaagatgaaagaatgactgtaatttccaaaatatgtactagcaagtgttactgactaaaatgcaaagctaaaatttgtgctgacaaaaaaaaaaatctacctaccaccaccaccacctagaaattctcaaccacagacagatgctcaagttcaagagatattctccatacatgtgtctcctaaggatgtactaagctgctaagtcgcttcagttgtgtccgactctgtgcgaccccatagatggcagcccaccaggctcccccatccctgggattctccaggcaagaacactggagtggattgccatttccttctccaatgcatgaaagtgaaaagtgaaagtgaagtcactcgtgtctgaccctcagcgaccccatggactgcagcccaccaggcccctccgtccatgggattttccaggcaaaagtactggagtgggttaccattgccttctccaaaggatgtactggccaactcaatatacgtgataaacacaccttctcggaggctttggttctctctggtagagtcaggaagtgactgccattcacttccattctgccagtgaaatactcactgtatactgtctctttgaaaatcctaaatctatttcagagaccagggatgaaatcttgcagccaacagggaccagtataagtgagtgaaatagaacataaggcaataggtagtaaagagacttgcttaaccaaagactgttctattctgtttagaggggaaattctttcccagcctcaggagattgctgcattatgggatgtgatcccagtgttcccagatttcccaattttccaaaagggatcagaacttggaattccatgtaaagtttcctagctgttacaatagtgtgtgactagtctgaatggccagcatcaagaagtctgcaaacaataaatggtggagagggtgtggagaaaagggaaccctcatgtattgttggtgggagtgtaagttgatacagctactatggaagacagtatggagcttccttgaaaaactaaaagtagaactaccatatgacccagcaataccactcctgggcgtatacccagagaaaaccataattcagaaagatacatgcaacccagtgtacatatcagcactatttacaatagccagggcatggaagcaatctaaatgtccatcaacagatgaatgaataaagatgtggtacacaaatacaatggaatattattcagtcataaaaaggaatgaagttgtgtcatttgcagagatgtggatagatctagagactgtcatacagagtgaagtaagttagaaagagaaaaatgttgtatattaacatacatgtggaatctagaaaaatggtacagatgaacctattttcaaagcagaaacagaatcacagatgtaaagaacaaacatatggataccagggggaaagtgcagggtgggagaatgggagatgggattacatacatatata

SEQ ID NO: 30025 - DNA, 3688 bp, Bovine  19866881048613
tgatctctgacgacctagagcggtgagatgggatacagggaggcttaagagggcggggatatatgtatacttacagctgattcatgttgtacagcagaagttaacataatattgtaaagcaattatgttgttgtagtttagttgctaagttgtgtctgactctttgagacctgatatactgcagcatgccaattatactccaatttaaaaaacaaaagatctttctccatctctaccaagaaaataatttcctatctaattattccaacctttggaatatttctgtatctcctcctaatgaatgtttcctctcatgatcaagggtcaattttcctgcttcttttgtgcctatatatatatatattttttgtatcctggatattttgtataaaataaaagcaatagctaaaataagtaatatttgcctcaagaaaagagcattctcctgtcaaaatgttagaattaggggctggatcaatctgatgtgtagttgagctgggtatgggctttgttggggctttatctgattcagcacacactggcttctaatatttgggggattaggcccttctcattagaaaagcctagggtttcaacatcagtgagcttctggagatttttttttgtatgttattgtcatgttgctagcttttctaactgtggaatatatatctctgatttacaatccttgtggaaggagggtaactaaggaaatgtcttttctctgtcattctgctcctggctttctaatccaggggatatctctctattttgctgctctgcctccatcttttggaaggcagctgccttgctttatataaaggcctgcaaagtcccagggggatttctctcagccaagtccatgctctgactctgatgtattgtccctgagcacattgtcaagtcctatagaaagggttggcagttggagcgagacttactctgtcgctggagtttctcagaattctaatctatcaagccagcccatgcacatacattaaaagtacattaaattttctgtggatttctctatttttcccctatgggttttttttgttgttgttgctttgccatgactgaaagtcattgtgtaggagtaaaaatatcttctaagaggagcttgtcacttgctagagtttaattcatttagattctttgcattcttggcaatctaatgagtttaaagaaacaaaagaaaacaaaaagcacttctgtccacctgaagggcttgtcagtttctagttttgcttcagttcagttcagtcgctcagtcatgtccgactctttgtaaatcctaactatgaagtaattttttttctagggagcaatatatatcagtctccttgttctccctctgcactttattctcattcttttgaaaagatcctttttcatgttcgtttgaggtaaagttttcgatgccaaagcattctgtttgcaggactcagagaggggattagcagtgaagtcatctgttccttacagaaagatgttcatcagttctccctgttttcatccccacctctcacccctcctattctccattgcccttgacttttcagggctctaggtggaagaattgtgatgtcttccttagatgtgttaatatcattcatgcatattttgactgctgcttcctcaaccttggttcattatttttatgaaacttaccaccttgctttatagtttctagagatttgttgaacactcctagggatcttgaattagaagattacatcaggatatatgctaactaacagaagagttagggctgaatcccaagcagcctgattccgggttcagtttatttttcattaacactatcactgccttgtttcattctcccatatttctttctgttttgaggtttcctgaaggcattactgaagaatcatccaagatgccacactgtaacagtggttcagctgacagctacccaagcaagtgctcttattgatgagccagaacatagccaagatacaggcctgactccatttcagatatagcttctttgagaatcactggaagatgaaaaggggaacttgtttcattctcaagccaactatagggccaatgaagttggtgagcaagcaccttttctttggaggttattatgtaggggtctactccatgggtctcctttggtccctgaaacctgagaagatattaattagactgttgaaaagagatgtgatgaatagccctttgcaggtccaatttaaactttatgattcagacataatggtaacccatgttgccatcagtactccaaatgtcagtctgattttgtagaggtggtatgtagcacctggtatcaccggatcctaggtcaaagaaggctgccttcagggagcctgctttctccctctaggtgaatagaattaccatggttattgtcatcttttttcctccctcttttgaatcccttctcctcctagaagtttgtcttaaaaatggatatatagagagtattcctttcctgatttagaatcagagttaactttcggaacagaacaagaatgtggtgatagctttagtccaactcaggctttatctcagcaattctggagcctaagggtatggcagtagtttattagagtgcctgcattttgaaatttccatagctttggatttatgtgaaattcattcacagtgaaacctggctatctgaagaccctcatcctgttatggaactgtgtcccaggtttttttgggagttctgtcatgtctgaattttaatttaggcataggtcattacttgactgccacagtaaactgatgatataatgaattgaaatattgtaaaaaacacagaggatgcaaaggaactatataccctttagttgcataaatattgcatatttataggatattccataaaccagcagctaatataacatgcttcctaatggctatagaatttatcataatttctcatagtaatctcaacatattaataagtggttcaaaacatctgttgctacatttttcagagtttattatggggctggatgaagcaaagttaatttcctagaaatagccctcagtaggtccaggtttaacgtgtgtgtaaggtagctttgatctggaatcaggatgtatttcctctattattttttttttctaatagtcaccttctagaactgagacaaggagaccctaagtgttagaggtagtttctgacaacatggagttttaggtggcacagaagggaaaaaagctttcctttgcaaattcaccatgatccatgcacttcttttgggtaaatttgaaattttttatactcagtatttagcataactttattgtgtatagggatcaagaagtaagtgacacaaacttccttgcctctaatattcagttaagaatctgaatatttgtgcagggctttcaccttgggattatgtgctggtttaggttgtgctaagaggtataaaccctcttagacttgtgtgtgctgggtctcctgatttgggtgcttattttgttggggtacaaaaaagggttgtgttgtgtagggccaaaagagtcaagtctcaaagaagttctcaacaacatttttccagaaaaagatgctcagcattcttaagtactgtcaattagaagatgcaaaaacattcctattcacgtattcaaatagtatttttaaaccaagatatattcaatatcactttatttcttcttttct

SEQ ID NO: 30026 - DNA, 1622 bp, Bovine  19866881053299
tacctaggggttgaatgaagatgaaaatctgaatgagcattaacggcaggtgggaattatgcagctttcttatgcttcaaatagaactgaatcagagaaagccataggtatgcacaggtatgttttaatgtatccttcctttgtgttattccttaagaattttaagatataaagctaaaagtattttaaggatagaggatccagaaaaatgggatataagaagtttctagaaactataataattcataagtaattatatctgacacctagcatttatgtcatggtagatgtgcaaaaattgcatttatttttattggtgtttaataatctgtctattcatgaccgaacatggggcttgtgaatgtgttagtgtgaagaaaggcggctctttatctcatctactatgcattccaaatctaaatatttcctttccccccaattcctttcatgattacgtgcctttgcctgtgccaataaaaggggagagagcaaaacagacaagtatttgttgtatcagagtagtttctaacacagaaagaactgtttcatttcactcattacagctaactgagagctgtaagcattagtgatgctagtttaccatgatgtcaattcagctgtctccccaattcccaggacttggaaatgctgaatctgcagctgctgtgacagttttttcaccctctctcaccaaaaaaaaaaaaaaaaaatttaaggcctccagcatcttcatcttagaaaaatcaaatatgtacatgctgtacttttatttcattaagtttcatttgaaacagatgacatttctatgtggatttttccaagaaaaatagtttctctatctgctttgatttgtgatcattttaaaatgctcagcgttaccgagagcacttagtctctgagtcaagttcttatgctgatagaacaccaatgccccctactgataaatttcccaaaacctttctatggacaatgagaacagaacccccttacttaaaacaagcatactattcaccagccttgtctgaaaaggacaagtacttcttggatcacctgtgtctgctttattagcctcttattagtgtaatttcctctattagtctttactaaagcagctagaagttatttcatgcttggctggctgtattagaaaaaacaattttaaaggtatcagcagagctttatacctgataaaatgtgaaccagaactaacatttgattatagtaatgtaattcatgttacattatatttatatttaatgggaaaagtccttctgaataccttatttgtctccctgtgtcttcagtatttatagaattcaggcataaacagactttaatacctaatgctccagatttacatgaatcccttctaatgtcatctccatcgagtaattggttggttttccctagtgacagagaacacactacctatcaaagcaacctgttgcatctttgaaaaattctggcagaaagttcatggaaaaacttttcagctttcaaaatattgggcaacttcttcccttcctttgctgtaacagctctaattcttcttcaatatttgaagagaaagatgatgccccttcttctggcattcttctctccctcaggaagagtgatgtcag

SEQ ID NO: 30027 - DNA, 1151 bp, Bovine  19866881082530
ggaaggaggatgaaggaattcccacacattgcttggccaaagcttcccaaccagcccttaggctcaatcagggtgatgcccgcaaaccacagacaagccagcctgtccctgctgcccctcccctagctgctcactgcatggactagccggatggctctgcttctgagaagcccctcacagcttccttcccattactcccattggtcaattgagtctgccttgatttaattcgctggggacatccaaatcagcctccattctctatccccatagaagctaagtgatcattaaaatataaattttacagacaggagtgctttcagagctcatttcagtccacctcattttgcaagtggagaaactgaggactttcttgctttcttacaaatgtatgtggctaatttagaaagttatatgtgaaaaaatcaccttctaattacatattctcatggaagcctcatcttatttcttaaacataatggaaatgaggtccaaaaatataatatgacttgcccaggtcccacaacagggaatatggatgcttaaaccctagtcttggtaatgtagatctgctttttcacaaggagtgtaccatgtgcccccaaaagtggaaggtttgataatacctccttaccatctcaacactacataatgattctaaccgtagaatacttcacatgtaacagctgagatataagtaacaactgttagttaaaaacagatattttaactggcattgccacctttatgtttaagacttaccttctcagtaacatactggcagtgttccatgtcatggctgccatcaggaattacctctggctcaacaatgggtaccagaccattctaaagagaaaaatagaggggacagaatgaagctctgttcactgggatctttttcttaacatttagcattccaactggtacaggatgaagcccttatggagaaatatcatataaatgacttaaaatcaatgaacataaatttaacaggatatctagtgagcatctgtggtttagccaaaaaaagaacagtgagggaaaaaaaagttttccttgaaatggggtacagtaaatgcacactctatttctgtatatcattccagagactattctactacctcagaacctatatgttatcctttagggca

SEQ ID NO: 30028 - DNA, 1048 bp, Bovine  19866881083635
cattgtctggttacagctttgattatcaccctggcagagtgcgtgctgctggcatcccatgggtaaaggttagaggtgtcccgggcaaggggaagccaggcagggattgaagtgaggtcagaaggaaactcaggagttgaagtggctttgtcttggaaaggaaggaggattacactctctccttacctatcagaatgctcctaaatacccggaacatttggtgggcttcacgacagggtaaaccacaggaacagctgaccagtgagactgtgatcagcttggctcgactgcaaaggaccgtggggtgcagagtggcaaagcagaaaggggcaactctcatgcttctaggccattgttttgctttgtttttcttttggtggagcacaatggactgtcaattctgttagggaaatgtatgtttttgcaatataatttaatggttgctctcaaatttctatagctttcatttgagtagttgatgaaacagactacctgctggttacatgtggcagggttatttttctgcctgggggtaattttattcttaggggaaaaagatgctatttctgtaaatctaaaatgttacatgcatcagagaactcaaggaaaaagcttttattctcttgagacaggcatagatagctccagtttcttcttcttgtttaaagccaccccataaagtgctatcacaaacacactccaaggatgaattgtttagtgctataaagtttatttgtgtgcaaatacacacacatattgcatttacactccacatgtagttatgctgtactctctaagagcactttagaagactcaacatagattttattccatggaaaataataaacgcagacaaataagaaagccacatgttaaaatgtaaataaatgatggatgtaaaaattttaaattttctactaaaagactgaaatctaaccatttggtcatggaatactgatttcctacttgttctgttttccctctttaaaccagatggtgtttctcaaaattcaggttataaaggcatagcacagactgcatttttttc

SEQ ID NO: 30029 - DNA, 1354 bp, Bovine  19866881119406
tggatttgaatctaagagatttttgtctacataattttgaggaaaatttctttgaattattttgtgtttattcaaactgaaaaaacataagctaaataatctgcctagaatcaaggagcaaatttttgatgggttgttagataacagaatcagatacaaaaatctagtaatctttctaaaattaaatgatagaaacttgcatttaaacttttaaagggactgtgagatcatgctaattggcattttaacaatctattgcttatcaattatttagcaagcctctgaggagcagggctatggtatcatagagtgactttcagacatttccccataaagttgaaccgtttaaagtgatcctatatgacaatgatgcctaaagagttaagattataaatatatatactttaaaaaacatgccattgaagggccagagaagacattcaggaaaaatgctgcagtgcgagaattttgtttactactaatatcattacttataagtgaattagtttttaatttcattataaaattcccttattaagtatcagcaggttctaaatgctggtttattcatttacctagtttgtttttatacaaactaatctgacttttcttaatgactgtgtgacattgctataaactggatcacttaatcagtggatggcgtaaaatggaaaatcatgcttcatgctgcatttcattttgcaattacataattctgcaggctctttttgggcaaataagaaaggcaaaaggataaggcttatcaaatatgtattatgaaaaagaaaaaagtccttcagtttcctttgtatagagtgctgtttgaattactctttagataagctgtagcgagccctttgcttgcaccatcaaggtaacagtatattttactgtattatctttggcttaagtgttattttgaatcctcctctgttatagaataggagcatagagtagactgtcagtatgaatttttgtgtttatttacatatgcactcacatggaaatatatttgtgatatcagcatcactgctttatcacaatgtcatatcttggtacatttgactctttttatgatgtagcattagggaaaagaatggagtcaaaagatctgtgtccttatccccaatctgccatccactggccatgaccgggtacatcaacatgctcttcatttcagatcccagagaggggatttgatcagtgtccatatgtataatgaacaaagtcaaggaaataaaaaaagaacaaaccaaactatctgttgacaaacatgccgtctggacagactgcttctcattttatgatgaaaacaaccagcaccaccacctcagcagcatctgccatgacaaca

SEQ ID NO: 30030 - DNA, 1352 bp, Bovine  19866881127749
tgggttcgataccctgggtaaggaagatcccctcgagaaggaaatggcaacccactccagtattcttgcctggaaaatcccatggacagagaagcctggtgggctacagtccatggggttgcaaagagttggacacaactaagcaacttcactttagaggatcaaactttttgaggggaaacctagtactacaatttgtctgaagacattgttggaaaatgatgcatatctatgtcaaagtctcaggtgagaaatttcttttaggaaaatattggaaaggcctcaccttttcctttcccttgataagctggtagctctttctatgaaaataattagaacaacacaactgacaggttgcctttttcctttggttgtcactcattcagtgtttctgattctagttcatattttcccagatcctatttttattttttatgtctctgttacctataaacaggttcaaatcctttgtcaatgaggtatataaaaaaggagagaaagaaagaaggaagggtgtgagggaggagaataccccaattttgctcataaaagggcacagtatgaaatagctgaccaaatgtatattttattctctttgctacaaacaatattcaatatttaccactccactggaaagccactgaagcagatcatgaaattttattttccctgaaaaagaacaaataatgggaactctaaaaagagctggtggttggtcttacaatggcagagagggattggaaatttgaaaaagaaacaatactgtaacatatttcttgtttatgtagatatgggaattgaaaagccgcattgatccttccaggcaacacttaatcatgcattaccccttggagcctaacaaacacctgtgaaataagtcatctgggaatgatctcagctgaagaactgaagctcaatttactcaaaaccacaaaactaagatttccttcagtgctgtaatggataagacaggaggctatagtgttaagacctagcttcaatttccagttctactattaattatttacaacacttgggcatgccacttaacctgtcctcatatgtaaaatgagaataatgagtacactctgcacaccttatttttccctcctccaaatgttccgtgtattttgcagtaatctccagaagtcttctgggccagtgcaagccttgtctgagcctcttccttggaaccaaagtctccaactcagagtcttctctcccactgcaggaaacaccatttggtccctttgcctgttgccaatgttccagctgacagtcaccccagcaagtgccctggcagatgagcctgtgcacatccaagcgacgggcctgcccccactgcagatggt

SEQ ID NO: 30031 - DNA, 1732 bp, Bovine  19866881142831
atagttatattaatgccaaacatgtattgcacatactgtatacaagtcactattttaagcacttaacatatatcagctgaactaattgtactactaatattactaagttcaaccatattaattatattatttccagggaaaataatcctcacatttttgatgtgaaggagagcaaagggaacatctcaatgtgagtaaagtcaggactggagatgtgtacatccgtgtatgcataaaagcagaggagagtgaactgagcagacgggtctcaatgtgggtgtcttaaacagaggctattggggcaggaagttaaaccattattaaaggttttgacagacctgagtttgtggtcaaattttccataacttttttctcaaagcttgctagccaggcctggtggcgtggggaagggcagaatttgaggaccgctcttacgttcagacatttgctatggatgagattcatcaacaaaaagtaggggaaatgctctcgcctctcagggtgcctgtggctttgaacaaatggaaacctggcctccctgtctccatgatcccttccccaaacaccgagagacaagtgttctcatgagttactaattaggtggaaccactctaatgatttcattgctgttgcagcttccaccgagagagcatttgatgcatgtaaagcaatcagaactataatccagtgctagcaaatgaaaatagacaagaacattattcctagtgagtgtatcaactttgcttactaccaacaagggtgatgggataggaataaagagtctgtctgccaaaagcccgcttagaattcccatctgttataatgggcaaacgtttcataaagtaaaacagtggtttcctcccagaatagctttgggaggtgaagacagaggaggaaattaactactggaaagagttcccctgatggcacttaagctgatcctggcttccctggtggctgttgttattttccatgtggatgctcttcaggaggaaaagcaagaagacaaactagcatctttgttttataaaaaagctgcagagctgcaaaatctcatatttaatatcaacagcagcctcaagtcactggcacctgcaaagtgctgggtgtaatcacctttttaaatccttcaatagtccaacgtgttagatacagtgactttcattttagagatgaagaaaatgaggctgcaagaggtaaagcatctttttttttcatattaatctttttcaaaatttattggcgtatagttgatttacgatattgtgttagtttctcctgtatatatagcatggtgaatccgctatacatatatccactcttttgtttagattcttttcccataggagtctttacagggtattgagtagagttccctgtgctatacaataggtccttattagttctctgttttatatatggtagtgaatatatgtcaaccccaatctcccagtttatccctcccttccctttcctccttggtaaccataaatttgttttctacctactgtgcttctgtgcctactgtgctcaaggtcaagtaacagagctgggatatgaacccacacctgttatttctagagctcacgatcaaaaccaccgtattacaggcttgtgtctaggatggccatgtctgtgtcttgcccaggccgtgtcagtgatgccctgtctgaagaggccggccaatcgaatgataggtttctgactggaagagattttcagacaccacaga

SEQ ID NO: 30032 - DNA, 771 bp, Bovine  19866881181910
aatgttagtagttgaataagacccttctttgtcctcattgttcctggtaacctttctgtgtcttttcctgacaagcatcttgaatgggtaccttttctttactgaacctgtgttgttgagggtcattgatatgcccttcaatgccagtatctccaaagccttttcccacctttatttttaacctctttgtagggtgctgttattgaccctttgaaacttcattctgtttgctcctagaatccttagttcatcttaatatatatcatcactgcttttcttggtggcttctcctcttcatcttctcaaaatgaaagatatcccatgttcattccttggccctcttcattgtccctctaaagtgtctctttggaaactgccttcaatccactaacatcaattatactccctgtgtggagagttcaaaactctctccagccttgtctttcctactaagctctaatgccacaatttcaaatacctggtagacactatctggagtccatcatggcctgaagaaagcaatgagagccaggtcccaagtatccactcgattaagcacataagaagaagtgtcttaccagggcccgcttcataaaggcctcctgggttgccttcttgttttcagccttgccaccccacgcagccagtgcactggcctgcagggcccgtccataagagaaacttagtttccagggctttggtagagggcaaaggttgatagcattgaggttgagagtagcatcctcttcactcacgccaccagacaaaaag

SEQ ID NO: 30033 - DNA, 1207 bp, Bovine  19866881184361
tgaaatatgttaaaaacatgccattgcgatctcaaaacccgtgcatctgaacacgtcctatgttttcctgtgataagctaagagaaataatggatattgctcctaaggcatttacagtctatttagcctattctattagatcctactggacacaatttgaaaatggatttaacagttttattttaaaaagtcaatatttccaaaatgctggaaattatatttcttgcaactaactgcttacaacaaaacatttaaacaacaacaacaaggctgttgcttccactctgagcaacagtggagggttatatggaaggaaagggcattatgggacagcttaatttaaggggcaagtgcattaatgggatagagggagttccatcttgtatactaagagtgtctacaccacctggttctcttgataacctgtcacttgtcactctgacttgaggccctggattttcccattattgggaattctgacgcttaagaatactggagggagatgcctggtggcactcacctgactggtgtggagccagtattgcagcctagatttgttcttgatgcgtggcagcagcagcctgtacaccatgtgctcaccaatggtggtcaggatggacaggccaaatccaatgcacagcagcatgaagagtccagagaagtgtttgatgcccatctgcaacgtctgtggcagaacaggaaaggaaaggtcacgaatgggaggctgcacctggtcccgtgcttgtccactcttggacgcacatcgttttctgctggacccaaggaaagctggagaccgttcctctgtgtgctctgcaggtgtcactatactacactgcaaaggggatccagccaggactgagggctgctgcacggcacaattcctgcgggtgctactcacatacagtgctactgtttgaatggttcctggagtggtgaagaggccctgtgtctagaccacgctatggtgtcaaaagggacactgagagatagaggtagagactgaaaattgaaacaatttagtatattaaaacatcaaaaagttatcaaggaaagaatctctcccagggacagagagtgagttagatttaaggggaaaagatgatgagcgcaataaaaattttcatttagatctgacagaaacatggataggatatcatctagttcaatgttctcattttaaagatgaggaactgggaccagaaaa

SEQ ID NO: 30034 - DNA, 879 bp, Bovine  19866881310120
tggattgcatgaacattagaaaatagaaaaatgaggctgaaaataatgttacccagtgtttctgtattgtgaattacggagtaaattttatatcacagtatttttccatgttattcccattttctttttaaaaatttatttatttttattgaaggataattgctttacagaattttgctgttttctgtcaaacctcaacatgaatcagccatgggtatatatatatgccctcacttttgaaactccctcctatctccctccccatcccacctctctagattgaaacagagcccttgcttgagtttcctgagccatagagcaaattcctgttggctatctattttacttatggtagtgtaagtctccatgttactctctccatacatctcaccctctcttcccctctccgcatgtccataagtccatattctctatgtctgtttctccattgttgccctgtaaataaattcttcagtaccatttttctagattctgtatatatgcattagaatatggtatttatctttctctttctgactcacttcactctgtataataggttctaggttcatctgcctcattagaaccgactcaaatgcattcctttttatggctgagtaatattacagaatattacagaagcaaggttctcctttatttgcacttaaatttctttattgaagtatagttgatgtataatattatataaattatatgtgtaaaatatagtgattcacgatttttactgccttttttctttttcagtctgtaatctctagtcaacaacattctttgacattacctttgatttacttggagctgtggcccaggttcgtctgacaacctgagtcattgcatcaaatcccttgtacagactag

SEQ ID NO: 30035 - DNA, 1339 bp, Bovine  19866881310414
ttatcttcttaaactcagtatagattaattaacaccatgaatttttaggttctgagaaaacttttgttttttatttacattctgggtatattcattcatcacacactttcaaagaatttactgctactatctagacactagagaaagttcctagacttgttttccagtttgcatcaagcggatttctgcatataaattgcaaattcctcaattcacgttcctactttgtttgtgagaattacttgagatagcagaattagaactacattcaggttaaattccagtggcagcacacaagttcaatctgttgaatgtgtatttgacatagttccacttgcttaatcttgctgatcctcatttttctcaactgcaaactttgtgaatcattgcatgtcttttttattgtgcatgaaaaatttctgaaatttgcaaaaaaacggagagagggaatgcctctttaacttagctgactgctactttctgatgcttggctcacaaagcagaaatgctgctttaggtgtgctgctcttgtgattcatttaacaagagcaaatgtgctgaacagaagagaaagataagcaaataccagctcagaccaaactggaagatggtctcaaatggaaaagctggcagcaaggtacaggcaggctgccctggaggaggtgggtagaggaggcatcttcttctctcagatgcattcattcggactagatgcttgaattctttgagggcccctccagtataatgactcaaccactgattccctgagttctctagagcaaagacagattgactattcaaccatagcaaacaaaattatcagaaaacagctcaagtatcaagggctagcctaagggaaaagtaaaacaagaggaaagtatctctcttctttctgttatcctgtagtttgcctgtctttttgcttgtgatgctttactttagcggatctctaagaggttggtttcctgggctcagtgctatggaattactgacctttaggctaaacctcctactgtacttttgcatccagcccaccctgaattaaggcaaaattgggcttactttaatatttaattctactaaataaaaactggcattaaaacaagtccctgtgccttaaggatttgggtagagctgtgccaaaaagcttacatcactagactgcaggtaaatttatagctattttcattcatttgcatttaatcaacccaggcttgctgagtttaggttcggcaaggaccttattggctgttacagtttgcagggtacaggactgctggtgacgtgcaatgactcaagtgagaagtttgagttccacagtctgcaggtcatttttcac

SEQ ID NO: 30036 - DNA, 1554 bp, Bovine  19866881319903
acatgttctgctatggaaaaggcaggaaaatgcttggtcaaagtctctgtctttcttgagttttggaagaagagacaaaagaggtaacatacaggctgtggcatctctgtactcttaattatggcctagtgtcagaatgaaaggccatagtttgacatcagacacacctgtgttagaatattggtccacccaccttctagcattgtccttggacacggatttactgaactctaagcttcagttttgtcatcagcaaaataggggaaataattacatttttatttgtaaattacttccactgtaagggttagaaatagttcatgtgaagtatatactatacctttagacatagaacaaatgttccagatatggtaactattatttaatgtctttaaaattttttcaatcaaggccatccccagtcacttttcctagtctttgagtagaagttttgcagttggagacccaaagtattgcattatgataaattcatagagggtactcaagacacatttcaaattaaaagaaagtaaattgaaacgtggactgtaacatagaagatttttgtgaagagttggatgatacaagtctaggtccttagcaatatacattaatccattgatcaccacaaattactttgtaatttacaaatgcaaataccagtagtaggaagttacactgccacagaagaaacagagaaatcagaaagtgtgaagaatgtactaattttcattaaagatataaatgtaaatcacatttgaagatccttccatcactaaatgcaatataactgctcattttggtagattgtgtataatagtaattattcacattagcactcccttgtgggactctaccacttaaaaagacttcgattttgcaacaagtaaaagtctccattatcttagattttaaaacagttttctgcttctttagggaagtagagaaccaaatcattaaaatatacagattaatcaatcaataattacctaggtagtagaacagaagaatgactataattgtgtttctgatgagcaatctactattagatttgtttacacacacacacacacacacacacatggttatagcctagggaataaaatagttattagtaaataggttaattttacttggtcaatttagtgatcagaaaagcaaagttgtagaaaaagaaacttcattattttaagaatatatggggcttaatgattatagacttttaattggatggacctcccaagggctgctgccgctgctgctgtcgcttcagtcgtgtccgactctgtgtgaccccagagatggcagcccaccaggctcccccgtccctgggatcctctaggcaagaacactggagtgggttgccatttccttctccaatgcatgaaagtgaaaagtggaaggtgaagtcactcagtcatgtctgactcttagcaacctcatggactgcagcccaccaggctcctttgtccatgggattttccaggcaagagtactgggagtggggtgccattgccttctctgtaccaagggctaccactgagtaaatatata

SEQ ID NO: 30037 - DNA, 1371 bp, Bovine  19866881359574
tgagtttgagtagctccgggagttggggatagacagggaagcctggtgtgtggcagtccatggggtcacaaagagtcggacaccactgagagactgaattgaactgaactgtagaaaatatgaagtagaaataaaacaaatattttctgtaattacactgctcagataccagtgctgttaacactgtgctatattttcttctagttactcctctttatagcctgtacaaatgcatattataaaattggaactatattgctatgtttcccaacttcttacttaacactatgttttgatttttttgacactttaaaagctctttaaaattatctctactggatgcatttttataatacatagtaacattgtaatgcattaattgtgctgttgctggacatttatgtgatttccaggtttctgatgttttgagaaaggctgcagtggatctttgcaataaattgatgtttatatatgaagttattttctttggacagattcctaggagtgaagtcaaggatgaaagggcatgaacccttttaaagctcttgatataaatggccaatttgatttatgaacatattgtaacaacttacaatagcagtgtatgctggtgttagtcttaatgtgcttccatcaagattgagaactatcaataaaacactcctattttgttaggtaagaatgtcatttcattactgtttcaattagactttctttgattacaagtaagagttaatatttaaaaaattattggtcaattttatttcttttctgaattgctgttaatatcctttatctataatttgattttagcattatttcatgtataccttgctctcttcctgaaaagacttgaggcagcttaaaggtcacataaaatacaagacaacataaattaaaatagtttgaagtagaaaaattacatcaagccagtaatgatgcttaaaatgcataccaccagacaataaatctgcttagtgcacaagaattttgcctccaagctctctagaactgagctcaaaaagagaatcttgccatttatccaattcacagtgacagtgagtgtgtgagagaggacactaattgttcaagatataattaatgatgatattaaaatctgacaatctaataaattctattttttgtgtgtgaccccttgttgtcatacactatgctagttgctttacttgggttattttaatttctatgactactcagtggggggcagttaccttattactgccatttacagcagtgcttggcatatgggaatagttaataagtattagcttggtctgttattattactaatattaagtatttcaatatttagaacaagtcacttgaatattttttaaataatatatataa

SEQ ID NO: 30038 - DNA, 1438 bp, Bovine  19866881379102
ataattttaaaataaaatttaaaaaataatggaaaatataatgaaaaaggccattatctgaatcattttgctgtacagcagaaattaacccaacattgtacaactacacttcaataaaataaatttaaaaactaaaaaaaaaaaaaagatttgtacagagtataaatgcttgttttaggttgggttcctccagaacagtctctaaatccaagacttgagggcaagtagtttgaaagtacctgctacaaatgggaaaggatgaagctaagacacagtacattgagggcaggtgcccagggtggagaactgggctcagtgcatgctggagacacctaggatatgcctcagaattatcccaaccaaggggcaaagaagctggtgtatttatcatttggtagctgcatggtggttcaaggtttccttcaaggggcattgattcctgggcactccagccagccctgcacacagccagcacactcccacatctcaggaagccctctttgtgagaaaatagcgagtgctaagggactgtgagcagggcaccagctgcctctgctgtaatgctcaataaactcttcttgtacagaattgaatggaattttcccagagctataagaaatgtcaaatgactccaagacctgaaatcactgatttttacttacctcctgcagatgtgtgttttcagcagtatcaactttgtcagggctgaacgagttgggggcattgccatctctaaaagcagcaggagggcagtgtttattctgactccatcacaccagtgggatgtcttacatacccaggctatgttacagatagagcaataaaagtacttttttatgctttttaaactaagcagtatgggatctcagtagagactccagggaagaaagactgtattgtcctttggaaagagtactgggccaggagttgggggatttaggtgtttatattctttctcacatgacctcacgtggccctacagaaatcacgttgaaccttatagactcgtttgctgacctgtaaaatggataggttgaacactaaggtttcttccagtttcaagtatgattgtcctatgaaataaggcaataggacttgtattatgtggattgagtaaagattggaagggaaaaaatacagacttacacatatgtacaaattatgcatattgatttctgtaacatgtgtgtctattcattctgtagtttttattccaaaaatgagagaacagattgttatgacattcagaatatatccttttctaataattttttcccctgaaagcaaatggtttcttctcctatttgtaagagagaatatatttcccatgtaggatcacaacaggaaagggaatttgagaatgagatcttttcttatgactgacatgattaagtagtctatagagatgaatgttggttgaaaattcatgtgaaaataa

SEQ ID NO: 30039 - DNA, 940 bp, Bovine  19866881728324
ctttccaagtaaaaatcagaccaagtcaattccacaacaaaaatcccttgaattttgtatgtactttgtggaatctccatgtccttctgcaattaagctgatgtagcagagcagccacatccctgctgtcagcgaaatgataacactctacccatcttacaagcttgtttaggtaaataaatgagattctctgtgtatattgaataaatgaatgagtgtatgaatcaataagtgaatcaatgaatacaaaagaagtacttatatctggctggggtaaaagacttggaagttgtagtgaaaagatgcagcttaaagggtcatgagggacttggctgtaaatgcccttgtgtatccgaccaagaagacagaatttcattctagaagaaaccagaaacatatgacagcttctgctacttcagataatctctagaaaaggaagtatcaaatcctatttacattatgtttcaatgcaaaaaataatcattagtttcaatgttctcatccatgttgaatcaaaatttcctgatgaaagttaatcctcctagtagcctgatttatattacttggctttcaccaagtcatcaacttcacaaggtaatttctggaatccatttttatgcattcatttctctggacataacctttgacctcttagaaaatagtcccaatagcactctgaagtgtgctgatgacatagacaattggaacagaatcgacaatggtttcagtttgctggagtccaggggtaatattcctacctgtcttcacctgtgctttgcagaaacccagtagccctcttttagacaggatttgttcttcacaaagacttgctgcttattatccagtgccctgtgatctccaagcatattgaaaattcatttcttccaatgcctttccctggtgccagccactgaaatccttgaccatcagtggatggaga

SEQ ID NO: 30040 - DNA, 1256 bp, Bovine  19866881910681
tgcttctgtgttgtgacccccccagtgctttatgagatgcaggcaacttccttgggccagtgctgctgaatggccaagtgtgtcttcattcgtgtctgtggtcactaaagggataacttggcttgcaaagtaggaaagtctgtgtttaagacaaaccccctcctcagttaatacactttctcaacttgaaagtcttggttgcagaaagatacatttttacaatacaagtaaaataataggaactgaggaacagtaaattatttatcacttaataaaaagaagggacaagtcataggtttattttaaataggaagatctctaatgacttgtttcccttcacagttaacttttaagaaaccatgttattttatttatatttgtatattatttgcactgttttcactgttcagtttaaatacaaagctgatcttgagatatatagaaacctaagctatctttaaagatttatgtatttgcttttggctgcgttgggtctttgtggctttgtgcaggctttctctagctgtgacaccaagggctactcttcactgcagtgtggggacttcccattgcggtggcttctcttgttgcagagcatgggccctagggtgtgtgggcttcagcagttgtgcacatgggctcagtagttgtggctcctgggcttagttgctctgtggcatgtgggatcttcttgagccagggtttgaacctatattccctgcattggcaggcagactcttaaccactggtccaccagcgaagcccctaagctgtctttaaagatgtgaaagtttgtgtttataaaggcttttctttctattcctattttatgattgtcataattataattaaacagatatgtgtcatggctaaaagtttcagaattatatccataacttgataaatttacatttaaacactgtagttatgcctctagtccctatgttgccatgtccttatgtatctgactgtcctcccagtccagttcttagaaaattcttaatattcaaaaggagctaatgagtgggaagcatcacatttgttctttaaaagatgttaaataagaaatgaatccattaaaaaatctgcaagaaaagctatctctcttggtggtttccctgttcgtaaagctccccaaatgtgcaggttttttttggtaatttaatttttgctgcagatgtccatccaatttatttgtgatttatcataaattttaatttgagtgaaagtgctgggcccagatttacaaagggata

SEQ ID NO: 30041 - DNA, 825 bp, Bovine  19866881925167
agtcggacatgactgagcgactgaactgaactgatatttattcaagaaaggaacatttgtggacctgttactgccaatgatatggcagtaacatatgatatggcaaaacagtcattaatttgctgggttatcttaggcaagctgcttcatctctctggaattcacttttcttgggggtgaaattagagagttaaggtaattaatgagatccaaatactagatacattttcaactctttccaagtaaaaggaaaaatgctatatcccaatgtcatacttgagttctataatagctaatcacctaaactgaaatatgagcattaacaaaccatcaagctaatgtcttgcattaattggtccacgaagacactggatgtcacgttcagttcctgatacgtcaatataccatctaatacttcacaactgaacaaagacttgaaccttagagccacagtttattggtatgggcaaggcctggaatcatactttgcttgcatgatctttccaagtttcatttctttgggacagaaattatacaggtgacctcaggatcatttcctttcatattttgagatttttatggtgtatgtgtttagaataccatcacatgataataggattttaatattcatggtctcattgtctgtctccataaatcagattcatatagattagcaccgtctgctacatacactgtctggagactcacgaaacatgagccagggcatggaaatctgtgtaaggaacaactttaagtcagaaggaggaaatagatcaatctacttttatttgtcaggcgaatacatgtaaagattagccaaacaaa

SEQ ID NO: 30042 - DNA, 1129 bp, Bovine  19866882115998
gtggcggattctgttgatgtatggcaaactaatacaatattgtaaagtaattagcctccaattaaaataaataaatttaaattaaaaaaaaaaaaaaaaagaaagcacagctggttacaagtggacattaactttgcccttctaatttttttttataattctactgtttcaagaaaaggttggcataaaaagtgatattaaaagcattacatttaatactttgttatttgtgcaagacaaaatgtcctgtgggtatataatattctcagattcctttcataaacccaacttatcctttaaaattattaaaatatttttcagattcaaaaaaaataataaaaataaaaaatcttaaaaaaaaataaagatataagtttgaaaataataataatgtgtaagtttgaaaactacaaactcacacacaaaggtgagttcctattcctccccctctgctccccgtctcccaggttttgcctcacctccactgttcagcttccgtgataagagctccaccttttcttgcagtttatcatagacggtcacaatctgggacaccgctcggcgggaggactccacgcgctcctgcagctgagattccatctcttcactggaactgctggccaaagtagcaaggaaagagaaagctggctcttgcccttcccctgaggacacagggggaaaaaagaagcccctaaaattataaaactgcaaatatcaaaatctactttttcccctcagatggagggcctcaaagcgaagccctacttcaaacacccagaaagcatgcagcgataaacttgtcacgaacacccacctctctctcggtcatctttccgttcttgattgctatcagagtctggttctggctcgggcacaacaagggcttttctctctgtgagtaggtctcccaaaccttgctccagatcataacgcttaaggatgatacggatgttttcatcaaactagagcagaggaggtacagttatgaagatacaaaaggaagcaactttggaaataaagagacggctacggagaactacagtgctcaaaccaaaacctgagtaaattaacaagctactacctgacttccagtagcggttgacaatcaacagtgaggcatcatcagtgg

SEQ ID NO: 30043 - DNA, 1055 bp, Bovine  19866880385884
acagcccctcgggcaggtttctgcaccgagttcccactctccacagaggtgtgaaagctaaggagagactccctagccagctgaacccactggtcagaggggaacttgccgggatgtggaagtgccaaggtcggggtcacaagcatagcccatctatgtcaccaggactgggctcagagctcaaatgacacctcagtctcggggcctctcctctgggtctgcactcccttccctgagcccagagaggtctcactgggctcagatctcagcctggcccacaggcagaggtcagttggaggcagtggaacagagatgacaggagcagaggggtgtgaggagtctcttggagccggaagagagacggggctgggagccgacttcagccagcttaaccccgggtcactgggggagggagggagggagggaggcacacgtgcgcgcatgcctgaggtcgcctgcgtgcttgcgcatgtgcacgctgaggtagtgcttccacttggtgacgtagccgcactcggtgcacatgtaatccttggtgctggagtgggtcagcatgtgcttggacaggtagctcacgtctcggcaagtgaagtcgcacagttcacacttgtggggcttctcacctgtgggggtggggtgaatggggaaaggacacaggtcagacacggactgactgaggtgccctgatgcctggcaggagtggaagctgaggtgctgatggcagagtcaacgctgcctcatggccctctcggatgatcacgcctccaccccgaaaccagggaagaggggcggaaacaaagacccagcttttttcaaagttggttctagatttgttatacagcttactggcactggtggccaactgctccacttagcccaatccacttagttttgtggaagaggaggaggaaaaaattaggtaatatgacatagtggttaactctggagtccaacacagtcataaagatattaatagctgacatttacacagtgctcactacgtgccaggcgcctttctgagcactttataaaaatgcctccccttacgaatcctc

SEQ ID NO: 30044 - DNA, 1686 bp, Bovine  19866880449440
cccctgctgcccttcacccccaattcccagctggcctgcaggcggggtgagcaggtgccagctggccaactctgcttttccttccccctaaggctcagcagtaccttgtggctcagctgataaagaatgcacatgcagtgcgggaaacctgggttcgatccctgggttgggaagatgccctggagaagggaaaggctacccactccagtattctggcctggagaattccatgcactgtatagtccatggggtcgcaaagagctcggacacgactgagcgactttcactttcacttttcaaggttcagcagtagaaggatgaagcagatggaacccagataagggtggtaccccccccatttggccccgccccctgcccaatgccaggacaaacccaggcttttcaaagccgaatcactgccccaccaggggtcttccggaatgcctcctgcccccaggcaagacaactcaaatccagctcaggagcaagtggaagggtttggacctggaactgcttgacggccaagtctcacggtgcatgttgcaccccaggtgcctcactcgcctgacctcctcctggtcctggtctggaggtgccttttcataatgtgactgcagtaacaagaacgactcagcaggcactaaggatgtcctgggcttaacactgggctcttcactttcatgattatcagtcctcacaaccaatgttcaccaggtaagcattatcccatttcacaggtgaggaaaactgaggggccaagagattaaatcacccaatcaaggtcacatagccagtagataaagacagctggtttttgaacgcggctccttacatccacctcatgctagtctcctcttgggtataatcttcatccagttgctcttactcttaatcaactgccctcctgttgggaacaagtcttctgcggcttaaaaactaattgtctcgggccctcaggaggatgaggcttcttcaatacacttccagaggaagaggaggaaatgggctgcagcaggagaaactgggatcagacatcagagagaacttcctgaatgcgaagggctgtgaaccacaggatggataagggaagctgcacatcctttgctcaattttttcttttttttccaaaaaaagacaagcatgtcctctcactgggtttaatcacccccagtggtgtgggccggaggaggggccagtctgccaaggctgctgtggctgggatgactgcctcgaggttcatgcaagaagacacgtcggtggccggcagggagggtgggctgggaaaaaaatgtgtctgtaggctgctgttctggaggaaggaaaaggcagagggccatggcgggtgggggaggtgcccaagccccggactggggggaggaagggccgggcagaatgcggactcagcctccggaggaacattccgtccagaaattcctcacaccctcccccctctcacccctccagcttcccctctcttgccccctgggagccctggaattcggacagtttttcaggccaaaaaagaccccatgacatcacatctactgccacggatagactgtgaggtcagggacagcgctgcctgcccattgggaggcgaatcgaggacccacattattctaggctcgtgtgttctcaaaatagagccctaagcagatgaagaaaaggggttgaaagccaaaggga

SEQ ID NO: 30045 - DNA, 898 bp, Bovine  19866880484417
gtgggcagaggcaggtaggatctgccggatccctgagcctggtcggctgcgattgccctggacaccagccagagaagacttgtttttcataaccaccaccaactacccggaagaagaaaaaaaacccaacaacaaaaacaaccatcgaacttttttttgtttggaatctgctgttaatggcccattggctgtacattattaaacaggcagctggagatctgccagggtagggtgcttgagccaagactcacagcctgaacacaatgttcctaggaaaacagtcacccgtggggtccctggggaggagcacccatggggagggcttccagctgttgccccttgccctgctcagccttcccactcctgcttttgctctgtttgtcttgtggggagcagggccctgctgcacctggagcccaagcatgctttatccagaccctgtgggtccctcaccaccccaggggcccaagttgctctttcccttcttatggttaagtggacaggctcctgcttctggtctgatctggctggggtggcactggctctcctgggggctaggctgggagctggacacctggttctctattcaagtccattgaccctgtggtgacgttgggattcccaacttgtcctttctgggcttcagttcccacatcactacaaggagaggattggtccctgcacgtgtgcgtgctgagtcgctcagtcgtgtctgactctgcaaccctatggactgtaacctgccaggcgcctctgtccatgggattctccaggcaagaatattggagtgggctgccatgccctcctccaggggatctcctccactcagggatggaacccttgtctcttgcgtctcctgcattgcaggcagattctttaccactagcgccacctggga

SEQ ID NO: 30046 - DNA, 1813 bp, Bovine  19866880499463
cccagccctgccccggggacgtgaggcactgttgcttgtagaatcaggattctttgaggcccagccctggctctcttcctggtctcctctgtttcatttccgccttctttctcttcttaagtctccctcaagctctgtctctctgtttttctctctggctcgtcccttccttaggagtttcaagtccctttcccacctttcttcctccccacgggccggagatggggatggatagatggcctctctctgaccgaagaggcactgtggcattgtggttacaccagtggccttctggggtgaactaaattcagctttgggctttgccactgcagggctgtgcctccccgagtgactatgtagcctctctgtgcttccgctgcccataagagcacttagcgtgaagcatatcgatagcatttaataaagagtagctgttgttgttgctgtcgttatggttatggaatgattgtattagcccaagtcctccgagaaacaagatgggattaaatgtgtaaagattttattaggggaaatgcttgagtgagagtaaggagccggggaaggctgagagagcctttagcaggcagcaagagcctgacccctggcgaaggggagacagggagctagagaggggcagaagtgtcccatacctccccgtcctctcaggacagggaatccaggagacacagttggccgacaagccttctcatccccagtaactgatcggccttaaaatcaacggtgggtagcagcctgagggagacgtggatttcaaagcacagctgggcccctgctcctcccacgggaggcctgcgaggtgccccctgaggccttgcgactcagaggaggacagggcctttggttctggagtctgaggtggggtgggacaggtggagggggtgacccaaggagctggaagggggcagaggcctgggtcccaggttgccatggagcatgagccccgggccttcttggcctggctgccaggcctcctcactcagggcctggcttcaggctgagtcctgggtgttagcttcattgtgctaatgatgtggtggtcctgattggagcagagggctgactgtacctggcctgtggcactgttctctgttccccacccagtcttcccttcctgcttgaggcacctcagtgctgaggggggaaactgaggcacagattcactgggcaggtgtgggttccgggcgggggcactcaggaatctgtattgttctgaatggccttcccttccccattggacagagccattcacttccaggttcatcctaggagaggctgggcagccggtaactacccctacgctaaccttgagtgtcctccgggactggcctgagtgtggcacaggggtgcagacacccgagccaagctgcgacaccattaggggaatgaagttggagcaggaacaagcgttttttgggtattgagctgaggctgtctgtgggcagtcagaccaggcccagtctggccagactgtcccccgtccactgcccgcctcagctccccgccactgcagacttcattgagatgcgtgagccacccagacggcctcttgaaccccagccactggatatgctaagcagggctaatttatcccctttctccttaatggaactgcagcaaagccagcaggggctgagtgtgttggaggcgactgatggggctgggggcggagggtggttctccacagttctgctgtaagaccccagctccctgtgtgactcagcaccgtccctctcaaggcggtcagctcagagaggagagcctgtcgtaagggagcagggacttcggacaggca

SEQ ID NO: 30047 - DNA, 1550 bp, Bovine  19866880656552
ttggtgggcgacaggctggcgggtcaggctgccttctgctgtattggctgctggctcacctcctagcctctactgaacggggccctgaaagtggcacaaaattggctgcctcacattcagggtcaccaaaatggtgtgagtgagagaagcaagcagggaaaggaaagggaaacttgtcaactccatgatggaggtacgagtctgcagggcagcaagagcacgtgccccccaggacacaccttccctgcctccccacctttcgagttctgcccattttaggctgtgccacaaagctgaatagtagaaggaacgatgctgccactgtgttgccatggcacgtgggcacttctctctaagcagaggatccagctgtggactgaacactctgctggctctgggcagtgggaagagctattctagagaaaggtctttggtatcaatttcctagtgagacaggcagcctctcaagtatagaaggcagggatgacttacactgctctgtataaatgtctgatgcttctgagattaaaagcattctgcccaggcacccgagagtcagaccctctctcatcttgttaaatggcagcaaaaactagcttggtagaaggggccaagggaaggagctggaaggcctaggcacaacatacctatagaaggttatcccaagagtgtggggtgctggaaatggctgtgtgggttgtggggaggcttagttcacctcaagatgtttaattcaatgggaacaagtgataggagaccagcacccattactctacttggagaacaggatggcctaaaccttaccagagggggtcccaaggtttggcatctgacacagacccaaacccccaggccctcgaccatgctgctctactgcggacagtgtcttgcaccctttagggatctcctcatcatctctatctcagataaagttgacctcctctttaggcaaaattcctgccaagactcggaccaggaaaaagaatgctttggaatagttccaggcctatttatgcaactaaatgtcctcaagcagattattccatttctacaagacatcatcaagacagttaagataggcttctcaactcagacccaaagaaaacagttcatcttggtaaaaaggtctgtgtttctttctagcagccactctcctcgatcacagagatgtggaaacaaggaggcccattcagatgtgaaaacctgtttgtcccatctttagtctgccaggcagctataggcgccccactgcccatctcatctgcagccactgcccagacacctgggtcaccaacacccatgacctccttggtaagcttaggagaggaaggcagtcctgttgcaggatggttctactcacgtgattgttttcatttcctttttctcggcatctgggcgtgcacggttcagcaccttgaggaagtcggatgtttttgcccgcatacgtgtgtgaatataggcctggaggcaaacacaatggatactgaagcagagtcacgttccagaaagacagctttgctctaagtagcggaaattatcagaaaggtctg

SEQ ID NO: 30048 - DNA, 1445 bp, Bovine  19866880668631
gggctgcggggggcactccgcgggagagggtctgtccccgtgggagtggaatgcggggcttccctcttctgcagaggggggctgtgccctgcaggaccctatgctttggatggcagcctgtccatccccctgcctctggacagagctggtcccactctggtggtggtggagagggggcttgaagaagaggtgggattgctctcaagtgtctgaccgccttgagttagacctcacaccctccacagcctggaagcttcccctccccacaatgggctagcctcctctctgggccactgcaaccctctgcagcccttgaacatggagctcatgttctgagtgcattcaggagaatgttctgtgtccctccaggagagtcagggccctgagttaaagcagacctgtttttcaagggcagacatcggatccccaaacaaggacatcagccgccccttgcaaagacatgggctctggctgagggaggcagtggggctgggcgagccggaactcagtgcagccctaatgcgtttcttttaaccttggggctgaacttagttccaaagccccgggagccttttccgaatgtgcctcctttgtcacaattattattagaaaatcaatggctacgtctgtttctctctaatgtttttgccaggagtgaaactagtggcagctctggaccaagccgctcggggaggctcgacggggaagggagcttggtggaggtgggggaagtgtgagagagggtaggggaccccccccccaaccgattctctgagggctgagagcctggggttgccccagggtccctgagtgggccctgcccagcccttcagaggtgtgccccgtctccattcaggttgatcttcatagcagcccctggttaggacggtgcgacccctacttttctcttctgtaaataagggttctttgaggcaaggggcttatttgttttaagtagggcggtttgtgagtctggtttacggtctttacccgaggctcttttttctcttggttgagctggtaggcaggttgcctctgatgaatgaagagctggcagtggaaactcaggacaccaccgcaaccggggaccttctgcatctgcaagtgctctccagacgaggctcctagttatgggctggtctgagtgcacgtcttggagtgactgtgtgtgtgtttgtgtgtgtgtgtgagagtgtgtacatccgtccctagacttggcagctggcagcctgctgttcatgacgagtaggtaggcttctcagcctgtgcttttcatagtggcctcaatggcggtgccaggcgggagctagggattcttggggccatgcagacccccccctgtgaagggtagatgacaatgcagtctgatggagggtgatttctgcttggctgtgctggctcgttgctaaagccgtctggtgtgtgcgtgtgcacgtgtgccatgg

SEQ ID NO: 30049 - DNA, 1623 bp, Bovine  19866880718908
aacaaaagaagaggattaacagtgcttttctctgctctttgaagatcggacttgttaagtactttgtgatctctcctctttgaatctgaagtgcgctgatggcagccaacactggtaatatttcacgttgtgctgtgctgagtcgctcagtcatgtctgaccctctgcgaccccatggactgtagcccaccgggctcctctgtccatggggattctccaggcaagaatactggagtgggttgccatgccctcctccaggggaatcttcccaacccagggactgaacccaggtctcctgcattgcaggtggattctttaccatctgagccaccagggaagcccaagagtactggagtgggtagcctatcccttctccaggggatcttcccgagcctggaatcgaatccacctgcattgcaggtggattctttaccagctgagctaccagggaagaccagtatttcacattaggtgtcatttatttttagcctctgccagtcagagggctcagaggtcacatccacagggcaaaccccagagcataggttgctgttcttgctgttcgtctcacaccagattctcttctggattgctttttgcttcatcctggcaggagttcaaagaaggacgcagagccagccacacagccccacaggtcctcttcagccacagggaacctcccttagagctgaaagataccgatgccgccgtgggtgacaacattggctacattacctttcggtgagctgggcagggttgctgcatttgcataccttggtgggttcatactgcagttgaaatggggctgagtggcaaaagcaggtgtgccagagtgttcctgttgccggtgccatgactataggaggcatgtcatggggcactaatataagtcatgtgctatttttatttttatacagtagtcattttccttttttccctgttttatctaaatcctcaggaaaaaaaaaaaggggtagcctggtgtgaagtaggaggggttagggccacttaagcactgcgtagcagctggttggggttctctgtcctttggcgcctgttgggtttttttgctcattagaccagagctctagccgagattcagttacccactttccctctggaaagattcatatccacccctctcacagtttgcttcagcctagtgatctggttcattgataacagctgacagtttagaatcgcagctcatacacacactgaccctgacaacactaaaatgtccccttttctgaagttctttaagtcaccagagtgctgaagatgcatcagtttattggaaataagcgggttgattaaccaggtttccttaagtctagtctacatgtttttttggcgggagggcacgttactctctctgaggttgggacagcctgttacagtttaattagcaatgtctctctttgtggtacataaactgatggtgaacttacagtcattagcatctcaggacctctgcagtatagttatctcctggcctggcgctcttttctcttgagagcaagttgacacacagtggtcccaccctttcttaggaggcatttcatttcgtttcaacaaaacctgatactcaaggactttgctgatgctgagatcactgagtag

SEQ ID NO: 30050 - DNA, 1780 bp, Bovine  19866880747348
caaaggagtaacaggcagacctgagggtgaacggccagaagaaactagatcatattcatgaccatatagaggttctgctcggatctgagcttcctaggttactcatgtggaagcttatactccagctccttgcagaagaatacagaatgagaagaaagaggtagtgctgaaagtctatcctttggctccaagactgttttacaaattaatcctgctggtgcatctttatctacaacaagcactgcagatatcctgaagggctactgaagaagttgtgcaagcaagatctgctgacataagaaatactggtcatgagagggcatggaccaaagagacctttctgaagccctagggaccaaatgtaactgtcccttctatacatcttagcccttctcctgatggagtcactcagagttggtggagatgacagtagggttgggggacacagatactgtgccagtaatatccctccttccctatgacttcttggcagccaaaagctgagcagctacaggatatggaggctgagaggcaagacctcagaaacttgtaggagagaaaaggctgagcggagagccactgtaagatggacatccttctgggaccactaaagtatggcttcctcttgagctacacggaagggttctgggagggggaggaaactcatcctactcactttagatacttcatacttctcttcttctcttattataaataacttcattttaaagttctagttcttttttccccttactaaactctagactctttaaggataagatccacatctgatttccaaaacccattgaaatttgtacctctagagacacctaagaccagtccagtcacagaatcagggtaaatttctttggatactgcccatcattagattggtgtgtcactattcctcaggccaccaccccaactctgtaaaacattgagagagcccattcctttcccttcaacaaaaccaggaataaaatggtttctactgacaagccaagtattccttatcttagtggcccggatgtggacaaaaatagaagatggcggtcccttggggaccacccccaaggagcattttgcccctcaggttatagagctactcatcttatcctttgacccttgggtaaagctgatgatgtgttgctagaccagatctccagggaaggtgaagcccttaactgccaatttccatagtgtgaatactgccattatgaccaatttcaagttacccatagttgaacggggggctgtgttctgctccgaagtatagaagcagggcatccatgttccccacaccagatcctggactcagcccaaaagccaactggcctggccccagctccctccctaaaccaactgtccatccccaagaagggcgtctccctccttgcagctggcatggtgactcagcttcccctaaatttaggaaaagggacagaaggcagactcagctgcccaggctcgtcttctgacctcctaccaccctgtcatctgaggggcttggcccaaggtccccctcaccccaggctctggtccacccccgcctgggcttcacccctacgataaagctggctcataggatttccgacccagtttagctatccccctggaatggttataggcttcggacaaagtgaaggtaggtccttcctgttccttgcaacatggcctggacactctgccatttcttgcctttatctccccagtaaacctgtctggttgccccactctgtctcctctctccagaaagataagtccattctctggtagagaa

SEQ ID NO: 30051 - DNA, 1970 bp, Bovine  19866880758553
gggctttgagtgggggcacacccccactcatagaatctgacgctcctcctgccccccctcattggactagttaggaggggcagggatctcctgggactgctttgcaggagtggtccctcccctacagggagtcctccccctgctctctgcagctgcctctcctcctctcctcctcctccctgctccctgctccctgctccccctcctcccccacccccactcccccaacccgggaggatgataaacaggctgccagctccgaatagggcctgacctcagcggcgaggcatctcccctcgccccccaccctcccagccgccagccctgcattcctggagaggatgaggttgagctgcggtgctcacccctcctttgtcctgccggctgctgcccaccggccacttccttccagctggtctcagcagagcattgaataccaaagggcccaactgggggccttggatagtatagttaacaacaacaacaataatattattattattaatgataatagtggttattatttattaagcaattaggttgcatgctaagcacattacatggatcatgtcactggattctcaagacagccccatgaggctgctattattattcttccagttttagcactgacagggaggggaaggtggattggaagggggggactgaggctcagagaggtcaaactgcttgccccaccccacaagctagtgaataggcggagccagaaccccccacccccaatgctgcagaggtcccagtggtcccctgcctccccatcctctccccttcacccccttcccctgccgcagcgttaggctccgatcagccggtctggtccctggacacaggacatagtcctgagagaagatgcagccatgggtggcaagacttgctcaggggaccggaactccctcgggcatctcacctgccagggaagatggatggggaccgcctggctgctgagaactttgcaaaggaaggttagtgtccctcctcattcctgctccagttcttagagacgtgaagttagggatctgggcaagcaggcaaccctctccaaggtattactgtaatgcttttgttttcaggctctggtggacaatgaaaggattcttttattagtatttcccctgtgaacttcacaatttcagaaattatactcatttccccagttctgttaatcagacccattttcagttgctgactagaagttccaggaggtgtggggtaaccaaactccccttactgagttgcaataattgcaaagctcagaagagttctgaaatgttgaccaaggctcaccatcttctgtttttaccatccagttcccttagtggtctaaccaccattcaactcgctgcagtctccctttctgccacttctgtgtgataactgtccagccacccagaccagtggtgcaggccctccctgccttcctctccttccttttcctcccatgatcatacagttcttgtcttcctttccagctctttcgttgctccagctcttggtggggctttaggctcctgctgggttggttatctgcttgcctccgaggttcacctagcagccttgagtgtcagagagatgtgggttcgaatccaggctttaccacccagtgaccttggggcctgtttattctgagtcacagctttcccatctgtaaacaggcaggatattgtcactatccagggatggtctagaggttggagattttagaagtttagagccaggcctgagctgcccttgataaacaagcagctctccactgtcttaccatcagctacatcaacagggactcccagcagcagcccactccatcctctgtggttgacgtccctggtgtagctgcatccctgccgatagggtacagacaagagcttgggcagacagcaaacgacgcccgcgggggacagttatcggcttcccacgcagtggggagcccctggtttcccagccgctgtcag

SEQ ID NO: 30052 - DNA, 717 bp, Bovine  19866880773751
ccccgactggctgcttccaccttcacagacccagctcttctctccagccttccattttccaaaagactggattcctcagctccaggtggcagggctgggtgtccaactgcttgcctggggctccggaagcgaggggatccgggaggccacctgctggggccagggcaccagaaagccacacggcaatcacactagctaacagccccagggcaagccatgccagctcccctcaggacaggcccaccctcagaactcccccaaaccccaggcccagctggacactgcactccccaccactgggccaagaagaaggtggagggacagaagaggaagcggacagggagcctttctgctagagccatctccctgttgtccatggactgggagaaggagggccctgaaagcaccagatattgccactgggagtcaacagctcccttcacctcctaagccttttcccagagctgcttaaggccacggcatgggataaacccgtgcacaccatcatctccctgacctgggcttctggcttccaaggagctgggatagaatgaggggattccctccccagaactaaaagccccagctgggatggaggatgccagtggaccacatcattctcaaatagagcagtgtgactctggatagaagggccaccatattggagtacatcaagtcaccaagctaaaggcacatgcccaggctacagtcctccat

SEQ ID NO: 30053 - DNA, 1770 bp, Bovine  19866880827820
tggtctgtgccctgaactttttatagcactgtgagcacagggtcctctgcttcagcccctccctagagaaaggagaggagacctacagatctggaatattccttttttccctcttccccccgtcctccgttttgttttctttgctgtcagaaaatgaaggaagaggttggtgagagtcccacatgtccttattcccagccaggaagatacgatgtagctgacctgaactggctattgtgtcttcttacctggaaacatctaacaaaagccttttaaggaccatctgtgtgacttgggcaagtcgcttcccttccaggaacctcacattcctcacttgtaaagttaagcagttggatacgatgctctctctccagaacatcctacgaaagcatctgtagtctgcaaagggtctggtgtgggaaatgtctaccagagaagtggggtgcgtgacactcggtagacagcttcttagttccaggccaacccttcctctgtttatcccaggcaggacaggagtgataattttgttctaaatgagattttccatatggggagtgaggaggggcttgggggaaagtggacagaaatgtgtttttttactctcatcctcaaggtttttatgatgaagtggagaaattgagcccatggagaaagggattaaaaggtgggagagaagcttcaggaaggatttagtctgactgttctagagaaagggcaaggtgggctggagtaggactgtcactggctgggggaagatgctgttcaggcttttcagcaggaggacagctgtgtgacccacagtggttgttgggagatggggtaggataagaaagcagctcgaggccccttccagcaatgctctgacgaagtctgagcagatcatcttcctgtgttagtttcctaggtcagccatgacagaggaccacaaacttggtgacttaagacagcacaagttgatgctgtcagtgtagctgagctgggaagtctaaagtcaaggtgttggcaggactggctccatctggagaccctgagggagactctgttccaggctttttctctttgctcctcatggtgggtggcagtcttggggtccgttggcttgtagacacgtctccccagtctcttcctccatcttcccatgatgctctcccctttgtctcccttcctctttttttattaggacataagtcatattggattggggtccactctaatctggcatgactgcgtcttaacttggttacatctgcaaagactatttccaaataaagttcccttcacaggtcctgggggttaggattctaacatatctttttggggggacagagatggagactcataacacctccagtcctctttttctttagacaacagtcctgagacgcgggctaaagtgaagtttgtccaagacacttccaagtattggtacaagcctgagatctccagagaacagggtgagtgttgggcgatactgaaggtcctgggatccatccgaggtcacactggctgctgcccatcttgtcttccctgggcaagggatataagcagactcactcctctctgcagtaggtgttggtcacagagaggaactggccccaaggttagacagtaggaggcaccttcccaaggccaagggcagggagcaggagttgtggttgtagctagttccttaaaagccgcaaagtcttgattttccagggcaaaatgaaaagtctggctgagatcatatggaaccttcatctgcatgctgtgggagatttctgcacattt

SEQ ID NO: 30054 - DNA, 1975 bp, Bovine  19866880870959
tgcctgaaaactgcactttctatagccgagctggactgtctgtcctttccaactatctgctactgtttagagttggtgctgtgtaatctgtgttctgcctctaccatgcatgccgaatgtagcatggcactggtgcctacaattctgcccctggcaagcatatttcttaaactaagtcatgctctcctcctgggttctcttatcctttataagtaatagcaggaagtgtaaggagacaattgccctggggctacccatgctttgattttacaggtgttgaccaattgcaaactaatgcctagactagaaaggacttgaagatggggtagtccctggaaagagcagacatgtctctaattaatcatctagggaaaaggtagctcctggggcagaaaatagagaacaagggagaaaacagactggggtctggactgcgcaagccagtatgcactccagggcaaacagaatattcgccacgagggggcagcagtcactgggcgaggaagtctgcaaggaagaggcccataaagaccggggcaagaaaagtctcatctaatacttagttttaagctcctctttgtgaataattcccttctgctttcccaggccctcactcaagttgtttcagcattccagcatgtttcaactaatcactggggtactagggaagagtcctccctcaaacccaaggaacaaaggagaatcagccccttgggatgagcatgacagggtgggggtggcaatggtggtagcttaggtctccagtggaaaaacaatctggggaaaagagttgaaaaggatctttccctttatggtaggaaagggcatttcactgaaggagggggaaaggcacacaccgatgagcttggaataaaattctacccacttgaaaaggttccagcaagttcgcccatacaacgtatcttctgtacgtcactttccatttatcacggctcccccttaaatggctctgctgctgctgctgctaagtcgcttcagtcgtgtctgactctgtgtgaccccagatgggagagcatgtttccattctgtgtagaacatccagtgccacaaagactgctgtgacatgtgcagcccaaatgccagtccttagcaagacgccgaggcctgttcttgccattctgttctagaagtggcagcttctatgcaggaccgtgtgaaccgcacaatttggctataaggttatctattttgtccccctgccagctttgataccggcctcaacatctctgcacagccctgcagaagaatccactcggaccgggggaccaaattagaggcaagggaggtggaggaaagggttcatccctctccctgatgacagtccctgttgccatcgtgacaggttcaagggcaagtatatgacctaagacgatcccactcagaaccaggctcagggtggttgtttaatgactgtggaaaagcaagtatgtagccttgtggctgctgaaagccattttgctaccataaatggcaaaccagtccaaagacaaacctaacacttggaggagacagaaccgagagaattgcagagaaacagatccagggtcctgaacatactgtgcccagagttcatcttctctgtgtatttttcagttatgtgagccagtaaattgtctttattgttgaagaccagttataagtggagttgtctggtggtggtggtttagtaactaagtcgtgtccgactctttgcaaccccatagactgtacctgccaggttcttctgtccgtgagattttccaggcaagactactggagtgggttgccatttccttctccaggagttgtctgtacatgcaaccaaaactgggcctgaccaagagagttctggaacccaacagtaatccaggatgagaggagaagggagagaatatgtgtcacgggcagacagttgtgtaacgccaggatgtgacaggggtgtgaccagggacccagctatggttggacctcccag

SEQ ID NO: 30055 - DNA, 1002 bp, Bovine  19866880880462
acagaatgcattatccccaagaaggagaatacacacaaagttgcacactcacacaatccaatgacacgggcaggtacacgcactcatcgcacacacgcaccgtgccatccccgctctgaccttgttgtgtagcacgaccacgttgtgggggtctgcattgagccaggtgtccatggccttgcagacgctgcagatcttctccagggccggggtgtggaggtcgggccagccaaattccaggacctgtggcccaagccatgagtaagaagtggcagaagcgcagagacccaacatgggtaggggacggtgaggggacgttagttcccgccctgcccatcaaccctactcggaggcaggggtgtggaggctgaggacactggtccaagactttgttctgacaccgctccctgtggggcctcaggttagtcaccacctctaccccagccccagccccagtttctcacatgtgtataatgcaaaagcttagcacccccgaagatcccaggtccctttcacacaactttgaccttaagacaagctctcctcccacacaccccaggggctggctcagggaggaagaaggaaagcggaaggctgatcacagctctttcccaggccctggacacacaaagcatcaagttttcaggccaaaaggggcctgagtgggacagagagtagacctgaatagcagtcatcaggttccttcaaactttaactcacagaactttaaagtacaagaaaacctgtgttcagaaggacccagagagctgatctaatccagcccatccacttttagacaggcaaaccaaggcccagagaactctgccgcccacccaaggtcacacaacgacggtcactggactccaggggctggagcggcacgcagagcccctccacacacgctcactcaacagcaggtgaaagaatgctggctgtcggaagcctgcactggcgattcccagccagggcaaatccagaagactgtcattaagactaaaatcc

SEQ ID NO: 30056 - DNA, 3258 bp, Bovine  19866880907735
cacgaggtccctcaaaacacaccctgccacagctctgccctaagacttctcagaggtgctgacagtgtgacacctctgctacttcctgacgctgtgacctcaggcaaataccccacctctctgtgctcctgcagtagctgcttcctagggctgtagtgatgttaaatacgtgggaaggagttaggacagggcctggatcatcacaggtgctcaataacatgagcgtcaccatcagcgtccctcctcctggtcaacacacacgtacacccacacacatacagacacaccacatgcacacacacccacttgtacacatatacacacaaacatacatacctatacacatacctatacacacacttgtacagacacaccacatgcacacacaacccacttgtacacatatacacacaagcacacatacctatacacatacacatatagacacaccacatgcatacacacagcccacttgtacacatacgtgcacaagcacacacatacgaaccacacatacccataaacatgcaaacacacaaggacaagcacacacactccacggtacacatacatgcacaggcacacatacctatacacacacacgtacagacactccacatgcacacacacaccccacttgtacacatacacgcacaagcacacacacacagtacaaaccacacatacccatacacatgcacacatataaagacaagcacacacacacacatacagacacaccacatgcacacacacaccccacttgtacacacacatgcacaagcacacatacacacacaaaccacacatacccacacatgtgcacacacaggacaagcacacacaatccactgtacacatacacatacaagcacacaaacaaaccacacataccatacacatgcacacacaggacaagcacacacacacacgacttggctcagatgctgtgtcccagccacagagactctcctcagaggacagctggacagtgagtgaggactcagaccatgagacgcccgaagtcaggggcaggtgagagaagaggggagaagagctggcgcaggagcggctgggatgagactccagcaggaagaggtggcacgcagaaaggatggggccctggaccagtggggggggggcccatcctcaccaggtagttgcctccatgtttggacttgagcatctgggccacctctcggaggttgctccggaagttctcctcattggctgtgctcgggaaggagacggcgatgatcctctcggtgacgtacaccaggtccagctcacagctgtcctccgtggtccggctcgtactcatgtttctggggagacagcaggcagcagatcagaatccaggcccccaggacgaggtccaggaacctgcacccctccacaccatacatggcccccagatctaacccaggagggcttggctgctccctgactctgagccaaggccagaggcttccccggggcaaggccagtgtagccctcaaggccagtctgggagagccggggagaacagagctgcgcagaagccggcaaggatctcaagccgtttcagaaacaaagagtaatgacactagtcctacatgttcatcagtcctgtcggcatcgccttcaacctatgatcccagaggtcagagccagggccggaaccagccagggcccaggagtccagctcagcctcccaacatacagcagccacctggtctggcagaagcttctcgaaggatccagggagagctccagagaggaaggagagcctgaagcgagggctcttgcatcccagagctgagccttctaccgccctctgcttgctctgagctgtggcatgggcggggaggccctcaggggtaggggcagctcaggtgacacgctcacctgggctccaggtaagccagaccacagcgcacattccagccctccctggaggcaggctgactcctgccctttgttcctggctctccccccacctctggcagctcccaccgcctccggggctgcttcctgccagtgacctccctggtttctaagggcccaggaggccgaggatgctgccacagtggcaggggactcccagacatcccagtgccatctgagcttctaagagaggtagggagctgcctgggccggcactgagtgagaggaagcgagggctcacacctttacacctcacccagctgctcttccagaggagggtccaggctgagctgacgggatggggaaaggggtctcgggaaattggtaatccattccaaagccccccagtggcttctaggggcacctcataccgttcttaccccatcaccagcctcctgcttcccctcgctacccaagatggaccacactcatgttgataacctctcactacctccgggtaaagctgggactggaggggcagtgggagggataccactggggtgtttcagagtgatggggtggcagtagggtgtacagccccaggacaccaagaaccggggcagaatccaaatctcctccagggttagctctgagccaggtgtatagatggggcttggacacaggggagccaaaggtgacatatagcttctccatggggacggtgactgggacgcagtgatagagatgccagtgtgctgggagcccactgtgaatttggcctccgagtcctgatcattcctggccctgcagcctatgggggtggggctcctactgaaggcggaacagcgccaccacctggacaacatcagcatcgaactctgcacccaccgattctcagctacaagggaggagggatctgctaagggggccctccactctctgtagacagctggcagtaggactactgcccactgggagcttcagctacacaccaagccctctctggctggggctccagatccctggggccagattctcactcatctcagaagcctcggatgaaggagaggcagaggaagccaaaaaaatcagagaacctggacccaggacaaagtaactctggatgagcaaagcactgagtcccctatgatccccttgccccagcccccatcagcccagccagccagagaacattccttttataaatgatcctcgagtatcagaagccactgctcatggaaaggaacagtatctagcacgggcctcaatgccagccagtcctgaaggcaaatccaagtgctgcctgttggtggttgcgtgacctttaacaagttgcctcatttccctgagacccagtttcttcatctgtcaaatggggataaaatacttacc

SEQ ID NO: 30057 - DNA, 2295 bp, Bovine  19866880958847
cagaaagctttaagtgtgcccagctgcactcagccattgccacaccgccttggcagagagtccagggcactgcccaggcccaaagagccaacccccaaccccgcacaggcatctagcaccccctagtcacagccaccaccccagttcatgtctctcctgactgggggctgctccccatgcttctgcctttctggcctggtggtccctctctgctctaccagcttggctgtttctgggagtctcagccggtgattagggccctaatcagcaggacttcctgccagcgactgccagaggtggggacagggttgggggttgggggagggaagcaaggtcaatccaaggtgaagttcaaagcctgggaccaggggaggcttcggaagggacgtggactcacagactcctccagcccagcatctctccagccctctttcctacagatgaggacaccgggcccagcaagggaagggactgctcccaagtgcaggaagaggcaggtgccttgctctccgaccaccctcggccacaggaactccaaggcaggaacccttccttacatgtcccttgaagccccctgcctgcccctgggcagccccatcccaggatcaagccccatgctgaacccacaggctgttccccataaagggttgtcagagcccaagtgactgctcaggtctgattgaggtcaaaggtcaacggtgagcccctcctctagatgagcaatggcctagaaatgggacagaaatgagcaggggctaagacagggaagacagatagggccaggctgaactcagaaaccctccccagctgtcatcatcatcagcccaagcctattctttcttcaaaaaaaaaaaaattgcttaatgccttttacagctgcaactgggcgggccaggggtccggaaacagagctcacacacactccacaccccctctccccaccccctgacctggagcaacctcagcctccctgggtgggaaccaggaccaggtggagggtgtatgtggcaggtcttgagggctgaccctgactaatgaggaacatcgggggcgctggaaagcagatgaccccaagagaggcctgagatggagaaagagcatgaccaggagcctgcaactgccaccaggggggtcagagctgccagcttcaaggcagacaggaagggctgggcgtggttctcccccacctcctaccaacaggggatggaactaaggctacagcgagagggatgcaggttagacctcggagagacctagagggcatgagacaagcaacttagagggcgtgagacacagcaacttagagggcgtaagacgcagcaacttagagggcgtgagacgcagcaacttgcagcattactgggggaatcccacttttaaaatatagatgctaccgctatgcatgtagcccatggtcaaggggagcctgcctggaggccaggccacatccttgctcagcctgggagtctctgatccggtgactctcatcaacaaatgggatgggagccaagaaggggaaactgggctggtttataataacacatcttgtttacagtgatggcagctttctcagagtcctccgtaaacacagctccctgggcagagaaagcctggagaggctcccttatctcccacctcccctcagtcacacagagagagttaggcagggaaagaaaatctcttctctaggctctgaggctaggacccctcaagggaaaacagtgccactatctcctccactctctgggcccataaccctccctgtcttagggctggaacagccgcaacaggagagaaaagagccaacccagagttgggcaccgagaataataccaccacccccaccaccaataataataataataatcactaatatttattgagcacttactatgtgccaggcactgttcaaagtgatttcaagaaactaactcatctgatcctcacaaacaaaccatggagcagaaattatcattaaaactggcaagggcattatactaagtgaaataagtcagacaggggaaagacaaatactgtgtgatgtcacttttatgtggaatctaaaaaatgcaacgacctcgtgaacagaacaaaaaaagaagcaagactcacagatacagagaagaaactagtggttaccagtgtgtgtgtttgcgggggggggggccagggggcaggcggggggtgctagagaataagtgcagggaagtgggagttacaagctattgggtgtaaggtaggctacaaggatgtattgtacaacaggaaaagagccactattttgtaataactgta

SEQ ID NO: 30058 - DNA, 842 bp, Bovine  19866881051375
tcctccccctaggtgccccgcattctcctctggctgaccatcgagctagccatcgtgggctcagacatgcaggaagtcattggcacagctattgcattcagtctgctctccgccggacggtactccagaggggccctagttcttcagcccagggctgggaacaactgctgcttcctccccaggccttctatttccccctggccacttcatcctgcagtcatctctgactcagttattgaccaatctgccagatggggaaacacagacccagatatgtaaagcgacttgctgcaaatcagacagatgttggtcatcttgcaggcttcaatactgcagccccaagctccctaccacgctggtcccctgcccagcatggaggtgccattttaggtctccagcaccctggctcccctctccctcagctgtctggggccccttgagtgcctgctccctggaggccccattccacggctccagccctgaggatgggagatccagactcctgaactgggctaggctgacccaggccactctggtttcagaatcccactctggggtggtgtcctcatcaccgtcgtggacactttcttcttcctcttcctcgataactacggtgggtgtgtgcctctcatccccagcgggactcgggcgaggagggggctggcaatgaatgtaatggtactctggtgaactgggagaagggctctgagcaaccttgctctgcacggccttgagcaacttagactagtgtttcttcatctacaacacgcagagactagcacagaggtcacagggctgtggggaggattcattgcggtaacacggtcaagtccggggcacag

SEQ ID NO: 30059 - DNA, 2022 bp, Bovine  19866881061751
tgtcctctgtacttaattctgccctgtgatccaactactacttatgtcttatttcgcttagctctcagagaatgtcagagtagttttcttaacttgataaacagtagataccaggagcctgaagcacatatcacactttcttgtgaaacattagaagcattcccattacaccagggataaaataaagatgattgttatcacggctatcatttaacattgtattggctatcctagccagtgcaataagacacgaaaaagaaataagagtcagagttgttgagtccaatcaagttttcatatgatcccgattctgtgcctgcactgatctcaggtgtctctaaaggtagaggtttcaatgcatgttggaaatcaaatgtggatcttatccttaaggagtctagagtttagtaaggggaaaaagaactagacctttaaaatgaagttatttgcaataagagaaatatgaagaaaagttctgtgggactgaagaaaaaagaaagatcactatcaggtagagagactggggaggctctgtgttgagtatatattttaaacagagccttggaagataggagtttgaaatgcatgagattattggaaaaggaaggctcataatgaagctaggaagtcataggatgtatttgaagaatggactggattgaaagcagataggctgtgtagtagagagtcaagaaaggagcctggggcttgcgtctggttggttttaaatgtcagacagagaagcttgaatcttagctagtggaagtgaaggaagccattactgtgttttaggaaaggatgccatggtcagagctgtagtttaggaagatgtatctggtgggtctggggaggaaggatacaaaaggggagagactttaagctgggagatgctaggagcttattggctaacctaggtgatggggactgaattagggtgctggccatggaaatgaaaaagaagagctgagggcagggatgctgtagtgggatgagaaccaacacatctacaagttgattgggtgtagtaagtgaagaggagggagatatcaaagataattctgaggctccataaatagaaacagaatgtttgttccgttaacaagccagaagttaggaggaggagcagtttggtgtaagatgaagatctcagtgttacttatgttgaatttgagtgacagtggaggctccagatagagatgtatggaaggcaattggacatctggaattggacctgaaagagtggaaagagctatagatttgggagtcctcctcgcaaagatgaaggttaacgctttgggcatggatgaaatctctctatatcagaaggcatggagagaaaagaacttagaatgaaatggctgtgagggaatggaagcccatgcagggccttgagaacgaatgttccgggcagggagaagacactgagacagtgggtcatcatagaagtcagaattgtaaagggttcccaggaggttaacaacgtcactgtggagcaatcacgaagaggaagactcgggaaaactcactgggcttgccagttaggtggcctcaggggtttcaaaggcgtattttcagtagagtggtgatgacggaagccagactgagggattgaggagtgagagatgagagagtgcagacagtacatcatctattcttttgaatggttttgtgataaaagggaagagggtggtagctaaagagggtagcaagatactgagagcttctttgtgtgaatataggagccatgagagtttttagaggtggaacagagagaggttgaatacgggggaagagtgagaagagaaagatataagcgagtgagaaagaaactgatagagcaggtctctttacgtgaaccatgaacttcctgatgttcaagctggttttagaaaaggcagagaaaccagggatcaaattgccaacatctgctggatcatggaaaaaagcaagagagttccagaaaaacatctatttctgctttatgactatgccaaagccttgactgtgggaccacaataaact

SEQ ID NO: 30060 - DNA, 1240 bp, Bovine  19866881101662
cggctctgcatgcgggacaggttccgccacagtcggtccttgcgcccaatctggaatgaacctgggaagtggtttagctgcagaggggacagagggtgggagcagggagagacagggccatgtgagaccacgagaagacagcaagactcactacaccattccaacattctaagctcctgttccatctgactgtcactgtctaaaggtccttaagtatcccgcgctgagcatccaccaaaaaacgattaaaacacaaacacaacacaacacaatgtagtgccctttaggagtcaatagttcatgacgtaaaagagtaactaagacagacataacattcaccgtaaaagtaaagaaaaacctgttaagtctttttccatgcctctaggacaaagaaaagcacctggctttcctggggaaaagggactattcacttcaaatgagacctctttacacatattcagcttggaggaacagaggcaatgtgcagtggttagaggaaaaacatgataaactgaaaacaggcattgcgtctcaagatacaccagggaaaaagtgtcttagatgctttatctgtccaagacactgtagctgacctactaggtgagcatgatccactgggggctcacacagcacccacctcccatactttctccaccctctgagccctcctgacttcactatggtcatcctcctcttccctacttctactaccaaccttcctctgcccaagtccaggggaagagcagctcagaaaaggcccctaccttctgatgctcctgaatggatcggaaactaggagacttcatgtggtgaccccagcagcccagccagtcatcattccctacagaaggcacatcaggaagtcagtcttactagcagctcggtccctgggacagagagtggctcagaggccccagaaataccaccagagcctgggcatggctcccagccccagttttctaggagttgccatggagctgtcctacatgaggccctggggtcaggactagaacaatggccctctgtcttccaattttgaggaacaggctccaggcagagggatttcagacctatgtcctcttatgaagttggaaacttcaggacaggatcctcacacagcagaagctaatctaggggttccctcctgcccagggcccatctgctggggcagaggacaggcttgaagtaaggcaagtgactcactcttgctgatcttgaagtgggaacgtccaatggtctg

SEQ ID NO: 30061 - DNA, 1495 bp, Bovine  19866881131163
ctctctccttagcctgtacctgagtcctttagtgtctaaattttgcattttgcagcattaccaacctgacaatcaggaatactaaagatcccattctcaatttgagtgcccatggcaatatggccaacttttaccttccttcatgatttcaaatataagtaaaaaaaaaaattcagtcagctgattccattctttagaattgagttcctattgaaacatcaaattgtatcacctaagcatatccacatgtataaaacatattatatgaataaataattgtgagaataatcaaattaatttaacctcaacaactacattatttgagaaaaccatttattctctagggaaaactaaccaaaaaacccctctccctaagatccacctaccatttatgtttaactctaccattcctggaaagaatttttaccaattttatcttccacaaatattcaaatttcccaagtgaacttctgatacttatagatatgacagaatgtctatgactcttaaaactagcttaacagatgtcagcaagtaaatacaattaaacagcagaaaatgattatcaaatagtgtgtgatacacatatacacgatcaaataaaattgaagcaaaatttacactacagccttcaatctctagaaacatggcctctaatacagattcttgtttataatttaataagttaaaaaccattaaactttgcctctgcctaaacaactcaactagaaaagctaaaaacagtaatatatgtacaaaggaaaaacatactagatctaggtatcaggagccagctctgtcacttactaacttttaacttacctttcctcaccactagttttctcagttgtaaaatagcaatgctacagtgttgcagaattaaatgaaatattgctaaaactcattaggcactcaatagacagcagcttcaatatgaatgaaattagtgtccactttctgaatttattccttgtctgcaacacgtctttctccaaagatcgcagacaagtaacttgttaacaacggtcaccaactcactgtctatagaggctaaacaggtgacacaaacgatttagacaggcaaaatatgaacacttctattcaaatctagccagttttgccatgaacccagcattaccagatcatctaattcttcaagaaaatgaaatcaaatttttatgtcaaactgcccattttaaattctggacaatgaattcaaaatttcaaatcaaacaaaacccactctagaggttaagatatagactggagaaccctagttcaaggcccctaggtgctatatatcaaacaactaggaataaatttaaagagagataatgaaaacactttgaattgtttaaggtgttttacattgtaagtcctctagtattattcagtgattgaactttttgagtgcctaattgtggccagatttatatactctaattagctgggtgtatgaatccatcagagtaatagaggccactatgttcacaga

SEQ ID NO: 30062 - DNA, 834 bp, Bovine  19866881162178
cccaagaaaggacagggtgctgtgttctctgggttttctttttgcctcctatatcctgctcctggagttgaagacgctggcctccttgaaataacagtaattgtaacaatctacctaactacccccgctaccctcgcctctgctcggcatctcccagaaagcctgctctcttaagccaaagcaccaggaaagggtaagtttaacaagacaaaacttttagcagtcacttctcctgtagctcaacatcacaaaaatctggctgttttcaaacctgcaagagccaaatggggagtccagatttccctgtttacaaggctgtgatgggataccccaacatctgtctccagaatggagagtcaaacagggggcaggtattttcatgatgactcttctgtgtcagtgaagccaaggtaaggagccaggatttctgcctccaactgcccatcatgagttggcatcctaaccctttccttgctaagtagtgtcacataaagccatgtgaaacagaaggtttaaataagatccagagtcttataatacaaaaatgtccagatttcaactgaagatcactcatcatacaaaaatccaagaagatctcaaactgaatgaaaaacgacaagagatgtcaacactgagataatagagatgttaaaattatctgacacaatgaatataaaaatcaactcaaaatggttcacagagtttaatgtgacatataaaactataatacttttagcaaaagagaaaaaaacctaggagataaccttcagaatatagggctagacaaaaagagttcttaaactgacatcaaaagcagatccatcaaaggaaaaa

SEQ ID NO: 30063 - DNA, 1563 bp, Bovine  19866881231804
ccccatgcagaaaaattggaatattgacacagcatttgagagtactaagctttcaaaagtgtatggttgtgcacatacctaagacatatgtatgtcttaggtcctaaatgtaaacctcagacaggcatttcatgtgtttttatgcagaattgacaggggaattaaatgcagtagctcagaaattgggctaaatccagactgacaacctaattttaaaacctatgaagtatatatttagatttggctggtttttttaccagtcttcttccattttattccagacaacatcttaacttatttttatactttaaacagatcttgtcttggagagtgtactggagatttgttccttagaagaattttgagtattcttttttgcatgtgaacttaaacactctccctcagagtccatgtggtgggacacttgtctaaaagggaaaagaacatctgcatttttgtaccggcagtgtctccagtgagtgacaggcctggcctcatgtgaaaaggcaatgcccaggaagccgtctgcccttcctcccgctctagactcagaggcagtggtaatttaacttgaaatgaccttagtaatgtggacttattttgctggttttcccctccaaaataaatcaagcactgtcctaggcctagttattttaaatttctgggaaaaaggaggatggtggatgcctagcctagaatgctgtgaccggggaggctggtcgtggtcacttgtctgcctgctgtgggtcctcgtttcccatgccgacatgcacctccagcctagtcaggatgccatccctcccttatcatttggcaggctgacttggagggatgcttattgctgtcatttggaaaaagacagggaggggccattccccactcttatggatatgctagtgctcggctttgaaggcatatgagctgtgagcatcagagaaaacctggtagatgttatcgtttcaacactcattacgtgaaaagcaatagttaccctttcggagattggtgaactaaaattgtttatattactagatctttaagttagttcagtaggtaagagaaattaagtggaagccactggttactatatgttcaggggcaagacaaacgcaattttcctcgtaggcagtagtgaagatgtcattttgaggatccttgctgcctgtatacatgtgggattatacctgtgggatattttcctgaactgaggaccctgaggcaaagtgaataattttagtagcattgccaaccccttctccacagaggttatgccatttccctcccacctccagtgcatgagtgtccattttcccaaagtggtgttgaacttttggatttctaccagtctgacaggttaaaaatggtgtctgctttctcttatgaacaaggtcaaactttttgtttttaatgctgaaggctaatttttttttgtcttttcttgtgagatgtctcttgatggcccctacccatttttctattgggttattgatcttctcagtttcttcatgtacttgggagactggccctttttctggataagagttgcagattttttttttccag

SEQ ID NO: 30064 - DNA, 1868 bp, Bovine  19866881232408
aaatgagccaaatcacattcatagtaattgctgccatttcttaagtaatggcaggaccttgacaaagaaaggcttaggaaacacttttacttggtcctccaaatgccctatgagaagagggacctgggattctgcaaggttaaggccaccatgcttgttaacggtggagtccaggtttgtcctgcattctggtagtcttttttctctttatatttttctttgtttaaataaaaattcagtgcaacagcacatctatataagaatatccacctcccagcctcacacacacaatttggtctatattttttcaggcctcatggggtcacattttcataattttttttttctacttgctatatatcaaagatatttttatctaaaagtagtacatttagatctatctcatattttttttttgtccagttcacgatacttcagagcatggatagagcaaaatgaaattaaccttactgatggatatctgggttgtttccaaatactgtaaagaaagctgccctacacatccttattcctgtatctttgtgtgtgtatgtgacacattctatagaacagatccctagaagtagaattactgggtcagaatacactcatttaaattttgttatgtggataaattgaccttcaaaagatcacactaatttatactctccataaactataagatagggtctgcttcccatagcctcaccaacactagttttattaaaaaaaaaaaaaaaaaaagcttaatttttgcccaagtgttgcaaaacagaagtggcatctcataggtacttttaactagaatttgtctgttagtgagattatggttagagacttttttttagtgaattgcatgtaggtttcttcccctccccttaaaaaaaaaaaaacaaaactgtttctttttcttactgtgcagctctttgaattttaaagatattaactcttcttatatattgcaaatgtctttctaggttccttctcaatttatttactatttctttcaccacattaaagtttagaaatgttatacgatcaaaccagctaatctttcccagtattctttgcacactgacaaggaaaattggtacaactgtagctggaagatgacagttaaaaaatagggaagctacccaaaaataagaagttgtagatgtaggaagaataacagggagaatctttcttctaacataaattgttcaactcccagtcataacgcatgccttgggagttaaatatgttatccacaagaaatcagagcagggaaatagcagattacctctaggaagccctgccaagccctgggtggtagagggaggctgggccttttgtttaaaccctggctgcagtccctgggtgggagggtcaacatggagaaaagaatccctgaggacaatagcagtaagaattgggcagaggtgtcaggaaaggtcttccctcctggattactgcctagcagacataaagccctttcagggagactgccaagagcttggtacaagttgtgcaccaccttgccagcctccaatcaacattcaccaactgcaaatcaaattacaacatctctaagtataaaaataggatgctaccttgtgtcttcatcttgtttataggcaaggatcaaaaatagcacagacaaaaaactcaggcttgcttatcctactgccctgctagcaactgtgtttatacctggagtctctccaggagcacctggggacagatttccagctactgcttccacaatgatctccatgttccctgtgtcctcttagtggctggggcttctaccaacaggcagcctgggtcaggaggcaaaggggggagggttcccaggacaggggctatggacaggctctaggattcca

SEQ ID NO: 30065 - DNA, 724 bp, Bovine  19866881382602
tagatgaataaataaaaataaaatggttcaaatgatatattttatgttatttatattttaccacaatttaaaaaatcaattgtaaaagaacatgttactatggttgattcatgttgatgttaggcagaaaccaacacaatactgtaaagcagttatccttcaagtaaaaaaaaaaaaaacacataacatgttaaacaataccatattgccactacaccaaaatttggtgaaattagaaaccagaaattcttcaggaaaaaaaaaagtaggaatcctaaagaaccataccaacacaggtgcaccctcctgcaagcccctcctctcatcattcagaagttttaggaccacattcaatacaaacctctacccacacatccatccaaagtatttacctggtttctgggtgtgacgccacacactgcagtaatgctagagcattgcaaactctgttagactggtgtgctgtcaaggtgggtgggttgatagatggataaatatttacaatttcctaaaaaatggaaatcaacaccatatgagcacggaataactttaattcccatggtatgaaagccaacaattttaattctgtatacccaataagaacagaaccatcaaagagggggcagaaataaacaatattcctttcatcacaaatatacctgactgagactatttgaaacatattatccctaggaagacttctaaggaggcaactgtggttacc

SEQ ID NO: 30066 - DNA, 1150 bp, Bovine  19866881409242
atattcccgagaggcccccaaacccccattcacatcctctgagcacagcagaggcagagaagtgtccctggtggctgatggcggccatgtgacacttggcgatgggaaggggcgcaccctgaaccctgaggggtggttcagccatagctgtgggtggcccaccagctctcatccgtcagagctggttcagcctgggaggcaggggcctttccaactcatgggggcgcctctggatgctcagagctccttccctcctgtagttgtctggagagggatccaggcagcggagttggggtgtggccagggtcagaggttgctgagttggaacagccctgtctgggaggtgttctcacgtgcatgccaggcccacggatgtttctccttcaatcagggcagctggaggcctccgtttaagttaatcacattatgctctggggagcaatatggaaattggagtgaggtctggagggaaatccgcacacacgggcacacacacgcacactcacacactcactgcagcttggagcacaatgctgccgccaccgccgcccaggcttgcgccgccgctgctgcgccttccccgcaggtggacgctgggtgcctggcaccgcctctgctctgcccgctcagcctcgcctgcggtcctctccccgagcctcctacgaagttgctgtgcccgccccccagcccgcctgggagaccggcaggcggaggccgtcaggccgaggggaggagagaggcagcagctggaggagtcccccagggtggaagcgcccccgcagcccccgcgcctcccatcggggcttccgggcagatggacctacgtcggggcggcgccgcgggggccccatcgagctcctcccgctagaggggccgggacacccgggctgctcctgcggggctaagcgtcccggagagcccggggcggggctctcgccttgctcctcaccgcctctccaaagcagccggttctcctccccctcccccgaaccctaaccctcgtgcccagggtgggggggcacccacctcgggggtcaacatgactcgactgagctggtgcttctcttgcgtgattcgatggagcaagtacctcttctcctgcttcctgcccctgcgcttctgtctccgaagacaggtaaactcacctaca

SEQ ID NO: 30067 - DNA, 1032 bp, Bovine  19866881449422
cccagacagcccttcaaaatggatttccatttgaaactactcccaaattatatgctaatgttttaacatggtttattgaactaaaataatgcaggtacagagctttaaaatacatacatatactagaaggcttgtaatgaaaaaagttgttccctggcctactctttaggggcggtagtctcaactctattacgtattcatccagattagatgcatatatctaaataaatccatatactactaattcttgatttattcattttaagggttatttgttgacttcctgccatgacagttaaaaacatgagtctatcacttctgttccccacctcccttatttatgtaaaaattttagttaaaccaataatcagcatttaaattatgtatgcaaatactgtttaccaatgagccaatgggtactacaactgtgccttataatttatacagcccttcatttttcttagagttaattattgcctttttccccctctcttgttagttttttgtattatctacagttggctgcccccacccctgaaggtgctcttaagactctgtccaaaagtctggcagtattttctgtatactcaaatgcataagttctgtttttttctctagaatcttcatcctagagtctccttcctcttgtttcaatcggaactgactgctctctagacttgctgtacagttgtcattctgggattttcctgggctggttttgcccatttcatggatcccatgccgtcttctttcttagtttacttccttgttttgctgaagcaccgcctctggtaactttgaaaggaaaaggcatagggggatatattggaatctttgcatattttaaaatctattttatcttaatacttgatttgtagttgaatttataggggggctggttattgaatttaagttttgaaaataatttcctgtcataaatttgaggatattattcattttcttctatcttccaggttgctattgtgaaaagcctgattcctattcatattcctgatcctttgtacgaaacat

SEQ ID NO: 30068 - DNA, 1425 bp, Bovine  19866881474237
aaaatagggcccttctacatctctcaagcccttctgcagagccgtggagcaatcaaggattctgcctctaccctatatccctttccagaaccacagtgcccctggatatcccctcccaagcctgccagggctcaaatgacagtttagccaacactgtaatgaaacagagtcccacatgtagtgggccctgcagccaccgctggggatggccacaggcagacactcctgccaacccttcgtctcgactggctggagctcagggcaatataggaagggggcctctctgggagcccctgagcccacccctagccaccaccaccagcgctgccagccctcccaagggttcagccagctcagccctgccatccccgcactcattcccaccccatctccccccgccctgctcccacagccctgccctttacagctggcatcactagatgtgcctgccggcggctatctcaagagttctgagaaatcaccttgcagcttcccagaaatgctgaacaaggccaaagagcaagtcacagtgacaccaatttgtctggcctcccacgcagcccaaggggaccctgcagcccccaggccagctccctctgcagtcccttgagctgggactgaaagacaggagtagagaaccctagtgctgagggtcttcttggaagaatccggcccccagaattcccccatccctcttttctgagactacgggggtctctcttgtattttaatctctcacagtcggaaagtctttcctcctacccaatcaccatcttccccattgcaggttcaactctgccaccagaagtgtctctaaactgtatgtgatgaccctgtttcaggaccctgttaccaattattcatctttcccagctggttcccctgctccacccacacaaggagagttccttgggcaaggatctgtcctgtgtttggtatcctgagagcccggcatatagcaggtatcagacatgattgtagaaacaatggatcaatctaccaatcaataggtcccgacatattttcctacttctaccacttactatccccttcccagggtttccccggaggctcagcagtaaagaacctgcctgcaatccaagagtcgcaggagacatagtttcaatccctgggtcaggaagatcccctggaggagggcatgacaacccactccaggattcttgcctggagaatcccatggacagaggagcctgacaggctactgtccatagggtcacacagagtcagacatgactgaagtgacttagcacgcacacagcaagcatgcatccccttcctaggggcttcccacatggcacaagtggtaaagaatctgcctgcaatctaagagttgcaggagacatagttttgatcccggcttgggaagattcccctagaggaggaaaggcaacccattccaggatt

SEQ ID NO: 30069 - DNA, 1999 bp, Bovine  19866880107503
gaactgaagagcttcttgatgaaggtgaaagtggagagtgaaaaagttggcttaaagctcaacattcagaaaacgaagatcatggcatccggtcccatcacttcatgggaagtagatggggaaacagtggaaacagtgtcagactttatttttatgggctccaaaatcactgcagatggtgactgcagccatgaaattaaaaggcgtttactccttggaaggaaagctatgaccaacttagatagcgtgttcaaaagcagagacattgctttgccaacaaaggttcatctagtcaaggctatggtttttcctgtggtcatgtatggatgtgagagttggactgtgaagaaggctgagcgctgaagaattgatggttttgaactgtggtgttggagaagactcttgagagtcccttggactgcaaggagatccaaccagtccattataaaggagatcagccctgggatttctttggaagaaatgatgctaaagctgaaactccagcactttggccacttcatgtgaagagttaactcattggaaaagactctgatgctgggagggattgggggcaagaggagaaggggacgacagaggatgagatggctggatggcatcactgactcgatggacatgaactccgggagttggtgatggacagggaagcctggcgtcctgcaattcatgggatcgcaaagagtcggacacgactgagcaactgaactgaaccgaattaaggtctctacacaaagctaacaaacatctggtaacaagaacatacaatggaaaaaataatgtgcctgtaggccaagcacttacaaaccaaccacaaggccagctagagctaaacgcgtccaaaaatcaagtattcctttttagttaagtttgtcttaacaaaagggggaaatgcaaactatatttaaatgtgcatacaaactgcaaatttaaatacctgaagttgcttcttaacacgttcatttttctgtgtttctgtcacacgttcctcctcacttctatggttcattaccccatcatttgataattcagcgctagcctcagcattattctcatcatgctcatcgtgttcattttctgtcggaggaatgactggtggtggtggaggcggaggtggggcagacatcacagtctttaactcttctttggtcttttccaagtcttcctgggctgcaaaagcctaaacataaaaaaataagcttataagcaacttactttgagaagcagtgattaaaagattcaagtcatcctttctatatgtcaggataataaaaacaagccccagtgatagaagcttattttcagaattaaagacaccactgtgtaaatcctaataaaactgttaattctagcaaggattatcaattgctactaaaagtgttgtacaaatggttgatgagaaaatggatataggtataatgacaaagaaattcacatgtgatagattacattttagcaatgataaaatataatcagacatgggaagaataagactgttattactctaatcccatgatcaattaaaataactgggccaatcagatattaagtgtcttctgatataatacaacaggaaatatcgaacatcaccaattgtctgagtaattatatcgtgctgggttgcctggaaaagtcctggtgtaattattaacaacactcccttacattctcaaaaagtgttccagtttggataataaattgtatgaaaatttctcttatgaggcatcacagccagaaacttttaatttgaatcctttaagcttttagatttatctttcagcttacaagaataccgaaggaaaaaagacaagctgaatgacatcataaggaaactagaaaaatacagaagtagggataatgcggatccttttaatacatcagtatcacaaaaagaactgtcctactaaaagagactgatcaaacagaagcaatgcaaaatcctactctggacactggcttggcaaattagctataatagactttt

SEQ ID NO: 30070 - DNA, 5533 bp, Bovine  19866880195150
attcttttcttaactaagatgatatattctctgtaaatcagcgcagcgatcattcagaaagcaaggtttaaaaaaacaaatgaaactgttaacaactctatgttcagctaagaaaaaagatggattgatttaaaattgcttgtagtggttacagaaaaaggctcagtctatttgaataagattgctaacagggttttcggtaatgtgaaaaaaagaaaaagatgtctgggtcattgtttttacagtaacacaccactgaactcaggattactccagaaaattactaatggagatgtagaaatagtggctatcacatttctcaatgctttgtaaaatgtggaattttcatttctagcacataaaaatgtcaagatgtgttcaaagaggaacacgttgttctggaaccactctcacactcaataggcagggccccagggtcagggagaagacaagaggtcctatctctccaaagctgaaaaagttatacaactcctggacaaacagcaggaagaacaacatgatgaataagcacctattttatgtgaaaaatgactgaggtagtcctcctcttgctcagcttcttgtaaatccttagggtcttggttgatgctcctcatttaactctgtctgggagggagtgtatacatattctagtttctcttttcttttcttatgcatttgtttaagttacaaaggcaatacacaaaatattcttattctattaaactgggtcttatgaagtttagacttcccaggtggctcagatggtaaagcgtctgcctataatgtgagagacccgggtttgatccctggattgggaagatcccctggagaaggaaaatggcaatccactccagtgctcttgcctggaaaatcctatggatggaggagcttgttaggttcccgtccacagggttgcaaagagtcagacacgcctgagtgacttcacttcacttatgaagtttatttttttgtaggtcaaaatttcaaatagggcaatctaataaaagaagtataacttagtaaaagattcaaacaatagaaaatacacagaataaaatgtaagaaactgtctattcttaatttttacaattctcttcccagaagtaacctctataacttctggaagtgtacccttcaagtctttttctgaatatttacatgatatagatatatataatttaaaatgcataagggggtttgttatatatgcattgctttacaaattgcactatgcatgtgaaatttttgcatgtcagaaaatccagattgcctcatcctagtaatagtaatacattccgtatgactgtttcatggtttatttaacctcagtatttgctattaatttcttttttaacatgtagctatatttttaaatgtcttgaatgatactaaatggagatcctaatgcatatttttaaataaaatttttatacattaaatttctagaaatgaaagagatgaatcagaggcatatgcatctaaagtttcattaagtcctgccaaattcacttcccaaaagagtttgccagtttatctactagcagtaactattttcccatatccttgcttttactaggtattataaatcttttaaattctaattaatctgatgggggaaatataatattatctttaaaaatattatattgaaatgtatttccttgattactagtgaggtcagacactttttgataggtttttattggccatttgtatttcttctactgattatcttttacaacctttgatttatatgtggattgaatattgcttccatggtaactcagctggtagctcctgtaatgtaggagaccctggtttgattcctgggtcgggaagatcctctggagaagaggtaggctatccactccagtattcttgggcttccctggtggctcatacggtaaagtatggattgaatattgattctctatttgttctactatttcttactggtattgtcttttacctttatggcaaatctcatcattaagaaatttttagttttatttaattaaatccaccaatgttgcccattttgaattctggagctttacagttcaagaggagaaggaaatggcaacctgctccagtactcatgcctggaaaattccatggatggaggagcctggtaggctacagtccatggggtcacaaagagtccgacaggactgagtgacttcactttctttctttctatagttccttttggagaaggaaatggcaacccactccagtgttcttacctggagaatcccatgtatggaggggccaggtgggctacagtcaatggggttgcaaagagtcagacatgactaagcaactaacacacacacgcacacacagagttcaagaaagatcaattttaagatttcaaaattatcttttgtattttattataatttttatatatttttcattgcagccatgaaattaaaagatgcttactccttggaaggaaagttatgaccaacctagatagcatattcaaaagcagacacattactttgccaacaaaggtccgtctagtcaaagctatggtttttccagtgatcatgtatggatgtgagagttggactgtgaagaaagctgagcgtcaaagaattgatgcttttgaactgtggtgttggagaagactcttgagagtcccttggactgcaaggagatccaacaaatccattctaaaggagatcagtcctgggtgttctttggaaggaatgatgctaaagctgaaactccagtactttggccaccacatgcaaagagttgactcattggaaaagactctgatgctgggagggattgggggcaggaggagaagggaatgacagaggatgagatggctggatggcatcactgacttgatggacgtgagtctgagtgaactccgggagttggtgatggacagggaggcctggcgtgctgcaattcatagggtcgccaagagtcagacacgaatgagcgactgaactgaactgaactctctattacatttgccattattgttttgtatatatgtaagttgaagtaaaagtctggttttattttttccaaatagtcatatattctaatattatttgttcaatgaatgtaatttcctaactgactgtgatgtcacctttatggaatatactgaagtcctatttacttataagtgtgtttctggactttgtattctgtttcatttatctctgtgtttctacatctatgtcatattaatctaactactatagcttcaaaatattttaaagaacatctgggagagtgctttcctcataatattttttaaaaaaatctttgctattaactcatattttctttgtcatatgaaacttagcatcagctaaggattcataatattcttgttgaagttttatccagaattaaattgaatatggattaattgaggagaggaattggttggaaagagatatgaaggaattttctgaggtcactgtcttagaccttactttgtgttggttgaatgggtaaatgcaattgtcaaaactcaatgaaatgaacacaaaatttgaacatcttaggattagtgtgtgtacttcataaagcaattttttaacatgacacctgatgagaagagctgactcattggaaaagatcctgatgctgggaaagattgagggcaagaggagaagggggcgatagaggatgagatggttggatggcatcaccaactcaatggacaagagtttgagcaaactctgggagatagtgaaggacagggaagcctggcatgctgcagtccatggagttgcaaagagtagtacatgacttagtgactgaatagaatagaatacaggcatgggttgtcatttcatataccagtggaacttcctgatccagggattgaacccccatgttgagtctcttgcattaagaggcagatgctttatcaccaactcacgtgggaagcaatagatctgataccatgtctattaaaatgtacatcagatttttatagaaactaacaatgtcattctaatatttatagctaaatgcaaaggaacttaaatagccaaattgaaaaattattccttattttaaaatttactataaagctacaattatcaagatagtgtggtatgagggtaataaaagacaaataaattgaaagaacagaatagaaagttcagagatagatccttatttctgcgctcaattgatttttgaccaaggcacaaagtcaattcaatgggttaaaaaagactttttaacaaatgcttctggaacaatagaatatttttatgggaaaaactgaatcttgatttcatctcactctgtgtgcaaaaattaatacaaaagttcttgaagaaaacataggaaaatatctttgtgaccttaagagtaagccaacatttcttgaaagggacagaaaaagcattaataaaatataaataaattggatttcatcaaaatttaaaatttttattctcccaaagatagcaatacaaaaaataggtaagccatagatgagagggaaatatatttacagtatcaatatatgatagaatatatttgtacacaaaatataaaaaatccccttaaatcaattaaaaaattaaaagaggttaaagatttaaacaataacgtaatgaaagaaaataaggatgaggaataagtccatgaaaaagtgcccagtgtcatcagggatctgctaaacctcaatgggatggcatctcatccacattagaatggattagtaaaagacggactacaccaaatattggataggatcaggagcaaccagaaccttcatacattgttggtgggtatatgcagtggtacaaccactttggagaatacttcagaagttaggtataaaggtaatcagatgtttacctatgaactagtaattccactcctaggcatttgccaaagggaaggaaaacatattttcaccaaataaataaataatccctttgtaagaatacttaaggaaactctgtttatagtagccaaatactggaaatcatcttgaatgtccatttacaaaagaccagataatcaaattgtggtttatttatatagtggaatattacccagaaataaaaaggaacatccacatcacaatcaacaacgtgtgtaagtctcacagatatgaaatgatattgagtgacaaaacccagacacaacagaatatatacacggtgtttccatttaaatggagtccaagaacaggcaaagctaaccaacagtgatacagtcagaaagcaattgcctctgaggagaggaattgactggaaaggggtatgaggccacagtcttagattttactttgttagtcacactcagtcgtgtcctactctttgtgaccccatggactgtagcccgccaggctttctctgtccatggaattctctaggcaagaatatactagagcgtttagtggtgttgggagaagactcttgagagtcccttggactgcagggagatccaaccagtccatcctaaaggagaccagtgcctggggtgttcattggaaggactgatgtggaagctgaaactcccaaca

SEQ ID NO: 30071 - DNA, 3200 bp, Bovine  19866880380349
aacctgcactccagccaaacacgaggatttaaggcagttccttcaatttggttgcacactggaactcactctggggagatttgaaatatactggcactatgaatttcatcctgagagatgtttattttttttggtctaggtgaagcatggccataggccaggtgattctaatgtacagctaagtttaaaaacactgacttaaagattctttctcctaaaatacctttctccatagcttcacaggataaaatctcacctattagtatggaaggttcccaactctgccttgaaacctttcccagaataccgttaaactcatttttggattatctgagtattgcacagggcctggcatacggttgggacttgataaatgtctgggggcatggtacatagtagagacacagtacatacttattggaagaatgatgtatagttggtcctcattatttgcagattctgtacttgcaaacttgcctattcactgacatctatttacccccaaatcggtctgtgcagtgctttacagccattccacagccatgtgcttgtgcagagaggcgaaaaatctgagttgccagaagcacacattccagctgaggctgaacaaatccctcatgttgaaacaagtgtcctaaaaaggactggttagctctatgattttcacatttttgtgctttctgttggtgaatttgctgtttaaatgggccccaagtctagtgctgaagtgctaagtgcaagaaagacgtgatgtgtcttatgaagaaatatgcgtgttaggtaagctttgttcaggtacaagttacagagctgttataggttcagtgttaatgaatcgacagtgtatacttaataaagtgtctctaaacagtaccacagtaccgtttagcttccctggtggctcagacagcaaagtgtctgcctgcaatgcgggagacccgggttcaatgcctgggtcaggaagatcccctggaaaaggaaatggcaatccactccagtattcttgcctggaaaatctcatggatggaggagcctggcgggctacagtccatgggctgcaaagagtcggacacaactgagcgactttgctttcactttttcaaacagtaccacatgtacaataaggttatggatagactggtccatgaaaatgttccgacaggaggcttgcaggaccctaatcttgtatttcctcaggagcagtggttcagtatttgtcgtaacttcacagaacatagctacagttgaccctggaacaacaccgggtttgaaatgcatgcatccacgagactgtgtgattctgggatggctgatccgggggtgcggaaccctggatcctgagggccgactgacgttatagaagaatttctgactgcacagagggtgggtggtgtccctactgcctgtgatattcaaggggcaaactgttcaaggaaaaacaagattgactgtaatttcactctctcctcagaattcttagtgaccgaacctgtaatttttaatgccagtttcatttggcaaatgggcacctcttatgtgccaggtcctggggatacagcaggaacaaagccagtcctttctctcagcaagttcacagagggagaggatgcaaacaataaacacatgtcaggtgacaatagatactacagagaaacttttaatcagggaggccttctctgataaggtggtgtctgtgcagataccaaaatgaagtggaaggaaggtgtaaaaggaggacacagggctaagtacaaagctctgagatgagcgcaggacagcaaggtggcctgtatgactggtggcaggcgagcaaggggaggagtcagaaagtgaagtcagaaaggcgaggtccagggaagccacatcatgaagagctttgcagggcaacgcttctcaaaactttacacaccatttgaatcataggagaatcttttgcatgtatgtgcttccagatacttaagaactgttttgacaagtttcaaccaaaaagctaatgggagtttgatggagagtgtgttgcagtaatacttgcttaaaaagcatgaaagattatattgtttaatcaggaataatttattgaaatttcctctgtcaatatagttccctagatttctttgtagtgggcttataagtttctttttaaacttgtcttaaaatagtttgcttttgttcttgctatgaatggtggttttttccttccctcatattttctaactagttattgttggtgtctaaaaaaatacttattttattcacatatatgaaactttagtgactgaggtatctcagggaactcagtgtttctattagtgcttcactgaggctcttgggttttccaggcatatataagaatgtaaaatcatcagattgcctctttcttaccaatttttatatctgttgccccatacttctgtctaattacattgcagcgttaacagtgattattttgtgatgttcctgatattaatgggaatgtctttagtgttttactctcaagcattatacttagcatacagcacatcacactgatggctcgttaggttgtacatacacatacacacaaaacatacttttatatcatgttgggcaaatttacctcttcatgcttcagctgtaaataaatagttgttttgagatttatgagttaacatatacaaaacacttaacactggaacagtgccaggcacaaagtaagcactcaataagtgctcagttcagttcagttcagttgctcagtcgtgtccgactctgcgaccccatgaatcgcagcacgccaggcctcccctgccatcaccaactcccggagttcactcaaactcatgtccatcgagttgctgatgccatccagccatctcatcctctgtacctatatgtaattatatgtatatagagctatacatttacataccacacaatatacagcctttagaaagttccttatagaagtatgctttccttctacatgaaagatttagggaaaaaaatttaaaatatggattgaattaatatgatacattaagatgatcatggggaaacagtggaaacagtgtcagactttattttttggggctccaaaatcactgcagatggtgactgcagccatgaaattaaaagaccttggaattccttggaaggaaagttatgactaacctagatagcatattcaaaagcagagacattacttgccaacaaaggtccgt

SEQ ID NO: 30072 - DNA, 2381 bp, Bovine  19866880397664
aaaaacactctgagataattacaactgtgggtgttgaagcttagcgatgttatgtgatatgtccataatgatacatattgcatgcatttttgaatacatgcaatttttgaattcccagtcctttaccttttccactatcagtataccacttgtaaaagagccatgaagtagagaagtgggtctgtcttggatccacccaggaggttttaataacactatacttgactgtgtagttcttcctaatagccacttcacttcagggttctttaggacacagttatgccaaggttgcagccatgtgggcccatatcagtaacaggctgttgttattccatctgaatttaaaaagttaaaataagtattttgcatagtttaattttgtctcccattttcttattgcagttctccagaacagaaggacaaatggctctctctccttcaaaggtattttttttagtatatattttctaattctgtaaggtataattacaccttaatgaagtaaatgaattaaagttttttctgcaagaatgtgccccaagctatcccccttcaccttaatagaaactgttcatttgtcctcaaaataagctgtttaaactgtacattagctactgcttactgtaagtaatgttctctgattacatgtatttctttcttactaggaaggagaatgttgaggtctggttagatctttctagacagaaatttatcaataatctttcccatctctttctgtgttcccagcctaccatttggagctaacagtttcctcaaagcatgtattatttccgtttccattcatggaggttttctgctgagcccctcaaaattcaattattatcccaacctttgagcatatggactaaaatgatcaattgaggctcatctcttattcccatagtccttccgtccttcctctctgctctcccttcccaagcttggagaaaaccaaggtgtatagctcaatgagaagtaaaagcccattgttttggtttggtctagtaaagtagtatatatgctcctgtacttatcactaagataagtgctaagtggacagtccagaaaatgtagggaagtgttgaggataaagcatcaccaaaagatgtcttaactggactgtgcttcccaaacctcttttaaaatggatctcctctgttcttctttgtgcctatgcctaatgtcctgagaaattttttttttaattctcttccaacccataatgtaatctgactttgctgagtctttccatctgtctttttaaaaatagcacataaatatattgaaaatattagcaaaatagaatgctttaaaaataagccattagcaaaatccatctgactcagtgttgttttgggttgttgttgcgtttgattagatacatcaatctagagaaagaaaaggactacccgaagagcattcccctcaaaatcttcgccaaggacattgggaattgtgcctatgtaagtgtttctaagtcagaacattaaattctaagtccctgcctaaggcagaacacctggatagaaagagagacaggcaggcagacaggctgggtatgtgctgtggaaggtaggcatttagaaaaatacattgtgagaaggtatatttccctgggtatctgtgttgtacatatgaaaagtaaccctagagaaaatgaagtgagagaaattcatattaactcagtatttaacatttacacttggtaagattattgcctgtcagatgtctctgtccttcctctaacattaatgcttctctggatcttttcagtagcagccacagaggctcgtagtaaagacatttccacaaggagatatttcctattagtattaagcaagttttccaacctgtcacttcttaagttgagagtaagttttggaaagttcttcattctttgagtttttaggtattgaattcctcagcttaacaaatggatgagccgagagagataacatttttaatgaatcagcacagattttatcattttggtcaaaataaaaattaagtttgtttatccctaagtgttatatgcaatcttatgactgaaatatagtccaaaatgttgtcgataatgcacaaaatagaaatgagcatttttatgatactgtagattgtcacacttctcagcagctctgttttatcactcatatcctggcttcagttcgtgaatgatgtgacacacggtcttttgctcttctgaagttgctccatggcaagagtctccttacagggagccctgcttccagagtgattccccccacataggagtgcatgtatgagaggcattcattctccttggcctttagttatgcacaacttggttagtgaattctgctaatgtgggaaaaaatagccacatgctctagttaaattgctat

SEQ ID NO: 30073 - DNA, 1164 bp, Bovine  19866880527372
atgctgatgctggtggtctgtgcaccacactttcaatagaaaataaaaagagggtggcccatgccaggcccttcatggctctctgctctggaagcctttctgttctaacacttggaatcagcagcaaattctcctttcccatgcttttaggaccattcttaagcataagatattcaagcaattttagtttaatacttagaagactcagtttctagttaatattgtacatttaaaattttaaaataaatatatcctcatgaaagacaattggtaaaaaaataattttaatcatccacagtcttagcaccccaaaatataccctattaatattttaatgtatttccttcaagacttatttttctgcatagattcagttgtatatatctgaaatcatactccctatctcagcttcagcaaattgaattatgagtcctaactcttctaatagaattgggattctagagtcccagttcctctaatagaattagacatccacaggcttgccattctggtaaacagtgtccaattcttcactcccttctaatggaagcatgtactcattcttgccaaagctggtgagcagagggtacttcctgacaccttgatgttgggcttggccaagtgacttaaattggtcaaagggatattagtagttattcaggtatggcaaggccaacagatccagaaataaatgccattgaagagagagtttgttcgcttacagatctcaagaaaaggagacctaccatactacaggccacacagggtcagtcaagaggcagaaggaacaaggggaaaatgtgggcaagatctttattgtggtttctgtgggaaggaatgggtaaagcagcgtaagcagattgactatttttaatagtttcagtgggttctgtgttgttcctagttgtctggcacctggccctggggtgattagagcagggaaatattggccagaaatgtaagagctccataaaagagatggttggggtatggcctctatatccatttgcatatgaaaagcatactggaaaacttagttattcactgtctccaggaattagctaatcctgggaggggcagtccctccagggtcagcaaggcccccaaaatgctaaagcatcaaaaatacagaataaaagacaaagcaacatatgcaagcacagg

SEQ ID NO: 30074 - DNA, 800 bp, Bovine  19866880565747
ttaaacttttttcttttataaaatttctaggaaatgaggcatttgcagaggttaattggtatcttatatgtagaagcctttcccttgaaaatctatataagttgtgctgcagaatattggataagacaggagctaaggtacatccatacagagatgtggactgagggaataattagtgagcatcatcaattccatccccacattcccctgtgagaaatcagggaagagttacagactgcaatgaattcaggtcccctgggcccagcatatcttatgaattcagattcataaatgggtcagaaagatgggctcctactttctcagccttccatgaaacaccatgaaaaggtaatgcaacattctctttcctcctctagaggaatgaagaagaatgagatcagggacctttatctttaatcccaaaccatttgctcatccaaagatcattattatagttcaggaactatgatgaggatataaagaccagaatgtaaaatcccttctctcatgtttctagtattcaactggggaaaataacaacataaaaaaaaaaaaaaaatacagaattgaaatgcagtgtagcagaggtataagaaaatgtaacaggaaatagcttacagggaatcatcaaagaaggcttcacaaagggggtcactttttagtggaaacttgaaaatgagtaaggttctgaagggccccagaagttgagagctgagaggaaatcaaggtactttaaagcaaggctgtctattaaagtcttctatgatgataagaatgctctatatccgtactgtccaata

SEQ ID NO: 30075 - DNA, 1132 bp, Bovine  19866880592687
atgtggaacctagtaaaaatggtacagatgaacttatttccaaggtaggaatagaacagacgtggtggacacaggcagaaagagggaacaggatggtgggatgaattgggagactgggattgacatatatacaccaccatgtgtgaaatagataactagcaggaagctgctataaagcacaggaagctcagctccatgttctgtgttgacccaaaggggtggcttaggggtgtggtgagaggaaggtccatgagagaggggataaaagggatacatgcaccccaagtttcactgcagtgctgcttacatcatcaacagatgaatggataaagaagatgtggtacatatacacaatggaatgatactcagccattaaaaagaatgaaataatgccatttgcaacatcacggatggacctgaagattatcatgctaagtggaaaatatcatataatattgcttatatgtggaatcttaaaaaaaaatgataaaacagaaacagactcacagagtaagaaaacaaaggggaagggctaccaaaggggaaaggtggtggacagtgacaaattgggagtttgggtttgacatgcacatactatttaaaataaataaccaataaggacctactgtatagcacaggaaactttgctcagtattctctaacaacctaaatgggaaaagaatttaaaaaagaatagataaatgtatatgtataactgaatcactttgctgtacacgtaaaattagcacaacattgttaatcgactatactccaaaataaaataattttaagaaaagaaaataaaaaagaaatcttggtaattcttcctgacttcagcctgtcctctgttcctttatttcttcagcatctccactctggccagccccaacacctccctgctcctttgcggctgctacagtttccgtaccatactttgcccactcattctttctccattggtttggaagcaaataaagtggaatccaacgtaaaatgcactgaccccaacgtaacgagacatttcatactaataaagagaatcatccaaattttaaaattcttagaagaaaacataggcaaaaagcattggagattacttcatgtatgtgacaccataagcacggaaacaaaa

SEQ ID NO: 30076 - DNA, 1637 bp, Bovine  19866880632298
acaagtgagtctctaggtaccaatttcaacatcattcaaagcaaactttcaagatgcgcatagtttttaaatatattcccatgtttatattataaatttaaagtgcaaatctcagagaggtgtaatgttttctaggagtttgaaaacacttgaaggatctgaaagaccagattaatctttttttaaaaaaaatcatttttactgattttgttagtttatgagcttaaaggtgtaatggaatctgattctgtcatttctgcttcttttgttattttatatcctatgccttgtaaggagggaaacttgtagcagcaaagtacatcaaagttaagctttgagaaatgatctatactgtatagataggggttttgtcctagaggtgctgaaatatgtccagtatcaacctgcaatgtgagaggaagagctcaccagccttgaccaaaaaggaagagaacaagataaattgggaagatagcactcaaaggaagaagagtgtagaagaaagaagggctgcaacagaagtggaacccagacactccactggaggaatgaaactatggttgaaagttgatcagtggcaaatgcaaaaaagtgttatgtattcatttcagtactctcaatgcattcatgaggggctaagacattattttttttactactaaggtttttctctctggtaacagaatcaatcactataccatgattccagacactatggaacctaacacaggacaacagaggcatagttattcctgagcatgagatgagagagaatggtacaatcataattaatttctttagggttgaaaaactggacaatgaattcagcaaaattatcccttcattttttcagcgtgagtgagactatttgtcaaatccctaaatgtcagtgaaaactgcttgaagataggtcatcaggacatcaataagacaatgcttctaagaactttctgaactcatggattctttatgcaattgaaacctcccattgtatctagagcattaaagttttgaaaacagaattgaataaattatttcattcttcaatacctaaacctctgcaaaactaggtgctccttctgtattctttgtttcaaatactttatttttaatataaatagtatataaaaatcaaaagaacttaaaagctaacagatatattttctttgtccctttgggattctttattccagcccacaaatcatacatgaaacaaagcagtttcttgaatattaaaatatagacaccatgaataagtctaaagttcaaatatagactcttttgtccaattatctgttgtggccagaaagacttgaggctgagcgctctcagctcaccccaccacatggaggagctctcccacctccaatgcagaggcttaagtctggtaaatggaggtggcctaagacacagagtggaacagcttctgatctttggttgtgcaagtgttcagttacagtttggggaaaactgcttcttggagctgttcactctttctccctttcccaggacctcaggggacccagtccttgagacttaggagagtctccagaggagcccactgaggtgtactgccctaggagtcctgctcacggcctgcatgcagcagccaacttttcacctgtagcacagacagg

SEQ ID NO: 30077 - DNA, 1421 bp, Bovine  19866880641443
agagattaagattctgtagagatataaaataaaatataataatggaaactctgggtggagacagttttcatctgaaatccattctactctgtctcctgagaaatatctaggagggaccatgtgacttagttcttgaaaacaagatgtgaatagaagtagtttgtccataaattcctgcacaagggttctttcctttgttcttaatggctagaataggctcagaagccacactgtagatttacagaatagtactatatttgaaatgttcttctcagaattcttatataagaaaggaattaatttttataatttattcagtttaccatgatttttatgatatcaggtagcataaactcttaatagagtagggttcaattcagttcagttcacttgctctgttgtatctgactctttgcagcctcatgaattgcagcatgccaggcctccctgtccatcaccaactcccagagtttattcaatctcgtgtccatcgagttgtctcatcctttgttgtccccttctcttcccaccttcaatctttcctagcatcagggtcttttcaaatgagtcagttctgcatatcaggtggggttgcttgtgatgtttattctcttctatatggttttctacatgttccaaatttccattttggaaaaatagtaatatgcaattaatgcaatatataacaagtattatttttcaaatctagacaccttactccaatacttcttcaaagtaatgaattacaagtgttttgagcaggtattatttttctctttttcattaggactatattgatggggcaggaaagcagcagaaacttctagggccctgtcacttctgatgtcttctccatattttagagattcttttctaactaaaaagtttgggtgtagaatgtagtttggggcttaagccaaactgggtttgaaattacttctgagacttggataagttacctaacctctctgagtctcaatttagtgtgagtgaataaaaatcatcccgtggtgcagcacaccattatgaatgttcttatgagatgtaagtttcttttatttccttcatttagaaaaagttgaccacttagacaaacacttgatattgagaagtgtgtaacatacaattttgtctttttaagcttgcactttgaccaaaatttcacacttttctggaaaggagaattatagcattacatgactaaatatgtcactgaattcctctttcctgttcattttcccattaggcatctggccagtcaatttagggagggaacgtgctgacaggctttcaaggttagcacaatatccctccacccctgttctaggctatattttgcaaaatatagctgaagcagagaattgtgttgctctctcagtagaaattagagcccactttgtgtaaacacaattaaaaactaa

SEQ ID NO: 30078 - DNA, 3884 bp, Bovine  19866880657369
ggaaaaagaaggggtagaaggttgtctgggatgcccacaacttggatgtttttctgtatacaggtgggatgagaggggtcagtagaaattgcagaatatgtgcatagttccagttctgtaagaaaggataggaaaagtctaaggcaggaaaaagaaacatatataatgtgtttccatgaggctcctctattaggtcggttttgctcattaatagttggcaccacttgccaattgtctcctgtctgctttcagcagagcagtccccactggagatgggaaagcttcagagtgaggcagcattccttacgtctccctcagtttctggcagcgttccttttcctgatgtccggccttcctgcgatggtaacatactgacttttcattgtcaagtctaccttatttgttggtaggcccagaaacgtgtttgctccctgtgtgcataactctcactaggcaggtagcactgcattcttgagtttctttttgtcttcacctttctccactccccctcccccccgcaactagataactgttgccagtacctgagtaactgtccctgatgtacagatgtacgtcccctgatgtacagataccttttctcttatttgtgcttgaattccagcaacaaagctaccatggaagtggagaggattagtgtctattctgattcacccctgaatccatcccctttaatttagaaaatgcctctgtgaaccactgatggaatcactgggactcacatagcagcagctctgcagcttctcccacatccccttttgcagaaagacttaaaagtctgccatcagcagtgggtgtccgaggcttgaggatcctcctgagtcactggagaagagacccacggccatggcactccattcgccagtcatgcctgttccatcagtcaggtgtccatcctcacacacgtggctgtaaactgaaacccacaccgcagaaaaccttggcacattattgcagatctttctagggctctggaagataactcttaaggtagacatcagctagagaaaagggttgtggtgtcctcacccacatctgaatccacccagcagtactaaattctaaaaagcattagagtccctggagctccaaagggagaaggctgattctctccacatttgatgaaaaccaagttggctcatatggccctgtagtttcaggctcatgctgctgttttgcagcctgactccttttgtttccccttccttccaagttattagggcaactatttgccaacctgatgccttaattcgccaacctgatgccttaattctaggatagtttcttatccacattctcagactccttgttactttctcttgatcatttctgcctccctagctatgttttgcatgttgaatgtagggggagtcttggaggtgaaatccataccagaacattcaagtaagttatccccaaatcctaaagcccttgggaaccatctgtccaagaagccatcatctcctcttcccaggtcccagatgagcaaagaagactgagggtgggagcttctactgaggtggaagggagcaaccgcagagaagggttgagaacctggagaaagacaaaggtgctttccatttcttaatctcttctttccgtttttaaattcattcttactggctgtccagttcattctttcatttatttcctgagatccagagatgctaataatccttttaagtagggtttttctaaaatttggtataaatataccaatttgtctgcttcagatgagccttcctctagccactgcaaagcaagatttttctaaacatgcctattccaaacatgacagagtaaaataagccctttcagaaagagatccactggcaggctccttatatttttctgcattaaaggccaggtttaatcacacacaaccttcaaggtgtattatccattttgctcaacaggaacttagaattagcagtgactttggcattttccctgggaaaccaatcccactgagcaaaagtagtcgaaaggatactttatagcaaacatccagggtcttttcctaatcaaaagtggccataaatcttctgagtcaccaacaggacttgcttgcggtataccatcctattgccaaattgttgaaataacaaatagaggcccataggatcatgccaattcataaatagagaattagctatttttactactaagcaaaaaaccccaaatgcatacacatatagcctgtaagtgactacagaaccgtgatgaatttccttctctatttatatggcactagaactacagtttgtaaacatcatcctacttttttagtaaacactcaacagacagttaatttgcactgatagctacattgtgttcactctgacatcctgtttttcataacttttttatcaagatcactctgtttttataattctttatcagagcctccctcagttgctccttatattataaccagcacatccttcaacacgccccatgagggtaggtccagttcagtctcccccagcctctcccggtctgtggaagtcccatctgcagtttggagtcacccagtagctgctcactttcctgttactaggaatgattctgggccttggcagctggcagggacttccaaagcaacagcagccattccaggggtttcctagttagcattcatttctttggcctgttcaggaaaggactggctggggaagtattggacacccagggaccaaccctacacgtccccaggtgcctgtccctttccccaccctagccataaaagagaaagaagacggtagcctgccccaatgggagatctcaggctggccaactgctgagtactttcagtccgatttcaaggtaccactggatgtggaattactatgttgagagaaaacacggctttcaacttgataataaagtattcccaaattgccctcctgaatagtcataccaatttatactcccacctgtaatgtatgagttacttctgtcacacatccgtggcaacatctggtgtttgcagactttatttcttcccatatgatgggtgtgaagtggtgtctcactttggctttaatttgcatttcttcaccgttgagcttttttcatttgtttgttggtcatatgggtttcctctcttgtaaattcactgtttatatctattgccttaaaaaaaaataaaaggggaggattacccttctcaatgtacaggaatactttatgtattctaagtactagtctttttatcagtcctgtgtattgcaagtaccttctcagtctatggcatttttattttgtttatggaatctttttcacaaagaagttttatgtactcaaatgtatcattcttttccttggtagtaaaaagaatttctctatcttgatatgaatgtgtcctgtaatttcttctaaaagtgttacagtattttcatatttaaatctttgatctatatacaatttatttttatgtgtggtatgaggtaaaagtacaattttattttttccacctaaataattgactgccctagtaccatttgttaaatgatccatatttttcttcatctatctgtaatgtcacttttatcatttatacacacgtatagctgaaagtccaatactttggccacctgatgtgaagagctgactcattggaaaagactctgatgctggtagagattgggggcaggaggagaaggggacggcagagaatgagatggctggatggcatcaccgactcgatggacatgagtttgaatgaactctgggagttggtgatggacagggaggcctggcgtactgcgattcatggggtcacaaagagtcggacacaactgagtgactgaactgaactgaactgatatatgtgtgcgagagagatcgatcttaggttcactttt

SEQ ID NO: 30079 - DNA, 908 bp, Bovine  19866880673007
tggcagtgcacctggtgccaatctgtggctccacagtcaacctcatcaaccacaaatgtcttagatggttctccccttccagttatataattggatccattgctcatagtcatgctcaaaatagaaacagacaacaagccatctgttccacatctccaagttcttccttagcataaagcaccatctctgctgttcattgttaccatggtaaggtgcacccacagtaacaatgaactgtgtgacctcagagctgcccacttagctgcctgagtgacactctgactcagtttcagctccttcgccagctcttacccagatttgggagtgaagatctaatgaaaacactttctattgtctggaggcactttctttgggctcatttaatgcattttatggtgcattaaatgtgtctgtgcgaatggctggatttgttttgctcaagtgtgaagaataattaagatcattctaagtcaaatgaagtgttgaaacacattgtcaaaggacctcagcactgtaaatgtctcgttacctctgacactttgtaattaggtctgtcactgttctcttaatttccaccgaaacattatattccttccacaccatctctgcctccttgtgtgtcaagaactcctcccattacacatacacatctgtgatccaggtgtcataaacatgcatcaggctgatgagaaagacctgtgcttggatggtgaccagcaaatccatgaagcctgtctgctgtctcatccatgggcaaaggttagggtgcagttgtcaagagaagacttacctccacagcagcaagacaaatggcaaatgtgtctcctctacccaggccatgtacatcctccttcacatggtgacaggtgacctgctggtctggctgagttatcttcctcttcctcagt

SEQ ID NO: 30080 - DNA, 1241 bp, Bovine  19866880754085
ttcttcccggctattcttgcagacttttattcttccaaattttaaaactgttttcccaagtccccaaaggattccattagaattttattgggctgtaataaacttataggttggttttaggaaaaacggacatctttacaatgtacgtctttcaagccaagaatatgacatgccttttttttttttttttaatggtccatgctatgcagcatgcaggatcctagttctcccaaccagggattatcccatgcccctcagtggaaacatgaaatcccaatcactggaccaccagggaagctccctgacatgcctatttatttatgtaagttttctttctcactggacacttattcttagtgatatgaactagtttcttctcaaaaggataattttgtttttgttgttactaacctttctgtgagaagcaagttcaacaaaatgaaatcatttcattgggttgggtcaccaagtactcttgacagttagcataaacacatgggtgtattgttgaaaactgtgttgtgatgattaactattcaagattccaggctgggatttttgttgaactgaatatagagaaaggtcagttgaaaaaactgcttggaagactcaagacaaccagaaaccaccaatgtatatttttgttctttgcctatgaaggatttctttttttaaaaaaagattgcttcattatttcagagcagagatggaggctataatcttatcttgaccacatatttgtggcacacctgagaattgtttgcataaatgcatgggctagaagccatatctactggtccaaaacctattctaaaactgaccagacagtaaagaagaatggtgtgtgccaagttatttaacaaagcttgcaaagaagtcaccaggccgctctctttttccttagtgttttcaatgcctaacacaatgtctcatatatacttggtgtctaatgatttattgaaggaataaatggactgttcagcaaggatttatctgtgtgctttttaaggtgaaaacttaaagagtgtaattggcttggttaactgccatcccctctgctccatgacagctccaacagcctctggattggtagctgagactgtcatgacctcctgactttgctcccctgacagtctcttccagggcctgcttttggagcttggtcagctcctcgtagttcaccttccattccagtggtgggtgttccccaaaagccaacttactgttttccttcccaccag

SEQ ID NO: 30081 - DNA, 656 bp, Bovine  19866880767720
atggggctgctgctgctgctaagtcgcttcagtcgtgtccgactctgtgtgaccccatagacggcaagcccaccaggctcccccgtccctgggattctccaggcaggaacactggaatgggttgccatttccttctccagtgcatgaaagtgaaaagtgaaagtgcagcttggctctaaaccacccaaagaaaccggcagccagcctgggatgtgcctactttgtctgcccatgaacagctcaggcccagcttgagggagatcaggctagggagaaggtgttcttggtcaccactctgctaccacaccaaatacagctcatcactgagggccagctaaagatatattattttaattttgcttaattattaaaacatgaaagctcattgttgagttagaaaataaagaaagaagaaatcattaatattttaataatgaatatttcattatccttttttttttacatagttgagcacatacaatatatgtgatttttgtttcctgcttttattactttatatgacatgaatattttcctgtagtgttgaggatactttgcatccatcagttttaatgactgcttaatattctttgtagtttgtctggccattcttcaatgggtggacatttaggttatttcctgttttttcaatataa

SEQ ID NO: 30082 - DNA, 961 bp, Bovine  19866880782370
cacacacacacacacacacacactcctaccttatgatgtctctctttgtacaaaaattacaagaattaagctgccagctgtctcactgagagctttcactgtaattatttcattaattttatatgatgtacaatagtaagtttatctgcacagttaagtatttttgcaattaaaactccatcagacttttcagaataaataaatagagctcattctctctcatgtaagatcttttgtttttaactttgtatattgtttttgcactgtcattaaaacataacttcacaacctagagtgaaagtgacccagcttagtttgtgaaccagaattcacactcaataaatgtttgttggatgaaaatatacttgatagacaaaataaaacaaaatccaatatgcttgatggtctgttgatggatgagatgggtactacgttccacattctctatttcctggtagtggtctcttaattttaagtagaagttgaaggcagaagctggaggaagtagacactaagctaataaaagtcctacaaataggaagggatgactagagaaaataatgcaaaacaactgaggtttctagcttcatggggggttgatattttgggaaattgtgccaggcaaaagaggcctgaatatcattgtaaagttattcagctcagctcacctcaatcattaaaacacacaaatacaggaatgaaaataccaatgttaaactatagtgatctctgagatgcattgaatctcttcctttaattaaatttatattttcaaaaaatgttctctgaaaacctgtgtgtgttttactactgaaatcacatttgagcaattgaattattatagaatcgttactgcttctttctctgcctctttggtgaacattgagatgaaaaagtaatatcaaacggtatctgaaaaaagttatggttgaggggaaaaagtaaaggtctgagttctaat

SEQ ID NO: 30083 - DNA, 982 bp, Bovine  19866880832481
tcactaaataccaacaaatccgtgtctattctcaaatcttttgacttgttctaattgatctgacattcccataacacatgcagtactctactggcattccacacggaggttattcgtaaaattgaaaaatgaaaactgtctaggcactgatcataatatatcccatgaggagctatttgcaagcaagatattacttcctctcttacagaataagtggataacttgtaggctaccatctgctcacaattatatcataaataattaaacattaaaggaatatttattaaaataaaaatacaagaatattttgtgtttgccagagagtgcaaataagtttcatctcatatacaaatgtcaatctgaggtcatgtctaggttcaataggaaagaatgttttgatggaatagtaagatctgcaatgaacacagacaggtcaagtgtcagaaatttactatccctggcatagacccttgggggagattacaatggtttgtgttaagtaataatgggcagttttcatgctagcatagcaaaaccaaaagaggtactattggcaattttccaaataagcaatcaagtgaaggtcaatgaccaatatcagtactgttagactaaatttaaatttcctgggaatttgcaatcttccaatatactgcctgaaaaagtaataaatcaccatgtttataactgtttgtccttggggtttacatgatatgggcttagttcatcagttgtgtttgatctaaaagttaaataaatattttcttcaaaaatttgctgtaagatctataaggcaggcttctatgttccatgaatatatattaatggaagaaagaataaatagacaagctccaaatggggaaaacactaaaagtttatgagtgggtatatgtcccaagcagaacatagaaaaaaacattctgaaattcatagtatttcttaagttttctgtttcttgaggaaaagccagagcatgccagat

SEQ ID NO: 30084 - DNA, 1920 bp, Bovine  19866880844053
cagatttatttgtgatccaaatgtttgaggattattgtgttcttacatggcaatacacaatcaaacaccagatgctcagcattcaacacaaaaaaggcagctgaacaatctgatctctttcatctgataaattttgataactaagaggctgacacagagccctccgtgtggctcagcctgggctcccctcatacatgatgccttgcaagcatgcctgaagccatctctgaagttgttcaagcagttggggtgctgcttgcatatccttgcagcatttgaggtgtggaagtctgagtgatgaggatgggagtgacaggagttttgtttacttagctacaaactgcagacactgaagcactagcaaccaaagcccaaaagaggaacaaaagaaatggatgattccagagaaagcctatgagacactgtcagatatttcctccaatgcttttaagtggaattatacaaatgagattggaactgttttacagaagctcaaaaataacagtatgtttacaaagaagaggaatgtcataaaatcatctccatctatatatatggaaaaagtacatatttcttctgccacaaaatgccataagaaaaagcattataatattggtgtagtagattgtaagtgcaatcatatttcttgacatttttagcaagtgtaattagtatttgagtatacactactgattgctaatctcatctttaggactctgtaggagttagaaaacgggtgccctctgatgggataatcagcccacatgaaaaatcatcatacttgtgtttcctctctctcacttctttcaggtcctctcctctccagggtcccagtgcttcttagaggtgcttaagtttctctaataacaaatgaaatcatttcctatattgattcaccctagtattttactgacttcctgcttcccacctgtgggaactcttgcatttgaaaataaaacgttgcttgtggcaaccatgcctaaactatagaaacagatctcaaatcatagcatttcagatgtaatggcacctgttgtatttaagtttgatgacagaggaagccaacaaccacaacgcttaagtaactattctacttaaaattcaggcatattatactgtatacacagctttgtcttctctattaactctattactcctgtgagctgggttcaagactaaattcagctgatatcataaatctcagctggtggttgactctaatgcatgctttgtagattcattccctaatgagtgaagtctggtgtgattttctggaaatatggctttgtgcacttcctccatcagccttcattttcccgctcatcagctttggcagctaattttgcagtctgttttgatcactttggggtgagctctcagcactgagccttcacaccttagcaactgcaggattccatgtcccacagagatatttgtgagggaagtctgactcagtttgttagaaaaataacttttctgatacacaacaaaattgatgtaattctactcacaccgggaaccagtggcaaaattaatgaaaaattgcttttcagcttttatttctatttgcctatgtgtgaaaattcagaatcacttagcaattgttttgaaccaaatagatcaggggaaagttgaggacacactattcttttcaaggggataggaaagtctgatttggaagagaattgcttataagttcgattagatcctatttgtttatttttgcttttattttgtttgccttgaagactgccctaagaaaacatctatctgctgtttatgtcagagaccattttacctatgctcttttataggagttttatggagtcatgccttgtatttaagtgtttaagctatttgaatttattttgtgtacagtgtgagagaatattctaatttcatgatttaaatgtgtatatt

SEQ ID NO: 30085 - DNA, 2696 bp, Bovine  19866880867489
agtttttatttatcctacacacagaaaataaaagcatatggtcagtctactctatttgggaattctttctaagtcttctaatacctttagattttcttttctctatttttagctgtgctggatcttccttgctgtgtgcaggcaactctgtagttgcggtgctcagtcttctcatttcagtggcttctcttgctgtgcagcatgagctctaggcaagcaggtttcagtaactgcggctggtgggcccagaagttgcagcttgtggcctctagagagcggtctcagtagttggtctcaggcttagttgctccacggcatgtgggatcttcccagaccaggaattgaactctgcattgcaagggagattcttaaccactggaccaccagggaagcctctaaattttcttttagacatttatatctctgatccagttggagtttgttggagaatgaagcttctctgatatcccaaacactaattaataaatatttttctttctcccttaggaaacaagggtgaatagctcttaagaggaaaaaaataaataaaacattcacgtttgtttttctacactaaatacaaaagtatttaaaacaaaaattttttaaaatagatataattttggatttttgtcttcactcactctggattgtgaagtatgtgagtgacacgcccatctgtgcgtggagaacagaaaaccccttctccagtatcactcatctgatgggaacaccccagcctcatgcatcaggatgaaatattacaggcactagtattactcctacagacagacaatactgggagtagcgagtgctacccttcgcttccttctggctttctagtctccttggaacaacatcctctgaggcctgtgatcctgtccctgcaaaacatgtagtgggtggtcgaagacaaagcaagacaggtccctggacagacttcccgggaaccacaggcctggccaaaccccaacctgagcctgaataagagccaaatgctcacattttcacctcatttgtgacatatcctggggcaaatagccaattgcctccatggcaggaacttcctttgcaggctacaaataaggatttttctatctcagccttcttttaacttactttaggaaaatttagagtacatcaggaataattgttttcttttaaagcactgtaatttagtttctttctggactttgagtgtatgagtcacattttgcaacagcaccatgagatgcaaatagacaaatattttttctgaaaactcgattttcaagctagatctttcattcctacttgttagttttagtcttaatagtgacgttcagttcagttcagttgctcagtcatgtccgactctttgcaaccccatggactgcagcatgccatgcctccctgtccatcaccaactcctggagcttactcaaactcatgtccattgagtcgctgatgccatccaaccatctcatcctctgtcgtccccttctcctcctgccttcaatctttcccagcatcagggtcttttccaatgagtcagttcttcacatcaggtggccaaagtattggagtttcagcttcagcatcagtcccttcaatattcaggactgatttcctttaggattgactggcttgatctcctagcagtccaagggactctcaagagtcttctccaacaccatagttcagaagcatcagttcttcagtgctcagctttctttatagtctaactctcacatccatacatgactactggaaaaaccatagctttgactagacagacctttgttggaaaagtaatgtctttgctttttaatatgctgtctacattggtcatagcttttcttccaaggagcaagtgtcttttaatttcatggctgcagtcaccaactgcagtgattttggagtcccccaaaataaagtcctttaacaggtcctgccacactcagtgtccccaaccctgcagcaggccaccgctgacccatgcctccaccggaaactcctggacagccacagacaaatctgggtcagtcttttgtggggccaccgttcctttctcctgggtcctggtgtacacaaggttttgtttgtgccctccaagggtctgtttccccagtcctgtgtaagttctggtggctctatagtggggttaatgacgacttcctccaggaggtcttatgccatcccaggcctattgcacccggagcccctgcccctgcggcagtccactgctgatctgtacctctgcaggagactcttagacacagcacagtttaggctttagcatagtttaggctttccttaatataatgaaaaagaaaattgattatgatatcaaccatgggtaccataactccttttagggaagaaagtgtatcatttgaataaataatttgaagggcttttcaagcttggaaaatttttggtcatatctcttcaaatattttttcagttctcctttttgcctttgaggactctaattacacatgcatgaggttgctcaaagttgtcctacatctcactggtgctgttttcatttgttttattctttttatacccgttcttcatttttcctagtttctgttgctatgtcttcaagtgcattgttttttcctttctaataactgatctgctgttaatcacatttcatatttgcataccaaatatctttggtattttaatatcttgaatgactctgccta

SEQ ID NO: 30086 - DNA, 2839 bp, Bovine  19866880883098
tgagagctgtgaagagaaaggactggactgaagaactcagagtgtaaacagcaaggctagttaagaaagtgaatctcacacagaagctgacagtatgctgggctcagagggaagcagcagagatggcaattggtatgcagtttttaattttatttacaggtaaaatcaacaagatctcggaacggactagtttggggcagaatggaggagaggatagggagagaaatctaaatttttggtgtgaaccatttttctgagatggacttccatttaaaaaaaaaaaaaaaggtttatgagaataatacaaaaaatttgattcaggcttgttaaggggacattacctactagacagaaaaataaagatgtccaataaggagttggatccttgagtctgagcttaagataaagatgagggatagaaatatgggtataaaagtcacgaatacacagccaacatttaaaattagtgtgtaggggggcaggtcttcactggtggctcagtggtaaagaatccacctgccaatacaagagacatgggttcgatccctagtccaggaagatcccacatgcctgaaggcaactaagcccatgttccacaaactactgagcagaggtgccctagagcctgggctccacaggaagagaagcgactgcaacgagaaccatgcaccacaactggagagtagccctgctcaccccaacaggaggaaggcccatgcagcagcaaagacccagtgcaaccaaaagtaaagtggcaataaaaaagaatgcaaaaaataaaaagatccacctgatgaaaaaacatcccaccttgccaaagcacttacaccagtttgactgtggtggctaaaagacatttaagggggagcttttcaacattaaggcagtgtgataccatgcttgattttctttttcttttgggccagggaatgaagaacagtgctctatcacctcctttttcacatttttcattttccgtttttttttttttttctgttgaagattaacactaattatcatgtctgacaaatatgtatgtatgatttaagtactttgtacattttacaggatgatggtgacttaatgagtgtttaggtagagcactctttccttctctttccacattttagctccatgtatttccacattctctctcattctcgttttctcagtgtgtacttttcataccttaatatgccctctaaccgtagcactacatgttttaatcattggcagtgattaaaataagcataggtgaaaagtctttgattattgtgtagaagatggctatgaatcatgaaaaggattagaaagtttaatagtgtagtgtacagcttgtggttaattttttaaatctcaatttaaaacattactggattttttaaaattacagtcctctgacacctggattgattggtgtttcatctcctgtcatcctttggttttctttgcccactgatttcacaaagatatagacagcaggtagtaagtccctaggaaagtttattgatgaaacactactgcaaataacagttgtctctgaaatatttcatagactgattagaaaaacagatatttaataaaagaaattatacacttgttggtaaaaaaaaaaaaaaaaaaaagaagctttagcaatattgggggggaaaaaaaactcagatgtaggctacacaggtttaggtcaaaactaaacaaaatttaacacctgtgcctttcagagatgatgtcaataaaatcatgtgactgccatatcaactaagaagattataattagagaaggaaagggttcagcctcaagtctactactattcagagaagcaaaaaaagaggggccaagagaggagggtcttttacataagagtaggctgctaagagatcactggattaaacaaacagaagttagaattaattggtaggagcaattcaaatggagtggaagagagaagtcaaggtcaaatgagaagaaatggttgataaagaagagaatgtttaaaaaaaataaaaatcaccagcgactgctagttgactctcattattctaccttcctcttccttttgcaaaattctgctgagcacattgttgcccaagataaagacctttcctaagccaggtgtggctatgactatgttctggtccagacacaagaggtgttaggtacaacttccaagttaagccccttaaagaaagctcagttggagaaagccctttgttcttttccccctttctatttcctgcttcttggaatgctgttctcatggccaaagttacatcaggcaccatggatagtgaccttgagacagaaagtaggtatattcatagacaggaaggaacctaagttgcctggtgaaaccaccataccaattctggactgcctacctccaaactttttgtatccaagattataaatccttacagctttagcaactgttactagcagccaaaccaaatctaatacttttgtatataatagttttgataacacaatattttttttttttttggccatcaaaacttcataaatgttgttggcttgtcttttggaactgtatgtatataactgagaagtttgcagtcagctagatacctgcctcccacttgcccatgttagtcagattttcattttggccaggattccaaaataattctcttcttatttctgaagttaagaactaccagggtgtagtcagtttttcatcgtttcatgaaatttttcctgctgtttagagtctttcagcctgcaagtgttacttttaatctcatacttttttttttccttttttttccttaaatctttttctgttccgtttgttggagtttctattttgggaatacaagt

SEQ ID NO: 30087 - DNA, 2094 bp, Bovine  19866880926881
aaatacttagttcatctaagcctaagttagaaaagtgtaatcacctgtgaaatggaactaattcttcaagggattattgctgggatgagatgcagcgatgtgtgcagggcatctgacaccatgctaggggtctgggtcgtttcagtctgcctgatcctctctcccacctctcccttctgtccttcagcaccttctcctggctcccacctgcctcatattgcttcgcaagattaatgttcttaaagcctgttgtaaaatgccattgtgatcgttttcttaagtccttacaaaatcccgtgagaaaaggaagaattaattagaacatgctaggcccaaaacttgtttgaattaaatgcaagttcagcttgaaacattttaattttgttttcattaagaaaactgtttgtactgattttttttatcctataaatgttgaatcaaaatatttggattaaaatctcaaaataaataccttagggtgaatattctttacactctgtctttagaactaaattgtcaaccttctactttagatataattttgtattatgtccatgacaggttcatgcctccagatgaccctcttggcagacatggcccaagcctggataattttctaaggaagaaacctattgttcctgaacacaaaaagcagccttgtccatatggtaactttctttatagtatctaataaatgcctttaagtagctcaaatggtaaagaatctgcctgcaatgcaggagaccgggttcaatccccacgtcaggaagatctcccagagaagggaatggccacccactccagtattcttgcctggagaatgccatggacaaaggagcctagtgggctacagtctgtggggtcacaaagagtcggacacactgagcgactacactttcagtttttttcactttaaagcacaatattaaacatttgttattaaaaataaacataaaattttggatggcatatagtatgcggttcttttgaatgtattaaattaaaaaaataataattgtttttacctagttgggttcagtgtatattcatttcccctgaattaaagcactgttctaaaaactcagataaatcctacatgaagttagtttccaggtagataaaaacttggagttcttccatctagctgcatatcagattagagtggctttatcacatcacagcagcacattttgctctgcaaaacaaaatgtcctacctgactgcagagttgtactggaagaggagaggcgggtaggagttgaggacgtgaaaggaattattactcagtcagctgactttcttattgctcttgatagcactgacatgggaagactgaaaggtggcatttctcagaagcagggagcagagtggccttgagcacagctcccattcctgcgcttgcttctttcttaaaagtgccacactgagtgtttaggagctggcggaatgctccttttgcctaattgattttactcttcataggaaagaagtgtacctatggacacaagtgcaaatattatcatccggaaaggggcagtcagcctcagcggtccgtggctgatgagctgcgtgccatgtccagaaacacagcggtcaaaactgcgaaataaggaggactggtgaaaagcaacagcgtcccctgcaacactaagggcgacagcacttctgatgtcaagcgaggtgctccaaagaggcaatcagacccaagcataaggactcaagtctaccaggacttagaggaaaagcttcccaccaaaaacaaactggaaaccaggtctgtaccttccttagttagtataccggctacttctaccgccaaaccccaaagcactacatctttaagcaatggccttccatctggagttcacttcccacctcaggatcaaagaccacaggggcaatatcctccgatgatgatggcaaccaaaaatcatggaacgccaatgccttatgaacagtatccaaaatgtgactcgcccgtcgacattggatattactccatgttgaatgcgtattcaaatctgagcatctcaggcccacggagccctgaaaggcgtttctcgttagacacagattacaggatcagctctgtcg

SEQ ID NO: 30088 - DNA, 2358 bp, Bovine  19866880971186
tttgttggcaagtatgtgtctgctttttatgtgctgtctaggttggtctaactttccttccgggagcaagcttaatttcatggctgcaatcaccatctgcagtgattttggagcccagaaaaataaagtcagtcactgatagtctagttctcagtatagaatgtactatactttccataataaatcgtactaatattaacagaaaactttaagcaggaaccaaatgatataaaagtatggtgagtgttaatatgaaaatagtaagttattaatctaagataccccaaatcaaggttttccattattttcttattggagaaagaaatggcaacccactctagtattcttgcctggaaaatcccatggacaggatgccatttccttctccagggggcttccctggtggctcagaggttaaagtgtctgcctgcaatgcgggtgacccgggttcgatccctgggttgggaagatcccctggagaaggaaatggaaacccactccagtattttcgcctggagaaggaaatggcaacccactccagtattctcgcctggagaattccacggagggaggagcctggcgggcaatagtccatggggttgcaaagagtcggacatgactgagtgacttctgagagagagaaattttatataaacatgtttctttctttctgttttttgtaagcagcaattcagtaattttctttgtatcatatttagataattgagaattcatgtatagtattaaacacagtctcttcttcctgaaataaaaataacttgacttctttagttgcattttcaattctccaaaaactgaagaaacagtgaaggattggcttcctgaaacttaattctaagcaacaaaaggtatttaggatgggcaagatttcttaagtgacaattaattggttatacctatattttatatttcgattcaggaaaacagtcaaaagcagagaaatctgatgtttattattcttggataaaagcatgccagggaccagtagaaggtgttgtaaacacgtcttgactttcaagacgagtgattaaggatttgtttaaaagtgttaacatggagctaaaagaatgttgccctctcattctctcagactggaaagacaggaaattctgggaggaaaaaacatcctctggatttgaagatattcctagagaacagtgttctctgggggaaaatttaggcatgatttcatgagtaaaccttcagctgaaactcagaatcctttttcagagaggtttcaaagacaagctgatttgaccaaacatgtcaggactgccagaaatggcattcttatcagagattttttgaagtagtatcaaaaaaattgttttaatgtcgatttaaaattggaggacaactcattttacttagtctcttattctggttttaccaagataccatatttattgctatttccacatttcttaccattcttcaaaagttaaactacagatgttaatgaaatgtccttgttgttgttcagttgctaagtcatgtctgactctttgtgacccaatggactgcagccaacaggcttccctgtccttcactgtctccagagtttgctcaaactcatgtctattgagtcagtgatgccatccaactatttgattttctgtcaccaccttctcctcctgccctcaatcaggatcttttccaatgagttggctcttcccattaggtggccaaaatattggagcttcaactttagcctcagtccttctaatgattattcagggttgatttcctttaggattgattggtttgatctctttgttgtccaagagattctcagaagtcttttctagcactttattttcagactagactctagcatatgataatcaggctgttatattcatattcttaacacaccaagttaactgaatcactgcttaactgaattaaccactctaaactattaccactatgaagcaaattatatttgttaaaagaacctatttcttatcaaagactcacaaatataattacatctgtttttctagtattatttcttactttccctctgaaatagatcctatatattaaatttaattaatcaatgtattagtcaatctggaaagcatacagttctctaggtttttatctctcatatctcctttgcactcagaattttttacactacatttcataaattgtttatggattctactttacctgcttttgatatttcactgtctccttatggcctcaagttcttatgaggcccctacttttatggcctaaaaactgattcatcattcttatgctgaaaaaactcatccttctgtattcttatggtactagattcgtgtcatgcttaacgacgtattttat

SEQ ID NO: 30089 - DNA, 1322 bp, Bovine  19866881019077
tcataaatgcctcttctcaatctggtgggttatctgtcggttagttccatcttcctttcaaaagaggagcaagcaacccaacctggtagatcagtagtactgcagggattggctcagagttgggcattatatccagaggatgagtgagtgagaaccttattcagacatttaatatgaagcctaggagaaggaaaacctcttttcttctgagataagagctcttaggtcttcctctaaggcaagtctttttgaccatgtggagaaaatctgcctgagatggagctaatgcagaggggaagtaagtcaagtgatgaaaaggagactgatgactggtaacattcgtcaggccagtgctgaaagctagtgccagtacttggacttttcatttacatgactcagtagggtctttttgattttggctaatttaaattgagttaatatcataactaaatgtttccttcataagagggaactttatctttgttctacagccatctctcctcacctcacaccaagttaatgatttcagagcttagcttaaatattattctttaggaaggtgcttcttaatcctccaaacaagataagctatctatgttacggctatgatgacatgattcttttctgtctttcccacgtgattctaagctccatgaggggacattgcagtggcctccagtatgcttggtaccttgccaagtgcctgataataaatatttttgaatgaatgatttaagagagaataacttgatgtcaggcactgtgctatgtgttttgacatatattatcacatgtaaacttcacaacaatctggtggcagatgctctgtgatccatttacaaatgtggaaacaagcatggatatgtaaagaaacattgtcaaatgaatctaaagagagagatccaggacataaagtgaagtcttgttccaaatgcagaattccttttctcatgctaccttctaagaacctcctaaatgtctatttgcactgtctcttttccctacaaaatgcttgtcttgaaagcattccctatggtattatgctctcttgagcgtgcgtgctcagtcgcttctgattctttgtgaccctacagactgtagcccgccaggctcctctgtctccagtcaagaatactagagtcggttgccatgtccttttccaggatattcttttgtaccttttatttaaatagatggttcagtaggtttaacatattccagaaatattttcatctttaccttgaacacttgagacataccctctttgtggctccctgtccccctgcaacaaacaagaaagaatatcctttagagtaatgggt

SEQ ID NO: 30090 - DNA, 1273 bp, Bovine  19866881037769
tgggaaacctgaactgtacatgcgaagaaggaagcctgacactattgaagtacaacagatgaaggcccaggctagagaggagaaacatcagaagcagttggaaaggtatggagtttatggcctttctttttcttaatttttgactgctgggtcttgcagcacatgggcacttctcttcttttgttgtgggacatgggctctagagcacccaggctcagtagttggggtgcatgggcttctctagttgcagcacgtgggcctggctgtcccaaggtacgtagaaccccagttccccagccaagtgtcaaacctgcatcctgtgctttggaaagtggattctttaccactgggccaccaggcaagtccctggcctttcatttttagttgataccagtaggttatctaaaatttaagaatcctcatcagtttctatagtatactctaaatttacatttttacattatattcatttaataccatgatatatggttgaccaaaaaatttgtccaggtttttccagaaggtgttacgtattaaaattgaatgacagcatgtgttatcactgtcctcttttaaagtgagtgtgtataattttcaagttagaaatctttgatagatatttctgagaaaatatctttttgagatttcacagatatgcttttcctgtattgtgcttgctttttactgacagactttggtgtggacatagtatgaaatttcaagtttgttttgcttgtgacttgtgtgtcttcatttttcagggtaggaatatgctgaatattttctttgaaacggtgtcagtgacgtgacgtgagtagtcactattcagagtttagtaactctggcactccctgtcagtgacactgatcttttaaaccagggttcacttagactttcgaaaaagatgttaaatatattaaattaagacttctgaaacataaaagtattgaataagttcctcgtttaccttggaaccacattattggctccagcactcataattcccaaatctgattctatactaatttagactttatgctttatttgaaaaaatttagagaccaaatttggagaaggcaatggcaccccactccagtactcttgcctggaaaatccatggacagaggagcctggtgggctgtagtccatggggtcgctaagagtcgggaacgactgaacgacttcattttcacttttcactttcatgcattggaaatggcaacccattccagtgttcttgcctggagaatcccagggacggggaagcctggtg

SEQ ID NO: 30091 - DNA, 795 bp, Bovine  19866881086877
ccggacttctgtgtatgatggttggaaaagataaaacttcaactaaatctcatgttttctcaccttaacagagtgtgcagggaagttaaagtcctgatctgcatctcacctgaacagacaacctgaacagctgcactgtggtgacagtgtttaatagaaagaaactgtaaagtaaaaaaatacaaagagaaaaataaaaatcatttgtcctcctactcccagacataaatactgataatattttgaagtattttccttcagtctgacttcttttcttctttgtatctttttaacttaattttaattattctgttttggttctctctaagtttattttcaatcaaatagaacaagtcccagtatttaaaaaccaagagacactgtcttgttatttctccaaattaccaaatgacaacacagagccttcaatctccttgttctgcctcttctctaaatcagtctgtctcttttctgatctccctgaaatcacaaacctctgaattattctgatataatttaaagaaaaatgtgattaaagaataataatttcaacattatggtaaactctgaaaaaaaaaagcatagctaatacaccaataaagtacataaaataaaatattaaaaacttccaataaaagattaaaataggaacaaagaaaacataaaacaaacagcaagttagtaaacttaaacccaactatataaatgattgtattaaatttaaataatttaaacattccaaataaaagcaagataatcaaactagacaaaagtaagacaaatcatacactgtat

SEQ ID NO: 30092 - DNA, 784 bp, Bovine  19866881179575
agtcctactggagcacacaaatgatgacagaaatgcacatgtgtccaggctagcagaaggactttctctgtaaaagagcaaacaccacacatcttcagtcaaatgatcaagcataggattgtttctacagagattatattttaaaattggtcaagaaatacaaagctctctctctattttttaatgcaatggcatagtttcctaacaggtcccttttcatagtaatgaaaacttacacatactcctttgtgtaagatatttttttactcagtacttcttgttacgtttagtctatctcgacctggtaggcctcaatatctcattataaacttttttaaacaaaaagcaaaaaatttttataataaacatatatatatcccaacctagattctactatcaaaattttactatacttgctttatcacatatctatccaactatctattaacccatttgatttttggtgtttcagtacaaactgatacagcagtacatttcaccctgagtattttagcatgcatatcatgtacaatgaaatgtaaaattctaggtatatatttcatgagtgttgacaaatgtattcacttgtgtgatttaaacccttatcaagatgtagaacattatcatcactccaaaaatttttcctcttattccttttcagttgttatattagataaagatggcttctatgtattggcctgagttatttcttcattgaaggctgagatccattagctccaactaaatgttgtataaaccaacatttttatacactcaattatta

SEQ ID NO: 30093 - DNA, 2712 bp, Bovine  19866881200994
cagaaatagatgtttttctggaactcttttgctttttcctgatccagcggatgtgggccatttgatcctggctcctctgccttttcttttcttttcttttcttttttttttttaaatatatataaatgagattttattgaaacagactcacaatcatgtatgtatagtctatgactatattcttgatgtaatatgagttaattagttgtgacagagaccatagcttgcaaacctaaaatattatgagaagaaattgaagttctttaaaattccccccattcctccctatgcatatttggaggttcattgaggaaagttttaagaagatacaaatccattttatgggtagccctctaagtcctcacacactctgccttttctaaaaccagctgaacatcaggaagttcacggttcacatattgctgaagcctggcttggagaattttgagcattactttactggcgtgtgagatgagtgcatcgtgcagtagttcgagcattctttggcattgcctttctttgggattggaatgaaaactgaccttttccagtcctgtggccacttctgagttttccaaatttgctggcatattgattgtagcactttcagagcaccatctttcaggatttgaaatagctcaattggagttccatcacctccactagctttgttcttcacattgacttcacattccaggatgtctggctctaggtcagtgatcacaccatcatgattatctgggtcgtgaagatcttttttgtacagttctgtgtattcttgccatctcttcttaatatcttctgcttctgttaggtccatgccatgtcaatacgtgttagctaccattaaatcacaaatctatcctcttttcccatttaaaaccattttgctaatttgacaatgctgcagatattgagaagttgtgatagcaaataaagatttggccaaagctttgctaaatggacaggcgcaaatctaagaacaatatcatgggtaatgaagtaaatctccttctatcctttctgatccccccaaaaaatcaatgggcaaagataaatgtaatatttgctcagagaaactgactttggggacattttcttttcagccttaaatgattttgtacctaggtaattataagtaagttgccaccattctgtgttatttaacggcatgcttagatttcagctttctattaacaagttctattgtggggaagctgtctttgaatagcagaaaggactacaggtgccctgagtgacacagtagctacccagctcttgtccatggtatcagctaattctataataggattattcctgctacgcaggaataaaatctcatggttagttgattattccttgtttaacttacactaatcacagttttaaaacaagacatatgatgtacagcatgtgtaccaatggcccagggtcttcaaccctcctctcctgggacaatgctaagtccagcttcaaagtgtaagacatatatattttctaagtgaattagtgtttcacacagtctgtttgtgatttataagtaaattaatccatacaggttgaaactcttcttactatgagctgtatctattttctagctgtagatttgttaaaatttgaatggagaaagcctccctgggactttcattttattggcaagacctagaaagagccaagataaatctccctgtgactaaggagcaaacttttatttcaggagaaattactttacatctaaattagcttgtatctctagaaatcttatctcaggtgtgataagccataaataattaccaatttcatgttagtaaaattaaaaccatgaaaagctactcaaagcaatttacaacttgacagaagaaggagattctgttcaaaagatagtatatttttccttcactgaatttagactaaggctcagagaggatgaaaattggaagaaaacaaactaaaattttgtcttttcttccctggaacttcaatattcaggttgagtgtatgcttctttttccccaagtgaaaagccagctttcaaatcctttcaagcattttcttttcctttgaatgctttcaggaacattgcgaggtcattttctttggatttctatttcctaatttttctgtttggtttgtactttgacataggtgccaaactacagtatctttgaagaaaagcaccttaaggcttattgcaggttctcattacatagtaaatgttgctttctggagccatcaaactgttaactcaaatgctaagcttctatcataagccatccattcacatagatgccaggcacagctggacagtgcctcacgataagcagtgtggattgtatatctgccctgaaggagacatttatttgtcttaggtttctcctgccaacactcgattacaaaccaagctcccaacactgtggaggcactcactggaaaggcgagccacctgcttagctcagtaatcagtcttttattccaatctgttcttgctgttggcatttcttctattcttaattatcacacttgtcacttagaccttggtaggataaatggcatagctcacattatgctgcagaatcattttctcagcaaatactctctacagacatagaaatacaaagaataaaaagggggaaacgtcagctaagggtaggccagggaaagagtatcttgagatgagtgaggtaagccctgccagctctatccttggttcat

SEQ ID NO: 30094 - DNA, 970 bp, Bovine  19866881256521
ttcatgctatatttttcactaatttacaataaaaacaatgtaccatggcagcagagtttcatgaatgctttaaaaagtttatgctccttacataaatcactggtttagtctcttgactgagggaaagcagtcagagacactggaggtggcatttctttccctcttcggcttctgcctcaccctagcccagctgtgagtcagtctcggtgtttatttctctcaaagaatccagcccaaggcctgactcctaccaagtccccaatcagtgtttggtaagtggatggctgaatgaatatagtttccacagattaaattgtgggatgagtaatttctgttaacgaggtaaaaatatgggatatttattatcaagattccattggtctacataggggtcatcacacatctttggtaaaaggccaggtggtaaatatctgcggctttacatgccataccagctctggtgcagctcctcaaatctctctttatagtgtgaaagcagccatagataatatgtaaacaaaccagtattcccataaaattttatttatggacactgagatctgaatttcatacaattttcatgaaacagtcttttgatttttttctaaccttttataaatgtgaaaaccattattagcttcaggaccatgtaaaaacagatggtgggccaactgtgacccaggggtcatagtttgctgaccacgttcattaagtattttagtaaaaatctagtgctttaaaataatacctgcctcataaaatttttaagagttaatgttcgtgaaaaaaaaaaatatgtaaaaggcaaataccataaaggtgtcaggtctcctaaattcacacagggtcatgctttaccactggtgagcaaggtgttttaaatagtccttttaaaaatgatttatattggataaaagcagatggaaatattcattattcattttgaagttctattttcaaccatagtcag

SEQ ID NO: 30095 - DNA, 922 bp, Bovine  19866881312513
atttacctgcttcttagcagggcttattctctattgcctgtcccccttgagtggacttgggcatggctgacacgggtgaggccaaatattctgggttctatcagttgccttgacaatagctcattccagtttttctaaagttgaggaaatcctcttccaaatgggaaacgtgtttggcttgcagtgtttggctaaactgcaaactgttccgaaggccctgagacagtttttcatgtgtgtttgaagggaaaacctgcccctctgaagatctcctgacttttttggggggggaggtcaaaactagtggccccaggcattttcttttcaggaactctcttcccaggcctccatcgagagcagacattgggagtctgcaaggaatgaggagtgagggaagcagtctagccaccccaagggttaagggcagcaggaacctggcagaaatagtcctgctgttccctcaacaggcctcacctgtcagcccagtcctacaccacccccacgtatcccagagcagagaagacggcccttaccatcaggagggtggcagccatgtgactggttaacttaggatgtgctcaaacagaccagcaccagagaacctgtttttatgcaatagtttctgtgctatgtgctgagataccgtgtgtctgctctcatggaacttacattccagaagaggaacaggagaagaaaagttccccaggaatgaatgatccaacactgggcccctcctcagccccattcctcctgcagatggagtcaccacgtcatgctcttcaatgactcactttgtgggtgtcctaacctgatcctcaagtgcccaaacactgcctgggttacagtctggcctccagcctctccctagaccatgctgctccgagtacagatactagccaggagtctttccaaatttcccaag

SEQ ID NO: 30096 - DNA, 587 bp, Bovine  19866881411811
aaagaacaagataagcagtggagaatgaatttgggaagagcattttcatacttggggaaaagaatccatattggagagtaatgggagaatacttagggaggagagagacaagttaacaggtaccttgaagtgactgctggttcactgaaaaaagtctcattaaagcaagtgtttaaaatgttttagatgttaaatatagcaagcgtaaataggagaaagaaatttagagatgccaaaaagcaagtagagtttaatcctctagcaggccttctagccccaggccttcaggactttcccctggtacaccccaacctctagcacctggaaagagcaaatatatgttcccttgcttgttctgcatgaagtgccatcttgattttctttttcttttgcttccccataggatatgcttttatttcttaatcagaaaggacctctcacaaaaggcatcttcagacagtcggccaatgtgaaatcctgcagagagctgaaagaaaaactgaattccggagctgaagtacaactagactgtgaatctattttcgtaatagcatctgtcttaaaggtaggaaggtttctcccttcat

SEQ ID NO: 30097 - DNA, 851 bp, Bovine  19866881554128
ttttcttagtgccatattcgttcagggcaatcttttactaattacaagtaaataagaaagcattttagagattaaagttttaaaaaccaaatctttaccatttgggtcagtaaaaataagttatttcaaatttatattatgtaatggagaaaatatatgcatcttacaggtctggtaattaaacttatttgttgttatatgtactgtttcatatttagtctgttgatttataggaactaaaaattatttaattgcttgcttggtacaagatgacattggataacattctttgaggtaaccagtgaaatctggaagatgaaaagaggcctgtcagtgtgaaaaaaaagttcaaccagaatattttaaaagaaaagttgttttgcctaacaaaattaggtataaattttttgaagtagtgtaaatcaagcttacacttatacctaatattaaaaatcgtgttagcttacttggaaacattttagtttcatagtacttatatgaattatcacaagctaaaggtgtggtattcactcagtacaaatgagttttatctagcttaatattataaaaaggaaacaactgataataccattttatccctatctaatcattatagtcctataataaaattacacagagcagatttacatagtgttaccaacacttttagtatgagactgaaagtgataacagaaaagatttaaatacgtttttaggctggttaattttcagtttaaaaactttataatatctggttttacttcaacaaatgtgaaaattctttaaacataatatttcattctaatgttccccacggctgtatttttcataaagtgttcatttgtttaaaa

SEQ ID NO: 30098 - DNA, 1389 bp, Bovine  19866880158073
taaactactgcacaattgtactctctcacacgctaataaagtaatgctcaaaattctccaagccaggcttcaacaatatatgaaccatgaacttccagatgttcaagctggttttagaaaaggcagaggaaccagagatcaaattgccaacatctgttggatcatcaaaaaagcaagagagttccagaaaaacatctacttctgctttattgactacacaaaagcctttgactgtgtggatcacaaaaaactgtgggaaattcttcaagagatgggaataccagaccacctgacctgcctcttgagaaacctatatgcaggtcaggaagcaacagttagaactggacatggaacaaccgactggttccaaataggaaaaggagtacgtcaaggctgtatattgtcaccctgcttatttaacttatatgcagagtacatcatgagaaatgatgggctggatgaagcacaagctggaatcaagatttctgggagaaatatcaataacctcagatatgcagatgataccacccttatggcagaaagcaaagaagaactaaagagcctcttgatgaaagtgaaaaaggagattaaaaacattggcttaaagctcaacattcagaaaaactaagatcatggcatccattcccatcacttcatggcaaatagatggtgaaacaatggaaacagtgagagactttatttggggggatccaaaatcactgtaggtggtgactgcagacatgaaattaaaagatgcttgctccttggaagaaaagttatgagcaacctagacagcttattaaatttgcatctcctgcattacaggtagatttttacctagcaataaatacaactagcagaaacagacccacacaaagtttagtttttagaattttccatgtagaacataaaaatatattttcaaataatacattcaataaataaagaagaaattgaaaatataactaaggaatgaaagactgggtaatttgaaaatgactcaaacagaacttttaggaataaaaatatataatgattgaaatgaaaattttagttgttgaattaaagagcatattaaacaaagatagataattataattattaaagtataaaatacatccaaaatatattttccataatgatgtacagagaaatagaaaacacttaaaagaaggtaaaagacatgaagtaacaagattttatgtgcctctaatcaaaattccagaaggtgacataggatggatgaagtaatatttgaaggaaaaaaggtttcaattttccctaattgttgaaattatgaattttcagcttccaaaatcacaacaaattcaaaatttcaatccctagacaagtgagagtgaaaatatatattatcaaaggaaaaaatat

SEQ ID NO: 30099 - DNA, 5488 bp, Bovine  19866880167740
atatgtttcattaggtgcaataagcttagtagctcatgttttgaggttacaatgattatgagcctttccaagattttgttgacatttccacatttatgttatggatttgacagttaaacttgaaatctcaaggagaaggggatgaagttgtagcctgaaaagaaattattttagaatttttagagaaaatatcaatgataaatgtttatctgcaaggctgataggagtgcaggcttttttagatctatgcacagataaccagttaaagcacaaagcaaaacaaagatgtatgcatagttgaaataattagctaaaactgaacaaaactgaaactgtaacagtggctcctagcaaataaaatttaattttgaatcagaatccaaaaactcttgagtgtataagctccataagttcactttttcagagtccagtgtgatattcaaactggccagaattgctaatatagatatatacacactgggtcctttacaacctgagtaggaaatactgttaaatgttaatgaatatgcaaatcagtgaacttgtggttgaaagtttttatggcaggttggcctatttgtaattcttctttacatttgtccagagcagcaaaatttagaactgctaaattttttgatacaatatgttctttttttgtttttgtttttgttaaaaaaagcttctctcatggctcagtggtaaagaagctgcctgtgatgcaggagacacaggagatgcaagttccgtccctggccaggaggatcccctggagaacgaagtggcaattcactccagtattcttgcctaggaagtcccatggacagaggaacctggagatttttaagattttgtatcaggcattagctgatttatagtacttagtttcaggagtacaacaaaagtgattcagttatacatacatcatttccttttcaaatgatttttccatttaggttattacagatttttgagcagaatttcctgtgctgtacagtaggtccttgttgtttatctggtttagaaaagcagagacattactttgccaacaaaggtccatctagtcaaggctatggcttttcctgtggtcatgtatggatgtgagagttggactgtgaagaaggctgagcgccaaagaattgatgcttttgaactgtgatgttggagaagactcttgagagtcccttggactacaaggagatccaaccagtccattctgaaggagatcagccctgggatttctttggaaggaatgatgctaaagctgaaactccagtactttggccacctcatgcgaagtgttgactcattggaaaagactctgatgccgggaggtattgggggcaggaggagaaggggacgacagaggatgagatggctggatggcatcactgacttgatagacgtgagtctgggtgaactccgggagttggtgatggacagggaggcctggcgtgctgcgattcatggggttgcaaagagtcggacacgactgagggactgatctgatctgaataatgcatatttaaacagtacaaaatgaaaagaaatgtatggaatttataaatacaaattcagagttgtgagtacttatagtggggcagggaggggatataggtgtcttgtcccctaacaccttattctaggtgtcttaaccaatgttgattttgtttcatcttctactaaaatgaagatacaggagagtttgttatattattcattatacctttttgtatgtcttagatgttggtaattctttttaattaaagaggtctactgagtacataaaataattcataaacaaaatgggagattatactcattcttagatgagagatgtcaacactggcatcttttcctttccctaggactctcaggtggtatatctatcatttccctttctgctttgtactgagactacttaaatatttatgtggttatatgtttataagacaataaatataaaaccaaggttgaaataggaaaatatttgcctgtttatttaaagaggaactcccactgtttaaaagaaatcctagagaatcaaatgggcttgattagataaaaattttttaaagaatcttccatataaccaaagcattataaaaattcaaaatacaaatgaaaaattagaaaaatatttacactaacatgggaaaggattcatacacttgatacataaaaatgttcataaaatgtacataaaaataatcaataagatcacagtgaaaaattcactaaagaataaatacaaatggataatgaacaaaacaagctagccttactaaagttaattaaaacagcaaggtgaatatttgttaaacctgttaaataagcaaaaattaaagataaaaattttagccagaactctgaggtaggtattctcatacacagctagtgggagttttattgagtaaaacttttggaaactaatgcgaaaatatatccagagccttaaaacaaataactctgaaatggtaatgccttctagagatccattctgagaaagaaggcataaaaattcaaatattcatttgtatggacatccgccctcacctgcatatttatttattccacacactctttgagggcagagatttaatcaatacacttcactttttctttgataaaactttccttacatttttgtggctctcacccctagctgaggaagactctgcagaagaagaggattgttcttaccttcagaagcgaagatgtaatagatacttatttatttttgtttgtttgtttttgccttttttttttttttttgcattttttaagatgcttatttcttgttcggaaagaaatgagttctttcaaactcttgaagcatggatttttccttaaaatctggagaaatccgtgtccgttctctagtgtaacttgaaggcatgtggcatcctgttcctgccaggcagttttctgagcagcttacctgtaatctgctatggtttgaagctgggtttctccaccttagcactctcgacgtttggggctggatggtgctttgttgttggggctatcttgtccattgcatccttgggctttatccattagatgccaatggacaacacacagtcatggcaaacagcaatccctctgaacagttctgcctccctggaggttgagaatccctggtttaaaaagttctttctgagagcatagatttctttttcctctgggctggggacataaactcttcttttggtggaagagtgttgatatgacatcataagaagagcatgttatgctgtgctcagaggcttagtcatatctgagtccttgagaccccatggactgtagcccaccaggcacctctgcccatggactcctccaggcaagaatactgaagtgggttgccatttcctttcccaggggatcttcccaatccaggcaacaaacctgtgtctcttatgtctcctgcattgacaggcagattctttaccaatagcgccacctgagaagcctcaaaagagcatataggatggaattccactgagaccaacttggggaaatgctacctgccatgcccactttgctactaacctgctgtgtgttcctgcattggccattttccacccttgaccttaattttcccatctgccaaaattaagaattttagctagaatccatggcttttaaaattgaagggcttctctgattgctcagttggcaaagaatccgcctgcaatgcaggagaccccagttcaattcctgggttgggaagacctgctgcagaagggacaggctacccactccaagattctggcctggagaattccatggactgtatagtcgatggggttgcaaagacttagacacgactgagtgattatcacattcattttcacttaaaatcgaaggctctgtaggggttgctccaagataagggggactggccaggcaatacccctctatcttctcccaaataagcttcactttgatctgttttacattttggtgtttcaaagaagaattggaacaatgtaatcggacgtaggtgtgatgacctggtgccctgagaaatgttctggtgataatgcctgttctgggatgtctgtgtgggtccttaggaccagtgtgaagggggctgaggttttccctggaagggaatttttgctcctagtgaagagccattagcttgagggcaggagacttgacaggcctatggcctggtccacgctgatgggcctagactgggaggcccgtgggagccattgaatgtgtctgctcttgttagtgggctgctctgatacctgaagctggcatggagcccacagtgcccaggtgacttggtgtacaccgacaacagcagggacagcagctgtggagtcttctagcttaaatgtggatgtgtttgagttttattcttactggaagatgggccaggatggatcctaggtcacaaaaagagttgatcaagccctgttaggcgcctctaggacatcatctatctgaggaaggagctatgcccattgggggctagaggtgaggggctacagggacttagagtcatccttccttcccagcatcttgttttccccaggttaggaatttacagacataactaggacacagccttacaagtaggtccatgagggagatcaaatcaggaggcagttggactccatttttaaaattgaattaatttttagaataaaggatattcccaggggaaactgcagttctggcctcctcatggtgaaggtcttcacaaacggtgggacacctgagttgggtgtctgttcctcaaggactttgcaaaaggggtcccaggtatggctggatcaagaaccaggtaccgccaacccctccatgcatgaccctggcttccctattatgatagtgcttatctcctgttcatttttacagatgatcacaaacaaggctgaacaatggtctgtctctgctttttcatccatgttgtatgtagatgttgtcagaaaaacatccttaaaaagtgattctttttcctccttcagcatgactaaaggtcttacagagaggaggtgagaaaaatctcctggcttttaatccatttgaaatttgaaaagttgttttcatagtgtcatttgacattttgctatcttttccagatctgttttattttttctctctttttgagcctacctgaaatcatgagatctgccattcccacagtgggtatgacttcagacatcaggggtctgagatggagatcgttcagtgaaagagctcattagcacgatcaaaaggctccgacagtgatcatctcaggatggagtgttgagagccactctgggttcggtcatggcctagggaatctctgctctgggcaactggacaattcccaaaacagcttccctgctgggcatggtgatcaggagctattttaggaagcctgagcatcctgaagtgagagttttgacaaactggacaaaaggatcctaaatgggtgtgtctccaagttcttttgtcagcagtagatcaggagatgtgtccagaa

SEQ ID NO: 30100 - DNA, 986 bp, Bovine  19866880232377
tataactgcttttgtgctacaatagcagaattgagtagttgcaacagaggcgttatggccaaccaaacctaccacatttactgcctttactgaacaagtctgtcaacccctactcttctagattgctttgcgctggccaggtaaagaagggttcaaagtatgggcagaagccagtgcaggaaggaatgagggaggaatactctgagctgagggaaccaaacaaacagaagtacagaggtgggcatctatgggttgaagtgatagagagacccacctggcagcagggcgattgtctgaagaagtggtgaccatgtggaaatggtgtttttgagttgggtgcaagaataactaagcgcctaaatgccaagtgaagaaatgaggactttctcttcatagtcagtagaaaggagctttattatgataattattgtcaggtgttttgctttgttttagtagataagtaaatcaaatgaaagacatagtcaagaataaattaccatttttttttaatctcagtaaagcagtcattttatttcatataactagataagtttactgtggagaaagaaaaccattagctttttacaccatttctataaatgtatccttccttttcattcatttcaaagaaaatttaacattgttatttatagtttcttacccagaacatacttgggttccttacacctgtgatccatattttcttcatgtttattacttgaagaatcaaagccctgagcagcaacagagataaagaatgatctttggccccatccttttttatttacagggtgtatgggtgttgtcattttgatatgcccaaaggttaaagcttaaagacagtacagaaagtgcagtcctccaaagaggtaaatacaccagggccagctcccagggaaatggtatttgatacttgtgctcctggccatcagccatttgagtctagtgccagggctacaggtcagcctagggaaagtttaaacaag

SEQ ID NO: 30101 - DNA, 3756 bp, Bovine  19866880341497
aattattccttaaatatgagaggacctaccaaaagaaagatcatgcccaaattaaacacaacttggcagggacatgccctatagatgtgtttctgatactgcagggcgattgtcacaagtgttactgccatttctgttcctagctttgtttcttacctgaaacaggtgttttcagggcacaggaagcaatttcttaatagcaactactgtcatcattttgcaagtgaccataaagtatcaagtgaccataaaagagtttgcctagcctgtttttgaaactcctccctcctctatttaattttataatgttatcagaacccattaccagatgctttccattttattaactttaaaattgaaatttgaaaatgttgtttgtttgtaatcactagaaataagaatgagaataagctagacattaagaccaggcagcctcatctgtttccactgggacaaactgtttaaaaggaaagatcaactttaaacttgtaactcccttaaaatctgaagtgatgccttttggaaagttttgcatttattgcgaattatgattttgactcattttatgatggctacttaataaaatgcaaaagagaactgaatcaattcagaaatttggattctctaatcttgccacctatggtttgaccttccacaaataatatacaatcctttgagccttagtttgcacatgtcttaaaaaggattaatagttcctattggtgctcctggtttttttgtgaagattaaatgtgtggtcctgggaccagacttaaaatgctgatgtttaagggagatataagtgctttattgttattgttcatgtttttgaacccccatcctcttgactggtcccagtcccttgaagtaatgcaaaggaaggtcatcgatccaaactttaggctttggagactttctatccctcctctgaagctccaggagcataagaatcccaccttatctcagacctggagtccaggcacttgaagttttctacctattgctcatggttcatttccttttcacctctgcctgacgctgacccttaccaaaggcaggggagaagcaacagactaacaaaacataggtctgctttgaagtttgcaggctcaagtcagccatttgatacagaaaccattttcttttccatgatgacaccgttatttatttgtgacccaattccacccaacttctcctcagactttcctacaaaatagtgtttcctaggccatataggggtttcccaggtggtacagtggtaaagaatctaccagcaatgcaggagaggtaggtttgatcttctgggtcaggaagatcccctggagaaggaaatggctacctgctcccagtatttttgcctggaaaatttcacagacaggaatctgtcagtctgcagtccatggggccacaaagaatcggacacaactgagcgactgagcacacacacacatacacaggctgtatatatagctctgccccatatttactggttatattatttttataattaagctatttttcttttgaaccataatgtcgggtgcaatgtctgggccgcactgagaggcaaatgcagggtatgactttgaccaaagacctttaacccttcctgattggatttctaccacacagtcttctgccctactcttgtggtttaagggaataccaataattccatagttcaatctgtagtctttctctccatcatccagatgatcttcagagtttctcttaaatttagtactttaatttcttctattttttactagctaaccttataactttttaccttttcctatactgtagattaagaatagattgagagtcaagaaaactgtgttacaggtttaagccagcaaaccttctgaggtctctcatctcttcctttctgtaaaccgaggaagaataaaaatccctttctgcttatgttatctgaaaaactgaccttttcccattagtcacagggacagagatggaaaaaaaagttttctcctgatttgaaagttcagtcacacagagaggattcccagagcacatcatttctattcccatttctattcactgactaggcagtacgtttccatataaatatttatatgtctacatatgtgtgcattgataacatttaaaaaaataatagttttcctcttgagaggagcctagggaagctttgaccttcatttgtccaaagaattctcatcatgaagtgaatatcaatgatgaaggtgacttgtggaaaagcaagtgattatttacatttccaataaaagtatgcctttcaatattatattttaaaaatagagaatttttctctggtggaaataattcagaagtttcccttggttttaaaaggcacatcagaacttatgtaatccacaggtgaggccaatatgaaccaatctggcaaaaatctttggccctcacactaccaagtgtcaggctctgcttggttcaattccctggcagtcctggctattccagactctgttgtatgccttgggcagagggcgatgtgtcagggttaaagttgctatttttttaaaatagatttttaaaaaattaggataaaagaaatatataaaatgaccagttatttaattcagcattgagccggccccttatgttaatagttacagagaaggaactctctgcaactgtgttgcagagaaaggaaagcaaaaatacaggtgtcttctgtgacaccatggccatgtatccccatatttgcccacactctgggccattaagcagggagttgaggagggttggacagtcccacagtacatggaacttgtgctgtgggacttgaccacagcttgaccacctccccctttgaaagacagaggtcacagctctgctgaggtataaagtgacaggggatttttgaagacatggtgatgacacctgcttctgtccctcatcagaagaaaaattacttcctatctatccatgcctaaatcatcatccttttcctcagctgctgattcctcctgctctggtgactttctttgacagcagtaggtggtacatggctcatgatagtgacagggacatcacattctaggttttgaagttcatggctgtggggaggtgcttgcgtgtgtgctaagtcgcttcagtcatgcccgactctttgtgaccatgtggaatatagccctccagactcctctatctatgggatttcccaggcaagaatattggagtggattgctatttctttctccaggggaatcttcctgaccccagggatcgaaccccaaagtctctttcgtatcctacattggcagataggattttaccactagtagagaggtgaagaaggataaaaataaagtgaagacagttctgatggtaaacactaatgtcatgataaagcaccctacatcataaaaccacatactgcgtatacagggattaaaaaagtgctcaagaaatatttattgtgggaataaatagatgtattgtaagaacacatagcagtaactcctttatcttcttttcttgttcagttttgtcactttgtgttataaaatgggcattcgtaaagtattgtcaacgttggagggatgggagctgtactatttggggcactttcatataccagctcccttcccaccttctgacaataaggctgtgcacttcctcctgctgagcctgtttccataatcaggaggacatgagctaggaaagacccttgaatggaagcaatcaattgtttttaaaatttttattagagaaggttatttacaagattgt

SEQ ID NO: 30102 - DNA, 1314 bp, Bovine  19866880380130
cttttgatgaaagtgaaagaggagagtgaaaaagttggcttaaatctcaacattcaagaaactaagatcatggcatccagtcccatcacttcatggcagatggatggggaaacagtggaaacaggggctgactttatttatttatttattttggacaccaaaatcactgcagatgtgattgcagccatgaaattaaaattattccttggaagaaaagttatgaccaacatagacagcatattataaagcagagacattactttgccaacaaaggtccatctagtcaaggctatgttttttccagtagtcttgtatggatgtgagagttagactataaagaaagctgagcactgaagaattgatgcttttgaactgtggtgttggataagactcttgagagtctcttggactgcaagaagatccaaccagtccatcctaaaggaaatcagtcctgaatgttcattggaaggaatgatgttgaagctgaaactccaatactttggtcacctgatgcaaagagctgactcatttgaaaagatgctgattctgggaaagattgaaggtgggagaagaaggggacaacagaggatgagatggttgggtggcatcaccgactcaatggacatgagtttgagcaggttctgagagttggtgatggacagggaagcctggcatgctacagtccatgggattgcaaagagtcagacaggactgagtgactttattgaactgaaggcacacaagcctcctgagtcaggcttcccatccctgcctcatgtcccttctctctcctctatgacagaggctgacacctctgaactcctgatcctgcccatgtatctgtccacttaccagtctgagtctccagtagctttaatctttttatgccctgttccccatcgatcacagtaagagtaactgcaatgtctgtattaagaggagattgtgatggcccagggaaaagtggcctgtgtaactggtgaatttcctccaagcacagtacagtgatctgtacatgctcactgtggctcctgtttttagatcattctgaggtgggcttgaagggattggcagaggatgctcaggaaaccaataaagataattaaaagtttagaaaattagaaccatggaaaacaggtagaagaataattattcagccaagagaagaaaagcctaaggggagatataagagtgaaaaattatttcctagaggataaactcagaccatcctccattaatattgagaagaaaacacagaaaaacatgtaggatttatatttgccaaaggaaatttatatttcccagataagggat

SEQ ID NO: 30103 - DNA, 2298 bp, Bovine  19866880399652
tttacatactctgttccatttaaagtgtttctcagattttgagacgtagctatgtctcttcttttaagggtaaaaaaaaagaaacataagatagaagaactgcataatttatcaaggataattaaaatattacatcttttgtatgggaggtttgagaatcttatttaggatttctcacttttctacacctgctcataacagtgtgtatttacaggcttgaaattggttgaatgaccttatccaaagagtttgattaatgaaatgacacccacctagagggaatgctgaagtttaatatatcagtcaaggaactggatgacaaacagttctatgattcaaaccagcaggtgacagggcactggcagaataagtagactagattagaaaaaatgatcaaagcatgtatttttaaaaaatgcagacatgtcttgggttttacaagttaaaataaggttaaatataatttctatcatcataggcaataaaaaaattagaatgggagaggcatggcttaacagtagcctatgtaacaaagtatagttttcagtacattcaatatgaatgaataaattggtgtgattattaaaaacaaatgtaatcttggcctaaattactagtgtacctaaaacatgaaagctgatagtatagttattttctgagttggctgggccatagctagagtaatgatttatagtgcaaaatccacatttcaagacaaatactgacaaaatactgactggggtatcaagccatcttgaagtcaagtcaactgagaaatgacttgagctgtagctatttgccttgagaagaaaatatttaggtgaattatgccatgtacctttaaatatataataggaagttttggtatgtccataacagttggagcaataatccaaaactataagcttaagagaagttatttcaggtcactgaaaggaaaagttttcaaatagtcagacttatcaagacatagaaagggttccccaatgaggtaatgagtactccatcactggaggcatacaagcctattctagacaattcattggcacagttgtaggcaccaatccagtgataatcaaaatcaataacattatcatgacattctctttcaaaactgagaaaccacaactaaatggataagtgtagattttaatcaactcacagctcaaccagtcttcactttacaaggtgtaaatactgaattattaataactttcctgaggcatggtgaatcaggggatgcaaagatctaagaaaaagaagtgtgaggagtttctggctgagtatatccagcttgcaaccattaattaaattttcaacagtccatttcatgttacctgcagaatcacagccacaggcaaatgtagaacacaaataagttataaatacataaacatttctattacactcaaggtttgtgattatacatgtggaaagggtagattgctttaagatttaggtgatgtgactggcaagcgattattcatgtggcattaagctttaaatgatctataagagtaaatctttggtgtaaagaagaaaaggaagacagatgttcaatatttgcccagtatattttttgttcatccagcaaagtttgcagatttagataactgaccattctgcccccaaagaattgagtatctttgtcttctaaagcattgtttccttcctaaaatggtctgcactgcattataaacaatgcttctataataaaccagtgagaaacgggcttttcttactggaaatgctacttgcatctctttaatggtttgtaactcaatcttttaagtctcagaaatgcagctgggataacaagtttgtcaacatgagttatgtgatgggtcttaggtattttacaagccacacttaacttaatccctttgctttctgagctggtcctccattacactgtaccagagttcacagtagccatttttttctcttcttaacttggtcactctcttcctatgttgttttataaaattctttgagggcagcattttaattatgttgagaccattatataacatttttttgcatcaccagctagaatttcagtagtggagcaaggcagaaagtgaaatgactatggagtcaagggtcagctcagttcagccactcagttatgtccgactctttgtgaccccatggaatgcagcacaccaggcttccctgtctatcaccaactcctggagcatgctcaaactcatatccattgagttggtgataccattgaaccatctcatcctctgtcatgcccttctcctgtcttcaatctttctcagcatcaaggta

SEQ ID NO: 30104 - DNA, 975 bp, Bovine  19866880462162
ctagcaactatatggaatggaaaaatgccaaaatcttctgtcctgttctcttgcaatctagcatcaatttgaaccaaatgatggagggcctgacatgctagcctgagagatgcacagtgaattaatcccaaaactgtcattagctatttccttgttgtcaaggcaaaatcatgtgggatgaccctcccttctcacaaggaagggaaaaagatgcaaatgaggatatttttaggtgactcatctgctcttggtttgtggatagaagcaccaaaattaaagttcataactagcatgtgaagaagaaatacactaaataatgaagaaacctttaagctgaatccatgtttttatttccagtaataaaattatccctaaattaacaaacagttctatatttagtgaatattttctaaagaacttggagatgaaaaaataataaacaaaatattacttaaaatttttaatccactattttgacataaaaagttaaatttttctgagatttctctgtatgaagctaacagaggtgtgctgataatagtgtgcatgaacatttcaggagtttccatagccattccacttccctctttgcagaaaattctgattaagggagaagaaaccttaaaggaaagaagaatatgtgagtggtggtaatcaggaaagttttcaatgtttattaatttttgatctatggataactttaagccagttataagaaagaaatatataagtataaaaataaaatgatgcaatatcatcccttactactggtacgtatgccagtatcttgttggtcttgcctttcctggtttttcagaaatcagcagcaaatagacatgtaattttggaaattcagaaaacccaaagcactgatgctggatgaatttggaatattttgatataaaatattagtagaaaatggattggaataatacttgtgaactattgcattttattaaaggcactttttttcat

SEQ ID NO: 30105 - DNA, 1651 bp, Bovine  19866880497413
aattgctctgcctcctatgttgtgtgtttgttgttaataatgtcaccatctattcagattctatttttgtttcttacatacctttggttcttatatccaatatattgacatcaaaaccaacattaatttttcaaatctcactcccaaattcctatcattggcctcatcatgccttgcatagacttttacagtaactttttaatataagactctccctactctaatcattaatcttcctacattattgctacagtcatcttcttaaggaccgatttgatctcatcattcaccagctccagaatctctattggccccgttgcatgttgcataaagtccaatcttggaagtgttggaaataaagccctcagctggtccctcagccccatccctgccactcagcttcaaccacactgaacttctcacccttccctgcacaagcctggaccattcacacctattttttatgctctttgacaattgcttcagttgatagaatattaaccatcttggtcatcttttcaacagaagacaaagatcaccttctctgggaagcctttgtaaatgctctcaggcagggtactccatcctttggcattttactttctacctgcaacatagcacttaacatatttgatgatttttctatcctggtgtctctgtcccattagactaggagagagacgtatcaaacttgtttgttcccagagcttcacagggagcctacacagtacctgcaaagtaagtgttggctaaacaaatgaacaaagaagcaaagcatagtgaaagaacttaagtcagaggaaggatacttagagcggtttcagaaagcagaacaatggtgggcagggtctagttgagtatgcagagtagaacatgctaagtgtcagagctttttttagaagtagaagtgtcccttttctacaaatgctcagaaagtgattgaccacttatgagcagctggctaagggatttgtacatgagataaggggtggctatactaaatgacctctaattcaattcagaacttgtgttattcttccttagtaacaatgcctcagatcatctgatgatttctagtaatgaataatagctgaattttaaccctggttctggaagcttatttctcataaataattgaggatgtactcagttggaactcagcagagccagggagaacagtatattaagcaaacacaaatgacacactgtaatttttagaagattgtacataaaaaccaaagtatcacgtttttaacattgcaggagtggggtttgcctttagtgctctcagagcagggagtaacttcctccctctcctgccttgtagggattggcattaagggacattgtctggcctgcatttggattgagtccagccctgtctgcttgtggtaaattgtagctctaatatctctgtgtgttttataaaatataaataattataatgcattgtttttatatagcatctttctctatggagtctaaagtgctgcacggatgtggtatctcattaaatctcacggcacactggggacattgggagaatgcaggtgatattatatcccctttgaacccagagctgaaaaggaattgcttcaaccaaaagtaaataaaagcatgactgaataaaagcaagatttataagacaata

SEQ ID NO: 30106 - DNA, 4010 bp, Bovine  19866880510894
atttcatgatatccattttcttttgacttggagccaaaaaaaaacaatacttattctaaaaagtacctgccaattggtaccaaagagaggtctgatacatattttattcttgttctaaatgtaaccagacactaaaaaatccagtacatttcaggagatattaaaactggtaagactaaaattactaatgtctcaattttaaaattccattaatagttcatgagttttccagaaaaggtcaactagaaaataaaggtcttcaatcctttagtctgtaattaagtagaaataatttattggtagcacttgtttttctacttaaaggtactgttggacatttgtccttgccaagctactgttgggttttaatcatttatccagtttttcaagataatattgaaatctaatttcccaaattacaagctactatttttatttaatgtcatttgaatagtgaatggcttgttctctaatttatcaatttaacagaagtgttaaatagcactatatctaggtctggctcctctacatcaccatatatctctctaacttcttctaaaacactgatagtcacctttggtgatattactgtggtctgcctgcttccaatatgctccaaacccataggtcctttctgcagagtgggagccacttaatctctcctggatgttcagtcttaccttaggctttggaccaacagcatccttatgagacagaaactctggctcaatgtagggcaccagatatcaagtcaagcttacttttagtccaactctgataactgatcatttggcaaagttttaacaattagacttctggcttgctcctgaaacctagtcccaattgatcctttagatgtggtaactgggtctcttgctcacatccctctgtgcctggtttctctgtcctgataaaaccattacgtctgtgctctgtatacaacagagcaccttcctgaatggacttcctcccaatgtctgtagttatgtcctggtcctatatcccatcccaacctcaacctcttccactcaagggcacgtctagttccaactttcagatcctctaaacttctggtccaatggagtgagcactgccatgcctgactcttctcaagatacacaaaaccaactgtaaattcaccaacatactgttaaaaaggaaggcatctggggaaaaaaaaaaaaaaaaaaactcttctatgctactggtggaaatgcaacctattccattcttttcaaaaagctattgtatgatttgttttcagattttttaaaaaaattctattattttgactcaaataattcccaaagagtctcctcttaaaatgtcagacattcaggcaaagatttatacacagaaatgcttcatttatatcaacagaaaaaaatgacctaagtaatcaatgaaatttggctcaataaattacaggatagctatatgataagaaatcttatagtctttttaaattatcttataaaacttaataaaatggaaaaaaatcagaatcaaaatcgtattctggttagtcatgactggtggaaatggttgttcagtaggtaagttgtgtgttcagatctttgtgaccccatggactgcagcatgccaggcttccctgtccgtcactatgtcctggaatttgctcaaattcgtgtccattgagttggtgatatctaaccatctcatcctctgccgcccttgtctccttttgtctccaatctttcccagcaaaagggtggaatggtagaagaatttaattttctttcctctctctctcttgcatgcacatttggttctatagatatcaaaagctctataccaagtaagtattgctctaaacctagaaaaatataaagaatataaaatatttttaaagcatgagagtatcttcaagtataataaagaatctaattgatttctctttttcattggttaacagggatggtttcccaaaaagagtcacactcagtgctgtaaccttaatctgcctctgtgtggtgccaactcctatcctcagaactctaaggcttactaagatcttagggatcttaagacaaaagcaggcaagaaaatacaccaaaaacactgtatctaaataccttattcaaatgtaatacaatgtagcaagctccagctgtctaatcccaccagtagattttttagatttttactgctattaggagaatcagacaactttagaacagattgagaaaagtgtaggtgggctccaaatttcaaaataaaaactcacattcatttctcacccaagggattaatataaacactgagtgctattgatttgaccagctttatattaacatacatatgaggataaaacaagtacacatgaatggtatgacaaacctccccagagacaagaaaaatagctgtataatgttacaaatctatacagtggtaatccagctctgatggcccccaaagctcattttctttctcatacactacttagctaatgaggctactaattcgagatagaacaagtataaagtaccttgaaccgtgctatgcactgggcaagtgctcaataatgatagttatttttacagctgctgaaaattagtgattttgtacattctcacttcagaaagaattaaaatgtggtaaaaatatacctcctccaaaaaatatacctaaaatgaatttcaaaagtcttctattcattgaattagcctttattcattgcaaaacacagttttccacatgagtccattatgtaaatttcattatgtggtaaatttctgtttattcagaatgatcagggaataaggctgtttagtactgctacttcaaaatgcaaatatagactaccaacatgttacccaagaaaattctctaacatacactgaaaataagtttgtctcttgatagtccaggagacagtttagaatctttcacaaatcatgaaattgccactgtggtctagacagaggacccatcagtaaagacattcaagaaaccatactctacacaatccaactttctcttcatgccttacaaagttcattactattaggatggcttcaactggagctaaaaaaaatattttcagtttcttaattaaatatactcggtaccagacttcaagcaatatgagtttcaaaaaacagcacaatcatcaactctctcatgtaattgaatttggccttgtattgaattctcattagtctgaaaggttcatgtatgggggcagaggctccattctcaaggtctttttgataacagatataatgcttggttatcacatatatttgatagatactcattcactgacagctgctccatgccaagcggaagatgactgctgtcttctttggtgggactaagaatctggaagttcctgaattagtcagataggttgcttttccaactacctgtaaagccgctttcatcttaaagtcaattctaccttctgtaggtctcagactctctggttctactgcaaaggttaacaaatcagttcaggagttgaatttcaaaagcagtgttgtataagagaagcagtctggtagagcacaaataactactgtgctggacactgtgaagtaagttatccaataccgacatcacaaggtgctctcacccatacagaaccgctgaggggacacagtattaggtcaacaagatcaactcaccactgtgactctgcagtcactattttcctacatcctagaatctaaaatggattataggtgacatgaaaatagcctcccactcagtagacagataaaggccaggtctagaaatgtgaacttcaagtagggtctactcctattaattatgactcaagtagggtcttttaccaatcatccttaatcataatgtattctgaaagtctagattaacactgaaaacctagaagggtataaataaaattcttgttatgttactaagagaaacataacactattaaaagaaaataagaaagtcatgaggactcaaattcataggattaattttaaaattctccagtagctgtatgaactcatctggag

SEQ ID NO: 30107 - DNA, 1302 bp, Bovine  19866880520788
attcattaccaactgaactatcagggaagccctttatgtagcctaaatgttaaataaaatctgattataatggctgggcatatgagtgactcacatttcagaaaccaaacaagaaccagtgtctttatgtgtaagctggacaaagctttgctccggagtgatcaacgaaacatgcaagcttgtctcactcatttattcatcaaatggtaaagaatctgcctgcaatgcaggagaccaaacctgggttggaaagatgccctggagaagggaatagcaacctactccagtattcttgcctggagaactccatggacagaggagcctggtggtctacagtctgtggagtcacaaagagtcagacacaactgagtgaataacacactattgcctgtattaggctttctaatgtgaatgcaacagtaaacaggaaacatacatagttcttgcctcacatgatttgctgtctttcttaccaactagattgttgatttagtaaaaataaataagcaaataaaattataaataatgataagttctaagaagaaaacaaataccaggtattgtaaccttttccaattctctccctcttcagctcatatttcttgaaaggattgcccacatttactgtccaccttgggcttccctggtggctcagtggtaaagaatctgcctgcaatgcaggagatttggttcccatccctggattaggaaggacccctggaggaggaaatggcagcccactccaatattcttgcctgggaaatcccatggatagaggagtctggtgggtatagtccttagggtcaaaaagagtcagccatgactgaagtaacttagcatgcatacactctctaccttgccatttgccaattacactgtcatctctactcttcttctactccatggtggtttcttgtcatcagttctcctgaatttcagcttttgtcagattatattgtacaaaccaacactgtttttgaggttaaccaagcacttctgactttggtgggccatcttttattttaagatggtcaattatggaaggacatagttgagaagtattatcttgactttttaaatgttctttggctcaaaacagaaaggggaacttttgcatatgggtattaaacattatgttattttcctaaatataaaatgtcattttaaaaaactttataccagtattgttgttgttgttcagctgctaagttgtgcccatctctttgtgattccatgtactgcaacatgccaggcttccctgtccttcattattctttcagagtatgctcaaactcatgtccg

SEQ ID NO: 30108 - DNA, 2617 bp, Bovine  19866880552406
ctttattgactatgccaaagcctttgactgtgtggatcacaataaactgtggaaaattctgaaagagatgggaataccagaccacgtaacttgcctcttgagaaacctgtatgcaggtcaggaagcaccagttagaactggacatggaacaacagactgcttccaaatcaggaaaggagtacatcaaggctgtatattgtcaccctgcttatttaacttacatgcagagtacatcatgagaaatgctgtgctggatgaagtgcaagctggaatcaagattgctgggagaaatatcaataacctcagaaatgcagatgacaccacccttatggcagaaagcaaagaagaactaaagagcctcttgatgaaagtaaaagaggagagtgaaaaaattggtttaaaactcaacattcagaaaattgagatcatggcatctggtcccatcacttcatggcaaatagatggggaaacaatggaaacagtggctgactttattttggggggctccaaaatcactgcagatggtgactgcagccatgatattaaaagacgcttactccttggaagaaaagttatgaccaacctagacagcatattaaaaatcagagacattactttgccaaccaaggtccctctagtcaaggctatggtttttctagtagtcatgtatggatatcagagttggtctataaggaaagctgagcaccgaagaattgatgcttctgaactgtggtgttggagaagactcttgagagtccctcggactgcaaggagatccaaccagcccgtcctaaaggaagtcagtcctgaatgttcattggaaggactgacattgaagctgaaactccaatattttggccacctgatgtgaagaactgactcattggaaaagaccctgattctgggaaagatcgaaggtgggaagagaaggggacaacagaggatgagatggttgagggcctcaccgactcaacagacataagtttgagtaaactccaggtgttggtgatgtacagggaagcctgccgttctgtagtccatggggttgcaaagagttggacacgactgagcaactgaactgaactgaacttcctaaaaaacaaaccttgttttaggagaagagagccatacagaatctatatgttcttgaacaaaatttttaacttgaacctcatttttctcttatgccaatatcaatgtctcatgattgtcatggacagatgatttcataaagcttttgacatatattaggtgctcaacatatgttaggtttcatatctgctagttggaattaagttcaacacagtactatagttttagagcatatagtatgaaacatcagagaaggcaatggcaccccactccagtactcttgcttggaaaatcccatggatggaggagcctggtaggctgcagtccatggggtcgctaagagtcggagacgactgagtggcttcactttcacttttcagtttcatgcactggagaagaaaatggcaacccactccagtgttcttgcctggagaatcccagggacgggggagcctggtgggctgccgtctatggggtcacacagagtcggacatgactgaagtgacttagcatagtatgaaatatgcagtatgtttcaaaataatgtgattaaaaacagggcaagtaaagttatactgaattttcaaacatcaaaagtactgatccagtattggtttcttatgagtgctgctcagtcacttcagtcatgtctgactctttgtaagcttatggactgtagtctgccaggcttctcccatggcattctccaggcaagaatactggagtgggttgcccatgcccccctcctggggatcttctccgcacaaggattgaacctgcgtctcctgtgtctccacattgcaggtggtttctttacccactgatccatcttgttttcttacataggtccataaaaccacagtatcaccaactgctttgtcttatttacatttccttagagttatacagcatcaaataagaaaaagaaaaactttggtcataaaaaaataaggcttaagcattaaacaattttttatgcatgtaattataacccccaacaatctgtaataaacacctggcaagattgctaaaactttgaacacaatagagtatattacagaaggttcttccatttcagtggggctctgtgtttgaatgaatcaccaaggaaacagaatagtttgggttaaagatcagttcaagcaaataatatctctttgtcagtctccctgagtgaaatctaggctgaagtaatcttaagcactttctaatgaaagaaacagtgaacactcaggttcaaaagagctgtttataatgataaggatccatattggaatcaaagtgcagggaagcacaaagcacccagctttttaatgcattatttatagtgggattttcaccccagtttgaagaagtgccttagcaacgggatcttgaacctcattctcattatctctaatgtcttcgtgtgggtaggatggtttaaatggctaatggaagtatttgcagactcctttgaaaataaagtgctctttctttccctgtttctctgtctttcctagtgattctgctgctgctgctgctg

SEQ ID NO: 30109 - DNA, 704 bp, Bovine  19866880557473
taactttctgttcttcttctctgataagtaagtaaatgtgcgtcatgtggctttcttcttgatgtgtactttttttccctcccctctctcagtgcccttggggagaagatccactcattggttttgtaccaaagctgacaaggcctcagttatcaggtggcccaggaggatgtcacaaatagaagaaaagctgttcccagagcaaataatgatgagccctgtgaaggcgcctgcatgcttgtacccacatgtggaggttttacaggggactaagaggtctgtgaaagagagttccaataagagtaagaaatccagcccacagatgggcagtcttcatcctgagagtgctcgccagcacttccggagcttctgttaccatgacacgcctggaccgtatgaggctgtcagccaactgcaggaattatgctctcagtggctgaggccagagatccactcaaaagagcaaatcttggagttgctggtgctggagcagttcctggacgttctgcccagtcatatccagaactgggtgcagaagtatcatccacagaacgtcaaagaggctgtggccctggtagaccgctttcacagagaatgtggtggaataagcaatgaggtgagcagaaagattccttatatgtacactgtgaaagagggtgaaagaggggtcaataactggagaatgagaggattaagtcactctt

SEQ ID NO: 30110 - DNA, 1591 bp, Bovine  19866880595856
ctccatgaatatatctaggtttgaaaataccaattgcagtgttgatgaaaatttatgacagtgttggcaaaagtaataatgcaagcaagcttctgtggctgatgatgtagtctgggaaaagcaatttgctaatattttcagtctgcattttggttcagttaccatgatattcataatgaatgaggaaaataacattttaaccaagaagtgccaaagagagtcaccaatgtattatttcattgtatatgcccagttcatctctgaaatgtggagtccgcccatgaacaccttgtattaatatgtgactgtgaagatgacaaataggttcaagggattagatctgatagaaagagtgtcggaagaactatggatggaggttcctgacattgtacacgaggtagtgatcaagactgccccaaggaaaagaaatggaaaaaggcaaagtggctgtctgaggaggccttacaaatagctgtgacaagaaaagaaatgaaaggcaagggagataaggaaagatataaccatttgaatgcagagttccaaagactagcaaggagaaataagaaagccttcctcagtgatcagtgcaaagaaatagaggaaaacaatagaatgggaaagtttagagatctcttcaagaaaattagagataccaagggaatttttcatccaaagatgggcaaaataaaggacagaaatggtgtggacctaacagaagcagaagatattaagaagaggtggtaagaacacacagaagaactgtacaaaaaagatcttcatgacccagataatcatgatggtgtgatcactcacctagagccagacatcctgcaatgtgaagtcaagtgggccttaggaagcatcactacaaacaaagctagtggaggtgatggaattccagttgagctatttcaaaacctacaagatggtgctgtgaaagtgctgcacccaatatgtcagcaaatttggaaaacttagtagtggccataggacattccaactccaaagaaaggcaatgtcaaagaatgttcaaactactgcacaactgcactcatctcacatgctagcaaagtaatgctcaaaattctccaagaaaggcttcaacagtatgtgaatcatgaacttcctatattcaaactggatttagaaaaggcaaaggaaccagagatcaaattgccaacatctgttggattattgaaaaaccaagagagttccagaaaaacattgacctctgctttattgactatgtcaaagcctttgactatgtggatcacaacaaactgtggaaagttcttcaagagatgggaataccagaccacctgacctgcctcctgagaaatctgtatgcaggtcaagaagcatcagttagaaccatatggaacaacagactggttccaaatcgggaaaggagtacatcaaggctgtatattgtcaccctgcttatttaatttatatgcagagtacatcatgagaaacaatgggctggaggaagcagaagctgaaatcaagatttccgggagaaatataagtaacctcagatatgcggatgacaccaccctaaggcagaaagcgaagaggaactaaagagcct

SEQ ID NO: 30111 - DNA, 1110 bp, Bovine  19866880620656
ccgattcagcttgtcccaggtgatccagtcagttgtaatgacaagtacaaccacagacgtcagagtaaaaagaaccgtcctgcaaggaacatgacagtaaagaacactagagtaattatataaacagtggggagtgcacatgatctgctatattaaacatctaccctttgccaagtactcatcctaaggcatagtccccaaaaggaagatgaaaaaagaagcaacttgagctttctttcaaaagtaattagaaaaaggtatgatagtatctctttgaagaattttcctaaagaaaaataaggcactgattatagaacaaataattagaacgaaatattataaataaccttacttagtgcactatatattccaaagagagcattggctgtaactctcattatatacatattgtttcactgaaggtggcagatatacacaaagcagatgggtaagaaagtccttgaattccatgatcattctaaaaagagagactatagatagatgggtctccttcatcgtccccatagcctgacgagctctgtagaggaaccacttcatgccgaatgcatagtctcttctcatgggactcatatcatagatcacttggggcctagtgacctatccaggtcacacaatgtctgattcccccatccctagttataagatatcgtgtgtgttagttactcagttatgtccgactttgtgaatgcagggactgtagcccaccaggctcttctatccatggaattctccaagcaagaatactggagtgggttgccattcccttctccaggggatcttcccaacccagggatcaaacccaggcctcccacattgcaggtgggttctttaccatatgagctactagggaagcccataagatattatgggcctgagatttttcttttatatatttttgtagcctccataaaatcttacacaattatataaagaaggagttcaaagaacatttgttgaaactgtaacaattatcaaataaagtcttaaagaaaatacttcaattggtctttaatattgatattcaaagtgaatctgaaatgtgggcaggaaaaagcaatcggccagagaattgtccataatgtagtagag

SEQ ID NO: 30112 - DNA, 1885 bp, Bovine  19866880657845
tttgagggctttgcacaactgcaataatgctaaccatgaaaacaagatccttcttttttcactttggaatgttatttgaaatataacatgaaataaaataattcatgaggctattggtttaaaaagaaaaatagtgtgtataacattatgaacatgtcttccatctgacagttgaaatgggtgaagttaaaatttcttaccatccaagctgtgacaaagtcccccatccaggtccctactgcagctaatttcatgaaactttcatttcggatgcccatatagtctgtaatgatatatgctctgtggaaacaaacacacaagacattgtccagactcagagaaccatacagtcaaagctttctggttcagcaacactcaaaagggaatttccccccttttaacaaactttcttgcttttgtctcaccagatgcgcttataaatctgaaaggctaggaggagctctgagggtgtctgggtcagttccaattagatttgaaaactgactgtggctacaccaattaccatgtgcctttcatttttgcgctgtaaggactgacaacagcttttggaaaatcaaacagaaatactcagcaaaggcatcattccatgctcactcaagtatgaggagaacagaaacaattcctgaattagtgtaactagaaaggaagagaagagctcactttcctccagttctgtcttctcaaagtcagaactattgaaaagatgctgggagtaagttttaagtataatgtcatatctgaaaaatgttcagaagaaagtcaagatttgggaaaaatttccacgtagggaagcgatgtaaaattttactcaaatacatgtgacttaaattattatttaatagcaatggccagattccacttcatcacttggcatagctagttattgtttgcttgctattaaacacaagtttatattcctcagagctcaaagaaaggttcaaaggtacacctgactattaaaaacaggtaataagatcatgcttattgcttattaagcattttcattttcttgtttggtagtgaagaaaatcctaactatcatttttcccatttgtaatttcactaagaaaactgggattcaaaaagatcacttaccctgcccaatgaataccatgtaactaatgaatggtacctaggaaccaaatttctctgtacatattttttttaattctaagtattttttttactcagttttattttactttaaatttttttccttttcttaaacatgataatacctatacaacttagagtacccattagattaactttaaaacaatatgcagtaaataaatgtttgttagttatctattgaaactatgaagaagcacatttttgaagtcattgagagttaaactgcttccaattcagttgttttttctagagttatttcagatagtttttttatctgatatttaaatgtacagatatttacacagatatttaaatggtttttaacaacaaaaacaaacttaagaattcttaacaactttttcaatgtgcttcatctacttactttggaggggctatgtacatatcttaaggtctcatctcaaaattctgggtcttattccatgcgtttccataatagccacacacacacaaaaaacttaagctaccaaaaactgcatactagcaatgtgctagagattgttattagcattttaaaaacacagtccccatcaactttcatatcagaacaacaaaatgtattgttattcccatttcacagatatggaattaaggctttagagagtttttgcaactttctcaagtttaagcatccaatgaatggacaagatttgaatataaatttgattgactcccaaatccatgcacttaactactgggctataccttcttc

SEQ ID NO: 30113 - DNA, 940 bp, Bovine  19866880677851
tgattaaccattcatacctttgcattcattttagaaaactaaaccatctgactttgcttttgtttcttaaaataataaaaagagagagagagaaaggtttttaaaaagtaaataatgtgattggacactgcagtatgttgttcctgcaggaaaagggaacaagacctcaagtctaacaagctggcaaataatattttctgaagggatggacaattgaagaaggcagagattttaaggcagtaacataagatggtaattatatatgaagaggagctcttagcattttgaggctctacaggtacctgctttccatgaaatatttttcattcaccctgacttccaattaccccaatcacgatagaagttcgccacagatcgtctcccctcaccagcacaggccatcacataggcatcggcccagtcactcaggctgctggcatccatcctgtatcctgcagccctagctcctcctcaccttctctgcttgcacattagccacaatctgtcagccagctgtacagcagcaaggaaaccagagagcagggcagccacacacagctattgacaatacagtcaataatcacttttcctattgtgtagaatctctgtaattgacttttacaggctttgctcattcttttaaaagtgtccaaatgaaatttaattttacgataacatttttaaagtttattttccatccatactcaaacaccctatatgcaacatttaatactgaacaatataggattaaatttcttaagatgtcatggcaaccaaagatgaaatttgaatttgaataaaagaagttggcctcccttaaaaatcttctcttagctggaaagaatgctgatataattttatgtggagtcttgtcaagtgcattcaagaaatgtcaaactatatttttagcaaggagttgcttaatcccataagactctct

SEQ ID NO: 30114 - DNA, 2758 bp, Bovine  19866880706934
ggtagccaaacttaccaggcagcggcactgctggcaattctgaacccaggtgtcgccactattgtacaaggtttccccgttttgatggaggcactgactgctcaaccttgggtcacattcagggcagcagaaaagatcaactgtgggattctcacagtcacagaccatccgtcgacacattacaaatccattctgtatgacaaggagaaaaagtagttaccaaaagcctctgtttctcaatatactgatatcatatgtatgtgggtgtgtctgtacgtgtgagtacctatgtagataaacatctatatatacattatacatatgtgctgtgctgtgctaagtcactgcattcatgtccgactctttgggagcctctggaccatagcctgccaggttcctctgtccatgaggattctccaggcaagaatattgcaatgggttaccatttcctcctccaggggaatatatatagatatatttataatatatctatattcataattatctctctctatatatacatgtatattacataatatatctaaaatcgggcttcccaggtggtgctagtggtaaagattctgccagtcagtgcaggagatgcaagagacatgggttccatcactgggccaggaagatcctctggaggaggatatggcaacccactccagtattcttgcctgggaaatcccatggacagaagagcctggtgggttattgtccatggggttgcaaagagtcggacacgactgcagcaatttagcatgcatgcattgctgcagcagtggggagggagtacaaatgacaagctcccttgctgcctgctcccagtgagctggttccttatttgggtgaaggtaggtgtcaggctggaggggtagcttaggtggtttgtccacccctttggtggtgtgaaacaccctgcttttgctcccagctcttcagaagtggcagttgggttttttggtctttttctgtcttatccataatttccccagtggtgcatgcatgaagctatttttcagttcttcatagtttgtttgtattctgttgtttgaggagacgtttgtccaggtgcaaacaccacagcaaagggccccaagtcccaggtcccagcccgtctcagtgggacctcatcttgaccacttccccaaagactggtttcaaataaggtcctacgcacagggtccccatgggcatgaattttgaggaacacttttcaacctagtatcattcacatcataaagttcactcttttaaagtgtctggtttggcggcattcagtacattcacagtgttgtgctaccactaaccgtgaggaatgggtcctcaccctgcaagggaggccctgtccctgtcggcagtcactcctcctcctctcccagtccccggcagccatgaatctgctttccgtctccatgcatttgtctaggttatctccctttccttctgtctgtctatgtatctgtctatgtcgcatcaccagttcaatggacatggacttgggtgaacttcatgagatggttgggacagagaggcctggcatgctgcagtccacaggcctgcaaagagttgcaaagagttagacgacttagtgactgaacaactacaacaatacatatctgtcacctgtcagggcttcccaggcggctctagcggtaaagaacgctgctggccatgcagcagatataagagatgagggtttaatctctgggttgggaagatcccttggagaagggagtggcaacccactctagtattcttgcctggagaatgccatggacagaggaacctggtgggctacaatccatggggtcacaaagagtcagacacgcctgaagtgacaacacagcacgtcacatcatctctcatctgtctatcatgctgcttacacctagtggttggaggctaggaattccactatcatcctagatgatctgacccttagcatcacggtgggaggctgagaaactctgttaggcatgcattgtggccttttcaaacaccctctgtacagagtgggtagctgagtgtctgttgtatagggctgctgaaagaaagaatgagactatacttgcaaatagacatcacctggccaaggtccctcagccagcaccaaatgcagagtggtgtgacctcacacacagagcttgtctgcagtgcaggaaaggcaggtcccatgttggggggcaggtgaggtgcctgctttgggtccacattgtcacagggttgtctctggggatggagaagggctcttaacctagtggttcagttgtgaccttaggcacaccccccagcgcatatctctagcaccatccagtagaatattggcaatgagggcaagctctatatctcattgtccaccgtggtaaccacgagccacgtgtggcaaatagacacttgaaagccagcttatccatcccagaaaccggattttaaacttcattaatttttacctttcaatgactgtgtgtggctggtgacaactagactggacatcgtggctctagactcgatgagacacaacatcttcaagagcagggatggaattgaattcctttccccctggccatccaggaccatgaatacgcaaacctcagtttccccatctgacaaacagaagaaggccccctcctgcacaattccagctctcgagggcaccttatcagagggactcacatgctccgagaaccatctctccctgccacttaccttgtcctctccttcctggtgagttggcttatcttcttcctagcaa

SEQ ID NO: 30115 - DNA, 1022 bp, Bovine  19866880718118
caggaaggcttactatctttgtaactctcacttcaccaccactgaccatttttatacttctatttaatggcatgttaagtgtcagctgacagcagagtagaagcagatgagcaaataaaaagttaaaaaaaaaacatgtttaattttaaattttttctaaaataagagtttctgaaaataagtgctcctgatacataacaactcttgatgaaatgatacttactttactacttggtaattgctcattgtcagcatcttcatccaaacagaccaagtcaccctccacaactcttgagccgtaagtttcaagtctgtaagacactgcctcattccagattttgctgctgtatgcatgaacgtagaatatgcgcagagaatgggggaaggagaaccacgcctggatgtagccctcctccgtcacgccaaagcgatgcagtgactctaacagtgctctctcccgaactttgaattcgggcatcagggaaagtgtgcctttagcatcctctgaaacaaagagatcagtcagttccttttattcaaaggccagttattaagagctttaccaggctctctaaatgtactgagctatcctgggaacctgcatatgaagataaggctcagcaccaactataaaccagagctacatttgaagaggttttttgtttgttaaaaatcattaatcatatggttcattcactttccctgctttaaaaagagcacattagtaactccaatgtcaggatggagattaactaatttgcaattatttagaacactttttttaaagcattatataagttcctgagctgagattttaaagagctattatggacatttgacaaaattttttcaataagaaagggttgacatctggatccttcaagtacactattcagtcattctactattcagcatgctttttaaaattagattactggactccatggcaaagctgcttattcaggtagggccttggagtaagcattttaacaaatgcaccaggtttctgtacacactaaagt

SEQ ID NO: 30116 - DNA, 1014 bp, Bovine  19866880769165
ccttctttatactattttttaatataaatttattattttaattgtattggtgttgccatacatcaacatgaatccgccacaggtatacacgtgttccccatcccgaacccccctccctcctccctccccgtaccatccctctgggttgtcccagtgcactattttttatactattttggtactttgttataaaaacccattatgcttatttggctcttccctgttttccttgcctcatctctatatcttcacttagaattcttgccaagacagaacttttttaggcgtcttaactacacagaactcttttcactttaaagcctttactaattctgttccctgtgctcttggcataacttttcacagaactatcttgaggtcttgggttaaacatcacttctatatagaattctactctggccacccaatctaagtagccagactttttattaatctcataacatcacctagtttgtttcttttctagcactttttacaatttttgattgtacacttgattattaatggatacagctataggccctgtcctgtgagagtagcaaccatatctgctttattcatcagcatgtctagggctcagtttactcagtgcttattttgtgaatgggcaaataaaagaacaaatgtgatctaagagagtgccatggagtaaagaaagctgctgctgctagcctatgatttaccacaaataactggccacagttggtttttaagtgagacatgaaaagtgattaggacactgaactttcaggagcatataaataacaaatacactgttcggttatgtgtaacaatcagtgagaactgactagtggcttaaaaattcatactgtgcctttttcccctgtcttttctctagaatggccacatctgttgctcagtggatccacagtgccttcaggaactgtgaagttaactgtctcactggaaatttctgtttaaagaatgtttcattaaaaagaccaaaaaagaaaaaaaaaaaggtaaaactta

SEQ ID NO: 30117 - DNA, 856 bp, Bovine  19866880775631
gtaagctggaaaatggtagaatcgtgatagcactcagatatatttgactccaaggtctgcacactcgacaattaacattcgttttcctggagcagagattttctggaacttctatttccatgtgtttctctccaacaaaaatagcagcaagaacaggagaaatgatacataggcacctgttaattttagttttaattttttattttttctttcctggtacaggagcagagaactgaatatgaaacagtgaagaaaaagtgcctttgtgtttctgtgtttcccacctactgttaatgtgggcttcccaggtggctttagtggtgaagaacctgtttgacaatgcaggaggcgtaagagacatgggttctatccctgggttggaaagatgccctggaggagggcatgggcagcccactccaatattcttgcctggagaatcccatggacagaggagcctggtggaccatggtccatagggtcacaaagagtcagacatgactgagtgatttagcatggcaccgcacagcactgtcaatgaatgccctgccagtaatgaccagactacttctcacacagctgggactagttatcaactgctttattaaagatacttggcttcttgtttcttcctttgctctccccatttccgcataactctgaagttttagaaataagatcatctacgtggaacctgtgatatttcatcatcatcatcatcattacatcatcactgatgttaatatttgctgagtgattgtcataggcctggaataatttaagcactttgatgttattttctcatttaatttttattaatgagactttttagttacttctaccattactctttctaatt

SEQ ID NO: 30118 - DNA, 716 bp, Bovine  19866880786305
catttaaagagtgaaggacatggtacaggcatcattctgtaggaactgaaaggtgatttagatccaccctcatggaacactgcaagtggcatacaccattaccaaagcaatatgtcatttataaattaaatacactgccaaacatttgtccaaaataatcttttctagagcataataaaaggagagcagtgggaacaaataatagaggcctggctttccagctaagacctacattgaaatgatgtaagttaacttatttaaaggtaatcaaattaaacaaacaaaatgattttatttttatggaatggatagaattttagaagaaagtaattcaatgctataaaggacaacacagtttcacagatctcaatttctttatttgttaaaagatgaaaccttagttagtagatgatctgtgaggtcccttttacctttaaaatattctgtgcttctacaagtgagataaattatttagtagaggataagaagctatattgtccctaattgtcgttttatttgcaaaccataaaaaaagagacaattaacagtactaggctcactattcagtatactttcaattttaaaatgtagaattaattacatccttattgaaaaataacattagcaatcagaaaataaagtaataatgatgatatgttgactatgtaaatgaatcacaattagctctctgttcaccttaatccttaaagactttg

SEQ ID NO: 30119 - DNA, 1687 bp, Bovine  19866880793307
tggaattttaattaccctttaaccatagtaagattttagcagatgcagaaaatctgaaggtattttggagggcctgtaagcaaaagagtctgcctgataaagcagatggttcctttagggactacagaaagtgtagatgtaaagaaaaatttacatcagttcttataggatcttagaagttaggataagacaattgggatctaatattggtgaagaactgaaaacttgagtaaagaagtgttcagagcagaatgttaggaaagtcctctggcgctagtggttttttggtaacattggaggaaaactgaggaggaaaggagcaaagtcgaaggacagaagagcgaagaacagttaaggggttctatcacttgaactacggagaagtcagaaggctacatagagtgatagcattaggaatatgtgttccagttcttagaataactctgttaatataatcctacgataaagggtttttagtgcacatttgttgaattaaagatgtgtttttgaaataatccccccagtttttcagtattccagtataagtggttgtctgccatctgtcatttaaactttattttaaattaattttttgacatttttagcattttaaacatgttaataatttttaacattagtttaaacacaaactattttttaaatgtaagagttaactgaatccaaatgataaatgatttatcattcataggttgaaaaatattgaaaaagaagttgaaaagaaaagaatgaatgtgtttaacattcgttctgtagaggattcccttagacttggtcagctcaaaggaaatcactttgatattgtcatcagaaatttaaaaaatcaaataaatgattctgcaaacctgagagagagaattttggaggcaatagaaaatgttaaggtaagaaaactgcactgtagagtattttgggaaaatctttatttacattaagatatgaagggaagtattttgtacattttctttttatgtgcgtgtataattatttaaaaaaatgataactgggtccattttacttagtttttatttttcttcttagtatatatctttgtattggaaaaaacacaacgttagtgtaattaaaaaaattgtatagactctcccagttggaagggtaaaacctatctgtttaaaaggacagattttttttttttagtgtctgccatttagagtagtattacaggcaaagagattaatttgaggggagactttgttcagcatttcttttcagaaatctttggtaaatagtttttatattactttcaaaatggtttttcttttcaatctaattttgaattttgtttcaatgtatgcaaatggtaaatcatatacattttactattcttacagtaaaaaaaattacttactgtaagttttaaaatgatatttgctgggcatctaaatgtgcacatatagccatagccttcattctgatcatataaactgtgggtcagcagacttttctctgtgaagggccagaaaagaaatgttcatgttttgtagacatatggtctctgttgcagctactctagtggctattgtgtggaagcatccatgaaccatacataaatgaatgagcatggccgtattccagtagaactttgtatacaaaaacagtggttacagggccagatttgacttgtgggccagttaaatagcttgccaac

SEQ ID NO: 30120 - DNA, 1580 bp, Bovine  19866880832544
ctgagaagtggggaattctttgtaagggatgctgattgcttgtgatcgcttgcctttcctggctgaagggcagggtgtaaggacagtgtgcaaatgcctggaccattaagggcagaacacctgagcagaatgctggaaagagcttatctgacagtgacatggctgtgagaacagggcttgaaactggatgaaaatgcctcagggcttccataacatttcatcccccatgaagaagggattttctggaagcacctttttaacattgaggatgattttgccaattaaaaaaacataggcacttttagaatttccactgccaaactgtgtttgatatattgagtcctatccttaacttttaaaaaaaaaatatgtttcataaagcctaatgatatttacagagatataaaagttgaaaatctagccaaggttatttggtgtttaaaatcaagtatgatattttcctgtgaaatcccatgatcattaacattgctttagtcagcattactaggaaatacatgccagtaagatgaaaattaatttacagttgagtgctttatgtcaggagaccacttgcctgatcgcagttatttgaaacagagcatattctgagcacattgcctgctgctttttcttggctgtagatattgacgagtgtgggactgggaggcacagctgtgccaatgacacaatttgctttaacttggatggtggatatgattgccgatgtcctcacgggaagaactgcacaggggattgcatccacaatggaaaaattaagcacaacggtcagatttgggtgctggaaaatgaccggtgctccgtgtgttcatgtcaggttggtataaacaaagcactgtaaccatttttatcaaggtgtaatttgcatgtatttcaagtgtacggcttgataaacaaatgcatacatctgattaacctctgcacaattaatataacataacatttccacctacccacgttggctggcctctgccctttcttaatcccatagccccagacacaagtaaacactgtgtcctatttctacagattagatttgtattttctacagcctcatataagtggaatcatataacacagttggccttccatatctgcaggatccacattcatggattcagctaactgtggatgaaaaatacttaaggagaaagctccagaaagttctgaaaagcaaaactttcattttcctgaccccagcaactttttacataagttctatattatattagatattataggtaacctagaaataatttaaagtatatgggagattatgtataggttatatgcaaatactatgccattttatataagggacttgagcatccatggattttggtatccacctgcaacctggaaataatcccccaggtatatgagtgaaaactatacttattcttttgtgtctgacatttgtctcagcattatgctttgacactcaattatattcgttacctgtataagtaacccatccctttttattactgaatagtgttcctttgtacagaaataccacagtgtgtttatctattcaatgatagaatttgattctaactagg

SEQ ID NO: 30121 - DNA, 3530 bp, Bovine  19866880843747
ttcttttgtctacaccatctacctcatgacctgaaatctgtaatgaatcctttgcttcatatttgataattttaaactcactcatgcttcagactcccttaaatcccacattggcagcaattttctttccccttgttggtccactgtgacctccctttttgaattcccacagctctcactatctgttctattcatttgatacttgatatgcatttcctgtattatcaaagtaattaatttttcatgcatatgtatcttatctttaaccagactttaaattccctgagagcaggggccatgtctgatatcttataaatgaacaaatgagtactcttctatagcttacaataaaaaggcaacactggcaaagataacatgtaaaagacaaaaaaaattaatgtatttattcattcagatttatcaaataatactatgttccaggcattgttttaggcactgaggattaaatgataagcaacaaagcattattcttgaccttgtgaggcttatggtatggctaggaaataaaaaattaataaataatttatacaaattatgtatatgtgtgtttgaaaaaaggaactagacaatattaacaggcccagaatcatttttatacactatactagtcagttcattcttagtcgacctgcccttcacccacattgcctgcccttcatccaaattaaaaagaaaattgcaacgaataggcactctgcagatgttagaaaacaaaaagaaacaaaggaatacaaatagcaggagcagtctgtttgagaaataagtctatcacaatcttgatgttttaatatccatccctagataaagctattcaatcagaaggtattacttagactgatcacttcttaaaagttatactctaaacctttaagaaagttcattttaaaacacaagaatatgaaatctacttctgcacttgccacctcaccattcagtgttttctatattaaaaaaaaaaaaaaaaaaatctccttactagaatttagggcaagaaattccagaatttactgcacagaaagattcccctatgaaattcaatctgcatcgtttctgtcattttggatatccaaagctatggtgatgtatcacacactcccttttgtccagcctctaaggaagcacaaaacctacaagggagcaaaactcatgaaatcaaaacatatttgattctatggaatcattttctactctagaaacatatgtgctaaacacaaatgctttgtaaatcatttcaattccttttttggaataaaaatgatttcttggataagctcaaaaaatcaagttccccttttcatatgttttgttgttgctgttcacttgctcagtcgtgtccaactctttgcaactccatggactgcagcacaccacgcttccctgtccttcacatctcccagagtttgcagcataataagccttagtggcataataatttcaggtttctctattgatggatatctcaaataaacaattctataaaaggcattatttaaattcatgcttaattttttaaacaatggaatcatccaaaaaaatggaaaacagaggcactggaaaagtacaaactgatagtccaatgaaatccaatttttgtaaatcctaatataatacctcaacaagattcagtgttaaaactaaagaaatttaactgaaatgtattaattctgatttcacatgtgctcttaaattatattctacatttgggaaatttgggatttgtgaccagtctgaaatcttacaagtttagtgctaatatgtaggaaaaccaactccctcattttattccagtcatacagcacaggtgagagggggatagttttaaatgcatgtaatcatttctgtctctgataaaaagcagtttccaatttgcaagagttggtattttaatttaggacaaatcccactacaaactataaatcatgacagggtttcatgttatgaactaaattgcttatagttttcatgtctcataaaaataagatttatatccaatgaactgtattcaattgtgtgctcatacaatcattcactcttcctcacacacactttaaaatgccaatattgtgttgaccttctaaaatatactaagagaagacttttcataataaaataaatgaggggaaagtcaacaaattagtgaaatgcaagggggagtgacattctatttaatatttttatttcattaaagaattacaaaaaaggaatctgtttacttggtcaagcaataattttgattattttgtaaaccatcccaatttctataacaaaagtgtctgtgcttgtagtgaacaatcccatagctcttaagatacataaaccatcatcaccattaccaccacctaccacaagcttgcatctacaaactgctaaaggtttaaatatggcctttttaaaaaatgaattatgtacaaaagggaacaacgatgaaaacattcatcacattccaaaccaatgcaggtgcctgcattaaaatgtggattcttttccacaaggctgcatggctatcagttccagagtttcctcctgtatgtgctttggtgcaaatggacacagtgggagctgagagaaaacaacttcatctgataggagggagtcagagaaagtatcacagagaacataatacttgaacttggatatgaaggaaaaagagaaattggccaaattaacaagaaggggacaagcatgatgagcacagggagcacgcatgcaaagggacagagaattgagaagacagcaggtttgagaactagcaaacaattccatagcatgtggaaagagaccaggttaaaagtcaggcaggagcagacaataatgtgctttgaagttttgattttttcctgtagctgataggagccatttacccatgttaaaaatatatatatatatgtatatatatattctagtagcaaaatccagaatgagttggaggaggagagaactattaggagaaaatgaccaacaagaatttgtgagtgaaagaagaaacaacagccatggagaaagaaaggaggagactagtttggagttcattaaaaaattaaatcaggagtccagttatcttatctagtaatcaccaacagttgctgaagattattatcccttttctaataccccacataatttcatagacttttaataaggggagaaaagaaaaaagtaacttaccaaataaaagtgataaagctgactattctataaaatcttatctattgtaagaaaaaaaaaaaagaggacatacttttgcattattttaaaataacttgtagtcaataaactacatgaaatctagagtgattttttttcaggggtgaatgatatcagtaagcaaattaaaaagccatgactaaatgtaattttagtataagagataagaccacaaaagagtaacttaacaaaatgtaataattacaaagccaaattatctgcctgtattattaaaaccattaccttcacctaaattttcttttttttttcaccttagattttcattcagtcttttatacataggc

SEQ ID NO: 30122 - DNA, 1368 bp, Bovine  19866880916582
aggcttgtgtcctttgctttggtaagccagggtcttacctggcaggctcaaacctgcctacaagggtcttacccacccaggatctccagttcagccctaacaaccagacagggcaatagcctctacatttgatctttctcacaataacatgcaacaataaaagcctgatttattgacggcttattgtgcaccacacccatttcatgtattaaaatgttaaaatctctgcaacaggcctgtgagatagatagctgctgttagtttcacttccaagtttacctttgaggaaagatactcaaaaagactgagcagttcatacaggatctcatgactagtccaagtggtggagtaaggatcagaaaccagtcaacagatctcatcagcccacatttcagtctctcatcttatacttcctcctgtgtatctcaaaagggatatgggtttttacagttagagatctggaatagggactattggtgttgaatctggttccactacaaccctagccacaccctgagcaaattgctactataaaattacagtaagaatccctattgcttcttttcttcatcattaggttactgttatccttattctctagtctctttccatcccagttgctacctaccacacagacctattgggagttttaaatgccgtaatatgtataagacacctatacaataccagttacataatgggtgctcaataaaggccattcttccttcccatcaaactttattgtgctatgaaaaccttctttcaggtcaaagtttattggtccagtacacaaatgatgattgcttactcatagaaattaatcatttctctagtgttggccagcagtgtttgaaaatggtatagacacaagccccagaaagaagccaagatggcagggctatgtatctcccattagcccatccatattttaaccaaacgactccatttctttttttataggcagcaaactgactccagtttcagacaacatctgggcaatgatagaaatagtggaagtaggaaactcttaaatgaaaactctccaatcatctgcctactccacctcctcaagcagagtcaaccctgccgataggcttaaaatgtgtcttgtttacatacaatgtctttgtaaaatccaaccgagtgcagaaattagaagtaaccacatgagattatgttttactgtttacctcatcccattagactaataatagagctatactccatttgaaaaaaaaaagaaaaagacaagctcagtatacatttcgaaatttggtgaaaactttttatcacaccaaatgatcctctctaaatggaccttgaaaccaaaaggaaactacaggaggaagcctctgtatccataccaag

SEQ ID NO: 30123 - DNA, 964 bp, Bovine  19866880931168
ctttgagtgaatccctgcactctatttccctgacagcttctctaacttgtttcttctgctgcttaaaaccactgtagagtaaatgtccacttctatttttcaataatatgtactatttacatagcatttgagcacaatttattgaatttgatcttgataatattcttttaaatatacattattatcctcattttatagacaaagatccttttgttcaaagaaacaaggatgttgcataagatgataatgtgagaggtggaaccaaggcttgaaccttagggcattcatctacaccacagtacttggcatactgatggtattaaattaggtgattgatgagttgtctcttgctgaaaattttttccgacttgggcatttcttacatgtaaacaactgtgaatatctttgaacttctccctactcatttccctacaaacttccctcttcctacttcaagactttcaagacaggagaggattaattttgtatcagctaccatttcagtatgtctaatcggaccctgaaattaatttgaaatttcctgcttgacttgaaaagtcattttgtgttttctgacctcatctcttgatcaccttgctgtgactgcagagcgaatcactctttcatgttcactgcaccatcgcttacttcctttcttccccttgagccattacatatgtccctctgtacaaaatatgtttcttgttgtttgaatctgtttttaattccagtcttcaatcatccttcattgcctggagtacttacagcttgtctgaaagcccatttgtaattttacccctttactttagatttcttctctctttctcttttttctctttaggaatcttgttctattgattttcttatagtattatctctatatctactgtttgttcaaactttgctatttttctcttctcactatagcagaagagtgaaatttatctgttaatcacacacatat

SEQ ID NO: 30124 - DNA, 1075 bp, Bovine  19866881056481
aatcctgctgactctgcatgcataaatcctgatcatccttcctttctctctctctttttaaatactctttgagtgacccataacatctgcaaattgtagtattacattttcccacttcaatccctgattttagcgaaactattggaagaataattaaaactatataaagagggtaaaaggtggtagatggtagtaggaaatcaagacatttatgctctgacatatacaaatgaaaagataatggtctacttggctatggatacttctgacactaagatgggttcaagagctccagtaggccacttgggcaaagtagatattttacaaatgatagtatattcattaagaggagtgttagatgaaagaaaataaaaatcgtctttaaacaactaaagcatgacacattattgtgtaagtgctataaactcaattttacaaatatccagaggaggtcctacagcaagtgagagacagggaaccttgcaaaggcttccctagggctttcttcactatgctaaactatcacacaggaaatacaaaaatgtatgtcaatttttagatgagacaataattcaatttaatttaattcttaaaaactattatgtattttaaattgtcacccattaaaataatactatttgctggtggcccagacaataaataatcctcctgcaatgaaggagacctaggttcgatccttggattgggacgatccctggaggagggcatggcaacccactccagtattcttgcccggagtaccaccacggacgtaggaggctggtggggtacagaccatggggttgcaaagagttggacacaattgagtgactcagcacagcacaaaataataatatatcctaagaaccatcttgagtctcatgcctgggctatgttatataccaaaacaaagaaacaaaaacataacccccctcaaaaacaacaccaataaccacaaagcaaaacagattgttattctctttcaaaacactaaagaatatctttcataaaggcatctctttgcctctagaaatgagaaagccagtctagtatcctgtgaaatctcacataaatt

SEQ ID NO: 30125 - DNA, 933 bp, Bovine  19866881169483
gaggaatcgctccgcagaagacacacttggttttggagctgagacataaattaggactcttttactgaacatgtctattttacagagaagaaaaaattttctctcccaactcaccaactgaactcttctgatacattttaaattcataaaaagttataatgttaaaaagagaacattcatattcaaagtatattctcccacgtgtgtttacaaaaccatctttcttacagcatattcaacgttgtgtaaaatcacattctattcggtagtatttcactattccataaagaatatggttgcatgtattttctacttcaaattgaatttttctagtaatttgggcttttcgtctctactaaatacatttctcactacagatctttgtgtgtcattttatcatctctcaaatatattccaaaggaagataactttatctgttatgaataaaacagaattgattttattttagtgatttgaaatattttaactatgaagcaaacccaatacaaacagaatcttatcactttggtgtaattctcactctcagtgagcagggccccagcaaaacacttcattaggtgacaactaacaataaacacagagcttgaattaacacatttagctcatgttttttgaacgttagttttcattattctatatgtgtcacatgtcaatctttacagaattttatctgcctttattttccttgatggaaaactgcttatagtttgacttttatcaaaagtgagctgttttgcttatctgttactttatggttttttaattacttttattaaaagttattcttcctcctattacagttgataacaaccactttgtcattgttctgagagaagacaatgttccgattcacatcttaaagagtttctttctttcttcttttatttttttatattagagtaaatttcttta

SEQ ID NO: 30126 - DNA, 1214 bp, Bovine  19866881373199
aatgagggcttgaattttctcaaaactctagacaggttcatgagtctttcctccttctcaaacctgagtttcacaagttatccgatctattaacagagatcttcccttccctctgccctgagccaaatggcccagaatccgttgggagtccatttctcacatgaccttttttctgaagtctcaccactgtgaccttactcagaaaaaagtcattgaaacactcaaagatgtgtttatctgctcttgcatatattaatatgtagttaatatttattaggtatagactaggtactggggctacaaagatgaataaaatacatatcatttattctaagattctcaacatttctgaaaataagaattaatgaaaattaaatggaaacgtttagtgaatatttaaaaattggagaaaggatcacaactgcataattcacattttcacagttactgaaattcaagtgaatttatagtgcattcagatataaaactatgtttaagaggataagtataaaggaaaataattaaattttcctgacttatatagaagagtagcagcattgtgttctgaatcaaacgcataatttttgctgagatgattaagtggaagatgtttatgcttccattggaaatttgattggtgtcatacagcatgttaactgaaagacatgctcatttttacttgcttaggaatccttataatgttcaataaagcggctgcatgtttttgcataacaaaagagaatgtgcatagttaatcagtgaatgtcgggataatgagcatgttacgtattttagcatctgttatatttatatttcattgtggccattaatggatgattttcctttccactgtttagaagaaaattttttcttattgttgcacagcagtttgaagtaggagttgtagtttttctagaagcaaattactcaagcgtattattgtatttggagtcactccttcagatatcagtgtgctgtgcagctgaagttcccagtcagtaagaaacccacaattgggggtcagaagctctcaatattttaatcccatatctccacactttcagagttggctagagagctgtcatgaaatgcccattaagaaaaatgtattcctcaacattatacacatgagttaattagccagaccccagcctgaacttctggaaaagttctgtaaacttctgggaaaaaaaaatgtgtttttctctgtaaag

SEQ ID NO: 30127 - DNA, 1639 bp, Bovine  19866881401721
cttggtgcttaaaggaatgatgccttcagcatagtgtccatagtgctttctctatgggcactaaactgttacttaaatctcactgaagtacactggcttcaaaattagccagggaaattcctattggcctttgcaagtgaaaaggattactgatgaagaaaatacattaaaccacactacaaaatatgcctttaggatgaattagattgtttgaacaacagttctgagagttcatccataccttagaatgtgtaaaaatcttgagtcaacttctttcaacattttaagtaaggatttacagtttgacttggattgtcttagtgatgaatgagatctgctatctactctactcattgaaaaaagcctacttcaatcagaaagacaagatttttctccaaagcttttaaatcttttaaatacaataagtgactaccgagagagagctccaaaagagtatggaattcatttgcccagagggggagaaaacaataatgaatattaggagaaaatgagagtataacttataagaataattgtcaaaagatacctataagcattaacctgctgatctttctcttttgtatatccttcatgtttattgctgggcatctctgatattcgttgttgccttgatcaccttcctagtgtcacccattgtgggaaatgatcctcccttttttcatcacatgttggtttacattctcttttcttgttctctgacttggttgaacgtgtctcatgagcttctttacacttatatgggaattaaaaggatgtcttggatcatcacaatgagcatttttactaattgcccaaatattaactgcctcatctaacagtatttaaatttgaccactttcttcctcccattatatactgtctcctttcctctgtgatctttggcaaatgacttaatctttgggttaaaggaatgatctttcaagctgtctagatgtaataaaacttatcttaaaaaacccactgctatcatgccagagcctgatggtaaagtttcttaaaagtaattacagtctgtgtaattgcaatacgccttgtttatagggaaaaaaacatttttttcattataatgaatctcagtttgatgtgtaatattatttacaaaaccgcatatttattgctctgtttaactaaattccatttacatgaaactcagaagtaattgtatatctttaactttcaaagagcaacattcatcaattcatcaagtatatgagttcttagtatatactacaggtatggagaaatgtaacagtgaacaaaacaggagaaaattccttatgttccttggggcttacattccaatgggagaggaaggtaataaacaaacaaataagcaacatctactgtacatcaagatttccaagggtttattcagctaagtgagaccatggcagttttgtcaattaagagaagtgtactgttgctgaaagaaatcaggtacttgagattcttaataagaagcaaaaatatcttccaaagcatgagtacaattcttcagaccaccactgttcactgtcatctaaaatcttgttgctaggacacggtaagcatagaaaaaccaagggcactttacaagctgggggcattttgggtagaataatgttctgatattcatgga

SEQ ID NO: 30128 - DNA, 3307 bp, Bovine  19866881463371
tactattgccaagatctatgtcatgaagatttttgcctctgttttcttctaggatttttacagtttcaggtactaagttttagttttaatctcttttgaggtgatttttgtatatgatgtgtatttttctttctttcttttcttttttttttttgcatgtagaaatccagttttacctgcaccacctgttgaagagactgtcctttcccctttgtgaccttgttgaagatcagttgaccatatatgtgtagatttatttctgggctctctattctctatgtgtttcatttattttcatttctctagatgtttcatttgatctctatatctgtttttatgacaattctattctgtaagaccatagtgagatgtcatctcatagtgagatgtcacctcgtcacagtgaggacaaccattatcaaaaagtaagaaaaaacgagtgttggtgaggatgtgaagaaaatggaaaactgtgcaagcttgtggaatgtgaaatgctggagccagtatgaaaacagtatggaggcttctcaaaaaaattaaaaatacaacttatcatatgtttcaacagttctgcttctggatatatagccaaaagaatcgaaatcaggatctggaagagatttgttttctcatattcattgtagcatttttcacagtagctaaaatttgaacataatattaatatccattgataaatgcatgggtaaagaaaatgtgaaatacacagccatacatgcaccaccaccccccaccccctgccccgaccacctcacgtgcacacactgtgcttttctggtggctcagtggtaaaaggatctgcctgccaagcaggaggtgcagattcagtccctgggttgggaaaatcccctggagaaggaaatggcaacccactccagtattcttgcctgggaaatcacatggagggaggaagctggcagacttcagtccatggggtctcagagagtttgacattgacatgtacacacacacacacacacacacacacacacacacacactggaatactatttagccttaaaaaatgaaatcctatcatatgcagcagtatggatgaattttgaattatgccatgtgaaataagctagtcacagaaggaaaaaatactatatgactcctaatatgtgagatacataaagcagtcaaagcagcaagtaaaatggtgattacataattggtgttcaatgagtgtaaagtttcagttatgcaagatgaaaatattttagagatctgtacaacattgtgcttattgttaagaatactgtattatacagtgaacaatttgttaagagggtagatctcatactatatatatatattttttttactcaaatgtttgaaaaaagaaatatattcaactcattactttatattggatgctgtgtgtgtgtgtgtgtgttagtcactcagtagtgtccaactctttgcaaccccatggactatagcccaccaggctcctctgtccatggaattctctaggcaagaatactggattgggtagcattcccttctccagggaatcttcctgacccagggttgaacccaggtttcctgcattacaggtggattgtttaccatctgtgccaccagggaagccagtattggatgccagtaagagacaaaccatctaagggacagagatgtggaatacatgtgagaaaatgaattcttgttgaaagagggcttacagactggatgaccacttaagattcctttagctgtgggtttctgtgatatctgtttgaagacgtgtgaagtggtttgcatatcattaagaatgctgtctctagtatagggataatttagtaatgctaatttactaattaatatactaatggtggtatttcaagtgctgtggattaaaaaaaataaggagaatgaaaagcaaagctcaaaaggatctgctttagctctatggcatttatgatgtattatggtccttgtttgatacatgactgtaataaagcattgccattcaattagagtaagttaagtttaaaattaatattgtgcctgtgtttgattccatttaaagggctggagaaaggaaagagggttttgaaccattcactgtgcattagcttcaatgacagactataaatcatagtaagtcatgggcctctgcccagttgtgatcgctgtgtggtccatgtcaatgtcaaactttaaaaatgtgcacctcagttagaacggcatgcatttagtaattggacagaagtaagtggaatgaataggaggttaaaatctggccctttggaaatgttttgacactttacccaggagcctgcatttattaatagtaatggtttctaaatttttattttggccagcttgctgattatatagaaagccctagaagagtgatgaaggaaatacattagtaaaaagtattaaaaattatctttgacatctctagcagaaggagcaagatcagatggttgatgaaagagcataattgaatcaataggaacatccattttagatttttttctttcttgttcgatatttaattcttcccattcgtgttatgaagatacatcaagaattccattattactaagaaaattcatcctgtgggcatccattttaagctttgaattttctcaaaattcactaattagcaattaatgaacagaagaaattagagaaataaagtacacaccatgtgtaagtttatgtatatagtatatactcaattgaagagaaaagctttgagaaggaattaaaatttcaaaattcctactgtgtcagagattcttttagacagtaactaatttgtaaacaacaagtattatttgcttgagaatatatgacattgtttaatatttatataccatcacatttttatattagttgtatgatatcatcaagattagttaattaactagttatgttattgccatgatgatcagctttttctttggtggaggatgataagaaaaaaatacattattcaggcactgatgtcaggcattggattcactacatcactatagcttgttatttctgcgtctgcaatgtggtaagcagtgtaaaggaacagcatttgcctattatatacatacctatcccactaaaacaaacattacacgatcacataccagtcttttaatgagaatctgatcctgaagtatcaatatatttatttgctttattcagtttaatatttttctggcattttgtatatggaatcttcaagtcagacaattccttggcaacaccattgagaaaaaataaacaaactcatccagtgatgaggattgggaagtcacctgcataaaatttg

SEQ ID NO: 30129 - DNA, 1176 bp, Bovine  19866880357840
tcaaaggcatctttcaaaactttgtagagtagttctcatgtactctgaagacaattttccttcacatctttctgccaagaaatgaatgtgttcctcaagtttatcactctctaatccctaatacgtttcaacttctactttttgccatgacttgtttgtatacttccaatgagaactctgtgaagacagaaaatgaatcctggaagaccggtcttatagtacagatgccgataaactggtaagagccaaatactgagaagctaacaaagctccatgtgccagatgtccttgaatggtttccatcttgcaggaaccaaaatcttaagggcttattcctctgtttcagcactcccttctaaccccctgtttagatcctcaaaatgaaacaccaacaggaacacctgagaaataaaacctaaccctgtcatcacactcactgctggcagagaccacgtgagtagtcggggaaatagccaagtgccaaactctaaatatttcaccttaccttatgtagcttttcaaacacaactctgaaaatgagtcatgatctgggaaaggaaggctagcatgaatcatcctacagcctttataagattaaattttctgagcatttaatgaaatatggcctagtgttaagaactaagaaatattatggaattaaaactcgtaggctaagaaaatgccatgcagacttctgccacccaaaaaaaacagaacattcaaagccacacgtagttggtagtatggcttcaaaatcataaatgtaatacctgcctagctgagtatgtatgtttgaaggaagagaatgagttaaaatgaagtgccattcattcccctaactagatacagagttttgtcagtaaacattaaaaaaaaaaaaacctgaacaataaagaagtttctcatccagcttttctacacattcaacaaaagctttgaaaagcattagatacacaaatcggagaaggtaatggcaacccacctccagtactcttgcctggaaaatcccatggacggaggagcctggtagggcagcagtccatggggtcgctaggagtcggacacaactgagcgacttcactttcacttttcacttttcgtgcattggagaaggaaatggcaacccactccagtgttcctgcctggagaatcccagggacgggggagcctggtggg

SEQ ID NO: 30130 - DNA, 1743 bp, Bovine  19866880403985
attcatgtatggatgtgagagttgggctataaagaaagctgagtgccaaagaattgatgcttttgaactgtggtattggagaagactcttgagagtcccttggactgcaaggagatccaaccagtccatcctaaatgagatcagtccttggtgttcattggaaggactgatgttgaagctgaaactccaatactttggccacttgatgtgaagagctgactcattggaaaagaccctgatggtgggaaagactgagggcaggaggagaaggtgacgacagaggatgagatggttagatggcatcaccaactcaatggacatgtgtttgggtggactctgggagttggtgagggacagggaggcctggtgtgctgcagttcatcaggttgcaacaagtcagacatgactgagcgactgaactgaactgaaagctcaaatgtgacactgctaaaatgctgtgagctcccaagcagctttttatttagggaagataggccaaaaccaactacttatttaaaatacaacatttagaacacagagatttattcagagaggagaaaacttttctttaaaaccagagtaagacatcaagatacctcatttaagattacaagagaccaagctgccacaaataagaaccaccacaaaaagaacttttagaaaccaaaaagcataataaaagaaatttagaaatcactatgagttagaagataaaactggagatatctcacagaaaatagatcaaaaggataatgagattttttttataaatgggaaaggaaagatatgaaaggtaggtgaacagtctaggaggtctaccagttgtaaagcagcatctccaggaagagaaagatcatcacacagttcaagaatatttgttcaactctctaaccagatcaactgaggtttgaggaagaaccaggtacccattggtgcagtttctctacatgttcaatttcaagcagaaaataaatctagacagtaccagatccctggagccaaatagaagattttttttttttaattacaagaatactgtttaaatcatctttttacttagctggagcaaagggataaatctttcaataagggataccttgaaagaactctttcactgattagtgatcaacaatgttcttctttccttagaaaaacaaagaaatcagtaggtgccaaaattattattccagagtcttcagcacagattgcctattgaatattctcacaaccagagaaagtacaaaatctgttctgacccatttagaacccaaagcttcattacaaacctcccaagaactggaaatctgcacttcattaggaacaggctgggatccagggcttcatgagggagttgcccgaatagcaggaggcagttggaagaaatcttctggattcctttacatttctaaaaataaacaggagactctcttgatgagcttaagatacagaaaatcaaaaaagcttaggccctaggttctttaatactcatcaaaataaaacctgttccaaagttataatgatcttagttgcatgataaaacctaattcctataccctttttaaattctttttcaatcttttattatccaattatacattgttttaaaattttaaaaccaattccaaataagtagtcaataatcgaaatagttttctaggtcatggcaaccctgtgatcacttcctcctctcacatatgcctgtctttgttagacaccagaaaaattctagaatcagagtatttc

SEQ ID NO: 30131 - DNA, 1653 bp, Bovine  19866880419995
caccccctgggaagcccaaagagacgcatggaaccacataaacttgctcgctaagttattgttaaccaaaaagaacttaatgtacgagggagggaagtgctgcctccaacagtttaaacccttttagtctctgtaatagcaggttgtatagtgttttaggttgagattagttgctcataaagttgtcaagataaagaacctttgcccaaagtctgtttctcagctgctttatgattagcaatacaacagctggagaaccacatcctgtggtctcctacctgttaaacagcttcacaacaccagatttttacatcaaatgaaaagggctattaaaatggattttagtttctggtgactgaggcttttgcggtctgacatgcagagcaactctgaaatatctgatgacttattcttattataattttggtatggtatgttagcattctgagcttgaaaacacaaaattttagcattcatagcatccctttcttaacaaagagaaatgcatttcttctaaaaggaaaaaagtattacaaaattacctagacgcaaatatatttcaagtggttatccaggccctatacaaaaacattccaatggaagcaaatcattcttggtagcattctttgcatttttaattccttgcattattcctgcaacttcaatggtttcattattaagtcaaaatgaaggtcttggcagcaatgtcctttgaatggtgaacaaagcaggttaattagaagcattctaatttttcttatgttacaaattgtcttgagtaaaagaaatggattagaagtctcataaggcaagaagaaaaatgacattgtatgctttctgttgaataagccactctaagaaaaaatattgtttatggaaagtctgtaacaatagtggatttttttcttttaaagaagattggccccttgccatctttttcactaagcatctattccctgtggtgaccacaacatcaacattttatgtaataatctattctgtcttctttttccctatagtcgtgaactcctttcttctagtccttcttgccctgcgtttggacagaaagagaatctttttgtgatcacagcgatctatggttgcctttcaattatcatcgcaggcattttccatttcccagattccctggggcaccctgagccagcttctcccactgtgcagcatgctcccaggataaattccctgccatcagttgctgtgtgggcaggaaatgcaaactaattttaaccttagcttcaccaaaccattattagaatctttaaaccagagaaaataaatcctacagtataggcaaaaggcaagcaagaatggtatttggagaaaatctggggctattaggcaagatggtttattgtaatctctgattctctccatgaataccaatccttgagagcagagtctatagatttgcatatttattattctcaagcacatgtcagacagacaatatttatctgggtcagtgagctcagttggtgtggagctaataaggccaaaagcatggactctttccccttagaaaccaggaaaatggactcagagaaaaaccaacctactctacattcacaagttgtatctctaaaccggccagacatcctgcaagtgcatgctggggtaacaagcagcagggga

SEQ ID NO: 30132 - DNA, 1874 bp, Bovine  19866880555756
aaaaggcatgggctgggttctactaggaagtccccttagttgagcaagaagttattgtccacccaggaggagctgacgccttgtaggtgtgtatgaccccagggttcgtgaactcctgctccaaggccaccacggaggttgaaaggcacatcctaaactgccatttagaacagaagccagtccttcctgtcccacctgacgcataggctcttgaggaagtggacttctgttcttccactgccaacacgtcatgccttcagtgggtcatcgtcgtagaggcacctggcaggggagaaatcagggaggaggaaagaagggagagaaaacagatggctctcctcctccgaccccatctccctctccaggtgcatggatctctgcccaggctcagagaagtaccgagaacaatggtaccccggtgcctggaagctatggaaacaggcagggatcctgctttttcatagctccattttcttctctctgttctcccttctctgtcttccccagacgtgtgagggaggtgtcgacctggaaagcagcgttcccaacactgctgaagatatgctagaggtaatcatacgagaaaatgagagactgtctatggagctgaatatcgacaaaagaatataagagcagacgtcaaagtgtcaatgttgtaggtggattaatctagtttcttttttaaatttttaattgatttttattggagtatagttgctttacaatgttgttagtttctgctgcacagcaaagcgaatcagctttggatttcctttccacttaggccaccacagagcgctgaggagcgttccctgcagcttctgattagttatcaattttatgtgaaagtgctagtcactcagtcatgtctgactctttgtgaccccagagactctagcccaccaggctcctttgtccatgaattctccaggcaaaaatgctggagcggagtagccattcccttgtccaggggatcttcctaacccagagatcaagccgtcttctgattgacagatgggttcttaaccatctgagccaccagggaagcatggtatgaatagtgtatatatgtcaaccccaatctctctattcatcccaggcttggttaccccatggtatccatacatctgttctctacatctgggatttagtttctaggcattgttttaggtttgtgtcttcttttttcctctcagtgttgtggttcattctgcttcccactgggagtggctgcccttcccgattctgcacataaatagatggtcagggatgagtgtcctgcctacactggcagaactcacgtctcctttcccttggctgattccccaacctaagctccccgttttcatggttcttctgaatctgccaggtgctcctgtcccctactggtccgcttatctcatgattagctttactgcagttgtttcaggatttgtttggcatgtgggtgaatctgcaaactctgatggcacccacattggagtgaagttgcaagccacatctcccagtcgtttggtgcttctcaagctcctggagcgctctttcttcattgtctgtttgtctttctgtccaggagtgtcactgggacctatcctgactaccaccagatgagaatcaggcctgagccatcagctatcactgagggcagaggaattacacttgtgacacggccatcaactgccccgcatttgcaaccttttggagtgtgcatcatctaagcaagtgtgacacagtcagtgtggcaggaaaagaaagattcgtgtttactctctctatactcagggatcaaacccaggtctcctgcactgcaggcagttcttcaccagctgagccactacggaagcctattttctctatattggtccatctccctg

SEQ ID NO: 30133 - DNA, 2305 bp, Bovine  19866880623914
tcaataaatggtgttgggaaaactgggccagctacattcaaaaagagtgaaaccagggccactttataccattcacaaaaattaactaaaaatggattcaagacttgaatgtaatgcctgaaaccataaaactgctagaagaaaacataggcagtaagcttcttgacatcagtcctggattgaagttttgaacctgacttctaaagcaaaggcaaagataaataagtgggactacagcaaattaaaaaagcttttgcacagcaaaagaacacatcaacaaaatgaaaagacagtggatggaatgggagaaaatattttcaaatcatatatctgagaaagggctaatattcaaagcatataaagagctcaaacaactcaatagcatggaaaccaaatgactcaatttaaaaatgggcagaagatctaaacagatatttttctaaagaagacattcagacatgaggagatgtttagcattagtaatcatcaaaatgcaagtcaaaaccacaatgagatatcacctcacatcctattaggatgactaaatttatacaatacttttctcacattattaaaatgtgagaaataacacattttattcacattattaaaatgagaaataaggaagttttggagaggatgtggagaaaagggaactgttggtgagaatgctaattggtacagttactatggaaaacaatatagagttttctcagaaaaattaaagatagaactaacttatgatccagctatcccacttctgggtatttatctgaagaaaatgaaacactaattgaaaaacattaacaacactagttgaaaaaatatatgcatcctggtattcattatttacaaaggccaagatatggaaatcactatgtgtatatataatattactcaactgtgaaaaagaaggaaatcttgctgtttcaacaacttgaggatcctgaggatattacacaaactgaaatgtcaggcaaagagaaacaaacatcttacaatttcatttatatgtggaatataaaaacaaaacaaatgaacaaaccaaacaaacatagatgcggaaaacagatgggtgggtgtcagaggggaagggagcagggtgttgagtgaatgcgtaaagggggttaattatcatggaagctgggaggtggcaactagccttgttgcggtgatcactttacagtgaaaacaaagattgaactattatgttgtacacgtgaaaccaatacaatagtctacaccaactttacctcaagaaaaaataatatgtaaaaaactcactgtgttagttactggagctcattttcctatcaatatgacacacaactctaagtgtgtgtcatagtgtaagccaactgtgagtggaacacaaccaatgaattttgtgtaaatatctctaaagttatgtgaacggtacattactcttgaacccttgtctggtctttttgagtgggccttttggagttgacttttagtggagataagattgattctctgtcactgtaaggatttgtagtatgagggcatataataggggcatgatagatgctggttgaattgaattgaattctctagtcttagagaaaatctgtcattgaaagagaatttagttaattctcataagacaagaagtattgcttgaaagttctttttgacatatttgagcagagtggattcaaatacctacttgctgtgatatagttagtgatatctattattttatctcatgttcccatgcaggttaccagggctgattctaggcacaattctgaattcagaaaactcagaaaactgtgtctttattctcccttttgtggattgatatttgtcacttagagcccattggaccgttcccctttcctcaacgtgtaagtatatatgtgttcaggtctcaagccccattgtccctgggcaattcttgctacttcctcaacgttgactaggaagataaataatagacaaatcatttatttaataaaaccaaatctagggtaatgtgtcctctggaaaagattaaccccctcaccctctttccttccttttgcctctcattaattgcctctaattactcaattgcatctaattattgccttctccagatcactgctgctgctgctgctgctaagtcgcttcagtcgtgtccgactctgtgcgaccccatagacagcagcccaccaggctgccctgtgcctgggattctgcaggcaagaatactggagtgggttgccattgccttctccagatcacaccgttgcctaaattcaaaggagtgatttttacgagactaagtcagaaagaatga

SEQ ID NO: 30134 - DNA, 1467 bp, Bovine  19866880652840
cccctttaaagactcttccacggaatcagactgtctataccggatgggaactttcactcttagcagtttgctgatgggcgttgcagccaatgctaggtcagcccaggactgaatttattcttggggcacggtgttgtgttcagtgttatggagaatacaaaccaagtgaaagactcgcaagtctagatagatgagatatgaagaaaccaacaaaataacacgaactagtggtataagcatttttcaaaggcctaaataactattgaggaaatgtaaagacaggaagacattggtatggatatttacagtttttttttttaatgttcagatttagctgctatttagctaataatgggctcccccgggtggctcagatagtaaagaatctgcctgcaaagcaggagatcagggttcgatccctgagttgggaagatcccttaaagaaggaaatgactacccactccaatattcttgcctggagaactccatggacagaggaagcctggagggctacagtcactggggtcacaaacagtttgatatgactaagaaactaacaattagctaataattctttgttaacctgatgggggacttccctggtagcacagccagtaaagaatctgcctgcaacatgggagacctgggttctatccctcagttgggaatgtctcctggaggagtgcatggcaacccactacagtattcttgcctggagaacccatggacagaggagcctggtaggctgtagtccatgagttgcaaggaggtggacacgactgtgtgactgagcacatgcacacaacttgaggggaccgttttggcttctttccaaataatgctgttgcatttagcctacatttgtttaacttcagagtatttcattctatcctgctggctgatgatactgacaaaaaaatttttttttcacatattaatgtacagcctactcgtatgctgtctctctttcatacacacaccctagaattcagaatcttcacttccctgtggcattacctttgaagcttattggctctgtgaagagtttgtgaagacttagtctgatgtatgacttcttcaaactatcagcttataactttcaactgactttgtggaataaactggaatttgttgcatgtcaccttctgtgcctggcttcttaggaggagtcattagcatagatcagtgtgtgaatgatcaccttgaggattttagtggaggctttactgcttcctgaagtggaaaagttatagctatattttccagtgtgatacctgtatactgaagaaaataatgtatgacttctcgattacatggatctgttttgtgggtagacaagataaaatatttgaaatactctggaatctcttggaaaaataagtcatacagcattgggtttcatatttagctgtgctcctcagtaatcaggaagattctcttttccctgtgagatttaacctcacgagg

SEQ ID NO: 30135 - DNA, 1672 bp, Bovine  19866880658608
tcaggactagtgttctgaacactacactgagaaacactgcaataaatccctggacacttcatgcttcactcctgccctactttaggccctgccatctcttacgtggaccatctctttcctgggcagcctcctctcgtctctctctgccaccattcactctacaggctctactgccagttttatttttcttgacagaaagaagtagtcatacttcactccttccccatctcccagctttaatatcatcattggctctcaaatacacatgggtcaactcctgggtctgctattataatcacatcaaaacctagtctcacccatctccgcaacttcatttcttaccaaatctctccttccccaagacatagcactttcttttgtcctttggctcttccactgatgcaaatggcctctcctgttcccacttacctttaatgaacttctccttaaaacccatttctaatgagatctcatctgagaaattttccctctggcatctggttggttactcctcagtgtctccctaatcacttgcaccaactgtatgccagcagttgtcagaataagaaattacccaagtatttgtccccaccactactctctgagccttttaagctttgtgtttccaactcctaacatactgcctgacacagaaaggcactcactgagtgaaaaaaattcaaatgaatgaataacatagtaagcaataacaaaacagggaaatgtagatgaagttatgaaagtttataactaggaaatgtattttgagaggtcatttattctggccaggaaaacacattagtctcagaaaacagtattactctgcttaaatagacctccaaggttccactttactgaaatcctgataaagaagaaacctttaccacaataggtcctaaaggaaactctatacctcccccaaatccttttacggtcttggggtaacagcctcatgaatagctcacctacgctagctaccccgctcaacaacagaccccagagccatgagcctctgcctgctctaggaactgtgtctactggaagaagtggtcaacccattctgttcctctgcattcctctttccatgaggatgccttcttttcaccttctggtggctctcagaggttagcagctcttccaaacatgcctccctacctttcactgctagcatttaaaatgtggggttttgtttaaaggtagaaatttcattacaagcacaccataagcaaataattctgcctgatggcttgctgaacttctttgctccaccaaaaaacttacctttcacaattagatctataggctccttgtgtttcttttttatattaaaaatgtgtggctcactgaaagcagtccgttgtggaggctcctcagaaggtccacttttggaatggtccttgggaaaacaaatccttttgtatgctgcctgaagttcttggaccgcatcaagtgtttccttttttttgatctccaaaggtatgaatttggtagattttggtttctgatgtttatttctgaagacatttatggaagtacctggaactttattctataaacaaaaataaatttaattaaatttaactgtataaaactaggtaataaatttggtaataaattaataaaattatatccactaaatatattttacaaagtactttactgtataagacat

SEQ ID NO: 30136 - DNA, 1414 bp, Bovine  19866880751999
atatttctttgagttgctcagaaatctctaaaattaagtttgaggtttccacatattcaatattttaaatcaggcaatctcaaacataattccataatttattaacatctctcaatatcattctcagtgatataataggaggaatgtctttcatgtagattcttaccatttttgcttacattcacttctgtctgtattttcattaatcctttctatatctcctttctttagaactaatttgttattttgtttattgcatatcttcattccttcttattttaatcatagtattttatgatgtaagtttgcttttaatttcagctttggccaggttccatggtttttaatatgcagtgttgtcatcatcattcctgatgcatttgataaattcagttttgatgtatttaataacccacagtttatctggaagagtatttaattttccagtgtttcatcaatatcaagaacaaaacggtattcactggcttcctgtgatacaaaatgaaaacattaccacaatttatcttctcacatcctggttttatttttgtattatctaagtttttagttacagtttttaaaatctccacaatattacataatttattttcaaaattaaagttgccacttttgcaaccacaggtaaaataattattcaaacatctcaaaattgatttgatgcacagctttagttagttatacacaattttcctattttttaaatctattattttagcatttgttagccaaacagttgagtttaaatcgtgactcattggtcatttactttctatgttttcttgtataagtaatagatagtctcctaaagaggagtgtggtctcagcattatctttgtttctaaattaatttttattggagtatagttgctttacaatgttgtgttagtttcttctgtacagcagactgaatcagctatatgtatacatatatcccctcttttttggattttcttcccatttaagtcactatgctactgctaagtcacttcagtcgtgtccgactctgtgtgaccccatagacggaagcccaccaggctcccccgtccctgggattctccaggcaagaacactggagtgggttgccatttccttctccaatgcatgaaagtgaaaagtgaaagtgaagtcgctcagtcgtgtccgactcttcccgaccccatggactgcagcccaccaggctcttccgtcaatgggattttccaggcaataatactggagtggggtgccattgcctaactgaatagagttcccagtgctaaatagttgatttgcattagttatctatttttatacatagcatcaatagtgtatgtatgtcaatctcaatctcccagttcattccgcctcactcttccccacttagtgtctgtatgcttgttctctgtgtctatgt

SEQ ID NO: 30137 - DNA, 2145 bp, Bovine  19866880753084
ccagagagtcgcctccactcaccacaaccagaaaaagcctgcattcagccacgaagcctcatcacagccaaaaatcaaataaattattttcaaattttttaaataaaataaagatgccaggaagctcctttttttcccaggaggatctttttgctaattgactaatgcctgaaaatctgacagaacacaaaagccattctttcacacaataattaaaaataaaattttaaatgtaaattgcttcaggagatgtaaaacatggaaaatttcaaagtaggctggaaattacccttacctgaccctcttctgaagaggggtttgagcagggcaagctgccagaaagaatctgaaagtcctgaagaaatagactaaaaaagaggccctgaaagtactgaaaataaaattttaccaggtccaaagctgtgcttagtatcaccccatccacaatgtcataaacaggaggcagatcccgaactgttgggagaagaattctttcctttggttatagaagcgaggaattatcgtcattaataattgcattgtctaaactcgagagagctttaaataaaaagtctgccctcattctccaacccacatattcattttcaacttctacctaataatcttgacatatttcattggttttatgagtttttttaatatctctctaacattagttaatttttaattgccaagaaggtttttaaaatctattatgggtattaggatatggaactactaagtttatatatatatatttatatatatacatttatctgactttgagatatttctgaagcctgtcataaagtcttaacttttaaaaagactctactactttcatgagctttctgcaaaaccactcatcagagccatttagaaaggaatatgacattaaaaggaggtaaattttcctcatgttatactgtgatttagttgtgctcgcccattaagtctaaatctgtcttccaaccagtgtgaagtaggcatgatttatttaaccctgatggtaaaggtctattaaaataataacttgaacatagtcattgaagaagggagtggcaatccactccagtattcttgcttgaagaactcaatggacagaggagcctggtaggctacagtccatggagtcacaaagagtcagacaatgactgagcagctaacacacacacacacatagtcatggctaatacgtcactcatcaaaaagagcaggccagggattccacggaaggctgtgggtctctccatgtcaagggaatgaacaaccaaagggactaaagatatcaacccctcaggaacttctctggtggtccaggggttaagactttgcctttcagggcaggaggtggggggtttgatccccggttggggagctaggatcccacacaccttgcagccaacacaccagaacacaaacagcagaagaaatattgtaacaaattcaatatagacttaaaaaaagtgatgtcatgaacagagaatctcattctcagagggtctcaaggagccaggaagcagcctattggaagtggggggtctccatgacacaatcatgaaccattatcacagaccagctctgcatttaacaaaggaaatgtctgcagttggataaggaaaacaacaacaaaaatcacggtgtttaaatctttaaaataacatacagcagtgttgctttacaatacaccttgttgatgaatggatttagacgttctaaggatcaaattcacattcctcgagtgttttcactatgactacatctacaaactttctcacagtcctttaaaatgttagggctttttaggtacttgaatccaacaatgactttaatcagtcattccactttttctacagccgtacacttatttcatcactaaacttctcaaaggcaagttctatccttatactatctacttcttgctctgtcttcactatccacttcttctcaatataaggacataaatcaattcattgcctcaacactctcctaaaactgctctagttaaaataaccagtcatacaaaaaacaacagtcctaagatatgaattctttactcctattccctgggggtaatcacctttatcagttctactctcagaaataagtccattaaatgttatgaaaatagtttgtaatagcaat

SEQ ID NO: 30138 - DNA, 2988 bp, Bovine  19866880848673
ggatcggctatccatgcccactttaaattattaaaacgcatgttgtaaatgattaaaatgtcaaattctgttacatatatttaattacaagaaaagaaaaaacaaaatgataaaagcaaaaaaaaaaaaaaaggaaaaacaggaaaacatagatttgtgtgaaatatagtgtttctacatgttattcaatcaaagcaaattcctacacttggaagccatattcttagttagatttgtccaactcaacccaccatgagggagcagaaaaccagacttctccagaaaattttttttttccaggactaaaagaagttcaagagaaatgctatctggagaggtatttaatgtggattaaagaacacacattgcccattctagtttcataaagctctcttctcaattagggctgaattataccctggctaaagcgagtcctacacctcctgttcttcctagagtcaatcaatagcatcatctcctagaaagggaggcctgacctctgacttccctgctcttgtattctggacaatttttatccatggtggtaatggtccaagggctggcagtagagggatatagtgttccatagctcttcaaaccaaaaatagctggtatcttttgggcacaattttgaaagtgttgtgactccaaatgtctgaattcattagaatttgggatttaaaacatttatgctatagattttctgtgattaggtttaaaaaagaacagagtggcaggttatacctttttaaaaatttcatatgaatttgatatccatttatattcagtaggaatatttgagacctagataagaaattctgtttttcttttcattaaatccaggttcccccatattaaccatttgttagccttcttggattattattaatatttgacagcattaaagttttagtaaaattatctctattcctattccagagcagacgtcccagctgatagtctacccagatttcattgaattctcagctgctagaagctgaggcatgtgcatgcgtgcaaatcgcttcagtcatgtatgactctttgcaaccctatggactgtaggctcccaggttcctctgtccatgggattctccaggcaggaatactggagtgggttgtcatgccctcctccaggggatcttcctgaacaagggattgagcccgtgtctcttacatctcctgcactggcaggcggattctttaccaccaacaccacctgggagccatcatatttcttcatatttacttggctacggacctcagatttgaaaacctaaggaagaaatatgtctttcctctggtgttgaaaaattttattctctttaaaccatacttaaattttttttctccttaaaattttccttgttattcttagcccttgttatttttagctttttgccaagtccttgcgtgattttcttcctttttttctgagctctttatgcacagaaagggtcaaggggactttattactcagtgaatcgtttataagtaaggatctccacctcaggtgtaagaacatgctgggtgtcatgtaggtgaatgtgtaagtacctgtgtatgtgtatgtgaacacacgtctctattcacttcctacagagaaacaggagccagaaaaaataaaagtgggtggtctgtgtgaggttggtgctacttgaaactgagtgactgcatagggctggtatttatacttacacataaacagtgacccaataatacactttttgtaaagacatttcattttgggtccatttggaagtgtcatagacacatgtattaatctccagagttgtctttttcagaaatttcaagagttttattgtttagagtgtctctgaatgctccttttgggtgtgatgtttgatcagatccacagttgataaactgtctccaaactgaaaatgttctgcatgaccctgtttaatttcatggagtctttagaaagggttttgtgtgcagactcaatccccgagtccggaagattctcctggagaaggaaatggcaacccactgcagtatccttgcctggaaaatcccatggacagaagagcctggtgggctgcagtccacggggtcacaaagggttggacaggactgagcgacttcacgttccctttctctttcagtctgcaaaaacagctccttcagctgctccaggtattcaattgcacttccaagtgacacttcctgaaaccaaatacagttgctattgagtgaatgaaggagtgaattagtgaggaagtgatatttaaagtggtctatttgttttagaggaagagcatggggtcttccaagaagtctcccttaatctaccactgaaatgagattgcagccaggaggatggagagagagctgaaatgtaaataggggaaaggagaatgatagatgagcaatagttttgcatactgaagaatgttccagactgccaggaagtcaccaggagggaagaagtaaacctgttgtctctgaacctgttgccctctgcagtgagttgatgcgtgttctcctaaccctccttctcgccttagctccctcccagatgggcacggagctaagttactgctaagggaagctagttactgcccacaccgcctttgattctgtctgcttgccatgcactcctacttcttctcagagcagcttatctgggcccttgccctgctgaactcagtgtcatgggactgtcattcaaagtggccttacttactatttacaatagccagacgtggaaatagtctaaaagtccattgacagaggaatggataaagaaaatgtggtacatatatacagtggaatattcctcagccataaaaatgaacaaaatagggtcatttgtagtgatgaggatggacctagggtctgtcatacggagtgaagtaggtcagcaaaacaagtatcatgtattaacacatacatatggaatctagaaaaatggtacagatgaacctatttgcagggcaggatagagtcacagatacagaacag

SEQ ID NO: 30139 - DNA, 1863 bp, Bovine  19866880857044
cgagccactcagtccatagcgtttattatggcaggcctggcaaactaaaacgcaaagtaacaaagaaagcacggtcgttctgatactcacaatgtctacaagagaagcacacttattttctgtaaatttttttccattagactaactttgaagattaacttttcttctaaaatttcttccatgagtactttaaaggaagcctgggataatggcatggtcagcttcaagagcatctcttcaataatgacactggagtgcttaatatggatcttttatacaatccttcaataccagtcagcagtggaaagaacaactcagaaagataatttttcaagacctcagaataactgggccattccctttctggtcattaggtgtgatccaaagcttaaactgatacctagaggcaatgcatacccaatttataatctgctatgacaattattgtgcccaaaatagcttttgaaaagatggccttgaatgggaggaatttgaggcaatcttgttaatgagtgaagactaatggattttggattgttggcgttgtcttccctctcagactctagaagaagtcagtaccagaaagtgtcttggctatggatgtgtttctcatagcataaggaaaacatttattttagttttgtttttaaagtttcaagtatatatatttcaccactgtttggcacctggagtcaaagaagtctgctctataaaatctcaggatatataaagaataaatgtaaacatgaaatatggaagaaatctgtatttgtattgcaataggactcagttttaagacacagagtgattattttaaatatattaaacaaatcataaacttctcctttggagtcaagcttcactctatcctacagtgagtattctcctgaatgcagtctgacttgtatgtataaatttttatttcatgccattcattttttaaggttgaagattaacttttcttctatagttgcgttagaatacaatattaaccttgagaagcactttgtattatctcttgactacttgttccttttagaactccctgatcatgttttctatttcaaagcaaaaaatcatcctcaaaagtaatattgtacttttaaaaatgtatgcgcacatataggtgataataaaacatgaaacaggacctatagtctaaataccaccctcaagatgttccatgacacatattcatggctagaaaaatactcatggctatacaaattattttttaacctatatattccatactttcacacaaaacaaagtgcttggcttgaaacacactgtccttataagatatactatttacacttgccagcttgatttttttcactgcctccttctctggccacatgacacactctccattatgaagggtgtcagatatgaaggtcattcagcaaagcagcctgacaaccattctttttttaaacggtggttgtacaagacacagactaaaaggcagccaccccaacttcaggattttaacactttatttgtctgttctgggtcctagttatggtatgcaggatctttttcagtggcaggcatattcctagttgcagcatgtgggatctagttccctgctgctaagtcacttcagtcgtgcccgactttgtgcaaccccatagacgcccaccaggctcccctgtccctgggattctccagaccagggaccaaatcttggccccctgcaggggagtgtggagtcttggccactagaccatcagggaagtccctcagacaaacagtcttgaggattcttactaaaatgttctctgatttttttctagtgacatctgttgtttctttttcttcctacttaacataattagaacctgagggatttggggtcat

SEQ ID NO: 30140 - DNA, 1576 bp, Bovine  19866880872566
gtctttgacttacttctgtatcttctaattctcattgcaatattttataagaaaggagaaaagaaatacataggtatcagtatattaataacaaaaacatccccaaatgctgaaactccaagttctactattatccctaaataatattggagggtgtgttgggtgtgattcagtgtgggaaacagaagccacttttcatacttcaaacaaaaaaagatctaacacgtgaaattaggggttgataaagtgtttggaagagtttggtctctagaaaccaatcacagaaccattccttagaactgactcactggaagctatttctctgagactaccatttgaacaattgagttcaagaacatacagtcataactgtagtgacgacattaggaagtggaaatgaaggagctgaacgcgacatttagcctcctctctacggcaactcctctgaaaacatagaaagctagataaggaaattggtagcatcactagcagaaaacttcacatcccgtgagcttgtttgccaatggaataaggcaaaagtcaagaaaatggcctccacttcacttctgcctcccgaatctcatgcaaggaatcttgcaaggaatctcatttctaggaaactaccataggaaaagaaattttcagcattccaaaccctacaatagagaaaaacatactagaagcatgatcaaatagaaattgaattagccagtccaccatgcccaccacacagaagggaagactgagtttaccacattgaaagatctctatggaattagcaggtgagccatatctccagcccagtgcctggcgcaacatcctgcacctattagatgctcatcaaaaatttagtaagtgaaagaatgagtccatgaataaatgcactgtggatgccacaaaaatgaactgtaatggtggcttctttcttttagtctccttttagaaaattattcctaaatgatgtagtgatagttgtttgttcacttatttcaaatacaaactaaaatattcttaactgtctcacttcccttttgtgtctgtctaagcagcttttagaaagctcaggaagtaaagttttaaaaatagaagaaatctagattttttttttctccttccttttgttggacaatgagtttccctttcacgcttttgtggttattattgctaaatgtttcctccaagaagaagtcttcctatttgggttatttttagaaagtcaaaagagaacttctaagcaatggctctttatttaggccaggatagcagcaactttgagtagattataagaatatagccctgcagttggtcaacctctgattctctttgttccacattaaacagcatttttcaagactactttttattctcttcccctatagcatataggggggggggatccatttacccctaacaaaaagtcacccagatatctccttgcttaaatgagaactaattaggattggcactaagttgcacaaactcttatcacagaatgttgggaccaaaagaagttttaagagtcacacggtgctactgtctcacttgtaggtgaaccgcttgtttgtagatgagcaaa

SEQ ID NO: 30141 - DNA, 1698 bp, Bovine  19866880874866
tacattaatataccaatatgatttcagttaagaatggaccattggcttgagaaagtagcttaatcattcatttgtattccctaaattatttccttgaaagacaatggctgaactaccccttttaaggtattcccattaaaattccacaagttccttaatgtaacctacagcttccaagttggacattcaccaaagtcacagaaacttaatgaaggagaggaacaagttcagtgtatctgtgacaggccagaaggtcaagtgagctcaaggacagacaactcataaggaaatacaatcaaaagcatgttaaaagactagccttccaaaataagctttctgaaaacaagtttgacaagaagacatatgctcctgaaaaaaattttagacttttttttattcattgatgttgtaagactataaaattatgattcagaagaaataatttgtgcatattaagcaatttgaaatcatgacttatacagcattccagttacattcaagctactgtgctaggaattctgggatgtaaaatatggaaataccaaatatttttagagtatgtgtgatctttatattacataatttgttagcagcccatgccatttatagagcattcagtaactctattaactgctcctcagttcttgctgatgatacatctctaaatctacagagtgaaaacaataaacagaagtgctacattgtggagtattaatgttgaaaaatgtaataaattcccagagttatcttccctaaaatatttatagtcaaggagttactgagttttagaaggcccttctgtaatagactaatctttttcaaggcaaatgctgtaaactctactgtcaatcaatttaataacaactgtaattttaaaagatacaaggccctggccacttactaaaaagggcaaagacagcacaaaacttcagaagatggagtcttcaacttataaggccacttgcatatctcctttctgtctatttggaccaaatgttcacaaatggactctaaacaatgaacacaaatcttttagaatgataggctagctctaaacaatgatgcaaattttttagaatgataggctaattttcaagagggaaattgcgaagagaaaataaattgcaatcaggatcttagttcatctcatagaacctaaagcctcaactttctttttcgtaattttctttcttttgtttcctcttctttctccaggctatcttttagaactgagcacttaaatacacctttatatgcacaagccaaacgagaccgcatttaatttgtgactctctgtagctatctctaacatactggttttaataattcccaaaataccaatttcactattttggttctttaaatttatgctttcaactttatttttatagcttcattgacatgtaaatgaaaaactacacatactgaaagtgtataatttgacaaattttgacatatgtttacacccatgggaccatccccccataaccacagtcaacttaataaacatttccattctctattgtaatccatcaggtctcacttcatttcccacacccattccaggtaaccacagatctgattctgtcatgggcctagtttatttgcaacttctagacttttatataaacagaatcatactcttgtactcttttttgtctgacttttttcagcataactcatttgagattcagtcat

SEQ ID NO: 30142 - DNA, 2331 bp, Bovine  19866880931318
gacttggtgttttaatttatactccgtttgaggttcaaaaaaaatctactgtcggcaacttttgaagtcttttctagaaaaaaacatctacatcatgttctgcaaagaccccagagtgcccacattttttgagtcactttttgtgatgcctaaggtgtccttattaaacctcattgctagttggaaaacaatgacactgaaattaagggaagaattcttggatatctcactgcttcctcaggagagactgaagtcatcctcaataaatgccatcattctaaggaaggcttgggattttgaacatcagcttaaaggaaaaatcctcctctaaggccacaacttcctctactttctgtttgatgccagagtgtttctacttttgtgtttgaactgaaatcatattatctgctgctacctgaagctctttcaacaccctctgcctccatagagaagagaagcatctttggaagtgtatccttatctttgttggtgtcccttctgtgcatcagatggagggtttacgttatgttttgggggagcaggtgggaggagcagctggtgtgagaagaagtgagcagcctgacaacagtaaaatggagagtagtgtgtgtgtgtgtgtgtgtgtgtgtgtgtgtgtgtgagtaaagagagctagtgccacaatatgaaaatggcccaagactgtaaactttgtggtctgttctccagagctaacaatacggtaaatgttccaggtgaaaagtcactgagaccctggaatcatgaaaatcagaacagaagaaactaggattaatagcaactttagtaatttatcatgaatttcagtgacacttgtaacattacattttccattgttttttttagttataattccacttaaatctttggtttcttctgtgaatatttggtacattcctattctgggtcaggtcctgtcacgagctctgagaaaggccaggaacaaggcaaagcagcagcatccatggacccagagggatggtccagggagggaggtgggagggggttcaggatggggaacatgtgtacacccctggcggattcatgttgatgtatggcaaaaccaatacaatattgtaaagtaattaggctccaattaaaataaataaatttatattaaaaaaaaacaccaagactagttttcagtttcatacaatgaaataaacactatccctttatttcaagcttagcaaattagtttaatatccgttctgttacaacagtgcacttcaaagagctatctgattttaattatatatggcatatataattatatattctttactttttcaaacacaaaaagaattatgataaatacgttttgcctcacaaaaaagtatcttttttcattccatatcagtacttagagagctccttttaatagctgcataggattccagcatataaatgttgtgtattttatttaaccagttcctgttgatgaatatttaggtcctttccaatcttcccaagagaggcaaagaagaatattgttggacatgtgttatttggcaaatgttcacatgtattgtaagatataattctggaagtggaatttctgggtcaaagttacatgtactggcactttaaaattttttaagtttattttggaatttctggccgcactgggtcttctttgctacatgaaggctttctccagttgtggcgagtgggggtcactgtctggtgaggcgtgtgggcttctcactgcagtggcttctcttgttgcccagcacgggctctagactgtgaggggacattagtcgaggtgcacgggctgagttgctccatggcacgtggaatcttcttggaccagggttggaaccctagttccctgcactggcaggcagattcttaaccactagaccaccagggaagtccatggcacttttgatgtgtgtgtatgtgtgcgttagttactcagtcatgtctgactctttgtgaccctgtagactgtagcccaccaggctcctctgtccatgggattctccaggcaagaatactggagtgggttgccattcccttctccaggagatcttcctaacttagggatataacccaggtttcctgcattgcaggcagactcttcaccgtctgagccaccagggaagcccaacagttttgatatatattgtcaaatttcctttggtttaagttgtatcaatttgcacttagtaatatgtaactacctgcttcctcaaaaccttgaccaaagcctgcattgtcaaagtttaaaattttttgtcaagctgctaagtagaaaatgatacctcctcagtagcatttaatttgtatttctcttattaagtaaga

SEQ ID NO: 30143 - DNA, 1431 bp, Bovine  19866880960776
agccatcaaggaatgtcatttcttgacctctctaaatgagactgggagacctttgcatgaccttgagttggaggtggcagtaagcaggaggaaaagaaaccccacgacgactaaaattgaatttcccaccacctggtgggacagaaattgaattttatttaggttcataggaagaaaagaaagaaatgtgacatttcttatattcctggcttgtagaccaagattcaagcatctttcatacataaaataatttattttctaaatattagcattagcaccgccacttcaagataggagtagaccacatgattaattcttttctctctcgtcagatttagagtgccttctgactcagccgcgtggttccctatagacacctctccccactgagacctatatgcaaaacccagcaaggtggttcaagtgagctccaagcgcccggaaggtggtgccatggcaaccatgtgaacaggccaatgattctgagttaggtgggtgggtctttgtggagacacattcaaatacatatgtgttgattagacaacttcctggtgggtttttagtatctgaagtatatcattaaaacaaaacaaagaacaacttttgaagaaaattttctccctgtttatcaccagatttgagatcgtggtttagacagtatttctcaaggggaaatgaaagaataatttagatcctccaagcagctatgatttcaagatgcttgcgagctgtgggataagccgtgatggggagagtagctacacaagaagcaccagtttgcagccacgtggattttctttgactagatggagtttatctcacctctgcgtctttgcatctgctgggctcttcgtctagatacctgttcctccatttttctcacggctgcttccttctcaccctgtatgcttgagctcagtgttactacaggcagcctttcctggccagtctttctaaaataggtctcctcttcctgtcctgcctctcagcatcctgcttgttccctttattgctctagaatcatcttaaatatttaatttgcttaccttttaatcaggttactaatttgtttatttaacctacactcctcccccataatgtaagctccacaaggttagagagacatgcttgttttgtttattccagtactcactcacatagtgttttacacagagaatgtcatcaattaatatttgttggatcatgtatgaaagaagataggagacagtctgcttggatatataatggtaatttctttttcctccacttggcagtgctgctcatgaataaatacctctgtgcttacgttcacttagcctctttaagagagtgcttttcatattggtattttggtttgtctgagccctgggtttcagctctgtagattattctatttgtcctttgtcaacctggttctccaccacagctttt

SEQ ID NO: 30144 - DNA, 1774 bp, Bovine  19866880993835
aggatgagatggttggatggcatcaccgacttaatggacatgagtttgggtagactttgggagttggtgatggacagggaggcctggcatgctgcagttcatcgggtcacaaagtcggacatgactgagcgactgaactgaactaaagtcatcttttacttacattctctccctcagttaatactatactatcagctcaaataggaaaatcacccaagcggggaaacagaaaattttctctacattcttatatttcattagttaacaaccattaaataccttaaaatttttattcttctcatcatccagaataattctcttattttttttcattgagaaagggaacatagaagagaaaatattttcctacaacagaaacctgaatgagctttaatataccttgaattaaaagaaatattttcagactcattaaaataaaacactaggattttaaaaataatattgagttcaccaaaaagtttgttcagttttttccattatggaaaaaaataaactttttggccaaggtagtattttaacatggatagtataatgttaccatttttggaaaatgtgtcaccaactgatcatcataaatgtggatccaagtagatctagaattgcctgttatcatataccaactcttcatcaagccccatcagggcttccctgatggctcagcaaataaagaatcaaaaaatcctcctgcaatgcaggagacacaggagatgagggtttgatctctggagtcaggaagatccccaggagaaggaaatggcaacccactccagtattcttgccttgagaattccacggacagagaagcctggcgggctgcagtcatggggtcgcaaagagttggccacgactgagcacatggcccacatcacattacacataatgtgtatgtcgaaattgcctgtgaccatgtgggttagagaaagagctcatggttcaggcactaagcaacaccttttctaaagggagcaaaggaggaggatcccagtggcttgcaggaattggtacctttgcccttgggtgatctctgcagttagagaacgcacgcacggtctgagaaaaaattcaccttactatggaccttgaaccattctgcacacacacagaaaaataaattaattcaagtgttcttaatgctgctaacattgtacttcactgaggagaaaaaaaaaaaaaggtgggtgcagatagaggggaggactacagagaaagaaatttggaaatggcacaaaaatctacattctgcctagggcttcccggagtatacatttatgaaaaggagacataatcaaacacgaaccatctattctgttgtgtaataattaacaaccctggtccaagcatgtggccctattcagatataaggcttttcttcttcttttttattttctacttcataacatacaaaacctcctgtccaaacagagcctggtgctacacccacaataagattcagcctcctctgtagttttaattaactcaggcccagcagttgtttttaacagttaacagtttgcatgagttacagtatgcacactgctgagacataaatgcaaagtaatcactctaataagtagatacaaacatttacaacaattgcaacaagtctctgcaacaataagggatataaagaaaaatatccagcagcaagccaggaaacaacttctcagtacaacagcatgagtatgaatatcattcaaaggctctgatccttttgttgcctttagtaatttcaataacccaaagccactaatgg

SEQ ID NO: 30145 - DNA, 2082 bp, Bovine  19866881011937
agtggtatagtatgtaatacattcatatgacgaaccaatgcagtgttttttaaaatttgagagagctgattcagaagatagaaaaagttgttctgtgtcagacattttcaaattaaacctaaaatacatttacttctctctgataagagaatgtgaaggtgttgtgggtttgataacccacggtgctaataaccatcattgagtgtcagctaattacagtgtgtaaaaataaagtatccagctaatggtaggttacattagtttcagttcttgaatcatcttgtgtaaacaaaagttgtaagaaaatgagatgaaaaaagttgagatagtacagagtatataagggctgttattactcccttaaagacactggcagtctccaaaatattgtccagtctctttaatgattgcacgattaaaggaattcctttggaaaacagagttcggtgtttgtgatacaacattaaaattcaggaaatgagattgcatgttttgaaagcattctcctctgaatgacacttttgtgttcaaaatattgtgagacatcctatggtagggactgttttgtgaaataaacagataaagcagtacttgatgtgttgacaagataactggaaacatcctgggagatttcagtcactcacagatgcagggtgtgtctatttgtgtttatgtgtgtgtagcgagggctcatggtatgtgtcagtgttctttggttttgtttcttgcatgttttttggctttgttttttgatttccagggaagtctggagggttacagtttaaggggtcgcaaagaatcagacacgactgagcgactataagttgtcttatcatctttaaaccaatcatgtacagtgatggtataatagttaagtgctggatagcatcaataattgctttcttgttgcaaagattttgaaatatccaaaagtcttgtttttctgtcttctcaaaatccatctgctttctgaagcctggtgtgttctgggcttatggtttgagtttgtggttgttcttcacagtagttctctgagaaatgctccctctctcctggcggccttccgtttcactcaggaggccagactagcaatggcctcactctctcttttgatactattttggtctttaaatgagttcatcttctaaataactgtttactgactttccttagccagatgataatgttagaccattgacaaaaccccaatttcattcattatataatgaaatggttacttagaatgcttttaaacaatttataaaccaaattttagaagactggttttctaaattattatttttccctattctctgggcagtgctttcaaaaaagtcaaaatccactgtgcctcaccccccttcacaaacatacacgtaccatacgtatgggtacacacacattatatatatgtgcgtgtgtgtgtgtgtatctgtattccagagttctgggttgtatttgggaaaggcatcattcttagagactcaaagtgcatattagcttatcagaagctttgaaaaatcctgtcgtgacaaagcctattggtacaggaatccccagctctggggccacggcctgttacaaggcaggccgtacagcaggagatgagttgcagagagcgagtgaagcttcatctgtattcacagctgctccccatcgctcgcattaccagctgagctccccctcctgtcagatcagtggtggcataataaatataatgcacttaaatcatcctgaaatcttcccccgctccctcaaccctcctggtccgtggaaaaattgccttctgtgaaactgggccctggtgttgtgttagaacatttcccaaagtatttgatcatagaccccttcgttgcggaataccctgttagtatcccctggagctcatgttctgtaaaatgctgccctgaagagaaacaggcatttaaatgttattactcactcaaatatagctagtgtctactatgggccaaccaccaagctaagcagaaggcatgtaattgatgactaatggtttttaccactttcacggggagagcagtgaatgagacagaacgcagtgtgatgggtgacaggtacctg

SEQ ID NO: 30146 - DNA, 1482 bp, Bovine  19866881014415
tgcctatagaaaaataaaaataggtggactataaagattttgcatctaattcaaaattttacattttcagtgtataagcttttcctgaatatatgttaatcatctttgaaagctatgttaatactttcaggtgactaaagcactatttaaaacacaacagataaatgagagtttacaaagtagtcaatacaagtctaccttaatctattatctttgtaacttaaaaatcatataagcccagttttgttttatcattcagtaattcttattttgttggcatctgaaaacctcattgtaagatctgatctctttttatcagatggaaacatatttgaccaaatatacaagcaggaacatatagatggtgatgatagtcatttcatcctagttgaatttcctttagtccaattactaatgcattttttctttcatgttatttattatgatgccttctgataattaagttctttccatgggaagaaatagtacattaggaaatatttattgagtaaaaagccttgctttgaaaaatctaccaatagttttatgtcctctcagcaagagtcaattgtaagatgaaattttccaaacattttcttttttataaaaataaaatttgctaattgaaacagagaatctgttgaacttttgttatcccctgtagagaagctaaaaatgcatgaattaatatactgtgactatggagcttagatactattaacaaggggaaaaataaatatgattctaggccaccaaccacttttagtatccttctagctattattttccctattgaaaaagtacattaggatttgatgtgcttggcatactgtacagaatgctaatacttgctaattatagactgctttaaaaaaaatcaggtagatctacaaataatgtccaatttatctgcacttgcaggaaaggcaattcaatattgctgagaaagtaagaggccagtggaagataccatataccatgacaattttaccttagctttgattctcttttcatattttaaaactggggtatagttgctttacgacgttgtgctttctgttgtacagcgaagtgaatcagccttcagttcaattcagttccgtcgctcagtcatgtctaaatctttgcgaccccatgaaccgcagcacgccaggcctccctgtccatcaccaactcccggagttcacccaaactcatgtgcatcaagtcggtggtgccatcaagccatctcgtcctctgtggtccccttcttctcctgcccccaatctctcccagcatcagggtcttttccaatgagacagctcttcacatcaggtggccaaagtattggagtttcagcctcagcatcagtccttccaatgaacacccaggactggtctcctttaggatggactggttgtatctccttgcagtccaagggactctcaagagtcttctccaacaccacagttcaaaagcatcaactcttcagcactcagcttt

SEQ ID NO: 30147 - DNA, 2163 bp, Bovine  19866881017971
cccacccacctgcccatccaataagcgtttgttgatcactcactcttttccagattctatgcttgatgcgaagaggtcagaaataatgagaaactcagaataaaacaaaacaagattttgagaggggatactaagacccatatttaccctcccacatggaacaataaaaaattcaattaaaatatatggaacaatggatttcaacatattggacagcagacaagaaaatacagggattcctgagaaattgagataagccctattattgccttggcttgccacctggagtttttcagcccacagtacacagagaacccaaacagaaccagaagactttatgatttgagaacatggagctgagagtctgggggcaaccaagacagagttctaagaacagagtaccagagaaaagagaactacggtgacttacagtgagtccctcttgagtatttagcagagtattcaccagtacctttgtgtaaggaaagtgcccaagtctgggaaaggagccatccaagactgttagggggaaccatacccagggctcacacaatgcttggaataatgcctgctcccaccaggctgactggaatacctcataattcacaatagaaatacttaggaaaatcttgcctcaataaagcagaataattaacccaagactgggcactgctccagactcacctaacgaatcataaatcaaaacttaaaggataaaactgtctccaagtaaattaacttcatcctagaacaaacgctcaagaagatttataataaaaaaaaatattcagcacctaacaagtgtgacatccggtcaaagattatcaggcattcaaagagccaggacccactccagtgttcttgcctggagaatcccaggggcaggggagcctggtgggctgccatctatggagtcgcacagagctggacacgactgaagcgacttagcagaagcagcagcaacaccccactttctactaaaaatttatcctaatttgggaaaattatcttaacatgcatgtctaaatgattaaagtatttaaaagatgatctttttagtcaattattgtgtcattgcctgttgtaatccatgagcttatgatactttataggcttccctggtggctcagatgataaagaatctgcctgcaatgcagcagacctaggtttgatccctgggttggaaagatcccctggagaagggaatggcaacccccaccagtattcttgcctagagaattccaaggacagaggagcctggcgagctacagtccatgaggtcccaaagagtccaacacgacttagtgactaacactttctctttcactatggtactttattagctccttgtaatatacaagaaaaagagaataggcaccaacatggttgaccatttgcctgtcacttggtactcaagggcttgagtgagcaaggttattggagattctgaacttgacattttccctgtatgctcaccaggctgtagagtcctactgccctagagacacagatgcaggggagagtttgcaatctccacaagtcttgccaagagtcaaaggaagatattttttcagagaaaaatctcaaaagtggaagtcacaggtttttctttgtagaggcgcaaaattgattgaaggagagaaactgggaatgaaaatgagaaagcactcctttttggaggtctacatgtaccagtatttaagatatcacctcatttagttgtaagcctgtaaaagtaccgttattcctgttttacagttgaggaatttattaacagaaggactaattaactttttggaggtcacaaagctagaaagtgccacagttaagttttgaaccttaagcttgatctttcagtccagagcactctctgctcctcactgatacctcagctcagtttgagagatcaaggacaccaccataactgtgatcccttcttgcccctggaatgttaagtccaccctcttctgaatccaagatctaaggatggaaaggagagaggtaggaaggcctgagtccctgggagaagaaattcaggtcctttaggggtatgggtcatgaaagtgtttcctagaagaataaagttgatattaaggttaagtctcttctgttacaaatgttgttgggctataagaacaagcaagtttttttcaaatgtcaagg

SEQ ID NO: 30148 - DNA, 970 bp, Bovine  19866881060523
tttatattaatgtttctttcatttatcagagccttgcagagcaaagttgctctcaccagggaatttatattcctgatattatagtaattcagtcatataaaacaaaggcttgttggtggatctctgcgtgttaggaagactgagtgtgtaatcttaataaacagtgatctaacaaaagaaacctaaagccttgctctcgaacagacttatgaaagtaattatacctttattgaagttattccattctccaacccctgctgttcctgttgtttcttaaagatggttattttctacttaaagaaaacagacaggctttagaagaagagctggtgttaaatactattacaccatttaatcagattctctgtgcagcttatagaacaatagtacaaatatttcaacctaaataataaaagattcaaagaaacccagaatggttaattagggtaacctaataattggagtaacaactcacatgatggtaggatagcaattaggggaaaacaaggcttccaaaggcgatggccattctcagggcatatcattagcacaggatttcataggcttggcacagccatggatgaagtgatagaaggcattagcagtgttaaataatgtaagatgagacaaaatgtcaagaaccatctttttaaaagttttagaggagaaagcaggaggaattttaggagcagctgcttggattaggtagctgaagcaaggtgatgacacatgtttcaggattgctctttgccccgagggttccgtctccagtttattcagggggtatttgagctctagggaagagtgtttaaatagctcctactgtcacataactgatttataaccaaaatctaatttgcattgtgaatttggaaacaaccatttcccataggcagatgacaggtggagaagggacttaaaacaaggagaatcctatagggagaagcaaccacagtccaactagatctca

SEQ ID NO: 30149 - DNA, 1248 bp, Bovine  19866881079057
aaaaataaaaggaggcaagaaagggatcgacaaaaagcaggctttgaatgcataatgaatgctttgcagctcattgatagacaacccttaaaacaaagcattgttgtgtgaaatgttctaggagaaaagaactcaagagtttatcaaatgagttattggaaaagaattttttttaatttgccagaaaagtaccaggccattattgcatcttataaattatttattattcttagatatgtcataaagtccaacacaaataaaggaaaaatgctgacaagacagaaatatcattgtgaatatagagatagctgcctgaaaccttgcaaaaagttctaagaatttttgcaccctgcctaccacattttcaccacttagatattttgcttttctgtatttgagggtgtcagcagtttctttttccagccagaccacccattcccatctttctttgcatgactaagctaacagaccgtaaaccctttgctctgtatgtgtgtgtgagagagagacagcaagagagaaagaaaattaaccatgaaaaattaagtaaaatatgatggtgaagagaaatccaattttaaaagcatctattcatatgattacctagtttatatgcatctctgcaagattctgctggggactgccttagctgttctggagtcttacttaataaaacagccaagtttattaagaaagaccctagtctttcactcttatgaagcaggctaatgaaatatcatagaaacggtttcattttaatactaagaagatattgcgtatctgactgtaaaatatttttcttcttattcactttaagagtcttatgagaatgactggtttaaagtaaaagcagcaatttcaaagttgcctagtcacacaaagacacaccatcactcaccttttctgctctttgcccattaattatttcagaatctggaagcacatatttatctctcatggcttttccagtgaatcacaggatcctccaaggcacttcaccaaatgttttacagatcgccaggttccgaaaatatttgttgatttgaacaagtatgtgtgtggagtgaggtgcatggaatctttcatctcccacctgctgcgtgcttaggaaattctagaacactgagggtcacatgactttatctgactttctttaccatggcaggtgtttgggaggtcacagctctattcttttgtatctgctctattattttgtatctgagaaccccactaaatatggggtttttc

SEQ ID NO: 30150 - DNA, 974 bp, Bovine  19866881086777
ccccgtccctgggattttccaggcaagagtactggagtgggttgccattgccttctccgtggtaatagcaaggacaggtgcaaagtcagcatggtgttttagaatttacagttgagacaggaaattatttagtgtagctatctaattttatagatgagaaatctttcagggctcataatagcttttgaggacatgatgaaatctgtgatttttctcttccaagtaaagcctgactcaaaattttatgtatgatcagcttgtttgcagtttaagaaactcttctttggcctgttttactctgatccctttagttgggggaactgtttactttcagccttaaaatcattgattttccttgagagcaaaagttaagcttaatcatggtcatccacattcttagagtgctgtctcatagaagaggaattaattggatttcaactaaaaattacttgaggaagaaaaatagtgccagagtctttattcgcttttttagtaatgctgtgcaatctcctggatttaaaaaattaacctcttgcattttgcttgagtaaggaggagcaccacacttaaactgtaagactagctttcatgaatattcggtgtgtgtgtatttttagaacttttaattgtaccctgatgcagctgccagactcccagaaaagtgttggaacgcccgtagtctttagaggtttgcctccacagaagtttaattttctgggcctgaggattgttacaaatgaagtaacacatacccagaaggagcgttctgctttgccatatgcatttcaggctataagacttgaaatagtaaagttttattttaaagtttctttttttgttttgtaatggtttatggcaagcttctctaaatgtgagcataaagacgcttgattatatttttaaatattgctctttgtttgccgacatggtaagtcattaaatgccattttaagtgtgagttgggaagatatcta

SEQ ID NO: 30151 - DNA, 1065 bp, Bovine  19866881087564
aaaacagttttacttctttatgtgaatatattatcttgtgataccgttatttcttccagaatgagacattaaaaattagttaatggacttttgtaagcaaggagtaccttagaattcacctgattcaacaacttccctttagagacaaccatgctgagaagcaaagagcaggaaattccctggtggtccagtggttaggactctgcactttcactgctgggggcgtgggtttgatccctgatcagggaagtaaggtctcacaagctgctctatgcagggtgacatatgaccagaaagaaactcagatctttagtttcattgtccagtacgtttcactccgcacacattatgaatagcatcacacaagatgctattaaaaagaaagggctgtggggagaatgctgaatctgttaagttgaagagtcactcaatggacttacagcatttgtgcttcatagaaaatgcttctacggtgggaataattccattgataaacctgattttttttctttttaggtgagagttatgtgtgcgcgtcaaatgaaccatttcgcaaagtggactacaccaaaaacgttaatccgaactggtccgtgaatatcaagggtggggccacccgctcggcccctccctcctcagtgaagagcgaagtaaaggaaagtaaagatttcatcaagcccaaattagtgactgtgattcgaagtggagtgaagcctagaaaagctgtgcggatcctcctgaataagaagactgctcactccttcgaacaggtcttaacagacatcaccgaagccattaagctggactcgggagtggtgaagaggctctgcacgctggacgggaagcaggtaggatgtttctagccccacacactctagcttgcttttaaaccctctctgtaccacaggagttacctagttaacaatatgaatgtcatagctcattagaaatgattctcctagttgtacttgtgaggagtgtgtgcgtgtgggtctttatcatgaaaaatgataaagcaagggcttccttgtctctttacccaagtatctcaaaagagatgtagag

SEQ ID NO: 30152 - DNA, 2068 bp, Bovine  19866881227823
ctcagcttggtgctctgtgatggcccagagaggtgggatggagcggggaggaaggctcaagagggatgggatatatgtatacttatagctgattcctgtcggacagcattgtacagcaattatactccaataagaaatagataaaaggatcaccacaaaaactaaatgaaaaagaaaataaattaaaactgcatctcaaggtgcccctctgtcctccagtcgagcccaaactcaaggtccacttctttctccctgatctgtattttgtcctgagtgatgcaaggacagctgagaaggcctggaactcattcttcaggatcgagggtggtggtcctggtggctgtgaagggattgtcagtttattcctaaagtcctacagctgcctggattctggcttttttcacagaaagatcccgtacactgggttcctattagttttctgttttataggtggtggtgcctcagtacatgtttcaatgctactctctcagttcatccctccctctcctccttgtgcccccctgtgcccatgaggttgttccctatgtctgcatatctattggtgccctggtactagctcatttgtaccatttttctagattccacatacatgcattaatatatgaactattcttagtctacggcatcaggatgctctgtgttctaccctggttagctggaaaaccccttcctctgcagctcaatgtgtgtgtgctgcagtgagcggccttggttcctttaggggagcaggttggagtcagagacaggcatcatcataccgcatgtacactcccttcccccttctctcctctttgccactccaccctagaagggaaagagttgagtccattcatcagacagagggcagatattggggcatagagaaacaccagcaattacaatgttgagtccacacgcatcacttattctgggaatgctcaatctttcagcatgcaaatgcctcagcactacacgtctgatttttgttccacgtaatttcaacaattgtgtaatattataaacatcaattgaatatctgtgctttcatgaaagtaaggtcccgcttttatgcaaatattaaccaagtagtttagaaaaccgaaagaagtaacaaagaaaataagacctgtgggcagatggtttctgaaattatatgtttttccgtgaggcattagctgttttaaaagcattaatgctgatctttcttctgggatgtgggtgtataatttaagataaaacaccttccttgcacaatgcaaagtttaccttgccaagtacttaatttataatgaatttttttctgttaaaatatttcctcaaataatttttagtaatttttcatggagtgccgggtgttctagaaagactctttcaggactgaaataagcttgaaaggattatccagagcggaatggaatacattttattaaagaattcctccttaaaaggaaattctataacttctcttatggaccctttctcaagtttatcagctgctctttcagaaagttaattttcgtttttcatctaaatatctcatgttgtacatccaagctgttattttatttttcctaaaatgaagaagagccaggaaccacattctgggtaaggcctttcatgggtgttatatggccagctacaattctctcaacatgaatggaagcatttcttttctgacaggcatgttataataacaacttgctatgggactttgattctagtggtaaataacccccttgtcaatgcaggagacataggagcccccaatttgatccctgggttggtaagatccccagaggagggcatggcaacccactccagtgttcttgcctagagaatccccatgggcagaggagcctggcagactacagtccaccaggtcacaaagagtcagacatgactgaagtgacttttagcacgcactcacgctagctctggcaaaagggcccaaacagccacgggaggcctttgcaagcagttgctgggccaccccgtgttaggacttcccgggcgaaaaatgccagtttgggcccctaggcccaggctccaggtgggcgcccagggtctt

SEQ ID NO: 30153 - DNA, 1713 bp, Bovine  19866881251978
ctagcccatgtccttcaccttcaacatgttaagagcttaaaagctaacaaagcttaacatttgccagacttattttattctaaaaaactcaaagttatccagaaaatagatgtaataatatcaagtcatgggctacttacataggaggggtgaacctgagggagccaaatgtaccagtgttataactcatttcagaacaaagtgaggactcctacatgctcttctccggagcatccgtggctgatggtgacagtagaggcaggagtaccagctggttcgcccactggctacattaactgaggcatgtcattagcctgcctgaagtcctgtttttcaccatgaaaacaaagcgattaatgcgctaatgcctcccaaatatcttttgaggtatgtgtagagatcaaactagataatacatgtgaattcataactgtacctattagctattatgacttccctggtggctcatatggtaaagcatctgcctatactgtgggagacccgggttccatccctggatgggggaagatcctctggagaaggaaatggcaacctgctccaatactcttgcctggaaaacccccacggactgaggggcctggtaggctacagtccatggggtcgcaaagactcgggcatgactgaatgacttcacacatagggaaaacagcatatattcaattatgaatttctgtagctggagtttcttgcagtgaaacatttctaatgttccataaaatccctcttccacctacaagtttgcctggttttaatacaccaagttacattttaaagatataaccattctctaattacaatggtttcctatattgcaagattaactgttacacttaagcgccgagtttagcatctggctcaacttttatgctttttactcagaccacacactgtggcataatatgctttgactttattccagtgttccacataaattttacacttcttaattgtcctttacagtaattctgtcttttaaaaaaattgtggcatcaagtgaaacacatgtggaaccacaggccaccacccaatcaaaacttcaatttttcctaatgagtcacctagcaattttataaaagataaaattcaggaaaagataacgaagttgctcaacaccaaagctgatattttaattatttataaagcagaagggaagaattagatattgctgaaacaaaaggatttttgcacttgacgtattttaagtgatttttacatgcacagtatgttttttaaagtgttctgatcccacatttagtaataaactccattggacgtctggcagaaattccctgccacaacagtttacatctaccatctgtgtctacaagaagcttccagatattctgccacctgattcactgtcccaactcttctcacttctattcacaggcttcttttcattttcatcatatactgtatctgccctgtgaggaagaaaatattaccaaaacaatatagtgttacatattcctgagcccaaactaagattgaagaatttttaacaaccaatttactctgaaatggattgatgaagctccagctcttgagaatgaggatacatcagcatcagagacatttatagaagggggggggtctttaaaacttggttagtcctctgccttcttttgctggataaggaaacaggctcagaaagtgagaggctggcccaaggccccacagactgaggtaagg

SEQ ID NO: 30154 - DNA, 1557 bp, Bovine  19866881326469
tcttcactctttatcttaagtggttgggtggacagttgtacactcctattagtaatctttacttccctgtcagtctttatcatatttcaatgcaattatttttaactgacttcttcttatagtacactgtatgatctgtgggggtagaaatcttgactttcttattcactttaagcgcacatccttctaccgatagtcaaagctatggtttctccagtagtcatgcatggatgtgagagttggatcataaagaaggctgagtgctgaagaattactgcttttgaattgtggtgctaaaaaaggctcttcagagtcccttggactgcaaggagatcaaaccagtaaatcctaaaggaaatcagccctgaatattaattggaaggactgatgctgaagctgaaactccaatactttggccacctgatgcgaagagctgactcattggaaaagaccctgatgctgggaaagattgagggcaggaggagaagggtgtgacagaggatgagatagttggatgacaccactgactcaatggacataaatttgagcaaactcctagtgatgctaaaggacagggaaacctggcatgctgcagtccatggggtcacaaacagacacgactaagagactgaacagttcactttaaaattttcagcaactagccatagtttctggaacatactctatacttagatgtctgcttattaaaaggttatttattacctttagctctttaacaaacttagtttatacaatataccacattttatggatttttttggatcatcagtgcctagtacagtggcaaatatgtagaaggcacttgataaatgttactaatagttaacttaagaaataaagatcttatgatatcagttattaatggcatcaagcacactgcactgatactagacccagatttctaacgagaatcactataccatcgtgttcgtgctcagggtatatgtcatttttagtgttttaacgtctttcccatttataattgcatatgcagtggtaccaagcaaatattatttctaaatgaatacaggatgaaagaatacttgttaaatagtatctgtgaatattccactagttattttgaggaaataaataattcacacattcagacttgaaaaaaagttgacatatctccagaaaagcgatgaaaatcattacgattccaagattcagtgatgtgttttaagataagagttgaagagacctcctcagggaattatcctagcaggaaagtgaaagaatttcccctacaaactcttcgctccacagaactaaatgttaaatatcttcatggttagaaaatgaattctcccttccactagctaaatatttctctgtggcttggatgaacatttcctaaatctgttatgacatgctccttcagagggcagctccaaaatgcttctgttgttttccttcgtcctttgaaggaatgtctagtaacttccctccaaactttaagtctttgtttccatccggaaaacagatggtctatttcatccaaaaagagtttctgtcaggcagtgagagaccagg

SEQ ID NO: 30155 - DNA, 809 bp, Bovine  19866881371113
atgtagctcttacacatttatgctaataaagtctgatgatttgaagtaagtaactcaatcatccaatttaatggtctttatctttgaaatttatcatttcaatattaacataaagagaaatattatgaatttataatccttaatactctcttatatgttaaatcattgacttcattttagaaagtgcaatagttttcttaattaaacattcagtaattaaaaagcaaagtaatataaagtataaataattttattcaggcaccaaaagttccaataagagaattaataagatttgatgcttcatatttcattacacataaatagcttttgtaggtaacactatttattgactatacttcattgctgtcttttgctgtttttctccatctttctttcattgactctaattatcctctttttaacctagaaaaaaatttttaattatacactctgcagtcatgctattgaataactgaaaattctaaacagttcacgtacatgagaaacataaccatacttcatataatgtccttattttacactacaaggatgtttagagaaacagcctacaatagaacaagaaatgaaactacagaataccactcgattacttggaaactgtcattattgtaaacagtatacatttaaactatcacaatggaatctcaaattttaaactcaacacagaaggttaaataccagtagaaaaataagtatgggttgagaactaaaattgttttaattccacaacatgatcagagtggtgtatataactgacttcaagaacaacctaaccagagaataaactg

SEQ ID NO: 30156 - DNA, 2118 bp, Bovine  19866881392418
tctggaagtttctggttcacataatgctgaagtctagcatgcaaagttttaagcatgactttactagcatggggtttcctggtggctcagaggttaaagcatctgcctgcaatgcgggagactcgggttcaatccctgagttgggaagatcccctggagaaggaaatggcaacccactccagtattcttgcctagagaatcccatggagagaggagcctggtaggctatagtccacggggtcacagagttggacacgactgagcaacttcactttcactttactagcactggagatgaatgctactgtctgatggttaagtctttagtactattcttactacccatctagggaattgggatgagggttcattataaaacaggggtgacaaaaaaagaaaaaccatctattatcacaactgttccctttctaggattattattaaaagatattttaacaccaaaaatgactgagggacacaatctcaggtgtgttgcgcacaaagtaagttttggattgaataatgagaaactggaggttctaggatttttgaaagtgctaactttttcctaatgggccagtcctcaacacaaattccggcacagactcaatattaggatcaatcctaagtgtatcaagggactttacaactgaccctcacttattaaaccagaatagaagacctcattgtggaagtcaattattaagaagtatttgcaactatggggcttcccaggtagctcagtggtaaagaattctcctgccagtgcaggagacacaagggcctagggtttgctctctgtgttgggaagatcccctggagtaggaaatggcaacctgcttcagtactcttgcctggagaatctcatggacagaggagcctggcaagctacatccacgggatcgcaaagagtcggacacgactgagcacagtgcacagtaaacttaaagccatgagtaaaaagtctgatcacatgtgagtttaaactggtggtcagattatctataacccagagaaaatgaccgatttctaaatgttgtacttttaatataaggccattgttaaagcactttaaacttctatgttgcattcattttattttatttgaattagatgaatgtcatacttttttatcttgctgcttttatctaagctttctctattaattagtaaatttaaaagaatatcaatctatcagtttaaaaaattacatgtcgtgaacaagggaaagtgaatttaaagcattcccattctgaaattaatgaaactttcctacattcaatttatcttaagctgatatataaaatcttaaagatcactgatgaagaagcaaaacatttaagaatcaaagcggcagggaaaaatggttaagaaggcagttaaataatatgcccttggatgatataatcagcaaaaataaattcaaggaacatagatctcttgtattataattaaataccaacattgtttaacttaaaggagagcaaaaatgttcataacagttcactctgagtaaataatctaaaataaggacatgaattaattaaaaaattattaaagtgcaggaatattaatttaaatttttttaatgtagcaagtattactacttttaagtcctctcatttcatgacaatcatgcatgttataagtttatccagaacatttttgctatattattcaaagatttcatgtgggaacattgtgtcattaatacatacatatctttataaatccaatcaaatttctaatacaaaatagaaaattagaggattgcagtcatttgattgttgaataatcaaagtaaagttattgcaaaaggttcacttcttcagtggaataagtatacagaattcataaatacgctaaaatttatttttatttttatttctatgctgttgttaatttttagatttataagcaaattaaacacatttgcaattgttgttcattcactcaatcatgtatgaccctttgtgaccccatggactatagcaaaccaaccttccctgtccttcactgtctcctggagtttattctaactcatgtccattgagtcagtgataccatccaaccttctcatcctctattgtccccttctcctcctgccctcaatctttt

SEQ ID NO: 30157 - DNA, 1145 bp, Bovine  19866881794280
tagaatttctgtgtgtgtatatatatatatatatatatatatcatctgaacattccaatagggttctccaaagaaggttgaatatgtcaaaatcaataaaacatacataaattgaccttctgatgaaatgaaacctaaaagaaagtgaatctgtcaaagtttagccacaagtattcaaaagagagatacagtatctaaggaacaaaatattttcatatgacaaggcacattagtaaaaataactttcctgtcccagaagctattttaaactaaagactgctgcaaaattattcagcactgattctctgcttaccaaactcctctgaaaagtaattttattttccaaatgcttccaattgagaggcagggtacgtattgatagcgccatggactacaggatcacggaagtgagtgatcctactggaaaacaggacaagccttgcaacaccgatatggacggcccttgcagccgtgacgaccgcgtgagaagactttctgcatggcagtctgtgaccttggtactcttctgtctgctttattccctcgtatatcttttttattttttactttgtagtcagcttttcaaagtcttccaaagttcaaagtatagtttccttgcaatttttagcatacaaacatctttttctcctcttaattgcttttgcttctgcatctttcacagctggagttccaatgagatagccaggtcatttcacacaccagacctgagtcttgccctacaaagtgcactgtgcatagacttctaaatcccagacccaactctgttgattcccggagtgaatatcattgactgtttctacaattttcttcaccagatctgttttgatatttgcattaagctggctcttacagactcctgttctagtttgcacatgatcattatttttcttcccctggtgactaaaatgttggaagtctgattttgattattgactccagccatctagtctctgttgggtggtagatagtagataacaggggatcttttttccatttgtttcttctgttagtttgtcttgaaacttggggtatcttctaatatgccttggattatcagtatacctaaaatcaagtttccctgtggctcagcggtaaagaatctacctgtaatgcaggagacacat

SEQ ID NO: 30158 - DNA, 1006 bp, Bovine  19866881890674
caaggacacaactacattgcatatccctgccatgtagcaaacatttaaaaaaatgtatctgaaagaaacatttctttaaccaatagagctgcaaaattgctttactgaataattctgagacctcctctctgcttttgacaataattagtcttacaacactgattatttattccctgaagtttaaaatataaatagtttaattaaattgctttcctccagttaatggaagtttgatgaataatgtttaattgaattaaacatttgtttaattgtttaaacattaagcaattgtttaatgaataaaagatagcagcactgtatatgttttatggcatttttcgaatacagctttgtctgtttttaaggtctatattttctttcctatatattaagatatatattacacaaaacataacacgaatttaagacaaaaatacaaaaccatttctccagagtgcccagtactattgacttaaggcctttattacagagaaagaactggcccacaacctttcagagctgcaagtgtgtctttaccattttcccactcctctttcttcactcaggtcctagcacctgtctcatcctcccgatcccaaatacccagggccctcacgctctcctttggatgtcaaaagtgagcccacttcaatgtcctctgctcaggcttgccttacacttaagaactccggggaataagttatctccctcttctctcttcctgacccccatcaaaacttccatcaactagagaaaagcaatgtaactaaactaagctacattagattgtgaatgattgattaacagactactcaaccctccctgggatatttttattttaaaagaggacactgtaatctaagtaaatctgtaataggcaaaacttgaaacagttcataaaagtagtgagaaatatacaggcttctctcagagagagatgttttaatacaaaacctcgtgagggtccttaaattatccctgtgtggccaccactcaccttcagctc

SEQ ID NO: 30159 - DNA, 1633 bp, Bovine  19866880470968
cccaggccctccagacccgcttgcagctcttgtgtggctctggccatacaaagagattctgggagatttcacttaaatcccctgtttgtaaaaatagtttttatccagtgtgttttatttatgtcacatttaagttctctttgcattctcttgccgagttctctctcccaaagtatgctacctctcttcccagggtctttttcgaaaccatgagcccctctcactctagtttttattttaaataattcatgaagccattagagtcataacctagaaaggaatttctctttctttatgaaagcctgcctgagccccttacaagcctaacgagcaaataaaatcctggatctgagttgttttaagagagcttacaggcatatttttggctaatgttcaaggttctctttaaacatttcaccataaagtcttctgactgcccctctttgtgggactgaaatgccgtgttgggaaaatatgtattttcgtttaaagtaaaaatggtcacacagtgcaaactttttgtcccaagaagcttgaattacaagctcccagatcaagcttcttttgaagttttaattccttttctcataaagaacacagcaccaagctatataaatatccataatgtggaaatatggttgtttcaggcatcagtagcttttacattggaacacctgaaaaaaaaaatagtaaggatcatctaagtatatcctatcctttgtactgagactagctcttttataatttttcaaccttttataagctaaaaataaacagtacataaaaataaagatggcacattttaaactattcagagactaattgctcagtgtcagaaatatttgagtaccagcgttgtcctcactcagttggttcttacactgcatcctcacataaagagagaatgaaatggaaaagcccaaatttaagctcgtctttcacctgtgcacaagtctggtaaggggcttgatgggaaggaaattgaaaggtaatttagcaatttaatgttacctgcagatgtcaaataatgcatgctctgttcctcattatcgtagaaaacaggaaagctgcataaattgatctgagagagaaaacaccagcctatttgttatatgccatccacatattttctgcaaccatgagaaaggcatgatccagaatatacgggggtgtggctatgcattctaatcaaatttaattccaagcaaatggagtcatttcaatgtaattaaagaaagactcttgagaggtaaagtagcatttacctggagtctttgctcacattcccctgtaaagaaccacttcctgttctgtcagtttctctatcttcagtgtactcagaggccacttccgtctcaggccagcggacactgaacgtgagctgggcattggcatttgtagttcacttgaaatttgacaaatttgttttcaatacaccctctcatgcgattctcttagccactcattttctataaaatctttctatttgacagttgtgaaaactaaggggggaaaaggatgatagttttgcccctgggtaccccgctggttagagaagtgactatgacacatgcattcaacacaacccataccttttcttctgctttcaaataataaaagaacagcttttgct

SEQ ID NO: 30160 - DNA, 1128 bp, Bovine  19866880548509
aagaaaagcaaaatagttatggggggaaatccagattaaaaaaatgcagatgtttaattgacctgtcagttacgttaggaggaaagaagggcagaaataaccagaagccactggtggaaaattaaaatcgtttcatgagccaatgccaagctaaaagcagtgaaaactgtaacagaatacagacaggggctttctcagctgagatctgaaaatgttaccatgtgcgattttgtaaattagccatttccaaaaaaaaaaaaaaaccttttgcattaaagcacaataaaagttcttcagactctcctctctctctttggtcgttaatttgggcacttaggcagaatttggctttcatcagagacaaactctccccccgtgctccttgccccctttctgagaccccctaatactgctgagtggccagaaattacagatgcaaaggggagctgacaaatgacggccaggcccctccccccgagcttagacagtcaaagctgctgccagaacatgcctgagagcagggagtgcagagacaaagacacaaagattccattttctcagtgaaaatagacttcatgtgtaaaacactagtgagaaaaatggaaagctgacacatatgtgcaattttcgagaggcagggctggatctttcaagaagattgaaattgcatttgattgcatcaaaaacctaacaaatgttgtttaacctaagaagtcttttcagtctgtaaaaagacattcagtggcaagatactttatttttttttctttttaaagcacatggtgcaaaaggaaaaagagtcttgagctcagtaaagagacgttgatttcatcctactgctacatcaagaattaaccctggttcagttcacgggtctacagaataaaggggaaagttaaaaaaaaaaatacaaaaaaaatactctattaaatcaaagggttcagagagataatattaaatccttacgagtatgttttctataaaaagaatcccctcccagcagccgcagggtatcattactggagaggcagcaagtggtttattagagattcaagccatggcatctgggccttgccaagcatgcaagttgcagcctgtgagcccctggctcccacagtccctcggcat

SEQ ID NO: 30161 - DNA, 1781 bp, Bovine  19866880658784
ggctcctctgtccatggaattttccaggcaagaatcctggaatgggttgccatttcctactccaggggatcttccctgatccagagatcaaaccctgcgtctcttacgtctcctgtattggcaggtgggttctttatccctgaggcacctgggaagccccaatatcgtatatgaaatatgtagaaatgataagtgggataggtatacaattcaacttattttttaaaagattttttgatgtgtaccattttttgaaatctttattgaattttttaccatattgtttctgttttatgttttggttttttggccccaagacatgtcagatctttggtccctagccaggaatcaaacccacaccccctgcataggaaggcaaagtcttcaacactgggcagccagggaagtccccattcaacttttatattatgaggtgtaccaaacatcagctgctcgtgacagtatcgaaacacagactggaatcactgccgtagagacttcatagaaatagttttcttctcccctccttgatttgattactgttttcaatattttctacttcttaacctactagaaaaatcactgagactatttcagaggatctctctttattctggaatatcaacacatttgttttatatttcaagcttaatctgttatagttaactatagacctgatttttcctgaatttagggataataatatcttgtcctctctgctgtcacgatagcaaagaccattttatacacagttttggttagcttctagtcggctttgtcaaatttagaaccacttgaacactgtggtttctaaatttagtcagagcctctgagctttaagttccgtttggcactggctgaacagaagctgctgctttgaaaaaaaaattcctgtggtagtagtggggtcgagatgtgtgcacagcacagacctcctcttatttaaaagaaatacattcacttttatttgaaagttgggagctccaaggggataaataataaaatatgaaactttaaaaaatgggtcatattttagaacagctctcaagcagaattgggctcttgggtttagggcatggcattctaaaaaagaatgaaagcaagcaagaagagggcctattttagtcgctttaaaacggacttgctttaacttggctctggagtagagcaaaatcagtccattaattgccaagcatttggtttttctctttttacttctttatttattatttttttggttttactaaagagggtcttggtgaaccttttgtttgtttgtttgttttttagaaaataaactcttctccatggtatgagagataatcagggtgtctcagaatcagatggatttatttttttcttttcacatttttgctaccaactcaaagtatgtgtttgggtgttagtaactcagtcgtgtctgactctttgtgaccccatggaccccaccaggcttctctgtctatggaattctccgggcaagaatactggagtgggttccattcccttctccagaacttaaagtgtaatggtcataaaatacatttacataggaggcaaggcaggccacgtcctaatcatttagacatgttaattcatttaatacaatcatctcttacctgcattgttgtccccagtttaaggatcaggagactgagttgtgggaactttctaaatgtcagatggtcaggggtggaaccagggtcagaaccagagccgtctttctgtagactttcaacccccactgtgccttgtaggcggacaattttcaaaaccacagt

SEQ ID NO: 30162 - DNA, 1558 bp, Bovine  19866880765099
ctagagatagagttagcttggtttcagtggggagtcacagctgaggcctgagtgcaggcacaatgatgaccaggattcagaatgtctgaggcttcaccattagctggacggcaggtcatttgattttcacacgtgctatctttcctaggacgggctcagaatgccctcacctcctcacgtgtcccaccaaacaagtgagtctgctgatggcccagttgacatcaaagtgcctcggacctgggcactgggatggtctcgtgttgccgcatctgcccatctgctcttgacttttcttatctccaaaagaaggagagaggcctccaggatctccagcattccatcgaagcaagatctcgctgtaagtctggggttccagagtctctgcagaagacagttggggatgggggcagtgcccacggctccctctgcggttctgaatggtgccccgtgactccactcccagtcaccgcccggccggcgctccggttcagccgaggtccgggcgtggcaggccaacccgctgccctgaccgaggtatacccagggagacgcgggtgctgtttacacaggcccggagctggggcctgcctcgccctggcccgagcctcttactgctctgcgaactggaattccccaaattttcccccaaattaaaagaactaacaaactgtattgcaaaaacaaacagagtttgtttttcttttaacaaataaaaactaatttatgctctagctttgttgccttgaatcaacccgaccgcacaatttcgctgccaacaaatttctgtattaacttctcaagttcgtcaagcttagcccttgctggaaaaagtatagggtttgcaagccactaattggcctaaaatgctcctctattttatataaacacacagcatagtatcaaaaatagagttgcattcattagcctaaaatccagcttcccacgtggaagcttttttttttttttatacccctcaagatttaggtctgcgtctggagttgaagggaaacttgttttttaaacatgtactctgtaatttcacattaaaaaaaaaagacggctttgatttctatttttgcctattaatgtattttataagcagtgaagctgaaaacgaaaatctttccctcagctctttggggctgatattattaggagagtaagtctgaaactatgcaaaagacaaagtaataacaagacaataacaatgacaataagaaaagagaaatagatgggatcctgtggattctgccacagacgggtgattaaatcccatcaccgtctgcagaccctggtctgcaatcctctgtgactctcccactccacgcctcaccagcctccgcagaaaacgcttccttcttcttcaggaagagcaagacgagcccgtgtgtcccctaggccagcttctcctgagcccagggtgcccggggtgtcttcctccgggcctccttcgtgctttgcctctgccgtttgtccctcttttgttgcaggaggcccgtctgcgcccgtctgtgttctctgttccacagcctcacactccctcctcaattaccagcct

SEQ ID NO: 30163 - DNA, 1736 bp, Bovine  19866880790211
ttactgctgagcaactggggaaacccatgggacttatttaacaatctgcatgtgtatagaaaaagacacagcccttttcctggagcaactgaggtgcggtcctcctcagtcgtctgtgcaaggcctccctctatcctttgtaatatgctcagtaagactgagccagtggtctaccaggtgttcattgtgaatgtactctttcccagcacttgcaaccattgggaaaataaaagggagaataatgcctttccttatctcacaggaaaaagataccaaggtataaaatcactgaaatgcatccttaggcttctttcttttaattcatctgtcttggcctcactgagcggcgtacaggaatcttccagttccccaaccagggatcgaacctgctctcgctgccattgaagcgtgggttcttaatcacgggaccaccagggaagacttaggcttcttttaatacattgaatgatacataaactacatacctaacctaaaaatgagaagcagagaagacagttgtgacaccaaggagtccaagtgcagtaacactaatatcaatgttctcaaaccccagggaacattgctctcccagctgtcttaggacgagttccttttgatttttgatgttttctggtgcctgtaaatggtaacatcattccgttctttggggagcttcttatcaatgacccatcgttcgtctacatcttttcacattcaccaattctctctcagaaatacagggaaatcaactcctacaggagggagggaagttcagatagcacagattcatctgattctgagtttcatccctaaattaaaggtttgccaaaatgttcagggttttacaaataataagacatcacttttcttatttgcttatattcacaaaaacaaaagtgagctcaaacgtgtcatcccctccccaagaattccaatgacgagggcttttctttctccctcttccctttttccccaaagtcacatcccctgcagccctgactcattccagattgctgcgaaccttgttctcttcagagcctggctatggaattcatccagacctctacctctcaccttggacgtccatgcactcctggtcctcccgtgctctgcagttttagggagaagaaaagtgttaagacccctctgtagtcacgagcagaagttaagctatgataaatcattttgtaaggagacacgtcttcccgctgtaatacttctaaaattcagaactgcaaaatatatttgaaccgcccttttctgccattttccagaatattagggcatctaattaaattatgcatgctgccttgaccaaataaggcctttgcttcattttaatggggagtgacatttattttcctaccctaaaagaattccatggagctttcgttggaagaaaggttaattttatctttaatatggtaactgtatagacatcaccatatcattttttttttcagattagccatcttaaagaggtagattttccttacctgcatcttaaaattaacaatagatttgataagtcacttcaacttttcatcctggttttacagcatatgttcttgtcgtatccccaatctgggaactgaaaatgtcatttgaatgcacaattgagaatcaacataattattttaaatgggttctttctatgtttcagagactattgaaatttgtacaatggggtcaaattgcaatttacaaacttttgtgcatttgaaaggatttcttgg

SEQ ID NO: 30164 - DNA, 1142 bp, Bovine  19866880790466
aatgacatcagcccctgagtatttattggaaggactgatgctgaagctgaagctccaatactttggcccctgatgtgaagaactgactcactggcaaagaccctgatgctggaaagattgaaggcaggaggagagggggatcacagaggatgagatggttggacggcatcaccaacttgatggacgtgagtctgagcaagctccaggagttgatgatggacagggaggcctggcgtgctgcagtccttggggcggcaaagagtcggacatgactgagtgactgactgaacaaaagcaacaaatatacaaaattatatataatgatatttgtagtataattggtattaatacatatattaatattatacacatctcttgtggtaaagtacacatttcctctcaaaagagccctgtcaatcttcaaacctcttttcatgtctgttgtattagactccacagtagatgcagggagtgagttatgggaaacacaccagtagaaaaacaaatgtaaaattcctttcctccaagctcccgtccggtttagccactactaaaccaaagtcaagaagagtgaaaaattaaatacactctctaaccctgccccatccagctagtgggagactgaacttgtatatctttgtcaagatttgagagatgtacgaaaatctagatcatctctgctttcctttgttgggttgtaatgatttacatcaggacctatttattaagagctctgaggtgggtcattgtaagttcaagtgcaaaagaggatctctatttgcatttgaattgccatgatcctccataaccaaccaaggaatgtctcctcttgaagggcaggtgggtaggaagagagattagtaaatgtcttgattccagatgactccagacctcccccaacacattatttttcaaactggggaatgaatggaggagttgggtgatgattactgtccttgcatttggaagacaaggaaacagtcctgaggatcatcctccccactttatttccctgaaggggaagatcaattagtatggttatcttctgctggtgcgtgataatttttacagaaagtatgagtgattctcggcatttactgcatattattccacaagaggccccggtactgtgcatcataaac

SEQ ID NO: 30165 - DNA, 1645 bp, Bovine  19866880803992
tatcataaacactcttcctgagcaaagagctttgctatgaacagcataaacgttcccacatgtttggaagcctgaagaaaacaatgcaggtcctgccacgtgtttaaaacgatgcatttaatgtgatatgaagtgcattaaagtaatttcaagacggctttacattcataaccaggcaggaaaacattaaagtgtggtacattttaatcacaagaaatactgaacagaatgggtcctttaaatttagggagcctgtttcttcataggtgtgtacaactcctatttgtgatattggaaattaataatccatgtgggagtgagagcttcaggatggcagcagttttacatatattgggaaagaggttactcctgttttgaattaactcccagctttcttggagacgatgtatcaggtctgtgccatttaccttctctgctgctgctgctaagttgcttcagccgtgtccgactctgtgcgaccccatagacagcagcccaccaggctccgctgtccctgggattctccaggcaagaacactggagtgggttgccatttccttctccaacacatgaaagtgaaaagcgaaagtgaagttgctcagtagtgtctgactcttctcaaccccatggactgcagcctaccaggcacccccgtccgtgggattttccaggcaagagtactggactggggtgccatcgccttctcccttaatacgctaagtgctgtgaaatgggaaaaacacagatataccatgtttctgtgagttggttggctggctggttggtgggtttgttttcaaagccactctgacagctgtctgaagaatgggtttgaaggaagagataatagaagctatgaacaggccaagtgtaaaaggaaagaaaaaaaaaggagagaacaggttttagagataaatttggggcagactccctggcactcatagtaaattgaaaggggagatggtttgtaggagatagggtctcgcaaggctactcaaagtttggtccatggtcacctggagactcagcaccctccccaaacttcctcaatcagaatctctgggattgagaaaaggcagggggaagggaggagccagaatttggtgttagaaaaagtcgactggatgatctgtattcatcccaaagttacagaagccctgggatagcagataaggcaaaatccccaggctggtgaacagagtggatggtgatttaaaatgagaaaggtaagtttggagtctagtcttgaaaatattctattctaatccttaaaagagattgaagtggagtaaaagtcactcagtcgtgtccatctctttgtgaccccatggactgagtccatggaattctccaggccagaatactggagtgagtagacttcccttctccagggaatcttctcaacccagggattgaacccaggtctcctgcagtgcaggtggattctttaccaactgagccacaagggaagcccaagaatactgaagtgggtagcctatcccttctccagtgcatcttactgacccagtaatcaaaccggggtctcctgcatttcaggcagattctttaccaactgagctatgagggaagccctaaaaagaaattattataaaataaatacataatactttcttgaatacatatt

SEQ ID NO: 30166 - DNA, 1444 bp, Bovine  19866880811715
tcatgtcaatgtatggcaaaaacccactcccaatattgtaaaataattagcctccaattaaataaatttaaaaaaagagagtcaaatagaagcagtgaatcagaggattagattttcccgtatttcaaagaacttctttcttttttcttcatgtggacagctgccatctaaagctccatgaaaagctcgcccttcttctgggagaatgtgtgatgggacgttattccaggaagaaggaactcgagtttctcgtgcttcttcttaggccttgcataaggaaactaaacacaggatgttttcttggccgttggcaggctagcaacttctggagtaagaccagtgagtagatttgattttaaaacttaccacaacttttctttgacatttataggcagagagacagatgttaacttgtaataaacttgaaagcataattccattctcagagccatgaaccaagtctgaactttccatggctctatccattcagccatcactttttagtgtttaatataattcagtctagtaatttcctagaaattcttcctattcagatgagttgaaatactgcagtactctctttctttttaaccagccctgtggtgctaagttgcctccgtcgtgtccagccctttgtgatgacatgcactgtggcctgctaggctcctctgtccattctccaggcaagaatactgagtgggtcgcgatctccccaacctgaagatcgaactcgtgtcccttacatctcctgcattggcaggggggttcttcaccgctagggccactcggaaaacccttttattgaagcgtaattcaaatatcatacaattcacccgttaaaaatatatgatccagtcttgtttagtatactcagagttgtgcaccggtcaatacaatctaattttagaatatttttcattcccaaaagaaatcctatactcactagcagtcattcacactctatccccaaactctgggtaaccacgcactagtttctggagatgtgcctgctttggacatctatgtattgaagtcatacaatttgtggtctttagtagcagactggtacttaacataatgtttccaaggttcatttaagtatgaatttgtattcctttcctttttatggctgaataatattccattgtgtatgtaaatagatataaatatataatattttatgcatttattaattcatgaagatttgctaattttctacttcttggcagtcatgaatagtgggtactatatattctcatatacaagattttgtatgaatgtaggttttcatttctcttgggtatatccctaggagtaaaattgctctagaaactctatgtttaatattctgaggaactgtccaactgttttccaagggcagctgtacagtactgtatccccatcagcaatgtgtaagcattctcatttctccgcctctccaaca

SEQ ID NO: 30167 - DNA, 1403 bp, Bovine  19866880883454
atatgattaagctgttctaccttccttgaataaattgagtatccatgtaattgcgtgtgtgaaattgtagcacagtgaaatgtcaggttgaagtattttaatcctgtttgaggggttgtaaatatttatagaagcttctgcttaatgtccttttagtctttagtcttcctgggtccaccttttacagactttttttttttctcttatattcttatttatcttcaaaaatatctctcaggtcatgatgacaggcttgacattttactgaatgaaagcaagtgttttacaggcaattaactttaagagattaccttattgaacctggaaaataaaatagaaaaggctcaaggaaccccgagttcactctacaacttcagcctcttaacctaggtaagtgcatggcttttacagacaccaaattacccagtaaggtcttcaattatgaaaattgttaggccttccagacatcacattacatttgagctgtatctatatattcgattccaactctactctcaactcttgggtggcctaaaattgagataattaattaaaccctttgaaaagcatctgccttccacattttgtcttggatgaaagaaattatttcatgctttacttacggaaagttaatacccaaaggctgcatattaccactgtctcaaattagaacctaccaaatcttaaaattggctattcacatgcaatctcctttaataacttatgaaaatttaaactaaattttggattaataatttatgtagaaagttccaccagtgagactccacatttctaagttttagagtgagcagtgaaaatatcagtaaggaaagtgggttgttggatgcgctctttcgaaaattgttataaaagacttgaaaaacaaggggaaaaaatccttcttaggaacttgtcttagagtgatatataatgagggtttcttaggtcacactaaagaaactcctgcctgctggcacaggagacttagatggatttcatccctgggtggggaagatcccctggagaaggaaaggacaacccactccagtattcttgcctgggaaattccatggacagaggagcctggcgggctacagtacatggtgttgcaaagagtcagacacgacggaagtgacttagcacatacacagattttataaatgcagatgctttaacctctgtgccaccagggaagctatatatatatatatatatatatatatatatatataggagaaggaaatggcacccactccagtactcttgcctggaaatttccatggactaaggagccctggagcctggtgggctacagtccatggggtcgcaaagagtcggacatgactgagtgacttcactttcactttcatgtatatatatataataagaacagtacatttttt

SEQ ID NO: 30168 - DNA, 1376 bp, Bovine  19866880885186
ggaagtaaaatttctgggaaggtatatatttcatagtctttttccattttttccttctttaagattttttttcaataactatctgtttaaactgaaattgtttagattccatcacacatgcttccttgcagttttgatatttccttctcagaaatccgaagtttttcagctaaagttcaggtcctggcttaaactgcatacttctggttttcccacattttatttcagatgttgagccaagctcaaattagattcatattttctgttctttaaaaaacaccccacaaactctgtatggttatagattatgtctgtttggaaaagttgggggagactaaaaaagatgtcttattaatgtgaagttcataatttagcctccaaagttctcttactgccatataataaagtaaaaataaaatgaatcaaggctaagatgtggataaaggggatttatttcaataaggaagaactcaaaagaaaacatggcttctagcaaaattaccattgtgcatcatagacccattattgctgaatattcaatgtgtttgaccaaccttcagtagcacataatgcaaagaaaggcttggacaatccttttatgaaatattaaggaaatgaaagcatagttccatttaataattatattcttcaagaaaataacttggaagcattcaaagtgctttatccaacaagcaatgctgttctttgatctcattttttcttttttttttttttttttgctttcccaagcactttttaaaattgaagtactgttgtttttcaacgttgtgttaatttcaggtttaaagcaaagtgattcatgtacacacacacagacatacacacacgtattctctttccaattcttttcccttataggctgtcacaaaacactgagcagcattccctgtgctggacagtagctccttgttggctatccactttctatacagtaatgtgtttattgttcttacatcttgaactcacgtgaattgcacgatgcttttcatacaactgtctcaccgtgtttgttcctagagtgtgatcatcccttgtctcattttaaacatgaggttgcccgaggccaaatgattaagcttacacactaccacatattaatccctaatattctgtaatgtgggtaaaggtggtgagtggtataggtgggatttgaagtcatgacctggggggtcgtgagtgtctcgctgcacagacttctttctgctggttggtctttaaaccatgtaatctattgacagttgtctgtatttttggaaagaagctaaaacaaaagctaaaaaaaagctataaaaagaaggtaaaactgagtaactaacacaactcatactcatccggagtgtcaaaattgcaaaaat

SEQ ID NO: 30169 - DNA, 889 bp, Bovine  19866881146370
atgggattctccaggcaagaatactggagtgggttgccatttcctattccaggggatcttccccaatccagagatcgaaccctgcgtctcttacagctccctgcattggcaggagggttctagtgcgtggaccttggcaccctgtcaatgctcacgaagtgccagccatattgttgttctcacctttatacagcttgtgcacttccaaaagcagacttcatttcatgttcaaagttttcagtgttgactagctgtcacccagacagaagaagaaaaatctggggcatccaattacaacgggctaaagtgccataacacacctgcagatacttcccaactgaacagcacctaagcatgacttcattttcctctccttgttactatactaacagtttataaataaacacactgtaacctctgagggaggcccggcatgtccggtcttgggagtagccagctgggccgtgggctgctggccctgtgtcaagagccagctcccctgtgctggtcattagctgccaggaaatgccttccttattagtcattatggcctgatgatgttctagtgatagtgttaatactgtgtgaaacgctgtagtttctaagttggattaggagatttgtactgtactttattattctagtttgaatcattaaagtgatcaccttgtcaaaggaaaaatacatcataaaattcatagtttccagtgttagcctggatttagtcctataatcaagagtgggaaaagtgagtggtattagaatattagagattcattctatctttggatgtgtttgttataaagggccttctgtgtgctcggcatcgctctcataagacatacctgaaccgacacagagagctgacagtcccgttagagaaacaaaa

SEQ ID NO: 30170 - DNA, 1555 bp, Bovine  19866881235608
cgcactctgaacttggctgtcaggtgacatacctggtctctaaaaggcataaggtttctcgcgatactcttgcagataaaagtgaacgttgagtggatgataataaacttactgtgggacagtgagtacccactcccaaagtttatcatactctgaatcactttcgccctagttaggtttcttatgacatgctttgggttctgtcgcttaatatttttatcactgacatggataaaaataaaggcacacttaggaaagcacgggcaaatgaaagatatccagctgtaaaaatagatttgcattacggtacaaagctggtaagacgggattcagggacgcattccacattagaatcgcactgcagctcaaaggcatgcagttcacaccgctggttctacggatgagggcactggtgctcagagaggcaaggcgattcgcccggaaggctgctccagatggagccaggctggagctctgggttctttctccgcactacgctttcatcttctgtactctgcagatgcctgccagagtagtctcggaaactgatgtttaattcgcagaattctggatagatttaacaacctgagcgtatgaatgtagagtcctttattttgacccaagcagacacaaatccctggcatctgtgcacaatggacaaggcaggggtgaaaaagacatgggcttttctttttgatgcagaaagtctctaaaatgtgatttgacttcataacgagctaactccactcagattcaccagcaggcatgaagcatcggggtcgagagcggcttttgcgcattctatcctgtcgtgagatgccagcctactctgtactgggctgcccctccaacagcctcacaaaacaagacctccatcacaggaccatctgcagggagaggatctgaaaatcatgaccgaaaccaaatgtttgttaaaactggccatgagatacttggcctggggaaacatgcactctagttatgtgtgtgcttgtttatcgtttgatacaagacattatgaaacagcagtgaggtgaataagggacttctttttaattatgttcagttctgtctgaagtgatctaaattttctgtagtaaagagactctggcaaagctaaattctctttctgattaaaaacactgttaatcttctttgcttttattaatctaaagtgactcaatacttctttttaaggaaaccacagagagttacattttttcgtatggtacctgaatatgttacccactgagccagaagatataaaccccagaagtccttttactcttctggccgttgggctgtacaagcaatcagctgtaggactttcattggcctgtttctcacttaacctcgcctaaatgtctgtagatttatgagttgcccccttgttttaaatctgtgaaaggattttatttcaaagcataatttattttattaataagtaatatcttatttccacatggtgttagtaggcatagttcaaagacattaaaaataaaattcacatttttctctttcttctcttgaaatatcctgttttttcacaatgaga

SEQ ID NO: 30171 - DNA, 905 bp, Bovine  19866881433127
atgtacaattgtatatgcagaattaaggccagatggggctataaaactagcccctaaatctcaacatttaattccgtgtgtttcagcaggatagcatggaatatcaatcaggaaataggtaggcgctggaatcattcttgtgcagttcctcaccactcttttctccctatgctgtcaaccaaagggacatgcctagaaatgggacctccaggattgaggagagggaaagaaaaatgaaaatgacttgatttcccagagggagagtagacattgtgcagaggctgtttttactcactcagatgctgaatatgaagactagccgtggttccccccagacagtgcccaactccatctcactgaatccaatacatattcatcagaccttagaattacttattcactgaggaggaaaggacttgcggcccttcatatgggcagacccggacatgagcgaacaagcagttggcttatgcaggctgcttttaggccgtgtgagtcacatgaatttttttgttgttttgtttggtaaatcagtcaaacaataggtctgccctctttcactcactcaaattgtcatacgggaagagacacttttctataattttatcaactcatacgctgtgtaagagacatacattgacccagtaactgtttcaaaaagaaaacatgtaaatctcggagacttttaacccacaacttttgaacaagaacagaccagaatgagggttccatcaatctcttcaccctcaaattggaaaaaaatatgcagtaaaataatttaagggaaatatataataaagaaatgaagggagaaaaggtattcatttattcataccttactttacttcagaaaagaatggaggagaatttataaaatatgatataaaggaataagaaaaaacaaa

SEQ ID NO: 30172 - DNA, 956 bp, Bovine  19866881482185
ggatcgctttcctggttgcagacagcccaacgtgccccttgtaacttcagggtgtggggaagacagtaagagggctccctgaggtcttgttcataagtgcacagatcccagtttttgaggggttttaaagctctttttgtgcaaaagagagcaacactatgacaaaacgattattttgcattggatagaacaggaaaaactgcagaatctacccaattttcagctttctgggattaccgcatgcctcgtgtttttcaaactgaaaaatgtagcatttttgcttcacaggcaaagctggaaatcagctatctgctctaacgcctaaaacagtggatttaatccaagttctcctagggatcctgttttattcactgccctgagcttatgttgggcttccctggtacctcagctggtaaagaacccgtctgcaatgcaggagaccctggtttgattcctgggtcaggaagagtgcctggagaaggaatggggtacccactccagtgttcttggacttccctggtggctcagatggtaaagaatccacccgcaatatggacgacccgagttctatcccagggttaggaagactccctggaggaaggaatggtaacccactccagttttattacttggagaatccccatggacacaggagcctggcaggctacagtccatgcggttgcaaagagttgaacacgacttagcaactaagcaagcttatgctggctctgaatgcaaggtgacaaattcacatatgttaatttcaatcattaaaagtataataacaataatcttcaaagcaaatgcatgagaaaactttcatttcttaagtcagcactcaaaacaagcaagggaaaaaaaaatagagggacatttaaactacatgtaccatgccaggcactgttaataggtatgaattatgtctactgggtttcataatggtatggataaacatg

SEQ ID NO: 30173 - DNA, 1136 bp, Bovine  19866881535708
actctgccatctgtgagagtgtaagagttcttggaaaatgactcattcagttaagcaaagacatgaaaccaaatttgaatagtaaaactatgtgagttacagagaatccagaatgctgggtgtcagcacaaagtcctgctaacacagtgtttagggtagttgtggggtcatgggaaaattaacagatgctacacaagtggatgagaaaagggctcatagtgggcaccactctttgaaattgacttgatttagttggcgggactaaatgtggaaggcctgctgctgttgttattcagtagctcagttgtatctgactctctgtgaccccatggactgcaacacaccatgcttccctgtccttcactgtctccaggagtgtgctcaattcatgcccattggttcagtgatgctatctaaccattatatcctctgccacccctttctccttttgccttcagtctttcccagcatcagaatgttttccagtgagccagctctttgcatcaggtggctaaagtattggagccttatcagcttcagactttactttcaccaccagacacatctacaactgagcatcgtttccacttcggtccagcagcttcatcctttctggagctgttagtagccgccctctgctcttccccactagcatactggacaccttctgagctgggagtctcaccttctggtgtcacatctttttgcctcttcatactgttcacggggcatcacagcaggaatgccgggagtggtctgccactccctcctccagtgggccatgtttggtcaggtctctccactatgacccgtctgtcttgagtggccctgaagggcaaggctcataggttcactgagtcatgcaagcctctttgcggcatcaaggctgtgatccatgaaggagtgaagacctgtcaggatcacttagttcaacagcattttgtcaattaagccattaaagaaagaatccaacttgagaatgcacttctgattgccaggcggaaggatgggggggaagggatagttaggcggtttgggatggacatgtacacactgttcagtttaaaatggataaccaacaaggacctactggatagcacaggaatctctgctcagtgttataaggcagcttggat

SEQ ID NO: 30174 - DNA, 914 bp, Bovine  19866881676381
aaatggctgtttgttgtgttttatttatttattttttactcccttcccattctctcttagagacactgaagcacactccagctggcaagcagaaacataataacaaaaagacgaagagacagggatgagatgaagggaaaaagccaccaccagagtctgtataattcacaaactgattatagactttgggcatttgagagttgaccccacttatataactcagagccaccagaaggctgaagggggtcccttaacgtaaagcaagttctacacattttagcaatttttacggtgagccaggagtgataattcaattgaataatattcctccagagtcttaggcatggtatagaactgcttaattgtaaaacagaaaaatcattttatgaggttcactgtaatgtttgcataagagccagtgtattcagtagcaataagcaggtattgtactttctattgtagaggaaactgtccggtttaagccccttttactcacttcttcagcatgcaaagacttcggactgaatgtgtttgcgttttgcggctttgtagcagttattaaagaaggtttctgtccattcctttcaggtattttgttttggaaggttttgagattttataaaaaattatattggagtattgctgactaacaatgttttgtaagtttctggtattttaaaatgtttttatttactgtttgagcagttccaagaaccatccacctgtggttccaccatcttttgtcacagtttcacacgattttcagggtgattgtaaaatttcgtaacttttcaggaagtctctgctgttatggtcgtagtgggtgggtgtcctgttctgatgctgatgaaaggacctgcctattagaatacgatagcaagtctcacaaagacacagggaatggggaggagggg

SEQ ID NO: 30175 - DNA, 2947 bp, Bovine  19866880210462
aaatagatggggaaacaatggaaacagtggctgactttattttggggggctccaaaatcactgcagatggtgactgcagccatgaaattaaaagatgcttgctccttggaagaaaagccatgaccaaccttagatagcatattaaaaagcagagacattactttgccaacaaagatccatatagtcaaagctatggtttttccagtagtcatgtatggatgtgagagttggactataaagaaagctgagtgccgaagaattgatgcttttgaactgtggtgttggagaagactcttgagaatcccttggactgcaaggagatccaaccagtccattctaaaggagatcagtcctgaatattcattggaaggattgatgttgcagctgaaactccaatactttggccacctgatgcgaagagctgactcattggaaaagaccctgatgctgggaaagattgaaggcgggagaagaaggggatgacagagaatgagatggttggatggcatcaccgacttgatggacatgagtttgagcaagctctgggagttggtgatggacagggaaccctggtgtgctgcagtccatggggtcgcaaagagtcagacacaactgagtgagtgaactgaactgaactgaaagctcctgaagaatctgagagatgtttgtagtccagtgtcctcattttagaccctgaagaattcttgtaactggttatcagaactagtgctccgtagtactccagttctttggaatctaacttttgattttaggagttaaagaagagtgaaaaatgacatcacaaactgcattgtgttcaacagtgtttctagatcagagaaagtgatttagataattcatctttcttgaaactccattttggtgtcttcctcctttacaacctcccccaagcagttctttgtctcagaataccacttatcaaaaaacataactcagaaagaatggaagaattgcctcaataaacataaaaatcttatcttctgtttaaagctattattctttgtatcaaaatgaatggttgttaccatactgttgacttcagactcttttacttccttgatattttcttcagcagtagataagaacatttcaagctctaaatactgaattctaatttgaaatactctattaaggaggatttaaggtctctttatgttgtaaatgctcttacttttggaagatgcaccaaatctggaatcatggcaaatacattcaaaggtactgccatctcacattagatttttttggttgaaaaatatttaaaagtcttaataattttgagtttgctaagaataatttcattcttatgagttatactgttaaaatttctcacaaatttttgtaccctttggaaagctcactatgactgtagtatccagtgcatgaaatagtcctggagctataatgtgctaatttcagagttttggggtctttttctgttctcatgaacaagagtttaacatgatgtttctctactctggttacatattagaatcacattaaaacatacaaaaaatcggttggtcaggttttattcccagagattctgactgaactgatgtaagatgattctaggtactgggtagtttttcaaagctccccagacccaggatattctaatgtgtagtcaggattgagaaccactgttttgttgttaataaatgaattttctaataaataaaaatgtaatttaaataatgtaatttaaaaacaaatgtaagaactatacaataaagcctctaataaaaaacatgaactgtatatgtagttcaattacttttaaaaagtctaaaattccggtgtttacatatatatgtcataattcccttgctatgaaaaaggaaatgaataatttgctgaatgaatagggattgcccagaagtctgccatctgtactcaaggagcagacctctggtactaaagtgggtttctgggtacagagtgtgaggtgagaccttatggtgttgacgtcttgggaagactctgtcgctgtcacatgatagagaaggttctgtgctgctgagtgtggtgatagagaatcttttcaatacttcttcaagagggaactaatcaagacctgtcttgagtggctaatggctgttgactgaagacaggagactgagttaagtaatctaataagggcccctataattctgagttccatttcatgggagggacagcatcaaggagttagttgataggcagtctcataagaattattgtcagaagcaactccaaatataacccaacatcagttccttacgctacatgattatgaggtagcatgctacctacatgattatgaagtagcactacatgctacatgataatgagaaaaatattagctatttgatattggagatcaagtcagaaagaagagtgtaaagactaggaggatagtttggggtcaacatacgagattgattttcaaatatattattctaaaagttgaggcaagatatggttagaacttgatggtcagcttaatataagagtaagttacaaagaaccaatatgttaggaaagaagaattggcaatattgagtgatgcttggaatgggagggctgaaagacaagaaatagctttttagtgactgttttatcaagaggtgtattttactgagagatgaactagcacaaatctgcgttattaacttttgaaaaaatatttatttatttgacggcgtcaggtctgagttgcgtcttgtgcagtctttccttgcagtgcacgggctctctagttgtggcttgcagccttggtagttacagcctgctccagcttagttgctccatggcttagttctccaggttcttagttctcagttctccaaacagtgatcgaactcaattccactgcattgcaaagtagattcttaaccactggaccatcccatgaatctgctttagagtacagctttagattcat

SEQ ID NO: 30176 - DNA, 1096 bp, Bovine  19866880385365
aaaattctaactgattttttgctgaaaaagagaaaaaatataacgtattttgtgatttatcataaataagccacacaaagtaagattctaatagttttgtaagtttacaattactattttctcatacagaagtcctcaatgacattgtgttcagtccataaaagcagagtctcttcaggagatgatctcacgttgtccttaataaagaagacagatcttctgatacaagtaactccatgttccctccatttttatttgtccttccttgtcattcatcactctaatctcaaagaaaggtcttgcttcctagtccaattttttttatctctactttaaacagtctttcccatcttccttctctaggaccaccagaaccattcattcctttagcattcacatatgtcttctttgggtccttaccttctacttttaaatttactcaggtcttttttcatgctattgtttttagtaacacagatctccttccttctcattatgtgctctagtttccgtatgttcaccctccttaacttcatgtattatggcttttgccctcacacttccacagaaagtgctcttcattgtttctacctcttcataaaactcacatgttttcattcccatagcatgaaacttaccttcctaccttattgactatttctctcccttctattaatcagtcaactatagacattcacaaaagttcttttgattgtaatctattatgctttacaaacttaccagcactgacaaacttatttactcctaaatctctctcaccaattttaacattttatgtaagaccaagtctcatatcactatttttcaggacatttgtacctgactgttccatcagtaacttaaattcaaaatacttgaaagtgaatttttccttctatcttcctaaggcggctgtcattcccctctgtcctatctccttagttagaaatcatatcaatttgttctctttgtatcaccagctcaaaaactaaatctgtaaccaggatctgctctttattacaccaagaacgctctggtgagtcattttttccacatgagcagccagtaccaccattctggtatcgatgttaagtga

SEQ ID NO: 30177 - DNA, 990 bp, Bovine  19866880616677
acacgactgagcgactccactttcacttttcactttcatgcattggagaaggaaatggcaacccactccagtgttcttgcctggggagtcccagggaccggggagcctggtgggctgccatctctggggtcgcacagagtcggacacgactgaagcaacttagcagcagcagcagcagcagtctacatcacagtcactttgtgcattggatgaacctgaaaagcaaccttgggtgaaagggcttttattaatgttgcccattatttctgtaaactgtttaaaataaattttatcaagtaatttgagaaaagaagaaacgtttccctcccctgtaaaggatcatgttgtatttcttaaattttatgagctgctacatcttcatcagggcaaagttaataatcctacaacagaaagtcctaagaaacatggacgtatttgatctgtggtcctccatttcttgtattcattattcttttgttatcttttagaagcgtgtttcttctgggttgatttctcagtacagtgttgtgcattgaaaagttgctctgaatcaggagattttcctgaaagcagagaggttgatagctacctcgcttgaagacatagatgggaaaaagaatagttgggattattggagttaccataaaatctatgaaatattattgttcaaagcgaaggcaaatgcagttgtaaactgaaagtttcatccagataccaaagatgtttgtagaaaaagctgaaaagtatccttgtcactaagtaatagatactcatcttcagaagcaaacagacccgcaatcatttggtctattttcctgcagttgccacaaatgactttctccctttgaacccaagctctgtagctccacaattggcttctgcccagaactctacttaagagaccataggctgaactgagtccttgaagtattaatagcttgcttttcatatggatcattttaaaagtctttattgaacttgttataatat

SEQ ID NO: 30178 - DNA, 3514 bp, Bovine  19866880659243
cccccacccttcacccgctgaggaggagcctgagagaagctatgaactacccagaacagcttgccgcaggcaggaaagtcaggaacaggacgcaagggttggaattagccaggggagttgttacctcggaactgcgcagtcccaagaattctgagcagaccgtgaagccagtttggaaaaggtgctcccatgaacagagagtgggtaaggctccaaagcagaaacccgttccacagcactgagatgatgtagaaatgcgaaaaatacctgccaagggaaaacaggttagataatgatcaaagcagatccacttgaagctattatgctagaagactattcttttccctcatgctgcaagcatagttttgcttttttaatagaacctgaatcctacagatgttcagatttttgaaatttcctttcagatgataggactggttaactcataggaaaaaggtttcctgaggttaataagaacatgaatggccttgttaaatttagattaaagttaacgatctgtcttatcttcgggtaacaaaattgggctcaaattcaaaaatagagggccccagggcctgacagggagagcctagactgtgctaccacaagccaaacctgtggaagatttctaaatctcaagtaatattgctgcaatagccatacaagttacacaagatttgcacaatcacatgctcatagggctgcaagaaaccttaaataggtcttctgatttagtgtctttctaaattgtgtcgacctaaattacttctatgataacatgacaaataagaactcataaaactagctatcaactcctgatgggtacagtctagtacaagtatagtgtgtgtgttaccatcaacagagtaacaaatgaaataaaaccacaaaagcaacataaattgcaattaacagagttaattttacttgaaagacaatgttggtttgctgcaatacctggtatggtacgagggcccaccacgggtttttttgaggtctctttacctattctctatttgaatcaacttaaaatctttctgactctgcaagttgcctggacatcacctggccttccctggtcttcaaagcatcacagctatattaagccttccttcttgtctcattaatctgtgatgcagtaagacaacctggagtcaagaagactacacacagactcaagagactcctcttctaggtgatccagaatatgcttctatgtcccagaactcacagtccgctagaccatgcccacaacccagtctaactaacgctgatctaagctgatcattccatagcaacccacttaattctcccaccactgttacaaattctgtcactagatctgtcctgagatgtcctgttaatcctgattcagctcttcttcatgcaaaagagcttagttcaagcatgagtgtcgattctgccccctctgccccatccctagaccctggcctctggttgcctaccagagtcttccttaagacacacttcctagaactgagcccaggtctggtctgagccaatacctcagaatggcagcagcgccttgctctgcaggctcccatggaaagaggaggggacagcttctgaggggcaactttagagccactttaccaatttcattttttcaaaaaaagagtactgagcacttcgaacctgctaggtgatgttcttggagctggggatgcagcagggagcagaccaggtgcctggcttgctgaaatttacctttcagcagagagtcagcaaatgaatctgcagacatcctgcctgatgctgggtaatgggacagaggtggtgcagaggagaggtcattctggatgggtggatggacaacgacggcccttctagaagtgatgcttggctagaatgagtaacccttgtgaatttctaggggaaagttttctaggcagacgaaacagcaaccacaaaggccctgaggtacaataaatgacacctatatagatagtgggcttccctggtggatcagtggtaaagaatctgcctgccaatgcaggagatgtgcgttcaatccgtaggttgggaagatcccctggagaaggaaatagcaacccactccagtattcttgcctggaaaatcccagggacaaaggagcttggtgggttacagtccaaggggtcccaagagtcagacatgacctagcgactaaacaacatatggacagtgctagagcatgaaaaaggagggaaagatgctatggggtcctgtaagggcactggcttttaagtgtgatgggccagcgttcgaacacagtgacttgaaggaataatctatgttttaaaaatctaacagaaaagttctggagatggacagtgctgatgactgcacaacaatgtgaatggacttaaagatgctgaattgtatactcagggttaaagtggaaaaggttatgtcatgtatatttcatcacaatccaaaaaaaagggagtatgtgagagaatatatgtgtgtgtgtgtgtgtgtgtgagagagagagagagagaaagagagaacatagctcattcattttggtcattgtttaaaaaaatcccctctggtacttaggtaagaggatcatctagttgtgggaagatcagttaagagtattcattccatcttcccaacaatgtgtgtacgagagagagagagagcgcgcgagagagcgagagaaagtgagaacatagctcattcattttggtcattgttcaaaaaaatccctctggtacttaggtaagaggatcatctagttgtgggaagaccagttaagagtattcatcccatcttcccaacaaccctggcaagtttatcttcatgtggcagatgagaaaacaaaggctcggaaggttctagttacttgtccaacacttcccaggaagtggcagtgtttggctccagactcagcctcgatgaccctgaagttaaaagtcacatggctgtgctcctggtcatgtggtcaagatttgtttgaacctacttttccacctctaccattacacataccaatttataccaaatcatgagtcattcaagtcactcacatgtttgatataagctgctaagccacattttgctctgccctacttgtgccatagggttttgattgacaggctgacttgtttttcttattcctacattttgcacattctctctcattttgtttgcctgattcctgctacatgaaatgtgttctactctttatttgaggttgtatctctatttatttatttatttggttgtgctgggtcttcgctgtggcactcaaactcttagttgcacatgcaggatctagttccctgagcagggattaaacccgggtcccctgcattgggagcgtgaagtcttagccactggatcaccaggaaagtcccatatttctttttgaaaagacccagctctagcctcaaaagcagattggaaaactccacttccttctgttctaaatactctccctgtttttcttccattcgcactatgcttaattgaagtgagcccttgggagcaaggatacagtga

SEQ ID NO: 30179 - DNA, 1362 bp, Bovine  19866880672177
aaagtatgagatcatgaatacttgtggttttcagctgcttaatgttggggtaatttgtatacggcaataggtactaatacaaatgcctaccttgcaaaactgtgaagaacaattggtaaaatgtgcttaattagattatctatgctaataagctaaaacatgtgaaacaggaagagaaaagcctagctcataaaaggcagcctataaatgttagttttctcttccattcacctctaaaatgagaacaatcataactgctctcttgtgaaaatgttttgaaaaatgtaatctactatggaactataatacatgtaataatgtaaggtattattgtaacaagaaagaaaacattgttactttaaaagctgtttgcagtttacactggtctggttggcccaaaaggaatgaagaattcttaagaagacactagctcttttgtttgggaggtggggaccctaaataagtgggtacgattatgagaaagaaaggaattcactgaaagctggaattcaaaacaggaggtgaccctgataatgtaagaatccccccaggaagctttggcaatcttggaaaaggtgtggttttcccacaatactcaagattgggccacatactatttaatgcgtatgttcaaagacaaagtgtctctaaaaggatggagggcctggagggtacatgggcaggaaatacaaagatcatgagataggtacaggcctgaaatctgaccccagaataaagcttagccttgagtttagggacagaatgaaggtataaagtaaattattatagaaacactcaaggaaaaggctctttctcaaagtatggaggacaagcatgtttgtcataaatattttccactacctctcatttttttattcttattaattcttaattaatcttcttaatctctcattcatttaagagatacaaagaaggtgtgttgtttgctagtcaaggaactgaatcaatagtaagtcaaaatttcccacaatttatgttactttaataaaatcatgtgattccttgggtcttctccttttttatcttttactttctttgagggagaagtagaattttaaattatttatttatttattattttttggctgtgccacgtggcttgctggagtttagttcccaaaccagggattgaaccctggccctggcagtgaaagtgccaagtcctaactcccggaccactagggcattcctggtatgagtttgtgtgtgtgtgtgtgtgaaaactaaggatccagagtagtcagagaataagacatttgtatacccagcttgggcattgtgcctgcagatgtggctgggtctgtcctttatttcagtctttcataagccacaggacgaagt

SEQ ID NO: 30180 - DNA, 2212 bp, Bovine  19866880781929
acttttaaaatagtgtattcagtggcattatttatgaagtacctgtatcacatatctgtatctgtactgagcagtgtttcctgctaagcagtaatgcatatttttaatcactttttacttattagagtcccccattcccatccttgttaaaagaagttggggaatggattctttttttcctctttccatctcttgctcctcatactgggggcccacagaagtatgcaggagataatttacttgcttttctttctggttcattgttaaatttgggatgagaaacacggacagagtattaagtttggtgatcattctaggaagagagtggagtatgtgagtggagtatgtagagtgtaagggaattaagagagaaggcactttctggtggacttgggtgaatatggatatatcatttaagacatacctcatgaggaaaactatcaaaatgaaataagcccagtacagatttagttaataatatccaccatttgttgagtatctatttagtataggtactgtgataaaattttatatgctttgacgtatttatttcaagacaagactgctattattctcaagttacagataaggaaaataagacttacagaagcctatgcagcttgtcagtgacaaagagagtatcacgagtcttctagtaactaccattcaataaaaagctgatgatgtgccagcaatcacgctaagtgcagttcaaacattattgtagcatctgcatgaagtaggcattattaccctcattttagagatgcagaaactgaggcaatatagttattggaatgacttaacttgtacttcagttatttaccagtatactgatgcagggtgttcataagttgaggtatactgttaagccttgaaagtattaaaaataaagataatttcatcagtgtgatcaatgcactgcataaacctaaaaaaatgtactattagactagttctgaattccaacttaatattttctattgatgatgaatcagctcacctacaccacctatctcacgcgtgtcttgtctctcctctcagtagagttctatatctgtatcccactgcaaaaacaaaaccttcatttcttcttgttctcttcttttatgagagtacattctcaagtaacgtcttaggtaaacgcgctgctttctttgatggatcattgtgtgactgaatatggtttttcgttttcttttccaattgattattcggtggggtataaaattgtaggttgaggagaaggaaatggcaacccactccagtgttcctccctggagaatcccagggacgggggagcctggtggtctgccgtctatggggtcgcatagagtcggacacgactgaagcgacttatcagcagcagctcctgttttaataaataaaaaacttcctatggaagacacagcatctcctcagaggatgaacggcacagtgggagaaaatagatttgctattcataagatgagaagtgctgttcatctgtgggagatcataagagatgattttctcccccagcttagcgtcagtcttttcacgctgatatcatgaatcagaataaaatgtaaaactgagaattaagccaacacttgggataaggagatggttctgtttatagaaatcacctctgcctagcagtgggctattaaaacagcagactacattagcagtcaagcacctaggagtttagcaatcatatgattaacaagttgaaaatagaaaagtgtaacaagcaaaacagagagggggaagacagtgacctacattatagttcattatcgagatgggaatgctaaaattaaaagccacgggtgtggactccacagttacagcattggggccacccactgtatgtgggacagccacagagaaggcaccacccggcccgaccaactcacctcggccatcctgggcgacccgacgtccggaagggccgactgcactgtgattcggggcacgggctgaggaaacaagggagcgagtgggctcggggctcgggggagcagggcagacagaatcagagaagccttccacccagagggaacttctacagcttgtagggattctgacaagtcactgcctggcagggctgtcaggggctgggcggggatgctgtgccggaaacatacaaagccaggagcagtcagtggcccagcgacaccagacgtgtaaggagtgcaggtgctctcttcgcttgcgcacggcacgt

SEQ ID NO: 30181 - DNA, 821 bp, Bovine  19866880858088
tttgtttgtttttgctaaaagctcgtttgagactctcacaaacgggaatacaatgagtttaaatggaaagggaaaacattttggctttttgagcagatttttagcccttcagtggggacaaaaacctgagtcttaatactgcaatggaaactgagtctgttgcttaatgcagtatcaggatgcagtttgtgggaaaataacctgtatttttatatgctgtttatccacacagacatgcgtatgagaacacgctgacacatgcacagatacatgctcaaataacgccacagtatttttaacaggaacatatggagatagatatagaaatgtagatatatagaaatagagatacacacacatatatgggtatacatgtggatattgatgtatacatacacacacacacatatatacatgtttgtggcgtttcttgaaacatgaattacatttacaaaagttgcatccttttgtcctagaaagagaagcttgcatggagtgtagagatttgcaaactaccctctctcctccttatctgaagcacaagccagtgattgtcattagcaccgcgcagaggtgtctgtgccaaagggtgacagaatagggaagtaatccccagtgtcagcagctgggcgcgatcctgcagcgaagtatgccctccgtgcctgccaggcctgtctctctctgttcgggaaagtggaatccaatgataaatgtcaatacacttatgttgccacatggaagtgagctgtagctgtctggagcacaaacagaagcggcagatctcaagatgtgggtgccagatggcacttaggagctgggcg

SEQ ID NO: 30182 - DNA, 764 bp, Bovine  19866880918297
tacatggcagaaccataaatattgtaaagtttaaaaataaaataaaaattaaaaaaaatgatagtttgttgcagatatccaaaggtacctctcttttaggaaatttctgtcttcattttaatgttctttgaacggtaaactatttccagccaccaactctgtggctggccctttacctttttattgccatttgcatctctgctaactcatttttgccgaggatgctacactattgacatgattctcccccctctggctttgtggcatttgctttgttgttttttgatacatccacttgcaccttgcataatgattaaccttcgtggattatctcccagcttggcttatgtatgtcaagcttcccctccagtgctattgtcagggctcaggaatatagcagatcaccatggcagatcagatgagggtaaattcaccctcttcccttctcatcacatttttagagagataaaattaatattttagtattaacagcaggtctgaaggggaaagaagacccaaaagggtagtctagggggatttctgtgtagggaaggaggtatctcatcccttaacttaagaaacagtggggatatttacgagatgattggtcaaccagcagataccctcttgtggaaataacacccaagacttgctgtttttagaaaatggctgctgcttcctatagtttctgcccaatcaccaggagcctgaaaattcccctgtatccctctgctaaaagaagttctctctcactgatgcaaaat

SEQ ID NO: 30183 - DNA, 958 bp, Bovine  19866881085471
atggagaaaaccatgtcaagtggatcagctctaatgtgcgactactagattaagagttccttcaaggcaaagcccatatctgtcagttcttgcctacacaccaaaagaagctgtgcacacacacatgtatgtgcacacacctcaaagagaaattaagttttgtgtcagttcgtctgtacctgtataattatttttttttgtacctgtataattaaattgcatgcacacactaaatatgtccaaatagagtttaatgtgaatgcccaaatttataaatattttatcaggttaggagaattctggcaaatcagtaaacatgattcagagaagcgtgagaatacctgttgatttcgtttgcaagctgagcttttggggaaggcaatatattttctaattgttccttgaccaaaatgagaaactcactgggtttcttaaaaataatcattgtttgcgtctttctctttggagactctgatttattgccttttgttttttggtatcaccacactggtttccccagaggacactgacgttgacagagaaagaccaaaagaacttttgtgacttcttccaaatgtcataacaaaagtaagtttcagcagtcttctgagggattgactttcaagcaggaactaggttgttttggaaacttacctaatgacattgttattatttcttgtgagtgataaggttgatagatcagtcccccttgcatttactgtaatcccttcagacctgagaggtgacctactagtacagaagctgtgtggccctaaagcttggccatagctctcgtctctctaagaaggatgtggcattggcttctgaaatctgtacatttgactgtgaacctccaagtgatgttttaataaagaagtccacttaaagattttgagtcatctttcatccttggaattttaaaaagatttgaaaaaatttaaggatagattgcaaagca

SEQ ID NO: 30184 - DNA, 1650 bp, Bovine  19866881101554
tacttctcactccacacatttctctattcactcacatgcctataaagtctcattctaatctctctcctgaattatagttctatatttctgtctggatgtttccacataccacaaactcaacatgtcctaaaatgaaccaactattttaatcctcatatccagttacataatgttccatctcattaatggaggcatacctgtactgtgccattaagtctaaaatctaatagtcacaatacattcattttcacctttcaccatctaaatggccactgctaaatcctttcagtttcaccttctaagttgttttttttttttttttaatctattcaatcccatccatcttcagggtcttagtttagactctagttgccaccactggctcacattattgcaaaatattccaaacaagtttccctgtccttcaacccatcttctattctggccacaatgaccttataaatactcaaacatgattgtataatttccctaacagaaaaatcttaatggctgctcattccattaggacaaaatctaaacaaggagaaacaaacaacaaagaaaaaaacatgcatcactgccagcgtctgcttacttttctaacctcatctctcaacatccctaccctccctccattcacagtaaccctaggctttagtcgtatgcaacaatgtattccaacctgcccctgttcttgaatgaccttctgcagcacaatgtagtgattaagagtttgggtttaggaaaaaaaggaattagaatcaatctcagttctactacttaatagctgtgactctgggtaagtaacttaacttccctaagccacagtttccttacatataaaatggtgatcgtatcaccatttgtaagtattaggtgagataatgcacgtaaacagcatgtggtaagcatccaaaaagcatgttaccaccaccattacttcctacgatcaaaacgagtagagtcagagtggtttaagatcctctaactgctaattcagtactttgtcctatggtatttccctaaatttaaaatcttagcctggcttattttcagccactttgtggttactgaagtctttcattttctgactttactactaatcatctacttcctggacccaggatataaaaataaaattatttaattgacttttaaaattgaaaaggtaaattaaatgtaataaggtcacctgtgtatttcaaaagaaaatttcaaaagcaatctttggctgttcccctttaatgtatttgtgaactatacaacaaaagcacctcaaaattttgcacaaaagcaggacaatggtgatatataaccactggttaacagccaaaaatttcacaaacccaaatgaaatttttggccaacccaacacaaggtatattatcaaaaaattagttctataatttgatgagtgctttgataactcactatttgcttcaaaaatattatgatcatacatgtttaatgactcatggccattactactttaatgtttacaggaagtatctgggaacaattaaaaaaacaacagataggacccataatatgaagtgaaacccttctgggaaacagaaacataccttaatgaactgaggtgtagctaatctgacagtagctacaaaacaaactctatcttcataagaaggc

SEQ ID NO: 30185 - DNA, 1258 bp, Bovine  19866881107478
aaactgaagttatgggtaccacttacacacagctgatctgtggaaccttcgaacttgttatctcatgaaatttcagcctgctttttcctttgtgatcacttcagcatcagtctagctctcctgacattgttacaatggctgtctacaactctagacttatgtccagtgtccccaacaactccaacaaaaatagaaactacctttccaatagtttaaaaaaaaaaaaaagatcgagtccagttggttctaacaggatcgtgtgctggcccctgaaccagtcaccatggcctgaggagcataacgctctgatccacgaatcctaggttcatataacctctgttggaaatcgactgagagtagaggagagattgtccccgccatcaaagaatcatggtgctgttaccagaataaggcacggatgctgagacagtattaaaaaaaaataaaaattgaaatgtctgctatggccttacagtagaggcaagatgaacaggtaggagtcctggcttcaaaggctgaaccttcatccaaaataccaagctgcattttgacactgttatttgatgaagcaaagaatattaatgtcacagaaaaattcacttttaggctcatattctcctaaatgtagatatattttgaaaatatccttacttacatgtatcaatatattttgccataagaattctgatctcacagtacagatgtgagatttgtacacagtacaaataaacagagaatcaagcatgttagacatctactcctctgacagatgatgtgagagggacccaaagtcttgttgctacctaagagcaaaggcggactagagctcttacccatctctccagtctcagcattgctgcaccttgaggacacaccccatataactctggccagcaataacccttcagatttttaagatttcactgtgaatgaagcatagttaaagctttaataggtcagctcataaacacctcattttttgttctggctaaagattaaacagtgcctatccatagggataactagctaagtggcaacatatgtcccccaaagctcactttgagtaagttctccctttattaattatttttcataagtattttaacatttcaaagctcacacttaatactaagaaaccaggcttgccaaatacattcacagtagaagatctgtcactctatacctagatctaccctctgctaaacttgtctctccataactgggaatagaccaatgttcaatgtggttacagggaagg

SEQ ID NO: 30186 - DNA, 784 bp, Bovine  19866881186898
atgcttgaaaaattttaaggatatttactctcattttctgtttatatctctgtgtatgaggcaagaataaggaaaactgtgattgcagtgtgattttcattctaactgatctttaaaatagtattttttattataataactatcacctcagataataactagtaattggaatttcttaatgctgagtttttatttttatttttcattaatgcttaatgctgctctattttttaaatttggccaagttgctattttaagatcatgggtttaagcactcctccatgaattggagttttactcttaggtacttccaagaaatattcatttctttaatcttattttcattatataataaattcagtcactttaacatggaaaaaggacattagaccctcctcccttaaagagcgagctgtgtgcacttatatcaggagctttcccatcatcatctctgggctttttcttgaggcaggtttggatttggtacagcttgggacagaagagtgtagagaccaaggcatgtggcatcaacatgggtggcaacaggcacggatcagcctgcaatccaaggggcaggcaggggtcatcctgtgatccaagggacaggcagagtctaatctgggagtgcttggagccaacagaggtgacatcaaaagtcaaagagaaatgagccaggagcccaggaagctgctagggggagccaaataaatgtgcaaaaggtaactttcttgcttaggataaatatgtagtcaatctctggccatatgtctcaagggtttctgat

SEQ ID NO: 30187 - DNA, 1051 bp, Bovine  19866881265451
ggaatgagaaagctgacctctgctccagtttgtcccattctttgtcctctcccttcttcaaggagtaatatttggggggaataaatccaggaaagggggttgagtgcttcagtgggaaggatagtagcactgactgactctgatcccatgtgcctttcacaggatgtggggcaagaaatgactcatcaagaagcctctgagccattgttaggcaaagagatttcatgggagcctggtgctttacatagggaatctcgttaagccaaaatgacttatcatgacaaaggggattgaaaacattccgttcattgccacagaaagagcagaaatggacttaggaaagcccagacccaatgttgagaattcaggctggatgcacagtgggcaacagcattccacattcattgcctaagctaacgagaaaactggcagcctgtagtgcgagagcaggccttccagagaaatcaggaccaaagactcagcctttaatactcaattataagcaagtaatattggtttgtttgtatttaactgtactttaaatatgctaccttgtgccagacactcttttgaaaagagtttattaatattaacccatttaattaatagagactctaaagcaagatagaggcatcatagtgtagatccggcgacaagcccatgtagaagacagtaaaggagctcattgatggtttctaccaatgtttgttaggcacttactatgtgccaggcaccttaacagttagtggtcagaactgtcttcttagctgcttgggttaaaagttagcagaaccctggaaaggagtaatttcaatcttatcccagaattctctacatattcttaggatatccctttaaccaactgagcatatttctcattattggctcattcttctttcagtctttttgaacaaagatctgagttcaaggacatttctaggtattacaatacatagattctattgtgggggaacttaacctgggtcagaatgctcatggcaaaaatcaggtaagaagctctttgacagcaggttgggggaatgaggctttt

SEQ ID NO: 30188 - DNA, 957 bp, Bovine  19866881386188
atctccagcatattgattccatagctcccttacaaaaacataacacttactgtatctgcttcttttccatcgatcatctgcagatcattcaaagaccactttttggttacttcatatttttcatctaaacctattctgtagtgtttcaccataattatttttacttcttcatttttggtcactgtgggacagaaaaagacttcgtttacatagactcttgcaagataataaattattcaccaagtcatagttttctgtatttatgtatctccttttcatataatgaacttgaaccatacattttatctgcaccctggttgtgaactctgaggtatctgaagcttcatgaatgttccctcaaatttgctcactgttctatcagtgtgttaactttatttttgctacagttgtggtcacatacagccgcggtaatatctgtcagatagaacaccgagctctgtgctttcagctctgagctttgtggtggaggatggagttcaactcagggcaggaaataagaggcttagcgtgagcatacagtcagtgccaaagtgtttaccagaacaagttggaattttaatttatgacaatataagaaaatgaggtcaggaaagtatatcattctgctcacccagcaaccaactgtggaagagagagcatgcaaataatattatgcacactttcttttaaagttgctctgagattttgaatgtaggattgctggcaacacagcttttactaacctatttggtattgtttgaggtttttaatcttctccagagtgtatctaaacttctagtatttgaaatgtgccattgaggcaaaaactttagtactatactttgaagggtgtggggaaaagcattgcttactttatatgaacgacataagggaaataattttctggccttaaaatcattgagttggtctcatacgaacacactaggagaatcagca

SEQ ID NO: 30189 - DNA, 1678 bp, Bovine  19866881395512
acagggcctggttgaagaagacatatgttaccacgagccaccaagtcaagttgtagaaaccgaaaggtgacagccatgaaatgtagatcagcagctctgccaagtagttaggggaagagacgtattcaaaccagtctccaaaagggattcggtggttacagtgaatgaccactcctgaaacgggagaagatacccttaacgtctgaagttgctagaagaaagttttaccactttgctcccaaagtcatttataaaaactcaaccagaaaaggatgtcacagacctgtacaaaccaccatgctatcaccacctccactgtcaacctactacatgtcagaaagtcacagactgaagttatactaactgtaaataagcacaaaagaaagcctgtttctccaacaatcctccaagctagtgatgaagagctcagattccagagtcagactgcatgagttagagtcctagctttgccacttacaagctgtgtaattttaggtaagttgcttaacctctctgtgcctctgtttcctcacctgtaaaatcagggtaagactgtatttgcctcaagcgagtactgtgatgttaaacataaagcgactcagaacagggctggcacaaagcaagtgcctgataaatgttgagtagcactgttcaatttttattatctcaaaaagcctaataaaaactgtatatgtgataagtcagtacaagctaactaaaaaagttaaatttttttgctttggctggaacgatactaacttggcacagtaatggtagtgctgacatgctggttcgacacttatatgcagtgcaggccccaaaatgtgggcacagcatagagtcacagaatgtcagggctagatggtgccagcgagggctgtcagtaaaatgctctcgttttacagatgggaagatcaagacccagagagtcttgtcaaaatgagtatttgatagattgattagttgactaattagagcaggaaagaaaagagagaaagaataagtacatttaactcctgagggctaaaaccccccagtcagtggttctaaaagatatcttacctgctttgtttttcctgagattgctgagaatgacatgacatttatactgatgggcagatgaccagatgaacatcatcattccgaggatatggaaccaccgagcctgcatcaagagattcttccctatcacatagactacagaaataagaattacctattagccaactctgcaaaacttcagaggctcagcgcattaaaaaaattatacagtctgcagaacacaattatccacttatttggttccttatgactagaaaaccaccctgatatcatttcccaagcacagaagggagaacactgtccctgtggatgaaggaggtatgctcctcagctaggggcagcttcagggctcactggcagagaactccagatcggcacattctcctgctccttcttcaagtgcttcaggcacggggatcagctctgtgggtcagcttccactcttgtgatgtattcttgtgtggtaagaccactctgcatttttattgctaagcctggtttgatgtcttctttcttgcagtctgctgtcagaaaaacaccttctgaaggatctcacctgagccatttctagggaaacttgaatacgactgactagctccagccaataagaaaatca

SEQ ID NO: 30190 - DNA, 821 bp, Bovine  19866881403501
ctctccccctcccttcccattcaggtgtttgaaatgacaagctgctatttattttgctccatttcccacttttaacagaaaccagtagctgaagatgtgccaggtggtcctgttgataaacaatgagttctaatacaagatttcctcctggaacgccagctttttttttctggcagatgaccgaggtgggaggaaacttggctctgtcttctagacatttttcctttggcagcttgtctccattccctacagagtgacagaagaaggagaatggtacgctggctgtgcaggagttcctggggctatttctggtggtggctaacagtctaaccttactcaacttactaaattcctgaggtcaggccacttcccaactgagcgtctggtcttaaagtggcccccatttgactctaggattccctggtgatattccatctgccacagctgcgaaaaatccaacctttcgatctcttgcaccttccatcaaagtatttcttttctctgttcctggacacagtaagtgctcaatagacctttttgaaagctcagtgaactctactctctattttcccagtttcacaaatattccattattgcagaattaatgcatcagcccagtaactgacgtcctactttctaagttccatgagtgagaggggagtgtgctggaggctgaaggtctgatggagaccagtttggtcacgtgtgggccatgtggccttggctagtttctgcagatgcaagaagcattgatcgagtgactgtggatcaaggattgtgcaggacacaaagataaagaaataaatgcattagcccacatg

SEQ ID NO: 30191 - DNA, 786 bp, Bovine  19866881405763
cgtcgtggggggaaatgagggcccagcactgtcggacaggatttcatggtggtgtcagtaagtagcaagaaaacacatagagtcttaagcattcttaagcagaagctcaattaaaaagacaacctttggaacaggctatgtggaaagccaagagatttggattctgccagtgcaggaaggaagggattccaaagataaagggcatccatcgcaaacatcttgttaccaagtcccaggagctctccatcaggaaatgaatagccatgtgctgcttcacagagacagagagagaggagagagaaggaatgtctgtaagataaccactagcatgagcctctagaatccaggtgttttggtttccaaaatcttcagggaaagtctatgtccctcagatgctaaatgcattaaaaggctgagaacctaacgtttccactgccctttgtattacaatcctttcctccacctttctatttaaaactaaatttggtttcattctttggtccagactctgccatggtgaccgttcctgatgtgcaagtaagaaaatttaattgctggggaaatgcagattttaggttaaaagtcatggagttgactgtttcttggcattaatgactctatttgagcagggttggtaatatgggttgaggaatgcctggtggttagtatgactaaattctggctctcacatgtgaccttcaccctgatgtcagacagggagtcagactaactcacgtgtctagatctgtgttaagagcagctgggtgtcgtacggggaggtaaagt

SEQ ID NO: 30192 - DNA, 1801 bp, Bovine  19866881549798
cattcatggtctacagctgccgatgggatcaggctggggtgggctacagctgggcccacatcttttgcttcctgccttttgctgtcctggttgccccatttccttatagttttcacctgagaacctccccatcattgcatacaagagtctttgtctcagggtgtgcttctgtgtctcaacctgagacaactggctttgtctgcagtaggcataccttgggtttggttgcagaccactgcaataaatcaaatatcacaataaactgattcacatgaattttttttgttttcctgttcataagaagttatgtttacactatactgtagtctgttaagtgtgcagaagcagtatgtccaaaataatgtacatgccttaattaaaaagtactttaatgctaaaaattgctgaccattatctgagccttcagcaagtcataatctttttgctgatagacttactcagtgcagggttgctacagccttcaatttgtttgaaaaaaaaaaagcaaaccaacagtatctgtgatgtacaataaaatgaagtatgcctgtactgggttgtgaagttttcagagttttattcttaatttcctagcaggaattctatagaaatacagtccatcagttttaagcatgtctctatcagatgactttctcttttggctaatatataaagagatatataaaggaagttatgctgctaaaatgttattttatatgcataaaggaaataacaatatggcttcttttagatgctgtttggccagaaaaacactattcctaccagggatggaggtggccagagtaggtgatagatgagtattcattgatttcttgattgatgaacctgattatgagaaggaaatatgttaatactgtttttaacagctttataggggtataattgacatggtaaaagtgtatattttgataagttgctttatgcatatgcccacaaaccctcaccacaatcaaaataatgaaaatgtacatcactcttcaaagtttcttcagctctttctggttccaggcaaccactgcttttgttttagtaacataaggctgaagaaaacctcagaggtcatgagcttcaactgctcagtagttgggcatgcctgagtacaggcatgcagggatttccactgggtaagaccatgagggcagttgacgtaaccagggccagccagtctgccatcagcatgtaataaagaagatgggtacaaagctggacactgatgacaactttggcatcaaggcaaagattccatgtgtgtggcaaattttgatgagtttcaggtaaactttgggatagcccagggttttgttacaattaaaggaggccctgtgagggagtgatgccatcctcgaaacgcacagcctaaataaaaacatacaaataaacctttccacccaaactcagacctcccagtctggtactggaaacggaatctcctggggggtggggcaactgatttctgcccttcacgttcatgccctcttggttctcttactggctgctgctggatacagaggacatactttcccattttaaccctttggctcaagtgtgctacctcgtggtccagctcagacatgtttagaatgttctgaggcactgctgaaagctctggcagaagcaacagagataacacagtgagagcagtagttctagataatctggcatttaaaacctagttttctatctttgctttatgagcctttcttccatgcctggaaatccccttttttgattcctttaagttcaagccaaacccagttcaccgctaactccttccgcctct

SEQ ID NO: 30193 - DNA, 722 bp, Bovine  19866881773965
ttgtttggcctaattttagttttctctaaacttatcttgtctacttctgctttttccttttaagctgtttaaaagctcaaatttgggctgagattcaagattgaaactagcttacatatctaatgagtgaaaagataggaaaaaaggacctgcgatatatttttgaggagaagggtattcgatcacctcacagatgaacaaggagaatagactactcaacattgactcattttattcttctcagaaatatcttaaatttctaaaaataatatcatctagtatttaatttagagcaacatgacatacatccatatacacctttgagaatttcgtatctctatggtctgcttaaaaaatcagagctaaaattatttgagaaactagagataaaatgagtagtgactactccttttatgatactaactgaaatgtcacttgtttttatattcagaaactcattccaggtctctcttgattattttactttagcatttttcagaagatcaaataatatcaatttttcttttcatttttttcaattacctttgatgaagtgcagtaaaaaaattttaacttatctatgtagagaaattatgcatttttcataaatacagatgtctttagaaaatgtaatattttgattctttttaaaatagactgaaaaaccagtctatgataagaaatgggttgtacaacttattgtatagaaataataaatttta

SEQ ID NO: 30194 - DNA, 1551 bp, Bovine  19866880659958
tactgattacactattcaactgttctgtgcagtttaatgcaatgtgttttataataaaaagctaaaaaaaaaacaacccaccataaatgaagttaaaacacaaaaactgggaaaaaagatacagctcatattataaacaaaaaactaacatcccccataagctcctagaaactgctaaaaatatcaacaagcccacagaaaaatgaagccaggacacagagtttctggcccctcaacaaattaaaagactcattcttgaaaggcagtcttttaaaaacctgaatggtcttttgaaagagttcccttgaaaatttaggtcagatcctttttactttctggcttaaaacctactaagcatttcccatctactcagatacatgtgtttttctatcaacgcagaatcattctgtcctgatctgtgtagctatgtatgttttttgccccccatcaaagtcagttttaaggatctggagaaactgaagcacctacttcttgtccttccctgccactagctgtgtagtatttcatccagtaatgaaaaaccacagctaattgatgcgtgaagttgttattgttcaataatatgaactaacctaacagctttgtgactgctccacatggatgtgtcctgggacaatgtgagtttacaagtggtttcacagtagtaaccttgaacattatgcagtttgcctcttcagactttcccacctaacaaagttggaaacatgcagaccagagaagtattaaggagcaggagctagttggggtggcgggcaatctgtgaaggaggaagggctgataagggagccacatcgaagaatagctgttcccactgccttgcttctgtggtgacaggtcagggagccctgggttctagctgcttgagtttctcctggagttcctggagctggcttcgaccccaggtgatgcggctctgaaggctggccatgtccgcagccagttgcagaccctcccggaagctggcttgagcttgtcgcagactgtgaggaaccaggattccaaaccatttcaaagggttctggggagctggggaggagtctggctctggggtccttgggagacccttgcgcctgtgcagagctgcctcgcgggatcccacctcctctggagtctgggtgccggctctcaccatccagaacttctggagtccgtcctgagcctcgctggtgccgacgcggacctggggctccatgtgggacgcatactgcaggggccctactgaattggcacccatggcatagcacgctttggagagcgagagccagccctcctccacccgggcgtttagccaggaaatctttcttaacactccttgttattctttggaactttgcattcagatgggtatatctttccttttctcctttgccttttgcttttcttcttttctcagttattggtaaggcctcctcaggcaaccattttgcctttttgcagttctttttcttggagacggttttgatcactgcctcctctacaatgttatgaatctctgtccatagttcttcaggcactctatcagatctaatc

SEQ ID NO: 30195 - DNA, 1192 bp, Bovine  19866880984998
aaaagaagattctgctcatcactttggtgttttagctactccctttccacaaaacaataaatccaatcttaatattttcagctttgtcttgagtctcattctcttttcccaaagtgagataattgtaacaatattcttaaagaaattctgtgtatgtgtgtagctctcccttttccagttgttattaaacttacttggtaaaagagacagcttggagataactggtaatacttaatatgtggtgaaatgagggggactgcttaccataacagctaggtaaatagacagcacttaatactctggtaattttagtgtaatatttgaattaattgagagatgtgtgtgtgtgtgagcacatatgcacacatgtgtgtgtgctcatgtatacatggtaatgtgctcagttgtgtttgattctttgcagccccaaggactgtagcccgccaggctcctctgcccatgaaattttttaggcaagaatactggaaagtgaaagtcgctcagtcatgtttgactctttgtgaccccatggactacatagtccatggaactctccaggccagagtactggagtgggtagccttccccttctccaggggatcttcctgacccaggagtcaaaccagggtctcctgcattgcacagctgtaaatataaaagattcacacaattttgtttaatgcttgtctctccagttttatatctggcacatgcatgcatgcttagtcactcagtcgtgtccaactctttgtgaccccatggaccacagcccaccaggcttctctgtccatggaattttccaggcaagaacactggagtgggttgtatttcctactccaatacctggcacagcattcaataaataacttttgaatgaagaacaactaaaaaaacccaatggtatacttaggagtaagatgaaccaaataggtaaaacatttatgcactgaaaacaataaggcattgatgaaagaaattagaacagatgcaaaaaaaaaaaaaaggaacaatatcccatatcatggtctggaagaattaatattgttaatatgtccatactatccaaagccagctatagattcaatgcaatccctataaaactcccaatgggcagttttcctcaaaatagaaaaaaacaatcttacaattcatgtggaatcacaaaaagaccccaagagcaaaagtagttttt

SEQ ID NO: 30196 - DNA, 1894 bp, Bovine  19866881280549
tttcagaatgggcgggtaggcgatcatctggtcaatcgctgtacagcttttacagctgctggagctacagttatgattattttagggactcctcaccttcaaacgaacattagcctcctcgccgtaggtagtgaagccgggctgtcgcctttattaactgcctggtctaagtcacgtgacagcaccttgcctccctatcctgcctattggttgcttcagtgagcacgcgcttcagtctggccaatcgctttgctactcccaccttctgttcgccattttaacttcgggcattgtaggaatcagcggaatctagtgaggtctctaccgacttttggttaagggcggaagcgaggaccgcggaggcgaggactgcgttgcgcaagcggtatccaaagattctcctggacccacgtggaagttgccctcaggatggtaaggagggatgttttaaactcctgttttggaggtcgggggctagtggaggctggggttgtggccggtggggtcggggcgtatgtttctggagcctgctttgcttggagaaaccgggtcgtctgaatgggcccgctcttccccagctgcgccgcgaggcccgccttcgccgcgagtacctgtaccgcaaggcacgagaggaggctgagcgaacggcccaggagaggaaggacaaggttcggcgcgcgcttgagggtacgtgtgtcccccgctttccgatcttttctagagaccttagttttaaaacccaacgggaaacaggccccaaagctgtaaaaggcgtttaattagcatttacttgtgttagagtggtgagtattttttcacgtatttactggtcatttcccttaactgttcgatcttcttcatggtttgcaaatgttcctttcaagatcgtatgaattacttgtcatttatgttacagtatccagattttacagcttgcttattaattttatttacagtgtctttgttgtttagtcgctaagttgcagtgtctaggcctttccagatttaaacatttcacgtggtcctatacatatttcccctgcatcgtttctgttcttgctacttgttgtcactacaaggtaatatctgattgtcctttactgttgttacaagtcccttgtatttgaaaactgttaattcgtgtagaacttcgttttatttgcgttgtaaattaggaatttaactttgcaatattttgcccactttccatttgcactgctgttaaaagagtctgtcacacgtgcctgattggaaatgctttatttatatgtatcttgttggttcttgtgttggtggagctctgtttcctgatagtacatcaactcagtacctccgttttaaattcactttgatgggcttaggttttagacatgtaaagtatgtgtatgtatattcatgtcaagcataatgtaatacagagcttctcagcgctagtggtaaaagaatctaccctgctgatgcaagaggtgtgggttcgaacccggaggaggaaatggcaaccgactccagtatccttgcctggaaaattccagggacagaggaacctggcggactgctgcccatggatcccgtagagagtctgttgggactgagctcctgatgtaatgacctatctgctcacattaagaaatgaaaatgataaatatattgaagtttagaaatatttcccccgacctagagaaccacagtattaaatattgattaaaaataagccatttccttcctcttctttttttcctgtatcatgcttgtttgtaatattaaatcatattggttgattttaggtagtattaggttttgtgtattcttttgccacattatgtttttgtttggcatcgttactaagatccattgagtgtaggtggggctcctgcaggtaaagattccacagggt

SEQ ID NO: 30197 - DNA, 1973 bp, Bovine  19866880388379
ttctggataagccgtaaaaagtccacatatcctctcagaccagtcagtttattcttatttgatttgtcaggtctctcctcctcttgttcggcactgtggcttctgggccatgacccaaggatctgctgcacccagatccttcttgaggcaaatcagagggatgataataaaagaagaactctacacacccttctcccccaagagcagaaagggggagaccacagtgctgatgaccccaagatgcaagtcacgggacatctgtctgtattatctgctgccccatggccaacactgccctccctcacccaggagctggttcgccaccggtaagacacagagcagtggggggaggtagtctagaatagtcctctgcttggccaacagacctccaggggccaagaaggtcagcagggatctttcaggtcctcttgagggtcccctcccacatcttacctgatgaggtcaatgggttgaaacttataaaacacccccgtagcgtgcccattcttgatacagcagctaaacaagaaaaacagggaaccaggttagaggtgaagtgtgcaactagtcaccttttatatccagcttagcaagtcaaaattagacacttgccaaggcatggtggccctagtggtaaagaacctgcctgccaatgcaggagacataagtgatgcaggttcaatccctgggtcgggaagatcccctggagagggcatggcaacctactccagtattcttgcctagagaatcccatggatagaggaacctggcaggctacagtccatgaggtcacaaagagtcggacatgacagaagcaacttagcagcatacacgtacagtacaggaactctactcaatactctaatgacctagatgggaaaagaatctaaaagagtggacacatgtttatgtataactgattcactttgctctacacctgaaactaacacaacattgcaaatcaactattctcagatcaaaattaattttaaaacaaagtaattattgataaagtgaagtcactcagtcgtgtctgactctttgcaaccccatggactgtagcctaccaggcttctccctccacggcattttccaggcaagaatactggagtgggttgccatttccttctcgggggagtcttcccgacccagggattgaacccagggtctcccgcgttgcaggcagatactctacgctctgagccaccagggaatgtaaaaaaggacagcaagagaagggctctctgaggaggtgaaatttgggttgagacctagaaggtgggggtgtgtttcaactaggagaacatgccttctgtgccaaggccttgagaaaagtgcatgtgacgtgtcctcacaggaaggccaggctgagcaaggggagaatcttgggagataatgctatttcacacttcctagtcttctgcatcgcatcttctcacacatcacacagaactcatgcaattctagcaaggagaagtgactctaaccaggtattctggatagatggctgaacatgagccctacaggaagtcttcaaagacaccatattaaaactgaaataagaattggcattcctactcggcagctatagactttttattgtcacagtgtcctccaacaacttcaaaaaagaaccagaaattgcatggaccctgatggtgcaaactgcacccacagtcccaccttctacagagcaggacaccccaacacagagggggcgacacggtgcccggtgggcaggtgcagatctgaatccgtgaagcctgatgctctgttccaggcaagaggctccaaacctgatcataccgttattactatctctcttcctccctgtcatcctggtgcttctactgccctgggtttttattccctccccagtgccaacgctgggctcaccagcaccttggctgtcacagtgacatcactgggggcccacagggaggccagctttgcgtcaagagatacaggcaagg

SEQ ID NO: 30198 - DNA, 1598 bp, Bovine  19866880428535
aaaatacttgaccagaacgtctcaaaactgtcagggtcatgaagaaggaggacaatgagagcagacagacactgtcacagaccagaggagacaggggagactgtacacccgtcacctggtatctcgggtgggatcctgaaacagagaggtgacaggactggaaaaacagatggaatctgaggaagtctcgcttaattaagggtagtatagcaatgctggcttcagcgccgtgacaactgtaccttggaatatgcactgtgaacgagaaagaagatgggcgtggtggggagtacaagggaactttctgtaatatctttgcaacttttctgtagatctgaagctgttgtaaaatcgtgtgtgtatgtgtgtgtgtgtgtgtatggtagggcctctctttcaaaacttcctgtctccttcaagaacctgctccattaatccacccctttcctgcctctgctgcctgtctcagccgctgttttactttctgccaacacacagaggaaggtttgtctgtcccaaaaaaacccatcagaaaacaagccctctcttcctccaactgcattgctcctcctggctgctctgtgctttaaccccagagtttgtagctaaaccatctccgagtcctcactcagttaggagtccctgtaacgtcccctgccctcctctgacccctgtccttcacgcaggatggtggctgttgaaaggatcagacggcttgggtcaccaccaagtgtgaaggcttctactctgtcctcacactttttgatctctgagcagtgacattgtggaaccctgccgctgcctcctcttctgttccttagatggaatcgctccagcaagcccttcctcctggacagctgccctggccatccaggccggctgcttccccaccaggatgtccaccccaggaaatgtgacccctactccacactggtctccccagcatcctcgccccctccctttctgtccacattttcctggagggcggggtgacttaagtcatttgagtagctcccctgccccatccacacttgggaccaaagcagtccttggtaaatcattattcagtgagtgaaggctgagcaccaaagaattgatgctttcaaactgtggtgatagagaagcctcttgagagtcccttggacagcaaagagatcaaaccagtcagtcctaaaggaaatcaaccttgaatactcattggaaggactgatgctgaagctgaagctccgatactttggccgcttgatgccaagagccaactcactggaaaagaccctgatgctggaaaagcttgaaggaaggaggagaagggggtgacagagggtgagatggttggatggcatcactgactcaatggacatgagtttgagcaaacttcaggagatagtgaaggacagggaagcctggtgtgctgcagttcatggggacccaaagaggtggacatgacttagtgactgaacaacaggtgaaggacgacttcaataaaagagaagagaatctctgggacttccttggtggtccagtggctaggactccgtgttcacaatgcaggggcccggggttcaatccctagtcaggggactagatcccacatacca

SEQ ID NO: 30199 - DNA, 2143 bp, Bovine  19866880445737
actctgacctcctgtccccacccaggtaagggacagagaccagtctcccattcaccatcacctgcccaaaggagaaaagccccatcagtagtcatggcaacgaaggatcctaggatttcacttgtagtctctttccacagttcatgacagtccctacacattcatcccactcaactccactgttattcacaaacttgggcactggccggcagctcttctaagataaaggggctctacagaccttggcaggagagtggactcttacaaagctgaacagccagccaggcatctggaacccaaaagctcaggggttaaaggaaaccttgagtccatctgcactcgagagggaagactgactcctcaagacaggctggggaagttgccatttgccaactcattgatgccctatctccaggagcatctaataggaacactttaatctttattttattttggtcaccagatctacagaggctccacaacatatcacaccaaacctgttaaaatacactcacctcccatgatgactataatttttgctgtaaaaaatttggaaagctttttatccttttgaattttaaacatttggctatgagctactcatttaatatatgacgagctgtgattatttttttcagcaatcactgtgcatgttcaagaagtcttgcaagagaaggtctaaccccttaagttgctttcatgtaatgaaatatttatgatttccaaaagaactgaaggatacaacctcttgtaaacaggtaatcaaacatttattttgatgagttttgcagtttcccttttgagttttggagccacacatttttcttaggccctaaacattttcaaaggctttcatctaggccctaaatattttccttcagaaggttggcaggccctagcctaggaacagggcgcaaaatgcctgctggacaaacagcctggtgtcaaccccaatcttctactagtgcaaaaaactggcaccccattgacgatgtaatgctactgacatcagaccctttctgggacttccctgggggtccagtggctaaggctccatgctcccaatgcaggggcctaggtttgatccccagtcagggaactaaaatcccacatgccacaactaaagattccacacgccacaactaagagtttgccaaactcagataaggaaatatttccatcagcagatgaatggataagaaagctgtggtacatatacacaatggagtgttactcagccattaaaaagaatacatttgaatcagttctaatgaggtggatgaaactggagcctattatacagagtgaagcaagccagaaagaaaaacaccaatacagtatactaatgcatgtatatatatatatatatatatatatatatatatatatatatatatatggaatttgactggaatgcgaaagtaggaagtcaagaaacacctggagtaacaggcaaatttggccttggaatacggaatgaagcagggcaaagacttaatagagttttgccaagaaaatgcactggtcataacaaactccctcttccaacaacacaagagaagactatacatggacatcaccaacaccaaaatcagattgattatattctttgcagccaaagatggagaggctctatacagtcagcaaaaacaagaccaggagctgactgtggctcagaccatgaactccttattgccaaattcagacctaaattgaagaaagtagggaaaaccactagaccattcaggtatgacctaaataaaatcccttatgattatacagtggaagtgagaaatagatttaagggcctagatctgatagaatagagtgcctgatgaaccatggaatgaggtttgtgacattgtacaggagacagagatcaagaccatccccatggaaaagaaatgcaaacaagcaaaatggcttttgctatgtaggttatatctggggaggccttacaaatagctgtgaaaagaagagaagcgaaaagcaaaggagaaaaggaaatatataaacatctgaatgcagagttccaaagaatagcaagaagagataagaaagccttcttcagcaatcaacgcccagaaatagaggaaaacaacagaatgggaaagactagagatctcttcaagaaaattagaga

SEQ ID NO: 30200 - DNA, 1386 bp, Bovine  19866880450954
acacacacactctctatgtagtccaaggagatactatacacacacacacactccaccacacacattggattagccagaaagttcattagggttttttcataacaccttatggaagaacaggaacgaactttttggctaacccagtacaattccatggtctaataagtctgagaagcaaaacctggcaatggacatcagcacatcaaaagctctaaagaatccagcaataaagaaactgtctaacttgcttagctagtgtattttcatcccctcttactgacaatgactgtcaataccctgcctgcaaaacacatcttggaatgttcaaacataaatacagagtgcttagtacaatgcaaggcacctaatatatcttaaaaatggtgaaaagtgaaaaagtgttaagtcactcagtcgtgtccaactctttgtgaccccatggactgtagcccaccaggctcctctgaccatggaattctccaggcaagaatactggagtggagagccattcccttctccgggggatcttaccaacccagggattgaacctgggtgtcctgcagtggaggcagattctttactgtctgagccatcagggaaccccctaataatggtagacatcactatataaagtattcttttcccatgccattcttttccctgcattctacttatgtgaatataatcataaaaaatactgctaatgggaacttccctggtggtccaatggtaagaactttgccttccaacgcaaggagtgcaggtttgactcctgtcaagaaactaagacccccacacgtcttgtgaccaaaaaacagaaacagtaatgcaacaaattgaataaagacatcaaaaaatgttttttaaaaaatagtactagtagtaataatgggttgttacactctggtgtttaaccacacagctaacccacaatagactggaatttgaaccaaggtgcgtccgactccaagtctttatgccatgctgcttccctatccctcagggatgcctggaatagccgagccctgctgccaaggttggaaggggccaatcacgggtcaatgcttccaccactgagccagtgagaagcagcccccttggggaggggggggctcctacctggtgccggatgccatcgtcaccgacgcactgggtacaggcctcctcagggacacagctgccttccagcatcacttggtgcggagggcagaagcagccttccaagggatggtccccgcaggagctcgagttgccctcacactgccgggggcagccactctcacagtggttgtagatcagggagggcgggcaggacacagctgcagagagagaaggagatgatcctcaggggccacagcaaccagagggaagcagataccactgatt

SEQ ID NO: 30201 - DNA, 846 bp, Bovine  19866880460883
gtcagcagagctggggccagtcctgggcagagagaaaacatgagcctttttcccgggggattatggttctaagtaacaggtgtgaagaggctggcgacttgaagggactttggggatcagtaaagaggtccttggtgagccatgctttgtatgagctgaggcaccacttttctttggagagagagggaatggaaaacatccgtccttcttcctggggcccccccccactttctgggagtaagagggcaggaaagggggtctctctcccccgagtctcgagcaggaaggaaggcctttggatattatcctgaagaagaaagctttgctgtttctggccagatgggtggtgtacgatggaaccaattagctgaaaagaaaggggaaaattcagaatttcaattttcaaagcagagactctttttttttttttttttaaaaagaaaacgtttgattattttcttctttcaaactgatttccatgcttgtttgggagtagattcttggtgtctgaagtctgtggttgagaggccaaagtggtgctcatttttgggtgaaattgtggatatgtggttacttttcagcgtgcctcttcccccccacccccactcctcctcctttcgtgtgccatcccctccctccacctggcagccactgatgggagggcccatatgttatcacctgagaaaggggagacccacagcagcaaggcagagacatcgtctgttacagcgttgtggagctctggtttgatgacctgaattgtcttggctccaaggcaaaaaatacttggtctgggcttcctctcttaggaagcagactagttaaccagggtttaagattccttca

SEQ ID NO: 30202 - DNA, 1603 bp, Bovine  19866880553148
cagaagattaaaaaaaatcagcaatgattcaaagcttcctttgaggagaatggagggttacttatggaacacgggagctgccttccccggagatccatcaaacatgcatagaaattgcagctacagggctgggtgtgagagttccaattaggggaggcctttcagacacactgcctggctgtcctgggttcctctggccgaggccaggcctggaggagggcaggtgcaagaagccggctgccccagagccctccccaccctgggactctctatcacccgcgtcgctgcctctctctttcccgctgtagggaagatgcaccagcaaagccctgtactccatcgacacggaggatgtgcaggaccagtgttcctgctgctcgccgacgcgcacggagcccatgccagtgcccctgcgctgcaccaacggctccatcatccaccatgtggtcctcaacgccctgcagtgccagtgctcctccaggaaatgcagcccgtgacgcgctgcccgcccgccacggacacccgctgcctcccgctaggctcggcgatctctgctccgcgcatgcgcactctactcccggaccttcccgggctcacaataaaggccaatctatcctctcgtcaaaggctggtggttcatccaggttgagatggctgggctgctctgagccgggtgctgaggtgggggctggggagtggagagggagcccaggctttcacaccagatccttttcaccccgagagagactgtactcagtgcagccactggacaatgaagctgggaaggatttagacatcatctcatccactgccctctccggccccttcaccgaggatgaaggtagctcagagagcgtgagtgacttgcccaaggtcacacagccgctgggtggcaaggccaggttcagaacccaaggacctagacacctgggcaagaaccctcgggctggtccagcagagccacatgaatctagtcctgacagattcagccttgatctcaccggaaccggggagggctgcatttttaggcctttctgcttccgctggataagaacctccagggaagataacgttggaggcaaatggcatgagttgcgttgagtcgcgttggtggggagttttagccaggtagagggaaggaggaatggagagaagttttatataactgctcaataattcaaaggctgtcaccctctatccatcatcaccccacctccaactttgagtagtctctaaggtctctgtgggaaagcagatccggggccagagaattattaatagctgtctctctcctgactgatcgcctgatgctccaccccaggaccgaggtgctgttggtggcatggggctccaagaaactcagtgggaggctacttcttcaacagggggtgccaatttcccagtgctcccatagcccgagttctcctcgtatttactgacaggacgattcgctaccaaggaaaaagctaaacttgaaaaattgcatgttttgatttaaaaaaaaacgtcagggagcagggtaaataggatgctgaaggagaaacatagtgggatgtgaaccaggagctctcccactctacacgctttccaaggggggatctgc

SEQ ID NO: 30203 - DNA, 915 bp, Bovine  19866880580359
actcgttgagtctaatgaccttgtgaagtaggaacgcctctcctttctttcttttgttttccaggtaaggaaaatgaggggtagagatattaattcagttttctttcctttaaaaaaaatatttatttattcggctgtgcagggtgttagtcgtggcatgcaaactcttggttgcagcatgtaggctctagttccctcaccagggattgaaccctgcgttgggagctctgagtcttagtaactggactaccagggaagtggctaaggcacaccaggacaaaggcacagatttatacgtaggcaagtctgactccagagtctgtgcatttaacactgtgccatggagacggctgcagaaagctgttctggacacagaaggaaggtaagggaaaggtctgaggctgaaaaaggtctcaagaggccagggagttcagctccataacatttgtgtcttcagcccttccttgcccaatcttgacttctggcttccctcctgtttcaggtctccactgccgatgaggctgtgaccaaaggcatcccactgctccccaccttcccccaggccggctgccttgcaaccacaacccacacgcccatgctgaacctccgtttgctctggggctctctgtgcagcccccaggccccggccccagagactggagatgctaggacgtgggtgcgccccctgatgccccgagcctagctcctcggcgcacagtggcacgatgcaagccaactcctcggccaagtctcttcccaccgagtgcccggactaccagcccatccatcatttgcatctggtggtctacagcgtggtgctggcggccgggctccccctcaacgcgctggccctctgggtcttcctgcgcgcgctgcgcgtgcattcggtggtgagcgtgtacatgtgcaacctgg

SEQ ID NO: 30204 - DNA, 760 bp, Bovine  19866880627938
actctcatctcctgttctagaaaaggcaaactgacccctcatgcagggagtggggctccaggagtgacagctggcttactgctcacctcttagtcccaccgccagcctgaagctccagtgccgggcacaggaaggcagacagaaggcctgggtgatatcccagcttagctcccaactcactgtgcaacactgggcgggcacttcctgcctgcccatgggcctcagtgtacccatccatgaaatggaggactcagaggaccatttcccggccctgccattcccggggtccccagtcccgctgctcgactcaccacatggtgtgatggtccgagaagatgtcttcgggttggaagatctcaccgtcgtagtaacaggggcactgggccttgggcacacaggaccctgtctcgtccaggaagagccccggcgggcagaagcagccctccagacagacctcggtgcattcctcgtccgggtgggagagtgagcggcaggtgaggttgcagggggtcccacactgctggtacacctggccgtgtgggcagctcagtgctggaggagagggcggggccaggacagacacagcggaaacgttacgacgagcaggactgtggttcctaggaccagcagtcccacccgctgcctctgagacccccaaattatacctgcatggtcatcgccttatcttcccactgggagcaaaagtgtgtttttatgctcacaactgtctgttctttttattttttattttttttctatt

SEQ ID NO: 30205 - DNA, 1864 bp, Bovine  19866880660827
cctcctcctcctcctcctcctcctgcgtcaccgccagcctcgttcctccacccacctctgcgatccccacttcaggacactgactccatgtcatgggtggccccacctctggaaatcaaactgcagaggccccgggattcggggtctgggtggggggtggaccagcaggggtggcgctggctgatgcccctcccacctaacctgcggcttccccccagaggctgtttgctcagcgctgggctcggcaggccgctgggctcttgcatgaaatggcttccaccctttggcacccggacagccggagcccggcaagagccagctgcgtttgcacagagcctggcaggttaggggagaggggagaggaggccaggtgtctgcctctgctcaggaaaataggacttctcccctgcctggctcctgatggcttttaccccctccactttgccctccagtggttatcaacaacaggtctgactcctgatgggggccccgggggcgagaggcgggattcctacacaggcacacacactctattcttttttttcaaaatggcccacagcaccattccagaccttcctctttgtgctccaacgaaaccactgctggtgcagaaccattttgataaacagcccttcggagggctgtcctcaccggaatgcttactctgctaaatgaagccttctgcggttttagacctcacccatcagtgttctcacgcttttcctttttgtgtccaaggtgaatcttccctcttacacacagaactgtgtgtccgtgtttgatgtgtcttgttttcctgttcaattccattttgcaaggaggcccgccttttgggatctgttgcacagtctcgggcttaatacccctgggacttaacacaagcaccttttctactgaagaacccaagccttgattggctttcttgggtacctctggctgtgagatgagggacctgaagtcacaggtcaccatggcttctgtggtcctgtagcctccttggtggatagtctggacagaggagcgtggaaaagtttctcgaagctgcatgtttatattctgtgttccccacctcccccagagtaggatcaggggaactttattgggagccatcacaggtcttttcaaccagtcttgcagaaaccatcattccctctaacctacagaagagcactgatttcatcatttggggacttgaaaatctggggaagagactatcggacccaggttcacccagagatcatcctttgcaaccaagggaattcaggagatcaaaagtgctaaacaatactttttttttttttttttttgaatttatgttttccaagtctaactgcagatacttgcctgcttcgttccgtggaaaaagtaacactggtccagggacatgttcgttttccgtcagacgatggcaggcagctgtggaaagcaacatcctgtgtccagatgagataattttattttaattacatccatccagtaattcttccccgccaccaaaaaaacactgacttctggatagtttttaaatactgcatgctgtcatccttgactggcaagtctgaatttttgggggtgggaaatcccatgaaatcagtaggaccttcctccaaaatcataatgatttgacatttgtataccctgaaaaaagcaccagagtaagtctaggcaccatctgtcaccaaagtcacagccttcttttttcttgagtatatactacatcattttatccatttacaattaggatgtttccatacctcggctattgtaaatagtgccgcagtgaacatcagggttcatgtatctttttctgaaatgagagcgactttcaaatttgcaaaacagtatcacgactacagttgccatg

SEQ ID NO: 30206 - DNA, 1676 bp, Bovine  19866880764775
ttaaattaaattaaattttattttatttttagtcatggcatttgggatctagtttcctgaccaaggattgaacctgggccccctgcactgggagtgcagagtcttatccactggaccaccagggaagtccctcccctctttttaatgggcttgggaagtgactacaaaaagagtaaccgcgtttgcaaggattcgtgtcctggcggcagggggagcaaggaggaagactgaggcatagtgtggggtcacttatcatcttcgtggctggtggaggctggatcataactcagcacggtccggagagaccgggaagatgggcaggaaatccctaaattgagctctcgaacctggacaaatccacagtaatgagtccagggacacggagtcctgagcacagatattaaccgggagggggatcttggaaggaagtgtttgttttccaaaaacaacaacagaggagccagtattttgtgagggacacgcagtgtccctgcacaggatagaggcaggaggcctggcctttggccccgagcagcctgggaaggtttgaagtgcgtgctttctcacctctgctctttaccgaggtggcctgtctagattgtggtcaatatctatgtttattttgcacttttcttatttaaaaaattttttattggaggataatggctttacaatgtggtgttagcttctgctgtgcagcaaagtgaaccagccatgggtacatcacttttttatacatatgaacgagtaccctgccacctgtccccgccatgctcacccctgacgtccacttctcccccacgagctacatcccaggaactggtgaggatgagatgatggagtccattcttgtgttaatgcagcaggttcatccagcagcaaacccatgtcccttgcatagtagcgcagatcttaatcactggaccaccagggaagccccatcttctcattttcatgaactgaaatgatatagaattgccattaagaattttctgatgagagtgagaaaattagtgttaccactgttggactaaataaaattccagttaaaaagcaaagaaatgtggcattttagttaacctgggtggccccttaggaggaaaatattaattctattaagcttcataaattatttggaagttgtgctccattacttattgctggctcttagaaattctgatttgtgacttctgcaaaagttccacaggaagaccctccccaggttcctgatgcccactcagccaggccagaacctctgccttcccagttattcagatctgaggcttgggttagtaaggtttctctagagaaacagaactaacaggattgttgtttgttgttcagtcgcccagttgtgtctgactctttgcaaccccatggactgcagcaggccaggcctccctgtccctcaccatctcccgaagtttgcccaaggtcatgtccgttgcatcggtgataccatccaaccatatgtgtgtacatatattatgtatatacatttgatatatatatcatcctcttctatggagttctccaggcaagaacactggagtgggttgccattctcttttccagggaatcttcctgacccagggatcaaaccccgggtctcctacattgcaggcagattctttactgtctgagccaccgggaaagcccctcctgccctgatgtaa

SEQ ID NO: 30207 - DNA, 1179 bp, Bovine  19866880796476
aaattaaaaaattttgtgaaagacccttgaatgagaattgcatttcatgcaagaagtccaatgttaaaaagctgtgctcactgaagaaagctcaaatttctcattttaagaagtctgggagtttttttccccacttcgggccgcggcgaggaggagccggagcgggagtgacaccgggccggacatataaaaaaaaaaaaaaaaaaagaagtctgggagattccattttaatgttttgtatcaattcaatatttaatatctttcctaatactttgttttacatcttccttcttattctcataattatattagatcaagaaaatagtaatataattgcctttttcccaacaggctttcaaaaggtatctccaaattcccttggtttgccccagtgtcatgtaccaaggtgaccaatgtcatgatgcactgggatttgaggaaggttaggaacctcccacctggctaatctaggatcatttccccatctcaagcttttcagcagaatcatatctgccaagtccctattgcaggtaacacattctggagataggggagccttggtggactttgggagcccattaccctgccgaccgtggcagggtatttggtagtgacttagcaatgctttgtgtcttcaccacttctcccctgaactccttaagcatgactgggtgtacatggagagcaggatgtcatagccccactcaaatgtttcaatgcattaacagcagacccaaccacggccactgctgggggtgtgcaccagctccttctccttctgccctctggagtgccgtctgggcacccatcccagtgccaatgagtcccctccaccttgaaagagttaagtgtcatgaaaagcagcatgcaaagggggcctctggagagcggatgctgtactttaggaaaatgcctcatttgcataggacagcatgagtgtgtgtgtagtgcacagcgctcatccagcaactagggtggggggcaccgagccatgagttagatggggctgccggggtggctcaaggactgtcaggctgttttatcagaggtatgagggctttaactgataaggacagagtgctattctcttctgcatcagtcaaactgtactggaggttgtacattgtgacaaaaaatggcagtgcccagcaaacatttcagggcttccttacaattccc

SEQ ID NO: 30208 - DNA, 1079 bp, Bovine  19866880806935
aacatatggatttgattgcatttccacaccccatcttcctctcctcttgcctggaaaatgaaaagggggaaaaaacagccaggcagggaccaaaatttgtagcatggctttaagcaagcttggagcatgccagggaaatagctggagctggtcaacacattcgaatggcagtggcagctggtcccatcagtaacactgacggccaggaacgtacccgccatcaggcaagagcagatacgcaggtctgccagagggcactgggagaaatggccctcaagtgccaaggccctcagatagccaaggtgccgtgtcatttccctgcagtttcaaaagcagtgtgtagggctgattccacttctgtcctcagactttatcaaaggggtggtatccagctgtgctctgtctccactggaaacaaaacagaaggacttccattagagcaaagggaaggcaattaagacatcaaaaggaatgaccagttgcaacgctgtcttatgaccaggcatagtaagcacatgcctataaatcatctatttacacatatttattgggtgcaactctcataagagttgcatgatgtgtcagagactaaactggatgatattcacatattattaccaggcctcacacttgcactacaggatgggtattatcaacccaactgtatagatgaggagtgagtcaagcaggccttaggaagtatcactacgaacaaagctaatggaggtgatggaattccagttgagctatttcaaatcctaaaagatgatgctgtgaaagtcctgcacccaatatgtcagcaaatttggaaaactcagcagtggtcaccggactggaaacggtcagttttcattccccccccaaagagaggcaatgccaaggaatgctcaaactaccacacaattccactcatctcacacgctagtaaagtaatgctcaaaattctccaagtcaggcttcagaaatatgtgagctgtgaacctccagatgttcaagctggttttagaaaaggcagaggaaccagagatcaaactgccaacatctgctggattatcgaaaaagcaagtagtttcagaaaa

SEQ ID NO: 30209 - DNA, 1046 bp, Bovine  19866880811242
ttgtgtgaaaagggggcagggggaaatgaagctaagtttggctgtgtgactaaacattatctctagaaggaggcgcttaaccactactgttgctgctccatgggaagggaactacgtggctagaaagcaggcttggaagagatttctcatttttaaaaaacatatcattaaagaatgtatacatgtgtataacagttactctgctgtacagcagaaattagtgcaacattgccaatcaactgtatttcaattaaaaacatatatatatatatagtttcccaaaggtgaactctaaacctaatgggtcacgagagaatactgcattctttctcatacttgtaactagctttggctagcaactgacggatgcgtccttccacctcttcgggggtctctgtctccgcaacgccctcagacatcccctctccttcctggggaagcatcagcagctgctgcagggtagctttcaactctggcagcatggcctcccactcctcagcggggtctagctctgcggctgaacgagaaggtttcagactcttgccttgagctccccactgtggggaaaagggtgtcaaggttgagagctcccccagagcccctactcacaaggcgctgtggctcgcctctgggccctcatctcttgtaatttctgggtctccttctgcagtggtccagcaaggtcagtgtcactaagctaccaagaaacaatgagtatcaggatcattgactcgtggaatttcacctgtttccatttaatccctcttctgggtgggccaagggctacgtaccttgcaggaaaagggattattggcaagaaagctggcgagcagttggatggcgcttttacagaccagcaccgacttgtctgccagacgccccacagctaaggccaccactgcctggaaacgcgtcaggggcagagcctgtggggaggcaggaggagaggatcagatcccagcccacactggccataatgtcaagatgatggtgaagtgcactctacatgtgcgagccactcagctgaggaaacttttctacgggat

SEQ ID NO: 30210 - DNA, 1755 bp, Bovine  19866880831819
tactggagtggggtgccattgccttctctatgcatgtgtatatataggtgtgtatgtgtattgtgtgtgtatatgagtgcatgtgtgtatatgtgtgtataaataggcgtgtatatgtgtgcatacttgtgttcaaaacccaactgagatctactcatcgctgggactcagtgggtgggccccctctgcagagccaggtcaggtccctgataactaactcctccagggttcctggattacaaggatcccttcttgagatatactgaccttccctgaaccagactgtccgggcacagttcctctctctaagaatcacaactattctaccaaacaaacaaacataacaaaattcattccaatctccaagaaaagtctattctaggccatgaatgcaggaggccaggagaggcagcaaagatgccaggagtggacgtggccagtaagccctcagctctgccagggcactgagtccctcccggaccaggtcacctccctccaggcctgtgagcttcctcccagggcagctgtgggcagaaataagagaaagacctgggtacgcactttgcaaataaaaggcgtgggcaatatttcatgaggatgtgaagagtgaattgcatcgttcccaacagaacgggtattttgtgtgcctctttgtgccatgcaggaaacttttatggtcattcaaattaaacatgtgtgtttacaaatgttagctccagcgcagacaggtgacttcttaggggaagaggctttacaggtgaacggtgggctcttcagaggaggaggcaagggggagaagatgtgcagacacgaagagcaacagaacaaaagaaataaggattgtgttcactcacacacacacaaaatgctaaaatcggaaccagtggaaaacaggcaatctgggactgttaggtgactggtaggagcaccactgaacgtgaagtcctgagtaagatttggagaaagcagactgcagggatcttgcttccccagtattcagcgccactgagggggcttccctcgtggctcaagacagtaaagaatctgcctgcaatgcaggagacccaaatttgatccccgggtcaggaagatcccctggagaaaagaatgtcaacccattccggtattcttgcctggggaattccacggacagatgagtctggcaggctacagctcatggggtcacaaccagtcggacacgactaagcgactaacactccttaaatttcttaaaacagcactttcccagcaggtgatggtaaagtgtctcaagaaaagggtgtctttttctaattagaaagaacatcgcatagaccagctgcatcccctacccagcctcccggagccctgggcttcacactgcagacaggactccaggataaaaactaagatccctgtgtaaggttcaacccacgctgacatttcctaggctgtcagaatttttttttttttaagtgacctaaggatctttctaaaacgttcactgtgcagtggagttacctgcaaatgaataccaattatttgagtatctatagtttggcactttttattactaggtctgcaccctaagccccagacgccagcagccctgccctcggagaagctaaatagtactgcaaatctttgtgcaatcaaacaagccattatgcgtcccagtagagaggctccggttttgttggcataacaaggaaacattcattcccccgggtataagtaatatgacctggctctcaacgagctgactccttgctgcca

SEQ ID NO: 30211 - DNA, 773 bp, Bovine  19866880851182
atggactggttggatctccttgcagtccaaggggactcctatgtgtatgtatatatgtaatgtgtgtgtagacatgtgctatgtgtgtgtggtgcatatgttgtgtatgtgatgtgtgtgtgtaaggtcagggaggagtcagggcaccaggtgggtttggaagcatctttgggaagaagacagcctccaaccatccagccatcatctcagaaaggccaggaccagtgaccaggccccttacctgtaaagcaaccattctctgtccgggacccagcctggtggccctcgtgggggctgggacccgatctctcacaccttgcggggcaggaagcttcagctctctccttcctctaaacacagttgctcagctggctcaggtgggaggtgtttctccaacctaccctggagtctggccctggagatcggatccagaagttctgttgctctggcctgggttcctccccagcctgggccggcctgtctgggacagccagcctccctggtccaccggtttgtggggcgctgcctatggaaggatcagggcctatgcgggggccctggagggccaggaggctcattggggcagaggctaagaggcctcccaccaaactgttcaaagccttatcgcctcggaggtgtttctagtaccatttccgtccattgtttcctctgggtcattaggaggaggcctgtctcctgttgtggctgctcacagctactgtggtgggaaaagaggggggcaggcgggctgaccgcagacgtcacgatttggg

SEQ ID NO: 30212 - DNA, 779 bp, Bovine  19866880853687
attgaagataagctcatccagagagaggacttgcgttgctacagccggtgcttggtggcactgtcgacctggaaatattttaagttcttgctattttgtttttaggaccaataaggaattcagacagaaaaaccacagcattgattataaagtgtctgcatatatttataactgtgttttttgataattttatttatcatttatttttggctgtgctgggtctttgttgctgcacgggctttttctctagttgtgggaagtgggggctactctctagttgcggcgtgttggcttctcactgtggtggcttctcttgttgcagagcacgggctctagggtgcttgggctttagcagctgtggcacgtgggctccgtagttgcggttcccgggctctagagcacaggctcagtagttgtggcacacaagcgtagctgctccgtgtcatgtgggatcttcccagatgagggatggaacccatgtctcctgcattggaagatatattctttactggtgagccaccggggaagccgtgtctgcatatatttaaaagaaaaaagaatagttctctagtagctgcctaggtttcagatgagcagattttctatgtagtcccataggggcagttcagatattagcatattttaaattcactctcaggtgaggatatagtcctttggggttctgactttatggtagggccttccattagatctccaactctacggaggccctgggttctgtctcctctgccacagggcaccctatgaggccaccatgc

SEQ ID NO: 30213 - DNA, 4517 bp, Bovine  19866880892157
atttgtgggctaggctgtctgacacaggctgcagtgatgctctcaagggggcaggattggtgacaggccgtgttctgtcaggcaggccgtcatccttcactcaggaagccatgggccgcttccaggagtctgaacccttctgtcatgtggacccggaagagtcagaggagaccaggttcctcagtctcttaggaaccatcttcaaaggtaaattccttttccttcttcagtcagcaaacaagacacttcagctagtatttatggcccattgactttatgtcagacactgacctgactcacagcctggcactgaaagaggccagagcggggtctgcaatgtgtctgcttgggaacggaagcaacccacaggcctgagatccgtagtcacagggagtagaagggtatttcaagccatagatgactcaagaaatcttttctgagaaatgaaccaagatattttagactaaattctaaatttatactttcctattgggagttccctggaaatccagtggtcaggactccacattcccattgcagggggcatgggtttgatccctggttagggaactgagatcctgcaagccgcatagcatggcaaaacaaaacgttcctatggtagaaacacattctcatggatgtttagaactgttgggtttccccatatacccttgaacaaaaactatcctgtaattctctaactctaggcccagcagctcccacccaggaggagaatccccaggcggctgcagggaacttgggcccaggagagactggctgtaaggacaagcccagtgggtcagagcctgaggaatgcagtgatgagctggtgaagcaggagttgctggtgcaatacctgcaggatgcccacagcttctccctgcagatcaccaaggccattggcatcatcagcaagatgatgtacgaacacacgacgacaggtgtgccggcatccccaccacagaggccagggcttgtggttggaaggacccatcccgtccgtacttgattgatgtccgtctgctcctttgaagggcccagattctctacttccatgtggctgctgtagccctgtggagtgtgcatatagcatttgacagggcactggagagaggtggggtcctcaggaaaaatggggagggtgtcccctcacatgttgttacattaagagaggttctgtctttaagtgttggggcgtttcgctgcgctgataggtgacatttgtgtctgtcctctcagtggtgcaggaggtgattgaattctttgtgatggtgttccaatttggggtacctcaggccctgtttggggtgcgccgcatgctgcctctcatctggtcgaaggagcctggtgtccgggatgctgtgcttaatgcctaccgtcaactttatctcaaacccaagggggactccgccaggtacacgggctgcattgcctttgctaacttcctgaagtcagcctctcccaggaggtgtctagtctcctgaggggaggcgggggagtgggctcctcctaggggacttgtagacccagaggcagtaggtctgtgatggactgggggagggaactcccagtgaaacccaacctaagcagttatttggtttatttttgtttctttttattgaaatataatacaacattatgtaagttacaagtgtagattgtagtgattcataatccttaaaggttatattgtttttagttataaaatattccccatgttgcacagggcatccttgtagcttattttacacaggatagtttgtcctgttagtcccctgccccgtagattgccgccccccagccctctccccactggcaacgactagtttgttctctttgtgtatctgaaatagttgtgtattgtttgacactggcgggattgcctaataacctatttgccaggtttagcttctccgtcttttaatgacccctgatctctgctgttcccatagagccaaggcccagactttgattcacaatctctctctgctgctggtggacgcctcagttgggaccattcagtgtcttgaggaaatcgtaagtatgctcacttccacttactcactcagcaaatattagtaagattatggtgtgctcagcaacttacttagcccctcaaagaaatataagattatttgctttcaactctagttggcggccaaaaaacataaaacattttagagcaatgcagcagatagtttagtggtataggtaacagttattgtagcgacagtaatataacacattatgccaggcactaatttaatcactttgctcgtattaacatgtttcatcctcacaatggctctaggaggcagtattattatctacgttttccaataagaaacttgaggtagagagagcttaaagaacttggctaacttcagccagttagcgacaaagtttaagattcaatctcaggcttcagagttccagaaaccatactcctgcctggtacgttatgttgacgagtagagaagagagcagtgtcaggtcgaagagttgagggcagagcttccgagtcaagggcagagcttcctgaaggtggcaggacttgatttggatcttgatgcatcagatttagagaattcaagagaggaggggaaacatttcagacagacctgagcaagagcactgcctgtgttgtacaaggaagaccgttgcgttctggcccaagattgttacctggaaaagatagtgaagctggaaacgggttggagctgaactgggaagatctgtgggatctaggacttgaaccttagcggccaggggccccagcatttcagtgtgacagagctactttgaagggtttgggtggtagggctcaagggagagatggtgctgaccacgagcctccactgggaggagcagcaccaccagcctcattttctcctcactgcggaaaagaaaagcctgctagaggcgcctggcctgagatggcgcagggcagcaactggccaggagcccatacagcaggccacagagagctgtttccatcagtacttggtgagcaatgctgtggcctgatgaagcagacgtctgggaaagcacagcacacaggctggtgggagccaaagcagggaatgttcctggaggctgctgccggtgtgcagtgacagggatctggacttccggggtgggaggaacagctatagagtggcacttcatggaagacaaattttaaaagggagaaaaggtggaatgagcgaccgatgcattaaaaatcaggtgacagaggtttgaagcatatgagactattcgtggtgttgtcactggcaaaatgaaaaggcaaagatgatggtatccattggggacacattgagttgatgttagcagtgagaaaacctactagaaatctccacaaagtgttgtccagactatagatgtgcacactcggcaaggtcagtttcagcacgtcatctaaagaaacgtttgcaggcaggagattagaaagtagcagaggtggaggtatctcccagaccccagctttacatcttcagctgcctaaggagtttcctctccacttcgggttctcagtgttctcttcagaggaggcagaccaggtgtcagggaatttgttactctggggcctgagccctttttcttttctctccagatctgtgagtttgtacagaaggatgaattgagcccagcagtgacccaggtgctgtggggagcgggcaaccgagaaggtgccctgctcccctctggagcgctgctcctccgtcatgctgcttgggatgatggcacggtgaggctcagatcagacaggccaaggggtgagcgagaagagaaaggttccctgaggaccgttactactgctccagtgagagcactcgggccggctgcgctctgcgtgtgcgtcgccgcctaaatggaggcagttccaacccgcccagcagagtggtcagtggcgcgcaagggatgctgagggccggccccacacgtagtgccccagggctcacgaagccctgggttgggacctggctcctacgctccttggtggtgttccccacacagaggtgtctgagtggctttaactctacggcttcttctcctagaggaaagccagagattgtgggaagcaacttggacaccctggtgaatatagggctggacgagaagctcccaccggactacaggttggcccagcaggtgtgccacgccatcgccaacatcttggacaggaggaaggcacgtggggtgggtgacgtccaacctagggagagtgggtgccccttgtccaccctcgacactcacccgcgttgtcttccctgcccttaacagccttctatgggcgaacgtcaccctcccttccggctgccccaggagcaccgcctgtttgagcggctgcgtgagatggtcacgaaaggtgagctgccgcgcagagcctggggcagaagggctcctctgtctatggtggcagcttccccctcttcctgtgcaggcagcgtccacccagacccgctctgggtcccgttcaaggaggcgggctgtggccctcatctaccagctgg

SEQ ID NO: 30214 - DNA, 2280 bp, Bovine  19866880944038
aaatcaaaggggtgagtggctgatgagggtaaatatgccaggagtatcattttttggttgctttcttgtctgtaattttgaaggtttgaaggcacaatatggtgatgactcctgccatttcatcctttatgtctcccttattactacacagtcatatgaatgcagagaatgaggaggcatcttttaaaagccttaggatactctatatgatgacctcaatattcactttcagccatactaggaaaacttacttttcatggagcaccacctaacagtgaatgtattagagcataaagtgtttggtatgtatgcacctatgtgtgtacacacataaacacacacacacacacacacacacacacacacagcatgaacatctcacacattattcacagtggaaaccactctaatcaatcaacctgattctatggcagttttaactcttaaaatcaatatctcctacataagtaggcacaaacataattcaaatatttaaatatttaagaggagaaaaatcactagaaaaccacgtgaaaaataagaccatcataaataagaaatgcctagcagtgatagtcttaactatgttgtcagtaacacttcaagctggagaatcaaagatgaacttaaaaataaatcataaacaagcaaacacacatcttctcttaatgttgttttaagttctttgaggctctaagatgttttagccaatgttacccattcaggatctccccttttaggactccagaccgaaaaagttggaagtctcaggaaatgtatgttttcgtgagtttttcagttctgcaattttaatgatccagcgacacaaacttctgacctttggttgctctctagatcagagcttcacaggtggagtgctgctttctgaatcgctaatagaaaataatgcatagtgtccctcaagatatgctaaacaaggtttttaaaagtattttatgttatagcactttagtcttttcaactagatttcagtgacacaatggtgtaaatgctgtatttgccataacttactggtggctcctgtgttacatacggttttaaataatgctctaaattgtttgttttcccaatgacaatgataaaatgttctgtggaatttgtaaaacgtgttgattaagtctattgaaaattgtgcactttttatttcatttgtgatactcttttatagttattagttctaaatgtgtatttgtatgagtcagaagtatgtgcttgtatgtggtgtgtgtgtaagtgtactatatcttgtacaaaatcaaacttatcctaaagaaaaagggcacattatgaccagccttaattcattgacatttttgttactgttgcaatttgggattaaaatttaaaaggagattatgtttttgttaaaaatagccttttttttaaccacatgaggaatgtgcattagtacttatttgagttcccacaagcaaatgatgcagcctgtgggatacccaatgctctttaagtttcaaacatcaattaatttattaacttcattactgtgcaaagaaactaaattcagactcacttccatccacaagacagccagtgcacttctaaagttgttcttccaaacatggaacccatttttcatggaacccatttttagggaacccaagttttctttaaaaaaatgtttctccaaaacattacttaaaaaaaaaaaatgagtcttctcaaatataatgaactgccttggctctgtgagagtcacgaaagacccatcaacattaggtggtaccaatgtgattccctttgcaaaaaagcaggaagcaacactcctgaatttttgctatctgcctaagtgcattcaaatactaatttaaggatctgcactggtggtcatgttcaaagcaaaactctgtaatctttaggtctgggatcttggtacaggatattaatctaccttcttttcttttactccatcttcagttgtgtttgtcccatatttaaggttgctagatagaatactggacacccagtgaaactcaaatttcagatacacatgaatatttttagaataatatttcccaatatttcatgagatgtacttatactaaaaattattcattgtttatctgaaattcacatttaattgggcatttctgcattttttttctaatcttaaatccctatgcatcctgtcttttacagtagggctacctataggggataatatcctacctctttccacactcctgtgttaagacagttcatgaaaatcagtagtcttaaatacccctcatgaaggaaaat

SEQ ID NO: 30215 - DNA, 2049 bp, Bovine  19866880949591
tgcttaataatgtaagtctcctagacagaaaattcaatccaaagcacaacaggcaaatcaggtcttcattccaaggaaagcattacaaaggccacaggatggcaagccaggaagaaatgccttgccttctatctctaacgtctgtctttatctctaagccagcttccagatgggcgcccactcccagcagctgggagctgggatcccagaactcttcctaagtccttgagcaagaaaatccccaccagaaggaaaaaaacagcatgccagacgccagagcagagccaaaggcttcctgcacgtggcccgacggccaggaacccagcccagcacagccatcgcaccccagaccctcggccacctgcccaacctcacctccaagtccttctccagctccagcccagcctccatcaggttgtgctcaaactcctctcgctgctccttcctctcctcctccagggcatcgagcggccccagctcgatgtcaccgggagcccccgcctgggggtccttgcccgtctcgccattggagacgatagccagattgtggcccggggagctgtggccggggtgtgccccgcgtttccggtagtggtaggcgagcacgtagtccaccttcctctggctgtcatagaagtgcatgcggctcacgcgggcctccgaggacaccggctcgctggcctccaagtaattgttgatgacctggccgaagaagaggggacacggagcggtgacatccagtgagggaggggcgagaggcgcgggaggctgacctggcgctctgggacctgggacggggacgaggaggccaggccctcacagcgaaaggacagagaggcccgagttcatcggccaggccgccactcctccgccccagccccgggtctagccccggcccacagacgcagcacacatgcacgctcacgcacacagatgcacatgcagcgtcaaccctgcgcatcccaccaccggcctccctccgcgcaccaagccccattccagcacacgcgcacaagtcgagcactcagcctcacaccggcgcacactgtgcctacctgcatcacccacgcgctctgacacgaagggccccccacatgcaccacgacaccccttcctctttgcagaggtgcaggcctgcctgcaaacacgccgtactcaccggcaggttctctggatccattggaacaaaggccgatttctagccgcctggcccacccgactcctaccccacgagggattcactgtccactctgcgcctcacagcgccatatcctcctctacccgctctccgtcctccccagccactggcgaggaccctgccagagaggctgcggtccactcccgtctgctcctggaggcgatgggaggttgagaagaggaggagaaagaactaggtggagccgggggagggacctgcctcccgctttgggtgtttccctgtttattaccagtttgatacccagctgcctccgcagccacctgagaggtcacctgggcaaccagatgaagcgccaggcacaggggagagcctcagaggcgccccagctgaggtccggggagggccggggagcttgcaggccaggggtggggccacccggcctcttacacctgtcttccccatcctcctctgaccaggggacccagtgctgctgggacagtgtgccatcccgtcttggagagacaggagataaagagagcctaacagaaaccccgcccccacacacaaacccacaatacacaccccgtgcccccaagtggaaggcatcccacaggcctgcccatccacacgccccagtactcacagagctgttgggggcgctccctccgccggacgcctggccggaaccttgggggacactgccctgcagaccctgggctgggggacccggcgcctggaggcactgctgtccgtgtttggggccctgaccccctctgaccactgcccgcgggctcagccggcgtggggagccagggagcaaggggatgtctgtgaaagacaaggacacagagggacagcagcttaggggatgggaaagcatggacacagga

SEQ ID NO: 30216 - DNA, 1693 bp, Bovine  19866880976388
ataaacatacaggaagtgaaaaatctataaatttgtttgggaataagctccaatactttggccacttgatgtgaagagccattggaaaagaccctgatactgggaaagattgaaggtaggaggagagggggacaacagaggatgagatggtttgataggatcaccaactcaacggacatgaatttgagcaaactctgggagtcagagaaggacagaggagcctggcatgctgcagtccacggagtcacaaagagccaggcatgacagcgactgaacaacaaagacccagtgatgaggacaagccaagggtatgttccttcccctccatggtctatgggaggatgcgagtaaataaaaatgagatacagaggcttctttacctcaggtccaactgcctcctaataaacccaagagggggatgcctgcagctgtgcccacgcctgctcccccgtcacagcctgtgactgggaggagtcttagaggattcagtccaggtgtgaccttgacccttctgttccagacacaccccaagcccagactcagctcactagaatacaggacaccgtcccaggccaggggagagtgactgcacggccccctcctcaccctcagagggaggactcaccacaggtgaagctgggtctgcactcgccaggattggccagcaccggctggaggccgtcttcgcagttaggcaccgggggcacgtcacagctcaccaagtcacacactgagggccagaggagggatgggccctcagagtccagcaaggccactcctgtgctactgagtggttccctacatttctacccatgagacctccactgtttacacacatgatggcaatgagataaaggtagagctagagatggagacagagggggagctggagatgaagagagagatgaagatgcaggtggagatggagatgcaggttcagatggagatacaggtagagatggagatgcaggcagagatggagatgcaggtagagttggagatgcaggtagagatggagattcaggcagagatggagatgcaggtagagatggagatgcaggtggagatggagatgcaggtagagatggagatacaggtagagatggagattcaggcagagatggagatacaggtagagatggaggtgcaggtagagatggagaagcaggtggagaaggagatgcaggttcagatggagatacaggtagagatggagattcaggcagagatggagatgcaggtagagatggaggtgtaggtagagatggagattcaggcagagatggagatgcaggtggagatggagatgaagttaaagacggagatacagagacaaggagtgggtagggggaggtgatgataaataaatatatacataatagacagatgatcaatagacagataacagatagatccaagatataggacaaactcatgttaattattcccatcatctgcagggactccagatctaggccaagtatcttgaaccctctagacctcaggatcaccttctgtaaggtgggaagtccaccacaccaggccagtctaaggctgtcctgaaataatggcagcaaagtgtccagcacattgaagaagctttgtactgtccataaatgaaagccttgaactaaatgaccacctgttccctctactgctaacaacccaagacgacggcatagggtcccaacag

SEQ ID NO: 30217 - DNA, 1609 bp, Bovine  19866881053719
ttaaagagttgagagaaaaggaaaaccaactcacaatactatgtgaaattatgcttcaaaattgcaggacagggactttcctggtggtctagtggttaggaatacaccttacaatgcagggaacacagatttgatcactggcggctcatacagtaaagaatctgcctgcaatgcaggagacctaggattgatccttggattgggaagatcccctggagaaggaaatggcaatccagtccagtattcttgcctggaaatattcatggacagaggagcctggtgggctcacaaagagttagacacaattgaggaactaacactttcactgtcagggagttaacatcccaaaggcctccaaacaactaggcttgcgcactacaactactgagcccacatcccacgctacaactaagacctgacgcagccaaaaaagtgcaggtcaaacagaaactgagggatctgctgccagtagatttgcaagaatgacaagacttgttaaaacaagttctttagaaacgtccatgtctgtataactgagtcaatctgccatacagcagagactggcagaactttgtaaatcaactatctttcaattaaaaaaaaaaaacagttctttagcgaggagggaatcaggaactctacataaaggaaggaagaacataaaagaaggaataaattaagggaaataaaaactttatatgtgaagtagtatgatgttacttgaaagtagacttggattagctgtaaatgtatattgcaaactctaaggcaatcactaaaaaaaaagtaaaaaggaagaagtttaatccacatactaagaaaggaggaaaaaacgaatcacattaaaatctcagttacaatcacaagtggcagagaagaaaaagactggaacataaaaacagggaaaaaaaggacaaaagatagaaaactgtaacatattgtagacatcactccaattatactcagaatcactttgagtatcaatggcctaaatgcatcaattaaaagacagaaattgtcagagtggattaaaaatatgacccaagtatatgttgtgtacaagaaatccattttaaatataaagacacatagattaaaagtaaatggatacagaaaaatatactatgctaaatataaaaaaaagcaggagtagctatattaatttcagatagagcatacttcaaagccaggaatgttatcagggataaaggacattatataataaaaaggggatcagttctgcaggaagatacagtgatctttaacgtgtgtgcacccaacaatagtgtcaaactatgtaaggccaaactgcaaaattgcaaagagaaatatatgagtccactattttacttagacacctcaagctctgtcagaaatggacagatacaactcagaaaaaatcagtaaggacacagttcaactcaacactatcatctatcagctgggtataaatgacacctaaacaaacttcatccaacaacagcagaaaacacattcctctcaaactcacatggagcattcaccatgatagaccacaatctgggccataaaatacgtcttaatagatttaaaagaatagaaattatacaatgtctactttcagacaaca

SEQ ID NO: 30218 - DNA, 1225 bp, Bovine  19866881068047
caggcaaagacatgggggaggatttggccttgatgaaatgacactgtggatttgctgtcatttttcattcatcattgttgaaggacctaaaactgtagggtatttattattccaggtactgagatgggaataagatctcataagctaccagcctgtaaaaatgctaaccagcgcctgtgtgcctggggtacctgggtcttagagattctgcatctgtcctctctgagtatctgcaggtgaaaaaaccccaccccttccagaggtgcctgggaggatgatggactggacacccagcagccttctcttcctctctgttaaaataacatcacatttcccctttggattagtgtctttactgtcctacagactaactaactgctttacggtgtgattgactgtcccagggctcctgagtggggctcacgtgtgtttctgacttcagaggggctagagttcccagggaccttgcatcctagctgaatgctgagtgcagggctcagcgtggcaggaccagggcaccactttgtgctgcccctcagtctgcaggaaggaggaatgcccgaaggggtccccaccctcctgccccccgcaccggatgcccgcccttcggaagacccggtgctgtgacgagtacgagtgtgcttgcaactgcaccaactccacggtgagctgcccgctggggtacctggcctccaccatcaccaacgactgcggctgcacgaccaccacctgcctccccgacaaggtaaggctgcccggctctggctgggatgatggccagacacgtgcttctcgtggaagacgtgccttcctgcccggatgagtgctgtgtggcctggtgggggggcatcagcattctctcttagcctgattcttgttagctcagggggtactcggagactaccgtgtctcagcatggctgcgtgctgaggttacagacgtggtgtaagatacagtcctgcctttaaagagctcctgtacagaagctggaagactgagtgggtgtagtgaaagtgttagttgctcagtcacgtctgactctttgtgaccccatgaactactgtagcctgccagcctcctcggtccatgggattctccaggcacggatactggagtgggtagccattcccttctccaggggatctttcccgacccagggatcaaacccaggtctcctgcattgtaggcagattctttagagcaagtttaggaaaatggttttaac

SEQ ID NO: 30219 - DNA, 1729 bp, Bovine  19866881098511
ccaggcctcctggggcctaaggactggtcatgttcacccttatgacaccacctgctccttcactcagcccattggagaactgtgcaagctgatcacatcccttgtgaccccctccctcacctggcttttagaaatacttggccgaaacccttaggagatcttggggatttttagggcaagagcggcctatctccttacacagccctgcaataaacctttctcttcctcaaactccaatgtttcggtttgtttggcctccctgtgcattgggcacgtgaacttgtgctaacaataaaagctttaaaccagcaagaattcaacccacaattcccccggcagactgtggttcccctttctctagagtctgatcagtcttcactggcaagaatagagcatccccaagtagttagtgggcaggccaccacaaaaagaattaaaaactgaattggggggagggttccaactcccagttatacctcaaattataaacacagctcgacttctgtacttcaaattataaacctggtctgaaaaatcaccaaactacgtagaaacatgatgttacactgacagggaaaaaaaaccaagccctgttttctaggctattaattcacctctctgcttaaaccgactccccagccctctggcctcaagaccacatggctgagatgaccgtcagctgagaagtgttcacggaaggatgacagagccatgctcgcctcatgcctctttccgttacccggccccactcccctcctggcccctcccctctggccttgaaccagagggtcctaaagggacttccttgcccgttcctgggatccccgtcccaaccgcccccacactgctcccccttaccggccggcagatgtccgcgcagggtttctgggagcactgggccacgcgcaggcccatcacagcatcctccagatccgtgcaggtgcaggtatcacagccctcctcccagaactggcccacggggtagatggtgcctcggtggacgcacacctgtagacgcaaggtttcctgagtgaattcactcggttcatctaaatgagaggtgagtgggcatctgctgggatcttccctggtggctcagacggtaaagcgtctgcctataatgccggtagactcgggttcaatccctgggtcgggaagatcccctggagaaggaaatggcaacccactccagtactcttgcctggaaaatcccatggacggaggatctacgtgttggaagctaccctaggtgctaagactacagcagtaagtgaaacagcatggtctctgcccacactagagtctggcctcttcccacccctgcccatctaacttaggaaagcccacccgtggactggccccctgtgagtctttcatggtccttgggtggggatataatacactggctgacctgactcactatcaccgctcccttcgctgcattaaactccttcctgtgtccctcggaaagctgtaccctagttctcagacttagtgatgtccttgcactcggaacccacccatgaatagccctctgtcccgtgaggagtggctgaaagtgaggggcggctgggcaggggctatgaacgagtgctcccttgaggcccacaaaggacgagggatggatcaaacaaaggctcgggcacggactgcgagctgtgtttgcggcacaggatccgtttggaagaactgtagactaggaaggagcctgggacatgcgatcccagcg

SEQ ID NO: 30220 - DNA, 1170 bp, Bovine  19866881216672
ctcatctgtccataggatttccctgtcaagaatactggagtgggttgctatttcctcctccaggggttcttcccagcccaggaattgaactcctgcattggcaggcagattctgaaagcttgctgctgcaagctatgtgttacaccagaattcgtgacctctggaggagaggatttctatccgggctcagagatgaggcttgactacttagagctttttgtgtagcgaagttctattaaagtataatagagagagagaaagcttctgacacagacatcagaagaggacagaaagagtgccctgttgctggtttttagcaaggcattttgtgtctgttagcaagctgctaatcagataagagagattcctcaaggctgagggagtttcactaggcccctctcccacaatatgcatttttgagatagggcggcacaaagtgtgtcatccctggccgtaaaacaattaacatgaatactggtttgttgagccattatcaccccaaggtttgagaagagaaaaaaaaggttagtcttaggtgaaactattttgaagaaaggcagattccaaagcaaatacatcatttcactaacatagcttaaaaaaatatttccataagaaaaattggttagctcaaggcagaaccaggtgctattagaagcccctttaattttgttgtagagaagggcaaaaaggctgccacttgcagcttatttcctcctgccacttgggcacctctggccttcctctgttaccctttcaattctttaccatctgacccaccagggaagccccctgcagatgttagatgtcaacttaattcttgccgggacctaagtgattaggttacgctgctctggctgtgtttattcccctgtgtagagagattggacagaagtgtccccaggagctgagtcgggaccctacgggggcaaagggttttgcagccttcctgacggaactagcagagcgcatcccagccatcctgatgtccagcatgtgcattctgctagaccatctggatggagaggtaggtggtcgcttggtcagtgggttgtgagtccatttttgaaaggctgtttcttaacatgaaggtagtaactttcacatgaagtcaaattgtctcggcttatcactgtggcaattccttcctgtagagaagcagataagttt

SEQ ID NO: 30221 - DNA, 1920 bp, Bovine  19866881246719
cccctgccctggctctgcctgcccagtgaagctgcccaggtgggcagtcgtgcccccacagagtctgtgccccttggggggctactattcctgccccacagccagtgctgatgtcccttcaaggatgctcttcctgggtcccctccctgactccccttcctcctttgggaggtgttctcaggactaaaccctccccttcagaaaaatctcagctggtgacacagcgcttctacctttgttccctcttacaactttcacaatcccattaacccaaccctaacccgtttaacccggcaatcccactaacccaacccaaacgcattaacctgacgaccccattagcctgagacaaacccgtttaacctaagagtcccgttaggttggctaattccatcttacagaggggcacgtcctacgtgtggtatgtatgtatgtgtgtatgtgtgtctatgtatgtgcagagtgtgtattgcatgtgttatctatgtatgtacacgtgggtgtatgtgtgtatatgaatgtgtctgtatatgtgtgtttgtgtgtgtatgtgtgcacttatgtgtatatgcatgtgtgtgactgtgtgtgactgtgtgtgactgtgtatgactgtgtatgaatgtgtacacacatgaatgcatgtgtgtatatgtgtctttgtgtgtatatgaatgcatgcctatatgtgtgtacatgtgtgcatgtgtgcatgtatgtatgtgcaaaagtgtgtattgtatatatgttatgtgtgtgtctttgtgtgtatatgaatgtgtgtctgtttatgtatatgtgtatgtgtgtgtatgtgtgcaagtgtgtattgtatgtgtgtgctgtgtgtgtgtgtgtctgtatgagtgtgtgagtcagagaggtaagtgacctactcaacatcatcccagatgtggcagaaacaagcccgcacctagcttttctaagttgagtggttttccccatcacaccacagtgacagccacgatgggaggtgtttgccagaagcgtgtccctttctgctgcttttctgtgtagaccccagcgaggaccagtgccttctagaggtggcagctcagctggtgttgctgggtctggcggtctttggttacagtcctggccagccgcccaggggactccactggagcttggatctaccaagtgtcgcatgcctgatggtgtgggtccctgctgaggctggcccaacaggctccggggcggggtgggggatcagcaggctgatgtgtccaccttccgctgtctcccttcttcctccctcctgcccctcagcccttctccctgcctgactgtaggcgcttgctcatggctggtggctgaggatggcagtcttgtgagtgtcgtctggctcatgaacacacaagcgcacacacacgtgcatgtggtcatggcagcctcctgtaacactcccttcaaaggcctgggagcaccgaccacgggtctgctggtctgggcaggggtggaaggatcgtgtttctctcctgacatccacccctttccccaggaccactgtggtagtaaccccggcaccttccgggtcctggtggggaatgaggggtgcagcgtcccctccctgaagtgcaggaagcgcatcaccatcctggtggaaggaggagaaatagagctgtttgacggggaggtgagtatgggctggtgccccaccctcagtgcccccgttagctgatggggagcagtgcccagcattagttcaggacacgtgcgggtggagcacgatgctgctggtggagagacctcaccacgtcccgcgaggggggcgggtgcagatggtgatggatttagtaaaaggaagtgcagacatgtgtggaggagggtgtgtaactgtatttgcaccagtgtaggaagagccagggcggacttggggggtagtggagggtgggagga

SEQ ID NO: 30222 - DNA, 1442 bp, Bovine  19866881247707
tcatctctggattcaagctggagtgcaggaagaccacctgccaggcctgccctgcggtaagagaggctgtggctggggggaccgggggggggagctgggcacttttaggacccaagcaatgggacctcactaggatctttaaataaaaactttgatgattttctgattctgtccagtatctgacaactgtcaggaagggactaaaagtcacctacccagattgcatttctcagaaattattataatttagttttgtacattttaaacattcttttagtgtatttgcaaggctgagaccatattcacaattctgtattctttttttaggcaacattttaagtaacatcattactgatctttgaaagcattaaaaatcagtcaaatatttatccgacagttaccagttagcccacaattatttatcagacacttgctatgtgcagatttctacacaacgttctctggagcggacctgcctcaaagtgtacttttattattgcacattgttgtccgactctttgtgaccccatggactgcaccctgccaggctcctctgtctatgggattctccaggcaagaatactggagtgggctgccatttccttctccaggggatcttcctgacccagggatcgaacccaggtctctagcatttcaggcagagtgtgtaccacagagccgccagggaagctctgttggacactggggtggtctaaaatagttcaccccgtttctgccaggtcacgatgatggtatttgctttgaatacctctgcaggtgggatcagggatgtggaatactcatttctagtggagtagaggagagcatgcacttcactggtctaatcacgactcttagcaaacccttcctcccccgcacagagctgcaccagtgctgaggaggataccctggcttcttctgcaggctgccccctgcatctggggctcctgctgtcctagaaaatacagttggtcagatgagtttgttgtgagctggatgcacagaatacataatgtaaccactcttttaggtggtggagcagtgggtaggggctggacggttcctggagaggagtctctcatcagaggagcaatgcactggccagaggggaggtgcgatggggcgagggatgaggaacgctggagcccgtgtggtcagcactcttgaggacaggctgtgttctgcacctgggcactgtgtgaggctccaagggagtgaagggaataggatacacattgtttctgatagaacggctcaaatagaacatccttgcctcagttaggaagaagggaccgaaatacgtgtttttacttttttaaaatttaaaatcccagttgttttagggtttccagtgcaagtgtgtgtgtgtgtgtgagtgtgtgtgtgtgtgagacaactcccctgatacatttgggcttgaatataggaaggaatgatgctgt

SEQ ID NO: 30223 - DNA, 923 bp, Bovine  19866881265424
ctccactcagtagaggccaatccgccaatctctcaagtctttaggctgcattcagctccctgagttgtgttcccctctcaacctatcacaggcaggggtcttttctccacagcaccgaaggacaagggagactgtgagaggaaccatctaaggaggccagagtagaacaaatagaacataggagtccgacctcccagcccacacactcctgccggccactcccccagcttctagactccagctttccctgggaaccttgcctcccagaggggctgaagtcaggccctggggcagtggctggtggagattggatctcagcctagagggaagtgaaagggttaacgccctcatgtccactgggccagtccagccagctctccccagagcctgtaagtccgggcttgcctctggtctctcaatttcaattccattcttactccctccacttccttcctggagaactgggagggcatccttgccaccagcagtgtctggggtgtcatttaatactgccagtaatcaccacctcctgtttactggctgtctttccctcatggctagtcttgttatctctgggtctctctctccatctttcacacgcacacacacatgaatgggaaaaaggcttctctccatcccagttcctgccccatcctactgctctccctaaaactgatccgaatcaactggaaagcaggaaacaagaagtaaggatgtatagagctggagataccaacatctcttctgaactacaagagcggggggggacagcaagctcagaacaagagaatacttggagggcaataggagggaggtggactaaattagaaagtatcaaaggataaagatccctcttccacatcaaaaagagccgtcacagtcagcgaggactggaacacctgaaattactggtgggttcaata

SEQ ID NO: 30224 - DNA, 805 bp, Bovine  19866881311549
accacatttgagccctgggatgaaaaataagagcaacatactttaaaaattatttatgattttaagcacatgaaaggcgtatcatgtacccggggagggcataatggggaccagctggtgaacatgtgtcctgccatttctgaagatgttcttcattctcctatgtccaagaataacagtaataatgatgcggccgctgatcatattaataatactaaagtggatcagggcgcctttcctggaccctgtggaacactggggaagagctgggctgctgggcttggtggggggctgagagggagctctggctcgcttccttcttggggaccacggagcctttccaaggatcagaggtttgagaagagagcctggatgcggaagtcaggaagcctgggtcctgagggctgggttcaccccccatgctggcagttccccacttctctgaggctcagtttcctcatctgcgactcagtgtgcaaatgcagctggtgggactggcttgcagagtctttgtggatcctgctgacatggagcctgtgggattccagtgctggttgcatggctgagcattgtgtgtatgaagtgaggaggggtcctcctcactgctgggcttcttcagcccttggagcaatcaacctctaaactcagcactggtacccaggagatgcccagatgtgtgtatgctatgaacaaatgtttccttttcatgaactgtctagagccatagaaggttagacttggacagtactttaaaagccatttagtcaagttctgtcttttataatccgtaagggattcggagagg

SEQ ID NO: 30225 - DNA, 1641 bp, Bovine  19866881311571
atcgtcagggaaaccgcacaagcccccacccccctcgggaaggcagtgtccaccctggggcccacctgatcatgcagaacttgcccagcgcgagtgaagccgctgtggagagctctgggttgctatagagaccagggttgttgcagactttaagcagaagtggaacaaaggcagccagtgtctgtttgcctggttaaagaacaagtcaaggtgtgggacgggctacctggctggggaaggctcacccagcagcccttctcaccttccagcagctccagctcacagatgccgcggatgagttctgcctcagtatcgtcagctgtggccccacccagccccatctcctcctccaaggtggactcagactttgaattctgatgggaaagcagccagggatcatgggtgagcagacagttttgattccagcctacccttcatttcacatgaatggatctggggaagggcaaattctgcaaagctcttcacaggcttgtcacgtgtatctgaagagcaaagcctcatgaattaaataggaaaagtactaaatcccctccatttgtgtctaaagtggccaaagcatcccacatctcttccgattcatcctcatagcagcatataacttcctgaacaaaataaatcgatggaacctgccagacaacggctcaaggtcacagagaaggtcagactttaccccactgctgcagggctgtatctcatttgtctgccagacatcactgcctctagtggagagaacacaaggtcccatcaggggccaggcccagtctccaaggctgccagcaaggcggtgggagtgtgcagggtctagcaaacactgcctcgggcacagcctggattttatgctgaggcccctacctcgatgttctggatttacctaaaacacctcgtgggtgatccatttatgttctcactaatcgtttccaggttatcaggagcaaggaggcagagcccccatgagctcaatgaataggagagaagcagagctccccagaaggaacgtaaaggacctgagggccagaagcgagtctgggcaagacttggggcaggaactccaaagtgcaggcgcgccgctcaccttctccttgggctccttcctcttgtgttcctgttcctcccgcaggactcggcgccgacagagctctccgctcacagcctgctccaggtgcaccagctgctgcagagccacgtccccggccagggacagcaggttcatcaacaggaaggtggggagcacgggcgtctcctctgcaggacgggggcaggaaagcagggagagaaaggccatcaagtctcacaggcccccgcactgttttctctgatggtccctggctcacgtgctctatacccaagcaaggagcaggagggcttccctggtagagaatggtaaacaatccacctgccaatgcagcagacgcgggtttccatccctggcccggggaagatcccacatgccttggagcaactgggcccaggtacccgcagttactgagcctgtgctctagagcctggcagccacagccacggaagcccttgtgccctagagcccacgctccacactaagagacgccactaccaggagaagcccatgcaccacaactacagcgtcatccccactcactgcaa

SEQ ID NO: 30226 - DNA, 1524 bp, Bovine  19866881349369
gggtggcagtgactgcctgagcgaaaaacagttacgagagagcttcgactgcatcaaaggtcagcctgccaccaactcgggacgactctgagaagacctgccctggaggtgctaagaagagacaccaagcacccagctgggaaggtgccagctgcccccaaccctgccgccccaccccgaggctcgcagtcagcagctggggtgcaggaagagctacacccagggcaggagtcatggcccggctacctccctgctggctgtgggttctggggaccctggcggggctctcggcaaccccaggccccaagagttgtccggagaagcactactgggctcagggaggatggtgttgtcagatgtgtgaaccaggtaagagggggccttgccaggggccagctgcttggggagagacaagaccaggcctgggactggagggaagcggggaggaatgctgcagaggccaagaggcagcccttggagagggcgggggagtggttttcctggggccttgaccctggcactctgctcacaggaacgttcttggtgaaggactgcgagcagcacagagaggcagctcaatgcaatccgtgtacaccgggggtctccttcatgccggaccaccacagccggccccactgtgagagctgccggcactgtaactctggtgaggtgggccagcgtttgggggagcagggcagagagctggtgtggagaagcaagaaggttggggcggggggagtctgagcttctgtggcttcagtggagcccatggtgggaactggggtgccctgggcaaggcatgttgatgtacagggagcgctgagaagaagtggttcagggcaggagtgagcaaagtttgacggactgatgaggaggggtctgtgactacaatcaatgcaaaacaggaagcggctctgggaccctagatttcagatgagcaactcaccccccgttcctaccccctccccaactgatgaattggtggtgttctcagagggcacatttgttctggaacttggaatacatcttcctaaggacgtgacaatacaagctagtgaaccacaacctttttttttttcccctccaaaagccaatgtaggaaagagaatgtgtatgtggcttgacttttattttgtaatttcatcatttttacaattaagaaatgaaatagcagctgcgttgtgaacactgtcatgctttccattttagctagaatttttgaaatgacgtatgtgccagtgtacatagatcgggagcttgaaagtggttcctttgaacagacattctccagcaagatacgattgcgggctatttaactcaagtatgatattacttacctgtaaatgcattgagtccagttagctttttcaatactgtattctttaaaataaatacaaggttttgccactgcaaaacagtcaaatggcaacatctgtaacacacaagaggtattcctcagtctacttacacataggactgtcatggggtgtgtctctcttctgggccaaaacccccagcaatatt

SEQ ID NO: 30227 - DNA, 1331 bp, Bovine  19866881370564
atgctactgcttcatgagaagctttatttttatttttaatttttttctggactaggtctgtatcagcctgaaacaagcagaataaacagctcttaagcaaatgaatacagtaatcctagagaaggctccgtgacgaataactttttccatgagtcagaccgaaggctaacatccacttgctttataaaggggaatgctttgtcatttatcaccggcagcctctgctaacaagctccggatgcagactagaaggagcctgtccaaaggggaagccccagatggccttttggagcagcagcctcgccctgcagtggatcaagggcttgctgctcacagctgagccgccctgtggcttgatgtatgtgctcggttgcgtcctttgcaaccccatggactgtagcctgccaggctcctctcttcatgggattttccacgtcctccgtgggttgccacgtcctcctccaggggatcttcctgacccagggatcaaacctgtgtcctgcattggcaggtgggttttttaaccactgagcctctgtggcctgatggccgttgccaaaactcccatagatagctaccagggaattgctcctcttcatccccacccagagagggtgaagccgagacacctgagatctgcaaactgtctgagcgagattgaaaaccgagacccttggtactaaaatctttgctgagcccaggaatgaatatttaatattaactgtcaggcccgttagggaaatgctctctctgcatgggaaatgattttgcctttagtggctctctgaggctaccggtccagcgccccatcttctgccagggtcacccgggcttgtggactgggagctggacagaaagaaaattgtctgatcatccccactcgactctattttatgggcctgtaaatccttttgatctcttaatttttgttattcagtcgctaagtcactttttgcaactcaatgaactacagcatgccaggctcctctgtttactgtctccaagagtttgctcaaattcatgtccagtgagtccatgatgccatccaaccatctcatccttctcctcctgccttcaatctttcccaggatcagaatcttttccatcgaatcggctcttttcatcaggtggccaaagtactggagcttcaacttcagcatcagtccttccaatgaatattcagggtttgatttcctttaggattgactagtttgaactcttaatatgccctatttattcagaccctgcagtgggactcaaaggggtgacctcatcctttcgttgtcacgccctgatggggagagaggaggcgatagggagagacgggccag

SEQ ID NO: 30228 - DNA, 2375 bp, Bovine  19866880388488
cctaaaagagagagattctgtcatcaagagtagaagtctagggggactgtaagcaaccttgtggaaggagcagagcccagcttaaagcagtgtgtggcatgacctttattcaccagtagattcccgtttctattgaaataaatttttcaaaagtttttttaaaagagtgttcttacatatagtaataaaaaatacacttactatgtatttgaaagaataaaagcattcagttccttggcccttgaatttaaactattttggtgcattgaaatctaacttctgatcctaggtttgaggctgacaagctgtatgacatatgctaagtcttttaacctttctcagtctcagtttccaactctgtaaaatggaaagcataatgtctgccctaaggcctatctctttaagactcaaaaccaaggggaaaaaagaaaatttcactttattttaaaaaacccagcatccttcttcatggtaaaataaataaaatgtatacctagaatcaacagatttatgactgagcagcttacttcatgatttggttctagaaatcaagatcaatccatttggggaaaaagacaaaaaatagacataggaaaatgaacagtttacaaacaatgaagtgcagatatctcctaactatatgaaatgatactcagtcttgctcagagaaatgtaaaaatgtaaaaaccatgctgttataccatttctttacccatcagatggcaaagacttgaaggtttgatgtactctgagggtacagggaagaggcattccagtaccactgctggtgggaatgtaaattgctagaatccctgtaaagggcagttagtaatagacatattgcaaactcacctttttacccagcagttccaattctagaatcatctccttatacataaactaacacatgtgaaaaatggcaattgtacacagtccttcactgcagcattaattataacgtaaaaaagattgagaccatctcaaatatctatcagtggagaattgtttaaataaattcaggtatacccacataactgaatattatatatctattaaaaaatctagagatctctaaaagagatctatgtactaccaagaacgatctccaagatatattgttaagtaaaacaaagcaagaaaaaagaaaccaaaccaagaaagtatgcacagtatgtgtagcctgcttccatttctgttctaaaagggaggtgagaatgtatgttaatgtttgtttatatatgaataagaaatctctagacggatgcacaagaaactagtcacggtgggctacccacggtgggtggggtaggaaggaaacaggtagaattgaagacaggaacgagagggagattttgccccaaattgctttttatagatataattttttgaaccatgtctgtatcaccagttcatagcacagtgtcatccctcactacttccaagtgatgtttaagggttgggacgtttcttattttacaggaggatattctgaatatccagtctgtacatgtgcagttctggtagtaatgatggttccattttttggcatttatattccttcatcttttcccttaatgtctcaggtttctagaagaagggaacttagaagaagctgaaatacaaaagcagaggatcgaacagctgcagagagaaaggcggcgggtcttggaagaaaataaggtggagcaccagccgaggtttttcaggtgtgtaaatggtggggtcctacgggtcattgttggcaggtactggtgacacccgttgcttctggactgaggagagtggatgggggtgtcccctccccgtgagagtgttctcagcactttccctgcttcacagtggtgacgtctgtcctttgccagggccggtctttgtgtggacactgcctccgccctcagtcgtcctgctttttttgcatcccttgctctttccctatgcctctcagcacctcccacaggactttgcagagaggtgctcagtaagagtttatgggagaagcaaagagaccaaccaaacccagctcccaataccaggccaatctgttcagacgggatctaagattggtttctctgcatcccctctcatgagtatagggcttccctgatagctcagttggtaaagaatccacctgcaacgcaggagaccccagttcaatttcctaggtcaggaagatcccctggagaagggatagactacccactccagtattcttgggcttcccttgtggctcagttggtaaagaatccacctgcaatgcgggagacctgggttcaatccctgggttggaaagatccccaggagaaggaacagctatccactcgagtattctgacctagagaattcaatggactgtataatcctggaatcgcaaagac

SEQ ID NO: 30229 - DNA, 3266 bp, Bovine  19866880430161
tccatggggtcacgaagagtcggacacgactgagcgacttccctttcacttttcactttcatgcattggagaaggaaatggcaacccactccagtgttcttgcctggagaatcccagggacgggggagcctggtgggctgccatctatggggtcgcacagagtcagacatgactgaagtgacttagcagcagcagcagcagcaacagcagcatagctcagttggtaaagaatccgcctgcaatgcaggagaccctggttcgatccctgggttgggaatatcccctggagaagagaaaggctacccactctagtattctggcctggagaattccatggactctatagtccacggggtcgcagagttggacaggactgagcgactttcactttcacttttcggcttttgttaccagcgtgtgatatgctgtgtcaccacaggggcccacaggggcttgtgtgactccagccctggccgctgaggccttggttgtcccgtgcagatggactggtggtgggggtgtcacttttgtcaggccttttggaaacttggccttcaaggaggatatgcccatgagggttctgagaaccctttggtttggggaccaacgggagcccctccctgtttccctgaggaggtgtccgcgctgttggtggccgcccaacagaggggtttggaaagacagtttgcctggggaagctctcctgtttggatttccatttcaagcctttcattttggcttgcttcctctgtcttgaaaataaactcctctttgtgctgctgagcagaggtgccctggggagttcttgggttccttaggctcacttcttcataccccgggccttctcccgccgcctgccctgcctatgcagtgtgttggtcaggctcttgttctgtgcaactcactgatttttaagccggttctgcttctttttcccatctgtgttttttgttgctcttcctgcacaacattctaatctggtttcataaacacccctgcaggcgctggtctgactaagaggctgtctgatctctcctcctaccttcagggtgtgagtacatttgacaaccgtcctgtcttttgaaactttgccaggaggttacttcctctgtgtcccttgggggagatatcagtgagcctgtctttgccaaggggttccttcagccatgacccctctctttgccaacagctcccctcttatgtggacgttcagaaatatcatgttctcgtcttgaattttagtccttgctttgtagaattaagcgtttaccaatgtcctttcagcacaaactatttttttttttaaacttatcttgtattagggtatagccagttaacaatgttgtgatagtttcaggtggacagcaaagggacacagacatacatgtgtatgtatccattctcccccaaactttcttcccacccagcctgccacataatattgagcaaagttctctgtgctatatagtaggtccttgttggttatgcattttaaatacagcagtgtcagcatgaacttaccgggcacctgtggacgagaacctgtgcattccaccctcctgggtctgtgcacttctctgcaggtccggaggctggtatcaacaccccccgccctgttcccatcataggcctttactggctcccccgcttcgaatcttccccagtttagcagtgtagctaatgtgattatttaaaaatgcatgtctgctcatttctctcacctgcttgaatgcccttctgaggctccctttgtcctcagataaagtctgcactcctaggcacgttgtgtccagccttcctgctcatctctggcacctgcaaagttaacccaccatctgggaactctccactcttgcttgctgtgagcctttgtttggagagtgctcccttcttcttggcccagctaattcctaccaggcttcagggggctacttagtcactgcttcatataagaagttctttcttcatccactggttctttctctgcacctgccagtctggcttcagtgacccccctccaccttttccacttgtatcttagtcattgtcaaagcctaggttgtagcccttttgcatctctggctccgtgcaacatgtctgatgctgcagagtgaaggagttggtactgcccgcagaggagctgtgcatgtgtacaggaagagcactgctggggctgtggactcccaaaatacagttggccccacagggctctgggcagcatttgaggctgtgttaatggtcgtggtccttgttcttcgggagcatgacctgggggttcacactaacccaccttggtgcctggtgtagcgggtggagtcagccggggcatcctggatgcccaggagtgtgggtaggttgagtgagtaagtgaaagcttgtttcatttgtcttttgacaactgtcctgtcttatggatgttattagtgcccacaccaattcaaaatgtgttaatacccgcaccttccacatgttatgcaagtactagctcagccacatcctcattccatagcctgtacacagattattaaatagaagcataaaaagaaggcgcattcttttttaaaaaatgttttattgaagtgcagttggtttacaatgtggtgttagtttcaggtgccttctaacaagcagattcctgcccccatccatgatctactgacacctactctccctgagaatatgatttttttaaaaacatttttccctctgtgtttatgtgtatatgtattcattttaaatttttattggagtgtagttgatttaccatgtttcaggtataccacaaagtgattcaattatacataaatccattctttttttagattcttttcccgtatgtgtcattacagagtattgagtggagttccctgtgctatatagtaggttcttattagttacctgttttatatatagtaatcactatatgttaatcccaaccttctggtttatcccctcccactgttttcttccttgttaaccataaaattgttttctctatccgtagctctatttatgttttgtaaataagttcatttgtaccatttttacagattttacatataagcagttaccatatatgtcctttctctgtctgacttcactcagtatgacaatctctaggtccattcatgctgctgcaaatggcattattttatttttaatgcctgagaagcactccgttgtacatatgtaccacatctttttctgttcctgtggaggacatttaggttgcttccatgtctgactatgtaaatagtggagcgtgc

SEQ ID NO: 30230 - DNA, 1025 bp, Bovine  19866880461268
aaatcccaggactgatctcctttaggatggactggttggatctccttgcagtccaagggactctcaagagtcttctccaacaccacagttcaaaagcatcgattcttcggcactcagctttcttcacagtccaactctcacatccatacatgaccacaggaaaaaccatagccttcacaagatgaacctttgttggcaaagtaacgtctctgcttttgaatatgctgtctaggttggtcataactttccttccaaggagtaagcgtcttttaatttcgtggctgcagtcaccatctgcagtgattttgattaaaagcatttccaaaaacactgtatattcttaccaggctcttcagttctggagcaagcagccagagagaggcccagggtgcctgcagcccctttaagatgcctgctcttccttgcacaggggcctgtgggagggagcaggtttccagggccctcttcagtctgggaaagtttccagagcaccgggctttcttgaatgctggcagtgccttctgctttcatggaaacatctaggtggggaggtggtgtcagaatatatgcaggttactttatgtcactgccttattggaagggagaaggagagatcaactttccaacctttaccctgacactcatttattaaaaaaaaaaattatttatttctggttgtgctaggttttcattgctgggcacgggctttttctggttgtggccagcgagggcttctctctagttgtgcagtcattgtagtggcttctgttgttgcagagcacgggctctaggcacgcgggcttcagtagttgtggcacacgggctcagttgccctgtggcatgagggatcatccccaaccagggatcaaacctatgtcccctccattggcaggtgtattcttaaccactggaccaccagcgaagcccaccctggcggtcatttagtttagaaccttttgtttaattttgtgaaagatgatgcttgggtatttggctttgtgtttgagggtacaggattcacgcta

SEQ ID NO: 30231 - DNA, 1048 bp, Bovine  19866880542047
tcatcatcctctcttatcaggcttctgttacgctttaagaaaatatagaggtacctgttctcgctcttagtggcattccctagtcatcttaacatttttcatatctaaatttaatagaaactcattgctctatttaaattacacttggtctttttgacaattttgtttcataacaattataatttcttcttacggtttatttcatatgacttaaaatttcttctttggaggtattcctttaaagtgctgctaattgcatgataacatttactacgaaatctgtatgttacctctgattgaaaggttcaatttcagtagatcaaaccatcaagtaatatcttttaaaactttcaaaagttttcaagaagaaaaccacagtctgagcaaagcagtatgtgttgttattttaatatactggtattttttcaggctcatgagaggctagaagattcaaaactagaagctgtcagtgataataacttggaattagtcaatgaaattctcgaagatatcacccctctaataaatgtggatgaaaatgtggcagaactggttggtatactcaaagagcctcacttcccaggtaaactttctctatcctcttctttccaagtcccctgtattcccaaaatactcttttagtagtttctgtttaagatgaagtttttgaaagatttagggccatatgttgcaaattacaacttagatgttttaatatcctcatacgcttatgctacataaacagatacacttactatacagatgtacagtgtctgtcaaagaaatgcattagaatgggtttttctttgtgtaattaaaaaaaaacaacaacaaacctatttcaccatcagaccacatgcttgggacacttttctcatggtgataatggatttttcttccttaataccactgtttcccagcccttcttgtgaccagtgatatgccttttcagtattgcttctaagactgggttgcagctgatgaccttagaacaagagagagctgtaggggagagaaacaagtgacatacttttccccagggacaaaa

SEQ ID NO: 30232 - DNA, 1104 bp, Bovine  19866880592810
tacaagctgggatataaatcagaatgctgctaaagatagggcagcacaatatggaagctagcccaaggggaaaccattaaaacatagataacactgggttaaagctacagaaaaatgaaaagggaaaaaccaaactgtttaaacattaaacatttgtttaaatattaaagtaaagttaggatgacagcaaaatcgatattaaatcaggcctggaaacttttatgacctcaaaccctgggcttcctaactgctagtgtcataaatgatgtcacttttcagcatagtcgtggctgccagcaggcaggtcagaaatgccagctttcatttaaattgtccatttgtgatgtaatttagcatttactcccagggacaaatgtcaccactctctgggcaccagcccctgaaagtgctgctgtaagcaaaatacttcccctcctaattccattctgcccccaggagcatggtttccagagaggcctatgagttcttctgggtttgaacaaagatttgaggaccatataaatgagttaagactcttttccagttggtgaagacagagattttgaggaaactcttcctgggatgaaaaggaaagggagttgtggaaagctgtacctgctatagaacatttcatgagcaggctgggattggaggcctgtgatgtggacacatggggtttcaaccaggggcagccttgaggtaccagctgcacaagggaacttgctggaaaggatggacttcttttgttcccaacctcaagccccttgattcttagtcccatcttcctcctctctccaagtacctccccaggccctgttatgttgacttctgcaggctaagttgcttcaggcatgtccaactctttgcaacctagtagggtagcctgccaggctcctctgcccagggaaatctccatgcaagaatactggattgggttgtcatttccttctccagggaatcttcccaacccagggatcaaaccatgtttcctatgtctcctacattgtaggcagattctttactgctaatgccacttgggaaggcccttgaaacacagaaggacctgctaaaatgctaacatgctctgggaagagcatcatcagc

SEQ ID NO: 30233 - DNA, 1295 bp, Bovine  19866880606752
cttgcctggaaaatccatggacagaggagcctggtgggctgcagtccatggggtcgctaagagtcggacacgactgagcgacttcactttcacttttcactttcctgcattggagaaggaaatggcaacccactccagtgttcttgcctggagaatcccagggacgggggagcctgctgggctgccgtctatgggatcgtacagagttagacacgactgaagtgacttagcagtagcagtagcagtatagttgattaacagtgctgtgttagtctcaggtgtatcccaaagtgattcagttatacatgtaatatatgtattgattctttttcaagttcttctcctatttaggttattacagagtattgagcagatttccctgtgacttactcctgaatcttgagggaagtttggcttctttaatgctctttgtccctctcctcctccagagccttagcacaagtcaggattgtcagatagtggcagatttagagggactgactcaccatcttgaaagcctttatccacctgcaggcatcaaaccaaatggacaatctgattcatttgtctctggggccaaaatgaacactatttaaacccacaacttgaaatcaaattccatttgggtgtcattaagccagggacaaatctttgccttttttgaaataaacaggaaagagagaaagagaagctatattttgctcatgtctttgtgaaaataaatttctttgtgatggaggagtaaccaggttcttgccctttccctaggtgtatgtggcagcctttgcggtgtctgcatatgcatctagctactttcgtgccgggagtaagccttttaatccggtccttggagaaacatatgaatgtattcgtgaggacaagggcttccggtttttttcagaacaggtaggtatacaccctttttttgtttgttgggagaagttgcacatgtctcccattaagcgtgcttttgaaatatttatttcccacctgtcactggcttcccagtaacagagataattacagttcttctacacacaaagagagagatcagtttccttccactgaaaccttgccaccacccatgggcttaaaggtgctagccaggctggggctcgcttggctgtgtgcatcaccacagttctttctgtttaaacgtgtagcagagaggaatttttaaagcacgaagcatttgcccaaactgcaagttaagagatttaaagtgtgcagcctagctcactgacatcaccattctaaaacaggagcactgccatcagaagcaggagcaccaaata

SEQ ID NO: 30234 - DNA, 1165 bp, Bovine  19866880633516
tccctggcgagaaacatcgtcaggaagttctcctcaggggcagtgcactcccctttcctacccttcctagtgttggtgcccatcaatgtgccaggatccatcaggatatatttaacttaccaaactaaatgctccactacaacagaataaacctaaactcacattcaacctacccatgcctgactatccacgtaaaggtctcagtctgcgaaagtcttcgatgtaaatcctcaacaagacaaggtgaagatgttatgatttcagaataagcacaaatttaaggtctaaaaatgtgtaagtcttagtaaagagaaaattctggtcggtgggcaaaacaggaaaaaataattaccaagcaacttcagttttaactcctatttccaatactaatgaaacatttactcatttatttagaaataaaatttcctgagcatctgtgagataaacaaaaatacccctatgatctgcacaagcaaggtcctgccctcacacaattgacagaggagcggaagaggaaacaagggaagaggacgcatcaatgagaagagccatgatggaagaacaaaggccattgattggagtgtgaagtcagaagagacttctcatgacacaggatgcctcagctggaacccaaacaatgaatcagtgtaaggagagggaagtgggtgcataacccatgcacaggaaaaccatgggcagaggcctagaggcaagagaaagctcatctctttggaagaatagaaagaagtctgtcataagacagagttactaggaacttaatgagagatagtgctggagacataagcaggaaacagatcctaaaaaatggacttagggattccaagggaatccctagggattccactgaaaggtattaaggaagatatcataaatatattgtattttataaaaatttttctgagtgtatggtggagcaaggactggagaggatcaagacaaaggtctagacaaaagaaaatgaactgagttacaagcaacacagacggagagaagtgaacagaggtaagagctatttagaagtcagaggaaaacagacttgactgggcagaccagcatagggagtaagtgttcaggcagcttgggttcaaatcctggatattccacttatagggcaagttactactctttctgcatctagcttccc

SEQ ID NO: 30235 - DNA, 1949 bp, Bovine  19866880655947
tcaggaggcaatttaagccccaaccaaacaaaagtgttttaaatttctcaggggcaagctgcactccatcttgaaggaaactgaaagagatatcaaacaatttattgtctgatgaccaccccctagttacttagcgaaagctatacgagaaaaaaacagcagccattaagagatgaagggcgtgcaacagagaacgagcttgagacatcactaattttgtgctttgggatggtgaatatctttgataattagtagttaattcattgttgcatttttagataagtcatattaagcaattactgtattccaggttaccatgattactttcgaaagggtaaaatgatgacctcactaattgtggattccatccaatacagttaagaataaacgtggctaccactctgcctttcacaatggaatcattaataattacttctttccactcatgaataaagtacattaactgaatgctagaaaagtagaataaatggtgcttttctactaaaaaagtactttcccgaaaggaaaaaaaaaaaaattttccataatacaaaatgctgtgttttacttctatcaaagtatctgcaaatatatatctatttcttagagtctccttcattattaaataggaatctccttcaataattgaagcagagttaactatttatatttcttttgttcaaacctccatgtcctaagtttacatacttcatgggggggtaggtttgcaagggtttattctagaaaggacattggactaaatggttctgatgcagaatattaacagtggaaaagttttacatactcactgataaataaaaggaatttttcaggatacctaatcacttttaatgaaggggcatgggagagagatagaacattaaaaagaaggagaatatctgtacatatgcctcatagacccacttcgaaattctccgcttggttaataaagccctgtttctgtgtttaattttctcctgatacaatgagtacaaaaataacccaccaagcccatccccatttccaccaaaagcctaacagctgttgaacttctgatttgaacaagatccactgcaggaccccagactggcaagacacaaaagtcgaaggccccatgacattttaatgcattgggttttcttctgctgacccacaacatgggtaaataaagataacctttaccaagaaacacaaactattcccagggcgccacagggggattccagcaaatgtcccgttagcatgagctgccaccacagtgactgtgaagagagagcacttcagctaaaagttacgggcgatgaattttagaaacctgactgctgatattagttatctgaacacagaaagtggctggagaaagccctacacaaaatctctttgttatccggttcagatgagtggttttctccactttgtttctcattaactgtttagaaagggattatcccaagttctgcctatttagttgtttttgttttgtggcttaaagttaccacacgttacctaataaaaatcacaccacattaaacaggctgtgttgagtatgctgcagttagtgtgactttactggtgttattttaagttgtctgttctctgaattcccttggaatttatgctgttaactcccacggatatgaacagacctcccaagcctgcagttacacacgctgtatatctatcagaaggcaacttaacttctagacgcggcacagacggctgcattttgtccctgaacacttgagttcctgaacacacttgtttgaaaatgtctcttagaatatatggtttagctggacagactaaaaattttgtgtaatcagagagaatgtttagaaaacgttgtttggggaggaaagtaatgctttaaagctacttccaagagaataaataatgcaattctccttctccagggccgtgggtctgctggctttagtactgctaataaa

SEQ ID NO: 30236 - DNA, 2951 bp, Bovine  19866880661234
ttggtaaagaatcctcctgcaatgcagaagaccccagttcaactcctgggttgggaagatccaatggagaagggataggctacccactccagtattctggcctggagaattccatggactgtatagtccatggggtcgcaaagggtcggacacaactcagtgactttcacttcacttcacatacattcattacaattacacaaaccttaagtgtacagtccataagttttgacaaatgcatacacctttgtaacccaaacctctatcaatatattcaacattaccatcctcccagaaagtcccttcatgccccttccaagtcaactcctccctcttcctcatccctccccccagtcatatatctattaataaccccttcaacatactcattgcttttgcagttaccagacatgattaagttcacaatatctgtcaaacatctcaaaaaagaagcacagctatgacaaacccctgtcagaccagtgtttctccaagcatagcatatcactggccttagcatcactcgagatgcttattaagagaacagattcctaaggcctactgcagaccctctgcatcacaatctcagaggaccaagcttgggaatcttattttctgctaattcagaagctgattctgagtcaaccaaccaaggtttaaaaacccttgcctgagtctaataaagaaggctttggctgagatttaaataattgcacgtaaattttaattaacatcatctgtgttggtgacagacatcatcataaaatatgacctgtttcattccaataagttcttttatatcttggaaagtctgaaagcaaagagttcctacatggaaaaatttctctatagccaagtaaaaatgtgccctttccttataaagacgtgtttattaggacccaaatttcaatgtctttaaacaaatatcagtaaacattgcagtgtttactccaacccatcctgtgtttgctcagatagtgaaaatgggtgtgggttttgacctgccatttgtggcaatatcctgacaatgctagatctattaattagttcattttctcttttttatcctaccaccacagcaagaaaaattccatcctgccttaaagcccaccagacccttggaaggacgaattgcccgactgattcagaaccaacgtcctctggaggctattcttgagcaaagaccatcttcctgcccagactgtacccctagagttctgtgtacttttcatacctttgtgcccagttctacagaaatgatggctctgagtgataacatacctgcagatgtgacacataaaaaccaggagattgaagaaaagattaaggaagaacaaagcttgctatctacctatgcactcccatcctgttacccaacaaaagatctggctaatacttacgacataaaaccatttccaaaaatcacagatactaaaaagacagaagatttgtactggagacagctgtcattaaaaccccaacttataccttactgtaacccagatcattacattccctatgaacatttaaatcagtataatgtgtaccaaaatcctgttagccttagtaagcctggtattttacaaagtaaaccagacctaaaaacttttgattttgaacactttttaagtaagccagaacagttgaccttgaatatggaggatgatgaagaaacaaaacctatcctgggttgggattcctagagctggagtggccaaacctcaaacggacctgctggagcttaagaacgctttttcaaaaactggtgcacaaaaacgtttccataaatcagttctagaagactataaagacctcaggggataaagagcactcggggaagaaacatcaattctatggccataattcctattatttctataattgagctattcatccttcccttcaaaacccagcttctagcaagaaaagaaaaaatataacagaatttcttcctcattgctggattctgttttttggagaaggcataatgagcttgttaatgaggtttatgttttcaggtatttaagttagggtctgatcagaagaacccagaaaaggtgatgttctgacttcttcaaaagtttaacaatttgacaataaaatagaaccagaaaaatttatagtctttaatctcattttcaaattatatgccaaggaatatttccaaaatcataataaacaatgtgtatgacaaaattttacaaaaaatatttgaaaaaaactcaaattcccgataatcgacaaacgtctatacaaactacagtagtaccttaataaaataaatatatggacactgtccctgtgtaggtaaatgtttgtataaaataacactaggtacaaagacaaaattcaaaagcccagttaactgagggactgacagctctacaaactacattaccttaataaatacgtgggccctgttcctttgtgtaaacacgtggacaaaataagttagtggaaaagacaaaactcaaaatgctctgcatgcgcacacattctaagttggatgtttcttttcctttcaccttctgatagagaaacaaccatttcttttatgaagaaaaaatgattttattgcaaagatctagaaatggttttaattagtaactgatgaactctatggcaagaaaggatggtgtcttagtctgtttgggctgctatgacaacataccatgaactcggtggcttatgtaaacaacaaacatcattctcacggttctggaggcggggaagtccaggtcacagcgctggcaggtttggtgtccggtgaggctctgcttcctcactgaccgccatcttctcaccacaacctcacttgataaaagaagcaagggatctatctgggcttcttttgagggcactaaccccattcatgaaggttctgccttcatgaactaaaggaaagtcgctgagtcctatccgactctttgcgacccatggtctatacagta

SEQ ID NO: 30237 - DNA, 1417 bp, Bovine  19866880721835
tatctgtttctaagaccctggaaattgcacacgtgaatatccatctttaatccctattaattatacagtaggtattatatttacctcatctagatttcagtggctttcactccaggcaattttgttgcattatttagacaaggcaaatattccatgtacaggacgacttcaaagagacaagggaaccacatgatcagaaatcactggcgtcaggccctcctaaaggtacatcaccagcctctctttaatgaagaccacattttacaacaatgctcccatgcacatgcaaatttatgtagattgtttacttagactagcgcttttgtacatcaatctcgctgtgcaccctcctctcctttttgccttgaaagagataatgtggctattccagtcatctgtcttcgggttttatggtctggagtgcccataaagatgacaagggctgcgtttcacaggcagcagccttccactgccctggccatgttgtgtcgaactagatgagacacactgctgaaccggatagggtccgtgctctcctccaggatgtatagttgggtgacaagtgaggcaccaacttggacagtcatgcaagtcctggctgctgctgagcattgctggggggatatccacggaatgctcttctgtacccttcaaagttggccagtccgacacactgccggtccacgctgttcttctcacttagatttaccttgggttggggtggggtggggcatctttccatagttctgattacaagcccatttttggaagaaagggctaagacatccaaatgacaaattgtttatttaccacaaacctggttagaactgaaggggaccccaaaactacacctgctgagaagataccatttcaatgatttatttcatttaaagaagcaccgtgagtcccggttaagaattcagactgatgtcagatagatttgagtttaatcccaatggcttccactgtatgacaaggttcttaacatccctctgactcagtttctccatctgtaaattgggaatggaatctgccttgtgggagtctgtgtgggttaaatgcaatgaagcacataaatctcttagcataatgattagcatgttacaagaacaaaaaaagactttggcaatgatttcattttttaatagggtactgtgaaataaaggtacctgattttgtttggttgtttttttaaaaaaaccaaaaaacacaagactcggcaagcggagttctgactgtgtggcctctcccctgcatggagtctgggggaggagggcagtgtggctgaccacatcacatccacacgcagagggatgaaagggaacgtctataaccagaggtctaggtggcttggagacagaggccaacagggcaccctctctatacagaaagtgcaagcaccaaccactctgctcag

SEQ ID NO: 30238 - DNA, 1168 bp, Bovine  19866880729849
ccatacagctggagcaggaaccataaagccaaggacacagaataagtgccgctgggttatccatgctctgtagtgtagccccttcccagcaccagcagcccatgaaatccatcttcccctcctctgatgcaactttgcatttgcaccttcatcatactcagtcttgcaatacccttaggttgttgtttgatattaatatcattggagtcacaaattttcagtcaggctgaaattgatctaatttaatttctgggccaatccttcccctttagaagggaagtccaggagacccagaaggttgtgtgacttactgcgaacaccaaagctcactcgtggcaaagcttggtcttcagatgcagaggacagcagagttttccccaacccagtctcacaatattatttaacttctgtgttttcatgtgcgactcctatctcagcatccaccctgaatgcgcccacactggtttttaaagttccctccaggcatatctgctcacaggctgtcctgcatttgaagggagtaatcgaagaaaacttgctaaactgggccagtcaagagaaggaggaattcctagacatgtcagcagacaaacatttcaagtagcttccccttcaattttacagacatattgatctgaaaagtgatatggataaaattttcaggtaggtagaggagggttatcttgaaccaatggccactgcgttccttcctgagagagcagtgcccttgggaaggtgggagctgggctgtgtacagggctgcacattgatactgttactcagaacacaaaggaggaggatattcgaagtttttcctgcaccttatgacgaatagactttacaacagactaactgtccttggactcaacttagcagcagctcctaacctggttcactttcaagcatagaggtgggggatgaaggtacagataaagtgcggggataaactgggggataaagtgcgcaaggcactgcgcacattcagagagagaggtggacgcagggaaagtggaggccagtctgccaattaaggggagaagtgaagcagacgacacctgacactgggtggagaaggtgggggtttcagatacgtatcggattctgtttttaccaagagggcagctttaatcaacttcccagtgtaaatattaccaatataaaccaaata

SEQ ID NO: 30239 - DNA, 1418 bp, Bovine  19866880890826
cgaacccaggatactaacttgctctccagatgcaagcggatgaggaggagccgccacagtagatgctctcgtgccatttcccgaagagccgatgtactgcttttccactctggtcaaacactgtaccttcaatctcatgggcgttagtgctccagtatttcgcctaggagtaaaaagagagtcatctgttagtgttttggggtcaatttattacgaatgttaagagaaaaaaggaagaggaaagaaacccgcaagaatgattctatgctgcatatggtttgttggttctggctttttaaaaattcatacttttaattatttaataaaaattaaaagctagctctttatttataggttgtagctcaatcatcaacatttgtgtaagacataattttctatctactttcacatcatgcactgcaggaaggaagggatcatccaccaggtgggggttgacccttaagccccttccagaacagctgtcccctgactgtcactgtggctctattacaatttaaaagaaatgtaactcatataacttactctctcaaggaactagacaatcctttgtaaacaacctttttttttttaccaagtttgtaaaccaatcaactttcagtttctactatttatttttttccccaaaccagatctgctcatctaacttatgggaaccttatgcaatccacattcccactgagtggtcctggactgagaacagctcagctagggcccagccttgtggattttacatatacagtaccacactgcggtcagcagagggagcgctaagtccctagagttgagtttttcaattttccttgcctgccctaaaaatctgcaaaagaccagaaggcattactccataaatcaaaaaattctactactattttcagccaaaatagaatccgtatctggaaaccaataaaatagagtgaaatttccaggccatatctggtagactagcttccccattccaagtccaaaataaaaataggaggaagggcagagtatagcagtacctcagagattaatcagacatgtaacagcgagttctctagtcaggttaaaaaggaaagcaaacactgtccaggcttttaagtttattctaaagcaggagtcatatttttctctgtagagatatttgtcagtaagtccaattacttactgggaagccacagaaagaagcagtcatgctccacacataactgctgctttcaaattatttttcaataccagaggcacatccagtgttctaattcttttcatctctcatagctatgaaaatatgttccctggtcctcagtagatgaataccacatggatggtataaatgggagtgaagcacattctttggggaaatttctgagagcagggtagcttgcaccggatcaatcaatcaatgtatctattatctg

SEQ ID NO: 30240 - DNA, 1417 bp, Bovine  19866880956774
cttgcctggaaaatcccatggatggaggaccctggtgggctgcagtccatggggtcgctaagagtcagacacgactgagtgacttcactttcacttttcactttcatgcattggagaaggaaatggcaacccactccagtgttcttgcctggagaatcccagggacgggggagcctggtgggctgccatctatggggttgcacagagtcggacacgactgaagtgacttagcatacatgtatccattttctctcaaactcctctcccatccaggctgccacaaaacattgagcagagtgccctgtgttatacagtaggtccttattggttatccattttaaatatagcagtgtatacctgtcgatcccaaactccctaactatctctttctcccagtcttatcccagcaaccataagaggaacatggatttttatcacaattgtttccctattccaataaagggatgtgtttaaaataagtcaatctgcgtatcagatatttttctttgaaacaaagatgactaaagctgccagagctgtagtttccacttggaatttccattaatactttggtgactccttagtgtcaacggaaacatctaagtccccatactcctcctctctgtcatctctgccagcttctaattggaacagttccaggactgctactgctgaacaattcccaccttttctcacatttttacctgccacatccaatactctgataattttatagataatcaaaaagaagaagagctgccactgtgtttggtccttctctattccagacaaaattcttacatggttgaagcgacagcctaggtaacattttatattttgcatttaaatggtagttcaattcccatagagctccatagactttatgaagatttttcaggttctcatatcaggtcaagttgatcaatctccttatctagttcttgagacagtttggttacccacaatatttaatgatcctaaaaatactgtagcgaacctctttaacaaatattagtaaaatcaactgatcagtctgttagtctatccatttacctatccattgcctttctgaaaaaaataatttaaggaaacgtattcattaaatgtttaaatgaagctgtgaatattccaggataaaactctactatactgatcttcaatcactcaaatccttagtgtgtgatcaaaatccacaccaacttgaggggaaagaatattatactggggggataaaacataacttattgctaaaaccccagaaaaacttgttggaaaaaaccccagaaccatattgcgccctggcctgtagtcaagagagccaggcccctgtctgggacagtccactgggtccttccacagatcacactatgtcccctggtccttcacctcttctcagttaataagagaggaggtgaag

SEQ ID NO: 30241 - DNA, 1726 bp, Bovine  19866880986955
atgttctagctattgcaaatagtgctgcagtgaccaatggaatacatgagtctttatatgcctaggagtgggattgctggatcatatggtggttttattcctagtttttaaggaatctccataccgtcttccatagtggctgtatcaatttacattcccaccaacagtgcaagagcattcccttttctctacatcctccccagcatttattgtttgtagactttttgatgatggccattctgaacagtgtgaggtggtatctcattgtagttttgatttgcatttctctaataatgagcaaagttggtgaagttttacccgttttaaacttattcttcctctcaggatattcagattcctggcagcataaattaaaccctccactctgttctcccagtgctgtctgtccccccgccccccactttgatttggcctcaggaaataccattgtagtaggattaatatgatagcaaacacctaacaagtgctaacacagagaacagcatttattcctttccattccctctagtttagagttataaataaaaaggtattagtaatttaaagatcctgtatgcttttgtattttggtcttaaaatttcactaccaggtggcactctggttagatgcccattgattcctcagtactaaggtctttcagtatcctgacagtgccatgcacttaaatatcaaggtccgtttcttaagagcaaactttttttttttaactgactactgcatgtcctgcttattaaaatgttgtctcaaattttagtcgctgatatatacaattcattaatttgattctaggctagccatgtaaaagagggaggaagtgctggtctcattccaagccagttcctggaagagaagagaaaggcctttgttagaagagactgggataattcaggtgacgaactcgacacaataagtaacaagtagccctttgtggccacattttcttacctctttcatctgaattagcagatgaatttatttaaaatatatctagagtcaacatctgcttcattgtatcactctcaaaaataaactttttgatccctttctgccacctgctggtattatatcagaattcagtggctcagctcacccctgcccatttcggctctgtaggatgcaaccctgggaagataattctcccagccctatagaataccccagggcaatgtatatattccaacatactgtttaagttatatttgccttgtcatccttcaggacctttttgtggaacaataagtagcaaaaaaaagaaaaagatgatgtatctcacaaccagaaatgcaggtatgttttaaatactttgagaagtccaagtgaactatgaactagctttatcattagtgtggcatatgttctaaatgtataattttaaatgaatgaattcatattagtacccgattgcaaggaactgcaatatggacactcagtgcagtaatatataggcattatttaaatcctgatatacatgcttgtactatcaccagtgtgctttattttatgagcataatttacagtaaaatgaattcattaagatttatgcttgtattaatgaaggaacaatgtgacaattgaaactgtttttttaagaactttgacaggaacttatgtgttatttctgcagaacaaaatccctttttatgactatgttaaaagtgttatgattaatggcaaacatattctaccataacattatccatgata

SEQ ID NO: 30242 - DNA, 1354 bp, Bovine  19866881019158
gtccttcctccctttgtctagttaactcctactcatccttcagatcttatctcaaagaccgcttattctgagaagcctccctgacactcccccagttcacttagaccatgtaggggttgttagtcataagctgcatccaacatggcaatgctttccacattgctcttacatggcccactgtgtatttattagtatggtgcttgagtctgctgccggagtgtgtgtttgctgagaataggggctttgtctgttttttccaccctctcagctccttgaacagtgcctagaaccaactaggtgcttaataagtacttggtccatgaatgtctgaatcccagagttggtggatagtcacccatttctccgtcttgcaagaccttgataagtagaatgtgacccacatcagggtactgtctgatggatccagaaagtccctagatttcctggaaataactgaatcagagcattttagaaatagaaaagaagtgggaattttattagtccaatccttcattttatagatgaggaaactaatgagcaacaaggttaagggcactcaactattaaattacagagttgaggcttggatacagtcctcagaatccctgccatctacacttctcattaaactattagttgtagatccccaaaatgccagataaatgcataattcagatatatttgtaatggtaaatggtccaggccaccgtcccctgcccctcttccccaatcttcacatggccagttcctgtcccttcctaagaaaatataaaccttccttacgttatcactatcccctgttctgataccacggagggccctccctttgaactgtgtgttgccatggcaactgctccttcacaaatatcaagattactgcccacaattgcctatgctgacgtggatggctgccaaacaaatcataggcgatttttttttttttttttttttttgagtcaagagggccgaaagcctcagatcaagttcaaattatttggaggatgtgtgtgtcaaggacacttagcatcagttctgatgggaaggcagataaaagcttgatttaggacaagggtaggggaggcacaggacagctcagcctcagagcttggagagctcttccagaagctctttgatgtgaaggagatgttggaagttgtgtaattcttgcaggcggcccagacacaaaggctgctcaaaaaatgcagaggggccaaatacgccgagagagcttgttctgtcctttattttcccctctactccatctccccttcatccttctcaagaaccccagatccagcatgcaggttttgtcccaaggagagagacattcgtgccacaggagtgcatttacagg

SEQ ID NO: 30243 - DNA, 2678 bp, Bovine  19866881131442
ttcatgtcatggctgcagtcaccatctgcagtgattttggagcctaagaaaataaagtctgtcactgtttccccatctattttgccatgaagtgatgggactggatgccatgatcttagttttctgaatgttgagttttaagccaacttaaacagctatgtcttatgttagcctcctgaagctgcaataacaaactaccacaaactcagtgacttaaaagaaattgattcccttatgattctagaatctagagatatgaaatcagtatcactgggtagaaatcagggtgttggcacagcctctagagaccctagagaagaagctcttcctgcctcctccagtttggatggctgccacaatttcttggcttatggctgcatcatcttaatttctgcccccataatcacatccccttctcctgtcggtaacaaatctccctctgcctcgttcttaaatggacatttgtggttatatctagggcccacctggatatccaggatggtctcccatttcaagatctttaacttaaccacacctgcaaagtctttaccatgtaagggaacactcagagtttccagagactaggacatggatatcttttgagggggccattatttaccctactatatgcctaaaaagatatgaggagagggatcaacagcatctaagaaaggacttttttagatgattaaagtagatgaagcagctcaacattgctaatcatcagagaaatgcaaatcaaaaactacaatcaactatcacctcacatatcaaaatggctatcattaaaaagaacacaaataaccacaaataacaaatgttcatgaggatgcagagaaaagggaacattttcacactgttggtgggaatgtaaagtgatgcaatcactgtggaaaaccttaaggaagaaagaatattaacaaaaagttatttatcactgcatttatctactgtctttctcccaacctgacaggaaagcagaggttattctctggagaaataaaggcaaaaaggcctcacagttatggccaccaaacagaatggaggagagaagtgtggcaaaggataaaaccagaggatgacaaggtacactagtgaatgaaggaatatgcaaccccctttctctgacccactcccaaaatgccaccatatagcacaaagtcaaagaaatgaagaattcctctctggagtaaaatgaacaatttcagaaaaatgcatctacgagtaataacatttatgagtgttccaatgaaaagaccaggtcttccttctaagacctgtagcagcacatctcaaattctggtgcctgtacctccttatagtcacaaaaattactgatggcttcaaactatgcaaattacaggtatcaaattgtaacattttagaaattaaaatgggaatttaaaaatacttattgattcatttcaaaataacaataacaaatctaccatataacataagtaacatttttaatgaaaaataattatttaaaacaaaaaatatttagtggaagagtggtagtttgaacaatctctttaaagtctgttgtaataaaatacatctgggctctcatatctgctcctgcatttaacctgttgcaacgttctggttgaagtatatgaagaaactgtagcctcacaataatatacatagttggaaaatggaaaatgtattttagtaccctttttggataagtgaagactgaaactccaccaaaacttgaaaatcactagtttctaaaggttatccttaggcagaatctgaaattataccagtgaactttttgtcctctgtttcattaaagtccattggtctatcttgcactttgaacgtatcttttgattttgtaacatcatgcatttatcatttagaaaaatctttgctcactgagttacagaggtcttccaaatgttgacacatttcattatacaatatccaaaaaaatcacatttgttaatattaccacagataccatcagaaaactctataagtattggtaagctgtcaagttccccatggccaatttaaatgtttcaaacttttatatttcttgaaagcttgaattttatcattggcaaaaaatagtatgagttgttttccttaaagtgacatgctcgctttattgatttttaagaaaatgtctggtaggtatccaactctaaatgatcatagcttgtctatcattcactcttgtaaataaaaatggttttcatgaaaaaaaaaaaaatcacttcaactttcaactcagacaagggcactaatgattcttcttgagacagccactgtatacagtgtgtggcagaaatgtcctaggaggacttgccattttcttgcacagaatgttaaaaaatgtgtactcaattcataaattttactatttcaccaaggttaaccttcatgtgaaactagcatgttatacaatagcttgtggtggtgaataatactggcatggctcatgtgccattacctttattcatggcaagaggtttcagcatgttttatccaccatgtgctttgcaccatctgtgtgaatgttaacacagtgaaaaagcaaacagctgtctgatacttaatatgaaaataattttgacctcatgaactccttgcaaatttctctgagatctcaggagtccttgaacaacactttgagaaccactaccttataaccaaagaacaaa

SEQ ID NO: 30244 - DNA, 1555 bp, Bovine  19866881239028
agggccatttacaggcccccgctcagtctctgcagcttgcacatgttttcaaacataatttcatgcctgctttctgacagctcattaaacaaaggcctctcggtgcctatattgcccgtctccctgctgagagtgtaacgtatttacagcctctgaagattgctggctgctggcgccttctctaccccgtggcctgcctgccaactgcttatcagtctcccccaaaggtgacatcctcctcatttgtttaggtagtgatggtcccctgtttgaccctcggaggccagcagcagcgtgattaggagtggctcctgcaccagctagataaaggcaatcatgggggcgaagacagcactggcttctaggggagcttcgccaggctgagccctcccattcaggaacgcgctggcagttcgttagcttgacagctggcagtgtacagaccgtgtgggatttctgcctaggagaaagcaaacaaggtttcggtagtgttgaggagatatctggggctgtgtacaagggtgatcagagcggattgctcctaattacctgtctcttgactgccattaaaccctcattacatatccaaagccataaagggccctacaaatgcagcaccttatacttaatttttatcctttcctcctgtgtttgccaagagcattttgctggggtcctggggggacagatgaagacatcttggatggagggagaggctgtaggctgcatccatctgccatttgacgatctgaaaactggtaacaggtttctgccactgcagtgttctgggggtgaaacatcatttccactgagtaggaatggggagagagcagggaggggaggcaggaaaggagggaaggaaagagagcaagacctcttttttcctaatcaggtctcagttaattcaacctttagctgttgtaggttaatggccagactccagaagcaggatttttgttaaagcttcagatgatcttggcccctgaatggctgtgttgtgcctctgggatccagttggtgccaaagcagactagggttacggtgtgatggcatttgcctcctgggcaggtgacagtgatggctaccactgcttaagcacctcctacaaatgagacagcacataagcattttcctacagaaggtaagaatttaacacaatactactctgggtaggcagcagtaggactattgcaccataatgaacatgacatgaacttgggcaaactctgggagatagtgaggggcaggctgcggtccatggggttacagagagtcagacatgacttagcaactgaacaacaaccaataatagactgaggcttagagagatgggaaatctccatcaagctcctagtcagtcagcaactgaatgcagatctgctggttccaaagtccccacttctatctcccaccttctgcccaatcgatgactacactggaacaccacaacagttgctaagtctgcttcccctctgcaagctctcaaaccccagcatgtatgcccatcaaccagagaaatggggactaggggagactcccagacgtgctgcattag

SEQ ID NO: 30245 - DNA, 1187 bp, Bovine  19866881304663
aaatgacatttttcaaattttcccattcttagctggtcttcttatatagagtttttcctcatcagctgagctgtttagttaacctaccagtgcatttccaactgaaaaggtagggaaatgccagcttcttccctttgccaattttaacagtaaagaattgtttaaaaggtcaatctcaaatggtaacatgagatttttttcagtcctgttttttaagtagcatcgtggacttaaggagttttcattaattcattatgtttcggtcgtatgtaatcctatgttttgttttgatttttcaaattatcatgactcttggccagttgtgggcagatttttaatatatgagtctgaagctgatgagagagatctggatcaagggagttctcagtagtggttcaagtcacaggaatgggtaatattgcctaagaagagtgtatagggtaaaaactaagcagcctagattagtgatttaagtagcttccataatttataggaataatccttaatatattaatttgtgagttttttctttgtaatttttcttcagtcttttatactattttcatgaaatgactaaaaattaccaattaatgccttggaaatttttagtactctattgggataatgagctgctacttttaataacttattccatctgtaatcaataaccacaggctgttttgaatccttctagtcactcttggaggcccatgatattgtggcatcaaagtgttacgagtcacctccatcaagcccggaaatgaataattcttctatcaataatcagttattaccagtagatgccattcgtattcttggtattcacaaaagggctggggaaccactggtgagttgatcagtcggtgccttcttaaagctgaaatcttacatactcgtgactgagtcactactctatctcatttttttctttcataatttttatctttatgaaaactttactcatgtttgtttcatcagtcttttttggcttgtgtataaaatacacaggtgatactctcaacttgatttagcatgcagaattaaaccaaaattaaactgaaatagaggagagaagttgtttgcctatgagtagaaaaaatttcagaggataactttttttcctatacccttgaagaaagaattgaggttgcttactaattatatatagagcaaaagcagaagaacct

SEQ ID NO: 30246 - DNA, 610 bp, Bovine  19866881313291
actcgttggcatgcaccacagctgttaagaggcagctcaggaagacaggaaaaagacgaaaatccaaaccctacaagccgaccatctgactttaattaggaaagagaacagtccccaaatgcacaaggatgggttcttttgtaggtcaaagtattatagtggaacttaaaaagaggtaatataataaccctatatatgaaggttagctcacactttaaaggatcttataatatggagacagtctccagctttctagacaagccatcctgtcctatagctgtagtaaacactcatctaagcacaaaaatccatgctttctaattaatgaaggcccattagacaacagcacagtaaactccatcacctgagaaggcaaagcctacatgtaaagcaagttctgtgcgtgaagaagatgagaatttcagtttgggacatgataatctagatattcattagacatctgagtggagagacagtgttgacaggtaaatatatggagctgttgctaagggggagtggtcatgactggagatatacattagagagtcattttgcagttacatgctactaaaagccatggaactgaagagaatctgcaagggggtgagta

SEQ ID NO: 30247 - DNA, 655 bp, Bovine  19866881371462
agatgagatgcatcaaaaataagtactaagtaatgtgagttcattttttcccataggatcataaaatagaaaaagagttctgctgattaagagaaaatatttaaaatgatcatggagatgtctttttgttttataatgaaaaagctcagtatgtactattttttaaaaaattagcaaaagctatcatccctacaatcatcaaaattagtggggctattgatttatttagggggcttcccaggtggctcagtggtaaagaacctgcctgccaatgcaggagatgcagttttggtctctggtggggggaaagatcctctggagaagagaatggcaaccaactccagtattcctgcctagaaaattccatggacagaggagcttggcgggctatatagttcatggggtcacaaaggagtcagatacgactgagcgactgagcatattgatttatttagcttgatttcttggtttggattaattggttggtgagagtgtattgaaaggaaattaatctcttgataagaacagtgctaatgttaatggataaacgattacatacacactcttatccattaagggaagctggagaaacctgggtagaagtatattatttgaggggttgggaagaagcagctcttacttgaagccacccaaa

SEQ ID NO: 30248 - DNA, 758 bp, Bovine  19866881419134
tttgtgacggggtctggagagagctttgctgctgactcggcatttcctggccatccttctctccttgtgccccttccttccagcctctccccagttttatctgatggcacagtgtgtcacatacctggtctgggaggatgtgctcaggggatcttgctctcagctaggttctcctagtcagactcttaccattgatgattttcttaggatttcaaagttgtttccataatcttccatgagggaaatgggaagttgacttatcttctttactcagcatcatagacctaactttactatctcctaaactctggattcttgcctttgtgctacaggttggccactgactttagaatatgtgtaggacatcatgaggccgacaaggattaaatcctgacccctgctggctggttctcctttccccccagttctgtgggcagtttcccggcacttcttgggcacagggccgaggctggttacatgggaggcaggagaagcctaggggagcctgagcgcacaggtgggagcatgcacccttcctgcaggtgtcggcgatggaggatgggaacatcatcaaggacagcaacgtggtgctggagatcccagctcccaccaccattgcctatggcgtcatcgagctgtacgtgagggcagacggccagttcggtgagtatgcctcagctcggggctctggaggtgggttgagtcattgaggagggacaccccattttaccctgaggctcatcttgtagaggattgcc

SEQ ID NO: 30249 - DNA, 781 bp, Bovine  19866881421985
tggatattcttcctttgctcagaaaacaatagaactaactggaaatttcagtcctgtaagtataatcctacttcttttcccaaatgatactagatgagtcatttgtttctctactgctttaattcctcagctatatgtttcaattactaagaaatttttttaattctaagctctaattttacaagtagcttttggcccaatttctcacctaaaaccaataaaagtttatcatatgtagagacaattataattatataactataattcagttcagttcttgttacacaggtacatttttacactgttagaagcattatcttagcaatgaactactaatacagacatctatctatattgtgtatctgaatatgaacttgcatttattctgaagtgtaactcaagttgcatgaggtactgtgaagcaaagctgtgtaccagcacacagaatgatccgtgtttagaactcacttacccccagtaaaattatgcagagataaaagtacacactcttcaaaatatggagcagttgaatttaattacgttaccctcagtcaattaattagaaagaattcattggtgatgtcattatgtcatgcttgggacaaatacattagagtgatcagacaaaatgtggcagtcagaacttccagggctaagcagaggtagtatttttcagaaagaattcccaagttagagtggagaaacttgtgagtattttcaaccactaactcttctctcttctataagtgaatccattgccagcaagttcatagtagatcat

SEQ ID NO: 30250 - DNA, 2659 bp, Bovine  19866881455693
tttcgggcttagccacggtgggaagttctaagaagggtggactcaggctgacatcttccaccaaggcaacacaggtatcccctttgttctccagtaccttctctgaagctaagtaccaactcagcccaaaggcaaagacagcccagaaatgtggaatattactggccaaggttacaacctcaaccagggggcttcatgggcagctgtatccatgctctagcctcctatctttccagagcaggagtctgggggcagaaccaagctccaaatgccaacagcagcaaccttcataacacactcttatattggctcttcctccctccctgtctttctccctgttccctcacttctgcttcctggaatccccaaataaacaacctgtgctcaagtccttgcttcaggctctgctctgaggggaactcaactaatgcagtggtcgtttaggttatttctaggcctctctttccccatctgcaaactgagaaaatggaattaaatcccttccagcttccacattctaagatgcctcctcttatacatcacaacaagggtgacctcttcaatctagagaagcaaacttgaccctttttctgaagctcagtgatagatcacaccaacaggttctggtattataagactaggtcattgaactttatggcaaatataggaccagacatttcaagcaggacaaagacgaagagagaagcactgagagatgtcataactggtgcatgttctacttcaaaatgatgacaatcactttaatgaactcacttgacaagaccttatcacagagaaacagcctcaactggaggacccagtctccttgaaccacttaaaagcccccaattctccagtactttggctcccaaagtatgtttgtaaatctgctgcttggtatttatgattagctttttcccacagagatgttgttagaaatgcttatgttcctaagccaggccattaagagtatttagtctataaaagagctgagcaccagcacaaaaggtcctaagaaaatatgtaacttgaccacactgcatttcgttaccagagagaatatttaacaatgcaatcaagattccaggaacaaatattcacccatgccaatagttacacagaaagatacatataaacatacatactggtaaaaggggatttctcaagaatcaaaatgtctacacagatgttcatttacttccttgtaactagtcttaatatcaagagagaccaacaaccaaaaaaacctctaaagctcaccaaaacagtcaagggttaaagtagaacaactgagttcaactcgcaaagcatgcagaacttcttggtcaagataagagtaaaaggagggaaagagggccattcagaataagtttgctcagaattaaagtggttatgtaatatggagctcagatcaacacaaaggacagtttaaagccaatgcccaacagctaaaagtcaagctgcaaaatcacaagagcccaaacttgagttgaagaaacaattgtttcttatttacataaagctaaagtcttataccttaataagtcaaagttgcatttatatgaaattgtatcaaagccccacagttagtatttgttcatttaatatttacatcaaccactaccactgctgctgctgctgctaagccgcttcagtcgtgtccgactctgtgcgaccccatagaaggcagcccaccaggctcctccatccctgggattctccaggcaagaacactggagtaggttgccatttccttctccaatgcatgaaagtgaaagtgaaagtgaagttgcttagttgtgtccgactcttagcaaccccatggactgcaggcctaccaggctcctccgtccatgggattttccaggcaaagagtaaaagaaagaatagattatatcaataaaaacaagcagcaacatggcagatttaaacccaagatgattaataaccatattaaatgtaaactatttaaacactacattataaggcagagattatgatattgaataaagtgcaagtcccaactatctactgccaaaagaaaactacttaattaaaaaaaaaaaaaaaaaacagaaataatttaaaatctggcttaaaatagtataccacactaatacaaatcaaaataaaactcagttgcttatactaatgtcagacaaagtagatttcaaagaaaagaataatactagagatagagttctcatagtgataaagaaatgtgatgtcatcaagaagacttgacaattctaattacttgggtccctaagaacagaacttaaaaatacgtgaagtaaaatttgatagaactgaaagtatatataaataagtctccacttacagtttgagactttcaccttcttctctcagtaattaatactgcaagtagacagaaaatcaggatactgcatacctaaataatgctatcaacaagtccaattgtgacatttatagaactctccacttaacagtaacaagatacatattctcttcattctcttcatagaaaacattttccaagatagactatttttgggctgtaaaatattccaatatatctaaaagaattcaaataatacaaagtatgttatctgatcatggtacatcaattctatgcaaactgatttatagattcaatgcaatctcaacaaaatcttag

SEQ ID NO: 30251 - DNA, 954 bp, Bovine  19866881467101
tgtgaactgtgtattgaaggatcgttatctaataatcccaactttttggaagctagaaataaacacaaaaggtttctgctcagtaaaaaaaataggatgtcacaaagcctatatgctttctttcctcatagcactgctgcttccatccttgtctagagtacatttagtcttactttaccaaaaaagactctgtcttcagcctccactaaaactgctctcagtggacatcaatgccttccttgggaaaataacgttctttcttttaagaatgggttctctaggcagcagtttttaaatgttgacttccctttcccttgactttttaaaagttgcataatttattgaggtgaaatggacataacataaaatcaatcatttgaaagtgagcagtttactggcctttagaatattcccagcgttgtgcaaccaccacctctatcgagttctgaaactgtatacaagcccctgtgtccccatcttttgaagtaaaaggcttcatatttagtttcccaggccccctctgagactcaaatagctggctcaagagttaatgattagaaaatgtgaacatgttgaaacaaagagctgttgggccaggaaactggtaacaatttcaggctgtaagttggccacatagcagttacctaactctcagttccctgaaagatatagataacaaaagctgacacacattcctaagttgtttttcagaaaccagatctctatcatatgaaaactgctggctgcaagcacatagaccccagaccagttaaaaccaaaagatggatgatgcctgaaacttcaactgaatgccaaccaattcatgtatctcatggtcctctccctcatgctgcctttaaaaatccttccttgaaaggcatcaggaatctcaggtcttttgagaatgggctgcctgttctccttgcctgatgctgcaataagcactgtattttc

SEQ ID NO: 30252 - DNA, 1397 bp, Bovine  19866881686750
cttcctaacccagggattgaagctgggtctcctgcattgtaggcagacgctttactgtctgagccaccagggaagccttatgcttagaaagcataattactcattaatacatgactttatccccattgtaaaggtcaaacaatggagaaatcagaggaaaacataaaaattatcctttaacatattctctcaccaattcttcttctccaagtttgatttctcaaagataagcaccaataaaaatttgtatatgtcactttacaggtattttattctgtatttacaaacatgcatacatatgtaaagaaatacacacacacagagattttttttaagtttgcttacaaacacagttaaggaagctggatactcccagttgagtgtcttgtttaactcacacaatgatttaaaatgttgcgtagttgcacaagttgtgtttttctataacataaacagcttagtacctattgtcatacacctgcctggcccttaagacttttgacacctgcttggcctctctagtctttttatgtgtgtgactctggatctcttttacatattgctctgtaaaatgctttctttaaaaaaaataaaaatgctacataacaagtatgtgatcctgacaatatatctgctgctaagtcactttagtcgtgtccaactctgtgagaccccatagacagcagcctaccaggctcccccgtccctgggattctccaggcaagaacactggagtgggttgccatttccttctccagtgcatgaaagtgaaaagtgaaagtgaagtcgctcagtcacgtctgactcagcgaccccatggactgaagcctaccaggctcctccatccacgggattttccaggcaagagtactggagtgggttgccattgccttctccgacctacctaattcttttctacatagtgttccatagtatacactacttttatattcaaaattttgaaaagtgcatattatcttatttataggcgtttaggtgcacattttcaatttgattcacgtttcctgaatgtgctcctgtctgctgattagctgtgatacaggaagtctttagtccctgtttaatttttcatcaaagatggttcgtgaaagggtgcatcgctgatgtggaaggctttcttacactgaacactccatcaataaagactcctgtttgcacagtggaaaagcagaattattacttagaaactcccttgaggaaatgtgctttttacacagaatggattatatgcctaaatgtcaaaggagttttcttaatttttgtaaatatccttcatgcccaggaaacagcagtaggctggagattttgtgaatcttaattgcctccattaccatagataaagcttaagtcatatttgtcctcggttctgtacattt

SEQ ID NO: 30253 - DNA, 867 bp, Bovine  19866881702678
aaagcggcatcctcctccgttctatttgagctgcagttggaacccactctggtcctcagctctggttatgggacaatgtggttttaagaatgtgtgagatttatagcttgaaaagtgccaaaaaatcaagaatttaaatcctccctgatttatgtctagcttgttagaggctctagggctttagaaatgctaaatgtttgagtgatgctctgaaggttgagctatattcctctttcagctgattattattaacaatggttgcctctaaagctttagtagctctcagctgtaacctttacacttggtacattcctgctttgtgaggggttataaattccatgatttaaaaaaaattaggaacatttttgaatttttgtagccaacagttccgagatcggttacctgggagatggagggttaagcatcctttatctctgctcacatatctgagctactttcctgttgaatgctgcaagtgtgtaatgagtgtttactaaagaacaattctttacccaagaagagaccatgataagcacagtcatttgttgtctgtatttgttgttgcttattatggatccaggagcatttggtgttgaaaaccaaacctgcatcccccacatggttactgtaaatgatttaaatcaattccttttacacagcatcaggaagtgcaatatgtagtaactaaatatgccatttaaattcttctcaggcaaatgttaaaaggcggggaggggaagctgagattagtgaggtaactgtatttaaatatttttgataggtttctaagatacatgtttctttttccaaagcaaatgcattcatgcctaagaaaaaacaaacaaacagggaaaaggctcttgtgtt

SEQ ID NO: 30254 - DNA, 1052 bp, Bovine  19866881782291
acatcattttacttgatatcccatagggttgttatggactttagaggaaaatgcttaaaactcaagctttggttttaaagtaatacgggcagaaattggaactgctttgatcacagaattcaactactgcacatattctattattgtaattggcaataacacatttaaaaaggcaaagtttctccttttggtagttataatctgtatcattcaagactgctgcaaaactcacaaatgagtgatatgagttaagaagaaagtgtaggaaggggataagaagacatttaaagctttatcagaacacagcacaaaggaagaactcaactctctacatttttctataaggcagatggtcaaactttttaatacaagatctaaaatacattgcttattaagaggtagaaaataccaaaacagtatttaaggaaaatgtgttgagttacttaaaacaatcagctactttattaaacttctggaaagtcaaactgccatgtggaatcccctgtgtattttaacactaaattggatcattccacgttcaacagagatgtgggcaaatagtggggggaggttgggggtggagtaggaaaacagtttttttaacttgtaatgatttaactctaaggagaaatttcctactgtttgggaattcattatgatatttaaaaaatagggatttctcaaattatcaacactttctctgtatgattttgcacataggcaatgaaactatagggagggatgacttcaaatgtttccctctttgagaaggtaccacacccatcttatataaaaacatatctcactcatcttataccattctctccagtcactgaaatgcaaatacgagtattcttcagactccagcaccagcagaattgttctgtgtgagcaattcaaaagctgtctgaggcaaaaagatacctgagctaccaaaataaacctgggtagcttatgcatgggtgagtaaccctaggtattcttttttcttaatgcacctgggagagatggattttctttacaacctaattttataaggcataaatttaatt

SEQ ID NO: 30255 - DNA, 1315 bp, Bovine  19866881958819
aatgaatcggcctaaagcatgttgaaatagatggcggcccctctcagagtagaggctttattcctgggtggaagaggtcaaactgtctgttaacaatctagaatgggccatttcagcccacagtaaatacctcaggttctttataaatatttttatttaaatcctgtttacatctgtgtacactttctcccttaatatgaatagttcatgttttaattttttgcctttgcttgaattatcaaacgcttttttctggtagttcctaagaaaagctccatttattaatatttatgccttgatcactaaactttattgccatgagagacagaattcttatgcaaactgcactctataaatttgtacaataaatgaaattcaaacttcaccacacttttctgatggagatttgaggagatccaaagaccacagagaagatagggggtgagatatgaactgtttgcccctagggtcattaagagtccatggcaggatggaagatggaacaaatccttaaaacaagagaagccttgcagctcaattcagaagccctgtcagaagcagcccaaacaataatgagtatctgcaaactctgaggggttctttgtacatcttttacttcatatacacccacacatctctcccgtccctaggggatgccccccaacagcttgggtattggtgggctacttgcctcactcacccagagggcagccctgaccatggatcgtaccacatgtctgttgagtctgaactgggactcttgcctgaggcttgccagactgccaagcactgcaggaaacaccagattctaagcaccatcctgtaggacctgctaaatagacctgccacctctactatcaatcaagctgcaaagctgtccgatgctctgtcgctctttgtgggagacctacagtgtctcagaagcttccttgttgccagcctgaataaagctactaatttggacctaacttatttttcaaaactcctcccagctcttcaactttgatgtcaaactatgttaacaatggctggcttggaaagtccctgtagaatttgtaagaaattaatgttagcttcctctcaacagaaacctagggctttgcaaaacacaccatatgcttgtcactttgccaatgaatcaagatgcttttgcagtcttctgagtctaaataattaatggtaatgtctaaagattaccccaaggttcagagagtaaggatcaggcctttccagtgtccgaagttacccaacctcagcccagtccaatatttcatgtgataaatggtcaggcttcaggaccacacacccccatcca

SEQ ID NO: 30256 - DNA, 3064 bp, Bovine  19866880232908
ctctttgtgaccccatggactatagcctaccaggctcctccatccatgggattttccaggcaagagtactggagtgggttgccatttccttctccagaggatcttcccaacccagggatcaaacccaggtcttccgcactgaaggcagacgctttaccatttgaaccaccagggaagtctatatatacctatcagcaggctgttaattagagaaagaaaatgtctcaaaactcagagtggtcccaggcccctcagccacaacatactctttgagataatattggcacaagatgcgtcatcccaggccataaacaactgacatgaatcttgaagaaaggcaagtttccaagtaaatatatagttccattaacatagattaggagaacgatgtatgagtaaaacatactggtttgttgagcccttatcgaagaaagacagagtctagggtaaatatatagttaattaacatagcttaagaaaaacatttccataagaaaatcccattggttagctcaaggtttgagaaaagttaagttcaggtggaaacaagtgtcctcatggtaacatagaattttaagagaaatctaattttgcatagcgaaggaaaaaatctctgacacttgtttgtttcctcctgccacttaagagagagagaaaaaaaagtctgacacttgaagcctatttcctctgtttgaagaccccttgccttcctgtctgttaccctctcaattctttaccaactgagctccaagggaagccctgctaagtagattttgacatctgcttatttctctatttttcagttgcatagttaatttatttaactgcctcctcattacgagttcttaagaaataatatcaccatttaattgggtaggtttcatagacttggcaaaatccatctatttctattcattattatttggtcttcataatacttttggtaaaattgggctcacattattttaccaacaaagaacctaaaactcagagaaatatatgacttatttcaagtgtgtactgcctttttaaaagctgtaactaaatagaattttcctatttctcgtaggatgatctttctactctacaatatggctactcatgatgatatttctccatgaattgtacaaaataaaagtaaagataagagcaattaccatttttcatcatttgattttggctattagtacaccaatagtttggataatagagtaatcacctaatacatggattattataatttttaaaagtaccaaaaataatctgatggttgtggctagacactagtcagctggtatactagttaagaaacattcacaaacaagactaaagggaaactgaggctggaatactactgaagacacttttcttcaactacttgtcacccaacttcttatcttccccaactgttattctagcattcataattattttgaacactgaagaggggtagatgaggttccttcctgctccatcacagaatgtattttgtccctactaagaagtaagatatgtcagtaacaatttaaaccagtagacctttatttatgccaaatgcattctgacatacaggcttctgtggtggttctatagtaaagaatcaacctgccaagcaggagataggggtttgatcgctgggtcaggaagatcccctggagaaggaaatgactgagaaatcccatggacagaggagcctagcaggctaaatttcatgaggtcaaaaaagagttgggcacaacttagtggttaaagaacaaacaatattttggcatacattatctcatttaatccaaagaaaatctttgtgaaataagtgaagataaaaaccatatttgaaagtgagagaaaccactgaagcttggcaaagtgaaataatttccttaaggtctcacagctcatgtaagaggcaggtgaggaaaaataattcttttttttttttagctccaaattcagcatttttgaatcacatctgtgagaccagataatttatgaccttcccctgaaaatattttttgcttcttctgtcctctcaatagaagtgactaggagctcattgcccctgggatattgattgcataaagattttcttttctctctcaggtggacacaaatggaaagccaagacctcttatacattttcctttcccatcaactaaaatggtattatgtaggctccttttatgagaaaaatgcaagcatgaggccaagtgggataggaaacagattttgtactgtttgaagcctatacgacttgagtggctctttttaagaaaaataattcaaaattatggatacaaattagacattcaagcaaatgtttgtttaaaacaggaagtctcaaacatatcacaaattaaaaaaaacttgacaaactataatatgtggaaaacatatcattagtattcattaacacatgtctaaaatactacattctctggctgaatatctttcccctcttcagatgacaaggattttgtcatatgattttcaataaagaaagaaaaaaatgattgtgaatcttctggaatgttttttctccccactcacaaacttatgaggagccaaacctcatcaagcacattcataatgaaatatgccctctggcctccatcttggatgagtgggcacagtaggtaggatgacccttctacatctgctgctgctgctgctgctaagtcgcttcagtcgtgtccgactctgtgcaaccacatagacggcagcccaccaggctcccccgtccctgggattctccaggcaagaatactagagtgggttgccatttccttctccagtgcatgaaaatgaaaagtgaaagtgaagttactcagttgtacccgactcttagtgaccccatggactgcagcctaccaggctcctctgtccataggattttccaggcaagagtactggagtggggtgccattgccttctccgccttctacatcagaagagtttaaataaagtctagtcagttctcattacaggaggagctcagaaacagtagcctagaaaaccttgcaggtaaccatctaacctaactggggttcagaattgtaaaatgctc

SEQ ID NO: 30257 - DNA, 1055 bp, Bovine  19866880288210
atgcaacaggctgtccaaaggctgggaagaattttttttttttgagaaaccagagcttggaaaagcatccacatatatttgggaatttagaaacccaaatatttgtccaaggaaggtcagatgctcagaaaagaccatagaatgctctaagcttttacctctggctgacctctagtctcagtgcaagcaggaagtgaagtctaattcagagttgtaaacagcctagctgagtttgagggagtgactcatcacggagtcaatctctaaaaactgggagggttttgtgtgtgtgtgtgtgtgtgtgtgtgtgtgtgttttagctcctggtgaacatggaaattgctatcaaaatactagctgaacacaagacaaaagaacaaagacttaaatctcaacacattgaaatatattacttcatattcatttggaatcgtaaggggccctgaatagccaaaacaatctcaaaaaagagagtaaagttgaacaactcacatttcccaattttaaaacttcaacagagctatagtaatcaaaacagtgtggtattagcataagcctagaagtatagacggagaaggcaatggcaccccactccagtactcttgcctggaaaatcccatggatggaggagcctggtaggctgtagtccatggggtcgaagatagtcagacacgactgagcgacttccctttcacttttcactttcatgcattggagaaggaaatggcaacccactccagtgttcttgcctggagaatcccagggacgggggagcctggtgggctgccgtctatggggtcgcacagagtctgacaggactgaaagcgacttagcagcagcagtggaagtatagacagacggagtagaattgagtgtttaaaaattaaacccatacatctatgaccaatagattttcagcaatgtgccaaggccattcagggggtgaagactcatctttttaatatatgatgcagacaactgcatatccacattcataaaatgaagttggattcctacctataaatacaaattcacaatgggatcagtgacctaaa

SEQ ID NO: 30258 - DNA, 3167 bp, Bovine  19866880637871
tggatatggaaattgctgtcaatctctggtggatgtttaaagtaaagtgctttctgccttccatggggaaattttattctactgggaaaagataaaactattctacagagggtgatagtaatgaggcagccacagaattgggtcttagaaacattgcaaagtaacctgtgacttggtttcccactatctgatttagtcccttatggaagtaaagtggtcataactcgtattgttgttaaagaaattttgaagctatgttttgttattcacaatcagataacctctaaagaaagtacttgggtcaaaatgggaaattgactatacctttctggaccactgcatagaggagtgagggtcacctgtgggtagtgtgaattttagagctggctgtatgcatgtgctgtttcaaggcagaggaagctagaggaaagccagagggagtggccaacagatgatagaaaggaccactgattggccaagtggatatcaaaaaacttggggaaattgtcaaatgccgttctttactaagtcatagtaaataatctgcaccctctctttcattttcccatgaaatgttcagaaaacctataatattcactaaactttggatgagtgtgctttttttttttttttaataatcagtgtacaggatgaatatattgggtggcaagattgatatctggtttgactaaatgcagcagttgggcccagactgggatttcaaatatgctgggctattgtttcagctttcatttgaagaaaagttttcataaaaatttcataaaacaggcataataaaaagagccttgaataaagaattgaaaggtatgggctaacattcaagaaccctcacctcttcattatgtctcatgtcatattactgatagagtactcctgaaagatattagaaggttttatgagttcaaatattaccaagagaataaaaagagtttataaaccataaagagctccaaaggttaaaggcagtgttttggttcacagtctagattatgagctccttttctttgcttttgtttcttaatatctagcacagcaatcataataacttaggaggtactcataaattgattgttgaagaaatcaatgtaggcttcaggatcgcatatgtattttatgtacatataaataaattggtctcaaaccattcattgacaaagagaatacaaactgtccttgtgtacttgggaacaaaggacaggaaatagcaatggaattgatttaagttaaagtcacatccaaatagaatggtagcaggggaagttgaataccccttccctagagagtctaaagagattgaattttgttctccttggagcaatttaagtctaatcttgatgaacttgaagatctctcagcatcttttctatctgtttaatcttaggattaaaatgaatctgaaatctttacggctgggatggcaattgatgtcttctgtgtgggcttagataactctgattcagtggggagtgtccaacaaatgcactgcagcatatatgtcacttggttggtttctcagttgactattttgagcatatttatcataagcatttctaatacataattccaaaaagcttaatacaatctgtaggcctttttaccatcaatgagtcacactgagcatgttcctttggcctttgatgtcagtgacagagagtgtgacttagtgctcttgtgactaattttgtgtaggttgcttctatatatggaacaacatgaataaatcactccctgtatttcagtggctttacataaatacataaacagtgcatcctggtttctgactgtgatagtttttaaagtgatggtaacatgtagaccagaatatatagcatctacacaagtttacttcttagttttccttgctcttagaactgctttcaggttgggataaggccctgcattttagagggccttgtgtatcatggaaacacacacagagtacatttatctaaaaaagtgtggttatttctgtcacctgggatgtaggactcatactggcacagttcatactgaaacaatgagcatccattctcgtgaccagtaccatttaggcctcagaaaactacttctccatatcttgtcctatattttcaaaatagacggttgtcaactccaagtgctataaagatttgtgagacatgatactgctggtgtcacagatggtctgtgctttagaaatcagagagaatttgagggcaaacttacatagataaaagaaaagacaagtaatttgtgtcagtctgggtttaatcaggaaacagaaccatttctaggtattatgagaaaaaacatcagtgaaaggaattaaggttgccatgattgtgggaagagctgagacagtggatgttggaagtctggagcttgaaggtcaggaaaatagtcattaagaacgagctggaggctctaagacatactattcttaaaggactgattgggaattgctgcaatctcagtagctctaagaaagcgtctaacaaccagcagacagcaacaatgcggatgcacctggtatgcctgggaagtcggtggatattctccttgtacccatgaatcttggtaccataaacccacaagaataatgacttcttttccattctgcctacaaaatatcacatgagtttctttcaccatctatctctcattcagaaccatacaaagctgagacttctaaaatatattgttcctggctactactctgcattgcataggagaggaataggggcagtgctgagctgacaaatggtagttcaatacaatcaccctttcatcaacgcaacatccaggtgcaacatttcttcttaaaattttaagttctgaataaagacaaatgtaacgccttgctttcaactactgtgaggcaacttacattaattcatgtacagacacatttattttccccaaagataaggcaggaaggctcatttgccactctatccatttctgataatccatgacttggatattaaaatacagagttgaccaccatgagcatatttttaatttcataattgagaatatatgagaaacttatacttatttataaacttaaactaaacttaaacttatttatacaaatacatatgtgtgtgtatgtgtgtgtgtgtgtgtatatatatatatatatatatatatatcaaagaataaag

SEQ ID NO: 30259 - DNA, 1945 bp, Bovine  19866880702899
atgagcgggatgcaggggttcctgaggaaggccagtgggcacctgtggtgggagaaagaaaaggcagtggcgggcagctcaggtggcaagaccagcacctgccttgttcaggtactaagccactattaagcgccacctgtatgcgggcctccgaggatggctgcgtccctgacttgtaggtgtcagtgatggagaagcagggcttgaggggggccccaaaaaggggaggcgatgtgctcaaggacccagacccccagccacagcgagcgtggggtgggggcagggagatcatgcctccaacgggtgaagttcccgccccgcctgcctcccaagatcccaatctatcacccctcgaatgtccccaggacccagtcctccaacagacgaacgcctcgggcgagccaggggccacccaggtcacagggaaggggacccggataagtgaggggaggaccaggtgatgtccagactggggccgcccatacggcagcctcaggctatacgtggccctggactcggcatggggctagtgggacttcaaaatgttgtttaaattttatttcacttcaataaatttaaattttaaaacccaaataatgtcatggatttctttagactcaactactttggcaggatgttgaacatggaacatccgaaccgagaagtgctatctgtaaaaacaacagagggttttggagaattaagggtgtgcaaaagaatgcaagacattttgctaatgatttttatattgatgatgcgctaaaatagtattttggatgtgtgcatgttaagtcgcttcagtcaagtctgactctgcaaccccatggactgtagtccgccatactcctctgtctatggggattctccaggcaagaatattggagtgggttggcaattcattctccagggaatcttcttgacccaaggattgaaccctgtcctgggggtttcccaggtggcgatagtgataaataacctgcctgcaaatgaaggagatgtaagagatgcaggtttaaaccctgggttgggaagatcccctggaggagggggtgacaacccacttgggtattcttacccagggaatcccacggacagaggagcctggtaggctacagcccatggggtcacaaagagttggacacgactaaagtgacttttcattctgttcatactgctcatggggttctcaaggcaagaatactgaagtggtttgccattcccttctccagtggaccacattctgtcagatctctccaccatgacccacccgtcttgggtggccccacacggcatgtgttagtttcattgagttagacaaggctgtggtccgtgtgattatattgactagtttcctgtgattatggttttagtgtgtctgccctccgatgccctcttgcaacacttactgtcttacttgggtttctcttaccttggacatggggtatctcttcacggctgctccagcaaagcgcagccgctgctccttaccttggaccaggggtatctccttatcaccaccccttctgaccttgaaagtggagtagctcctcttggccctcctgtgctggtgcagctaccactccttgtattaacattaatgatatcaatcccataacatataattgaactattcatgatgcattaatcttctctttagattactaggggtttcccttgtggttcagctggtaaagaatctgcctgcaatgcgggagacctgggtttaatccctgagttgggaagattctctggagaaggggatggctacccactccagtatcctggcctggagaatttcatggactgtatatactctatggggtcacaaagactcagacacgactgaacaactttcactttcactttgggattagtagaaattgatgattcatctgaaagaaaatcaaacttttattacatcaggtcttcaaaaaaaaatcataga

SEQ ID NO: 30260 - DNA, 1248 bp, Bovine  19866880941731
taccctataagataaagaattactgaagctgtcattcaaaatgattcaaatctcttaagagttatatctccaaagtcttataattatttactcagttccctcgatcttttatccaagtatggttttacctcaagagcacattcatctctctagtcagtggaaatatttattcctctttatatattattaaattaacttcatgacttagaaataagtgtctcatgaatcttgttatcatgaattaataagaattctgtacatttgtataatgctttacagtgttcttccacataaattatcttgtttagtttccatagatagcatattcaaaagcagagatattactttgccaacaaaggttcgtctagtcaaggctatggtttttcctgtggtcatgtatggatgtgagagttggactgtgaagaaggctgagcgccgaagaattgatgcttttgaactgtggtgttggagaagactcttgagagtcccttgggctgcaaggagatccaaccagtccattctgaaggagatcagccctgggatttctttggaaggaatgatgctaaagctgaaactccagtactttggccacctcatgcaaagagttgactcattggaaaagactctgatgctgggagggattgggggcaggaggagaaggggacgacagagaaggggacaactcgcagatgaactctgggagttggtgatggacaaggaggcctggcgtgctgtgattcatgggctcgcaaagagtcggacatgactgagtgactgatctgatctgatctgatagtatgttagggaaagctgatattaataccccaatattaactctgaggaattgaaaacttaggaaaacataaatcactttcttgagttcatatggctgtggattgttgacctggacttagatttaatccagctttttctttcccttagctggaatgatggtgaattcactaaggtgcaggattctgtgagatctagccccaaactatcatccaggtagcctcaaccatttattagaatttttttgtgtgcccagtggtttagaacttgggtgtgatagcacattagagatgaatgagattggtgtatataactaagaagcgggaaactttggtggactttgaaggaggaatgtagttttaatgggtggagacaagaattatgtcttactgggttaagggcagcaggaacaaagatactaagagaaggagaagttggaaaatattgagaagaggg

SEQ ID NO: 30261 - DNA, 933 bp, Bovine  19866880948981
accaggattttgatttgtaaaccaaaacatgtcaccccaaaataatgcttctttgacataaagataatgttgagttgattatttcaagaaatagctggcacaggacaagctcttaggaaagaaaatgagtttcccttttgtaaaggaaatttacattttgtaaaggaaatctctctttgtacccggaagagaaggataactcttcttcacaagagactcatcaatggagaaagtaccactccaatctgcacaacaaattgtactcttttttgctatgcttctcctggttaccttcccataatttgcctcttcttgtccagaagtccactgccccctcttttttagcctaaaatggtataagcgtctcagtctgaaacatccctttaaactgtttatgactgaatttctcccatgtatatgtaaatagaaatacatatctcaaaattttgctgtctgttgctaatctcttttgttacaaaagcccagttgaaaatgtagacatctaaataaaaaatacttttcctctcctacagactcaaccaggaacttctgcttgtgtctaccttagtgcccattggtgagacatgtttcttctaaggcactttgcctggaccattgtttaaacttctgactcaaagtgcagacttatctgtgccttcattgaagctactttgtatgtgatttctacgtaacatttaagaacagttcatcccgccctgggattggtgcatcccagccgtccttagtctttctccatattgtactttcatcctggtactgtcctacttagcctctccaatctgaatgtgccactattcaccaattttcaaatttctagaaaccaagtattcacggaatatcccctcctcatagctctagctcgaggataccatttccccagaagctttgtgttaacattgttattttcaaaac

SEQ ID NO: 30262 - DNA, 1085 bp, Bovine  19866881220696
agcaggtccctctagaataagcttgcttccactctccaaggctagtatacaccctcttaacactcacttaataagagtaactatattacatgaagcagttcttagtgccaagtttcaagccatgggctatatgaaaagaaagttactaagacaacccattgtgatttcccaatctccccagataggtttatcaggataacagagactataagagagaggcttgggatcattttgttccctcaacaaaccactgggagagcatttctgagtgtacaaaggacatctgagctaattacagagttaaatagaaagtagctacagctaatggtaaaactaatgaattatgaagtcatttcaccatcatttctttcaggtttaaaatgaagaaggtgggctaggtcatctctgaggcctccttaagctctaaaaatctatgtctgtagagagtacctccatttaaactgacattttatgttaaacatacaaaaacttattgacatacaaacaaacatataaaaactaagaatgcattctgtaagtaccagtatagcatcagtatggctaaagcctgaacttttaaaggaaaatagaaagcagacgcttaagaatagagaagccataacttaataatttgtgcagtacctatgagttttgaatgataaggcacttgaatccacaaagcatttgacaaattccagttcataaccatttgtttatcagcatatttgcagatccccaagtgtggtggagtttgtaaatgtagtattatataggaatgcagtatgtattattattcaggaaatgataccatggaataagaaattttacaaaatttatttcatcatttcaaaatttatggtcataaaggcaatttgacaatgtcagcagggtgaggaacacagtgctccatctccctggtcataaccaaatggccccaatttccagtcattcatgttttctggaacatgggtctccatttcaaaatgtcctaatagttatgaatgacttgtttccaatataaatactaatgtgtttttctatcagattagctcattatggaataatgtacatcaatttcatgcgta

SEQ ID NO: 30263 - DNA, 1103 bp, Bovine  19866881244044
attatatctctttaatagaaaggaaaagtaccctaaagaatcctcccctgcagaaacctttcattgcttcaagatcctttagaattatggtgtctccaaagtgatttattattagatgtactgaaccacgtaaatcaatgttatcttgaagttcaaacagatcaggtaagaggaaccactaaataacatcaaagctgttgtaaagaacaactcaggaggatgataaaaggagtcctgagatttgatccatgtgtataaacaatactgtgcctgctccttctaattataaatacacaaaatttgattaatcataatgtgaagttttctcaagggaaaaacttactccactaactcaactattacatgtttcttgtcattttaacatgacagagcatccttatagctctgagaataagaaacactttggcatatggatctgagaatgaattattttttttttttgtatatacaaagctctgaaaaagccatgtgaaggctgaatgatgtgctgagtggttttaaaatatttcatcaagaatctttgaatttttcaagaaaagaaaatactgtttaccgttataaggaaagttgacagaaataacactcaaatatgaacaaattgagttccaatttatctgaactgattttttaaaaataatttcagacctacaagggcatttcttttatacatctctgattaagatattgaacaaaacatgtttttgttttttttcaacatctgggttctagtgtcagagaagtgagtgacgttttctgactgcctctctgacttccttttcacaagactcagagctcttgctgttgacattgaatgaagtgcagagcaaaagagacatgaaaaaactctcttcaaaaagtttaactattagtattcctcacaataattcaatccttacaatcagccaagtcttcaaatagatatactgtctgatattattcatctccatcttcttcacagttgagctaaccattttacaatgtaggtttcagaagtcaaatagaagcatacatgtcttaggcttttaaaaaatatattaagtcctcctcccaatagaaagttgtccctggtaaacttgaaaagg

SEQ ID NO: 30264 - DNA, 1502 bp, Bovine  19866881264596
taaatgaggggttgggataagaatggttgtggagaatcagagaatgaaagtgggtacaaagagaaaaaagattgaggaactgctgagacccagaaataaaccatttacctttcaagtggaaattgagcgaggtaaaccccacagggagacagcacgctgcacatttaaagtgaagagcagcggtggttaatggacagaatgactcacctgatgtatttttccagcaaacggaatttctgaatcaagcatcttttgttatgagcatcaagagaatacaaagacagtctaaatccaacaaaggaaatcattgattcaaaaagaatagatgaaaacttattgataacaagccccagagcaattcaacctcaaaaatatttggctgtatatactaaatgtggctcagctccttagggaatatcatgcccaaagactcatcccaggattttatcattagcaaatgctctttaattagaatgacttttatttgtactgaggtcacagttataaaaatgtattctccctagggggaaaaaatgtattgaagggctactcctagtattcagtcatgtgtttggaagttttgcttacatctaatattcaactcagcagcttccagatgtgtcatgttgctttgattttatcgatccttgttacccaagggcatttgggcaaactaaatctcaatctactgtaatcgagagaaattagggtctttgtcagcaatggtaaagaatcctccagctaagcaggagatacaggttcaatccctggattgggaagatctcctggagtaggaaagggcaacccactccagtatttttgcctgggaaatctcaaggacagaagggcctggtgggccacagcccattggtcacaaaagagtcaaacacaacttagcgactaaacgacaacaacaaaacaaaaggtctttatagtactgatgagtttcaagttaatttgagacagtggataattttcatggtttcagctgaacattacctcatgcttcatctagacctttacaatacagtgaaggttttcagactttgagaaacacaatatgtgtggattcaagttacatctttctccttttcctccttttatctatcagccttgagtttaaaaaaaaaaatgatcattttctgaagggcaatggagggggcatgtaggagagcacacataatcacaaaagaaagaacacttaagtagggatagttactctaacttccctggtggctcagatggtaaaccgtctgcctataatgcaggagacccagattggatccctgggtccagaagaccctctggagaaggaaatggcaacccattctagtactcttgcctggaaaatcccatggatggaggagcatagtaggctacagtccgtggggtcgcaaagagtcggacacgactgaatgacttcactttcactttcactctctctctaacagaagaaaaaagttccacagtttgtgctaagattgcttatgctgccatgttta

SEQ ID NO: 30265 - DNA, 2196 bp, Bovine  19866881363758
aatggttgagccagaacagtggttctcaacgatgaatatacagcgatatcactaggcacctaaaccacttcatgctgggacctcaggccccccagactatgagctaattgattcggtgggctcagacaccatgtggtttttaaaaatctccctaaatgagttaaatatacagtcaggactgagaatcactgccctggaggggaaataaggttagtgttccctgacactgggttatcaaatgcagcagattcttctatgaaagatcattccttaaagaacagagaatcagcaaagacattgtacttatgaaaatattctagcttaggggattttatgttcaaatatgggccctgtatctcaatcaatttgttcacagaaggtttgctgctgctgctgctaagtcgcttcagttgtgtccgactctgtgcgaccccatagagagcagcccaccaggctccccgtccccgagattctccaggcaagaatactggagtgggttgccatttccttctccaatgcatgaaagtgaaaagtgaaagaagtcactcagtcgtgtctgactcttagcgaccccatggactgcagcctaccaggctcctccatccacaggattttccaggcaagagtactggagtagggtgccattcacagaaggtttaggttgtccataattagatattcagaaaagaaagaaacaaggagttctcaagaggtcttctttgcctatttccagtaagcaggggttccctaataaaagatgtagactctataggattccttccccttgctgtgaagtagattattgttcagaggtattcacttctctccagtatctccatagccttaaagcacttttcttaatcttgccttcagccttagccacatgactctgccagtggaatgtgagcaagcaaaacatggtaaggtttggcatgtgcttgagaaatggaacttcatttaatccaccagggacatgataaaactgtcttgattatctttctggcccaaggaggataagagacacactgagtagagcagactccacccacccacagacctgcagttgcatcctctcagctcctgggacctgaagcagagctcctaggaaatcaatctgaagatggacaagctaaataaatgcttactttgtatgtggcttttactttttggtcatttgatatgtagtcatactgtggccaaagctatctcatatatttgctttccatgtcttcattaacttaaaatgtgctcccatccctaacatgtttttccaaattagctcaaaatctgcttgtttaaaagcatgttcctgtaacatgtgggaggtgattttattatctcctttcctcatcatccctgcaaacaaatatggtattaggttttatgttttggaggatgttccatgaaacacttccatcaacagaaaggactctagtccaggattgaggtcaaggtcttaccaaccaattgctgggttcatcacagaactatcctaagagtctaaatttagaagcaatcaatgtgactaccgttaggacaatacttaagtaatatttgtaattttcataaaataaactgttatctcacattttaaaaatactttaagaaatataagcaggaggcagtctatatcaacaaagcaagatatcaaactgccaataaggtacggtttcaatggtataaaataaaataaatatataaagtctataagtataccaaaatgttagtggagattatccctgaacaagggcattaagagtgattattttcttttttaaagcctttcctgtactttctaaattttctttaatgaacaagttttaacttcaggaaaaaacaactctaaaaagggtaagaaagaaaacagtccctgagggactcatagctctgaataacacataattcaaaaggggaaacagttgacaaatacaacttattcagctagcaaaatgacataaaactgacctgtcagttagtgacagtcctctacttgtaaggatccctgatttcttcttgggtctctctttctgcatggctactgctagaaataagtttgtttggtctctcaaatcctgcacagttctatatactgagttgccttctccttagaataagaagctgttcaatacaaacaaataaggtgttttatttgtatttgtcttcatttaacttttccagttccactaaaccgcatga

SEQ ID NO: 30266 - DNA, 1273 bp, Bovine  19866881392774
tatgtacgtatgtatgtattctaacaggattcgggtagtttcttgtaaaggaaatgatatatgtctttattggtctagacagcaattaaagtcttcttcaaaactgaaaagacttttacagctaaaatttcctctgtgcccgtgtattaggggaaaacagatatcttatttattcacttttcctattctctttctccaccttttcctcttagaaaatttatctctgtccccattagtgattctctctccttctgcagaggactttcttaagttgtcagcagaccaagaacagcattaacgacttgatcagagaattaagaaggccataactaccctagtgtgaaagattaggggtgtgagaactgagaaggaacccaccaacctctctgcaacttctcaagagagcccagccttggaattcaggccatcaccctgtcactctgtctcaagcaacagagtatttgactcaactcagcaaacttttgtcgagtgcttgctacacatacctactctatccctcttactcttccctcccaatttaccagtaaaaatcgactcaaaataatatgtgtagtattgggtgttaatataggatacgcacacacacacaaaacatagtgcctggtgttaagatttcacatttctgccataaaaatgtgacatagtatacctttgtgggtccatctgtttagcagcaaatgaaggtatatgctatggataacactgaatttcacagggagcttcttcaatcaaggagaaaggtacattgtcactgggtgctcattttacttcagatttgtgtgtgctgtagtttgctaagattttaactcaacagtgataactataagaagtccctgataataatggcagtatttaagtcatctcactccacatgcaaaagcaatcttgtaggaaatgagacacagtattgtaattagaaatagatcgagtcaataaatattaaaaagtaagtatatatatatattcatttagccattttttcctcagtagtacctgcaatacaggctcatcctaacatctgacccatgaaattaagatgataaggagttattgaaagagaatatggagagaatttaaaagtcatggctttttgaaattccagtgtgatttttacagttgcaagttgatgcttcttcccctccccgcacctaaacggtaaacaagaaataactggcagaggacaaatgaatgcatttcagtgagtcccatttataactctatgagttacattttgttattttgatagactcaa

SEQ ID NO: 30267 - DNA, 838 bp, Bovine  19866881450055
aattaatacgcagtcctttccatctatagttagtgttctaaaactgtgtgtgtgtgtctaaagatagaaattcaataaaagatatcaggttcacaaacattgagaggagaactcatattcaggcaatttgtcagaaagtgttccaagagtaaccaataagagaatgaggagaggaaagcaggatagggaagatgaagaagccatacaagggtatgattcaatgtgaagtcctaacctcactttcactatgagcatcagcctcagtctgctagagctaaaagctctagactataaattatacatcacagtttgtcccagctggaggtaaaggagctagactttaatcaataattggctaagggccactccagaaggatgtgaactcctaggtactttcagttctgtgtgaactgttaatgcagttctagtggccagagagcaagtttccaagagaatcctgacataaaccactagaagttcacacaacttgggagggtagttagaagattctgaggcaatttggacagaggacaaataattgaaaagataatgagaattacagttacaaaggaatgacaaaatgctattaccattgcagatggtttgtttattaaggatatgttagtatacaaataatgctttacttgtctgaggatactacaattaaagtgtgaggactgaaatagaaatgggaatttcaaggttacaactaccgagaaatccaaattaatacatacctaggctcttgcaggtattgtagaacagaagtggtaagagtcgccatcactgccttgtttacatttttagaggaaaagatagagtgaaatttaaatcacag

SEQ ID NO: 30268 - DNA, 868 bp, Bovine  19866881502596
cttgttgacttgaattcaattatattcatttttgacagtgtaattgatatcagagttaactctaaatgatctgctaaagtttcttttgtcttcctagttttaatggagctatttaaaagagcaaggcaattgttatctctgttatccttaaacaaaaaagtatttggtttaaatttattcgaactagagaatagaatactaattatcattcaccatgtttaaaaagatcctattaggtggtccacattaaagattctctgctaagcctttagtttctagaggtccaccccttgctaataagtgacctcaaccaaaggaatgcctccttataaaaggattgtaacctgctgtatcatcttcatgactggcttatggatatctctttctttcatagcaactagaattccttatcctatgaacattttgatactgaatgtaggcacggctttgctatcagttgtaagatggagtaaagttccaggtgagagcttttaagttctcttgtctcacagaaattttaaagcatatctttcttcttgaggtcagtcacactgccaaacattctacctcaatttctttttcttttcagagctactttttccagaaaattgccttgtggaaaaggagctgcctttcaaaactggtgtgaggggcatgaaagctatactattcatactaatgatggaccattggaagagtacatgctcacagactttctcctgtaatcttgaggaaggtgtattttccatcagttttcacttttaccagcccttgctctctggtgagttactttttaatgttctgactacgctaccctggttgctagtatccccatccagggcttcacaaagaccatgtgttttatggt

SEQ ID NO: 30269 - DNA, 719 bp, Bovine  19866881692619
actcaggctgctgctcatgatggaacactcaaactctgcctttcccactttgcctgcccacatctcgtattaccctctttgactgtctttgctggtttttcatatttaagtttactgtcacttcctcctaggcttgtctgatgtcccatgtcttggttggctttctctattatgtgctcctgagcttgcctttctataaagttatcatgatgcacaagcatctctgacccctattatctgggagctccataacaaaaagccctggttggttaggtcactaatgaatttccagacctagcacaggaagtgacaaatactagaggcttaataaatattaattgaatgatcaagataatgaattaaatgagttatacaatccaaataataactaatagtaacaaaagtagctaacattttcatagtgcttactatgtgtgagccatagttccaggtatttgagtaccaagtactatttcagtcacttaattgttctaacattttcataattaggtaataacatgttttgttttcattttacaaaagaataaaccaaaagatgatgaaatagtgatttaaaccagtggttagcaatctactacctttgagccaaatctggccaactgcctggttttgtaaataaagttttattggtacacagccacgcctatttgtttatgcatcttctatggctgcttttcctctgtgatcaaagagttatg

SEQ ID NO: 30270 - DNA, 897 bp, Bovine  19866881881806
tttctatttgccccagaagcagccaaatacaggcactatttaacaccaataatggctgtgtttctctgaatttgcatttagtcaattgctagcaaaccaaatcatatttgtagtacatggaagtaggatgtggaggtggtgtgctctttaaataaagctttttaagaatttaacaactaacaccctaatacacctacttttatacattgggctttttaataatgggttttagtaaaagtatttcaagttttacaaatgaagtcatatttcaaatgtactacaagagctttcttttaaaaactgttactttatcttgaatccttctatggatatgttttctgattcatttcatttttttatacttttgatagattcgaatttttataaatcagatttagtttttcttaaagtaggacacagctggattactctttatcctacagatgcatgctgctaagtcgcttcagtcatgtctgactcttttcggccccatagacggcagcccacgaggctcccctgtccctgggattctccaggcaagaacactggagtgggttgccatttccttctccaatgcatgaaagtgaaaagtgaaagtgaagtcgctcagtcctgtccgacttttatcgaccccatggactatagcccaccaggccctccgtccatgggattttccaggcaagagtactggagtggggtgccataacatagggtaattagttaatatccacagctttctgatgagatgaataaaacacgaagctctatatactatcagtctcctctctcaccttttcttctcacatgccggcaagttttttgtggttgaaaattggcagggaaatgttgcaggttaatttcctctatctcaagatagaggctctctttaagatacat

SEQ ID NO: 30271 - DNA, 3285 bp, Bovine  19866880388599
aatggatggtgatgatggttgcacaaaagcatgaacgtgcttaaggccactgaagtgtacactttaaaatacttaaaatggtgaatttaatgtcatgaatttcaccacacacatacacaagcagcacaggcttttctatcacaatgaggccgggaagttaaaattaagaatcctttgccattccaggataaagaagttgtggtacatagacatacaatggaatattactcagccattaaaaggagcaactttgagtcagttgatgtgaggtggatgaaactagagcctgtttacagagtgatgtaagtcaggaggaggaaaacaatgattaaatattaatgcatagaggatagaatctagaaaaatggtactgatgaatctatttgcagggtaggaatagagatgcggcacacacagagaatggacttatggacacagagtgggaaggagagggtgtgaggaagtgagacagccacgtcgacatgtacacattaccacgtgtggaacagatagctggtgggaagcttctgtaatacgctgggggctcggctcagtgctctgggacgacccagagttgtgcgatggtggtggggtgggcgggaggctcaacagggaggggatatatgtatacttacgactgattctgttggcagaaaccaacacaccattgcaaagcaactattttccaattaaaaataaatgaaaaaaaaataaggtgaataggaagaaatcacaaaaaagagaatcctttgctgttccacatggctttcctttctgctcttttacccagtgtatcctgcacgcttcctccgggcattgccaccccaaggcacccttttagataaggatgcagctgagcggggtgcctgggctgggaggcagaaaggttcagctggaggagctgtggagggatttcctgtcaagccacaatcacgccactgctgccgtcccatcctctacaccctctgttcgctttgccgtgtgaggacaggcgggctcgggggagttgagcaccagacccgcctaggtcctagggaccactcttggctcagccttctccccatcactaagctcccgcgtctgacattaagcagccaggatgactgacccagggcatctcaccctcacctccttggagggttaggggaagtgagagcctacagccttcctcctgggagacaaaatccggtggccgtgggagttgaagggtcaagaaggaagagaagggcaggttcccagggacctgctgttcccccagcagccatctgctgctgcctggggtcagagccacattttcctacacgcttctcgcttctcgcaactcaaatgttgcccttgaatcaagattgtggttaaatagcgctaaataattaatcgcactcttgaactggtgttctcggcctgcttatgcttttctggttgcttctgctggtctctctttttaattcagaagtggtattaataatttatgagcacgtccgtggtcacatatacccaggacccgccgtcactctgcgagtcagaatcaatactggggaagttacagcctccaacctcaggctgtctctttcctgctctttttggaacagaaatgagggtcaagtctatgtatagagagctggcctggatcaggctcaagagctttttattctgttcaacgacgttgacaggcgctgggtcctgacagactttaaatagatgtacgttctgtgacaaagagcacccagggagagaaattagaaaatggaaaatggagcactgctttttattcagccaggacttcaaaaaagggggagaaggggtatctgataagctgattccaggaggcagagttgcaggaggagaaggctctggaaggtttgggatccttattaaggaagtaagcggcccccaccaaaatgggaaacagaagcaggactgggacctggtgtaggagatctctgcggtgcatttcaggctggcggataaaggatgtcctaaaggaaccaagagggaaattgagcacaaagaatgtccctgggcttgcctgtggctcagtggtaaagaatccgtctgccaatgtggtagatgcaggagatgtgtgttcgattcctgggtcagtaagatccgctggagaaggaaatggcatcccactccagtattcttgcctggaaaattccatgggcagaggagcctggtacactacagtccgtggtgttccaaagagtcagacacaacttagctactaaacaacagcagcagactgtcctcgattacaaaatgtctgcagaggacaaacgagaacactctaaatataggactgctctagaaggggatcagggatgagggcggggtaggtgggagattcatttttactgaatatgttccagaatcttaaaaaattttgccatttgtaagtattcttctttggaggaatcaggaaacgaatccatgaggacatcaactggaggcaggttcaaagaggcttatttgtggtgaacaaaaagaaatcagaaacacatagactgagagggcttttttcctggtttgtaaatatttttattaggtcctgtaagtactcttgcctggaaaatcccatggacagaggagcctggtaggctgctgtctatggggtcgcatagagtcagacgtgactgagtgacttcactttcacttttcatgcattggagaaggaaatggcaacccactccagtgttcttgcctggagaatcccagggacgggggagcctggtgggctgccgtctctggggtcgcacagagtcggacacgactgaagtcgccttggcagcagcagcaggagcaaagacgtaaaacgcagttaaatgaggttgcactatgcaaaatgactttattggtattcaataggtcagatatggtataatattggcaattttacacaggttaatccagaacttttcaaccttggcactattgacgttttgataattgtatggtggtggtcggggggatgttttgtgggttataggttgtttagcagcatcatttgtctctattcaccagatgccaacagcacctcctcaagttgtgacaatctttgattttcatgtctccagcaggagtagcaacataattttggggttcagtgcaaaataaaaatgccccttatataaaaattattaagaatttcaagagagtgacagcagaaaattaaatgaagcatggggcctggggcccttctaagagtggtaccccattccactatacaatttacaggcccacaaagctgatcttggtctccagaagctgcccaatgtgggaaccaac

SEQ ID NO: 30272 - DNA, 2341 bp, Bovine  19866880569481
catgaagtgatgggctggatgtcatgatcttagttttctgaatgttgagttttaagccaactttttcactatcctctttcactttcatcaaggggttctttagttcttcttcgctttctgccataagtgtggtgtcatctgcatatctgaggttattgacatttctcccagcaatcatgattccagcttgtgcttcatccagcccaggatttctcatgatgtactctgaatataagttaaataagcagagtaacaatatgtagctttgacatactcctttcccaatttggaaccaatctgttgttccatgtccagttctaagtgttgcttcctgacctgcatacagatttctaggaggcaggtaaagcagataagataaggtggtctggtattcccatctcttttgtttgttgtgatccacacagtcaaaggctttggtgtagtcaataaagcaaaagtagatgtttttctggaagtctcttgctttttgatgatccagtggatgttggcaatttgatcatatataatatataatgtttgcacaatgtgtgcatatatgatatataatgtgtacatgatcagcagtgtctgttgaccccatgggctctcaccctctggggttctctatccgtgggattctccaggcaaaaatactggagtgggttgccatgccctcctctaggcggtcttcctgacccagggacagaacccaggtctcctgcactgcaggcagacgctttaccgccgagtcgccaggaaagccgtggaggggcacacacacacgtgaaccactgtcgtcactcacaatggctgcaatgttggccccagcccagctcagaggggcgtggcagccggatctcgggtggatgggtgagctcggggctgtgagcgtgtcccggacaggctccctttgggccttgcgtgaattcagtccctgctcatgactgtcttcgtggcaggcgtgacagccatgaggcttggcacagggaaccagggccggacccacagggtctggctcccacaagatgttctggtggatgccatctccgagtcaggacggctggtgttccagagctggggaacctgggctcccaggacactgcaaggggtcctcattgcgaaagtctgccagaggggaaagactcgctcatttttccgatggtgttacaccaaatgtaggtgcaatgtgctctgagcaaaatgatcctttctgtcagacagggacttgttagctgatagaggaggccgccttccctcctctgttttccctgtcgtgggctcagccttagaatcctgccctgccccgtaatttggaagaacagcagtaacaatgacaaccaatgccagtcgtatccgcagggagagtcctaggaggtgaactataattatctaaatttgactccgagggggattttgaggtttacaaccccgtattctctgccacagaaagcactgctgctaatgtctctttttgctgagggtgtggcttgcagcaaagtgccccatggccaatttcaggtgattcccagaactgtgctgtttgccaaaacccactcagagagttcattgtatctcagggtggtggtgtttgggagggctacttctagaaacttcttagagttgccatgcttcgtgaaggaaagtttaagctttctcccaaattacgtttccatcaagaagcatctagttcttgcactctcttacacttaatcacaccagctttcccatgaggggtgtgggtgtgtgtcctacttagtggcatgcatacgtgctaagttgcttcagtcatgtccaactgtttgtgaccccggggactggagcccccaacttctctgtccatgggattctcctggcaagaataatggagtggattgccattcccttctccagagtaaagtgacttttaaaaatggcttttatgttccttcacaagagttcctgctaccttaggaccagaggagacccaggacaccaagggtaattggggcagcctcaccagctaagtgcctccctcctgcttctaaggcttccacattctagatctgcatctcagcaaaattacaggtaacggccagaaacaagggttgaatttgggtgtcatggtcaggcaggcttgcatttaaatctaggctttgccttgttgctagtgcagctatgtgtgcatgacctaaccaccgaacagtaaattctctgcagcacaaaggacttgcccaaacgccacagctaggaaacttcagcccagcttcaatctgtgttagatcgccttaaggtgacccctgccctggaactgaattcttgctcaagtaagtgcaatgttgtcaaattgcaaaatccacattgt

SEQ ID NO: 30273 - DNA, 2869 bp, Bovine  19866880605872
cctgcagtgtgtgagacttgagtttgattcctgggttgggaagatccccggagaagggaaggctacccactccagtattctgtcctggagaattccatggactgtatagtccatggggtcacaaagaatctgacacaactgagtggctttcactttcacacctacccccccgccccccccaaaaaaagacatttcttactgaagcatgtaatatgtaccagttgtggacacttttgccggcctgatcagcagggaaatgaacaagtcctcccacccaggtatcaaaggcttttaccccaggccaccctagcagcctaccacaaaatgtagagatggcaagaccaagcccagccaaggtcctcctggtggttcctggcctgagccccagtgcccacaaaccacccgtacttccagtggtgatggcagcaacccatagcttcaaagtcctcaggccggtccaccttggagaccctctttcactgtgctagaggaaacccagagctgccatctggtatctgtcagtttttccaactgacttgtgccttccccagcatcctcctcccctcttaattcatgacatcaaaacactggcttttccttatttttcttgagactcaggagggccaaatcaataggcttttgctcttttatttctctccctactacgggttgagggaagagagccatcctaattgttcagaggcagtaacttcctcccctcaatctagtagagaaggaaccagccagctcttacttcttcctggttgtttttcttcccaccacagtctgttttttgtttcccttctaccacatacctctaaagctattgtatgacttgtcatgtgtcacctgagccttcagtaaaataagcaaacaacactcttctgttaaaaaagacaaagataatttttcactggaccttgaatgttacaatttattacatgttgaagtatataggaggtaaactgtcatgatgtttgcaacttacttttaagtggctcagaaaaagcaaaactagacaaagaaatatggcaaaatggttcagttgttgaatctagctggaggagaggctatatggttaaacattttttttattaaaacgtttgaaaaatgaacacagaagggaacacaattgggagtgagacttcttagtgtacactttgttgtgtcgttttaaatattgacgcgtatggatggattcctttttaaaaatacagttaaggatttataaaataagtaaggattgattttaacataacaaagtgtttttaaaacgcagctttgatctctgtgttaaaaattgatagagtggtttaactgtgactgtaatatattgagtaaagtagttttacctcatagaagtaatagctgtgatttatagcatgcctgttatgtgatgggcactgtgttttccgtctcatttaatccattcaacaggcgagatattacacatgggcaaggccatgtagttaaaattgtggagacagaatttgagcccaggtgaggaaatatttaaaagtttttgattgattaaaagtgataaccatttggtttctaaatacatggttttatccaaaagttaacaagacacggtatttgtcctcaaattgctgatagtataatgtagatatcagagtcaaaaaatagcaagtagtattgagcattcactctgcctgggccctgtgctctgtgtcttacttgcattctggtatttcatttatgattctttcatctttgtgaggcagtcttttcatagttaaagaaacttgagactcaggaaggtctaatttgtccaagggcctcataacttagtatgtgtgagagtcatgatttggcatcaattaattgattccaaaatctaagatcttaacctttatatactctgatcacttattactatatgtaaagagaaaaatacgtgtggtaaaagaagtaaaatgttacaggaatttagaaggggttgggttgtacagctaacatacctgttttcaggtgtgagatttgtgaaaatgcatatacttgatagagtagataaatggagcataatctgatgttaggcagtttaggatggaggggacagatgtggcaggaaataacatgaagtaattaggttgaagagaatttttaaaagaattgctaggacacggtaactaagttgattttcttaggaaaggagttggcaaggaaagggtaatgccagaatttcatttttttaaaaaaattgagagaataccattactgaaaatagaagtaaggaatgaggagctctttgagatatgattgtgagttcatgttgtggaatttagtgcttgtaggactaaaataaagaagtccacatgcaagtaatctattttctgtccatgccttttgaccttgactgtgtattagagaatctgtggaatttaaagccagaacgcacagacacatatcccaggtccaggctccatctgctaaatcagaatctccagagttgaagctctgaatactgacctttctgaagtgccacaggaaacgagccccttccacgtatgcctgctgggagtataaattggtacaatctctggacatccacctggcaacagtttcacttctaggaatttattctatagatacagccatgcattgtgaaatggtctctgtacagggatgtaaactgtagcattattgacagttgccaaagatgggaaacaacttgcaagtttatcaggaggggattggttaaattagttatattttgatctgtacagtggaataacacacttgttaaaagtattgagctctcagtgtacaattgatgtgatagaatgacctgtatgatatattaaataggaaaagaaataggtcttctgtactcagaaggataaacaaa

SEQ ID NO: 30274 - DNA, 3062 bp, Bovine  19866880623738
cgtttccaggaagatgtgattcatgagcttagtttgggggcggcagggagggttcacccagaggacatgtaggggacaggcgtatctatgaggagggcacagcacaggtctgggtaccctcagacccacctaggagctacttggacatttccccactgatttcattcttcccagcccctctctgggcaaagcatcaatggccagggaaaaaaaaaagtggaatttctaaaggtcttaccctgctaaagccttgcgatcagaaaataaacaaaccacaaatcccgaatatggcatgtggctgttgttaggcttgaatatctcagaaagtgagcaatctgtgagatgctcccatgtggggacacagcctgtggttcgtgtgtctctggataccatcaacagcggctgcagctagctcatttcagccctgacaccctcccccgcagaatcaccatggagcgcaaacagcccgggacacaggaggcgggaagccgcatttatccgagctctatgtgaccagctgcgtgagaagtttgcctcttctcgggcaggtcaccctggattctcattttttcctctgtaaattgagagacggaaacgagttcgatccaggagacccgtggattactcacagatgtggtctattaactcactcaagagggacgcatgtgattttttttttttaatgttttaaattagttgccaacatttaaaaatttggagaaattgcttgaaaatccagatttcggttagctttgaaaaaattagaaaatttgacaccagcacacaggacagccgtaaaaccgggcaccctattagatgctacagaccatgctgctccctgttgccttggcaatacagaggccagtgtcagttttccctccatacgtgtcccagctcgttcagttatatccccttgccaggttgctaagctggatgaggtccccaggcccagttgtctttaaagctctgtgactacgcctcatgcttacttttacccctctcttttctctaaacaagtctccttcttaggttcttgtggcagaactgcctgccagttagagcagggcttcttagccttggctgtacagttgaatttactgggggaggttttaaaaatctcagtgtccaggctgcacctggatggtgggaaccaggcctcggtcctcttaaagctgcaggcgattccagtgggcagcgtagggtgagaagcgttgagttaaagctgaaagtgcaatggactagctcaggaggggatgagctgctgttgctagaggtggttaagccgacgtagataagcacttagcagggaccagctgctctcttgtggattcttctccttgcactcgccctgccttcaccccacagggtccccccaagctcagctcagtgtcattgagcacacacattacacttacagggcttcaggacatccctgaccgtccaataattaagactccacacttccagtgcagagggcacgggtttgatacctgatcaaggaagatccggcatgccatgtgatgtggccaaaaaatatttttaaatcaaaaaaataaaggggctcagcatagggtaagtggaaggttttactagagagaaagaggttggaccacactctcattctaaatccaagcaggagaaaaaccatgatgggaaacaaaagtgaggacaaccagagtggccgttttcccacctctggattatatggaacttggaggctgtctttgttgttgttagtcgctcagtcgtgtccgactctttgtgaccccatggactgtagcccgccaggctcctctgtacatggaattctccaggcaagaacactggagtgggttgccgcttccttcttcctttgtcttagtatttatttttatttatttggctgagctgagtcttagttgtggcatgcaggatctttgaactcttagttgtagcatgtggggtctggttccctgagcagggattgaactcggaccccctgcaatgggagcacagagtcttagccactggaccaccagggaagtccatgtgtttactcttgagactccatggtgagagccgtaagctcagttaaaaactattacaaatttcatgggaatgggagcttgtagctcagggggagccggggtagaaaactgttggtcagagaaatctgggaggtgaagcagaaggaacagcaggtatcctcccctttccttcatcctggacggagtgctgagttagctttgcaggggttcagcatccatgccgacagcctttcaccccgtcacgagcaggaggggcctctcttccagaagggcctcctttacctccatcacatcagctgctctcagaaaggccttcagccacagcactctcccactacctcgtttccagccaggctacccgactgttgtgtactgcatagacccacagcctgcagttccccagccctggctccccacacaggtgcaagtctgggaacaacactagcaatttcatattcataatgttttattcttcttattgttgttgttcagtcacccagtcatatctggctctttgcaaccccatggactgcagcattccaggcctccctgtccctcaccatctcccagagtttgcccaaatccacattcattgcatcggtgatgccatccagccgtctcatcctctgacaccctcttctccttctgccctcgatctttcccagcatcagggactgggaaagaacagataacctttcagatgaccacaatactggagcctcagcttcagcatcagtccttccagtgaatattcaggattgatctctcttaatattgactggtttgatttacttgccgtccaagggactttcaggagtctttgcaggagtcttcttaaaagcccccaaactgttcaagctttaggtcctccaaacctgcactttcttccaagccagtcaggataggcaggggtctgattcccacattactttgttcctccctcccattcaatgtccctggtcatggcacaggcaggccataggaagcatcacagaatgatgtcagagtgccccagcccgttcctgcccatatcat

SEQ ID NO: 30275 - DNA, 946 bp, Bovine  19866880637985
ccctccaacttttttctagccgcaacatttgaaatcagccactcagctgtccaagatcactgggaccagccaacaccattttttgagcttaactccttattactgatcaaccatgagctcccaaattcatcagaattattccaccaaggtgaggccactgtcaacattcatttgagggccttctacacctacctctctctgggcttctatttcaaccacaatgatgtgactctggagggtgtggaccacttttttgtgcaaattggccaaggagaagttcaagggcatggagcttctcttgaaaatacaagaccagcgcagcagctgtgccctctttctggacatgcaaaagccatctcaagataagtggggtaaaacccaggacaccatggaagccatccttctcatggagaagaccccaaaccaggccttttgaatctgcatggcctacgctctgcccgcacagacccccacctctgtgacttcctggagagccacttcctagacaaggaggtgaaattgatgagttaccacctgaccaacctccacaggctggctgctccccaggctggagtgggtgaatatctctttgaaaacaccctcaagcacgatcaggaacccctggggccctgtggcctttgaggagccccactaatatcagagcttgtgcctaaacccctctctgctgccactgggcagctatttaacacactggaaacctctctcaagccttggagcaaatggaaacaataaagctttttgcagcaaaaaaaaaaagtttaagatggttaatttaatgttatgtatttatactcacaattacagataagataaaattaatatgtaaatctattatgacccatgcagggctacataccagaaaggaaattctggaaacatagctccaacttagccagtttaacacaaaacaaattctccacacaat

SEQ ID NO: 30276 - DNA, 993 bp, Bovine  19866880686838
catcttctgtcgtccccttcttctcctgccctcaatctttcccagcatcagggtcttttcaaatgagaaggctcttcgcatcaggtggccaaggttttggagtttcagcttcaacatcagtcctttcaaagaacacccagggctgatctcctttaggatggactggttggatctccttgcagtccaagggactctcaagagtcttctccaacaccatagttcaaaagcatcaattcttcggtgctcagctttctttatagtccaactctcacattcatacatgactactggaaaaaccacagccttgactacacggacctttgttgacaaagtaatgcctctgctttttaatatgctctttggcttagcttccacttttgcaggagctggtttagctgacaacctccccgatctcctcttgggctcctcctttgctgacccctcagtggagctgaccttcctcttgggcatcttggcgtaggggcaggcaagaacctgcctgagggccgcggtgagcctagagccttcgcaaagctgagtagcctgacctctgctgctcctcccgccgcccgagctccaaattgccattttatatgtatgtagttccaaataatattcagcagtttttgctgttgaatagttttagtaactgcatcagaaaatgtaagccttgtcagtgatccttaggttatttataatggcagattaaaattctattatagtataatgaaaaatcattacttctccttgtctgagaaacttcttcaacaaggaaaataataaaagcacaaatgcaaacttcattttaaaatctgatctctgaaatatagatcataaaatagaaaaagactctggaattagagaaggccagacaggtgtggaacaatgcaggaaaagggtgcccactactgcaaatagctgaaagaacccctatctctctgtgaatatagcctgtggtgaattatctgactcattaaaacaacaggaacggga

SEQ ID NO: 30277 - DNA, 1352 bp, Bovine  19866880695841
ggattcgagttgcatatggtcaacccatgtgcctgcagaacgctggcccctgtaccctgcccttcgcctactgcacataaagatttaatatacagtcagggagatgcttgagacttaagaggaagcacaggttattcagggcttccccagtggctcagtggtaaagaatctgtctgcaaagtaggagccacaggagatatagcttcaatccctgggttgggaagatcccctagaggaggccatagcaacccactccagtattcttgcctcgaggatcccatggacagaggagactggtgggctacagtccatggggtcacaaaagagtcagcacaattgaagcaacctagcacacacacatgcaaaggttattcaataagtagttgcgagacatgtgatgagctaactgggaaaatattcaagtcagattctccactggcaccacaccaataaggataaaatatgatctagccatgaagagttatgcttaggagcagttttatatgaaaattcattcaaccgtattttagtccatttgggcagccagaacgtaatgccatagcctgggaggcttataaacaacaccggttgatcgctcagcattctggaggctggaggtctgagatcagggtgccagtgtggccagatgagggccccctcctgggtcacaggcatcttgtatcctcacaaggcagatggggtgaggggtctttggagcctcttccataagggcactaaccttattcatgagggctccacccttatgacctaactacctcaaaggccccatctcctaataaccatcacattgggcattaggattccaatgtgtgaatctggcagggacaaaaatagtcaagccatcgcacttccatgtgtgtgcactactgacggtgcctttgcctcttgcaaaaccttaatggagaggtttggcagccctgaaagcttctcacttcattcatgtcacatggtgtggacaaatccgtgctctttaaagagaagcagaacgcccatcccacatgctgtgctcttgaacccacctcgttgggacttgaaaggcctctgccttaagccagcctttcttccctctcttttgttcacttcctgacggaccagcattcagaggccatgtccctattaacacagttgcagcctttcccgagaaaatccctggagggcccccgggttggggaggactttaaagtcactttccttccagatgtttgatgtgctcccttccccactctgctggtcccaaccagcagtcatcgctcacggaaacgtgctgtcgtctggaagggggacagtgggactatcaactagggggctggagttctgactcccatcaggct

SEQ ID NO: 30278 - DNA, 1094 bp, Bovine  19866880726379
ccaaggagtatacccatattacagtgtatccaggagtgcttgttaccaatacagagttctgagcccttttccagatactccgattcagcaggtctggggtaggattcagagatctgatctgcagcctacccctgctagatactagtatgtttaaaggaagctctgtgcacctgcggcatgtaggtctggaaagtagtgattacagcattaagtagcccagtggcaggcagtggaatgggtgggcagtctgaacaagggcccgtgactgtcaggctgtagggctcaccaggagtggggtagcccgtctgcctctgccttctgcattgatggagcccagggcatgtgctttacaccactattccaaacctgccttctgttataagaggtagatggaaagcggcccttacaataatccagacctcgattatacttagattacttgttaccctgctgtcttctgacgcaggagacgattgcagaggagaggagagacatttgaggctcaaaatccctgacttgctgaggaatatcgtgaggccttgatgcctctgctatttgtgcatgtactgttttgttttttgttgtgaactgatgatctttttgtttttatctttttctttctgcagaagtaacagtgtaatccttgctgatgaaatgggcctaggaaagaccatccagaccatatcattcctctcctacctgttccaccaacaccagctgtatggcccctttcttatagtcgtccctttatccaccctcacctcatggcagagggagtttgaaatctgggcaccagagattaacgtagtggtttacataggtgacctgatgagcagaaatacggtgtgtaaacaaaaagaattgggatagaatctgtgttataaatgtatttgggaaattgacctaaagctattatagtctttagtaaattgtgcttctgacactgtgctatgcccctgttactgggagatttctgtatcacaaaaacacaattctgatagtcttaaaaacgtatgcttactttgtaaagaaaaacaacagctatacatgaacgggaatctttcctagttggattgcagtattaagtttttctt

SEQ ID NO: 30279 - DNA, 1878 bp, Bovine  19866880735302
tctttggtctgtaaaataccacttaccctgcagagctaagggggtagccacactacccagcgctggcacctgcaccaaccagcccagcaaccaccaagtattgttacagactaggctttccacgaaaagcctattttaaaaattagaagcatcatctaatctgaaatggggcatttcccgatttcagtttcttggcattggtaagtattctcgcagtgaaaaaaattaaagcacgaaactcagctgcacctatttttgtctcaaaggcacaattccctttacatcaaatcatattcccctgcaacttcaacatggatgacaactctacacgacacagcttttggttacaagtagttaattagttctccctgtggttatggaaagataatgtcacaaatatatcccttttttaacacccaaacttgcaaattacaggctaaacaccgtcctgcgtgtctacatctgcttagaactccaacgtcacagctctgcgttctgaaaaataagaaaggttcatcaaaaattactaggaagtggcgactggaaagtgagggattaaaaaaaagacgtgttaaaaaggggacaggagtgaagacatggcccaacagggccgcgaagcagagggaaatagctctgttgggagtggaaaatcaatttgccagggccgtgataagtctgggacatcacctacaccttcgtgagaacccaccatgactcccacgctactgtccgcagtcagagcgtgaggacacgagtagaaggtgggtactctcacaacccgaagaccaccgagcaaaccgtctgaaacgaaccgaagagttaatgtgtcaagagctttacttccgggaagaccaacatctctatttcgcccagttgtttccaggatggcttctagaaaatattgcttggtaaggggaatcgtttccgagccacagattgtatctcagatgttcacgttataaaaatcagaattgttatttattctttcataaaagtaagccagcgataaactagcgcttaacctgaaaatcagaagagcttgtaacatggagaaagttatttgacgactaacagccagaaaaaaaaatctcactgattatctattatactgtaaaagccgatctacaaagagaggataaatttcctgatgcccgctaaacctatcctgttgcttcttacacgtttattctgggttttggtagtttttaatagttataatttgtcaatccgtttgtaaaaaacgggttttccttgcttcggaacctaatcatttttaaactggttgacagtcaacgtgactatttacgaagttgtttcttgcgtcttgttcctgtgttagtagccctttctgcaccagagttcgatatgtaagatttttagttttcttttcttaacttgattaagaaaatgcctgttcattccgactttacttgcctaagtataaactagtactggcctggaaattgtgaactaaattttactacgtctaggaagataaaatggacacccccacttcacattgtagcttacaacggagatcagcgacagggttccaagcaatgtccgggcgcctttaagaggaagcgcggtaattttccaccgccccgctagccccgcccacgcggtagacggctgggcgcggcgaagtgcggctgcgtggcgcgcgccttctgttgcttggaaaccacctcctccaccctcggcgcccaaagtccttttgtttccaagatggcctctgagtcctgtcttaaagagccaggtacaaagccagttgaacatccttgagcttagcagaaagcaagagtcgtaatggctggctttaagagtattctgtgccaatagccaatatttatttgcttttataacgttaaaaaaatc

SEQ ID NO: 30280 - DNA, 1694 bp, Bovine  19866880796461
tttaacgtaatagctgcctattaaacataaattaagtacagagttaaatgtctccaggacacaaaaagccccaaatgcctgccaaacccagaatggagcctctggctggaaggggctgggagggcggccgcctggcctgggtgtgctccgggctggatgcagtgggagccccgcgccctgcccagctgtctgcgcacgaagaagcagctttcccagggtcggggtggggagaaggaccggcttcgcagcgcacttcagtcccgattacgactcataaatctttcagtttcatagacattcctgaatatgccagaaatatagaaatgcttccaagagaacctgtgaggcctcgatggcctcgaaaatgccagagtgattgtgagttctgccccttctccccactccccctcccggccatagacaggcccttatcctgggcttggaccacggttggagatttccagcccctggactccttccagaccattccctaccctgcccttgttcagccatccctcttccttccttcctccttgcctcatcctctccctccccacttcttccctcccttccttcttcccttccccctccatctcccccttccttccctccttcccaactccctctcttccagaaatacttactttacacctactgtgtgctaaacactctggtagcagtacagtggcagcaaaaacagatcccagggcttctgttttggtgggagaagcagacagtgatcagcctgctttttctgggacacagcctgaactcagactctttggaccttctctctcctgatctctaaacccctgggaataaaggcctcatttatttccattctcatttcctacaacttcctccttcctcttcccaacaggccagccactaagtgcacccagttatttatgtttcttaggactccttctggggactgcctgcatagaatttacccaggattatagcttaaaatgagggcttccctggtggctcagacggtaaagaatctgcctgcaatgcaggaggcctgggttcgatctctgggatgggaagaccacccagaggaggaaatagcaacccactccagttttcttgtctgggaaatcccatggactgagaagcctggtccacggggctgcaaagagtcggacacgactgagcatgcaggcatactcagagatgactgggtatgaatcagtgcagagctctgttgatacagctgtgccctctggaacaggcgtccccgcaggccagctcctctgcacagccagttcccggatggctcatggcctgctggcccctgctcctagctgagtaaggcaagaatggcaatgtacagtgactaagagaaaaggttcactcctggcccctctacattctggctctgtagcgctgtggacgcaaccactaggaacgtgcttgcccaagtatacatgaggatgtggactgaaaaaaacacacagcctaaaagctatgagttacgttttatttggtggccacaactgaggacttaagcctgggacacagctttcggtagctctgagagcctgctccaaagaggtcagggaggaaccaggacataaaggagtttttgcaacaaagactaggtagttggaacatgagaagattctaattagagaaaaccaggcagctcaggttaaggaatttagcactttcctatgtatgggaagatg

SEQ ID NO: 30281 - DNA, 2311 bp, Bovine  19866880817267
tactaagcgagataagtcagaaaaagacaaataccatatggtttcaattatatgtggaatctaaactatgacaccaaggaacctacctgtgaaacagaatcgtggacgtaggaacagatgggtggttgccaagagggaggtggttgagggggtgatgatgtgggaggctggggttagcagatgcaagcttttatatatagaatggataaacaataagatcctactgtatagcacagagaactatattcagtatcctatgataaaccataatggaaaagaatattaaaaatgtataactgaattcactgtgctgtacagtggtaattaacatggcattgtaaatcaactatacttcaattaaaaataagcctttgtctttactgaaaaactgcatgaaagaagagcgtgaagtgaagtcacacaagtagaatgacaaccgcacgttcactgctgaatgcatcaaaattacaggctttctgttacaccaagttacagcctgagatcccctccgtgaagtgccttgtggtctgcctgggaggaaaggctcatgcttttcttcacataatagaaagacaaatcttatcatttagccaaactctgaaagggctatttgaatggggtgcagacgacatttctttaaagagggccaggaagtttgcccagtaaaacgttaaagagataccatttcattgcaattataggtttcttcctcccaccacaggttacgtgggtgcatctctgtctattatggagtaaatctctttatttcaacctccccttctccacctacagtctcatgtacatcagtattaggaagattattttgccacttagattacatttttctttgttcaattcattctgcttgagatcattctgctgtcaagaattccttgtccagtggcagcgacagagaaataatttaaaatttcacttcttacctagatgcctgacttcccatcctctcttcctcaagccctcctggttaaatctgagccaagatttcccaagcatctatctttcagagtttcaaatgttcctctttttattaggaaaacataagatcattcattctgaccaatatttctgtatttttcaaactcagatatgtttgtaagattgagccaggaaaacagaaacctctctgggtattttgagcaggaagagatttaatgcagggagttagaggtttgcaatactattggacaaacggagatgataaagtcagggaaaaccaaaactaacattcaggaaataagaaagtatagagacccttaaaatggccatgggtgatctatgctgctcatcgccataaaatatatcatcttcaggggggtggtctgagaagaccctggcaaaagctcatgtctactgtttctgaagttcatgtgattgtccaaaaatctgcaggtgcagtaatgacttctgctttctattttctgcttctgaatcacattgaatgcctcccattctgagtctaaatcagaatcctgctgatgagggatgctgggaaatgtagttctcagaatccaaccccacaaatacagcagagactttataaggaaatagggatgaatattagtttcccacaacaaacacaccaagtgtccacatttttccaagtactctgttagtggagatagatatagatagaaagatagagacagctattctacattttccacatgaagaaatggagctcagatttgttaggtaatttgtccaaggacatacaaccaacaagtgagaattgatctcatttctgagcccacattctttctacaacattctcctgtctcatatgtttaggacacaaactttcataacctatactattctcttgcagtgtatcttcagaaactatccaggaataaatttctcctacttcaggagccagtttacatgtcttatttcatagcatttccatgcagctttgtctccctccctccagtgatattctgcctcagatggtcctgatgctggatgtccacatctcctctaccagtttcttttttaagaattaatttatttattttaattgaaggataattattttacaattctgtgatggttttagccatacatcaacatgaatcagccacaggtatacatgtgctcccccatcctgaaccccacctctctcaatttcacctgatccctagttgtctgaggtttgctcactttcaacttgatattgttaacttccaagctggtacataagggagtccccataagcccctacttcaacgtctaaggcacctcttcagaaggtctgtgatgacctctgaaaatctctgagtcaccagtacag

SEQ ID NO: 30282 - DNA, 1763 bp, Bovine  19866880829692
attcggtacagccaataaataaatattttttaaaagcgccattctggaggaggccttgggagagttaggactgggtctatagggaaagtagagaatatattgcacaagaagtctgaagaccctggtttgagtcccaagactgctgcttacaagtcacttgactggttgacttccttctctaagaaaactgggtcaacctcagtgctggcctacatagtgtgaggcttgttattcagtcactcagtcgtacctggctctctgtgaccccatagacttcagtgcaccaggcttccatgtccttcaccatctcccagagcttgctcaaattcatgtccattgagtcagtgatgccatccagccatctcatcctctgtcgcccccttctcctccagcccacaatctttcccagcatcaaggtcttttccaatgagtctaaccattgtgtgaggctaaccattcagaattaacttggggaccaggggaggtaattctttattaagttgttaatttcctgattcagatgaggcttacagtaatgatcccttcaccagtgggaatggaaggctaaatccagggtagaaatagtctgggtcttaggtcattttatcactgacctcttctccaggcctggcccatcaactcggaggggggtttgtcccaaagccattgccaccatcaaacactggtggcttaggagtctcttttgtgtaacccccgagttactcatattctaataacaaggaccatccacagctgaagcgacagtgtctttgctgtcgagtgatagcaaatattttttagctccagaggttctgggaggtggtttaagctctaccaggcaatgaaggggcttcccaggtggctctagtggtaaagaacccgcctgccagtgcaggagatataagagccacagatttgatccctgggtcaggaagatcccctggaggagtgcagggcaatccacttcagtattctcgcctggagaatccccatggacacaggagcctggcgggctacaggccgtagggtcacaaagagccgaacacaactgaagcaacttagcacacatgcacccaggcaatgacaggttgctgcctgcaggtaatcccctcagcagcagagcggatgaagtagcatcattcaaagagaaagagaaaaggatgtcctcttgggatgctcattgcaaatacagttctggagcaaaggaacgagttaagcttgctgttaacctttagaagcaggaaaaaaatagatgggagagaaggctgaggtctctggttagtggttttttaaaaatctgtcagatttaattaaatcatcacaagtgccttttaaagggctctgtgtggttgtcctgcatggtcagaggaacgtgatccaagaggcagccggggccttggcggatctccaacttctgtcctttcccaggcaggaaacacaagtcagcccagtagcgctcgtcattgtgtggaccctgaaggccatcaaatgcaggtctggcatcggatccggaggctcagcacgatgctcggaactttgccagaaaatctgatgcccacatcttttgtccctgaactggctagactttctctacagtgcagcctctgctgtatatctgctgagtcccaggttccagtctcccctcccttttcactccccataccaccagaggcacaatatgtaggacttaaattctgttctcccatctaagagatagctattaaatgagaagtctccattggtaaaaatattcagttcagtca

SEQ ID NO: 30283 - DNA, 1323 bp, Bovine  19866880832655
ggtgttggatgtcctcctgtggacccaggagtatgggggctctactggtggcatggtcagacttgaggctagcctggctcactgagagcaccaacttgggtaagcatggaggcctggggaccaggcattggcctcaagaatccccagggtttgcccagctctgcaggtttaccccagcctctgaaacaaatctccaatctccacttccacaaacctggaaagccacatcctgagatccccccaagatgccagagctctcatgcactcccaaagaaaggacagtgatgagctgtggggtccctggaccaccgctggctgccgatgtagacgatgagagaccaggctgtctgagagccctgctcctggctttgctgctgatctgtgcaaagcatcaccaagagtccctcagcgaccacctgtgacacactgctgttccttagggatgatatgcgccatatcccataaagtgccttcagcttagagaaagccctcttggccactttttctgaaagtggcaaccaccgtgcttgccatgtactcagcacaggaacccagggagacagacaaaaaaggcgctttggcgatgatttttggccctcctcatttattgccgtccacgctcgtaaaacatggtgcttaatcgtcttggcaattggggtaaccgctttgaaaaataattactgccttcttggagattactttgccttctaattaaaacctccagactggtatatttaaaggtgcattgtcaatgcagcatcccagatacacccagctaacctcatttgggaaggcaaaattaattagtttgtgtttcaacacccagctgttatcctaaggaaaagaaatcgtctacaagtcggccatgcacactgtctctaaattggccagggtggctaaggagagataaaggaaatggagagtgatttgttcctgcataactccaccagcttctagaacaagctgctcgttagacggtggccccatgtccctgtcagacctcgctcgggagttctcgtttacccagagaggcagaatcggaaatgagagggtccctcctgccgctgagctcagttcactgtggagcctcttttgctcctaatacctttcgctgagcgatcctgtgcagcagatttgagaggctgggcatttctcttcctgtcccagccggtcagactcacaaagcttcgtgcactgctagccacccgcctcctttactaccacttccccttttgcaattccattttaagtccagcacttgccgagcaccgtggaaaccaggataatcaattctagtttatgctacaataacaatccccggag

SEQ ID NO: 30284 - DNA, 878 bp, Bovine  19866880834581
gaagagctgagggttcttcctgaccataaacttaactctcaattgtgttgcaactcacagcttgcctggaaccgctctcggaaactttaagaacaagtgcaataatcagcttatgatttacaatagcagccaggcttctaaactgaccgttgccaaaaacgcctgccttttactggaaggagtagtctcaggcccctccctgctccctggcagggcccccgcacgtctggcatccgggcaagtcctcctcaattagcgccaacagaaaggtcacttactgaaacacaaggccccacagtttgccagacctgcggctccgggttccaacctgtggctcttaaaggagcagaaccagctgtgcctgaggcagttcttccatcaggttttgaggttggagaaccgctgggctcacctcccaacctgcatttgttctgctttgtgaagtgggaggaagatacggctcatctggataaacatctgtagaaacccgggcctgtggggccgcccccgctgctgctggtggggtcctgccctgggctgagtcttggggactccaggtcagttctgtgccccgtgacaggacttcgtgtggaatataggcaagtccctaacctacagacttctgacctccaagatggacagaatgacagccactttctgcagccagagctgccccacagagggttcacacctttctctgcatttcttttgtgacccaagaggaaactgttaccaaagcagagtccccactgaccccatgcactgagatggccttggggaaggggtggtttgggggtgggcagggaagccatccctcgtcctttggcccctactctgtatgctgtaagacatgggccttttcaccttcatttgcacag

SEQ ID NO: 30285 - DNA, 1846 bp, Bovine  19866880894171
cttccctcggtgtacacagggtcacactccccacactaactgctcctctacagggacactccatgagtcaccatctactcactcgccggttcctgggcagcaccactcacgcctttactgtaacctcacacggtgaagcagggacggctctggggggctcgtgctctctgctccccggaacatctttggctcacctgtgccgaggtccttgtgagaggctgggtccacacagctggtgacgggagctccgtgggctcagcacctcctggtccacttctcctcctggtacttggaactcgttcagcttgggcttgtagagcacctgcccagagcactgcctgggggacctaaccagagccccagccacggtcaccccaccggggccatgcatgagtgctgtgtgggggagactaggaaactgtgtctctgctcaggttgggttccctccccacagtactgacactacccgggccagagaggaagggcaggctggcttgcaggcccccgagccatcaacaggccgtggggtccgcagagcaggccccagctcggcctcccctgtaggaggtcgggtcgtgaccctttgagttagaggggccagggggaggactggtggagcctgcgtttcagagttcaaggtttttgttttttttttcctctggagttgttgataggagatgcgagttattcccaaagatgtctcatcatgaggaaaaaggagcttccttttgttcacatcaggacttgtagtgccatatgccgccacaaaaggcagcatcagccagatcagtgttaaattgattacagaaagtacagtatcctcacaaaagcatctgttgaggtgccggagtgtgtgtgcagagtgggttggtagaaaaagcatttcctcatagtcagtcagtatgaatactgtatgcttctgtcaaaaccagaaatttgcacaaataggaattatctgactcgtggatgggagaagccgcccccaagtctctgaggatggttttccatggagactggctctgaaggatgtagttactaggtagagcaggggccgaggaagaggagagttagcgccaccaggaacctgaccaggagcacggattcacctgtgtgccctcgtctccgccgaggacgcggcaaccccagactggcccccccatcggctgctgccccgggctccccctcctttcagccattcctttctcacaccctccgacgggaatccaggacacctctcacgtcgtgctgcagacactctaacctgataacctgagggccgcatcagggcgcatgcgcacggtgcaaacgcaatccagttacgaattcacacagcgacgcggaaatcctacagaccaaaacccactcgtcagcaggagcggtgggcccccggctcgtctgggggcggccgtgtcggcgaggagagccaggccaggggtccaggctgctttagtccatctgcgccccacttggttggggacgggtgatttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgactcttgtatattaaaaagtgttactgaggatttttagaagcaggcgaacacgttgcattgcattggcgtgacccgtgaccggactcaccacctcatctcgcttcctcctgtcgctgggtcatcgggattcttggacagcttgtgaaatggagcttttcccctacccgggcccctgttgtgtcgtgggtccaggacct

SEQ ID NO: 30286 - DNA, 1065 bp, Bovine  19866880946253
agaggggaaaaataagaaactttggagatatgattggatagcagaatgaagaatgaccacactttcccacggctgtcacgttcttgcctcttcccagagaccctctccgctccctgtccatccccgacttagcatttcaaagcagatgccactttggcagagctctcatggtgcaaattttcccaagtcagatttatgtctttggggtttttgcttatttattcatttcatgcaccatttcgcccgggcagtcggaataccgaaacgcctattaaagtgatccctctgcgcccaggtccctgcagaaaggagccattattgctccccgtgctaaggaatgttccaggaacacaggctcacacacgtgtgtgcaccagccgggccggtgtcctcccattgctctaggaaggtggaagaagggcctgcctgcggagggaggtgggggagcaaagccacttcacgtggattttgacccgggacagctgagcagaggagcgcagggctcctggaggcaggaccagaatggaaaattgtcatctctgaagtcagccttacctagacttgctcaagaggcgtgggttcaatccctggatcaggaagatcccctggaggagggcatggcaacccactccagtattcttgcctggagaatcccatggacaggggaacctagcgggctatggtccatggggtcacaaagagtctgacgtgactgagcatagcagcagctacctagactcaggaaaagggagtgtgcctcaaagcaggaagcccaaactgctcacccgcaagcttcatttatacctgaaaagtgacacttttgcccccaaaccatcctccctgtggaacccaggcttgctcagctctctgccctcctggcagggtggtcttggcatgggatcccacgcccggctcctgcctgctgtgggcccttctgacccagagaagccctgctgacaggcccaccgtggccctcttggctgcagatccggctgcgtgtggctccagggggagctggggggtggggagggtgtccagttgggaaagctgaggtgtgcccttttc

SEQ ID NO: 30287 - DNA, 1479 bp, Bovine  19866881013499
tattcttggtgcaagaccagggttttcattctttaaatttctcactgattgcagaccagtgcacgaccacctgggtaactagaacgcagttcacaccatgactcactgtgtgtgtcgggggtccccaaatctcttcatccagaggagcccctgatgttgcaaatgtgaaattgctacagacgttacttagtgcttgtctttacttttctgtacttgtctcggcagggatccgtaacagacagtcaacacactggctctggtccatggaccacactttgagtagttctggtttagagttgatttcgaggtgaattgctgttcagaactcacctttttgtgtgatctcaattcaagtttcagtctccaaaatatgaaatgaagaaaatatcaatacttaactcaagaatttcagtgagaacaaattaagataatatatctaaagtacatggaatcctagcctaaagtgctcatcccatatggactttgatttatcacttaggataatacaaaaaaagaaagactatatataacgtgaggaggggttaatcgctggatggtgaaacttagggttgatctgtatttttctacatacttttttctgttttataaattttctacaatgatcgtaaatgactctataatcaagaaaaatgtcattaaaatttgttgtgcctattttctctgcactgaatttttttttctgccagagtttaatattctttctcaataacccaatataaacacacatattaagtaaagaaattggttttgcaaacaatttccaatctttctttgatgttttgtaagcatctacctaatattcacgttgcaatttccagtgaaggaaagcacagcctacaaaaacttgccccactaatcccgggagccctgggacgcttctcactcctgtcttctcacctgatgtcactgatcatcccttaacctggacttctctgttgattgttttgcgtcacagcccagccccagcttctggggcataggggcgattcagagagccacttgcagggagaggagggggtgccacaaatcttgtaactcctaggggccgaggggaccacttcctgttggccttgtgcctgcgtgtgtgctgagtcacttcagttatgtctgactcttctcgaccctatggactgtagccagccaagctcctccgtccatgggattccccaggcaggaataatggagtgggttgccaggccctcctccgggggatcttcccgacccagggaacacacctgcatctcttaggtctcccgcactggcaggcgggttccttaccactcctgccgcctgggaagcccccccaccccagccattgctcaaattctgctgacgatcgtccgatcctggcaacagcactgccgatctgttaaaatgaggggtggagggtaaagaaacgtgaagattataaaggcatcctttcttttcacatcttcacgaataaagttctggccaggt
